United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 64

SEQ ID NO: 2909314 - RNA, 24 nt, Human
gaugguccuggggcucugugcagg

SEQ ID NO: 2909315 - RNA, 13 nt, Human
gauggucuggucu

SEQ ID NO: 2909316 - RNA, 17 nt, Human
gauggucuggucuaugu

SEQ ID NO: 2909317 - RNA, 21 nt, Human
gaugguccuggggcucugugc

SEQ ID NO: 2909318 - RNA, 15 nt, Human
gaugguccuggggcu

SEQ ID NO: 2909319 - RNA, 13 nt, Human
gaugguccugggg

SEQ ID NO: 2909320 - RNA, 20 nt, Human
gaugguguuacugcaguuga

SEQ ID NO: 2909321 - RNA, 17 nt, Human
gaugguuauuuucuuuu

SEQ ID NO: 2909322 - RNA, 13 nt, Human
gaugguuccccug

SEQ ID NO: 2909323 - RNA, 18 nt, Human
gaugguuccccuguucac

SEQ ID NO: 2909324 - RNA, 21 nt, Human
gaugguuccccuguucacucu

SEQ ID NO: 2909325 - RNA, 23 nt, Human
gaugguuauuuucuuuucuuuca

SEQ ID NO: 2909326 - RNA, 11 nt, Human
gauguggagcc

SEQ ID NO: 2909327 - RNA, 12 nt, Human
gauguggagcca

SEQ ID NO: 2909328 - RNA, 13 nt, Human
gauguggagccag

SEQ ID NO: 2909329 - RNA, 14 nt, Human
gauguggagccagg

SEQ ID NO: 2909330 - RNA, 15 nt, Human
gauguggagccaggc

SEQ ID NO: 2909331 - RNA, 16 nt, Human
gauguggagccaggcg

SEQ ID NO: 2909332 - RNA, 18 nt, Human
gauguggagccaggcgug

SEQ ID NO: 2909333 - RNA, 14 nt, Human
gauguuaguguuuu

SEQ ID NO: 2909334 - RNA, 18 nt, Human
gauguuaguguuuuaaga

SEQ ID NO: 2909335 - RNA, 16 nt, Human
gaugugguuuucuuaa

SEQ ID NO: 2909336 - RNA, 20 nt, Human
gaugugggggaagaccuggc

SEQ ID NO: 2909337 - RNA, 22 nt, Human
gaugugggagggagcagacagg

SEQ ID NO: 2909338 - RNA, 16 nt, Human
gaugugggggaagacc

SEQ ID NO: 2909339 - RNA, 23 nt, Human
gaugugggagggagcagacagga

SEQ ID NO: 2909340 - RNA, 12 nt, Human
gcaaauguguac

SEQ ID NO: 2909341 - RNA, 16 nt, Human
gcaaauguuuaaacau

SEQ ID NO: 2909342 - RNA, 17 nt, Human
gcaaauguuuaaacauu

SEQ ID NO: 2909343 - RNA, 12 nt, Human
gcaaauucuuuu

SEQ ID NO: 2909344 - RNA, 16 nt, Human
gcaaauucuuuugaau

SEQ ID NO: 2909345 - RNA, 17 nt, Human
gcaaauucuuuugaauu

SEQ ID NO: 2909346 - RNA, 20 nt, Human
gcaaauucuuuugaauuguu

SEQ ID NO: 2909347 - RNA, 15 nt, Human
gcaaauguggcuccu

SEQ ID NO: 2909348 - RNA, 20 nt, Human
gcaaagggagcacuggguug

SEQ ID NO: 2909349 - RNA, 18 nt, Human
gcaaagggagcacugggu

SEQ ID NO: 2909350 - RNA, 22 nt, Human
gcaacaagaccaccacuucgaa

SEQ ID NO: 2909351 - RNA, 21 nt, Human
gcaaauuuuuauuuuuuagug

SEQ ID NO: 2909352 - RNA, 12 nt, Human
gcaaauuucaaa

SEQ ID NO: 2909353 - RNA, 16 nt, Human
gcaaauuucaaaagac

SEQ ID NO: 2909354 - RNA, 20 nt, Human
gcaaauuucaaaagacaugu

SEQ ID NO: 2909355 - RNA, 22 nt, Human
gcaaauuucaaaagacauguug

SEQ ID NO: 2909356 - RNA, 23 nt, Human
gcaaauuucaaaagacauguugu

SEQ ID NO: 2909357 - RNA, 22 nt, Human
gcaaaccacacuggacuccggc

SEQ ID NO: 2909358 - RNA, 12 nt, Human
gcaaagaucaaa

SEQ ID NO: 2909359 - RNA, 14 nt, Human
gcaaagaucaaaau

SEQ ID NO: 2909360 - RNA, 15 nt, Human
gcaaagaucaaaaua

SEQ ID NO: 2909361 - RNA, 16 nt, Human
gcaaagaucaaaauaa

SEQ ID NO: 2909362 - RNA, 18 nt, Human
gcaaagaucaaaauaaaa

SEQ ID NO: 2909363 - RNA, 21 nt, Human
gcaaagcugaugacaacuucc

SEQ ID NO: 2909364 - RNA, 16 nt, Human
gcaaagcucuguggcc

SEQ ID NO: 2909365 - RNA, 19 nt, Human
gcaaagcucuguggccaca

SEQ ID NO: 2909366 - RNA, 13 nt, Human
gcaaaggcuggga

SEQ ID NO: 2909367 - RNA, 15 nt, Human
gcaaaccacacugga

SEQ ID NO: 2909368 - RNA, 17 nt, Human
gcaaaccacacuggacu

SEQ ID NO: 2909369 - RNA, 18 nt, Human
gcaaaccacacuggacuc

SEQ ID NO: 2909370 - RNA, 20 nt, Human
gcaaaccacacuggacuccg

SEQ ID NO: 2909371 - RNA, 14 nt, Human
gauuuuuaauuaaa

SEQ ID NO: 2909372 - RNA, 20 nt, Human
gauuuuuaauuaaaaacuag

SEQ ID NO: 2909373 - RNA, 22 nt, Human
gauuuuuaauuaaaaacuagua

SEQ ID NO: 2909374 - RNA, 16 nt, Human
gcaaaccaagagauug

SEQ ID NO: 2909375 - RNA, 18 nt, Human
gcaaaccaagagauugcu

SEQ ID NO: 2909376 - RNA, 20 nt, Human
gcaaaccaagagauugcuaa

SEQ ID NO: 2909377 - RNA, 21 nt, Human
gcaaaccaagagauugcuaau

SEQ ID NO: 2909378 - RNA, 22 nt, Human
gcaaaccaagagauugcuaauu

SEQ ID NO: 2909379 - RNA, 12 nt, Human
gauuuugauaac

SEQ ID NO: 2909380 - RNA, 13 nt, Human
gauuuugauaacu

SEQ ID NO: 2909381 - RNA, 17 nt, Human
gauuuugagguaaagau

SEQ ID NO: 2909382 - RNA, 13 nt, Human
gauuuugccugug

SEQ ID NO: 2909383 - RNA, 17 nt, Human
gauuuuguaagaaguuu

SEQ ID NO: 2909384 - RNA, 21 nt, Human
gauuuugggguuguguuguca

SEQ ID NO: 2909385 - RNA, 21 nt, Human
gauuuugguauuacacuguau

SEQ ID NO: 2909386 - RNA, 19 nt, Human
gauuuugauccaagcuggu

SEQ ID NO: 2909387 - RNA, 19 nt, Human
gauuuuaugaucaguguug

SEQ ID NO: 2909388 - RNA, 21 nt, Human
gauuuuaggagcuaaggcucu

SEQ ID NO: 2909389 - RNA, 20 nt, Human
gauuuuagcuaggauuugaa

SEQ ID NO: 2909390 - RNA, 24 nt, Human
gauuuuagcuaggauuugaacacu

SEQ ID NO: 2909391 - RNA, 19 nt, Human
gauuuuaggagcuaaggcu

SEQ ID NO: 2909392 - RNA, 11 nt, Human
gauuugcaaua

SEQ ID NO: 2909393 - RNA, 19 nt, Human
gauuugcauauucauucau

SEQ ID NO: 2909394 - RNA, 15 nt, Human
gauuugcauugaaca

SEQ ID NO: 2909395 - RNA, 20 nt, Human
gauuuuaauggauuguuaau

SEQ ID NO: 2909396 - RNA, 23 nt, Human
gauuuuaauggauuguuaauuuc

SEQ ID NO: 2909397 - RNA, 14 nt, Human
gauuuuaauuguca

SEQ ID NO: 2909398 - RNA, 15 nt, Human
gauuuuaauugucau

SEQ ID NO: 2909399 - RNA, 16 nt, Human
gauuuuaauugucaug

SEQ ID NO: 2909400 - RNA, 11 nt, Human
gauuuccugug

SEQ ID NO: 2909401 - RNA, 13 nt, Human
gauuuccuguguc

SEQ ID NO: 2909402 - RNA, 13 nt, Human
gauuuccuugaau

SEQ ID NO: 2909403 - RNA, 22 nt, Human
gauuuccuugaauguggcuuga

SEQ ID NO: 2909404 - RNA, 15 nt, Human
gauuuccuugugcaa

SEQ ID NO: 2909405 - RNA, 17 nt, Human
gauuuccuugaaugugg

SEQ ID NO: 2909406 - RNA, 16 nt, Human
gauuugagcucagccc

SEQ ID NO: 2909407 - RNA, 18 nt, Human
gauuugaugcuguuugac

SEQ ID NO: 2909408 - RNA, 18 nt, Human
gauuugaagaacauguga

SEQ ID NO: 2909409 - RNA, 14 nt, Human
gauuucuaaucaaa

SEQ ID NO: 2909410 - RNA, 16 nt, Human
gauuucuaaucaaaag

SEQ ID NO: 2909411 - RNA, 13 nt, Human
gauuugacauugc

SEQ ID NO: 2909412 - RNA, 12 nt, Human
gauuugaccucc

SEQ ID NO: 2909413 - RNA, 13 nt, Human
gauuugaccuccu

SEQ ID NO: 2909414 - RNA, 17 nt, Human
gauuugaccuccucccu

SEQ ID NO: 2909415 - RNA, 20 nt, Human
gauuugaccuccucccuguu

SEQ ID NO: 2909416 - RNA, 20 nt, Human
gauuugaagaacaugugaga

SEQ ID NO: 2909417 - RNA, 19 nt, Human
gauuugaagaacaugugag

SEQ ID NO: 2909418 - RNA, 15 nt, Human
gauuggggaauuaaa

SEQ ID NO: 2909419 - RNA, 19 nt, Human
gauugcgguuuacagcuau

SEQ ID NO: 2909420 - RNA, 13 nt, Human
gauuguaaaaaaa

SEQ ID NO: 2909421 - RNA, 23 nt, Human
gauugggggggccaaaaggaaaa

SEQ ID NO: 2909422 - RNA, 23 nt, Human
gauuguaaaauagcuuguauagu

SEQ ID NO: 2909423 - RNA, 22 nt, Human
gauuguaaaccgcuuuggccug

SEQ ID NO: 2909424 - RNA, 23 nt, Human
gauuguaaaccgcuuuggccuga

SEQ ID NO: 2909425 - RNA, 13 nt, Human
gauuguaaacuuc

SEQ ID NO: 2909426 - RNA, 18 nt, Human
gauuguaaaaaaaaaugc

SEQ ID NO: 2909427 - RNA, 22 nt, Human
gauuguaaaaaaaaaugccuuu

SEQ ID NO: 2909428 - RNA, 12 nt, Human
gauuguaaaaua

SEQ ID NO: 2909429 - RNA, 20 nt, Human
gauuguaaaauagcuuguau

SEQ ID NO: 2909430 - RNA, 18 nt, Human
gauuacagggaugagcca

SEQ ID NO: 2909431 - RNA, 20 nt, Human
gauuacagggaugagccacc

SEQ ID NO: 2909432 - RNA, 21 nt, Human
gauuacaggcuccugccacca

SEQ ID NO: 2909433 - RNA, 18 nt, Human
gauuacaggcuccugcca

SEQ ID NO: 2909434 - RNA, 18 nt, Human
gauucacaaugaaaugcu

SEQ ID NO: 2909435 - RNA, 22 nt, Human
gauucacaaugaaaugcucucc

SEQ ID NO: 2909436 - RNA, 21 nt, Human
gauucuauuuauauguacaug

SEQ ID NO: 2909437 - RNA, 20 nt, Human
gauucuauuuauauguacau

SEQ ID NO: 2909438 - RNA, 15 nt, Human
gauucuauuuauaug

SEQ ID NO: 2909439 - RNA, 12 nt, Human
gauucucagggu

SEQ ID NO: 2909440 - RNA, 17 nt, Human
gauucucagggucucug

SEQ ID NO: 2909441 - RNA, 19 nt, Human
gauucucagggucucugcu

SEQ ID NO: 2909442 - RNA, 23 nt, Human
gauucucagggucucugcugccg

SEQ ID NO: 2909443 - RNA, 21 nt, Human
gauucucagggucucugcugc

SEQ ID NO: 2909444 - RNA, 22 nt, Human
gauucucagggucucugcugcc

SEQ ID NO: 2909445 - RNA, 14 nt, Human
gauucuccugccuc

SEQ ID NO: 2909446 - RNA, 16 nt, Human
gauucucaugccucag

SEQ ID NO: 2909447 - RNA, 13 nt, Human
gauugagaaggag

SEQ ID NO: 2909448 - RNA, 16 nt, Human
gauugagaaggagaga

SEQ ID NO: 2909449 - RNA, 17 nt, Human
gauugagaaggagagaa

SEQ ID NO: 2909450 - RNA, 18 nt, Human
gauugagaaggagagaaa

SEQ ID NO: 2909451 - RNA, 15 nt, Human
gauugauaauugcau

SEQ ID NO: 2909452 - RNA, 17 nt, Human
gauugauuugaagaaca

SEQ ID NO: 2909453 - RNA, 15 nt, Human
gauugauuugaagaa

SEQ ID NO: 2909454 - RNA, 19 nt, Human
gauugagaaggagagaaag

SEQ ID NO: 2909455 - RNA, 14 nt, Human
gauugagaaguuca

SEQ ID NO: 2909456 - RNA, 19 nt, Human
gauugcagguggaacucag

SEQ ID NO: 2909457 - RNA, 17 nt, Human
ggcaacccccagccugc

SEQ ID NO: 2909458 - RNA, 16 nt, Human
ggcaacccccagccug

SEQ ID NO: 2909459 - RNA, 18 nt, Human
ggauuggauuauuuaaua

SEQ ID NO: 2909460 - RNA, 15 nt, Human
ggauugcugccacuu

SEQ ID NO: 2909461 - RNA, 16 nt, Human
ggauuggauuauuuaa

SEQ ID NO: 2909462 - RNA, 22 nt, Human
ggauuggauuauuuaauaacau

SEQ ID NO: 2909463 - RNA, 15 nt, Human
ggauuggcacuguuu

SEQ ID NO: 2909464 - RNA, 17 nt, Human
ggauugcuacuguccua

SEQ ID NO: 2909465 - RNA, 17 nt, Human
ggauugcuugagcccag

SEQ ID NO: 2909466 - RNA, 14 nt, Human
ggauugcugccacu

SEQ ID NO: 2909467 - RNA, 16 nt, Human
ggauugcuaugaauga

SEQ ID NO: 2909468 - RNA, 19 nt, Human
ggauugcaauaucugaagc

SEQ ID NO: 2909469 - RNA, 23 nt, Human
ggauuacaagcgugagccacugc

SEQ ID NO: 2909470 - RNA, 19 nt, Human
ggauuacaggcuccugcca

SEQ ID NO: 2909471 - RNA, 21 nt, Human
ggauggagcccaggcgggagc

SEQ ID NO: 2909472 - RNA, 19 nt, Human
ggauuacaggcaugugcca

SEQ ID NO: 2909473 - RNA, 19 nt, Human
ggauuacaggcgugagcca

SEQ ID NO: 2909474 - RNA, 22 nt, Human
ggcacccggccccugcugguuc

SEQ ID NO: 2909475 - RNA, 18 nt, Human
ggcaccggggccucggac

SEQ ID NO: 2909476 - RNA, 12 nt, Human
ggcacccucugg

SEQ ID NO: 2909477 - RNA, 15 nt, Human
ggcacccucuggccg

SEQ ID NO: 2909478 - RNA, 20 nt, Human
ggcacccucuggccgccuag

SEQ ID NO: 2909479 - RNA, 19 nt, Human
ggcacccuguggcccuggc

SEQ ID NO: 2909480 - RNA, 23 nt, Human
ggcacccaccaucaugucuggcu

SEQ ID NO: 2909481 - RNA, 13 nt, Human
ggcacccacccug

SEQ ID NO: 2909482 - RNA, 14 nt, Human
ggcacccacccugg

SEQ ID NO: 2909483 - RNA, 18 nt, Human
ggcaaugucaggaacaga

SEQ ID NO: 2909484 - RNA, 18 nt, Human
ggcaacccccagccugcu

SEQ ID NO: 2909485 - RNA, 22 nt, Human
ggauuguaaaaaaaaaugccuu

SEQ ID NO: 2909486 - RNA, 23 nt, Human
ggauuguaaaaaaaaaugccuuu

SEQ ID NO: 2909487 - RNA, 21 nt, Human
ggcaauauagcaagaucccau

SEQ ID NO: 2909488 - RNA, 23 nt, Human
ggcaaugcuggcuguuggcuggg

SEQ ID NO: 2909489 - RNA, 15 nt, Human
ggcaaugcuggcugu

SEQ ID NO: 2909490 - RNA, 14 nt, Human
ggcaaugcuggcug

SEQ ID NO: 2909491 - RNA, 15 nt, Human
ggcaaucaauguuca

SEQ ID NO: 2909492 - RNA, 15 nt, Human
ggcaaugauggcaau

SEQ ID NO: 2909493 - RNA, 19 nt, Human
ggauuacaagcgugagcca

SEQ ID NO: 2909494 - RNA, 14 nt, Human
ggaugcugccugag

SEQ ID NO: 2909495 - RNA, 21 nt, Human
ggaugcaacacgcauggucaa

SEQ ID NO: 2909496 - RNA, 21 nt, Human
ggaugcauguuuuccagcucc

SEQ ID NO: 2909497 - RNA, 15 nt, Human
ggauacugcagggcc

SEQ ID NO: 2909498 - RNA, 16 nt, Human
ggauacugcagggcca

SEQ ID NO: 2909499 - RNA, 21 nt, Human
ggauacugcagggccaggacu

SEQ ID NO: 2909500 - RNA, 18 nt, Human
ggauacaaccucccucuu

SEQ ID NO: 2909501 - RNA, 22 nt, Human
ggauacaaccucccucuuguuu

SEQ ID NO: 2909502 - RNA, 20 nt, Human
ggauacagcaguagacauuu

SEQ ID NO: 2909503 - RNA, 17 nt, Human
ggagaugccauccucuu

SEQ ID NO: 2909504 - RNA, 12 nt, Human
ggagugcaguga

SEQ ID NO: 2909505 - RNA, 14 nt, Human
ggagugcagugagc

SEQ ID NO: 2909506 - RNA, 20 nt, Human
ggagugcaaugacacagucu

SEQ ID NO: 2909507 - RNA, 20 nt, Human
ggauauccuuaucagagcua

SEQ ID NO: 2909508 - RNA, 22 nt, Human
ggauauccuuaucagagcuaag

SEQ ID NO: 2909509 - RNA, 16 nt, Human
ggauaguaugagcccu

SEQ ID NO: 2909510 - RNA, 18 nt, Human
ggauaguauuuuuaucca

SEQ ID NO: 2909511 - RNA, 11 nt, Human
ggauauuuaag

SEQ ID NO: 2909512 - RNA, 12 nt, Human
ggauauuuaagg

SEQ ID NO: 2909513 - RNA, 19 nt, Human
ggauauuuguacuguuuaa

SEQ ID NO: 2909514 - RNA, 22 nt, Human
ggaucaaaccccgaccaccugc

SEQ ID NO: 2909515 - RNA, 16 nt, Human
ggaucaaaguucugcu

SEQ ID NO: 2909516 - RNA, 23 nt, Human
ggaucaaaguucugcuuucuccc

SEQ ID NO: 2909517 - RNA, 21 nt, Human
ggcauggcuuuauuuguuuuu

SEQ ID NO: 2909518 - RNA, 23 nt, Human
ggcauggcuuuauuuguuuuuuu

SEQ ID NO: 2909519 - RNA, 20 nt, Human
ggccacaugggagcagucca

SEQ ID NO: 2909520 - RNA, 18 nt, Human
ggccaccaaagcugccca

SEQ ID NO: 2909521 - RNA, 17 nt, Human
ggccaccaaagcugccc

SEQ ID NO: 2909522 - RNA, 16 nt, Human
ggccaccaaagcugcc

SEQ ID NO: 2909523 - RNA, 15 nt, Human
ggccaccaaagcugc

SEQ ID NO: 2909524 - RNA, 13 nt, Human
ggccaccaaagcu

SEQ ID NO: 2909525 - RNA, 14 nt, Human
ggccacauuuaaua

SEQ ID NO: 2909526 - RNA, 20 nt, Human
ggccacauuuucagccaaag

SEQ ID NO: 2909527 - RNA, 18 nt, Human
ggccacgugauguggagg

SEQ ID NO: 2909528 - RNA, 18 nt, Human
ggccaccaggugccuuuc

SEQ ID NO: 2909529 - RNA, 17 nt, Human
ggccacuccagaccccu

SEQ ID NO: 2909530 - RNA, 16 nt, Human
ggccaugggccuccug

SEQ ID NO: 2909531 - RNA, 19 nt, Human
ggccaggccgggccuguac

SEQ ID NO: 2909532 - RNA, 11 nt, Human
ggccaggcugc

SEQ ID NO: 2909533 - RNA, 15 nt, Human
ggccaggcugcucuu

SEQ ID NO: 2909534 - RNA, 14 nt, Human
ggccaggcugcucu

SEQ ID NO: 2909535 - RNA, 23 nt, Human
ggccauguccaaagaggcugccc

SEQ ID NO: 2909536 - RNA, 22 nt, Human
ggccauguccaaagaggcugcc

SEQ ID NO: 2909537 - RNA, 16 nt, Human
ggccauguccaaagag

SEQ ID NO: 2909538 - RNA, 15 nt, Human
ggccauguccaaaga

SEQ ID NO: 2909539 - RNA, 13 nt, Human
ggccauguccaaa

SEQ ID NO: 2909540 - RNA, 20 nt, Human
ggccauucugccgcccccuc

SEQ ID NO: 2909541 - RNA, 14 nt, Human
ggccauucugccgc

SEQ ID NO: 2909542 - RNA, 14 nt, Human
ggccauuaggaaac

SEQ ID NO: 2909543 - RNA, 17 nt, Human
ggccauuaggaaacugu

SEQ ID NO: 2909544 - RNA, 15 nt, Human
ggccagccuggggcc

SEQ ID NO: 2909545 - RNA, 18 nt, Human
ggccagccuggggccugg

SEQ ID NO: 2909546 - RNA, 19 nt, Human
ggccagccuggggccuggc

SEQ ID NO: 2909547 - RNA, 20 nt, Human
ggccagccuggggccuggca

SEQ ID NO: 2909548 - RNA, 21 nt, Human
ggccagccuggggccuggcag

SEQ ID NO: 2909549 - RNA, 22 nt, Human
ggccagccuggggccuggcagg

SEQ ID NO: 2909550 - RNA, 15 nt, Human
ggcacuagccuuugg

SEQ ID NO: 2909551 - RNA, 20 nt, Human
ggcacuagccuuuggcucug

SEQ ID NO: 2909552 - RNA, 21 nt, Human
ggcacuagccuuuggcucugg

SEQ ID NO: 2909553 - RNA, 20 nt, Human
ggcacggucuucccucuucc

SEQ ID NO: 2909554 - RNA, 14 nt, Human
ggcacuagccuuug

SEQ ID NO: 2909555 - RNA, 23 nt, Human
ggcacuaacguugagccccugga

SEQ ID NO: 2909556 - RNA, 17 nt, Human
ggcagcuugaggguugg

SEQ ID NO: 2909557 - RNA, 22 nt, Human
ggcagcugcuuuugucuauggg

SEQ ID NO: 2909558 - RNA, 23 nt, Human
ggcagcucauagaguccccccuc

SEQ ID NO: 2909559 - RNA, 15 nt, Human
ggcagcucaucucug

SEQ ID NO: 2909560 - RNA, 16 nt, Human
ggcagugggagcugcc

SEQ ID NO: 2909561 - RNA, 23 nt, Human
ggcaucuuugccuugggcugcuc

SEQ ID NO: 2909562 - RNA, 22 nt, Human
ggcaucuuugccuugggcugcu

SEQ ID NO: 2909563 - RNA, 21 nt, Human
ggcagugggacagggcauggc

SEQ ID NO: 2909564 - RNA, 14 nt, Human
ggcagugggagcug

SEQ ID NO: 2909565 - RNA, 13 nt, Human
ggcagugggagcu

SEQ ID NO: 2909566 - RNA, 20 nt, Human
ggcagggucucacucugucg

SEQ ID NO: 2909567 - RNA, 19 nt, Human
ggcagggucucacucuguc

SEQ ID NO: 2909568 - RNA, 14 nt, Human
ggcagggugacccu

SEQ ID NO: 2909569 - RNA, 14 nt, Human
ggcagguagccagg

SEQ ID NO: 2909570 - RNA, 15 nt, Human
ggcagguagccaggg

SEQ ID NO: 2909571 - RNA, 23 nt, Human
ggcaugaaguuuccuuggcuggu

SEQ ID NO: 2909572 - RNA, 22 nt, Human
ggcaugaaguuuccuuggcugg

SEQ ID NO: 2909573 - RNA, 21 nt, Human
ggcaucuuugccuugggcugc

SEQ ID NO: 2909574 - RNA, 20 nt, Human
ggcaugaagagcaaaaauau

SEQ ID NO: 2909575 - RNA, 13 nt, Human
ggcaucuuugggg

SEQ ID NO: 2909576 - RNA, 16 nt, Human
ggcaucuuuggggagg

SEQ ID NO: 2909577 - RNA, 16 nt, Human
ggcaugcggucgggca

SEQ ID NO: 2909578 - RNA, 13 nt, Human
ggcaugccuugug

SEQ ID NO: 2909579 - RNA, 14 nt, Human
ggcaugccuugugc

SEQ ID NO: 2909580 - RNA, 17 nt, Human
ggcaugcggucgggcag

SEQ ID NO: 2909581 - RNA, 12 nt, Human
ggcaugcugggg

SEQ ID NO: 2909582 - RNA, 14 nt, Human
ggcaugcuggggca

SEQ ID NO: 2909583 - RNA, 13 nt, Human
ggcaugcuggggc

SEQ ID NO: 2909584 - RNA, 16 nt, Human
ggcaugcuggggcaag

SEQ ID NO: 2909585 - RNA, 12 nt, Human
ggcauggcccug

SEQ ID NO: 2909586 - RNA, 17 nt, Human
ggcauggcccugggguc

SEQ ID NO: 2909587 - RNA, 13 nt, Human
ggcauggcccugg

SEQ ID NO: 2909588 - RNA, 16 nt, Human
ggcauggcccuggggu

SEQ ID NO: 2909589 - RNA, 17 nt, Human
ggcauggccagguggcc

SEQ ID NO: 2909590 - RNA, 18 nt, Human
ggcauggccagguggcca

SEQ ID NO: 2909591 - RNA, 22 nt, Human
ggccucggacuuagcugggaga

SEQ ID NO: 2909592 - RNA, 16 nt, Human
ggccucgggacaccug

SEQ ID NO: 2909593 - RNA, 22 nt, Human
ggccucgggacaccugcccugc

SEQ ID NO: 2909594 - RNA, 23 nt, Human
ggccucgggacaccugcccugcc

SEQ ID NO: 2909595 - RNA, 16 nt, Human
ggccucgggaccucag

SEQ ID NO: 2909596 - RNA, 20 nt, Human
ggccucaaaggcccgcucua

SEQ ID NO: 2909597 - RNA, 17 nt, Human
ggccucggacuuagcug

SEQ ID NO: 2909598 - RNA, 20 nt, Human
ggccucggacuuagcuggga

SEQ ID NO: 2909599 - RNA, 18 nt, Human
ggccucaaaggcccgcuc

SEQ ID NO: 2909600 - RNA, 19 nt, Human
ggccucaaaggcccgcucu

SEQ ID NO: 2909601 - RNA, 21 nt, Human
ggccuaugcacauauggacuc

SEQ ID NO: 2909602 - RNA, 20 nt, Human
ggccuaugcacauauggacu

SEQ ID NO: 2909603 - RNA, 13 nt, Human
ggccuaucuccua

SEQ ID NO: 2909604 - RNA, 18 nt, Human
ggccuaucuccuagggcu

SEQ ID NO: 2909605 - RNA, 14 nt, Human
ggccucuguguccu

SEQ ID NO: 2909606 - RNA, 20 nt, Human
ggccucuguguccuucccug

SEQ ID NO: 2909607 - RNA, 19 nt, Human
ggccucuuccgugacguca

SEQ ID NO: 2909608 - RNA, 16 nt, Human
ggccucugugccuucu

SEQ ID NO: 2909609 - RNA, 16 nt, Human
ggccuagcccacccug

SEQ ID NO: 2909610 - RNA, 17 nt, Human
ggccuagcccacccugc

SEQ ID NO: 2909611 - RNA, 18 nt, Human
ggccuagcccacccugcu

SEQ ID NO: 2909612 - RNA, 22 nt, Human
ggccuagcccacccugcugccu

SEQ ID NO: 2909613 - RNA, 23 nt, Human
ggccuaaucucauaccucugacc

SEQ ID NO: 2909614 - RNA, 15 nt, Human
ggccuaggauucuaa

SEQ ID NO: 2909615 - RNA, 13 nt, Human
ggccuaggauucu

SEQ ID NO: 2909616 - RNA, 20 nt, Human
ggccuacagcuuugaucccu

SEQ ID NO: 2909617 - RNA, 23 nt, Human
ggccuacagcuuugaucccugac

SEQ ID NO: 2909618 - RNA, 15 nt, Human
ggccggugugggcug

SEQ ID NO: 2909619 - RNA, 16 nt, Human
ggcccugucccuccca

SEQ ID NO: 2909620 - RNA, 17 nt, Human
ggcccugucccucccac

SEQ ID NO: 2909621 - RNA, 18 nt, Human
ggcccugucccucccacc

SEQ ID NO: 2909622 - RNA, 20 nt, Human
ggcccugucccucccaccuc

SEQ ID NO: 2909623 - RNA, 21 nt, Human
ggcccugucccucccaccucu

SEQ ID NO: 2909624 - RNA, 22 nt, Human
ggcccugucccucccaccucug

SEQ ID NO: 2909625 - RNA, 23 nt, Human
ggcccugucccucccaccucugu

SEQ ID NO: 2909626 - RNA, 16 nt, Human
ggcccugggcucggag

SEQ ID NO: 2909627 - RNA, 18 nt, Human
ggcccugggcucggaggc

SEQ ID NO: 2909628 - RNA, 21 nt, Human
ggcccugggcucggaggcugc

SEQ ID NO: 2909629 - RNA, 15 nt, Human
ggcccugucccuccc

SEQ ID NO: 2909630 - RNA, 17 nt, Human
ggcccugguccuuccag

SEQ ID NO: 2909631 - RNA, 22 nt, Human
ggcccuggugcgaauggacuuu

SEQ ID NO: 2909632 - RNA, 15 nt, Human
ggcccugguccuucc

SEQ ID NO: 2909633 - RNA, 12 nt, Human
ggcccugguccu

SEQ ID NO: 2909634 - RNA, 15 nt, Human
ggcccugggguccca

SEQ ID NO: 2909635 - RNA, 22 nt, Human
ggcccugcaauguaucccuucu

SEQ ID NO: 2909636 - RNA, 16 nt, Human
ggcccugcagccagcu

SEQ ID NO: 2909637 - RNA, 17 nt, Human
ggcccugcagccagcuc

SEQ ID NO: 2909638 - RNA, 20 nt, Human
ggcccugcccugguuuccug

SEQ ID NO: 2909639 - RNA, 13 nt, Human
ggcccugcccugg

SEQ ID NO: 2909640 - RNA, 12 nt, Human
ggcccugcccug

SEQ ID NO: 2909641 - RNA, 15 nt, Human
ggcccugcccucucc

SEQ ID NO: 2909642 - RNA, 21 nt, Human
ggcccugcccucuccuuccuu

SEQ ID NO: 2909643 - RNA, 15 nt, Human
ggcccugcaguguuc

SEQ ID NO: 2909644 - RNA, 22 nt, Human
ggcccugcaguguucgcuuggc

SEQ ID NO: 2909645 - RNA, 23 nt, Human
ggcccugcaguguucgcuuggcu

SEQ ID NO: 2909646 - RNA, 10 nt, Human
ggcccugcau

SEQ ID NO: 2909647 - RNA, 11 nt, Human
ggcccugcaug

SEQ ID NO: 2909648 - RNA, 11 nt, Human
ggcccugcccu

SEQ ID NO: 2909649 - RNA, 17 nt, Human
ggcccugcccuggcagg

SEQ ID NO: 2909650 - RNA, 14 nt, Human
ggcccugcccugag

SEQ ID NO: 2909651 - RNA, 18 nt, Human
ggcccugcccugaggaag

SEQ ID NO: 2909652 - RNA, 19 nt, Human
ggcccugcccugaggaagg

SEQ ID NO: 2909653 - RNA, 22 nt, Human
ggcccugcccugguuuccugcc

SEQ ID NO: 2909654 - RNA, 15 nt, Human
ggcccugcuccugca

SEQ ID NO: 2909655 - RNA, 17 nt, Human
ggcccugcuccugcagc

SEQ ID NO: 2909656 - RNA, 18 nt, Human
ggcccugcuccugcagca

SEQ ID NO: 2909657 - RNA, 21 nt, Human
ggcccugcuccugcagcaugg

SEQ ID NO: 2909658 - RNA, 13 nt, Human
ggcccugcugccc

SEQ ID NO: 2909659 - RNA, 14 nt, Human
ggcccugcugccca

SEQ ID NO: 2909660 - RNA, 15 nt, Human
ggcccuggaacucua

SEQ ID NO: 2909661 - RNA, 15 nt, Human
ggcccuggcucugcu

SEQ ID NO: 2909662 - RNA, 18 nt, Human
ggcccuggcucugcuguc

SEQ ID NO: 2909663 - RNA, 19 nt, Human
ggcccuggcugagggcagc

SEQ ID NO: 2909664 - RNA, 22 nt, Human
ggcccuggcucccacaggcccu

SEQ ID NO: 2909665 - RNA, 13 nt, Human
ggcccuggcuccc

SEQ ID NO: 2909666 - RNA, 17 nt, Human
ggcccucucccuuaccc

SEQ ID NO: 2909667 - RNA, 11 nt, Human
ggcccagagag

SEQ ID NO: 2909668 - RNA, 21 nt, Human
ggccauucuuuuuuucuuggc

SEQ ID NO: 2909669 - RNA, 13 nt, Human
ggcccaaggcggc

SEQ ID NO: 2909670 - RNA, 14 nt, Human
ggcccaaggcggcc

SEQ ID NO: 2909671 - RNA, 22 nt, Human
ggcccacgccuguaaucccagc

SEQ ID NO: 2909672 - RNA, 17 nt, Human
ggcccacgugguugggg

SEQ ID NO: 2909673 - RNA, 23 nt, Human
ggcccacucaggggucacugagg

SEQ ID NO: 2909674 - RNA, 11 nt, Human
ggcccacacac

SEQ ID NO: 2909675 - RNA, 12 nt, Human
ggcccacacaca

SEQ ID NO: 2909676 - RNA, 17 nt, Human
ggcccaaggcggccccu

SEQ ID NO: 2909677 - RNA, 21 nt, Human
ggcccaaggcggccccucccg

SEQ ID NO: 2909678 - RNA, 16 nt, Human
ggcuccaggcuccuuu

SEQ ID NO: 2909679 - RNA, 14 nt, Human
ggcuccauauauau

SEQ ID NO: 2909680 - RNA, 17 nt, Human
ggcucccacaggcccuu

SEQ ID NO: 2909681 - RNA, 11 nt, Human
ggcuccaugcu

SEQ ID NO: 2909682 - RNA, 18 nt, Human
ggcuccaugcuccucacu

SEQ ID NO: 2909683 - RNA, 18 nt, Human
ggcucccacaggcccuuc

SEQ ID NO: 2909684 - RNA, 19 nt, Human
ggcucccacaggcccuucc

SEQ ID NO: 2909685 - RNA, 11 nt, Human
ggcuccaggcu

SEQ ID NO: 2909686 - RNA, 15 nt, Human
ggcuccaggcuccuu

SEQ ID NO: 2909687 - RNA, 12 nt, Human
ggcuccagcugg

SEQ ID NO: 2909688 - RNA, 21 nt, Human
ggcucaaguccucuuuucuga

SEQ ID NO: 2909689 - RNA, 15 nt, Human
ggcucaaguccucuu

SEQ ID NO: 2909690 - RNA, 13 nt, Human
ggcucacaccugu

SEQ ID NO: 2909691 - RNA, 16 nt, Human
ggcucacaccuguaau

SEQ ID NO: 2909692 - RNA, 19 nt, Human
ggcuagaguccucacuccc

SEQ ID NO: 2909693 - RNA, 18 nt, Human
ggcuagaguccucacucc

SEQ ID NO: 2909694 - RNA, 14 nt, Human
ggcuagaguccuca

SEQ ID NO: 2909695 - RNA, 13 nt, Human
ggcuagaguccuc

SEQ ID NO: 2909696 - RNA, 16 nt, Human
ggcuaggaccccucca

SEQ ID NO: 2909697 - RNA, 20 nt, Human
ggcuagaguccucacuccca

SEQ ID NO: 2909698 - RNA, 14 nt, Human
ggcuagcuggagcc

SEQ ID NO: 2909699 - RNA, 15 nt, Human
ggcuagcuggagccu

SEQ ID NO: 2909700 - RNA, 16 nt, Human
ggcuagcuggagccug

SEQ ID NO: 2909701 - RNA, 17 nt, Human
ggcuagcuggagccugg

SEQ ID NO: 2909702 - RNA, 22 nt, Human
ggcuaggaccccuccauguggg

SEQ ID NO: 2909703 - RNA, 19 nt, Human
ggcuaugggggcacugagg

SEQ ID NO: 2909704 - RNA, 17 nt, Human
ggcuauggacacagggu

SEQ ID NO: 2909705 - RNA, 17 nt, Human
ggcuaugguguggacug

SEQ ID NO: 2909706 - RNA, 19 nt, Human
ggcucaagcgauucuccug

SEQ ID NO: 2909707 - RNA, 15 nt, Human
ggcuaguugggcuuc

SEQ ID NO: 2909708 - RNA, 16 nt, Human
ggcuaguugggcuucc

SEQ ID NO: 2909709 - RNA, 19 nt, Human
ggcuauagcuacaggaagc

SEQ ID NO: 2909710 - RNA, 14 nt, Human
ggccuggggccuga

SEQ ID NO: 2909711 - RNA, 15 nt, Human
ggccuggggccugag

SEQ ID NO: 2909712 - RNA, 16 nt, Human
ggccuggggccugaga

SEQ ID NO: 2909713 - RNA, 17 nt, Human
ggccuggggccugagag

SEQ ID NO: 2909714 - RNA, 18 nt, Human
ggccuggggccugagaga

SEQ ID NO: 2909715 - RNA, 20 nt, Human
ggccugucucauccccaggg

SEQ ID NO: 2909716 - RNA, 19 nt, Human
ggccugucucauccccagg

SEQ ID NO: 2909717 - RNA, 18 nt, Human
ggccugucucauccccag

SEQ ID NO: 2909718 - RNA, 17 nt, Human
ggccugucucaucccca

SEQ ID NO: 2909719 - RNA, 23 nt, Human
ggccugaagaguccucugaauga

SEQ ID NO: 2909720 - RNA, 22 nt, Human
ggccugaaugcuuauagguggc

SEQ ID NO: 2909721 - RNA, 13 nt, Human
ggccuggccuggc

SEQ ID NO: 2909722 - RNA, 14 nt, Human
ggccuggccuggcc

SEQ ID NO: 2909723 - RNA, 16 nt, Human
ggccuggccuggcccu

SEQ ID NO: 2909724 - RNA, 17 nt, Human
ggccuggccuggcccug

SEQ ID NO: 2909725 - RNA, 18 nt, Human
ggccuggccuggcccugc

SEQ ID NO: 2909726 - RNA, 19 nt, Human
ggccugaagaguccucuga

SEQ ID NO: 2909727 - RNA, 13 nt, Human
ggccugaagaguc

SEQ ID NO: 2909728 - RNA, 22 nt, Human
ggccugaaaggagcccuuaucu

SEQ ID NO: 2909729 - RNA, 16 nt, Human
ggccugaaaggagccc

SEQ ID NO: 2909730 - RNA, 12 nt, Human
ggcgccuggccu

SEQ ID NO: 2909731 - RNA, 16 nt, Human
ggcgccuggccuccag

SEQ ID NO: 2909732 - RNA, 14 nt, Human
ggcgcggccagccc

SEQ ID NO: 2909733 - RNA, 14 nt, Human
ggccugucugugac

SEQ ID NO: 2909734 - RNA, 16 nt, Human
ggccuguggaaugagu

SEQ ID NO: 2909735 - RNA, 18 nt, Human
ggccuguggaaugagugu

SEQ ID NO: 2909736 - RNA, 19 nt, Human
ggccuguggaaugagugug

SEQ ID NO: 2909737 - RNA, 22 nt, Human
ggccuguggaaugagugugcau

SEQ ID NO: 2909738 - RNA, 23 nt, Human
ggccugucucauccccagggguc

SEQ ID NO: 2909739 - RNA, 22 nt, Human
ggcgccgcaaaccacacuggac

SEQ ID NO: 2909740 - RNA, 19 nt, Human
ggcgccgcaaaccacacug

SEQ ID NO: 2909741 - RNA, 20 nt, Human
ggcgccgcaaaccacacugg

SEQ ID NO: 2909742 - RNA, 13 nt, Human
ggcggccccagca

SEQ ID NO: 2909743 - RNA, 17 nt, Human
ggcggccccucccgccc

SEQ ID NO: 2909744 - RNA, 16 nt, Human
ggcggcgggcggcugg

SEQ ID NO: 2909745 - RNA, 20 nt, Human
ggcggaucaucuaauucucu

SEQ ID NO: 2909746 - RNA, 20 nt, Human
ggcggcacaggucgggcgca

SEQ ID NO: 2909747 - RNA, 21 nt, Human
ggcggagcuugcagugagccg

SEQ ID NO: 2909748 - RNA, 20 nt, Human
ggcggagcuugcagugagcc

SEQ ID NO: 2909749 - RNA, 23 nt, Human
ggcggagcuggccccgccgccug

SEQ ID NO: 2909750 - RNA, 17 nt, Human
ggcggagcuggccccgc

SEQ ID NO: 2909751 - RNA, 20 nt, Human
ggcggagcuggccccgccgc

SEQ ID NO: 2909752 - RNA, 13 nt, Human
ggcggagcuggcc

SEQ ID NO: 2909753 - RNA, 13 nt, Human
ggcggagccggcc

SEQ ID NO: 2909754 - RNA, 14 nt, Human
ggcggagcuggccc

SEQ ID NO: 2909755 - RNA, 15 nt, Human
ggcggagcuggcccc

SEQ ID NO: 2909756 - RNA, 16 nt, Human
ggcgcggccagccccg

SEQ ID NO: 2909757 - RNA, 20 nt, Human
ggcgcuggguauuggaaaug

SEQ ID NO: 2909758 - RNA, 22 nt, Human
ggcggaaagccuguaagccugc

SEQ ID NO: 2909759 - RNA, 19 nt, Human
ggacgcuccgcugccgugc

SEQ ID NO: 2909760 - RNA, 16 nt, Human
ggacugcugcugccug

SEQ ID NO: 2909761 - RNA, 17 nt, Human
ggacugcugcugccugg

SEQ ID NO: 2909762 - RNA, 18 nt, Human
ggacugcugcugccuggc

SEQ ID NO: 2909763 - RNA, 20 nt, Human
ggacugcugcugccuggcca

SEQ ID NO: 2909764 - RNA, 23 nt, Human
ggacuggcuagaguccucacucc

SEQ ID NO: 2909765 - RNA, 22 nt, Human
ggacuggcuagaguccucacuc

SEQ ID NO: 2909766 - RNA, 20 nt, Human
ggacuggcuagaguccucac

SEQ ID NO: 2909767 - RNA, 19 nt, Human
ggacuggcuagaguccuca

SEQ ID NO: 2909768 - RNA, 16 nt, Human
ggacuggccccugggu

SEQ ID NO: 2909769 - RNA, 17 nt, Human
ggacuggccccuggguc

SEQ ID NO: 2909770 - RNA, 14 nt, Human
ggacuggccccugg

SEQ ID NO: 2909771 - RNA, 15 nt, Human
ggacuggccccuggg

SEQ ID NO: 2909772 - RNA, 18 nt, Human
ggacuggccucugcugau

SEQ ID NO: 2909773 - RNA, 19 nt, Human
ggacuguggcacuugccug

SEQ ID NO: 2909774 - RNA, 14 nt, Human
ggagacagccccag

SEQ ID NO: 2909775 - RNA, 15 nt, Human
ggagacagccccaga

SEQ ID NO: 2909776 - RNA, 12 nt, Human
ggagaggagaga

SEQ ID NO: 2909777 - RNA, 16 nt, Human
ggagaggaacuccuug

SEQ ID NO: 2909778 - RNA, 17 nt, Human
ggagaggaacuccuugg

SEQ ID NO: 2909779 - RNA, 15 nt, Human
ggagaggaagagaca

SEQ ID NO: 2909780 - RNA, 19 nt, Human
ggagacagccccagagcag

SEQ ID NO: 2909781 - RNA, 17 nt, Human
ggagacagccccagagc

SEQ ID NO: 2909782 - RNA, 13 nt, Human
ggagaggaugaga

SEQ ID NO: 2909783 - RNA, 20 nt, Human
ggagaggaugagagcccaga

SEQ ID NO: 2909784 - RNA, 13 nt, Human
ggagaggagagag

SEQ ID NO: 2909785 - RNA, 14 nt, Human
ggagaggagagagg

SEQ ID NO: 2909786 - RNA, 15 nt, Human
ggagaggagagaggc

SEQ ID NO: 2909787 - RNA, 18 nt, Human
ggagaggagagaggcaga

SEQ ID NO: 2909788 - RNA, 15 nt, Human
ggagacaagaaaucc

SEQ ID NO: 2909789 - RNA, 18 nt, Human
ggagacaagaaaucccug

SEQ ID NO: 2909790 - RNA, 21 nt, Human
ggagacaaugucugcagcccu

SEQ ID NO: 2909791 - RNA, 20 nt, Human
ggagacacuggccccucaaa

SEQ ID NO: 2909792 - RNA, 17 nt, Human
ggagacacuggccccuc

SEQ ID NO: 2909793 - RNA, 21 nt, Human
ggagacacaacaacuccuagg

SEQ ID NO: 2909794 - RNA, 12 nt, Human
ggagacacagau

SEQ ID NO: 2909795 - RNA, 13 nt, Human
ggagacacagaug

SEQ ID NO: 2909796 - RNA, 18 nt, Human
ggagauacugguggaagu

SEQ ID NO: 2909797 - RNA, 12 nt, Human
ggagagugucaa

SEQ ID NO: 2909798 - RNA, 19 nt, Human
ggagagugucaaccagaca

SEQ ID NO: 2909799 - RNA, 20 nt, Human
ggagagugucaaccagacag

SEQ ID NO: 2909800 - RNA, 21 nt, Human
ggagagugucaaccagacaga

SEQ ID NO: 2909801 - RNA, 22 nt, Human
ggagagugucaaccagacagag

SEQ ID NO: 2909802 - RNA, 18 nt, Human
ggagaguggccauucuuu

SEQ ID NO: 2909803 - RNA, 21 nt, Human
ggagaguggccauucuuuuuu

SEQ ID NO: 2909804 - RNA, 22 nt, Human
ggagaguacauugaaggccugg

SEQ ID NO: 2909805 - RNA, 21 nt, Human
ggagaggaugagagcccagag

SEQ ID NO: 2909806 - RNA, 22 nt, Human
ggagaggaugagagcccagagg

SEQ ID NO: 2909807 - RNA, 23 nt, Human
ggagaugaaaucuuacagcuggg

SEQ ID NO: 2909808 - RNA, 12 nt, Human
ggagauauuuaa

SEQ ID NO: 2909809 - RNA, 20 nt, Human
ggagaucaaggagaggaggc

SEQ ID NO: 2909810 - RNA, 21 nt, Human
ggagaucagaaaaauggagca

SEQ ID NO: 2909811 - RNA, 14 nt, Human
ggagauagggaaag

SEQ ID NO: 2909812 - RNA, 23 nt, Human
ggacauuuauuaguaucuuccau

SEQ ID NO: 2909813 - RNA, 20 nt, Human
ggacauugcggacagccacg

SEQ ID NO: 2909814 - RNA, 12 nt, Human
ggacauucuugu

SEQ ID NO: 2909815 - RNA, 21 nt, Human
ggacauguuuuuguuuucuuu

SEQ ID NO: 2909816 - RNA, 15 nt, Human
ggacauuaugugugc

SEQ ID NO: 2909817 - RNA, 18 nt, Human
ggacauggccccugugag

SEQ ID NO: 2909818 - RNA, 21 nt, Human
ggacagccacggccaggccag

SEQ ID NO: 2909819 - RNA, 20 nt, Human
ggacagccacggccaggcca

SEQ ID NO: 2909820 - RNA, 19 nt, Human
ggacagccacggccaggcc

SEQ ID NO: 2909821 - RNA, 15 nt, Human
ggacagccacggcca

SEQ ID NO: 2909822 - RNA, 16 nt, Human
ggacagauucagucuu

SEQ ID NO: 2909823 - RNA, 18 nt, Human
ggacagauucagucuugc

SEQ ID NO: 2909824 - RNA, 20 nt, Human
ggacagauucagucuugccu

SEQ ID NO: 2909825 - RNA, 22 nt, Human
ggacagauucagucuugccuua

SEQ ID NO: 2909826 - RNA, 21 nt, Human
ggacagagguuaucuguccca

SEQ ID NO: 2909827 - RNA, 16 nt, Human
ggacagaguaugaaca

SEQ ID NO: 2909828 - RNA, 15 nt, Human
ggacgccacccagca

SEQ ID NO: 2909829 - RNA, 24 nt, Human
ggacgccgggccggcccuagccca

SEQ ID NO: 2909830 - RNA, 17 nt, Human
ggaccuugaacugggua

SEQ ID NO: 2909831 - RNA, 15 nt, Human
ggaccuugaacuggg

SEQ ID NO: 2909832 - RNA, 11 nt, Human
ggaccucaucc

SEQ ID NO: 2909833 - RNA, 18 nt, Human
ggaccucauccaaacaau

SEQ ID NO: 2909834 - RNA, 11 nt, Human
ggaccucccuu

SEQ ID NO: 2909835 - RNA, 13 nt, Human
ggaccucccuucc

SEQ ID NO: 2909836 - RNA, 17 nt, Human
ggaccucccuuccgacc

SEQ ID NO: 2909837 - RNA, 20 nt, Human
ggaccucccuuccgacccuc

SEQ ID NO: 2909838 - RNA, 15 nt, Human
ggaccuccucuuccc

SEQ ID NO: 2909839 - RNA, 16 nt, Human
ggaccuccucuucccc

SEQ ID NO: 2909840 - RNA, 23 nt, Human
ggaccuccucuucccccuuccaa

SEQ ID NO: 2909841 - RNA, 21 nt, Human
ggaccacugcaugagcuuuua

SEQ ID NO: 2909842 - RNA, 18 nt, Human
ggaccacuguuucuugcu

SEQ ID NO: 2909843 - RNA, 19 nt, Human
ggaccacuguuucuugcuu

SEQ ID NO: 2909844 - RNA, 21 nt, Human
ggaccacuguuucuugcuugu

SEQ ID NO: 2909845 - RNA, 13 nt, Human
ggaccacucagcc

SEQ ID NO: 2909846 - RNA, 16 nt, Human
ggaccacucagccccu

SEQ ID NO: 2909847 - RNA, 17 nt, Human
ggaccacucagccccua

SEQ ID NO: 2909848 - RNA, 21 nt, Human
ggaccacucagccccuaggag

SEQ ID NO: 2909849 - RNA, 21 nt, Human
ggaccaauaaaauuucuaaga

SEQ ID NO: 2909850 - RNA, 16 nt, Human
ggaauuucuuguuucu

SEQ ID NO: 2909851 - RNA, 23 nt, Human
ggaauuuaagagcaguccauuuc

SEQ ID NO: 2909852 - RNA, 13 nt, Human
ggaauuuauaauu

SEQ ID NO: 2909853 - RNA, 21 nt, Human
ggaauuuguucaaguuuuggg

SEQ ID NO: 2909854 - RNA, 17 nt, Human
ggaauuuuugcuugacu

SEQ ID NO: 2909855 - RNA, 14 nt, Human
ggacaaaacuucuu

SEQ ID NO: 2909856 - RNA, 21 nt, Human
ggacaaaacuucuugucagac

SEQ ID NO: 2909857 - RNA, 15 nt, Human
ggacaaaguauuuga

SEQ ID NO: 2909858 - RNA, 12 nt, Human
ggacaaauguga

SEQ ID NO: 2909859 - RNA, 19 nt, Human
ggacaaaugugaagaugca

SEQ ID NO: 2909860 - RNA, 14 nt, Human
ggacaaauugagac

SEQ ID NO: 2909861 - RNA, 17 nt, Human
ggacaaauugagacagu

SEQ ID NO: 2909862 - RNA, 20 nt, Human
ggacaaauugagacagugca

SEQ ID NO: 2909863 - RNA, 19 nt, Human
ggaauugauuugcauugaa

SEQ ID NO: 2909864 - RNA, 18 nt, Human
ggaauugauuugcauuga

SEQ ID NO: 2909865 - RNA, 17 nt, Human
ggaauugauuugcauug

SEQ ID NO: 2909866 - RNA, 15 nt, Human
ggaauugauuugcau

SEQ ID NO: 2909867 - RNA, 19 nt, Human
ggaauguuugccucugccu

SEQ ID NO: 2909868 - RNA, 19 nt, Human
ggaauuagcuuggggccag

SEQ ID NO: 2909869 - RNA, 20 nt, Human
ggaauuagcuuggggccagg

SEQ ID NO: 2909870 - RNA, 22 nt, Human
ggaauuagcuuggggccaggga

SEQ ID NO: 2909871 - RNA, 22 nt, Human
ggaauuaaguuaucuuuaaaau

SEQ ID NO: 2909872 - RNA, 19 nt, Human
ggaauuacauguaaaacau

SEQ ID NO: 2909873 - RNA, 12 nt, Human
ggaaugcagugg

SEQ ID NO: 2909874 - RNA, 23 nt, Human
ggaaugccugagugccuggccaa

SEQ ID NO: 2909875 - RNA, 14 nt, Human
ggaaugccugagug

SEQ ID NO: 2909876 - RNA, 18 nt, Human
ggaaugccugagugccug

SEQ ID NO: 2909877 - RNA, 19 nt, Human
ggaaugccugagugccugg

SEQ ID NO: 2909878 - RNA, 14 nt, Human
ggaaugcuguguua

SEQ ID NO: 2909879 - RNA, 15 nt, Human
ggaauguguggccug

SEQ ID NO: 2909880 - RNA, 18 nt, Human
ggaagugacauuguguca

SEQ ID NO: 2909881 - RNA, 20 nt, Human
ggaagugguggcuguggaag

SEQ ID NO: 2909882 - RNA, 17 nt, Human
ggaaguccaauguggca

SEQ ID NO: 2909883 - RNA, 16 nt, Human
ggaaguccaauguggc

SEQ ID NO: 2909884 - RNA, 15 nt, Human
ggaaguccaaugugg

SEQ ID NO: 2909885 - RNA, 23 nt, Human
ggaagugaagagggagaagggau

SEQ ID NO: 2909886 - RNA, 20 nt, Human
ggaagugaagacuggaagcu

SEQ ID NO: 2909887 - RNA, 13 nt, Human
ggaaguccucugg

SEQ ID NO: 2909888 - RNA, 14 nt, Human
ggaaguccucuggg

SEQ ID NO: 2909889 - RNA, 14 nt, Human
ggaaguaguccuug

SEQ ID NO: 2909890 - RNA, 16 nt, Human
ggaaguaguccuuggc

SEQ ID NO: 2909891 - RNA, 18 nt, Human
ggaaguaguccuuggcau

SEQ ID NO: 2909892 - RNA, 22 nt, Human
ggaaggccucuuggagaccuua

SEQ ID NO: 2909893 - RNA, 13 nt, Human
ggaaggguggugg

SEQ ID NO: 2909894 - RNA, 18 nt, Human
ggaaggguuuguggcugg

SEQ ID NO: 2909895 - RNA, 11 nt, Human
ggaaggugggg

SEQ ID NO: 2909896 - RNA, 13 nt, Human
ggaaggucucauu

SEQ ID NO: 2909897 - RNA, 16 nt, Human
ggaagguggggacagg

SEQ ID NO: 2909898 - RNA, 23 nt, Human
ggaaguaacaguaacgcagggga

SEQ ID NO: 2909899 - RNA, 18 nt, Human
ggaaguacaugaauacaa

SEQ ID NO: 2909900 - RNA, 19 nt, Human
ggaagggggggcuacauua

SEQ ID NO: 2909901 - RNA, 20 nt, Human
ggaagggggggcuacauuau

SEQ ID NO: 2909902 - RNA, 21 nt, Human
ggaagggggggcuacauuaua

SEQ ID NO: 2909903 - RNA, 17 nt, Human
ggaaggggacccccgcc

SEQ ID NO: 2909904 - RNA, 22 nt, Human
ggaaggggacccccgcccccug

SEQ ID NO: 2909905 - RNA, 16 nt, Human
ggaaggggacccccgc

SEQ ID NO: 2909906 - RNA, 21 nt, Human
ggaagggcaggaaggagagcc

SEQ ID NO: 2909907 - RNA, 15 nt, Human
ggaagggcaggaagg

SEQ ID NO: 2909908 - RNA, 12 nt, Human
ggaagggcagga

SEQ ID NO: 2909909 - RNA, 14 nt, Human
ggaagggcaaaacc

SEQ ID NO: 2909910 - RNA, 17 nt, Human
ggaaggcuggcugggca

SEQ ID NO: 2909911 - RNA, 14 nt, Human
ggaaggcuggcugg

SEQ ID NO: 2909912 - RNA, 17 nt, Human
ggaaggcugagaggaga

SEQ ID NO: 2909913 - RNA, 12 nt, Human
ggaaggccugac

SEQ ID NO: 2909914 - RNA, 20 nt, Human
ggaaggccugacuucugcug

SEQ ID NO: 2909915 - RNA, 12 nt, Human
ggaaggccuggg

SEQ ID NO: 2909916 - RNA, 13 nt, Human
ggaaggccugggu

SEQ ID NO: 2909917 - RNA, 14 nt, Human
ggaaggccugggug

SEQ ID NO: 2909918 - RNA, 21 nt, Human
ggaaggcucuucuccccagag

SEQ ID NO: 2909919 - RNA, 22 nt, Human
ggaaggccaaggggagucaccu

SEQ ID NO: 2909920 - RNA, 14 nt, Human
ggaaccucugucuc

SEQ ID NO: 2909921 - RNA, 15 nt, Human
ggaaccucugucuca

SEQ ID NO: 2909922 - RNA, 23 nt, Human
ggaaccucugucucauccuccug

SEQ ID NO: 2909923 - RNA, 19 nt, Human
ggaaccugaggccugaagg

SEQ ID NO: 2909924 - RNA, 15 nt, Human
ggaaccugcaaaaaa

SEQ ID NO: 2909925 - RNA, 16 nt, Human
ggaaccugcaaaaaau

SEQ ID NO: 2909926 - RNA, 13 nt, Human
ggaaccugacccc

SEQ ID NO: 2909927 - RNA, 13 nt, Human
ggaacgcagauga

SEQ ID NO: 2909928 - RNA, 14 nt, Human
ggaacgaugugucu

SEQ ID NO: 2909929 - RNA, 15 nt, Human
ggaacgaugugucug

SEQ ID NO: 2909930 - RNA, 21 nt, Human
ggaaccuuccuuccugcuuga

SEQ ID NO: 2909931 - RNA, 13 nt, Human
ggaaccuugcugu

SEQ ID NO: 2909932 - RNA, 15 nt, Human
ggaaccuugcugucc

SEQ ID NO: 2909933 - RNA, 16 nt, Human
ggaaccuugcuguccu

SEQ ID NO: 2909934 - RNA, 17 nt, Human
ggaaccuugcuguccug

SEQ ID NO: 2909935 - RNA, 22 nt, Human
ggaaccuguccuaaggaaccuu

SEQ ID NO: 2909936 - RNA, 13 nt, Human
ggaaccugccaug

SEQ ID NO: 2909937 - RNA, 11 nt, Human
ggaaccugcca

SEQ ID NO: 2909938 - RNA, 20 nt, Human
ggaaccuuccuuccugcuug

SEQ ID NO: 2909939 - RNA, 19 nt, Human
ggaaccuuccuuccugcuu

SEQ ID NO: 2909940 - RNA, 16 nt, Human
ggaaccuuccuuccug

SEQ ID NO: 2909941 - RNA, 13 nt, Human
ggaaggauuguaa

SEQ ID NO: 2909942 - RNA, 16 nt, Human
ggaaggauuguaaaaa

SEQ ID NO: 2909943 - RNA, 23 nt, Human
ggaaggauuguaaaaaaaaaugc

SEQ ID NO: 2909944 - RNA, 13 nt, Human
ggaaggcagacag

SEQ ID NO: 2909945 - RNA, 14 nt, Human
ggaaggcagacagc

SEQ ID NO: 2909946 - RNA, 17 nt, Human
ggaaggcagacagcagg

SEQ ID NO: 2909947 - RNA, 18 nt, Human
ggaaggcagacagcaggc

SEQ ID NO: 2909948 - RNA, 22 nt, Human
ggaaggcagacagcaggcagcg

SEQ ID NO: 2909949 - RNA, 14 nt, Human
ggaaggcagggagg

SEQ ID NO: 2909950 - RNA, 19 nt, Human
ggaaaggcucagucucagg

SEQ ID NO: 2909951 - RNA, 20 nt, Human
ggaaaggcucagucucagga

SEQ ID NO: 2909952 - RNA, 23 nt, Human
ggaaaggcucagucucaggagca

SEQ ID NO: 2909953 - RNA, 23 nt, Human
ggaacagcuaugggagccccagg

SEQ ID NO: 2909954 - RNA, 14 nt, Human
ggaaauagcuaaua

SEQ ID NO: 2909955 - RNA, 18 nt, Human
ggaaauacccuucuuuua

SEQ ID NO: 2909956 - RNA, 23 nt, Human
ggaaauacccuucuuuuaugagc

SEQ ID NO: 2909957 - RNA, 20 nt, Human
ggaaauaauaaagaugcucu

SEQ ID NO: 2909958 - RNA, 22 nt, Human
ggaaauaaaaccuuucaaauuu

SEQ ID NO: 2909959 - RNA, 19 nt, Human
ggaaaguucagaguuuucu

SEQ ID NO: 2909960 - RNA, 21 nt, Human
ggaaaguuuacccaugaagau

SEQ ID NO: 2909961 - RNA, 20 nt, Human
ggaaauaaaaccuuucaaau

SEQ ID NO: 2909962 - RNA, 19 nt, Human
ggaaauaaaaccuuucaaa

SEQ ID NO: 2909963 - RNA, 18 nt, Human
ggaaauaaaaccuuucaa

SEQ ID NO: 2909964 - RNA, 16 nt, Human
ggaaauaaaaccuuuc

SEQ ID NO: 2909965 - RNA, 15 nt, Human
ggaaauaaaaccuuu

SEQ ID NO: 2909966 - RNA, 20 nt, Human
ggaacccagcaguucuguua

SEQ ID NO: 2909967 - RNA, 18 nt, Human
ggaaccaugaagacagga

SEQ ID NO: 2909968 - RNA, 15 nt, Human
ggaaccaagcaggag

SEQ ID NO: 2909969 - RNA, 20 nt, Human
ggaacagcuaugggagcccc

SEQ ID NO: 2909970 - RNA, 13 nt, Human
ggaacauaaaaag

SEQ ID NO: 2909971 - RNA, 16 nt, Human
ggaacauuuauuuuau

SEQ ID NO: 2909972 - RNA, 17 nt, Human
ggaacauuuauuuuaug

SEQ ID NO: 2909973 - RNA, 18 nt, Human
ggaacauuuauuuuauga

SEQ ID NO: 2909974 - RNA, 21 nt, Human
ggaacauuuauuuuaugagaa

SEQ ID NO: 2909975 - RNA, 23 nt, Human
ggaacauuuauuuuaugagaaau

SEQ ID NO: 2909976 - RNA, 18 nt, Human
ggaacauuucuguaaaua

SEQ ID NO: 2909977 - RNA, 19 nt, Human
ggaacauuucuguaaauac

SEQ ID NO: 2909978 - RNA, 21 nt, Human
ggaacauuucuguaaauacca

SEQ ID NO: 2909979 - RNA, 22 nt, Human
ggaacauuucuguaaauaccau

SEQ ID NO: 2909980 - RNA, 15 nt, Human
ggaacaucaucaagg

SEQ ID NO: 2909981 - RNA, 22 nt, Human
ggaacaucaucaaggcacugcc

SEQ ID NO: 2909982 - RNA, 18 nt, Human
ggaacauaaaaaggacau

SEQ ID NO: 2909983 - RNA, 23 nt, Human
ggaacaucaucaaggcacugccu

SEQ ID NO: 2909984 - RNA, 15 nt, Human
ggaacauccuuugca

SEQ ID NO: 2909985 - RNA, 20 nt, Human
ggaacauccuuugcagggca

SEQ ID NO: 2909986 - RNA, 21 nt, Human
ggaacauccuuugcagggcag

SEQ ID NO: 2909987 - RNA, 22 nt, Human
ggaacauccuuugcagggcagc

SEQ ID NO: 2909988 - RNA, 23 nt, Human
ggaacauccuuugcagggcagcc

SEQ ID NO: 2909989 - RNA, 15 nt, Human
gcuuuguaugcacuu

SEQ ID NO: 2909990 - RNA, 14 nt, Human
gcuuuguccccugc

SEQ ID NO: 2909991 - RNA, 15 nt, Human
gcuuuguccccugcu

SEQ ID NO: 2909992 - RNA, 16 nt, Human
gcuuuguccccugcuu

SEQ ID NO: 2909993 - RNA, 21 nt, Human
gcuuuguccccugcuucagau

SEQ ID NO: 2909994 - RNA, 18 nt, Human
gcuuucaaagcauuuaca

SEQ ID NO: 2909995 - RNA, 18 nt, Human
gcuuucagaaaacgggaa

SEQ ID NO: 2909996 - RNA, 19 nt, Human
gcuuucagaaaacgggaag

SEQ ID NO: 2909997 - RNA, 19 nt, Human
gcuuugugugaaggcagag

SEQ ID NO: 2909998 - RNA, 18 nt, Human
gcuuugucuggaagaaag

SEQ ID NO: 2909999 - RNA, 14 nt, Human
gcuuugucugucgu

SEQ ID NO: 2910000 - RNA, 15 nt, Human
gcuuuguugcacuga

SEQ ID NO: 2910001 - RNA, 16 nt, Human
gcuuuguugcacugaa

SEQ ID NO: 2910002 - RNA, 13 nt, Human
gcuuuguguugua

SEQ ID NO: 2910003 - RNA, 15 nt, Human
gcuuuguguuguaau

SEQ ID NO: 2910004 - RNA, 22 nt, Human
gcuuuguguuguaauucuucag

SEQ ID NO: 2910005 - RNA, 13 nt, Human
gcuuuguguuugg

SEQ ID NO: 2910006 - RNA, 19 nt, Human
gcuuuguguuugguuuaca

SEQ ID NO: 2910007 - RNA, 20 nt, Human
gcuuuguguuugguuuacau

SEQ ID NO: 2910008 - RNA, 21 nt, Human
gcuuuguguuugguuuacauu

SEQ ID NO: 2910009 - RNA, 22 nt, Human
gcuuuguguuugguuuacauuu

SEQ ID NO: 2910010 - RNA, 23 nt, Human
gcuuuguguuugguuuacauuua

SEQ ID NO: 2910011 - RNA, 15 nt, Human
gcuuuguuaaaaaaa

SEQ ID NO: 2910012 - RNA, 23 nt, Human
gcuuuguuaaaaaaaaaaagauu

SEQ ID NO: 2910013 - RNA, 20 nt, Human
gcuugaggguugggcuggug

SEQ ID NO: 2910014 - RNA, 18 nt, Human
gcuugaggguugggcugg

SEQ ID NO: 2910015 - RNA, 11 nt, Human
gcuuuagagcu

SEQ ID NO: 2910016 - RNA, 14 nt, Human
gcuuuagagcuagg

SEQ ID NO: 2910017 - RNA, 23 nt, Human
gcuuuauuuuuuaaguauuuaua

SEQ ID NO: 2910018 - RNA, 11 nt, Human
gcuuucaagug

SEQ ID NO: 2910019 - RNA, 15 nt, Human
gcuuucaagugccuu

SEQ ID NO: 2910020 - RNA, 21 nt, Human
gcuuuauuuuuuaaguauuua

SEQ ID NO: 2910021 - RNA, 19 nt, Human
gcuuuauuuuuuaaguauu

SEQ ID NO: 2910022 - RNA, 16 nt, Human
gcuuuauauauggaca

SEQ ID NO: 2910023 - RNA, 18 nt, Human
gcuuuauauauggacaug

SEQ ID NO: 2910024 - RNA, 19 nt, Human
gcuuuauauauggacaugg

SEQ ID NO: 2910025 - RNA, 17 nt, Human
gcuuuauuuuuuaagua

SEQ ID NO: 2910026 - RNA, 20 nt, Human
ggaaaagcugcugacagugu

SEQ ID NO: 2910027 - RNA, 18 nt, Human
ggaaaagcugcugacagu

SEQ ID NO: 2910028 - RNA, 12 nt, Human
ggaaaagggaag

SEQ ID NO: 2910029 - RNA, 14 nt, Human
ggaaaagcugcuga

SEQ ID NO: 2910030 - RNA, 19 nt, Human
ggaaaagcggacaucagcu

SEQ ID NO: 2910031 - RNA, 22 nt, Human
ggaaaacagaacaucauuagaa

SEQ ID NO: 2910032 - RNA, 18 nt, Human
ggaaaagcagcucucccc

SEQ ID NO: 2910033 - RNA, 14 nt, Human
ggaaaagcagcucu

SEQ ID NO: 2910034 - RNA, 12 nt, Human
ggaaaaauguuu

SEQ ID NO: 2910035 - RNA, 13 nt, Human
ggaaaaauguuug

SEQ ID NO: 2910036 - RNA, 14 nt, Human
ggaaaaauguuugu

SEQ ID NO: 2910037 - RNA, 20 nt, Human
gcuuuguuuggauguaauuu

SEQ ID NO: 2910038 - RNA, 22 nt, Human
gcuuuucacugcuggcugccuu

SEQ ID NO: 2910039 - RNA, 23 nt, Human
gcuuuucacugcuggcugccuua

SEQ ID NO: 2910040 - RNA, 13 nt, Human
gcuuuucacugcu

SEQ ID NO: 2910041 - RNA, 22 nt, Human
gcuuuguuuugggggucaggca

SEQ ID NO: 2910042 - RNA, 14 nt, Human
gcuuuucacugcug

SEQ ID NO: 2910043 - RNA, 18 nt, Human
gcuuuucacugcuggcug

SEQ ID NO: 2910044 - RNA, 13 nt, Human
gcuguccucccuc

SEQ ID NO: 2910045 - RNA, 15 nt, Human
gcuguccucccucca

SEQ ID NO: 2910046 - RNA, 14 nt, Human
gcuguccugaucug

SEQ ID NO: 2910047 - RNA, 18 nt, Human
gcuguccuugaaugccau

SEQ ID NO: 2910048 - RNA, 15 nt, Human
gcuguucuacuuuuu

SEQ ID NO: 2910049 - RNA, 14 nt, Human
gcuguucuagcacu

SEQ ID NO: 2910050 - RNA, 13 nt, Human
gcuguucugcacu

SEQ ID NO: 2910051 - RNA, 14 nt, Human
gcuguucugcacug

SEQ ID NO: 2910052 - RNA, 15 nt, Human
gcuguucugcacuga

SEQ ID NO: 2910053 - RNA, 16 nt, Human
gcuguucugcacugaa

SEQ ID NO: 2910054 - RNA, 17 nt, Human
gcuguucugcacugaaa

SEQ ID NO: 2910055 - RNA, 22 nt, Human
gcuguucccauguagcccccug

SEQ ID NO: 2910056 - RNA, 12 nt, Human
gcuguucuucug

SEQ ID NO: 2910057 - RNA, 20 nt, Human
gcuguucuucuguucugcag

SEQ ID NO: 2910058 - RNA, 20 nt, Human
gcugugggcgugagaccugc

SEQ ID NO: 2910059 - RNA, 22 nt, Human
gcugugggcgugagaccugccc

SEQ ID NO: 2910060 - RNA, 21 nt, Human
gcugugggcgugagaccugcc

SEQ ID NO: 2910061 - RNA, 14 nt, Human
gcuguugacauauu

SEQ ID NO: 2910062 - RNA, 17 nt, Human
gcuguugacauauuuaa

SEQ ID NO: 2910063 - RNA, 19 nt, Human
gcuguugacauauuuaaug

SEQ ID NO: 2910064 - RNA, 23 nt, Human
gcuguugacauauuuaauguuuu

SEQ ID NO: 2910065 - RNA, 13 nt, Human
gcuguugaaagca

SEQ ID NO: 2910066 - RNA, 14 nt, Human
gcuguugaaagcaa

SEQ ID NO: 2910067 - RNA, 19 nt, Human
gcuguugaaagcaaaaaug

SEQ ID NO: 2910068 - RNA, 20 nt, Human
gcuguugaaagcaaaaaugc

SEQ ID NO: 2910069 - RNA, 16 nt, Human
gcuuagagaauguucu

SEQ ID NO: 2910070 - RNA, 18 nt, Human
gcuuagagaauguucucc

SEQ ID NO: 2910071 - RNA, 12 nt, Human
gcuuagagcagu

SEQ ID NO: 2910072 - RNA, 18 nt, Human
gcuuagcuuugcucugcc

SEQ ID NO: 2910073 - RNA, 17 nt, Human
gcuuagcuuugcucugc

SEQ ID NO: 2910074 - RNA, 19 nt, Human
gcuuagcuuugcucugcca

SEQ ID NO: 2910075 - RNA, 15 nt, Human
gcuuaguaaaauuua

SEQ ID NO: 2910076 - RNA, 16 nt, Human
gcuuaguaaaauuuau

SEQ ID NO: 2910077 - RNA, 19 nt, Human
gcuuaguaaaauuuauuuc

SEQ ID NO: 2910078 - RNA, 14 nt, Human
gcuuaguaucucau

SEQ ID NO: 2910079 - RNA, 22 nt, Human
gcuuaguaucucaucaacaaag

SEQ ID NO: 2910080 - RNA, 23 nt, Human
gcuuaguaucucaucaacaaaga

SEQ ID NO: 2910081 - RNA, 18 nt, Human
gcuucucauccugcaggc

SEQ ID NO: 2910082 - RNA, 22 nt, Human
gcuucucauccugcaggcagcu

SEQ ID NO: 2910083 - RNA, 16 nt, Human
gcuucucaucuuguga

SEQ ID NO: 2910084 - RNA, 18 nt, Human
gcuucucaucuugugaaa

SEQ ID NO: 2910085 - RNA, 17 nt, Human
gcuucauuuccuguguc

SEQ ID NO: 2910086 - RNA, 10 nt, Human
gcuucauugu

SEQ ID NO: 2910087 - RNA, 11 nt, Human
gcuucauugua

SEQ ID NO: 2910088 - RNA, 16 nt, Human
gcuugaggguugggcu

SEQ ID NO: 2910089 - RNA, 13 nt, Human
gcuucuccccaga

SEQ ID NO: 2910090 - RNA, 14 nt, Human
gcuucuccccagaa

SEQ ID NO: 2910091 - RNA, 15 nt, Human
gcuucuccccagaau

SEQ ID NO: 2910092 - RNA, 17 nt, Human
gcuucugaaugugcuga

SEQ ID NO: 2910093 - RNA, 16 nt, Human
gcuucauuuccugugu

SEQ ID NO: 2910094 - RNA, 13 nt, Human
gcuucauuuccug

SEQ ID NO: 2910095 - RNA, 18 nt, Human
gcuucaguggcagcugcu

SEQ ID NO: 2910096 - RNA, 17 nt, Human
gcuucaguggcagcugc

SEQ ID NO: 2910097 - RNA, 17 nt, Human
gcuucaucauucccucu

SEQ ID NO: 2910098 - RNA, 19 nt, Human
gcuucaucauucccucuca

SEQ ID NO: 2910099 - RNA, 16 nt, Human
gcuucaguggcagcug

SEQ ID NO: 2910100 - RNA, 17 nt, Human
gcuuauaauaaaggacu

SEQ ID NO: 2910101 - RNA, 17 nt, Human
gcuuaugaauauauuua

SEQ ID NO: 2910102 - RNA, 15 nt, Human
gcuuaucucuuuuau

SEQ ID NO: 2910103 - RNA, 21 nt, Human
gcuuaucucuuuuauauuugu

SEQ ID NO: 2910104 - RNA, 22 nt, Human
gcuuaucucuuuuauauuugua

SEQ ID NO: 2910105 - RNA, 23 nt, Human
gcuuaugacaucacuuguacaaa

SEQ ID NO: 2910106 - RNA, 22 nt, Human
gcuuaugacaucacuuguacaa

SEQ ID NO: 2910107 - RNA, 18 nt, Human
gcuuaugacaucacuugu

SEQ ID NO: 2910108 - RNA, 12 nt, Human
gccucccacugg

SEQ ID NO: 2910109 - RNA, 17 nt, Human
gccucccacccccaucu

SEQ ID NO: 2910110 - RNA, 21 nt, Human
gccucccgaauagcugggacu

SEQ ID NO: 2910111 - RNA, 13 nt, Human
gccucccacagac

SEQ ID NO: 2910112 - RNA, 20 nt, Human
gccucccaaggagaacaaau

SEQ ID NO: 2910113 - RNA, 21 nt, Human
gccucccaaggagaacaaaua

SEQ ID NO: 2910114 - RNA, 12 nt, Human
gccucccacccc

SEQ ID NO: 2910115 - RNA, 13 nt, Human
gccucauauuuaa

SEQ ID NO: 2910116 - RNA, 15 nt, Human
gccucauauuuaaag

SEQ ID NO: 2910117 - RNA, 22 nt, Human
gccucauauuuaaagacaggga

SEQ ID NO: 2910118 - RNA, 15 nt, Human
gccucagugccacua

SEQ ID NO: 2910119 - RNA, 24 nt, Human
gccucaguccuccccucacagccu

SEQ ID NO: 2910120 - RNA, 17 nt, Human
gccucggccucccaaag

SEQ ID NO: 2910121 - RNA, 20 nt, Human
gccucggcuuuucucagcug

SEQ ID NO: 2910122 - RNA, 19 nt, Human
gccucggcuuuucucagcu

SEQ ID NO: 2910123 - RNA, 21 nt, Human
gccucgggacaccugcccugc

SEQ ID NO: 2910124 - RNA, 18 nt, Human
gccucggcuuuucucagc

SEQ ID NO: 2910125 - RNA, 15 nt, Human
gccucccgaguagcu

SEQ ID NO: 2910126 - RNA, 23 nt, Human
gccucccgaauagcugggacuac

SEQ ID NO: 2910127 - RNA, 21 nt, Human
gccucggacuuagcugggaga

SEQ ID NO: 2910128 - RNA, 20 nt, Human
gccucggacuuagcugggag

SEQ ID NO: 2910129 - RNA, 20 nt, Human
gccucuccuuguggccuggg

SEQ ID NO: 2910130 - RNA, 21 nt, Human
gccucuccuuguggccugggc

SEQ ID NO: 2910131 - RNA, 22 nt, Human
gccucuccuuguggccugggcc

SEQ ID NO: 2910132 - RNA, 21 nt, Human
gccucuauccuacaaggccua

SEQ ID NO: 2910133 - RNA, 13 nt, Human
gccucucacacac

SEQ ID NO: 2910134 - RNA, 15 nt, Human
gccucucacacacau

SEQ ID NO: 2910135 - RNA, 23 nt, Human
gccucucaccucugugccucugu

SEQ ID NO: 2910136 - RNA, 20 nt, Human
gccucguuggaagaggaaca

SEQ ID NO: 2910137 - RNA, 22 nt, Human
gccucgggacaccugcccugcc

SEQ ID NO: 2910138 - RNA, 13 nt, Human
gccucgggaccuc

SEQ ID NO: 2910139 - RNA, 15 nt, Human
gccuaauaaacaauu

SEQ ID NO: 2910140 - RNA, 19 nt, Human
gccuauaugagaagaauag

SEQ ID NO: 2910141 - RNA, 18 nt, Human
gccuaaguauuaaaacau

SEQ ID NO: 2910142 - RNA, 14 nt, Human
gccuaaguauuaaa

SEQ ID NO: 2910143 - RNA, 14 nt, Human
gccuaaggcugaac

SEQ ID NO: 2910144 - RNA, 12 nt, Human
gccuaaguauua

SEQ ID NO: 2910145 - RNA, 16 nt, Human
gccuaaggcugaacuu

SEQ ID NO: 2910146 - RNA, 15 nt, Human
gccgaggacuuugau

SEQ ID NO: 2910147 - RNA, 16 nt, Human
gccgaggagccaggca

SEQ ID NO: 2910148 - RNA, 18 nt, Human
gccgaggagccaggcaac

SEQ ID NO: 2910149 - RNA, 18 nt, Human
gccgaggaggugccugga

SEQ ID NO: 2910150 - RNA, 21 nt, Human
gccucaagugauucuccugcc

SEQ ID NO: 2910151 - RNA, 20 nt, Human
gccucaagugauucuccugc

SEQ ID NO: 2910152 - RNA, 19 nt, Human
gccucaagugauucuccug

SEQ ID NO: 2910153 - RNA, 16 nt, Human
gccucaaccuccuggg

SEQ ID NO: 2910154 - RNA, 14 nt, Human
gccucaaccuccug

SEQ ID NO: 2910155 - RNA, 14 nt, Human
gccuauccuggcca

SEQ ID NO: 2910156 - RNA, 21 nt, Human
gccuaucuccuagggcuaugg

SEQ ID NO: 2910157 - RNA, 16 nt, Human
gccuaugagcauccug

SEQ ID NO: 2910158 - RNA, 20 nt, Human
gccuaugagcauccugagcc

SEQ ID NO: 2910159 - RNA, 20 nt, Human
gccucacuucuaggguaugg

SEQ ID NO: 2910160 - RNA, 19 nt, Human
gccucacuuggucugccag

SEQ ID NO: 2910161 - RNA, 20 nt, Human
gccucacuuggucugccagg

SEQ ID NO: 2910162 - RNA, 22 nt, Human
gccucacuuggucugccaggcc

SEQ ID NO: 2910163 - RNA, 22 nt, Human
gccucacugauauauuuuccag

SEQ ID NO: 2910164 - RNA, 14 nt, Human
gccucacccuugcg

SEQ ID NO: 2910165 - RNA, 17 nt, Human
gccucaccgcuucccuc

SEQ ID NO: 2910166 - RNA, 20 nt, Human
gccucaccgcuucccuccug

SEQ ID NO: 2910167 - RNA, 16 nt, Human
gccucaccucuaccca

SEQ ID NO: 2910168 - RNA, 17 nt, Human
gccucaccucuacccaa

SEQ ID NO: 2910169 - RNA, 18 nt, Human
gccucaccucuacccaaa

SEQ ID NO: 2910170 - RNA, 23 nt, Human
gccucagccucccaaagugcugg

SEQ ID NO: 2910171 - RNA, 16 nt, Human
gccucagccucccaag

SEQ ID NO: 2910172 - RNA, 20 nt, Human
gccucagcuacccacuaucc

SEQ ID NO: 2910173 - RNA, 23 nt, Human
gccucagcuacccacuauccuuc

SEQ ID NO: 2910174 - RNA, 15 nt, Human
gccucagccucccga

SEQ ID NO: 2910175 - RNA, 16 nt, Human
gccucagccucccgag

SEQ ID NO: 2910176 - RNA, 18 nt, Human
gccucagccuccugagua

SEQ ID NO: 2910177 - RNA, 16 nt, Human
gccucagccuccugag

SEQ ID NO: 2910178 - RNA, 14 nt, Human
gccucagccucccg

SEQ ID NO: 2910179 - RNA, 14 nt, Human
gccucagugccacu

SEQ ID NO: 2910180 - RNA, 12 nt, Human
gccucagugcca

SEQ ID NO: 2910181 - RNA, 18 nt, Human
gccucagucucccucccu

SEQ ID NO: 2910182 - RNA, 15 nt, Human
gccucagucucccuc

SEQ ID NO: 2910183 - RNA, 15 nt, Human
gccucaguauauuua

SEQ ID NO: 2910184 - RNA, 16 nt, Human
gccucaguauauuuaa

SEQ ID NO: 2910185 - RNA, 21 nt, Human
gccucaguauauuuaaacuca

SEQ ID NO: 2910186 - RNA, 20 nt, Human
gccucaguaagacgacaagg

SEQ ID NO: 2910187 - RNA, 15 nt, Human
gccucaguccucccc

SEQ ID NO: 2910188 - RNA, 16 nt, Human
gccucaguccuccccu

SEQ ID NO: 2910189 - RNA, 18 nt, Human
gccucaguccuccccuca

SEQ ID NO: 2910190 - RNA, 22 nt, Human
gccucaguccuccccucacagc

SEQ ID NO: 2910191 - RNA, 23 nt, Human
gccucaguccuccccucacagcc

SEQ ID NO: 2910192 - RNA, 15 nt, Human
gccucagcugccuca

SEQ ID NO: 2910193 - RNA, 14 nt, Human
gccucagcugccuc

SEQ ID NO: 2910194 - RNA, 19 nt, Human
gccucagcugccucacuuc

SEQ ID NO: 2910195 - RNA, 16 nt, Human
gccucagcugccucac

SEQ ID NO: 2910196 - RNA, 20 nt, Human
gccucagcugccucacuucc

SEQ ID NO: 2910197 - RNA, 19 nt, Human
gccucagcugaaugccucc

SEQ ID NO: 2910198 - RNA, 12 nt, Human
gccucaggcugc

SEQ ID NO: 2910199 - RNA, 11 nt, Human
gccugcacaca

SEQ ID NO: 2910200 - RNA, 13 nt, Human
gccugcacacaag

SEQ ID NO: 2910201 - RNA, 17 nt, Human
gccugcaaacgcugccu

SEQ ID NO: 2910202 - RNA, 16 nt, Human
gccugcaaacgcugcc

SEQ ID NO: 2910203 - RNA, 20 nt, Human
gccugauugccaagcucagg

SEQ ID NO: 2910204 - RNA, 21 nt, Human
gccugauugccaagcucagga

SEQ ID NO: 2910205 - RNA, 19 nt, Human
gccugauugccaagcucag

SEQ ID NO: 2910206 - RNA, 20 nt, Human
gccugaugcucccuccccug

SEQ ID NO: 2910207 - RNA, 13 nt, Human
gccugauggaccu

SEQ ID NO: 2910208 - RNA, 14 nt, Human
gccugauggaccug

SEQ ID NO: 2910209 - RNA, 17 nt, Human
gccugcacuccucaggg

SEQ ID NO: 2910210 - RNA, 13 nt, Human
gccugcuucccac

SEQ ID NO: 2910211 - RNA, 21 nt, Human
gccugcuucccaccucccugc

SEQ ID NO: 2910212 - RNA, 22 nt, Human
gccugcuucccaccucccugcc

SEQ ID NO: 2910213 - RNA, 23 nt, Human
gccugcuucccaccucccugccc

SEQ ID NO: 2910214 - RNA, 22 nt, Human
gccugcuggucacagccuccuc

SEQ ID NO: 2910215 - RNA, 18 nt, Human
gccucugccucugacaca

SEQ ID NO: 2910216 - RNA, 12 nt, Human
gccucugccugu

SEQ ID NO: 2910217 - RNA, 22 nt, Human
gccugaagucacacagugaguc

SEQ ID NO: 2910218 - RNA, 19 nt, Human
gccucugcugauccuccca

SEQ ID NO: 2910219 - RNA, 18 nt, Human
gccucucgguugaaaccu

SEQ ID NO: 2910220 - RNA, 15 nt, Human
gccucugccuuagag

SEQ ID NO: 2910221 - RNA, 18 nt, Human
gccucugccuuagaggag

SEQ ID NO: 2910222 - RNA, 19 nt, Human
gccucugccuuagaggagc

SEQ ID NO: 2910223 - RNA, 13 nt, Human
gccucugccuguc

SEQ ID NO: 2910224 - RNA, 18 nt, Human
gccucugcugauccuccc

SEQ ID NO: 2910225 - RNA, 19 nt, Human
gccugaugcucccuccccu

SEQ ID NO: 2910226 - RNA, 17 nt, Human
gccugaugcucccuccc

SEQ ID NO: 2910227 - RNA, 16 nt, Human
gccugaugcucccucc

SEQ ID NO: 2910228 - RNA, 14 nt, Human
gccugaugcucccu

SEQ ID NO: 2910229 - RNA, 16 nt, Human
gccugauccuccaaca

SEQ ID NO: 2910230 - RNA, 14 nt, Human
gccugaucucuucc

SEQ ID NO: 2910231 - RNA, 15 nt, Human
gccugaucucuuccu

SEQ ID NO: 2910232 - RNA, 16 nt, Human
gccugaucucuuccug

SEQ ID NO: 2910233 - RNA, 17 nt, Human
gccugaucucuuccugu

SEQ ID NO: 2910234 - RNA, 15 nt, Human
gccugagugccuggc

SEQ ID NO: 2910235 - RNA, 12 nt, Human
gccugagucagg

SEQ ID NO: 2910236 - RNA, 18 nt, Human
gccugagucagggcccag

SEQ ID NO: 2910237 - RNA, 19 nt, Human
gccugagucagggcccaga

SEQ ID NO: 2910238 - RNA, 20 nt, Human
gccugagucagggcccagag

SEQ ID NO: 2910239 - RNA, 22 nt, Human
gccugagucagggcccagaggc

SEQ ID NO: 2910240 - RNA, 23 nt, Human
gccugaguccacgaccuaggcag

SEQ ID NO: 2910241 - RNA, 23 nt, Human
gccugacccuacuucuuuugcuc

SEQ ID NO: 2910242 - RNA, 13 nt, Human
gccugacagaaac

SEQ ID NO: 2910243 - RNA, 15 nt, Human
gccugacagaaacca

SEQ ID NO: 2910244 - RNA, 22 nt, Human
gccugaaugcuuauagguggcc

SEQ ID NO: 2910245 - RNA, 19 nt, Human
gccuggcagggaggucagg

SEQ ID NO: 2910246 - RNA, 20 nt, Human
gccuggcagggaggucaggc

SEQ ID NO: 2910247 - RNA, 23 nt, Human
gccuggcagggaggucaggcccu

SEQ ID NO: 2910248 - RNA, 21 nt, Human
gccuggauauuauucuuguag

SEQ ID NO: 2910249 - RNA, 22 nt, Human
gccuggauacaguauaaaaaua

SEQ ID NO: 2910250 - RNA, 14 nt, Human
gccuggccaccucu

SEQ ID NO: 2910251 - RNA, 20 nt, Human
gccuggcauucuuguacagu

SEQ ID NO: 2910252 - RNA, 22 nt, Human
gccuggcauucuuguacagugu

SEQ ID NO: 2910253 - RNA, 15 nt, Human
gccuggccaaaggga

SEQ ID NO: 2910254 - RNA, 20 nt, Human
gccuggccaacauggcgaaa

SEQ ID NO: 2910255 - RNA, 16 nt, Human
gccuggccaccucucu

SEQ ID NO: 2910256 - RNA, 17 nt, Human
gccuggccaccucucuc

SEQ ID NO: 2910257 - RNA, 18 nt, Human
gccuggccaccucucucc

SEQ ID NO: 2910258 - RNA, 19 nt, Human
gccuggccaccucucuccu

SEQ ID NO: 2910259 - RNA, 13 nt, Human
gccuggccacgcc

SEQ ID NO: 2910260 - RNA, 15 nt, Human
gccuggccagaugca

SEQ ID NO: 2910261 - RNA, 14 nt, Human
gccuggccagaugc

SEQ ID NO: 2910262 - RNA, 17 nt, Human
gccuggccaggcagauc

SEQ ID NO: 2910263 - RNA, 15 nt, Human
gccuggccaggcaga

SEQ ID NO: 2910264 - RNA, 23 nt, Human
gccuggccaggcagaucugugcc

SEQ ID NO: 2910265 - RNA, 17 nt, Human
gccuggccagggccugg

SEQ ID NO: 2910266 - RNA, 14 nt, Human
gccuggccaggagc

SEQ ID NO: 2910267 - RNA, 15 nt, Human
gccuggccaggagcu

SEQ ID NO: 2910268 - RNA, 21 nt, Human
gccuggccagccuacaauggg

SEQ ID NO: 2910269 - RNA, 16 nt, Human
gccuggccagccuaca

SEQ ID NO: 2910270 - RNA, 19 nt, Human
gccuggccaggagcucuuc

SEQ ID NO: 2910271 - RNA, 14 nt, Human
gccuggccaggcag

SEQ ID NO: 2910272 - RNA, 19 nt, Human
gccugggggaguuuuccuc

SEQ ID NO: 2910273 - RNA, 21 nt, Human
gccugggggaguuuuccucua

SEQ ID NO: 2910274 - RNA, 23 nt, Human
gccugggugacaaagugagacuc

SEQ ID NO: 2910275 - RNA, 20 nt, Human
gccugggugacaaagcgaga

SEQ ID NO: 2910276 - RNA, 15 nt, Human
gccuggguggacaug

SEQ ID NO: 2910277 - RNA, 19 nt, Human
gccuggguggaucggccuc

SEQ ID NO: 2910278 - RNA, 23 nt, Human
gccuggguggaucggccuccucu

SEQ ID NO: 2910279 - RNA, 19 nt, Human
gccuguagaauagccugug

SEQ ID NO: 2910280 - RNA, 20 nt, Human
gccuguagaauagccugugg

SEQ ID NO: 2910281 - RNA, 22 nt, Human
gccuguagaauagccuguggcc

SEQ ID NO: 2910282 - RNA, 23 nt, Human
gccuguaguuaggaaauaaaacc

SEQ ID NO: 2910283 - RNA, 13 nt, Human
gccuguauacuuu

SEQ ID NO: 2910284 - RNA, 15 nt, Human
gccuguauacuuuag

SEQ ID NO: 2910285 - RNA, 17 nt, Human
gccuguauacuuuagua

SEQ ID NO: 2910286 - RNA, 18 nt, Human
gccuguauacuuuaguau

SEQ ID NO: 2910287 - RNA, 19 nt, Human
gccuguauacuuuaguaug

SEQ ID NO: 2910288 - RNA, 22 nt, Human
gccuguaguuaggaaauaaaac

SEQ ID NO: 2910289 - RNA, 19 nt, Human
gccuguaguuaggaaauaa

SEQ ID NO: 2910290 - RNA, 18 nt, Human
gccuguaguuaggaaaua

SEQ ID NO: 2910291 - RNA, 17 nt, Human
gccuguaguuaggaaau

SEQ ID NO: 2910292 - RNA, 16 nt, Human
gccuguaguuaggaaa

SEQ ID NO: 2910293 - RNA, 14 nt, Human
gccuguaguuagga

SEQ ID NO: 2910294 - RNA, 13 nt, Human
gccuguagcccac

SEQ ID NO: 2910295 - RNA, 14 nt, Human
gccuguagcaguga

SEQ ID NO: 2910296 - RNA, 22 nt, Human
gccuguagcccacucugcucgc

SEQ ID NO: 2910297 - RNA, 19 nt, Human
gccuguagcccacucugcu

SEQ ID NO: 2910298 - RNA, 17 nt, Human
gcccucucccucuaggc

SEQ ID NO: 2910299 - RNA, 21 nt, Human
gcccucucccucuaggcucug

SEQ ID NO: 2910300 - RNA, 22 nt, Human
gcccucucccucuaggcucugc

SEQ ID NO: 2910301 - RNA, 24 nt, Human
gcccucucccucuaggcucugccu

SEQ ID NO: 2910302 - RNA, 17 nt, Human
gcccucucccuuacccu

SEQ ID NO: 2910303 - RNA, 21 nt, Human
gcccucucccuuacccuggga

SEQ ID NO: 2910304 - RNA, 22 nt, Human
gcccucucccuuacccugggaa

SEQ ID NO: 2910305 - RNA, 16 nt, Human
gcccucuccuuccuua

SEQ ID NO: 2910306 - RNA, 16 nt, Human
gcccugaggaaggagg

SEQ ID NO: 2910307 - RNA, 22 nt, Human
gcccugaggaaggaggggaagc

SEQ ID NO: 2910308 - RNA, 18 nt, Human
gcccggcuccaggcuccu

SEQ ID NO: 2910309 - RNA, 17 nt, Human
gcccggcuccaggcucc

SEQ ID NO: 2910310 - RNA, 15 nt, Human
gcccucgcugcuucu

SEQ ID NO: 2910311 - RNA, 16 nt, Human
gcccucgcugcuucug

SEQ ID NO: 2910312 - RNA, 17 nt, Human
gcccuccuuguccaccc

SEQ ID NO: 2910313 - RNA, 19 nt, Human
gcccuccuuguccacccac

SEQ ID NO: 2910314 - RNA, 13 nt, Human
gcccuccuuucug

SEQ ID NO: 2910315 - RNA, 17 nt, Human
gcccuccuuucugugcc

SEQ ID NO: 2910316 - RNA, 18 nt, Human
gcccuccuuucugugccc

SEQ ID NO: 2910317 - RNA, 20 nt, Human
gcccuccuuucugugcccua

SEQ ID NO: 2910318 - RNA, 13 nt, Human
gcccucgacacuc

SEQ ID NO: 2910319 - RNA, 23 nt, Human
gcccucgacacucaccaugaagc

SEQ ID NO: 2910320 - RNA, 21 nt, Human
gcccucgcacggccccgaagg

SEQ ID NO: 2910321 - RNA, 11 nt, Human
gcccucucccc

SEQ ID NO: 2910322 - RNA, 15 nt, Human
gcccucuccccaccc

SEQ ID NO: 2910323 - RNA, 20 nt, Human
gcccucuccccaccccuacc

SEQ ID NO: 2910324 - RNA, 22 nt, Human
gcccucuccccaccccuacccc

SEQ ID NO: 2910325 - RNA, 23 nt, Human
gcccucuccccaccccuaccccu

SEQ ID NO: 2910326 - RNA, 22 nt, Human
gcccugaggugaaagggagcua

SEQ ID NO: 2910327 - RNA, 21 nt, Human
gcccugaggugaaagggagcu

SEQ ID NO: 2910328 - RNA, 22 nt, Human
gcccugauguguccucagggag

SEQ ID NO: 2910329 - RNA, 20 nt, Human
gcccugcuuugggcugcccu

SEQ ID NO: 2910330 - RNA, 21 nt, Human
gcccugcuuugggcugcccug

SEQ ID NO: 2910331 - RNA, 19 nt, Human
gcccugcuuugggcugccc

SEQ ID NO: 2910332 - RNA, 23 nt, Human
gcccugcaauguaucccuucuca

SEQ ID NO: 2910333 - RNA, 20 nt, Human
gcccuggaacauccuuugca

SEQ ID NO: 2910334 - RNA, 21 nt, Human
gcccuggaacucuaucugggc

SEQ ID NO: 2910335 - RNA, 22 nt, Human
gcccugcuuugggcugcccugg

SEQ ID NO: 2910336 - RNA, 23 nt, Human
gcccugcuuugggcugcccuggu

SEQ ID NO: 2910337 - RNA, 15 nt, Human
gcagacucuacagag

SEQ ID NO: 2910338 - RNA, 15 nt, Human
gcagacuacacagga

SEQ ID NO: 2910339 - RNA, 16 nt, Human
gcagacuacacaggau

SEQ ID NO: 2910340 - RNA, 14 nt, Human
gcagacgccgggga

SEQ ID NO: 2910341 - RNA, 17 nt, Human
gcagacaggaggaauca

SEQ ID NO: 2910342 - RNA, 22 nt, Human
gcagaccuccccagccccuagc

SEQ ID NO: 2910343 - RNA, 23 nt, Human
gcagaccuccccagccccuagcc

SEQ ID NO: 2910344 - RNA, 12 nt, Human
gcagaccucugg

SEQ ID NO: 2910345 - RNA, 19 nt, Human
gccccuccucucugcccua

SEQ ID NO: 2910346 - RNA, 12 nt, Human
gccccucccuuc

SEQ ID NO: 2910347 - RNA, 14 nt, Human
gccccucccuucaa

SEQ ID NO: 2910348 - RNA, 15 nt, Human
gccccucccuucaac

SEQ ID NO: 2910349 - RNA, 18 nt, Human
gccccuccucucugcccu

SEQ ID NO: 2910350 - RNA, 15 nt, Human
gccccugccacccug

SEQ ID NO: 2910351 - RNA, 14 nt, Human
gccccugccacccu

SEQ ID NO: 2910352 - RNA, 13 nt, Human
gccccugccaccc

SEQ ID NO: 2910353 - RNA, 12 nt, Human
gccccucucugg

SEQ ID NO: 2910354 - RNA, 14 nt, Human
gccccucucugggc

SEQ ID NO: 2910355 - RNA, 15 nt, Human
gccccucucugggcc

SEQ ID NO: 2910356 - RNA, 17 nt, Human
gccccucuccuucuuag

SEQ ID NO: 2910357 - RNA, 14 nt, Human
gccccucucaccaa

SEQ ID NO: 2910358 - RNA, 15 nt, Human
gccccucgccugugg

SEQ ID NO: 2910359 - RNA, 23 nt, Human
gccccucgccuguggagcucagc

SEQ ID NO: 2910360 - RNA, 15 nt, Human
gccccucucaccaaa

SEQ ID NO: 2910361 - RNA, 21 nt, Human
gccccucucccgccagacugu

SEQ ID NO: 2910362 - RNA, 16 nt, Human
gcccggcuccaggcuc

SEQ ID NO: 2910363 - RNA, 18 nt, Human
gcccggcuaauuuuugua

SEQ ID NO: 2910364 - RNA, 20 nt, Human
gcccggccgcuccaccagca

SEQ ID NO: 2910365 - RNA, 17 nt, Human
gcccggcgccccugcca

SEQ ID NO: 2910366 - RNA, 15 nt, Human
gcccggcgccuggcc

SEQ ID NO: 2910367 - RNA, 18 nt, Human
gcccggcgccuggccucc

SEQ ID NO: 2910368 - RNA, 20 nt, Human
gcccggcgccuggccuccag

SEQ ID NO: 2910369 - RNA, 21 nt, Human
gcccggcgccuggccuccagg

SEQ ID NO: 2910370 - RNA, 22 nt, Human
gcccggcgccuggccuccaggc

SEQ ID NO: 2910371 - RNA, 23 nt, Human
gcccggcgccuggccuccaggcc

SEQ ID NO: 2910372 - RNA, 22 nt, Human
gcccggagauuggacggccuga

SEQ ID NO: 2910373 - RNA, 19 nt, Human
gcccggagcugccccucuc

SEQ ID NO: 2910374 - RNA, 23 nt, Human
gcccggagcugccccucucuggg

SEQ ID NO: 2910375 - RNA, 15 nt, Human
gcccggaugcugcuu

SEQ ID NO: 2910376 - RNA, 16 nt, Human
gcccggaugcugcuuc

SEQ ID NO: 2910377 - RNA, 16 nt, Human
gcccggauucugggag

SEQ ID NO: 2910378 - RNA, 15 nt, Human
gcccggauucuggga

SEQ ID NO: 2910379 - RNA, 17 nt, Human
gcccggauucugggagg

SEQ ID NO: 2910380 - RNA, 14 nt, Human
gcccgccugcccac

SEQ ID NO: 2910381 - RNA, 15 nt, Human
gcccgccugcccacc

SEQ ID NO: 2910382 - RNA, 16 nt, Human
gcccgccugcccaccu

SEQ ID NO: 2910383 - RNA, 18 nt, Human
gcccgccugcccaccugc

SEQ ID NO: 2910384 - RNA, 22 nt, Human
gcccgccugcccaccugccugg

SEQ ID NO: 2910385 - RNA, 23 nt, Human
gcccgccugcccaccugccuggc

SEQ ID NO: 2910386 - RNA, 14 nt, Human
gcccgccccugcag

SEQ ID NO: 2910387 - RNA, 15 nt, Human
gcccgccccugcagc

SEQ ID NO: 2910388 - RNA, 16 nt, Human
gcccgccccugcagca

SEQ ID NO: 2910389 - RNA, 15 nt, Human
gcccgccacacagac

SEQ ID NO: 2910390 - RNA, 21 nt, Human
gccccuucauugauuuccugu

SEQ ID NO: 2910391 - RNA, 22 nt, Human
gccccuucauugauuuccugug

SEQ ID NO: 2910392 - RNA, 23 nt, Human
gccccuucauugauuuccugugu

SEQ ID NO: 2910393 - RNA, 19 nt, Human
gccccuucccacucacccc

SEQ ID NO: 2910394 - RNA, 23 nt, Human
gccccugcauccccuuggcugug

SEQ ID NO: 2910395 - RNA, 14 nt, Human
gccccugcaucccc

SEQ ID NO: 2910396 - RNA, 20 nt, Human
gccccugcauccccuuggcu

SEQ ID NO: 2910397 - RNA, 15 nt, Human
gccccuuaggccagu

SEQ ID NO: 2910398 - RNA, 12 nt, Human
gccccuuccccc

SEQ ID NO: 2910399 - RNA, 16 nt, Human
gcccgacagccuggca

SEQ ID NO: 2910400 - RNA, 17 nt, Human
gcccgacagccuggcac

SEQ ID NO: 2910401 - RNA, 19 nt, Human
gcccgacagccuggcacag

SEQ ID NO: 2910402 - RNA, 23 nt, Human
gcccugguggcagugggagcugc

SEQ ID NO: 2910403 - RNA, 22 nt, Human
gcccugguggcagugggagcug

SEQ ID NO: 2910404 - RNA, 21 nt, Human
gcccugguggcagugggagcu

SEQ ID NO: 2910405 - RNA, 20 nt, Human
gcccugguggcagugggagc

SEQ ID NO: 2910406 - RNA, 19 nt, Human
gcccugguggcagugggag

SEQ ID NO: 2910407 - RNA, 18 nt, Human
gcccugguggcaguggga

SEQ ID NO: 2910408 - RNA, 17 nt, Human
gcccugguggcaguggg

SEQ ID NO: 2910409 - RNA, 14 nt, Human
gcccugguggcagu

SEQ ID NO: 2910410 - RNA, 23 nt, Human
gcccugguuuccugcccugggag

SEQ ID NO: 2910411 - RNA, 21 nt, Human
gcccugguuuccugcccuggg

SEQ ID NO: 2910412 - RNA, 20 nt, Human
gcccugguuuccugcccugg

SEQ ID NO: 2910413 - RNA, 19 nt, Human
gcccugguuuccugcccug

SEQ ID NO: 2910414 - RNA, 18 nt, Human
gcccugguuuccugcccu

SEQ ID NO: 2910415 - RNA, 17 nt, Human
gcccugguuuccugccc

SEQ ID NO: 2910416 - RNA, 22 nt, Human
gcccugguuucacuggcccaag

SEQ ID NO: 2910417 - RNA, 20 nt, Human
gcccugguuucacuggccca

SEQ ID NO: 2910418 - RNA, 18 nt, Human
gcccugguuucacuggcc

SEQ ID NO: 2910419 - RNA, 16 nt, Human
gcccugguuucacugg

SEQ ID NO: 2910420 - RNA, 15 nt, Human
gcccugguuuccugc

SEQ ID NO: 2910421 - RNA, 14 nt, Human
gcccugguuuccug

SEQ ID NO: 2910422 - RNA, 21 nt, Human
gcccuggugcgaauggacuuu

SEQ ID NO: 2910423 - RNA, 16 nt, Human
gccgagaucacgccac

SEQ ID NO: 2910424 - RNA, 12 nt, Human
gcccuuucugug

SEQ ID NO: 2910425 - RNA, 20 nt, Human
gcccuuugcaucguccccuc

SEQ ID NO: 2910426 - RNA, 13 nt, Human
gcccuuucugugu

SEQ ID NO: 2910427 - RNA, 16 nt, Human
gcccuuugaagccuca

SEQ ID NO: 2910428 - RNA, 17 nt, Human
gcccuuugaagccucag

SEQ ID NO: 2910429 - RNA, 18 nt, Human
gcccuuugaagccucagc

SEQ ID NO: 2910430 - RNA, 19 nt, Human
gcccuuugaagccucagcu

SEQ ID NO: 2910431 - RNA, 22 nt, Human
gcccuuucuguaccauuuauuu

SEQ ID NO: 2910432 - RNA, 16 nt, Human
gcccuuucuguaccau

SEQ ID NO: 2910433 - RNA, 19 nt, Human
gccgagaucacgccacugc

SEQ ID NO: 2910434 - RNA, 18 nt, Human
gccgagaucacgccacug

SEQ ID NO: 2910435 - RNA, 21 nt, Human
gcccuuccucuccacugccuu

SEQ ID NO: 2910436 - RNA, 17 nt, Human
gcccuuccucuccacug

SEQ ID NO: 2910437 - RNA, 16 nt, Human
gcccuuccucuccacu

SEQ ID NO: 2910438 - RNA, 18 nt, Human
gcccuuccucuccacugc

SEQ ID NO: 2910439 - RNA, 19 nt, Human
gcccuuccucuccacugcc

SEQ ID NO: 2910440 - RNA, 22 nt, Human
gcccuuuccccgacgcccaccc

SEQ ID NO: 2910441 - RNA, 21 nt, Human
gcccuuuccccgacgcccacc

SEQ ID NO: 2910442 - RNA, 20 nt, Human
gcccuuccucuccacugccu

SEQ ID NO: 2910443 - RNA, 23 nt, Human
gcccugggcucggaggcugcccc

SEQ ID NO: 2910444 - RNA, 14 nt, Human
gcccugguccaggg

SEQ ID NO: 2910445 - RNA, 13 nt, Human
gcccugguccagg

SEQ ID NO: 2910446 - RNA, 15 nt, Human
gcccuggggcugggc

SEQ ID NO: 2910447 - RNA, 16 nt, Human
gcccuggggcugggcc

SEQ ID NO: 2910448 - RNA, 18 nt, Human
gcccugguccuuccaggc

SEQ ID NO: 2910449 - RNA, 15 nt, Human
gcccugguccuucca

SEQ ID NO: 2910450 - RNA, 23 nt, Human
gcccugguccagggaagcuggcc

SEQ ID NO: 2910451 - RNA, 20 nt, Human
gcccugguccagggaagcug

SEQ ID NO: 2910452 - RNA, 18 nt, Human
gcccugguccagggaagc

SEQ ID NO: 2910453 - RNA, 17 nt, Human
gcccugguccagggaag

SEQ ID NO: 2910454 - RNA, 16 nt, Human
gcccugguccagggaa

SEQ ID NO: 2910455 - RNA, 15 nt, Human
gcccuggugcugcca

SEQ ID NO: 2910456 - RNA, 16 nt, Human
gcccuggugcugccac

SEQ ID NO: 2910457 - RNA, 17 nt, Human
gcccuggugcugccaca

SEQ ID NO: 2910458 - RNA, 21 nt, Human
gcccuggugcugccacacuuc

SEQ ID NO: 2910459 - RNA, 16 nt, Human
gcccugggaggcagug

SEQ ID NO: 2910460 - RNA, 17 nt, Human
gcccugggccacacuga

SEQ ID NO: 2910461 - RNA, 15 nt, Human
gcccugggcucggag

SEQ ID NO: 2910462 - RNA, 16 nt, Human
gcccugggcucggagg

SEQ ID NO: 2910463 - RNA, 17 nt, Human
gcccugggcucggaggc

SEQ ID NO: 2910464 - RNA, 19 nt, Human
gcccugggcucggaggcug

SEQ ID NO: 2910465 - RNA, 21 nt, Human
gcccugggcucggaggcugcc

SEQ ID NO: 2910466 - RNA, 18 nt, Human
gcccugggaaaccccuuc

SEQ ID NO: 2910467 - RNA, 22 nt, Human
gcccugggaaaccccuucucug

SEQ ID NO: 2910468 - RNA, 23 nt, Human
gcccugggaaaccccuucucugu

SEQ ID NO: 2910469 - RNA, 14 nt, Human
gcccugggaggcag

SEQ ID NO: 2910470 - RNA, 11 nt, Human
gcccugggagg

SEQ ID NO: 2910471 - RNA, 17 nt, Human
gcccuggcagggggcau

SEQ ID NO: 2910472 - RNA, 21 nt, Human
gcccuggcagggucauccugu

SEQ ID NO: 2910473 - RNA, 16 nt, Human
gcccuggcagggggca

SEQ ID NO: 2910474 - RNA, 15 nt, Human
gcccuggcagggggc

SEQ ID NO: 2910475 - RNA, 12 nt, Human
gcccuggcagga

SEQ ID NO: 2910476 - RNA, 19 nt, Human
gcccuggcaggaugacccu

SEQ ID NO: 2910477 - RNA, 12 nt, Human
gcccuggcucug

SEQ ID NO: 2910478 - RNA, 14 nt, Human
gcccuggcucugca

SEQ ID NO: 2910479 - RNA, 17 nt, Human
gcccuggcucugcuguc

SEQ ID NO: 2910480 - RNA, 20 nt, Human
gcccuggcucccacaggccc

SEQ ID NO: 2910481 - RNA, 15 nt, Human
gcccuggcucccaca

SEQ ID NO: 2910482 - RNA, 19 nt, Human
gcccuggcucccacaggcc

SEQ ID NO: 2910483 - RNA, 13 nt, Human
gcuaaauuuucug

SEQ ID NO: 2910484 - RNA, 19 nt, Human
gcuaagcaagcuaaccuua

SEQ ID NO: 2910485 - RNA, 19 nt, Human
gcuaagcuaggaaugaaau

SEQ ID NO: 2910486 - RNA, 15 nt, Human
gcuaagcuaggaaug

SEQ ID NO: 2910487 - RNA, 12 nt, Human
gcuacgccugca

SEQ ID NO: 2910488 - RNA, 15 nt, Human
gcuacuauaaagaga

SEQ ID NO: 2910489 - RNA, 16 nt, Human
gcuacuauaaagagaa

SEQ ID NO: 2910490 - RNA, 18 nt, Human
gcuacuagaauucuguau

SEQ ID NO: 2910491 - RNA, 21 nt, Human
gcuacuaaguucacauuagaa

SEQ ID NO: 2910492 - RNA, 22 nt, Human
gcuacuaaguucacauuagaau

SEQ ID NO: 2910493 - RNA, 14 nt, Human
gcuacgaaucuucc

SEQ ID NO: 2910494 - RNA, 15 nt, Human
gcuacgaaucuuccg

SEQ ID NO: 2910495 - RNA, 16 nt, Human
gcuagaguccucacuc

SEQ ID NO: 2910496 - RNA, 13 nt, Human
gcuagaguccuca

SEQ ID NO: 2910497 - RNA, 14 nt, Human
gcuagcaucccuga

SEQ ID NO: 2910498 - RNA, 14 nt, Human
gcuagcuggagccu

SEQ ID NO: 2910499 - RNA, 15 nt, Human
gcuagcuggagccug

SEQ ID NO: 2910500 - RNA, 20 nt, Human
gcuaucucugugugcacaaa

SEQ ID NO: 2910501 - RNA, 21 nt, Human
gcuaucuggaggccuuccagc

SEQ ID NO: 2910502 - RNA, 16 nt, Human
gcuaucucugugugca

SEQ ID NO: 2910503 - RNA, 13 nt, Human
gcuaucucugugu

SEQ ID NO: 2910504 - RNA, 20 nt, Human
gcuaacaaggcgaaauccug

SEQ ID NO: 2910505 - RNA, 16 nt, Human
gcuaacaccagacaga

SEQ ID NO: 2910506 - RNA, 20 nt, Human
gcuaacacacagcucccaua

SEQ ID NO: 2910507 - RNA, 18 nt, Human
gcuaaaugccuaauaaac

SEQ ID NO: 2910508 - RNA, 19 nt, Human
gcuaaaugccuaauaaaca

SEQ ID NO: 2910509 - RNA, 18 nt, Human
gcuaaauaaucuuacucu

SEQ ID NO: 2910510 - RNA, 23 nt, Human
gcuaaauggucgcccaggagaca

SEQ ID NO: 2910511 - RNA, 19 nt, Human
gcuaaauggucgcccagga

SEQ ID NO: 2910512 - RNA, 23 nt, Human
gcgugagccacugcaccgggcca

SEQ ID NO: 2910513 - RNA, 12 nt, Human
gcgugaaucugu

SEQ ID NO: 2910514 - RNA, 19 nt, Human
gcgugacacucuccuugca

SEQ ID NO: 2910515 - RNA, 21 nt, Human
gcgugacacucuccuugcagu

SEQ ID NO: 2910516 - RNA, 15 nt, Human
gcgugaucaaagcca

SEQ ID NO: 2910517 - RNA, 16 nt, Human
gcgugaggucccagga

SEQ ID NO: 2910518 - RNA, 18 nt, Human
gcgugagccacugcaccg

SEQ ID NO: 2910519 - RNA, 16 nt, Human
gcgugagccacugcac

SEQ ID NO: 2910520 - RNA, 23 nt, Human
gcgugaacccgggaggcggagcu

SEQ ID NO: 2910521 - RNA, 16 nt, Human
gcgguccacccaggag

SEQ ID NO: 2910522 - RNA, 13 nt, Human
gcggggacagcuc

SEQ ID NO: 2910523 - RNA, 12 nt, Human
gcggggacagcu

SEQ ID NO: 2910524 - RNA, 19 nt, Human
gccugugcauguaugucuu

SEQ ID NO: 2910525 - RNA, 15 nt, Human
gccugugcaaugcau

SEQ ID NO: 2910526 - RNA, 13 nt, Human
gccugugcacaca

SEQ ID NO: 2910527 - RNA, 15 nt, Human
gccugugcacacaca

SEQ ID NO: 2910528 - RNA, 23 nt, Human
gccugugcacacacacacacaug

SEQ ID NO: 2910529 - RNA, 17 nt, Human
gccugugaacugaacuc

SEQ ID NO: 2910530 - RNA, 19 nt, Human
gcgguccacccaggagccc

SEQ ID NO: 2910531 - RNA, 18 nt, Human
gcgguccacccaggagcc

SEQ ID NO: 2910532 - RNA, 19 nt, Human
gcgggcggcugggucugug

SEQ ID NO: 2910533 - RNA, 19 nt, Human
gcgggcuuauuuauuaaca

SEQ ID NO: 2910534 - RNA, 20 nt, Human
gcguagcgugcccgugugca

SEQ ID NO: 2910535 - RNA, 21 nt, Human
gcgucaggguuggugugcuga

SEQ ID NO: 2910536 - RNA, 14 nt, Human
gcgucagucuuuuu

SEQ ID NO: 2910537 - RNA, 18 nt, Human
gcgucagucuuuuucugu

SEQ ID NO: 2910538 - RNA, 19 nt, Human
gcgucagucuuuuucuguu

SEQ ID NO: 2910539 - RNA, 23 nt, Human
gcgucagucuuuuucuguuguaa

SEQ ID NO: 2910540 - RNA, 17 nt, Human
gcgucccaagauguuga

SEQ ID NO: 2910541 - RNA, 14 nt, Human
gcgucccaagaugu

SEQ ID NO: 2910542 - RNA, 14 nt, Human
gcguccagaaaugg

SEQ ID NO: 2910543 - RNA, 19 nt, Human
gcgucccagucucuggcag

SEQ ID NO: 2910544 - RNA, 15 nt, Human
gcgucccgcaccugu

SEQ ID NO: 2910545 - RNA, 16 nt, Human
gcgucccuagcaguga

SEQ ID NO: 2910546 - RNA, 19 nt, Human
gcgucccuagcagugaacu

SEQ ID NO: 2910547 - RNA, 16 nt, Human
gcgucuuccgccccug

SEQ ID NO: 2910548 - RNA, 18 nt, Human
gcgucuuccgccccugcc

SEQ ID NO: 2910549 - RNA, 20 nt, Human
gcgucuuccgccccugccug

SEQ ID NO: 2910550 - RNA, 21 nt, Human
gcgucuuccgccccugccugc

SEQ ID NO: 2910551 - RNA, 22 nt, Human
gcgucuuccgccccugccugcc

SEQ ID NO: 2910552 - RNA, 15 nt, Human
gcucagcggggacag

SEQ ID NO: 2910553 - RNA, 20 nt, Human
gcucagcggggacagcuccu

SEQ ID NO: 2910554 - RNA, 17 nt, Human
gcucaggugucccugca

SEQ ID NO: 2910555 - RNA, 18 nt, Human
gcucaggugucccugcac

SEQ ID NO: 2910556 - RNA, 22 nt, Human
gcucagcggggacagcuccuuc

SEQ ID NO: 2910557 - RNA, 21 nt, Human
gcucagcggggacagcuccuu

SEQ ID NO: 2910558 - RNA, 19 nt, Human
gcucaggugucccugcacu

SEQ ID NO: 2910559 - RNA, 15 nt, Human
gcucagcgccagccu

SEQ ID NO: 2910560 - RNA, 16 nt, Human
gcucaguaauuugagg

SEQ ID NO: 2910561 - RNA, 12 nt, Human
gcucagucccau

SEQ ID NO: 2910562 - RNA, 21 nt, Human
gcucaguaauuugaggacaac

SEQ ID NO: 2910563 - RNA, 20 nt, Human
gcucagucucaggagcaugg

SEQ ID NO: 2910564 - RNA, 17 nt, Human
gcucagucucaggagca

SEQ ID NO: 2910565 - RNA, 14 nt, Human
gcucagucucagga

SEQ ID NO: 2910566 - RNA, 23 nt, Human
gcucagucccaucagagagcgag

SEQ ID NO: 2910567 - RNA, 21 nt, Human
gcucagucucaggagcauggg

SEQ ID NO: 2910568 - RNA, 17 nt, Human
gcucagugcaaccucug

SEQ ID NO: 2910569 - RNA, 18 nt, Human
gcucagugcaaccucugc

SEQ ID NO: 2910570 - RNA, 19 nt, Human
gcucagugcaaccucugcu

SEQ ID NO: 2910571 - RNA, 20 nt, Human
gcucagugcaaccucugcuu

SEQ ID NO: 2910572 - RNA, 21 nt, Human
gcucagugcaaccucugcuuc

SEQ ID NO: 2910573 - RNA, 16 nt, Human
gcucaguucagaauca

SEQ ID NO: 2910574 - RNA, 17 nt, Human
gcucaguucagaaucac

SEQ ID NO: 2910575 - RNA, 19 nt, Human
gcucaguugcuaaacacug

SEQ ID NO: 2910576 - RNA, 19 nt, Human
gcucauauggggcugggag

SEQ ID NO: 2910577 - RNA, 19 nt, Human
gcuagcaguaaaagaugaa

SEQ ID NO: 2910578 - RNA, 19 nt, Human
gcucaccagccccagugcc

SEQ ID NO: 2910579 - RNA, 18 nt, Human
gcucaccagccccagugc

SEQ ID NO: 2910580 - RNA, 23 nt, Human
gcucaccagccccagugcccaca

SEQ ID NO: 2910581 - RNA, 20 nt, Human
gcucaccagccccagugccc

SEQ ID NO: 2910582 - RNA, 13 nt, Human
gcucaccuagagc

SEQ ID NO: 2910583 - RNA, 14 nt, Human
gcucaccuagagcc

SEQ ID NO: 2910584 - RNA, 15 nt, Human
gcucaccuagagcca

SEQ ID NO: 2910585 - RNA, 16 nt, Human
gcucaccuagagccag

SEQ ID NO: 2910586 - RNA, 17 nt, Human
gcucaccuagagccaga

SEQ ID NO: 2910587 - RNA, 18 nt, Human
gcucaccuagagccagac

SEQ ID NO: 2910588 - RNA, 19 nt, Human
gcucaccuagagccagacc

SEQ ID NO: 2910589 - RNA, 20 nt, Human
gcucaccuagagccagacca

SEQ ID NO: 2910590 - RNA, 23 nt, Human
gcuccaggcuccuuuagcgccca

SEQ ID NO: 2910591 - RNA, 16 nt, Human
gcuccaggcuccuuua

SEQ ID NO: 2910592 - RNA, 13 nt, Human
gcuccaggcuccu

SEQ ID NO: 2910593 - RNA, 14 nt, Human
gcuccaucuccacu

SEQ ID NO: 2910594 - RNA, 16 nt, Human
gcuccaugugccucuu

SEQ ID NO: 2910595 - RNA, 17 nt, Human
gcuccaugugccucuuu

SEQ ID NO: 2910596 - RNA, 17 nt, Human
gcuccauuuacaaacua

SEQ ID NO: 2910597 - RNA, 22 nt, Human
gcuccauuuucuuauugcgcug

SEQ ID NO: 2910598 - RNA, 19 nt, Human
gcuccaugcuccucacugc

SEQ ID NO: 2910599 - RNA, 23 nt, Human
gcuccaugcuccucacugcccgc

SEQ ID NO: 2910600 - RNA, 13 nt, Human
gcucccucucccc

SEQ ID NO: 2910601 - RNA, 15 nt, Human
gcucccucucccccu

SEQ ID NO: 2910602 - RNA, 20 nt, Human
gcucccuccccugcccuggu

SEQ ID NO: 2910603 - RNA, 19 nt, Human
gcucccuccccugcccugg

SEQ ID NO: 2910604 - RNA, 23 nt, Human
gcucccuccccugcccuggucca

SEQ ID NO: 2910605 - RNA, 13 nt, Human
gcucccucccgca

SEQ ID NO: 2910606 - RNA, 24 nt, Human
gcucccugaagccagccuucuucc

SEQ ID NO: 2910607 - RNA, 13 nt, Human
gcucccugcccca

SEQ ID NO: 2910608 - RNA, 14 nt, Human
gcucccugccccaa

SEQ ID NO: 2910609 - RNA, 15 nt, Human
gcucccugccccaaa

SEQ ID NO: 2910610 - RNA, 12 nt, Human
gcucccugaagc

SEQ ID NO: 2910611 - RNA, 13 nt, Human
gcucccugaagcc

SEQ ID NO: 2910612 - RNA, 14 nt, Human
gcucccugaagcca

SEQ ID NO: 2910613 - RNA, 15 nt, Human
gcucccugaagccag

SEQ ID NO: 2910614 - RNA, 16 nt, Human
gcucccugaagccagc

SEQ ID NO: 2910615 - RNA, 17 nt, Human
gcucccugaagccagcc

SEQ ID NO: 2910616 - RNA, 18 nt, Human
gcucccugaagccagccu

SEQ ID NO: 2910617 - RNA, 20 nt, Human
gcucccugaagccagccuuc

SEQ ID NO: 2910618 - RNA, 17 nt, Human
gcucccuccccugcccu

SEQ ID NO: 2910619 - RNA, 21 nt, Human
gcucccucccaggacucugac

SEQ ID NO: 2910620 - RNA, 19 nt, Human
gcucccucccaggacucug

SEQ ID NO: 2910621 - RNA, 18 nt, Human
gcucccucccaggacucu

SEQ ID NO: 2910622 - RNA, 15 nt, Human
gcucccucccaggac

SEQ ID NO: 2910623 - RNA, 14 nt, Human
gcucccucccagga

SEQ ID NO: 2910624 - RNA, 18 nt, Human
gcuccaagauucuagaug

SEQ ID NO: 2910625 - RNA, 23 nt, Human
gcuccagcuggccgggagccuga

SEQ ID NO: 2910626 - RNA, 17 nt, Human
gcuccagcuggccggga

SEQ ID NO: 2910627 - RNA, 14 nt, Human
gcuccaagaccuag

SEQ ID NO: 2910628 - RNA, 18 nt, Human
gcuccaagaccuaggcuc

SEQ ID NO: 2910629 - RNA, 16 nt, Human
gcuccaaaugcagcuu

SEQ ID NO: 2910630 - RNA, 14 nt, Human
gcuccaagauucua

SEQ ID NO: 2910631 - RNA, 15 nt, Human
gcuccaagauucuag

SEQ ID NO: 2910632 - RNA, 16 nt, Human
gcuccaagauucuaga

SEQ ID NO: 2910633 - RNA, 17 nt, Human
gcuccaagauucuagau

SEQ ID NO: 2910634 - RNA, 19 nt, Human
gcucucggguugugugucu

SEQ ID NO: 2910635 - RNA, 18 nt, Human
gcucucugaguccuggcc

SEQ ID NO: 2910636 - RNA, 21 nt, Human
gcucucugaguccuggcccaa

SEQ ID NO: 2910637 - RNA, 16 nt, Human
gcucuccuuucuuucu

SEQ ID NO: 2910638 - RNA, 14 nt, Human
gcucuccugacuuu

SEQ ID NO: 2910639 - RNA, 16 nt, Human
gcucuccugacuuuua

SEQ ID NO: 2910640 - RNA, 14 nt, Human
gcucuccugccaca

SEQ ID NO: 2910641 - RNA, 17 nt, Human
gcucuccgaccagacac

SEQ ID NO: 2910642 - RNA, 13 nt, Human
gcucuccgaccag

SEQ ID NO: 2910643 - RNA, 19 nt, Human
gcucuccccugcccugcug

SEQ ID NO: 2910644 - RNA, 19 nt, Human
gcucuccgaccagacaccu

SEQ ID NO: 2910645 - RNA, 19 nt, Human
gcucuccucuugccacugc

SEQ ID NO: 2910646 - RNA, 22 nt, Human
gcucuccucuugccacugccuc

SEQ ID NO: 2910647 - RNA, 15 nt, Human
gcucuccucuugcca

SEQ ID NO: 2910648 - RNA, 21 nt, Human
gcuccuucuguccuacucugu

SEQ ID NO: 2910649 - RNA, 19 nt, Human
gcuccuuggcuuaccugac

SEQ ID NO: 2910650 - RNA, 15 nt, Human
gcuccuucuguccua

SEQ ID NO: 2910651 - RNA, 22 nt, Human
gcucccugugacaaaauuuuau

SEQ ID NO: 2910652 - RNA, 21 nt, Human
gcucccuguguccaccugugg

SEQ ID NO: 2910653 - RNA, 22 nt, Human
gcucccuguguccaccuguggg

SEQ ID NO: 2910654 - RNA, 12 nt, Human
gcucccuucagc

SEQ ID NO: 2910655 - RNA, 13 nt, Human
gcucccuucagcc

SEQ ID NO: 2910656 - RNA, 14 nt, Human
gcucccuucagccc

SEQ ID NO: 2910657 - RNA, 15 nt, Human
gcucccuucagcccc

SEQ ID NO: 2910658 - RNA, 19 nt, Human
gcucccuucagcccccagc

SEQ ID NO: 2910659 - RNA, 20 nt, Human
gcucccuucagcccccagcc

SEQ ID NO: 2910660 - RNA, 23 nt, Human
gcucccuucagcccccagccccu

SEQ ID NO: 2910661 - RNA, 17 nt, Human
gcucgagcaguccugcc

SEQ ID NO: 2910662 - RNA, 17 nt, Human
gcucuccagccugggag

SEQ ID NO: 2910663 - RNA, 18 nt, Human
gcucuccagccugggagg

SEQ ID NO: 2910664 - RNA, 19 nt, Human
gcucuccauucaauuucag

SEQ ID NO: 2910665 - RNA, 16 nt, Human
gcucuccccugcccug

SEQ ID NO: 2910666 - RNA, 17 nt, Human
gcucucccauuuccuga

SEQ ID NO: 2910667 - RNA, 21 nt, Human
gcucgagcaguccugccucag

SEQ ID NO: 2910668 - RNA, 20 nt, Human
gcucgagcaguccugccuca

SEQ ID NO: 2910669 - RNA, 11 nt, Human
gcucucugcug

SEQ ID NO: 2910670 - RNA, 14 nt, Human
gcucugcuccucuc

SEQ ID NO: 2910671 - RNA, 13 nt, Human
gcucugcuccucu

SEQ ID NO: 2910672 - RNA, 18 nt, Human
gcucugccgucucuggag

SEQ ID NO: 2910673 - RNA, 17 nt, Human
gcucugccgucucugga

SEQ ID NO: 2910674 - RNA, 16 nt, Human
gcucugccgucucugg

SEQ ID NO: 2910675 - RNA, 13 nt, Human
gcucucugcugua

SEQ ID NO: 2910676 - RNA, 22 nt, Human
gcucugccuucgaggucagagg

SEQ ID NO: 2910677 - RNA, 23 nt, Human
gcucugcugacagacacaggccc

SEQ ID NO: 2910678 - RNA, 20 nt, Human
gcucugcugacagacacagg

SEQ ID NO: 2910679 - RNA, 19 nt, Human
gcucugcugacagacacag

SEQ ID NO: 2910680 - RNA, 18 nt, Human
gcucugcugacagacaca

SEQ ID NO: 2910681 - RNA, 14 nt, Human
gcucugcugacaga

SEQ ID NO: 2910682 - RNA, 13 nt, Human
gcucugcugacag

SEQ ID NO: 2910683 - RNA, 21 nt, Human
gcucugcuccucuccccagca

SEQ ID NO: 2910684 - RNA, 19 nt, Human
gcucugcuccucuccccag

SEQ ID NO: 2910685 - RNA, 22 nt, Human
gcucuggacaggcauguucucu

SEQ ID NO: 2910686 - RNA, 21 nt, Human
gcucuggacaggcauguucuc

SEQ ID NO: 2910687 - RNA, 16 nt, Human
gcucuggacaggcaug

SEQ ID NO: 2910688 - RNA, 15 nt, Human
gcucuggacaggcau

SEQ ID NO: 2910689 - RNA, 14 nt, Human
gcucuggacaggca

SEQ ID NO: 2910690 - RNA, 23 nt, Human
gcugccaaggccagaguggccug

SEQ ID NO: 2910691 - RNA, 22 nt, Human
gcugccaaggccagaguggccu

SEQ ID NO: 2910692 - RNA, 18 nt, Human
gcugccaaggccagagug

SEQ ID NO: 2910693 - RNA, 22 nt, Human
gcugcauggggugggguagggc

SEQ ID NO: 2910694 - RNA, 15 nt, Human
gcugcauuagaaaaa

SEQ ID NO: 2910695 - RNA, 20 nt, Human
gcugcaugccuggucuuucc

SEQ ID NO: 2910696 - RNA, 14 nt, Human
gcugcaugccuggu

SEQ ID NO: 2910697 - RNA, 18 nt, Human
gcugcaugccuggucuuu

SEQ ID NO: 2910698 - RNA, 13 nt, Human
gcugcaucuuaua

SEQ ID NO: 2910699 - RNA, 17 nt, Human
gcugcaucuuauagcac

SEQ ID NO: 2910700 - RNA, 19 nt, Human
gcugcaucuuauagcacuu

SEQ ID NO: 2910701 - RNA, 22 nt, Human
gcugcaucuuauagcacuuuga

SEQ ID NO: 2910702 - RNA, 23 nt, Human
gcugcaucuuauagcacuuugaa

SEQ ID NO: 2910703 - RNA, 14 nt, Human
gcugcauccagagg

SEQ ID NO: 2910704 - RNA, 19 nt, Human
gcugaugucccuagaaaac

SEQ ID NO: 2910705 - RNA, 20 nt, Human
gcugauguccucaccacaug

SEQ ID NO: 2910706 - RNA, 23 nt, Human
gcugauggauaaccuauaugauu

SEQ ID NO: 2910707 - RNA, 13 nt, Human
gcugauggucugg

SEQ ID NO: 2910708 - RNA, 16 nt, Human
gcugacuguccucucc

SEQ ID NO: 2910709 - RNA, 21 nt, Human
gcugacuguacuccucccagg

SEQ ID NO: 2910710 - RNA, 17 nt, Human
gcugagucccaggcuga

SEQ ID NO: 2910711 - RNA, 22 nt, Human
gcugagucccaggcugagccuc

SEQ ID NO: 2910712 - RNA, 21 nt, Human
gcugagucccaggcugagccu

SEQ ID NO: 2910713 - RNA, 15 nt, Human
gcugaugcaggauuu

SEQ ID NO: 2910714 - RNA, 20 nt, Human
gcugaguuuucucuuugugg

SEQ ID NO: 2910715 - RNA, 17 nt, Human
gcugagugggagaaggc

SEQ ID NO: 2910716 - RNA, 22 nt, Human
gcugagugggagaaggcaguga

SEQ ID NO: 2910717 - RNA, 16 nt, Human
gcucuucuccaggcug

SEQ ID NO: 2910718 - RNA, 14 nt, Human
gcucuucuccaggc

SEQ ID NO: 2910719 - RNA, 13 nt, Human
gcucuucuccuuu

SEQ ID NO: 2910720 - RNA, 17 nt, Human
gcucuucuccuuucaca

SEQ ID NO: 2910721 - RNA, 21 nt, Human
gcucuucuccuuucacaaccu

SEQ ID NO: 2910722 - RNA, 23 nt, Human
gcucuucuccuuucacaaccuuc

SEQ ID NO: 2910723 - RNA, 23 nt, Human
gcucuucugcccaauuggaggaa

SEQ ID NO: 2910724 - RNA, 20 nt, Human
gcucuugauaccccccucug

SEQ ID NO: 2910725 - RNA, 12 nt, Human
gcucuucuccag

SEQ ID NO: 2910726 - RNA, 20 nt, Human
gcucuuccgaaaaccaggcc

SEQ ID NO: 2910727 - RNA, 13 nt, Human
gcucuucgcgccc

SEQ ID NO: 2910728 - RNA, 21 nt, Human
gcucuucgcgcccgccccugc

SEQ ID NO: 2910729 - RNA, 20 nt, Human
gcugacagacacaggcccgg

SEQ ID NO: 2910730 - RNA, 17 nt, Human
gcucuuucgucacccuu

SEQ ID NO: 2910731 - RNA, 21 nt, Human
gcugacagacacaggcccggc

SEQ ID NO: 2910732 - RNA, 17 nt, Human
gcugacagacagcccuc

SEQ ID NO: 2910733 - RNA, 21 nt, Human
gcucuuuaugaaugaaaaaac

SEQ ID NO: 2910734 - RNA, 22 nt, Human
gcucuuguuuuuauuaauuuau

SEQ ID NO: 2910735 - RNA, 23 nt, Human
gcucuuguuuuuauuaauuuaua

SEQ ID NO: 2910736 - RNA, 22 nt, Human
gcucuugugcuggauggagccc

SEQ ID NO: 2910737 - RNA, 15 nt, Human
gcucuugucccacgu

SEQ ID NO: 2910738 - RNA, 22 nt, Human
gcucuugucccacgugucuucc

SEQ ID NO: 2910739 - RNA, 23 nt, Human
gcucuuguccucaguccauuuau

SEQ ID NO: 2910740 - RNA, 22 nt, Human
gcucuugauaccccccucuguc

SEQ ID NO: 2910741 - RNA, 23 nt, Human
gcucuugauaccccccucugucu

SEQ ID NO: 2910742 - RNA, 22 nt, Human
gcugacugccaauaacauucuu

SEQ ID NO: 2910743 - RNA, 21 nt, Human
gcugacuccacgauccugcca

SEQ ID NO: 2910744 - RNA, 18 nt, Human
gcugacuguacuccuccc

SEQ ID NO: 2910745 - RNA, 19 nt, Human
gcugacuguacuccuccca

SEQ ID NO: 2910746 - RNA, 18 nt, Human
gcugaccucccagugacc

SEQ ID NO: 2910747 - RNA, 23 nt, Human
gcugacuagaagggccaguccug

SEQ ID NO: 2910748 - RNA, 15 nt, Human
gcugacuagaagggc

SEQ ID NO: 2910749 - RNA, 20 nt, Human
gcugacuaaauuuggggaca

SEQ ID NO: 2910750 - RNA, 18 nt, Human
guaaugaugucguuugaa

SEQ ID NO: 2910751 - RNA, 20 nt, Human
guaaugcuuagagaauguuc

SEQ ID NO: 2910752 - RNA, 12 nt, Human
guaaugcugcac

SEQ ID NO: 2910753 - RNA, 14 nt, Human
guaaugcugcacuu

SEQ ID NO: 2910754 - RNA, 17 nt, Human
guaaugcugcacuuccu

SEQ ID NO: 2910755 - RNA, 21 nt, Human
guaaugcuuaagggaguuuaa

SEQ ID NO: 2910756 - RNA, 19 nt, Human
guaaugcauacagaaauau

SEQ ID NO: 2910757 - RNA, 16 nt, Human
guaaugccucugucua

SEQ ID NO: 2910758 - RNA, 15 nt, Human
guaaugcgauuuuau

SEQ ID NO: 2910759 - RNA, 16 nt, Human
guaaugcgauuuuauu

SEQ ID NO: 2910760 - RNA, 19 nt, Human
guaaugcgauuuuauuacu

SEQ ID NO: 2910761 - RNA, 20 nt, Human
guaaugcgauuuuauuacug

SEQ ID NO: 2910762 - RNA, 17 nt, Human
guaauguggaagaaaau

SEQ ID NO: 2910763 - RNA, 18 nt, Human
guaaugugugguggccuc

SEQ ID NO: 2910764 - RNA, 20 nt, Human
guaaugugugguggccucag

SEQ ID NO: 2910765 - RNA, 17 nt, Human
guaauguguuuuagagu

SEQ ID NO: 2910766 - RNA, 20 nt, Human
guaauguuaauguuauauca

SEQ ID NO: 2910767 - RNA, 18 nt, Human
guaauguagcguguuuac

SEQ ID NO: 2910768 - RNA, 20 nt, Human
guaauguagcguguuuacau

SEQ ID NO: 2910769 - RNA, 21 nt, Human
guaauguagcguguuuacaug

SEQ ID NO: 2910770 - RNA, 17 nt, Human
guaauguaaaauccauc

SEQ ID NO: 2910771 - RNA, 16 nt, Human
guaagugcuacauaaa

SEQ ID NO: 2910772 - RNA, 15 nt, Human
guaaucguguccccu

SEQ ID NO: 2910773 - RNA, 17 nt, Human
guaaucgaccugccucg

SEQ ID NO: 2910774 - RNA, 22 nt, Human
guaaucuccacagucaaagaag

SEQ ID NO: 2910775 - RNA, 14 nt, Human
guaaucucucugca

SEQ ID NO: 2910776 - RNA, 17 nt, Human
guaaucucucugcagcu

SEQ ID NO: 2910777 - RNA, 18 nt, Human
guaaucucucugcagcug

SEQ ID NO: 2910778 - RNA, 19 nt, Human
guaaucucucugcagcugc

SEQ ID NO: 2910779 - RNA, 20 nt, Human
guaaucucucugcagcugcc

SEQ ID NO: 2910780 - RNA, 21 nt, Human
guaaucucucugcagcugccg

SEQ ID NO: 2910781 - RNA, 22 nt, Human
guaaucucucugcagcugccgg

SEQ ID NO: 2910782 - RNA, 16 nt, Human
guaaucugauggcuuc

SEQ ID NO: 2910783 - RNA, 23 nt, Human
guaaucuguacauuuuguuguaa

SEQ ID NO: 2910784 - RNA, 17 nt, Human
guaaugaaaaugaauau

SEQ ID NO: 2910785 - RNA, 13 nt, Human
guaaugaaguaaa

SEQ ID NO: 2910786 - RNA, 15 nt, Human
guaauugaacuuauc

SEQ ID NO: 2910787 - RNA, 15 nt, Human
guaauucuucaguug

SEQ ID NO: 2910788 - RNA, 15 nt, Human
guaauugacaugugc

SEQ ID NO: 2910789 - RNA, 18 nt, Human
guaauugacgguuuuuua

SEQ ID NO: 2910790 - RNA, 12 nt, Human
guaauugcuuuu

SEQ ID NO: 2910791 - RNA, 14 nt, Human
guaauuaaauuaug

SEQ ID NO: 2910792 - RNA, 15 nt, Human
guaauuguaauuuug

SEQ ID NO: 2910793 - RNA, 14 nt, Human
guaauucaagaaaa

SEQ ID NO: 2910794 - RNA, 13 nt, Human
guaauucaagaaa

SEQ ID NO: 2910795 - RNA, 21 nt, Human
guaauuccucucacuaaacuu

SEQ ID NO: 2910796 - RNA, 21 nt, Human
guaauucaguguauuucaguu

SEQ ID NO: 2910797 - RNA, 13 nt, Human
guaauuaugauuu

SEQ ID NO: 2910798 - RNA, 14 nt, Human
guaauuaugauuug

SEQ ID NO: 2910799 - RNA, 21 nt, Human
guaauuaugcacuaaauauga

SEQ ID NO: 2910800 - RNA, 15 nt, Human
guaauguuauuuucu

SEQ ID NO: 2910801 - RNA, 19 nt, Human
guaauguuuucuuugcaaa

SEQ ID NO: 2910802 - RNA, 21 nt, Human
guaauguuuucuuugcaaagu

SEQ ID NO: 2910803 - RNA, 16 nt, Human
guacagacuuguugug

SEQ ID NO: 2910804 - RNA, 23 nt, Human
guacagacagagaauaugucugc

SEQ ID NO: 2910805 - RNA, 16 nt, Human
guacagacauauuuaa

SEQ ID NO: 2910806 - RNA, 17 nt, Human
guacagacauauuuaac

SEQ ID NO: 2910807 - RNA, 20 nt, Human
guacagagaccucccuguuc

SEQ ID NO: 2910808 - RNA, 18 nt, Human
guacagcuguuuaagaug

SEQ ID NO: 2910809 - RNA, 13 nt, Human
guacagcugggcu

SEQ ID NO: 2910810 - RNA, 21 nt, Human
guacagaguguggacucuggu

SEQ ID NO: 2910811 - RNA, 15 nt, Human
guacagcaugugccu

SEQ ID NO: 2910812 - RNA, 12 nt, Human
guacagcccaga

SEQ ID NO: 2910813 - RNA, 14 nt, Human
guacagcccagagg

SEQ ID NO: 2910814 - RNA, 16 nt, Human
guacagcccagaggcc

SEQ ID NO: 2910815 - RNA, 23 nt, Human
guacagcccagaggccaacacug

SEQ ID NO: 2910816 - RNA, 19 nt, Human
guacauacccuggccgccc

SEQ ID NO: 2910817 - RNA, 22 nt, Human
guacauacccuggccgcccccu

SEQ ID NO: 2910818 - RNA, 22 nt, Human
guacauaauacacuugcccugc

SEQ ID NO: 2910819 - RNA, 23 nt, Human
guacauaauacacuugcccugcu

SEQ ID NO: 2910820 - RNA, 20 nt, Human
guacauaaauugcauaaagc

SEQ ID NO: 2910821 - RNA, 21 nt, Human
guacauaaauugcauaaagca

SEQ ID NO: 2910822 - RNA, 22 nt, Human
guacauaaauugcauaaagcau

SEQ ID NO: 2910823 - RNA, 23 nt, Human
guacauaaauugcauaaagcaua

SEQ ID NO: 2910824 - RNA, 16 nt, Human
guacauaacucuguaa

SEQ ID NO: 2910825 - RNA, 12 nt, Human
guacauaaaaga

SEQ ID NO: 2910826 - RNA, 16 nt, Human
guacauaaaagaauuu

SEQ ID NO: 2910827 - RNA, 15 nt, Human
guacauaaacaauga

SEQ ID NO: 2910828 - RNA, 15 nt, Human
guacccacugcucug

SEQ ID NO: 2910829 - RNA, 18 nt, Human
guacauauguaaaauaaa

SEQ ID NO: 2910830 - RNA, 17 nt, Human
guacauauguaaacaua

SEQ ID NO: 2910831 - RNA, 22 nt, Human
guacauaaugcuuaauuucuaa

SEQ ID NO: 2910832 - RNA, 18 nt, Human
guacauaguuauuuauuu

SEQ ID NO: 2910833 - RNA, 17 nt, Human
guacauaguuauuuauu

SEQ ID NO: 2910834 - RNA, 16 nt, Human
guacaggguuuuuacc

SEQ ID NO: 2910835 - RNA, 13 nt, Human
guacagucugucu

SEQ ID NO: 2910836 - RNA, 14 nt, Human
guacagucugucuu

SEQ ID NO: 2910837 - RNA, 17 nt, Human
guacagucugucuucug

SEQ ID NO: 2910838 - RNA, 19 nt, Human
guacagucugucuucugua

SEQ ID NO: 2910839 - RNA, 20 nt, Human
guacagucugucuucuguau

SEQ ID NO: 2910840 - RNA, 21 nt, Human
guacagucugucuucuguaua

SEQ ID NO: 2910841 - RNA, 15 nt, Human
guacagaauuuugga

SEQ ID NO: 2910842 - RNA, 17 nt, Human
guacaguaggauaagcc

SEQ ID NO: 2910843 - RNA, 20 nt, Human
guacaguggugccaucauug

SEQ ID NO: 2910844 - RNA, 19 nt, Human
guacagucuugcagcagga

SEQ ID NO: 2910845 - RNA, 15 nt, Human
guacccucuggaggg

SEQ ID NO: 2910846 - RNA, 17 nt, Human
guacccuccuggcucuu

SEQ ID NO: 2910847 - RNA, 17 nt, Human
guacccucucagcucca

SEQ ID NO: 2910848 - RNA, 18 nt, Human
guacccucucagcuccag

SEQ ID NO: 2910849 - RNA, 19 nt, Human
guacccucucagcuccagg

SEQ ID NO: 2910850 - RNA, 16 nt, Human
guacccacugcucugg

SEQ ID NO: 2910851 - RNA, 20 nt, Human
guacccacuuagucauguaa

SEQ ID NO: 2910852 - RNA, 17 nt, Human
guacauauuuguggaau

SEQ ID NO: 2910853 - RNA, 17 nt, Human
guacauauuuauuuucu

SEQ ID NO: 2910854 - RNA, 19 nt, Human
guacauauuuauuuucuuu

SEQ ID NO: 2910855 - RNA, 17 nt, Human
guacccaucuaguacuu

SEQ ID NO: 2910856 - RNA, 12 nt, Human
guaccuggugga

SEQ ID NO: 2910857 - RNA, 19 nt, Human
guaccuguuccuuagaccu

SEQ ID NO: 2910858 - RNA, 18 nt, Human
guaccuugaccuuuguac

SEQ ID NO: 2910859 - RNA, 19 nt, Human
guaccuugaccuuuguaca

SEQ ID NO: 2910860 - RNA, 20 nt, Human
guaccuugaccuuuguacag

SEQ ID NO: 2910861 - RNA, 12 nt, Human
guaccugaaaag

SEQ ID NO: 2910862 - RNA, 14 nt, Human
guaccugaaaagua

SEQ ID NO: 2910863 - RNA, 18 nt, Human
guaccugaaaaguaacuu

SEQ ID NO: 2910864 - RNA, 23 nt, Human
guaccugaaaaguaacuuggcuu

SEQ ID NO: 2910865 - RNA, 14 nt, Human
guaccucaucccau

SEQ ID NO: 2910866 - RNA, 16 nt, Human
guaccucaucccauga

SEQ ID NO: 2910867 - RNA, 15 nt, Human
guaccuccccugccu

SEQ ID NO: 2910868 - RNA, 16 nt, Human
guaccuccccugccuu

SEQ ID NO: 2910869 - RNA, 17 nt, Human
guaccuccccugccuug

SEQ ID NO: 2910870 - RNA, 18 nt, Human
guaccuccccugccuugc

SEQ ID NO: 2910871 - RNA, 20 nt, Human
guaccuccccugccuugcug

SEQ ID NO: 2910872 - RNA, 13 nt, Human
guaccuccucuca

SEQ ID NO: 2910873 - RNA, 14 nt, Human
guaccuccucucag

SEQ ID NO: 2910874 - RNA, 16 nt, Human
guaccuccucucagug

SEQ ID NO: 2910875 - RNA, 18 nt, Human
guaccuccucucaguguu

SEQ ID NO: 2910876 - RNA, 19 nt, Human
guaccuccucucaguguuu

SEQ ID NO: 2910877 - RNA, 14 nt, Human
guaccucuggcuga

SEQ ID NO: 2910878 - RNA, 15 nt, Human
guaccucuggcugac

SEQ ID NO: 2910879 - RNA, 21 nt, Human
guaccucuggcugacuaaauu

SEQ ID NO: 2910880 - RNA, 17 nt, Human
guacgucugacaggcaa

SEQ ID NO: 2910881 - RNA, 15 nt, Human
guacgucugacaggc

SEQ ID NO: 2910882 - RNA, 14 nt, Human
guacgucugacagg

SEQ ID NO: 2910883 - RNA, 11 nt, Human
guaccuugcuu

SEQ ID NO: 2910884 - RNA, 13 nt, Human
guaccuugcuucu

SEQ ID NO: 2910885 - RNA, 23 nt, Human
guaccuugcuucuuacugauaau

SEQ ID NO: 2910886 - RNA, 21 nt, Human
guaccuuuugaggagccccag

SEQ ID NO: 2910887 - RNA, 23 nt, Human
guaccuuuugaggagccccagcu

SEQ ID NO: 2910888 - RNA, 22 nt, Human
guaccuuuuuuguuuuuucaaa

SEQ ID NO: 2910889 - RNA, 23 nt, Human
guaccuuuuuuguuuuuucaaaa

SEQ ID NO: 2910890 - RNA, 12 nt, Human
guacgcacagac

SEQ ID NO: 2910891 - RNA, 13 nt, Human
guacgcacagaca

SEQ ID NO: 2910892 - RNA, 14 nt, Human
guacgcacagacag

SEQ ID NO: 2910893 - RNA, 15 nt, Human
guacgcacagacagg

SEQ ID NO: 2910894 - RNA, 12 nt, Human
guacgugacccu

SEQ ID NO: 2910895 - RNA, 13 nt, Human
guacgugacccuc

SEQ ID NO: 2910896 - RNA, 14 nt, Human
guacguuuguaugu

SEQ ID NO: 2910897 - RNA, 17 nt, Human
guacguuuguaugugug

SEQ ID NO: 2910898 - RNA, 15 nt, Human
guacuucuccacccu

SEQ ID NO: 2910899 - RNA, 14 nt, Human
guacuucuccaccc

SEQ ID NO: 2910900 - RNA, 23 nt, Human
guacuacacauuuuuaaauuguu

SEQ ID NO: 2910901 - RNA, 13 nt, Human
guacuaagcauuu

SEQ ID NO: 2910902 - RNA, 13 nt, Human
guacuaaauuuaa

SEQ ID NO: 2910903 - RNA, 17 nt, Human
guacuaaauuuaaauuu

SEQ ID NO: 2910904 - RNA, 14 nt, Human
guacuuuuugugaa

SEQ ID NO: 2910905 - RNA, 15 nt, Human
guacuuuuugugaag

SEQ ID NO: 2910906 - RNA, 23 nt, Human
guacuuuuauuuuacacagaaac

SEQ ID NO: 2910907 - RNA, 12 nt, Human
guagaaaaacau

SEQ ID NO: 2910908 - RNA, 20 nt, Human
guagaaaaaaaaacagcucu

SEQ ID NO: 2910909 - RNA, 21 nt, Human
guacuuguggacacagcucuu

SEQ ID NO: 2910910 - RNA, 16 nt, Human
guacuuguuucucugu

SEQ ID NO: 2910911 - RNA, 12 nt, Human
guacuuguuugc

SEQ ID NO: 2910912 - RNA, 20 nt, Human
guacuugugaaacacagcug

SEQ ID NO: 2910913 - RNA, 21 nt, Human
guacuugugaaacacagcugu

SEQ ID NO: 2910914 - RNA, 22 nt, Human
guacuugugaaacacagcuguu

SEQ ID NO: 2910915 - RNA, 21 nt, Human
guacuuuucccauuuguaauu

SEQ ID NO: 2910916 - RNA, 18 nt, Human
guacuuuugagugugugu

SEQ ID NO: 2910917 - RNA, 19 nt, Human
guacuuuugagugugugug

SEQ ID NO: 2910918 - RNA, 22 nt, Human
guacuuuugagugugugugugc

SEQ ID NO: 2910919 - RNA, 24 nt, Human
guacuuuugagugugugugugcau

SEQ ID NO: 2910920 - RNA, 19 nt, Human
guacuucuccacccugcuc

SEQ ID NO: 2910921 - RNA, 18 nt, Human
guacuucuccacccugcu

SEQ ID NO: 2910922 - RNA, 17 nt, Human
guacuucuccacccugc

SEQ ID NO: 2910923 - RNA, 16 nt, Human
guacuucuccacccug

SEQ ID NO: 2910924 - RNA, 21 nt, Human
guacuucuccacccugcucuc

SEQ ID NO: 2910925 - RNA, 20 nt, Human
guacuucuccacccugcucu

SEQ ID NO: 2910926 - RNA, 23 nt, Human
guacuugaagucuaaaagcagaa

SEQ ID NO: 2910927 - RNA, 18 nt, Human
guacuugaguguaauguu

SEQ ID NO: 2910928 - RNA, 23 nt, Human
guacuugccagaaguuguggauu

SEQ ID NO: 2910929 - RNA, 21 nt, Human
guacuuccugaguggccaggg

SEQ ID NO: 2910930 - RNA, 20 nt, Human
guacuuguggacacagcucu

SEQ ID NO: 2910931 - RNA, 16 nt, Human
guacuuguggacacag

SEQ ID NO: 2910932 - RNA, 13 nt, Human
guacuugguccaa

SEQ ID NO: 2910933 - RNA, 15 nt, Human
guacuugguccaacu

SEQ ID NO: 2910934 - RNA, 19 nt, Human
guacuugguccaacugcaa

SEQ ID NO: 2910935 - RNA, 21 nt, Human
guacuugguccaacugcaacu

SEQ ID NO: 2910936 - RNA, 22 nt, Human
guacuugguccaacugcaacuc

SEQ ID NO: 2910937 - RNA, 21 nt, Human
guacuuggaguauuggggucu

SEQ ID NO: 2910938 - RNA, 23 nt, Human
guaagggaggaggagcuucuggg

SEQ ID NO: 2910939 - RNA, 15 nt, Human
guaagggauuucuua

SEQ ID NO: 2910940 - RNA, 16 nt, Human
guaagggauuucuuag

SEQ ID NO: 2910941 - RNA, 14 nt, Human
guaaggcucuagau

SEQ ID NO: 2910942 - RNA, 16 nt, Human
guaaggcucuagauca

SEQ ID NO: 2910943 - RNA, 24 nt, Human
guaagcuccuuuguggagugcugg

SEQ ID NO: 2910944 - RNA, 13 nt, Human
guaaggcucuaga

SEQ ID NO: 2910945 - RNA, 20 nt, Human
guaagugagugugcugcugu

SEQ ID NO: 2910946 - RNA, 18 nt, Human
guaaguaccacucaggcc

SEQ ID NO: 2910947 - RNA, 14 nt, Human
guaagucaguguug

SEQ ID NO: 2910948 - RNA, 17 nt, Human
guaagucaguguugaga

SEQ ID NO: 2910949 - RNA, 19 nt, Human
guaagucaguguugagaug

SEQ ID NO: 2910950 - RNA, 17 nt, Human
guaagucucaacucugu

SEQ ID NO: 2910951 - RNA, 15 nt, Human
guaaguaauuaugca

SEQ ID NO: 2910952 - RNA, 18 nt, Human
guaaguaauuaugcacua

SEQ ID NO: 2910953 - RNA, 13 nt, Human
guaagccaaagaa

SEQ ID NO: 2910954 - RNA, 17 nt, Human
guaagccaaagaaauga

SEQ ID NO: 2910955 - RNA, 22 nt, Human
guaagccaaagaaaugaacauu

SEQ ID NO: 2910956 - RNA, 17 nt, Human
guaagcacuguuuuucc

SEQ ID NO: 2910957 - RNA, 19 nt, Human
guaagcacuguuuuuccau

SEQ ID NO: 2910958 - RNA, 20 nt, Human
guaagcaggagagaaauuuc

SEQ ID NO: 2910959 - RNA, 17 nt, Human
guaacuuuuguaagaca

SEQ ID NO: 2910960 - RNA, 15 nt, Human
guaacuuuuguaaga

SEQ ID NO: 2910961 - RNA, 14 nt, Human
guaacuuuuguaag

SEQ ID NO: 2910962 - RNA, 19 nt, Human
guaagaaaaugcuagaaga

SEQ ID NO: 2910963 - RNA, 17 nt, Human
guaagaaaagugguugu

SEQ ID NO: 2910964 - RNA, 12 nt, Human
guaacuuuaugu

SEQ ID NO: 2910965 - RNA, 16 nt, Human
guaacuuuauguguaa

SEQ ID NO: 2910966 - RNA, 18 nt, Human
guaacuuuauucuugaaa

SEQ ID NO: 2910967 - RNA, 14 nt, Human
guaacuuuaugugu

SEQ ID NO: 2910968 - RNA, 15 nt, Human
guaacuuuaugugua

SEQ ID NO: 2910969 - RNA, 21 nt, Human
guaaauguuuguuaaaaauaa

SEQ ID NO: 2910970 - RNA, 19 nt, Human
guaaauuaaacauaaaaca

SEQ ID NO: 2910971 - RNA, 14 nt, Human
guaacugugucaug

SEQ ID NO: 2910972 - RNA, 14 nt, Human
guaacuuaaaauag

SEQ ID NO: 2910973 - RNA, 14 nt, Human
guaacuuauauuga

SEQ ID NO: 2910974 - RNA, 15 nt, Human
guaacuuauauugaa

SEQ ID NO: 2910975 - RNA, 19 nt, Human
guaacuuauauugaagaca

SEQ ID NO: 2910976 - RNA, 22 nt, Human
guaacuuauauugaagacaauu

SEQ ID NO: 2910977 - RNA, 23 nt, Human
guaacuuauauugaagacaauuu

SEQ ID NO: 2910978 - RNA, 15 nt, Human
guaacuuauguagau

SEQ ID NO: 2910979 - RNA, 16 nt, Human
guaacuuauguagaua

SEQ ID NO: 2910980 - RNA, 22 nt, Human
guaacuuauguagauauuuggc

SEQ ID NO: 2910981 - RNA, 20 nt, Human
guaacuucacauuaaaaaau

SEQ ID NO: 2910982 - RNA, 18 nt, Human
guaacuucuuauggaauu

SEQ ID NO: 2910983 - RNA, 21 nt, Human
guaacuucuuauggaauugau

SEQ ID NO: 2910984 - RNA, 20 nt, Human
guaacuucuuauggaauuga

SEQ ID NO: 2910985 - RNA, 22 nt, Human
guaagaaaucucccaugugcau

SEQ ID NO: 2910986 - RNA, 16 nt, Human
guaagaacuaaagaag

SEQ ID NO: 2910987 - RNA, 17 nt, Human
guaagaauucagaagac

SEQ ID NO: 2910988 - RNA, 22 nt, Human
guaagaaguuucuuaaacauug

SEQ ID NO: 2910989 - RNA, 11 nt, Human
guaagaagccg

SEQ ID NO: 2910990 - RNA, 15 nt, Human
guaagacaaagguuu

SEQ ID NO: 2910991 - RNA, 14 nt, Human
guaagagacagaau

SEQ ID NO: 2910992 - RNA, 23 nt, Human
guaagagacagaauguaucugug

SEQ ID NO: 2910993 - RNA, 10 nt, Human
guaagagacu

SEQ ID NO: 2910994 - RNA, 20 nt, Human
guaagauuauagauucuaaa

SEQ ID NO: 2910995 - RNA, 21 nt, Human
guaagauuauagauucuaaag

SEQ ID NO: 2910996 - RNA, 22 nt, Human
guaagauuauagauucuaaaga

SEQ ID NO: 2910997 - RNA, 23 nt, Human
guaagauuauagauucuaaagau

SEQ ID NO: 2910998 - RNA, 14 nt, Human
guaagaugucuguu

SEQ ID NO: 2910999 - RNA, 18 nt, Human
guaagauuauagauucua

SEQ ID NO: 2911000 - RNA, 18 nt, Human
guaagaguguagaagcau

SEQ ID NO: 2911001 - RNA, 22 nt, Human
guaagaguguagaagcauuccu

SEQ ID NO: 2911002 - RNA, 19 nt, Human
guaagaucguucucugccu

SEQ ID NO: 2911003 - RNA, 14 nt, Human
guaagaguguagaa

SEQ ID NO: 2911004 - RNA, 13 nt, Human
guaagaggcugga

SEQ ID NO: 2911005 - RNA, 15 nt, Human
guaagaguguagaag

SEQ ID NO: 2911006 - RNA, 17 nt, Human
guaagaguguagaagca

SEQ ID NO: 2911007 - RNA, 13 nt, Human
guaaauaccagga

SEQ ID NO: 2911008 - RNA, 16 nt, Human
guaaauaccauugaca

SEQ ID NO: 2911009 - RNA, 19 nt, Human
guaaauacacaacacacac

SEQ ID NO: 2911010 - RNA, 14 nt, Human
guaaauacagguag

SEQ ID NO: 2911011 - RNA, 15 nt, Human
guaaauaguauuuga

SEQ ID NO: 2911012 - RNA, 17 nt, Human
guaaauaguauuugaga

SEQ ID NO: 2911013 - RNA, 16 nt, Human
guaaauaguauuugag

SEQ ID NO: 2911014 - RNA, 18 nt, Human
guaaaucagauguugaau

SEQ ID NO: 2911015 - RNA, 19 nt, Human
guaaaucagauguugaauu

SEQ ID NO: 2911016 - RNA, 22 nt, Human
guaaaucagauguugaauucuu

SEQ ID NO: 2911017 - RNA, 14 nt, Human
guaaauauucuaua

SEQ ID NO: 2911018 - RNA, 15 nt, Human
guaaauauucuauau

SEQ ID NO: 2911019 - RNA, 19 nt, Human
guaaauauugaggcuuugu

SEQ ID NO: 2911020 - RNA, 22 nt, Human
guaaauauugaggcuuuguguu

SEQ ID NO: 2911021 - RNA, 17 nt, Human
guaaaucacauccuuau

SEQ ID NO: 2911022 - RNA, 13 nt, Human
guaaauauucuau

SEQ ID NO: 2911023 - RNA, 16 nt, Human
guaaauauaugaacau

SEQ ID NO: 2911024 - RNA, 21 nt, Human
guaaauaucccaaacugugau

SEQ ID NO: 2911025 - RNA, 15 nt, Human
guaaauaugaaucug

SEQ ID NO: 2911026 - RNA, 16 nt, Human
guaaauaugaaucugc

SEQ ID NO: 2911027 - RNA, 23 nt, Human
guaaauaugaaucugcucacuuu

SEQ ID NO: 2911028 - RNA, 23 nt, Human
guaaagugauaauuucuggaauu

SEQ ID NO: 2911029 - RNA, 18 nt, Human
guaaagugauaauuucug

SEQ ID NO: 2911030 - RNA, 17 nt, Human
guaaagugauaauuucu

SEQ ID NO: 2911031 - RNA, 13 nt, Human
guaaauaaaaaga

SEQ ID NO: 2911032 - RNA, 19 nt, Human
guaaaguccuuuucuugcu

SEQ ID NO: 2911033 - RNA, 20 nt, Human
guaaaguccuuuucuugcuu

SEQ ID NO: 2911034 - RNA, 14 nt, Human
guaaagugaagaau

SEQ ID NO: 2911035 - RNA, 19 nt, Human
guaaagugaagaauccuuu

SEQ ID NO: 2911036 - RNA, 17 nt, Human
guaaaagguauuaaauu

SEQ ID NO: 2911037 - RNA, 16 nt, Human
guaaauccugccauuu

SEQ ID NO: 2911038 - RNA, 17 nt, Human
guaaauccugccauuua

SEQ ID NO: 2911039 - RNA, 19 nt, Human
guaaauccugccauuuaaa

SEQ ID NO: 2911040 - RNA, 20 nt, Human
guaaauccugccauuuaaaa

SEQ ID NO: 2911041 - RNA, 14 nt, Human
guaaaucuuuuaca

SEQ ID NO: 2911042 - RNA, 19 nt, Human
guaaauguguuggacaaau

SEQ ID NO: 2911043 - RNA, 20 nt, Human
guaaauguguuggacaaaug

SEQ ID NO: 2911044 - RNA, 16 nt, Human
guaaauguuaguuucu

SEQ ID NO: 2911045 - RNA, 19 nt, Human
guaaauguuaguuucuugg

SEQ ID NO: 2911046 - RNA, 22 nt, Human
guaaauguuaucuuauacugua

SEQ ID NO: 2911047 - RNA, 13 nt, Human
guaaauguuauuu

SEQ ID NO: 2911048 - RNA, 15 nt, Human
guaaauguuauuucu

SEQ ID NO: 2911049 - RNA, 16 nt, Human
guaaauguuauuucug

SEQ ID NO: 2911050 - RNA, 18 nt, Human
guaaauguuauuucugca

SEQ ID NO: 2911051 - RNA, 20 nt, Human
guaaauguuauuucugcaaa

SEQ ID NO: 2911052 - RNA, 17 nt, Human
guaaauguuuagguuuu

SEQ ID NO: 2911053 - RNA, 22 nt, Human
guaaauggcuuauccagcuggu

SEQ ID NO: 2911054 - RNA, 13 nt, Human
guaaaugucuuug

SEQ ID NO: 2911055 - RNA, 14 nt, Human
guaaaugucuuugu

SEQ ID NO: 2911056 - RNA, 15 nt, Human
guaaaugucuuugua

SEQ ID NO: 2911057 - RNA, 18 nt, Human
guaaaugucuuuguaagu

SEQ ID NO: 2911058 - RNA, 17 nt, Human
guaaaugcaaaguucug

SEQ ID NO: 2911059 - RNA, 17 nt, Human
guaaaugcagcgugaag

SEQ ID NO: 2911060 - RNA, 11 nt, Human
guaaaugccac

SEQ ID NO: 2911061 - RNA, 15 nt, Human
guaaaugcuguguug

SEQ ID NO: 2911062 - RNA, 13 nt, Human
guaaaacacagag

SEQ ID NO: 2911063 - RNA, 14 nt, Human
guaaaacacagagg

SEQ ID NO: 2911064 - RNA, 19 nt, Human
guaaaacgcugucaaaagu

SEQ ID NO: 2911065 - RNA, 21 nt, Human
guaaaacgcugucaaaaguug

SEQ ID NO: 2911066 - RNA, 21 nt, Human
guaaaacuacacaucccuaau

SEQ ID NO: 2911067 - RNA, 17 nt, Human
guaaaagauuaaacugc

SEQ ID NO: 2911068 - RNA, 19 nt, Human
guaaaaaaaaaaacaauua

SEQ ID NO: 2911069 - RNA, 23 nt, Human
gguuuuuuuuuuuaaaaaaagaa

SEQ ID NO: 2911070 - RNA, 13 nt, Human
guaaaaaaaaaug

SEQ ID NO: 2911071 - RNA, 19 nt, Human
guaaaaaaaaaugccuuug

SEQ ID NO: 2911072 - RNA, 22 nt, Human
guaaaaacacugaaaaauuaua

SEQ ID NO: 2911073 - RNA, 20 nt, Human
guaaaaaaaaaugccuuuga

SEQ ID NO: 2911074 - RNA, 23 nt, Human
guaaaaaaaaaugccuuugagac

SEQ ID NO: 2911075 - RNA, 15 nt, Human
guaaaacaaaacaaa

SEQ ID NO: 2911076 - RNA, 11 nt, Human
guaaaaagaaa

SEQ ID NO: 2911077 - RNA, 12 nt, Human
guaaaaauacaa

SEQ ID NO: 2911078 - RNA, 14 nt, Human
guaaaaauaaaauu

SEQ ID NO: 2911079 - RNA, 13 nt, Human
guaaaaauaaaau

SEQ ID NO: 2911080 - RNA, 12 nt, Human
guaaaaagaaaa

SEQ ID NO: 2911081 - RNA, 13 nt, Human
gguuuaauauuac

SEQ ID NO: 2911082 - RNA, 12 nt, Human
gguuuacuuuca

SEQ ID NO: 2911083 - RNA, 14 nt, Human
gguuuacuuucaaa

SEQ ID NO: 2911084 - RNA, 13 nt, Human
gguuuuccacgcu

SEQ ID NO: 2911085 - RNA, 13 nt, Human
gguuuuccugaaa

SEQ ID NO: 2911086 - RNA, 22 nt, Human
gguuuacaugugauguuuuagu

SEQ ID NO: 2911087 - RNA, 19 nt, Human
gguuuacauucaucucauu

SEQ ID NO: 2911088 - RNA, 22 nt, Human
gguuuacauucaucucauucca

SEQ ID NO: 2911089 - RNA, 12 nt, Human
gguuuacauuua

SEQ ID NO: 2911090 - RNA, 15 nt, Human
gguuuacauuuaaag

SEQ ID NO: 2911091 - RNA, 18 nt, Human
gguuuacauuuaaagcau

SEQ ID NO: 2911092 - RNA, 17 nt, Human
gguuuaccuagagaaca

SEQ ID NO: 2911093 - RNA, 14 nt, Human
gguuuacaggcccu

SEQ ID NO: 2911094 - RNA, 23 nt, Human
gguuuugccauguuggccaggcu

SEQ ID NO: 2911095 - RNA, 18 nt, Human
gguuuuuaaauuuuguaa

SEQ ID NO: 2911096 - RNA, 19 nt, Human
gguuuuuaaauuuuguaau

SEQ ID NO: 2911097 - RNA, 13 nt, Human
gguuuuuaccugu

SEQ ID NO: 2911098 - RNA, 20 nt, Human
gguuuuuaccugucacauug

SEQ ID NO: 2911099 - RNA, 22 nt, Human
gguuuuuaccugucacauugca

SEQ ID NO: 2911100 - RNA, 23 nt, Human
gguuuuuguuuguuuccuuuguu

SEQ ID NO: 2911101 - RNA, 9 nt, Human
gguuuuuuu

SEQ ID NO: 2911102 - RNA, 19 nt, Human
gguuuuuuuccuguuucug

SEQ ID NO: 2911103 - RNA, 14 nt, Human
gguuuuuuaauaua

SEQ ID NO: 2911104 - RNA, 15 nt, Human
gguuuaaagagucua

SEQ ID NO: 2911105 - RNA, 20 nt, Human
gguuuaaagagucuagauuc

SEQ ID NO: 2911106 - RNA, 22 nt, Human
gguuuaaagagucuagauucaa

SEQ ID NO: 2911107 - RNA, 20 nt, Human
gguuuaaacuuguuugcugu

SEQ ID NO: 2911108 - RNA, 20 nt, Human
gguuguuuuuuccuuugcuc

SEQ ID NO: 2911109 - RNA, 13 nt, Human
gguugucagcucu

SEQ ID NO: 2911110 - RNA, 14 nt, Human
gguugucagcucuc

SEQ ID NO: 2911111 - RNA, 14 nt, Human
gguugggcuggugu

SEQ ID NO: 2911112 - RNA, 17 nt, Human
gguugggcccagaucug

SEQ ID NO: 2911113 - RNA, 14 nt, Human
gguuggggugacag

SEQ ID NO: 2911114 - RNA, 15 nt, Human
gguuggggugacagu

SEQ ID NO: 2911115 - RNA, 14 nt, Human
gguuggaccccaga

SEQ ID NO: 2911116 - RNA, 23 nt, Human
gguucuuugagggacugccucug

SEQ ID NO: 2911117 - RNA, 15 nt, Human
gguugcuaacugaac

SEQ ID NO: 2911118 - RNA, 13 nt, Human
gguugcuggagcc

SEQ ID NO: 2911119 - RNA, 15 nt, Human
gguugcuggagccug

SEQ ID NO: 2911120 - RNA, 17 nt, Human
gguucuuucuuccucug

SEQ ID NO: 2911121 - RNA, 14 nt, Human
gguugaagcaccaa

SEQ ID NO: 2911122 - RNA, 18 nt, Human
gguucuuucuuccucugc

SEQ ID NO: 2911123 - RNA, 23 nt, Human
gguucaagcgauucuucugcuuc

SEQ ID NO: 2911124 - RNA, 22 nt, Human
gguucaagcgauucuucugcuu

SEQ ID NO: 2911125 - RNA, 20 nt, Human
gguucacugcaaccuccgcc

SEQ ID NO: 2911126 - RNA, 21 nt, Human
gguucaagcgauucuucugcu

SEQ ID NO: 2911127 - RNA, 11 nt, Human
gguggccucag

SEQ ID NO: 2911128 - RNA, 12 nt, Human
gguggccucagc

SEQ ID NO: 2911129 - RNA, 19 nt, Human
gguggcccacgccuguaau

SEQ ID NO: 2911130 - RNA, 16 nt, Human
gguggcccgacagccu

SEQ ID NO: 2911131 - RNA, 17 nt, Human
gguggcccgacagccug

SEQ ID NO: 2911132 - RNA, 18 nt, Human
gguggcccgacagccugg

SEQ ID NO: 2911133 - RNA, 19 nt, Human
gguggcccgacagccuggc

SEQ ID NO: 2911134 - RNA, 20 nt, Human
gguggcccgacagccuggca

SEQ ID NO: 2911135 - RNA, 13 nt, Human
gguggcccugucc

SEQ ID NO: 2911136 - RNA, 23 nt, Human
gguggcccugucccucccaccuc

SEQ ID NO: 2911137 - RNA, 20 nt, Human
gguacuuuugagugugugug

SEQ ID NO: 2911138 - RNA, 17 nt, Human
gguacuuuuugugaaga

SEQ ID NO: 2911139 - RNA, 13 nt, Human
gguagaaaaacau

SEQ ID NO: 2911140 - RNA, 16 nt, Human
gguagaaaaaggguca

SEQ ID NO: 2911141 - RNA, 19 nt, Human
gguagaccaggauuucuaa

SEQ ID NO: 2911142 - RNA, 18 nt, Human
gguagaccuuuauugggu

SEQ ID NO: 2911143 - RNA, 16 nt, Human
ggucacagccuccucu

SEQ ID NO: 2911144 - RNA, 17 nt, Human
ggucacagccuccucug

SEQ ID NO: 2911145 - RNA, 14 nt, Human
ggucacacacugau

SEQ ID NO: 2911146 - RNA, 19 nt, Human
ggucacacgaccggggcca

SEQ ID NO: 2911147 - RNA, 13 nt, Human
ggucacagccucc

SEQ ID NO: 2911148 - RNA, 15 nt, Human
ggucacagccuccuc

SEQ ID NO: 2911149 - RNA, 13 nt, Human
ggucaaucccaaa

SEQ ID NO: 2911150 - RNA, 12 nt, Human
ggucaaugcuau

SEQ ID NO: 2911151 - RNA, 14 nt, Human
ggucaaugcuauuu

SEQ ID NO: 2911152 - RNA, 16 nt, Human
ggucaaugcuauuuuu

SEQ ID NO: 2911153 - RNA, 23 nt, Human
ggucaaugcuauuuuuguuuuua

SEQ ID NO: 2911154 - RNA, 22 nt, Human
ggucacaaauccuaaaagaagc

SEQ ID NO: 2911155 - RNA, 21 nt, Human
ggucaagggcuuacuauuucu

SEQ ID NO: 2911156 - RNA, 16 nt, Human
ggucagagccugcagu

SEQ ID NO: 2911157 - RNA, 15 nt, Human
ggucagagccugcag

SEQ ID NO: 2911158 - RNA, 14 nt, Human
ggucagagccugca

SEQ ID NO: 2911159 - RNA, 13 nt, Human
ggucagagccugc

SEQ ID NO: 2911160 - RNA, 12 nt, Human
ggucagagccug

SEQ ID NO: 2911161 - RNA, 12 nt, Human
gguccccagggc

SEQ ID NO: 2911162 - RNA, 13 nt, Human
ggucccccucagc

SEQ ID NO: 2911163 - RNA, 20 nt, Human
ggucccccucagcaagcccu

SEQ ID NO: 2911164 - RNA, 13 nt, Human
ggucccccugcag

SEQ ID NO: 2911165 - RNA, 15 nt, Human
ggucccccugcagcu

SEQ ID NO: 2911166 - RNA, 16 nt, Human
ggucccccugcagcua

SEQ ID NO: 2911167 - RNA, 15 nt, Human
ggucccagccacccc

SEQ ID NO: 2911168 - RNA, 14 nt, Human
ggucccaggcagag

SEQ ID NO: 2911169 - RNA, 16 nt, Human
gguccccaccugggac

SEQ ID NO: 2911170 - RNA, 14 nt, Human
ggucccacucaguc

SEQ ID NO: 2911171 - RNA, 12 nt, Human
ggucccacucag

SEQ ID NO: 2911172 - RNA, 22 nt, Human
ggucccacucaguccauagcag

SEQ ID NO: 2911173 - RNA, 14 nt, Human
ggucccagccaccc

SEQ ID NO: 2911174 - RNA, 22 nt, Human
ggucccacgaauuugcugggga

SEQ ID NO: 2911175 - RNA, 12 nt, Human
ggucccaccccu

SEQ ID NO: 2911176 - RNA, 16 nt, Human
ggucccaccuccagcc

SEQ ID NO: 2911177 - RNA, 17 nt, Human
ggucccaccuccagccc

SEQ ID NO: 2911178 - RNA, 22 nt, Human
ggucccaccuccagcccgggag

SEQ ID NO: 2911179 - RNA, 18 nt, Human
ggucagaggaccuguauu

SEQ ID NO: 2911180 - RNA, 19 nt, Human
ggucagaggaccuguauuu

SEQ ID NO: 2911181 - RNA, 20 nt, Human
ggucagaggaccuguauuua

SEQ ID NO: 2911182 - RNA, 23 nt, Human
ggucagaggagagauagccugug

SEQ ID NO: 2911183 - RNA, 21 nt, Human
gguacuuguggacacagcucu

SEQ ID NO: 2911184 - RNA, 22 nt, Human
gguacuuguggacacagcucuu

SEQ ID NO: 2911185 - RNA, 20 nt, Human
gguacuuguggacacagcuc

SEQ ID NO: 2911186 - RNA, 20 nt, Human
gguacuucaggggcacuuca

SEQ ID NO: 2911187 - RNA, 14 nt, Human
gguacgcacagaca

SEQ ID NO: 2911188 - RNA, 15 nt, Human
gguacgcacagacag

SEQ ID NO: 2911189 - RNA, 16 nt, Human
gguacgcacagacagg

SEQ ID NO: 2911190 - RNA, 13 nt, Human
gguacgugacccu

SEQ ID NO: 2911191 - RNA, 14 nt, Human
gguacuaaauuuaa

SEQ ID NO: 2911192 - RNA, 14 nt, Human
gguacccuccuggc

SEQ ID NO: 2911193 - RNA, 13 nt, Human
gguacccucugga

SEQ ID NO: 2911194 - RNA, 15 nt, Human
gguacucuuguugag

SEQ ID NO: 2911195 - RNA, 14 nt, Human
gguacuauauuugc

SEQ ID NO: 2911196 - RNA, 13 nt, Human
gguacuuagaguu

SEQ ID NO: 2911197 - RNA, 21 nt, Human
gguacuuagaguuucuguuug

SEQ ID NO: 2911198 - RNA, 15 nt, Human
ggguugggcuggugu

SEQ ID NO: 2911199 - RNA, 22 nt, Human
ggguugggcccagaucuggucc

SEQ ID NO: 2911200 - RNA, 14 nt, Human
ggguugggcccaga

SEQ ID NO: 2911201 - RNA, 12 nt, Human
ggguugggccca

SEQ ID NO: 2911202 - RNA, 15 nt, Human
ggguugugugucugu

SEQ ID NO: 2911203 - RNA, 15 nt, Human
ggguuggggccgggc

SEQ ID NO: 2911204 - RNA, 15 nt, Human
ggguuggggugacag

SEQ ID NO: 2911205 - RNA, 14 nt, Human
ggguuggugugcug

SEQ ID NO: 2911206 - RNA, 15 nt, Human
ggguuggugugcuga

SEQ ID NO: 2911207 - RNA, 16 nt, Human
gguacccacugcucug

SEQ ID NO: 2911208 - RNA, 20 nt, Human
ggguuucaccauguuggcca

SEQ ID NO: 2911209 - RNA, 17 nt, Human
gguacccacugcucugg

SEQ ID NO: 2911210 - RNA, 19 nt, Human
gguaccccuuucuggcucu

SEQ ID NO: 2911211 - RNA, 19 nt, Human
ggguagaguuuacagcucu

SEQ ID NO: 2911212 - RNA, 21 nt, Human
ggguggacaaacuggagucug

SEQ ID NO: 2911213 - RNA, 22 nt, Human
ggguuccagcaauucuccugcc

SEQ ID NO: 2911214 - RNA, 19 nt, Human
ggguuggccccugcccggc

SEQ ID NO: 2911215 - RNA, 22 nt, Human
ggguucuaggcaucucuguacu

SEQ ID NO: 2911216 - RNA, 14 nt, Human
ggguucuuucuucc

SEQ ID NO: 2911217 - RNA, 16 nt, Human
ggguuggccccugccc

SEQ ID NO: 2911218 - RNA, 15 nt, Human
ggguucugcugggac

SEQ ID NO: 2911219 - RNA, 12 nt, Human
ggguacuaaauu

SEQ ID NO: 2911220 - RNA, 16 nt, Human
ggguuccgcacuuucc

SEQ ID NO: 2911221 - RNA, 21 nt, Human
ggguucccuuuccuuccaucc

SEQ ID NO: 2911222 - RNA, 18 nt, Human
ggguucccuuuccuucca

SEQ ID NO: 2911223 - RNA, 20 nt, Human
ggugcuaaauggucgcccag

SEQ ID NO: 2911224 - RNA, 17 nt, Human
ggugcgggcaccuguag

SEQ ID NO: 2911225 - RNA, 14 nt, Human
ggugcgucugggag

SEQ ID NO: 2911226 - RNA, 19 nt, Human
ggugcgucugggagguugg

SEQ ID NO: 2911227 - RNA, 12 nt, Human
ggugcuaaaucu

SEQ ID NO: 2911228 - RNA, 15 nt, Human
ggugcgaucuggguu

SEQ ID NO: 2911229 - RNA, 20 nt, Human
ggugcucaccaugcuuccag

SEQ ID NO: 2911230 - RNA, 23 nt, Human
ggugcucagaauaaggcaggcau

SEQ ID NO: 2911231 - RNA, 22 nt, Human
ggugcuaaauggucgcccagga

SEQ ID NO: 2911232 - RNA, 21 nt, Human
ggugcuaaauggucgcccagg

SEQ ID NO: 2911233 - RNA, 23 nt, Human
ggugcuaaauggucgcccaggag

SEQ ID NO: 2911234 - RNA, 13 nt, Human
gguggcagcugcg

SEQ ID NO: 2911235 - RNA, 12 nt, Human
gguggcagcugc

SEQ ID NO: 2911236 - RNA, 11 nt, Human
gguggcagcug

SEQ ID NO: 2911237 - RNA, 23 nt, Human
gguggcagcugcgguccacccag

SEQ ID NO: 2911238 - RNA, 15 nt, Human
gguggcagcugcggu

SEQ ID NO: 2911239 - RNA, 15 nt, Human
ggugcuccaggcagg

SEQ ID NO: 2911240 - RNA, 15 nt, Human
gguggcaguggaggu

SEQ ID NO: 2911241 - RNA, 18 nt, Human
gguggcaguggagguggg

SEQ ID NO: 2911242 - RNA, 19 nt, Human
ggugcccuguucucuacca

SEQ ID NO: 2911243 - RNA, 15 nt, Human
ggugauaaggacaug

SEQ ID NO: 2911244 - RNA, 16 nt, Human
ggugauagcauugcuu

SEQ ID NO: 2911245 - RNA, 22 nt, Human
ggugauagguauaaguggugug

SEQ ID NO: 2911246 - RNA, 22 nt, Human
ggugcccagcuauaccugugcc

SEQ ID NO: 2911247 - RNA, 14 nt, Human
ggugaccucugccu

SEQ ID NO: 2911248 - RNA, 18 nt, Human
ggugaauggccuuccuuc

SEQ ID NO: 2911249 - RNA, 21 nt, Human
ggugacaaagauggcucagag

SEQ ID NO: 2911250 - RNA, 13 nt, Human
ggugacaagagcc

SEQ ID NO: 2911251 - RNA, 14 nt, Human
ggugacaagagccu

SEQ ID NO: 2911252 - RNA, 17 nt, Human
ggugacaagagccugau

SEQ ID NO: 2911253 - RNA, 13 nt, Human
ggugacagagcga

SEQ ID NO: 2911254 - RNA, 12 nt, Human
ggugacacagac

SEQ ID NO: 2911255 - RNA, 13 nt, Human
ggugacacagacu

SEQ ID NO: 2911256 - RNA, 14 nt, Human
ggugacacagacuc

SEQ ID NO: 2911257 - RNA, 15 nt, Human
ggugacacagacuca

SEQ ID NO: 2911258 - RNA, 20 nt, Human
ggugacacagacucauccug

SEQ ID NO: 2911259 - RNA, 16 nt, Human
ggugaccucugccuga

SEQ ID NO: 2911260 - RNA, 12 nt, Human
ggugaggccugu

SEQ ID NO: 2911261 - RNA, 17 nt, Human
ggugaggccugucugug

SEQ ID NO: 2911262 - RNA, 19 nt, Human
ggugaggccugucugugac

SEQ ID NO: 2911263 - RNA, 20 nt, Human
ggugaagagaaccgagcaaa

SEQ ID NO: 2911264 - RNA, 19 nt, Human
ggugaagaugggaacgcag

SEQ ID NO: 2911265 - RNA, 19 nt, Human
ggucugaggaauccagacc

SEQ ID NO: 2911266 - RNA, 22 nt, Human
ggucugagccacagcagcauuu

SEQ ID NO: 2911267 - RNA, 23 nt, Human
ggucugagccacagcagcauuuu

SEQ ID NO: 2911268 - RNA, 17 nt, Human
ggugaaccacuucauuc

SEQ ID NO: 2911269 - RNA, 18 nt, Human
ggugaaccacuucauucu

SEQ ID NO: 2911270 - RNA, 16 nt, Human
ggucucacucugucgc

SEQ ID NO: 2911271 - RNA, 12 nt, Human
ggucucacucug

SEQ ID NO: 2911272 - RNA, 21 nt, Human
ggucucacuauguugcccagg

SEQ ID NO: 2911273 - RNA, 16 nt, Human
ggucugacccacugcu

SEQ ID NO: 2911274 - RNA, 15 nt, Human
ggucugacccacugc

SEQ ID NO: 2911275 - RNA, 20 nt, Human
ggucucgaacuccugaccuu

SEQ ID NO: 2911276 - RNA, 19 nt, Human
ggucucgaacuccugaccu

SEQ ID NO: 2911277 - RNA, 16 nt, Human
gguccgguguucuaag

SEQ ID NO: 2911278 - RNA, 17 nt, Human
gguccgguguucuaaga

SEQ ID NO: 2911279 - RNA, 23 nt, Human
ggucccuugcagcuaguuuucua

SEQ ID NO: 2911280 - RNA, 17 nt, Human
gguccggacacuccuag

SEQ ID NO: 2911281 - RNA, 18 nt, Human
gguccggacacuccuaga

SEQ ID NO: 2911282 - RNA, 20 nt, Human
gguccggacacuccuagaga

SEQ ID NO: 2911283 - RNA, 21 nt, Human
gguccggacacuccuagagaa

SEQ ID NO: 2911284 - RNA, 21 nt, Human
gguccgguguucuaagaugug

SEQ ID NO: 2911285 - RNA, 16 nt, Human
gguccuaaaagcaaaa

SEQ ID NO: 2911286 - RNA, 18 nt, Human
gguccuaaaagcaaaaua

SEQ ID NO: 2911287 - RNA, 22 nt, Human
gguccuaauuaccagucuuuaa

SEQ ID NO: 2911288 - RNA, 22 nt, Human
ggucucacuauguugcccaggc

SEQ ID NO: 2911289 - RNA, 17 nt, Human
ggucccuccccuucucu

SEQ ID NO: 2911290 - RNA, 13 nt, Human
ggucccugccuua

SEQ ID NO: 2911291 - RNA, 14 nt, Human
ggucccugccuuag

SEQ ID NO: 2911292 - RNA, 20 nt, Human
ggucccuccagaaccacccc

SEQ ID NO: 2911293 - RNA, 15 nt, Human
ggguacauuuauaau

SEQ ID NO: 2911294 - RNA, 16 nt, Human
ggguaaugagaggugg

SEQ ID NO: 2911295 - RNA, 20 nt, Human
ggguaauuuagauuguaaac

SEQ ID NO: 2911296 - RNA, 13 nt, Human
ggguacagcuggg

SEQ ID NO: 2911297 - RNA, 15 nt, Human
ggguacagcugggcu

SEQ ID NO: 2911298 - RNA, 18 nt, Human
ggguacccacugcucugg

SEQ ID NO: 2911299 - RNA, 15 nt, Human
ggguacccacugcuc

SEQ ID NO: 2911300 - RNA, 13 nt, Human
ggguacccacugc

SEQ ID NO: 2911301 - RNA, 23 nt, Human
ggguacuuguggacacagcucuu

SEQ ID NO: 2911302 - RNA, 22 nt, Human
ggguacuuguggacacagcucu

SEQ ID NO: 2911303 - RNA, 19 nt, Human
ggguacuuguggacacagc

SEQ ID NO: 2911304 - RNA, 20 nt, Human
gggguucuuucuuccucugc

SEQ ID NO: 2911305 - RNA, 22 nt, Human
gggguucuuucuuccucugcug

SEQ ID NO: 2911306 - RNA, 15 nt, Human
ggggugcagcaguga

SEQ ID NO: 2911307 - RNA, 18 nt, Human
ggggugacggcccucauc

SEQ ID NO: 2911308 - RNA, 12 nt, Human
ggggugacacag

SEQ ID NO: 2911309 - RNA, 21 nt, Human
ggggugacagucaucaucagg

SEQ ID NO: 2911310 - RNA, 18 nt, Human
gggggaaggccaagggga

SEQ ID NO: 2911311 - RNA, 12 nt, Human
gggggaaugagc

SEQ ID NO: 2911312 - RNA, 16 nt, Human
gggggaaugagcccag

SEQ ID NO: 2911313 - RNA, 21 nt, Human
gggggaaugagcccagagaac

SEQ ID NO: 2911314 - RNA, 15 nt, Human
ggggcuuucuggaga

SEQ ID NO: 2911315 - RNA, 12 nt, Human
gggggaaagcac

SEQ ID NO: 2911316 - RNA, 17 nt, Human
gggggaacgaugugucu

SEQ ID NO: 2911317 - RNA, 18 nt, Human
gggggaacgaugugucug

SEQ ID NO: 2911318 - RNA, 11 nt, Human
ggggcuuggcg

SEQ ID NO: 2911319 - RNA, 19 nt, Human
ggggcuuggcguggagcag

SEQ ID NO: 2911320 - RNA, 20 nt, Human
ggggcuuucguccacagcuu

SEQ ID NO: 2911321 - RNA, 21 nt, Human
ggggcuuucguccacagcuuc

SEQ ID NO: 2911322 - RNA, 22 nt, Human
ggggcuuucguccacagcuucc

SEQ ID NO: 2911323 - RNA, 22 nt, Human
ggggcuuagggucggaacccaa

SEQ ID NO: 2911324 - RNA, 20 nt, Human
ggggcuuauaauaaaggacu

SEQ ID NO: 2911325 - RNA, 18 nt, Human
ggggcuguugaagucacc

SEQ ID NO: 2911326 - RNA, 11 nt, Human
ggggcugggcc

SEQ ID NO: 2911327 - RNA, 16 nt, Human
ggggcaggcugggcca

SEQ ID NO: 2911328 - RNA, 15 nt, Human
ggggcaggcugggcc

SEQ ID NO: 2911329 - RNA, 14 nt, Human
ggggcaggcugggc

SEQ ID NO: 2911330 - RNA, 13 nt, Human
ggggcaggcuggg

SEQ ID NO: 2911331 - RNA, 16 nt, Human
ggggcaggagggcccu

SEQ ID NO: 2911332 - RNA, 15 nt, Human
ggggcugcuggccug

SEQ ID NO: 2911333 - RNA, 18 nt, Human
ggggcugcccuugggcca

SEQ ID NO: 2911334 - RNA, 22 nt, Human
gggcugugcacccagaagaaga

SEQ ID NO: 2911335 - RNA, 18 nt, Human
ggggaugugggagggagc

SEQ ID NO: 2911336 - RNA, 14 nt, Human
ggggcagagccucc

SEQ ID NO: 2911337 - RNA, 15 nt, Human
ggggcagagccuccc

SEQ ID NO: 2911338 - RNA, 21 nt, Human
ggggcagccaaacccaugagg

SEQ ID NO: 2911339 - RNA, 20 nt, Human
ggggcagcugauacaaauug

SEQ ID NO: 2911340 - RNA, 20 nt, Human
ggggcagaucuuggacucau

SEQ ID NO: 2911341 - RNA, 20 nt, Human
ggggauaaaaugacuacuua

SEQ ID NO: 2911342 - RNA, 14 nt, Human
ggggaugugggagg

SEQ ID NO: 2911343 - RNA, 15 nt, Human
ggggaucauaaaguu

SEQ ID NO: 2911344 - RNA, 19 nt, Human
ggggaucauaaaguuagaa

SEQ ID NO: 2911345 - RNA, 20 nt, Human
ggggagggugacaguggccg

SEQ ID NO: 2911346 - RNA, 14 nt, Human
ggggagggugacag

SEQ ID NO: 2911347 - RNA, 15 nt, Human
ggggagucaccuucc

SEQ ID NO: 2911348 - RNA, 23 nt, Human
ggggaggaccugacccuacuccc

SEQ ID NO: 2911349 - RNA, 22 nt, Human
ggggagcuuggcugagggucug

SEQ ID NO: 2911350 - RNA, 18 nt, Human
ggggagccaaaaucucaa

SEQ ID NO: 2911351 - RNA, 18 nt, Human
gggcuucaguggcagcug

SEQ ID NO: 2911352 - RNA, 17 nt, Human
gggcuucaguggcagcu

SEQ ID NO: 2911353 - RNA, 16 nt, Human
gggcuucaguggcagc

SEQ ID NO: 2911354 - RNA, 15 nt, Human
gggcuucaguggcag

SEQ ID NO: 2911355 - RNA, 16 nt, Human
gggcuucacuguauaa

SEQ ID NO: 2911356 - RNA, 19 nt, Human
gggcuucagccuaguggcu

SEQ ID NO: 2911357 - RNA, 14 nt, Human
gggcuucagggcag

SEQ ID NO: 2911358 - RNA, 15 nt, Human
gggcuucagggcagg

SEQ ID NO: 2911359 - RNA, 17 nt, Human
gggcuucagggcaggug

SEQ ID NO: 2911360 - RNA, 19 nt, Human
gggcuucagggcagguggg

SEQ ID NO: 2911361 - RNA, 20 nt, Human
gggcuucaguggcagcugcu

SEQ ID NO: 2911362 - RNA, 19 nt, Human
gggcuucaguggcagcugc

SEQ ID NO: 2911363 - RNA, 14 nt, Human
gggcuuggcgugga

SEQ ID NO: 2911364 - RNA, 20 nt, Human
gggcuuggcguggagcaggc

SEQ ID NO: 2911365 - RNA, 20 nt, Human
gggcuucccaguggcugcug

SEQ ID NO: 2911366 - RNA, 21 nt, Human
gggcuucccaguggcugcugc

SEQ ID NO: 2911367 - RNA, 22 nt, Human
gggcuucccaguggcugcugcc

SEQ ID NO: 2911368 - RNA, 23 nt, Human
gggcuucccaguggcugcugccc

SEQ ID NO: 2911369 - RNA, 14 nt, Human
gggcuucaguggca

SEQ ID NO: 2911370 - RNA, 24 nt, Human
gggcuuagagcaguuucuguccug

SEQ ID NO: 2911371 - RNA, 14 nt, Human
gggcuuagagcagu

SEQ ID NO: 2911372 - RNA, 20 nt, Human
gggcuuauaauaaaggacug

SEQ ID NO: 2911373 - RNA, 12 nt, Human
gggcugugaucg

SEQ ID NO: 2911374 - RNA, 22 nt, Human
gggcuuaccuguacacugacuu

SEQ ID NO: 2911375 - RNA, 15 nt, Human
gggcuuaagaaaucu

SEQ ID NO: 2911376 - RNA, 13 nt, Human
gggcuuagagcag

SEQ ID NO: 2911377 - RNA, 21 nt, Human
gggcuguugaagucaccuugu

SEQ ID NO: 2911378 - RNA, 15 nt, Human
gggcuguuuagggga

SEQ ID NO: 2911379 - RNA, 22 nt, Human
gggcuguuuaggggaucuggaa

SEQ ID NO: 2911380 - RNA, 16 nt, Human
gggcucugugcugaca

SEQ ID NO: 2911381 - RNA, 16 nt, Human
gggcucuggagagaaa

SEQ ID NO: 2911382 - RNA, 13 nt, Human
gggcucuggagag

SEQ ID NO: 2911383 - RNA, 14 nt, Human
gggcucuggagaga

SEQ ID NO: 2911384 - RNA, 15 nt, Human
gggcucuggagagaa

SEQ ID NO: 2911385 - RNA, 21 nt, Human
gggcucugccccagcucuggc

SEQ ID NO: 2911386 - RNA, 15 nt, Human
gggcucugccccagu

SEQ ID NO: 2911387 - RNA, 20 nt, Human
gggcucugccccagcucugg

SEQ ID NO: 2911388 - RNA, 20 nt, Human
gggcugacuagaagggccag

SEQ ID NO: 2911389 - RNA, 23 nt, Human
gggcugagcuggggaccugguac

SEQ ID NO: 2911390 - RNA, 15 nt, Human
gggcugagcccuggc

SEQ ID NO: 2911391 - RNA, 13 nt, Human
gggcugagcccug

SEQ ID NO: 2911392 - RNA, 17 nt, Human
gggcugagcccuggcag

SEQ ID NO: 2911393 - RNA, 16 nt, Human
gggcugagcccuggca

SEQ ID NO: 2911394 - RNA, 18 nt, Human
gggcugagcccuggcagg

SEQ ID NO: 2911395 - RNA, 19 nt, Human
gggcucugccccagcucug

SEQ ID NO: 2911396 - RNA, 12 nt, Human
gggcucugcccc

SEQ ID NO: 2911397 - RNA, 13 nt, Human
gggcucugcccca

SEQ ID NO: 2911398 - RNA, 14 nt, Human
gggcucugccccag

SEQ ID NO: 2911399 - RNA, 11 nt, Human
gggcucugccc

SEQ ID NO: 2911400 - RNA, 19 nt, Human
gggcucucugcuguacaua

SEQ ID NO: 2911401 - RNA, 20 nt, Human
gggcucugcaauuccccucu

SEQ ID NO: 2911402 - RNA, 21 nt, Human
gggcucugcaauuccccucug

SEQ ID NO: 2911403 - RNA, 23 nt, Human
gggcucugcaauuccccucugcu

SEQ ID NO: 2911404 - RNA, 14 nt, Human
gggcuccugcaggc

SEQ ID NO: 2911405 - RNA, 12 nt, Human
gggcuccuccca

SEQ ID NO: 2911406 - RNA, 14 nt, Human
gggcuccucccagc

SEQ ID NO: 2911407 - RNA, 23 nt, Human
gggcuccuggaaaggcucagucu

SEQ ID NO: 2911408 - RNA, 20 nt, Human
gggcuccuggaaaggcucag

SEQ ID NO: 2911409 - RNA, 12 nt, Human
gggcuccuggaa

SEQ ID NO: 2911410 - RNA, 11 nt, Human
gggcuccugga

SEQ ID NO: 2911411 - RNA, 18 nt, Human
gggcuccuggcagaaggg

SEQ ID NO: 2911412 - RNA, 21 nt, Human
gggcuccuggggguggggagg

SEQ ID NO: 2911413 - RNA, 20 nt, Human
gggcuccuucuccaccccag

SEQ ID NO: 2911414 - RNA, 13 nt, Human
gggcucucagcuc

SEQ ID NO: 2911415 - RNA, 14 nt, Human
gggcucggaggcug

SEQ ID NO: 2911416 - RNA, 15 nt, Human
gggcucggaggcugc

SEQ ID NO: 2911417 - RNA, 18 nt, Human
gggcgcggccagccccgg

SEQ ID NO: 2911418 - RNA, 23 nt, Human
gggcgcggccagccccggcccug

SEQ ID NO: 2911419 - RNA, 18 nt, Human
gggcgaucgcggcggagc

SEQ ID NO: 2911420 - RNA, 12 nt, Human
gggcgaggcagg

SEQ ID NO: 2911421 - RNA, 22 nt, Human
gggcgccgcaaaccacacugga

SEQ ID NO: 2911422 - RNA, 15 nt, Human
gggcgcggccagccc

SEQ ID NO: 2911423 - RNA, 18 nt, Human
gggcgcgaucccacacag

SEQ ID NO: 2911424 - RNA, 22 nt, Human
gggcgaucgcggcggagcuggc

SEQ ID NO: 2911425 - RNA, 13 nt, Human
gggcgcccaccuc

SEQ ID NO: 2911426 - RNA, 21 nt, Human
gggcgcccaccuccccacgcc

SEQ ID NO: 2911427 - RNA, 17 nt, Human
gggccuuagugggccag

SEQ ID NO: 2911428 - RNA, 18 nt, Human
gggccuuagugggccagg

SEQ ID NO: 2911429 - RNA, 20 nt, Human
gggccuuagugggccagggc

SEQ ID NO: 2911430 - RNA, 22 nt, Human
gggccuuagugggccagggcug

SEQ ID NO: 2911431 - RNA, 16 nt, Human
gggccuguggaaugag

SEQ ID NO: 2911432 - RNA, 22 nt, Human
gggccuguggaaugagugugca

SEQ ID NO: 2911433 - RNA, 12 nt, Human
gggccuguacag

SEQ ID NO: 2911434 - RNA, 15 nt, Human
gggccuguacagucu

SEQ ID NO: 2911435 - RNA, 17 nt, Human
gggccuguacagucugu

SEQ ID NO: 2911436 - RNA, 19 nt, Human
gggccuguacagucugucu

SEQ ID NO: 2911437 - RNA, 21 nt, Human
gggccuguacagucugucuuc

SEQ ID NO: 2911438 - RNA, 15 nt, Human
gggccugguugaaga

SEQ ID NO: 2911439 - RNA, 14 nt, Human
gggccuguugcccu

SEQ ID NO: 2911440 - RNA, 12 nt, Human
gggccuguugcc

SEQ ID NO: 2911441 - RNA, 13 nt, Human
gggccuggcaggg

SEQ ID NO: 2911442 - RNA, 22 nt, Human
gggccuggcauucuuguacagu

SEQ ID NO: 2911443 - RNA, 22 nt, Human
gggccuggcagccgugccuuca

SEQ ID NO: 2911444 - RNA, 10 nt, Human
gggccuggca

SEQ ID NO: 2911445 - RNA, 21 nt, Human
gggcccuccgaccacuuccag

SEQ ID NO: 2911446 - RNA, 14 nt, Human
gggccuggaccugc

SEQ ID NO: 2911447 - RNA, 16 nt, Human
gggccuggaccugccu

SEQ ID NO: 2911448 - RNA, 13 nt, Human
gggccuggaccug

SEQ ID NO: 2911449 - RNA, 20 nt, Human
ggcucccacaggcccuuccu

SEQ ID NO: 2911450 - RNA, 21 nt, Human
ggcucccacaggcccuuccuc

SEQ ID NO: 2911451 - RNA, 13 nt, Human
guauuucagugua

SEQ ID NO: 2911452 - RNA, 21 nt, Human
guauuucaguguaguuaauuu

SEQ ID NO: 2911453 - RNA, 15 nt, Human
guauuucauguggcu

SEQ ID NO: 2911454 - RNA, 16 nt, Human
guauuucauguggcug

SEQ ID NO: 2911455 - RNA, 17 nt, Human
guauuucauguggcugu

SEQ ID NO: 2911456 - RNA, 18 nt, Human
guauuucauguggcugua

SEQ ID NO: 2911457 - RNA, 18 nt, Human
guauuuauugaagaaaca

SEQ ID NO: 2911458 - RNA, 22 nt, Human
guauuucuuauacgcuuuucuu

SEQ ID NO: 2911459 - RNA, 12 nt, Human
guauuuauuuug

SEQ ID NO: 2911460 - RNA, 13 nt, Human
guauuuauuuugu

SEQ ID NO: 2911461 - RNA, 15 nt, Human
guauuuauuuuguaa

SEQ ID NO: 2911462 - RNA, 16 nt, Human
guauuuauuuuguaau

SEQ ID NO: 2911463 - RNA, 17 nt, Human
guauuuauuuuguaauu

SEQ ID NO: 2911464 - RNA, 23 nt, Human
guauuuauuuuguaauuaugauu

SEQ ID NO: 2911465 - RNA, 15 nt, Human
guauuugggaaacuu

SEQ ID NO: 2911466 - RNA, 21 nt, Human
guauuugggaaacuugucacu

SEQ ID NO: 2911467 - RNA, 22 nt, Human
guauuugggaaacuugucacuu

SEQ ID NO: 2911468 - RNA, 13 nt, Human
guauuugcaguuc

SEQ ID NO: 2911469 - RNA, 18 nt, Human
guauuugauucaaaauau

SEQ ID NO: 2911470 - RNA, 19 nt, Human
guauuugauucaaaauauu

SEQ ID NO: 2911471 - RNA, 21 nt, Human
guauuugagaguucuaaauuu

SEQ ID NO: 2911472 - RNA, 19 nt, Human
guauuugagaguucuaaau

SEQ ID NO: 2911473 - RNA, 14 nt, Human
guauuugaaacuga

SEQ ID NO: 2911474 - RNA, 14 nt, Human
guauuugaauuaaa

SEQ ID NO: 2911475 - RNA, 18 nt, Human
guauuugaauuaaaacuu

SEQ ID NO: 2911476 - RNA, 21 nt, Human
guauuugaauuaaaacuucuu

SEQ ID NO: 2911477 - RNA, 22 nt, Human
guauuugaauuaaaacuucuua

SEQ ID NO: 2911478 - RNA, 23 nt, Human
guauuugaauuaaaacuucuuaa

SEQ ID NO: 2911479 - RNA, 14 nt, Human
guauuuauuuaugu

SEQ ID NO: 2911480 - RNA, 21 nt, Human
guauuuauuuaaaagauucau

SEQ ID NO: 2911481 - RNA, 16 nt, Human
guauuuauuuauguac

SEQ ID NO: 2911482 - RNA, 13 nt, Human
guauuuauuuaaa

SEQ ID NO: 2911483 - RNA, 14 nt, Human
guauuuauuuaaaa

SEQ ID NO: 2911484 - RNA, 18 nt, Human
guauuuauuuaaaagauu

SEQ ID NO: 2911485 - RNA, 19 nt, Human
guauuuauuuaguauuuau

SEQ ID NO: 2911486 - RNA, 11 nt, Human
guauuuauuca

SEQ ID NO: 2911487 - RNA, 12 nt, Human
guauuccccuuc

SEQ ID NO: 2911488 - RNA, 16 nt, Human
guauuccccuucccac

SEQ ID NO: 2911489 - RNA, 14 nt, Human
guauuccugccucc

SEQ ID NO: 2911490 - RNA, 21 nt, Human
guauuagugauauuucucuag

SEQ ID NO: 2911491 - RNA, 22 nt, Human
guauuagugauauuucucuagu

SEQ ID NO: 2911492 - RNA, 14 nt, Human
guauuauucuacua

SEQ ID NO: 2911493 - RNA, 12 nt, Human
guauuauugcug

SEQ ID NO: 2911494 - RNA, 14 nt, Human
guauuauugcuguu

SEQ ID NO: 2911495 - RNA, 17 nt, Human
guauuauugcuguugcu

SEQ ID NO: 2911496 - RNA, 20 nt, Human
guauuauugcuguugcuuga

SEQ ID NO: 2911497 - RNA, 12 nt, Human
guauuauuuaua

SEQ ID NO: 2911498 - RNA, 19 nt, Human
guauucaaaaauuaucuau

SEQ ID NO: 2911499 - RNA, 15 nt, Human
guauuacuucugcua

SEQ ID NO: 2911500 - RNA, 14 nt, Human
guauuacuucugcu

SEQ ID NO: 2911501 - RNA, 13 nt, Human
guauuacuucugc

SEQ ID NO: 2911502 - RNA, 23 nt, Human
guauuacccaagaaguaaagaug

SEQ ID NO: 2911503 - RNA, 22 nt, Human
guauuacacuguauuuguaucu

SEQ ID NO: 2911504 - RNA, 13 nt, Human
guauuacacugua

SEQ ID NO: 2911505 - RNA, 14 nt, Human
guagagguuuuguu

SEQ ID NO: 2911506 - RNA, 14 nt, Human
guauuuguucaugu

SEQ ID NO: 2911507 - RNA, 15 nt, Human
guauuuguucauguu

SEQ ID NO: 2911508 - RNA, 16 nt, Human
guauuuguucauguuu

SEQ ID NO: 2911509 - RNA, 17 nt, Human
guauuuguucauguuug

SEQ ID NO: 2911510 - RNA, 18 nt, Human
guauuuguucauguuugg

SEQ ID NO: 2911511 - RNA, 22 nt, Human
guauuuguucauguuuggugca

SEQ ID NO: 2911512 - RNA, 20 nt, Human
guauuugggaagugaagacu

SEQ ID NO: 2911513 - RNA, 19 nt, Human
gucaagagggucugaggaa

SEQ ID NO: 2911514 - RNA, 18 nt, Human
gucaagagggucugagga

SEQ ID NO: 2911515 - RNA, 12 nt, Human
gucaagaagaaa

SEQ ID NO: 2911516 - RNA, 15 nt, Human
gucaagaagaaaaag

SEQ ID NO: 2911517 - RNA, 17 nt, Human
gucaacuucaacauuua

SEQ ID NO: 2911518 - RNA, 20 nt, Human
gucaccugaagacucauucu

SEQ ID NO: 2911519 - RNA, 15 nt, Human
gucaccuagcaagcu

SEQ ID NO: 2911520 - RNA, 16 nt, Human
gucaccuagcaagcug

SEQ ID NO: 2911521 - RNA, 19 nt, Human
gucaccuagcaagcugccg

SEQ ID NO: 2911522 - RNA, 16 nt, Human
gucacccuccaccucu

SEQ ID NO: 2911523 - RNA, 14 nt, Human
gucacccuagcccu

SEQ ID NO: 2911524 - RNA, 20 nt, Human
gucacccuagcccucucccu

SEQ ID NO: 2911525 - RNA, 22 nt, Human
gucacccuagcccucucccucu

SEQ ID NO: 2911526 - RNA, 23 nt, Human
gucaccaucuuaagagaugccuc

SEQ ID NO: 2911527 - RNA, 20 nt, Human
gucacccaggcuggagugca

SEQ ID NO: 2911528 - RNA, 16 nt, Human
gucaccccaaguaguc

SEQ ID NO: 2911529 - RNA, 23 nt, Human
gucaccccaaguagucugcucac

SEQ ID NO: 2911530 - RNA, 13 nt, Human
gucaccccagagc

SEQ ID NO: 2911531 - RNA, 14 nt, Human
gucaccccagagcc

SEQ ID NO: 2911532 - RNA, 15 nt, Human
gucaccccagagcca

SEQ ID NO: 2911533 - RNA, 17 nt, Human
gucaccccagagccaca

SEQ ID NO: 2911534 - RNA, 18 nt, Human
gucaccccagagccacac

SEQ ID NO: 2911535 - RNA, 19 nt, Human
gucaccccagagccacaca

SEQ ID NO: 2911536 - RNA, 20 nt, Human
gucaccccagagccacacau

SEQ ID NO: 2911537 - RNA, 21 nt, Human
gucaccccagagccacacaug

SEQ ID NO: 2911538 - RNA, 17 nt, Human
gucaaguuccuuugggu

SEQ ID NO: 2911539 - RNA, 16 nt, Human
gucaagugggaucugu

SEQ ID NO: 2911540 - RNA, 14 nt, Human
gucaagugggaucu

SEQ ID NO: 2911541 - RNA, 22 nt, Human
gucaaugcuauuuuuguuuuua

SEQ ID NO: 2911542 - RNA, 17 nt, Human
gucaagaguaguuauau

SEQ ID NO: 2911543 - RNA, 21 nt, Human
gucccagccaccccgggcucu

SEQ ID NO: 2911544 - RNA, 18 nt, Human
gucccagccaccccgggc

SEQ ID NO: 2911545 - RNA, 14 nt, Human
gucccagcuacucg

SEQ ID NO: 2911546 - RNA, 22 nt, Human
gucccagcuacucagaagccug

SEQ ID NO: 2911547 - RNA, 23 nt, Human
gucccagccaccccgggcucucu

SEQ ID NO: 2911548 - RNA, 16 nt, Human
gucccagccaccccgg

SEQ ID NO: 2911549 - RNA, 15 nt, Human
gucccagccaccccg

SEQ ID NO: 2911550 - RNA, 14 nt, Human
gucccagccacccc

SEQ ID NO: 2911551 - RNA, 19 nt, Human
gucccacuuggcaucagcu

SEQ ID NO: 2911552 - RNA, 12 nt, Human
gucccacugugc

SEQ ID NO: 2911553 - RNA, 14 nt, Human
gucccacugugcag

SEQ ID NO: 2911554 - RNA, 14 nt, Human
gucccacucagucc

SEQ ID NO: 2911555 - RNA, 15 nt, Human
gucccacucagucca

SEQ ID NO: 2911556 - RNA, 20 nt, Human
guccagggaagcuggccgag

SEQ ID NO: 2911557 - RNA, 15 nt, Human
guccagggaagcugg

SEQ ID NO: 2911558 - RNA, 13 nt, Human
guccagggaagcu

SEQ ID NO: 2911559 - RNA, 14 nt, Human
guccaggcacagga

SEQ ID NO: 2911560 - RNA, 15 nt, Human
guccaggcacaggau

SEQ ID NO: 2911561 - RNA, 16 nt, Human
guccacccaggagccc

SEQ ID NO: 2911562 - RNA, 15 nt, Human
guccacccaggagcc

SEQ ID NO: 2911563 - RNA, 13 nt, Human
guccacccaggag

SEQ ID NO: 2911564 - RNA, 23 nt, Human
gucauguuggucaaaagcuggau

SEQ ID NO: 2911565 - RNA, 16 nt, Human
gucauguguucccuuu

SEQ ID NO: 2911566 - RNA, 18 nt, Human
gucauguguucccuuugu

SEQ ID NO: 2911567 - RNA, 23 nt, Human
gucauguguucccuuugucuuuc

SEQ ID NO: 2911568 - RNA, 14 nt, Human
guccacccaggagc

SEQ ID NO: 2911569 - RNA, 21 nt, Human
gucaugguuucuuggagggcc

SEQ ID NO: 2911570 - RNA, 15 nt, Human
gucauguaaauacug

SEQ ID NO: 2911571 - RNA, 16 nt, Human
gucauguaaauacugu

SEQ ID NO: 2911572 - RNA, 19 nt, Human
gucauguaaauacuguugg

SEQ ID NO: 2911573 - RNA, 20 nt, Human
gucaugguuacaaacuacag

SEQ ID NO: 2911574 - RNA, 15 nt, Human
gucaugugacaggua

SEQ ID NO: 2911575 - RNA, 12 nt, Human
gucauguggcua

SEQ ID NO: 2911576 - RNA, 17 nt, Human
gucaugugggucuucca

SEQ ID NO: 2911577 - RNA, 18 nt, Human
gucaugugggucuuccag

SEQ ID NO: 2911578 - RNA, 20 nt, Human
gucaugugggucuuccaggg

SEQ ID NO: 2911579 - RNA, 21 nt, Human
gucaugugggucuuccagggg

SEQ ID NO: 2911580 - RNA, 12 nt, Human
gucaugcuucau

SEQ ID NO: 2911581 - RNA, 12 nt, Human
gucauggccaca

SEQ ID NO: 2911582 - RNA, 13 nt, Human
gucauggccacac

SEQ ID NO: 2911583 - RNA, 15 nt, Human
gucauggccacacug

SEQ ID NO: 2911584 - RNA, 16 nt, Human
gucauggccacacugu

SEQ ID NO: 2911585 - RNA, 17 nt, Human
gucauggccacacugug

SEQ ID NO: 2911586 - RNA, 18 nt, Human
gucauggccacacuguga

SEQ ID NO: 2911587 - RNA, 20 nt, Human
gucauggccacacugugaca

SEQ ID NO: 2911588 - RNA, 21 nt, Human
gucauggccacacugugacac

SEQ ID NO: 2911589 - RNA, 22 nt, Human
gucauggccacacugugacaca

SEQ ID NO: 2911590 - RNA, 18 nt, Human
guccagcuggccuggaca

SEQ ID NO: 2911591 - RNA, 17 nt, Human
guccagcuggccuggac

SEQ ID NO: 2911592 - RNA, 14 nt, Human
guccagcuggccug

SEQ ID NO: 2911593 - RNA, 13 nt, Human
guccagcuggccu

SEQ ID NO: 2911594 - RNA, 12 nt, Human
guccagcuggcc

SEQ ID NO: 2911595 - RNA, 19 nt, Human
guccagcuggccuggacag

SEQ ID NO: 2911596 - RNA, 13 nt, Human
guccaggagccug

SEQ ID NO: 2911597 - RNA, 12 nt, Human
guccaggaacaa

SEQ ID NO: 2911598 - RNA, 15 nt, Human
guccaggaacaagcu

SEQ ID NO: 2911599 - RNA, 18 nt, Human
guccaggaacaagcuaau

SEQ ID NO: 2911600 - RNA, 23 nt, Human
guccacuguguauagaaguagau

SEQ ID NO: 2911601 - RNA, 14 nt, Human
guccacuguguaua

SEQ ID NO: 2911602 - RNA, 23 nt, Human
gucaucuuucuuuucuuugaguc

SEQ ID NO: 2911603 - RNA, 12 nt, Human
guccagaaaugg

SEQ ID NO: 2911604 - RNA, 17 nt, Human
gucaucugauuggacag

SEQ ID NO: 2911605 - RNA, 19 nt, Human
gucaucugauuggacaggc

SEQ ID NO: 2911606 - RNA, 14 nt, Human
gucaugaagcccaa

SEQ ID NO: 2911607 - RNA, 20 nt, Human
gucaugaauucuuaugcuua

SEQ ID NO: 2911608 - RNA, 15 nt, Human
gucaugauggcacca

SEQ ID NO: 2911609 - RNA, 16 nt, Human
gucaugcaaaggcugg

SEQ ID NO: 2911610 - RNA, 17 nt, Human
gucaugcaaaggcuggg

SEQ ID NO: 2911611 - RNA, 18 nt, Human
gucaugcaaaggcuggga

SEQ ID NO: 2911612 - RNA, 13 nt, Human
gucaugcauaaau

SEQ ID NO: 2911613 - RNA, 14 nt, Human
gucaugcauaaaua

SEQ ID NO: 2911614 - RNA, 17 nt, Human
gucaugcauaaauaugc

SEQ ID NO: 2911615 - RNA, 18 nt, Human
gucaugcauaaauaugca

SEQ ID NO: 2911616 - RNA, 19 nt, Human
gucaugcauaaauaugcag

SEQ ID NO: 2911617 - RNA, 12 nt, Human
gucaugcaugaa

SEQ ID NO: 2911618 - RNA, 17 nt, Human
gucaucaggagaaaaag

SEQ ID NO: 2911619 - RNA, 14 nt, Human
gucaucaucagggc

SEQ ID NO: 2911620 - RNA, 15 nt, Human
gucaucaucagggcc

SEQ ID NO: 2911621 - RNA, 16 nt, Human
gucaucaucagggccu

SEQ ID NO: 2911622 - RNA, 17 nt, Human
gucaucaucagggccug

SEQ ID NO: 2911623 - RNA, 18 nt, Human
gucaucaucagggccugg

SEQ ID NO: 2911624 - RNA, 20 nt, Human
gucaucaucagggccugggg

SEQ ID NO: 2911625 - RNA, 21 nt, Human
gucaucaucagggccuggggc

SEQ ID NO: 2911626 - RNA, 23 nt, Human
gucaucaucagggccuggggccu

SEQ ID NO: 2911627 - RNA, 23 nt, Human
gucaucuagcgcaauugaaggau

SEQ ID NO: 2911628 - RNA, 22 nt, Human
gucauccuuggucuuuguaucu

SEQ ID NO: 2911629 - RNA, 23 nt, Human
gucaucgcucguguguucuaucc

SEQ ID NO: 2911630 - RNA, 23 nt, Human
gucaucugaauuugcccugggaa

SEQ ID NO: 2911631 - RNA, 16 nt, Human
gucaucucagcuggau

SEQ ID NO: 2911632 - RNA, 17 nt, Human
gucauauacugccaugu

SEQ ID NO: 2911633 - RNA, 22 nt, Human
gucauauacugccauguacuag

SEQ ID NO: 2911634 - RNA, 16 nt, Human
gucauauguuaagcag

SEQ ID NO: 2911635 - RNA, 23 nt, Human
gucaucaauaguguccuaugcaa

SEQ ID NO: 2911636 - RNA, 17 nt, Human
gucaucaauguauuugu

SEQ ID NO: 2911637 - RNA, 15 nt, Human
gucaucacuuuucag

SEQ ID NO: 2911638 - RNA, 17 nt, Human
gucaucacuuuucagug

SEQ ID NO: 2911639 - RNA, 20 nt, Human
gucaucagagcuccucuguc

SEQ ID NO: 2911640 - RNA, 16 nt, Human
gucaucacuuuucagu

SEQ ID NO: 2911641 - RNA, 14 nt, Human
gucaucagccacca

SEQ ID NO: 2911642 - RNA, 22 nt, Human
gucauagaaauuacacccaaag

SEQ ID NO: 2911643 - RNA, 13 nt, Human
gucauagaaauua

SEQ ID NO: 2911644 - RNA, 22 nt, Human
gucagccuucccccucccaggg

SEQ ID NO: 2911645 - RNA, 21 nt, Human
gucagcgcagguuuaguuuac

SEQ ID NO: 2911646 - RNA, 21 nt, Human
gucagcgccuggccuacccag

SEQ ID NO: 2911647 - RNA, 19 nt, Human
gucaccuuccaggaccccu

SEQ ID NO: 2911648 - RNA, 13 nt, Human
gucaccuucccuu

SEQ ID NO: 2911649 - RNA, 17 nt, Human
gucaccuucccuugcca

SEQ ID NO: 2911650 - RNA, 16 nt, Human
gucagcaauuuaacua

SEQ ID NO: 2911651 - RNA, 22 nt, Human
gucacguggaggagcagugcag

SEQ ID NO: 2911652 - RNA, 16 nt, Human
gucacguacugucuga

SEQ ID NO: 2911653 - RNA, 23 nt, Human
gucacgugcgcugggcacuuccc

SEQ ID NO: 2911654 - RNA, 15 nt, Human
gucagccaggagcug

SEQ ID NO: 2911655 - RNA, 20 nt, Human
gucagccaggagcugucacc

SEQ ID NO: 2911656 - RNA, 13 nt, Human
gucagccauugca

SEQ ID NO: 2911657 - RNA, 23 nt, Human
gucagccauugcacccagcccag

SEQ ID NO: 2911658 - RNA, 16 nt, Human
gucuacacugcaauca

SEQ ID NO: 2911659 - RNA, 19 nt, Human
gucuacacugcaaucauau

SEQ ID NO: 2911660 - RNA, 21 nt, Human
gucuacacugcaaucauaugu

SEQ ID NO: 2911661 - RNA, 22 nt, Human
gucuacacugcaaucauaugug

SEQ ID NO: 2911662 - RNA, 22 nt, Human
gucuaauuaaaacacuuucaaa

SEQ ID NO: 2911663 - RNA, 22 nt, Human
gucuaauugcaucucaaaauua

SEQ ID NO: 2911664 - RNA, 15 nt, Human
gucuacaaauauaag

SEQ ID NO: 2911665 - RNA, 20 nt, Human
gucuacaaauauaagauuuu

SEQ ID NO: 2911666 - RNA, 23 nt, Human
gucuaagauaguaacaaugaaga

SEQ ID NO: 2911667 - RNA, 21 nt, Human
gucuaaacaaugcugauuugg

SEQ ID NO: 2911668 - RNA, 20 nt, Human
gucuaaagauggaguuucua

SEQ ID NO: 2911669 - RNA, 21 nt, Human
gucuaaagauggaguuucuaa

SEQ ID NO: 2911670 - RNA, 12 nt, Human
gucuaagauucu

SEQ ID NO: 2911671 - RNA, 13 nt, Human
gucuaagauucua

SEQ ID NO: 2911672 - RNA, 14 nt, Human
gucuaagauucuag

SEQ ID NO: 2911673 - RNA, 15 nt, Human
gucuaagauucuaga

SEQ ID NO: 2911674 - RNA, 16 nt, Human
gucuaagauucuagau

SEQ ID NO: 2911675 - RNA, 18 nt, Human
gucuaagauucuagauca

SEQ ID NO: 2911676 - RNA, 19 nt, Human
guccugugagguuucccaa

SEQ ID NO: 2911677 - RNA, 20 nt, Human
guccugugagguuucccaau

SEQ ID NO: 2911678 - RNA, 15 nt, Human
guccugugaucuuau

SEQ ID NO: 2911679 - RNA, 20 nt, Human
guccugugaucuuauuuuuc

SEQ ID NO: 2911680 - RNA, 22 nt, Human
guccugugaucuuauuuuucua

SEQ ID NO: 2911681 - RNA, 19 nt, Human
guccuuaaaaaucacacug

SEQ ID NO: 2911682 - RNA, 22 nt, Human
guccuuaaaaaucacacuguaa

SEQ ID NO: 2911683 - RNA, 14 nt, Human
gucgugggugugug

SEQ ID NO: 2911684 - RNA, 16 nt, Human
gucuaaacaaugcuga

SEQ ID NO: 2911685 - RNA, 11 nt, Human
gucuaaaacuc

SEQ ID NO: 2911686 - RNA, 12 nt, Human
gucuaaaaacac

SEQ ID NO: 2911687 - RNA, 12 nt, Human
gucguuuuccaa

SEQ ID NO: 2911688 - RNA, 17 nt, Human
gucguuuuccaaacuga

SEQ ID NO: 2911689 - RNA, 18 nt, Human
gucucagacuuuuguaca

SEQ ID NO: 2911690 - RNA, 19 nt, Human
gucucagacuuuuguacau

SEQ ID NO: 2911691 - RNA, 20 nt, Human
gucucagacuuuuguacauc

SEQ ID NO: 2911692 - RNA, 23 nt, Human
gucucacuguugcccaggcuggc

SEQ ID NO: 2911693 - RNA, 22 nt, Human
gucucacuguugcccaggcugg

SEQ ID NO: 2911694 - RNA, 21 nt, Human
gucucacuguugcccaggcug

SEQ ID NO: 2911695 - RNA, 20 nt, Human
gucucacuguugcccaggcu

SEQ ID NO: 2911696 - RNA, 19 nt, Human
gucucacuguugcccaggc

SEQ ID NO: 2911697 - RNA, 18 nt, Human
gucucacuguugcccagg

SEQ ID NO: 2911698 - RNA, 17 nt, Human
gucucacuguugcccag

SEQ ID NO: 2911699 - RNA, 16 nt, Human
gucucacuguugccca

SEQ ID NO: 2911700 - RNA, 23 nt, Human
gucucacuauguugcccaggcag

SEQ ID NO: 2911701 - RNA, 13 nt, Human
gucucacuguugc

SEQ ID NO: 2911702 - RNA, 21 nt, Human
gucucacuauguugcccaggc

SEQ ID NO: 2911703 - RNA, 20 nt, Human
gucucacuauguugcccagg

SEQ ID NO: 2911704 - RNA, 19 nt, Human
gucugauucccaagcucug

SEQ ID NO: 2911705 - RNA, 18 nt, Human
gucugauucccaagcucu

SEQ ID NO: 2911706 - RNA, 17 nt, Human
gucugauucccaagcuc

SEQ ID NO: 2911707 - RNA, 21 nt, Human
gucugaggaauccagacccgg

SEQ ID NO: 2911708 - RNA, 15 nt, Human
gucugagccacagca

SEQ ID NO: 2911709 - RNA, 16 nt, Human
gucugagccacagcag

SEQ ID NO: 2911710 - RNA, 20 nt, Human
gucugagccacagcagcauu

SEQ ID NO: 2911711 - RNA, 21 nt, Human
gucugagccacagcagcauuu

SEQ ID NO: 2911712 - RNA, 22 nt, Human
gucugagccacagcagcauuuu

SEQ ID NO: 2911713 - RNA, 21 nt, Human
gucugauucccaagcucugcu

SEQ ID NO: 2911714 - RNA, 20 nt, Human
gucugauucccaagcucugc

SEQ ID NO: 2911715 - RNA, 13 nt, Human
gucugauuggcuu

SEQ ID NO: 2911716 - RNA, 14 nt, Human
gucugauuggcuug

SEQ ID NO: 2911717 - RNA, 18 nt, Human
gucugauuggcuuguaga

SEQ ID NO: 2911718 - RNA, 19 nt, Human
gucugauuggcuuguagaa

SEQ ID NO: 2911719 - RNA, 22 nt, Human
gucugauuggcuuguagaauug

SEQ ID NO: 2911720 - RNA, 18 nt, Human
gucugauggaucccgaag

SEQ ID NO: 2911721 - RNA, 19 nt, Human
gucugcagauagaaagcau

SEQ ID NO: 2911722 - RNA, 11 nt, Human
gucugcagccc

SEQ ID NO: 2911723 - RNA, 18 nt, Human
gucugccaauuuuugccu

SEQ ID NO: 2911724 - RNA, 21 nt, Human
gucugccaauuuuugccuuca

SEQ ID NO: 2911725 - RNA, 12 nt, Human
gucugcagcccu

SEQ ID NO: 2911726 - RNA, 13 nt, Human
gucugcagcccug

SEQ ID NO: 2911727 - RNA, 15 nt, Human
gucugcagcccugag

SEQ ID NO: 2911728 - RNA, 19 nt, Human
gucugaggaauccagaccc

SEQ ID NO: 2911729 - RNA, 18 nt, Human
gucugaggaauccagacc

SEQ ID NO: 2911730 - RNA, 15 nt, Human
gucugacccacugcu

SEQ ID NO: 2911731 - RNA, 17 nt, Human
gucucuucuccacugga

SEQ ID NO: 2911732 - RNA, 14 nt, Human
gucugacccacugc

SEQ ID NO: 2911733 - RNA, 13 nt, Human
gucugacccacug

SEQ ID NO: 2911734 - RNA, 15 nt, Human
gucucuucuccacug

SEQ ID NO: 2911735 - RNA, 16 nt, Human
gucucuucuccacugg

SEQ ID NO: 2911736 - RNA, 14 nt, Human
gucucuucuccacu

SEQ ID NO: 2911737 - RNA, 16 nt, Human
gucucggacuaagccu

SEQ ID NO: 2911738 - RNA, 23 nt, Human
gucucgcuuuguugcccaggcug

SEQ ID NO: 2911739 - RNA, 19 nt, Human
gucucgcuuuguugcccag

SEQ ID NO: 2911740 - RNA, 17 nt, Human
gucucgcuuuguugccc

SEQ ID NO: 2911741 - RNA, 16 nt, Human
gucucgcuuuguugcc

SEQ ID NO: 2911742 - RNA, 23 nt, Human
gucucuaugccagcucaguccca

SEQ ID NO: 2911743 - RNA, 17 nt, Human
gucucuaugccagcuca

SEQ ID NO: 2911744 - RNA, 20 nt, Human
gucucuguugacuggcugug

SEQ ID NO: 2911745 - RNA, 14 nt, Human
gucucucccucagg

SEQ ID NO: 2911746 - RNA, 15 nt, Human
gucucucccucaggu

SEQ ID NO: 2911747 - RNA, 21 nt, Human
gucucuccuguaagccaaaga

SEQ ID NO: 2911748 - RNA, 11 nt, Human
gucucuccuuu

SEQ ID NO: 2911749 - RNA, 12 nt, Human
gucucuccuuuu

SEQ ID NO: 2911750 - RNA, 14 nt, Human
gucucuccuuuucu

SEQ ID NO: 2911751 - RNA, 15 nt, Human
gucucuccuuuucuu

SEQ ID NO: 2911752 - RNA, 19 nt, Human
gucucuccuuuucuuuugu

SEQ ID NO: 2911753 - RNA, 20 nt, Human
gucucuccuuuucuuuuguu

SEQ ID NO: 2911754 - RNA, 22 nt, Human
gucucuccuuuucuuuuguuac

SEQ ID NO: 2911755 - RNA, 23 nt, Human
gucucuccuuuucuuuuguuacu

SEQ ID NO: 2911756 - RNA, 16 nt, Human
gucucuauuucauuuu

SEQ ID NO: 2911757 - RNA, 15 nt, Human
guccugugaauuucu

SEQ ID NO: 2911758 - RNA, 21 nt, Human
guccuguaguugcguggacuc

SEQ ID NO: 2911759 - RNA, 23 nt, Human
guccuguaguugcguggacucug

SEQ ID NO: 2911760 - RNA, 20 nt, Human
guccuguaguuuuauuuuau

SEQ ID NO: 2911761 - RNA, 22 nt, Human
guccuguaguuuuauuuuaugu

SEQ ID NO: 2911762 - RNA, 15 nt, Human
guccuguaugucugu

SEQ ID NO: 2911763 - RNA, 18 nt, Human
guccuguaugucugucau

SEQ ID NO: 2911764 - RNA, 20 nt, Human
guccuggggaaccugacccc

SEQ ID NO: 2911765 - RNA, 19 nt, Human
guccuggggaaccugaccc

SEQ ID NO: 2911766 - RNA, 15 nt, Human
guccuggggcucugu

SEQ ID NO: 2911767 - RNA, 17 nt, Human
guccuggggcucugugc

SEQ ID NO: 2911768 - RNA, 16 nt, Human
guccuggggcucugug

SEQ ID NO: 2911769 - RNA, 18 nt, Human
guccugggagugagcugg

SEQ ID NO: 2911770 - RNA, 17 nt, Human
guccugggagugagcug

SEQ ID NO: 2911771 - RNA, 19 nt, Human
guccugggagugagcuggu

SEQ ID NO: 2911772 - RNA, 18 nt, Human
guccucccauccccugga

SEQ ID NO: 2911773 - RNA, 19 nt, Human
guccucccauccccuggac

SEQ ID NO: 2911774 - RNA, 20 nt, Human
guccucccauccccuggacu

SEQ ID NO: 2911775 - RNA, 21 nt, Human
guccucccauccccuggacug

SEQ ID NO: 2911776 - RNA, 15 nt, Human
guccuccccucacag

SEQ ID NO: 2911777 - RNA, 12 nt, Human
guccuccccuca

SEQ ID NO: 2911778 - RNA, 16 nt, Human
guccuccccucacagc

SEQ ID NO: 2911779 - RNA, 11 nt, Human
guccuccccuc

SEQ ID NO: 2911780 - RNA, 21 nt, Human
guccuccccucacagccucug

SEQ ID NO: 2911781 - RNA, 22 nt, Human
guccuccccucacagccucuga

SEQ ID NO: 2911782 - RNA, 17 nt, Human
guccuccccucacagcc

SEQ ID NO: 2911783 - RNA, 18 nt, Human
guccuccccucacagccu

SEQ ID NO: 2911784 - RNA, 19 nt, Human
guccuccccucacagccuc

SEQ ID NO: 2911785 - RNA, 20 nt, Human
guccuccccucacagccucu

SEQ ID NO: 2911786 - RNA, 16 nt, Human
guccucccauccccug

SEQ ID NO: 2911787 - RNA, 17 nt, Human
guccucccauccccugg

SEQ ID NO: 2911788 - RNA, 22 nt, Human
guccuccaucccaacagccaug

SEQ ID NO: 2911789 - RNA, 23 nt, Human
guccuccaucccaacagccaugc

SEQ ID NO: 2911790 - RNA, 21 nt, Human
guccuggccagauggcccgga

SEQ ID NO: 2911791 - RNA, 22 nt, Human
guccuggccagauggcccggau

SEQ ID NO: 2911792 - RNA, 16 nt, Human
guccugggagugagcu

SEQ ID NO: 2911793 - RNA, 15 nt, Human
guccugggagugagc

SEQ ID NO: 2911794 - RNA, 11 nt, Human
guccuggcucc

SEQ ID NO: 2911795 - RNA, 17 nt, Human
guccuggcuccugaggg

SEQ ID NO: 2911796 - RNA, 14 nt, Human
guccuggcuccuga

SEQ ID NO: 2911797 - RNA, 21 nt, Human
guccugggagaaccucaggcu

SEQ ID NO: 2911798 - RNA, 17 nt, Human
guccugggagacccaug

SEQ ID NO: 2911799 - RNA, 20 nt, Human
guccugggagaaccucaggc

SEQ ID NO: 2911800 - RNA, 19 nt, Human
guccugggagaaccucagg

SEQ ID NO: 2911801 - RNA, 19 nt, Human
guccuggcuccugaggggc

SEQ ID NO: 2911802 - RNA, 15 nt, Human
guccuggcuucaggc

SEQ ID NO: 2911803 - RNA, 23 nt, Human
guccuacucugugucaggugggg

SEQ ID NO: 2911804 - RNA, 15 nt, Human
guccuacucuguguc

SEQ ID NO: 2911805 - RNA, 13 nt, Human
guccuacucugug

SEQ ID NO: 2911806 - RNA, 21 nt, Human
gucccaggcugagccucaguc

SEQ ID NO: 2911807 - RNA, 17 nt, Human
gucccagguuaucuggg

SEQ ID NO: 2911808 - RNA, 17 nt, Human
gucccagucucuggcag

SEQ ID NO: 2911809 - RNA, 14 nt, Human
gucccugggccagg

SEQ ID NO: 2911810 - RNA, 17 nt, Human
gucccugggccaggguc

SEQ ID NO: 2911811 - RNA, 18 nt, Human
gucccugggccagggucu

SEQ ID NO: 2911812 - RNA, 19 nt, Human
gucccugggccagggucug

SEQ ID NO: 2911813 - RNA, 16 nt, Human
gucccauaggcccagu

SEQ ID NO: 2911814 - RNA, 18 nt, Human
gucccauaggcccaguga

SEQ ID NO: 2911815 - RNA, 13 nt, Human
guccuauguguga

SEQ ID NO: 2911816 - RNA, 17 nt, Human
guccucacucccagucc

SEQ ID NO: 2911817 - RNA, 16 nt, Human
guccucacucccaguc

SEQ ID NO: 2911818 - RNA, 14 nt, Human
guccucacucccag

SEQ ID NO: 2911819 - RNA, 23 nt, Human
guccucaccccuguccucacugc

SEQ ID NO: 2911820 - RNA, 13 nt, Human
guccucaccacau

SEQ ID NO: 2911821 - RNA, 14 nt, Human
guccucaccccugu

SEQ ID NO: 2911822 - RNA, 15 nt, Human
guccucaccccuguc

SEQ ID NO: 2911823 - RNA, 17 nt, Human
guccucaccccuguccu

SEQ ID NO: 2911824 - RNA, 20 nt, Human
guccucaccccuguccucac

SEQ ID NO: 2911825 - RNA, 21 nt, Human
guccucaccccuguccucacu

SEQ ID NO: 2911826 - RNA, 22 nt, Human
guccucaccccuguccucacug

SEQ ID NO: 2911827 - RNA, 18 nt, Human
guccuaucuaucuuccaa

SEQ ID NO: 2911828 - RNA, 16 nt, Human
guccuaugaaugcuuu

SEQ ID NO: 2911829 - RNA, 19 nt, Human
guccuaugaaugcuuugca

SEQ ID NO: 2911830 - RNA, 20 nt, Human
guccuaugaaugcuuugcau

SEQ ID NO: 2911831 - RNA, 13 nt, Human
guccuaugcaaua

SEQ ID NO: 2911832 - RNA, 14 nt, Human
guccuaugcaauaa

SEQ ID NO: 2911833 - RNA, 15 nt, Human
guccuaugcaauaaa

SEQ ID NO: 2911834 - RNA, 16 nt, Human
guccuaugcaauaaaa

SEQ ID NO: 2911835 - RNA, 20 nt, Human
guccuaugcaauaaaauuau

SEQ ID NO: 2911836 - RNA, 21 nt, Human
guccuaugcaauaaaauuauu

SEQ ID NO: 2911837 - RNA, 13 nt, Human
guccuauggaaac

SEQ ID NO: 2911838 - RNA, 23 nt, Human
guccuagcuugggaggcuucccc

SEQ ID NO: 2911839 - RNA, 22 nt, Human
guccuaggccacaccaucuccu

SEQ ID NO: 2911840 - RNA, 18 nt, Human
guccuagccacucaggag

SEQ ID NO: 2911841 - RNA, 19 nt, Human
guccuagccacucaggagg

SEQ ID NO: 2911842 - RNA, 15 nt, Human
guccucaguccauuu

SEQ ID NO: 2911843 - RNA, 16 nt, Human
guccucaguccauuua

SEQ ID NO: 2911844 - RNA, 18 nt, Human
guccucaguccauuuaua

SEQ ID NO: 2911845 - RNA, 17 nt, Human
guccucauucaaaggga

SEQ ID NO: 2911846 - RNA, 15 nt, Human
guccucauuucucca

SEQ ID NO: 2911847 - RNA, 17 nt, Human
guccucauuucuccaga

SEQ ID NO: 2911848 - RNA, 14 nt, Human
guccuccaagccag

SEQ ID NO: 2911849 - RNA, 18 nt, Human
guccuccacacaagggaa

SEQ ID NO: 2911850 - RNA, 22 nt, Human
guccucagggagcagggaaggc

SEQ ID NO: 2911851 - RNA, 22 nt, Human
guccuccagaagccucuggcua

SEQ ID NO: 2911852 - RNA, 21 nt, Human
guccuccagaagccucuggcu

SEQ ID NO: 2911853 - RNA, 20 nt, Human
guccuccagaagccucuggc

SEQ ID NO: 2911854 - RNA, 19 nt, Human
guccuccagaagccucugg

SEQ ID NO: 2911855 - RNA, 18 nt, Human
guccuccagaagccucug

SEQ ID NO: 2911856 - RNA, 14 nt, Human
guccuccagaagcc

SEQ ID NO: 2911857 - RNA, 13 nt, Human
guccuccagaagc

SEQ ID NO: 2911858 - RNA, 16 nt, Human
guccucagggagcagg

SEQ ID NO: 2911859 - RNA, 13 nt, Human
guccucagggagc

SEQ ID NO: 2911860 - RNA, 18 nt, Human
guccucacucccagucca

SEQ ID NO: 2911861 - RNA, 18 nt, Human
guccucacugcucccuga

SEQ ID NO: 2911862 - RNA, 19 nt, Human
guccucacugcucccugaa

SEQ ID NO: 2911863 - RNA, 20 nt, Human
guccucagagaauuucuacc

SEQ ID NO: 2911864 - RNA, 20 nt, Human
guccucacugcucccugaag

SEQ ID NO: 2911865 - RNA, 21 nt, Human
guccucacugcucccugaagc

SEQ ID NO: 2911866 - RNA, 17 nt, Human
gugcaaauggaagacaa

SEQ ID NO: 2911867 - RNA, 19 nt, Human
gugcaaaugucagauacaa

SEQ ID NO: 2911868 - RNA, 23 nt, Human
gugcaaaugucagauacaaugua

SEQ ID NO: 2911869 - RNA, 22 nt, Human
gugcaaaguucccuacuuccug

SEQ ID NO: 2911870 - RNA, 23 nt, Human
gugcagggaggagguggcagccc

SEQ ID NO: 2911871 - RNA, 20 nt, Human
gugcagggagggcaguuuuc

SEQ ID NO: 2911872 - RNA, 16 nt, Human
gugcaggcuggccagc

SEQ ID NO: 2911873 - RNA, 17 nt, Human
gugcaggcuggccagcc

SEQ ID NO: 2911874 - RNA, 18 nt, Human
gugcaggcuggccagccg

SEQ ID NO: 2911875 - RNA, 20 nt, Human
gugcaggcuggccagccgcu

SEQ ID NO: 2911876 - RNA, 15 nt, Human
gugcaacagacaagu

SEQ ID NO: 2911877 - RNA, 14 nt, Human
gugcaacagacaag

SEQ ID NO: 2911878 - RNA, 13 nt, Human
gugcaacagacaa

SEQ ID NO: 2911879 - RNA, 18 nt, Human
gugcaggugcuauuguua

SEQ ID NO: 2911880 - RNA, 15 nt, Human
gugcaucucagccca

SEQ ID NO: 2911881 - RNA, 22 nt, Human
gugccagguuuuuggucugacc

SEQ ID NO: 2911882 - RNA, 20 nt, Human
gugccagguuuuuggucuga

SEQ ID NO: 2911883 - RNA, 14 nt, Human
gugcaucucagccc

SEQ ID NO: 2911884 - RNA, 18 nt, Human
gugcaucucagcccacau

SEQ ID NO: 2911885 - RNA, 15 nt, Human
gugcaguaauagcac

SEQ ID NO: 2911886 - RNA, 19 nt, Human
gugcaugcgccuacucgcu

SEQ ID NO: 2911887 - RNA, 18 nt, Human
gugcaugcagcaucuaag

SEQ ID NO: 2911888 - RNA, 20 nt, Human
gugcccacaggaucagucug

SEQ ID NO: 2911889 - RNA, 17 nt, Human
gugcccagaacuucccu

SEQ ID NO: 2911890 - RNA, 19 nt, Human
gugcccagaacuucccuga

SEQ ID NO: 2911891 - RNA, 20 nt, Human
gugcccagaacuucccugau

SEQ ID NO: 2911892 - RNA, 23 nt, Human
gugcccacccugggagacagacc

SEQ ID NO: 2911893 - RNA, 22 nt, Human
gugcccagcuauaccugugccu

SEQ ID NO: 2911894 - RNA, 21 nt, Human
gugcccagcuauaccugugcc

SEQ ID NO: 2911895 - RNA, 20 nt, Human
gugcccagcuauaccugugc

SEQ ID NO: 2911896 - RNA, 18 nt, Human
gugcccagcccggaccuu

SEQ ID NO: 2911897 - RNA, 23 nt, Human
gugccauagaguuuaacacaagu

SEQ ID NO: 2911898 - RNA, 21 nt, Human
gugcccacaccggggacaggc

SEQ ID NO: 2911899 - RNA, 17 nt, Human
gugccauagucacaugg

SEQ ID NO: 2911900 - RNA, 23 nt, Human
gugcccaagaauagaugcugacu

SEQ ID NO: 2911901 - RNA, 18 nt, Human
gugccagucuugugucug

SEQ ID NO: 2911902 - RNA, 17 nt, Human
gugccagucaagaagaa

SEQ ID NO: 2911903 - RNA, 21 nt, Human
gugccccaugccuguccagcc

SEQ ID NO: 2911904 - RNA, 14 nt, Human
gugcccucgcugcu

SEQ ID NO: 2911905 - RNA, 15 nt, Human
gugcccucgcugcuu

SEQ ID NO: 2911906 - RNA, 18 nt, Human
gugccccaugccugucca

SEQ ID NO: 2911907 - RNA, 16 nt, Human
gugccccaugccuguc

SEQ ID NO: 2911908 - RNA, 23 nt, Human
gugcccagcuauaccugugccuc

SEQ ID NO: 2911909 - RNA, 20 nt, Human
gugauccacccaccucagcc

SEQ ID NO: 2911910 - RNA, 18 nt, Human
gugauccacccaccucag

SEQ ID NO: 2911911 - RNA, 15 nt, Human
gugauccacccaccu

SEQ ID NO: 2911912 - RNA, 11 nt, Human
gugaggagcug

SEQ ID NO: 2911913 - RNA, 23 nt, Human
gugaggauuaaauaauguaaaua

SEQ ID NO: 2911914 - RNA, 14 nt, Human
gugaggagcugcug

SEQ ID NO: 2911915 - RNA, 21 nt, Human
gugaggacaaauugagacagu

SEQ ID NO: 2911916 - RNA, 17 nt, Human
gugaggagccccaucug

SEQ ID NO: 2911917 - RNA, 21 nt, Human
gugaggagccccaucugucua

SEQ ID NO: 2911918 - RNA, 18 nt, Human
gugauccucccaccucag

SEQ ID NO: 2911919 - RNA, 15 nt, Human
gugauccucccaccu

SEQ ID NO: 2911920 - RNA, 14 nt, Human
gugauccucccacc

SEQ ID NO: 2911921 - RNA, 14 nt, Human
gugauccacucgcc

SEQ ID NO: 2911922 - RNA, 22 nt, Human
gugauccucccaccucagccuc

SEQ ID NO: 2911923 - RNA, 20 nt, Human
gugauccucccaccucagcc

SEQ ID NO: 2911924 - RNA, 12 nt, Human
gugagcugggca

SEQ ID NO: 2911925 - RNA, 23 nt, Human
gugauccacccaacccuaucucc

SEQ ID NO: 2911926 - RNA, 20 nt, Human
gugauucacagugugaaucu

SEQ ID NO: 2911927 - RNA, 20 nt, Human
gugauccgcccgccucggcc

SEQ ID NO: 2911928 - RNA, 22 nt, Human
gugauucuccugccucagccuc

SEQ ID NO: 2911929 - RNA, 20 nt, Human
gugauucuccugccucagcc

SEQ ID NO: 2911930 - RNA, 19 nt, Human
gugauucuccugccucagc

SEQ ID NO: 2911931 - RNA, 18 nt, Human
gugauucuccugccucag

SEQ ID NO: 2911932 - RNA, 17 nt, Human
gugauucuccugccuca

SEQ ID NO: 2911933 - RNA, 16 nt, Human
gugauucuccugccuc

SEQ ID NO: 2911934 - RNA, 14 nt, Human
gugauucuccugcc

SEQ ID NO: 2911935 - RNA, 16 nt, Human
gugauucuaaugucuu

SEQ ID NO: 2911936 - RNA, 21 nt, Human
gugauuccuaagccacuugaa

SEQ ID NO: 2911937 - RNA, 20 nt, Human
gugauucucaugccucagcc

SEQ ID NO: 2911938 - RNA, 23 nt, Human
gugauucuccugccucagccucc

SEQ ID NO: 2911939 - RNA, 13 nt, Human
gugauucuccugc

SEQ ID NO: 2911940 - RNA, 23 nt, Human
gugauuguggaauggagauucag

SEQ ID NO: 2911941 - RNA, 19 nt, Human
gugauuguggaauggagau

SEQ ID NO: 2911942 - RNA, 14 nt, Human
gugauuguggaaug

SEQ ID NO: 2911943 - RNA, 16 nt, Human
gugauugggacagagg

SEQ ID NO: 2911944 - RNA, 12 nt, Human
gugauugcagcu

SEQ ID NO: 2911945 - RNA, 13 nt, Human
gugauugcagcuu

SEQ ID NO: 2911946 - RNA, 18 nt, Human
gugauugcagcuuuaugu

SEQ ID NO: 2911947 - RNA, 19 nt, Human
gugauugcagcuuuauguu

SEQ ID NO: 2911948 - RNA, 22 nt, Human
gugauugcagcuuuauguucau

SEQ ID NO: 2911949 - RNA, 13 nt, Human
gugaaaccuuuuu

SEQ ID NO: 2911950 - RNA, 14 nt, Human
gugaaaccuuuuuu

SEQ ID NO: 2911951 - RNA, 17 nt, Human
gugaaaccuuuuuuaag

SEQ ID NO: 2911952 - RNA, 18 nt, Human
gugaaaccuuuuuuaaga

SEQ ID NO: 2911953 - RNA, 19 nt, Human
gugaaaccuuuuuuaagau

SEQ ID NO: 2911954 - RNA, 21 nt, Human
gugaaaccuuuuuuaagauuu

SEQ ID NO: 2911955 - RNA, 22 nt, Human
gugaaaccuuuuuuaagauuuu

SEQ ID NO: 2911956 - RNA, 17 nt, Human
gugaaagcauauggguu

SEQ ID NO: 2911957 - RNA, 17 nt, Human
gugaaagcugagaacuc

SEQ ID NO: 2911958 - RNA, 20 nt, Human
gugaaagcugagaacuccug

SEQ ID NO: 2911959 - RNA, 21 nt, Human
gugaaagcugagaacuccuga

SEQ ID NO: 2911960 - RNA, 15 nt, Human
gugaaaacggagcug

SEQ ID NO: 2911961 - RNA, 12 nt, Human
gugaaaaucuug

SEQ ID NO: 2911962 - RNA, 16 nt, Human
gugaaaaugugugugu

SEQ ID NO: 2911963 - RNA, 17 nt, Human
gugaaaccugugaagcu

SEQ ID NO: 2911964 - RNA, 13 nt, Human
gugaaacacagcu

SEQ ID NO: 2911965 - RNA, 14 nt, Human
gugaaacacagcug

SEQ ID NO: 2911966 - RNA, 15 nt, Human
gugaaacacagcugu

SEQ ID NO: 2911967 - RNA, 16 nt, Human
gugaaacacagcuguu

SEQ ID NO: 2911968 - RNA, 14 nt, Human
gugaaaauguacug

SEQ ID NO: 2911969 - RNA, 14 nt, Human
gugaaugugggcac

SEQ ID NO: 2911970 - RNA, 23 nt, Human
gugaaugugggcacuggcccagg

SEQ ID NO: 2911971 - RNA, 21 nt, Human
gugaauuaauuaaacauugug

SEQ ID NO: 2911972 - RNA, 14 nt, Human
gugaaucagagcac

SEQ ID NO: 2911973 - RNA, 18 nt, Human
gugaauaugccuguaauu

SEQ ID NO: 2911974 - RNA, 22 nt, Human
gugaauaugccuguaauucagu

SEQ ID NO: 2911975 - RNA, 17 nt, Human
gugaaaguacauuugga

SEQ ID NO: 2911976 - RNA, 21 nt, Human
gugaaagucagaugcccagag

SEQ ID NO: 2911977 - RNA, 15 nt, Human
gugaaagugaggaaa

SEQ ID NO: 2911978 - RNA, 21 nt, Human
gugaaagggagcuaucaggaa

SEQ ID NO: 2911979 - RNA, 17 nt, Human
gugaaauaacaaaaugg

SEQ ID NO: 2911980 - RNA, 19 nt, Human
gugaaauaacaaaauggac

SEQ ID NO: 2911981 - RNA, 16 nt, Human
gucucucacagaugug

SEQ ID NO: 2911982 - RNA, 17 nt, Human
gugaaaucaaaggugcu

SEQ ID NO: 2911983 - RNA, 15 nt, Human
gugaaauggauacua

SEQ ID NO: 2911984 - RNA, 19 nt, Human
gugaaauggauacuacauc

SEQ ID NO: 2911985 - RNA, 16 nt, Human
gugaaauggccaggau

SEQ ID NO: 2911986 - RNA, 21 nt, Human
gugaaauuuauuaguuaauau

SEQ ID NO: 2911987 - RNA, 18 nt, Human
gugaaauuucuagccugc

SEQ ID NO: 2911988 - RNA, 22 nt, Human
gugaaauuucuagccugcacuu

SEQ ID NO: 2911989 - RNA, 22 nt, Human
gugaaauuuucuugauuugagu

SEQ ID NO: 2911990 - RNA, 20 nt, Human
gugacugguuaucacaccau

SEQ ID NO: 2911991 - RNA, 17 nt, Human
gugagcaggcugugagu

SEQ ID NO: 2911992 - RNA, 16 nt, Human
gugacucuuuuuaggg

SEQ ID NO: 2911993 - RNA, 18 nt, Human
gugacucuuuuuagggcc

SEQ ID NO: 2911994 - RNA, 20 nt, Human
gugacucuuuuuagggccag

SEQ ID NO: 2911995 - RNA, 22 nt, Human
gugacucuuuuuagggccaggc

SEQ ID NO: 2911996 - RNA, 13 nt, Human
gugagccacugca

SEQ ID NO: 2911997 - RNA, 21 nt, Human
gugagccaccgugccuggcca

SEQ ID NO: 2911998 - RNA, 17 nt, Human
gugagccaccgugccug

SEQ ID NO: 2911999 - RNA, 15 nt, Human
gugagccaccacgcc

SEQ ID NO: 2912000 - RNA, 15 nt, Human
gugagccaccgugcc

SEQ ID NO: 2912001 - RNA, 16 nt, Human
gugagccaccacgccc

SEQ ID NO: 2912002 - RNA, 22 nt, Human
gugagccaccgugccuggccac

SEQ ID NO: 2912003 - RNA, 15 nt, Human
gugagcuacagagcc

SEQ ID NO: 2912004 - RNA, 18 nt, Human
gugaggaaagcacacagu

SEQ ID NO: 2912005 - RNA, 13 nt, Human
gugaccuguuuau

SEQ ID NO: 2912006 - RNA, 23 nt, Human
gugaccugccccgcccagcugca

SEQ ID NO: 2912007 - RNA, 20 nt, Human
gugacucgagucacacucaa

SEQ ID NO: 2912008 - RNA, 16 nt, Human
gugacaacacuugugu

SEQ ID NO: 2912009 - RNA, 18 nt, Human
gugacaaaauuuuauaag

SEQ ID NO: 2912010 - RNA, 20 nt, Human
gugacaaaauuuuauaagca

SEQ ID NO: 2912011 - RNA, 12 nt, Human
gugacaaaccau

SEQ ID NO: 2912012 - RNA, 16 nt, Human
gugacaaaccauccag

SEQ ID NO: 2912013 - RNA, 23 nt, Human
gugacaaaccauccaguggaggu

SEQ ID NO: 2912014 - RNA, 19 nt, Human
gugacaaagauggcucaga

SEQ ID NO: 2912015 - RNA, 17 nt, Human
gugaauuuuuuuuuccu

SEQ ID NO: 2912016 - RNA, 14 nt, Human
gugacaagagccug

SEQ ID NO: 2912017 - RNA, 21 nt, Human
gugacaagcagauacugcugu

SEQ ID NO: 2912018 - RNA, 21 nt, Human
gugacccucugcugaagacuu

SEQ ID NO: 2912019 - RNA, 12 nt, Human
gugacccuuccc

SEQ ID NO: 2912020 - RNA, 23 nt, Human
gugacccuucccaaucagcacug

SEQ ID NO: 2912021 - RNA, 12 nt, Human
gugaccucaggc

SEQ ID NO: 2912022 - RNA, 16 nt, Human
gugaccucagcuuuga

SEQ ID NO: 2912023 - RNA, 13 nt, Human
gugaccugagggc

SEQ ID NO: 2912024 - RNA, 18 nt, Human
gugaccuccacagcuacc

SEQ ID NO: 2912025 - RNA, 19 nt, Human
gugaccucaggcacuagcc

SEQ ID NO: 2912026 - RNA, 13 nt, Human
gugcuuguuuuau

SEQ ID NO: 2912027 - RNA, 20 nt, Human
gugcuuguuuuauaaaauuu

SEQ ID NO: 2912028 - RNA, 14 nt, Human
gugcuuuaaagaua

SEQ ID NO: 2912029 - RNA, 20 nt, Human
gugcuuguucccucucccug

SEQ ID NO: 2912030 - RNA, 13 nt, Human
gugcuuguguaau

SEQ ID NO: 2912031 - RNA, 14 nt, Human
gugcuuguguaauu

SEQ ID NO: 2912032 - RNA, 17 nt, Human
gugcuuguguaauuuau

SEQ ID NO: 2912033 - RNA, 18 nt, Human
gugcuuguguaauuuaug

SEQ ID NO: 2912034 - RNA, 16 nt, Human
gugcuugccacagagc

SEQ ID NO: 2912035 - RNA, 17 nt, Human
gugcuuuuccuauuugu

SEQ ID NO: 2912036 - RNA, 19 nt, Human
gugcuuuuccuauuuguuu

SEQ ID NO: 2912037 - RNA, 12 nt, Human
guggaaaaacac

SEQ ID NO: 2912038 - RNA, 15 nt, Human
gugcuuuuaaaugca

SEQ ID NO: 2912039 - RNA, 23 nt, Human
guggaaagccucugcugccaugg

SEQ ID NO: 2912040 - RNA, 15 nt, Human
guggaaagccucugc

SEQ ID NO: 2912041 - RNA, 14 nt, Human
guggaaagccucug

SEQ ID NO: 2912042 - RNA, 13 nt, Human
gugcuuaaguucc

SEQ ID NO: 2912043 - RNA, 14 nt, Human
gugcuuaaguucca

SEQ ID NO: 2912044 - RNA, 21 nt, Human
gugcugccauuugauuuuucu

SEQ ID NO: 2912045 - RNA, 12 nt, Human
gugcugugugcc

SEQ ID NO: 2912046 - RNA, 19 nt, Human
gugcuguggccugggcaag

SEQ ID NO: 2912047 - RNA, 16 nt, Human
gugcugcccugaagaa

SEQ ID NO: 2912048 - RNA, 11 nt, Human
gugcugcccug

SEQ ID NO: 2912049 - RNA, 21 nt, Human
gugcugccacacuucaggcuc

SEQ ID NO: 2912050 - RNA, 22 nt, Human
gugcugccauccagguucagcu

SEQ ID NO: 2912051 - RNA, 16 nt, Human
gugcuucuccccagaa

SEQ ID NO: 2912052 - RNA, 17 nt, Human
gugcuucuccccagaau

SEQ ID NO: 2912053 - RNA, 21 nt, Human
gugcuucuccccagaauucac

SEQ ID NO: 2912054 - RNA, 22 nt, Human
gugcuucacaguagagccagcu

SEQ ID NO: 2912055 - RNA, 13 nt, Human
gugcuucagccug

SEQ ID NO: 2912056 - RNA, 18 nt, Human
gugcuucagccugaggcu

SEQ ID NO: 2912057 - RNA, 15 nt, Human
gugcuucagccugag

SEQ ID NO: 2912058 - RNA, 15 nt, Human
gugcuucaauuaaua

SEQ ID NO: 2912059 - RNA, 18 nt, Human
gugcuuauguaugaggua

SEQ ID NO: 2912060 - RNA, 22 nt, Human
gugcugaacaaaaaauaaaaau

SEQ ID NO: 2912061 - RNA, 18 nt, Human
gugcucuggacaggcaug

SEQ ID NO: 2912062 - RNA, 17 nt, Human
gugcucuggacaggcau

SEQ ID NO: 2912063 - RNA, 14 nt, Human
gugccgacagaagg

SEQ ID NO: 2912064 - RNA, 15 nt, Human
gugccgacagaagga

SEQ ID NO: 2912065 - RNA, 16 nt, Human
gugcucuggacaggca

SEQ ID NO: 2912066 - RNA, 15 nt, Human
gugcucuggacaggc

SEQ ID NO: 2912067 - RNA, 14 nt, Human
gugccuuuuauagc

SEQ ID NO: 2912068 - RNA, 18 nt, Human
gugccuuuuauagcuauu

SEQ ID NO: 2912069 - RNA, 17 nt, Human
gugccuuugcaaaucag

SEQ ID NO: 2912070 - RNA, 18 nt, Human
gugccuuuauguauuugc

SEQ ID NO: 2912071 - RNA, 12 nt, Human
gugccuuucaaa

SEQ ID NO: 2912072 - RNA, 13 nt, Human
gugccuuucaaau

SEQ ID NO: 2912073 - RNA, 18 nt, Human
gugccuuucaaauuuaga

SEQ ID NO: 2912074 - RNA, 21 nt, Human
gugcugacauggcucuggacu

SEQ ID NO: 2912075 - RNA, 19 nt, Human
gugcugccauccagguuca

SEQ ID NO: 2912076 - RNA, 18 nt, Human
gugcugccauccagguuc

SEQ ID NO: 2912077 - RNA, 15 nt, Human
gugcugccauccagg

SEQ ID NO: 2912078 - RNA, 12 nt, Human
gugcugccacac

SEQ ID NO: 2912079 - RNA, 15 nt, Human
gugcugauccuugca

SEQ ID NO: 2912080 - RNA, 14 nt, Human
gugcugaguagaug

SEQ ID NO: 2912081 - RNA, 20 nt, Human
gugcugaguagaugcgcagc

SEQ ID NO: 2912082 - RNA, 14 nt, Human
gugcugagauuaca

SEQ ID NO: 2912083 - RNA, 15 nt, Human
guggagaagcacacu

SEQ ID NO: 2912084 - RNA, 24 nt, Human
guggagaagcacacucuggucuug

SEQ ID NO: 2912085 - RNA, 22 nt, Human
guggagaaauuccuugauucac

SEQ ID NO: 2912086 - RNA, 15 nt, Human
guggacuugaacuuu

SEQ ID NO: 2912087 - RNA, 16 nt, Human
guggacuugaacuuuc

SEQ ID NO: 2912088 - RNA, 19 nt, Human
guggacuugaacuuuccug

SEQ ID NO: 2912089 - RNA, 13 nt, Human
guggacuuuuauu

SEQ ID NO: 2912090 - RNA, 21 nt, Human
guggacuguggcacuugccug

SEQ ID NO: 2912091 - RNA, 14 nt, Human
guggacuguggcac

SEQ ID NO: 2912092 - RNA, 22 nt, Human
guggacuguggcacuugccugg

SEQ ID NO: 2912093 - RNA, 16 nt, Human
guggacuuagaaagca

SEQ ID NO: 2912094 - RNA, 18 nt, Human
guggacuuagaaagcagg

SEQ ID NO: 2912095 - RNA, 19 nt, Human
guggacuuagaaagcaggg

SEQ ID NO: 2912096 - RNA, 20 nt, Human
guggacuuagaaagcagggg

SEQ ID NO: 2912097 - RNA, 22 nt, Human
guggacuuagaaagcaggggcu

SEQ ID NO: 2912098 - RNA, 17 nt, Human
guggacuggccccuggg

SEQ ID NO: 2912099 - RNA, 16 nt, Human
guggacuggccccugg

SEQ ID NO: 2912100 - RNA, 21 nt, Human
guggaaccacugacuacuggc

SEQ ID NO: 2912101 - RNA, 16 nt, Human
guggaacuaauaaaua

SEQ ID NO: 2912102 - RNA, 13 nt, Human
guggaacccagca

SEQ ID NO: 2912103 - RNA, 14 nt, Human
guggaaccucuguc

SEQ ID NO: 2912104 - RNA, 15 nt, Human
guggaaccucugucu

SEQ ID NO: 2912105 - RNA, 17 nt, Human
guggaaccucugucuca

SEQ ID NO: 2912106 - RNA, 20 nt, Human
guggaaccucugucucaucc

SEQ ID NO: 2912107 - RNA, 24 nt, Human
guggaaccucugucucauccuccu

SEQ ID NO: 2912108 - RNA, 19 nt, Human
guggaacauaaaaaggaca

SEQ ID NO: 2912109 - RNA, 21 nt, Human
guggaacauaaaaaggacauc

SEQ ID NO: 2912110 - RNA, 20 nt, Human
guggaacauaaaaaggacau

SEQ ID NO: 2912111 - RNA, 16 nt, Human
guggagagcuggugcc

SEQ ID NO: 2912112 - RNA, 14 nt, Human
guggagagcuggug

SEQ ID NO: 2912113 - RNA, 18 nt, Human
guggagaggcccggccuc

SEQ ID NO: 2912114 - RNA, 12 nt, Human
guggagagcugg

SEQ ID NO: 2912115 - RNA, 19 nt, Human
guggagacuggggggcuug

SEQ ID NO: 2912116 - RNA, 20 nt, Human
guggagacuggggggcuuga

SEQ ID NO: 2912117 - RNA, 18 nt, Human
guggagacaaugucugca

SEQ ID NO: 2912118 - RNA, 19 nt, Human
guggagacaaugucugcag

SEQ ID NO: 2912119 - RNA, 22 nt, Human
guggagacaaugucugcagccc

SEQ ID NO: 2912120 - RNA, 16 nt, Human
guggagcaugggccug

SEQ ID NO: 2912121 - RNA, 17 nt, Human
guggagagcuggugccc

SEQ ID NO: 2912122 - RNA, 14 nt, Human
guggagagcccggc

SEQ ID NO: 2912123 - RNA, 17 nt, Human
guggagcaugggccugg

SEQ ID NO: 2912124 - RNA, 11 nt, Human
guggagccagg

SEQ ID NO: 2912125 - RNA, 12 nt, Human
guggagccaggc

SEQ ID NO: 2912126 - RNA, 13 nt, Human
guggagccaggcg

SEQ ID NO: 2912127 - RNA, 14 nt, Human
guggagcucagccc

SEQ ID NO: 2912128 - RNA, 15 nt, Human
guggagcucagcccc

SEQ ID NO: 2912129 - RNA, 16 nt, Human
guggagcucagccccg

SEQ ID NO: 2912130 - RNA, 21 nt, Human
guggagccuuuuaacugugca

SEQ ID NO: 2912131 - RNA, 19 nt, Human
guggagcgggguaugaaga

SEQ ID NO: 2912132 - RNA, 18 nt, Human
guggaugccugguggcag

SEQ ID NO: 2912133 - RNA, 16 nt, Human
guggaugccugguggc

SEQ ID NO: 2912134 - RNA, 19 nt, Human
guggauccaauguuagaga

SEQ ID NO: 2912135 - RNA, 12 nt, Human
guggaugaucaa

SEQ ID NO: 2912136 - RNA, 21 nt, Human
guggaugccacagcccagcuu

SEQ ID NO: 2912137 - RNA, 14 nt, Human
guggagugcagugg

SEQ ID NO: 2912138 - RNA, 17 nt, Human
guggagugcaguggugc

SEQ ID NO: 2912139 - RNA, 19 nt, Human
guggagugcaguggugcga

SEQ ID NO: 2912140 - RNA, 16 nt, Human
guggauauaaaaugug

SEQ ID NO: 2912141 - RNA, 17 nt, Human
guggauauaaaaugugc

SEQ ID NO: 2912142 - RNA, 20 nt, Human
guggaguuugacauuguaug

SEQ ID NO: 2912143 - RNA, 14 nt, Human
guggauaacaaaga

SEQ ID NO: 2912144 - RNA, 16 nt, Human
guggauaacaaagaua

SEQ ID NO: 2912145 - RNA, 18 nt, Human
guggauaacaaagauauc

SEQ ID NO: 2912146 - RNA, 15 nt, Human
guggaucaccugagg

SEQ ID NO: 2912147 - RNA, 13 nt, Human
guggaucaccuga

SEQ ID NO: 2912148 - RNA, 16 nt, Human
guggaggcugcaguga

SEQ ID NO: 2912149 - RNA, 13 nt, Human
guggaggcagcca

SEQ ID NO: 2912150 - RNA, 15 nt, Human
guggaggcagccagg

SEQ ID NO: 2912151 - RNA, 11 nt, Human
guggaggcagu

SEQ ID NO: 2912152 - RNA, 17 nt, Human
guggaggagcagugcag

SEQ ID NO: 2912153 - RNA, 15 nt, Human
guggaggagcagugc

SEQ ID NO: 2912154 - RNA, 12 nt, Human
guggaggagcag

SEQ ID NO: 2912155 - RNA, 13 nt, Human
guggagcugccug

SEQ ID NO: 2912156 - RNA, 13 nt, Human
guggaggaaggau

SEQ ID NO: 2912157 - RNA, 14 nt, Human
guggaggaaggauu

SEQ ID NO: 2912158 - RNA, 15 nt, Human
guggaggaaggauug

SEQ ID NO: 2912159 - RNA, 16 nt, Human
guggaggaaggauugu

SEQ ID NO: 2912160 - RNA, 19 nt, Human
guggaggaaggauuguaaa

SEQ ID NO: 2912161 - RNA, 20 nt, Human
guggaggaaggauuguaaaa

SEQ ID NO: 2912162 - RNA, 23 nt, Human
guggagggcacauuccuugccug

SEQ ID NO: 2912163 - RNA, 21 nt, Human
guggcagugggagcugccugu

SEQ ID NO: 2912164 - RNA, 19 nt, Human
guggcagugggagcugccu

SEQ ID NO: 2912165 - RNA, 18 nt, Human
guggcaguggaggugggg

SEQ ID NO: 2912166 - RNA, 19 nt, Human
guggccaaauuauuugugu

SEQ ID NO: 2912167 - RNA, 19 nt, Human
guggccaaaagcuagacag

SEQ ID NO: 2912168 - RNA, 14 nt, Human
guggcauugaaaug

SEQ ID NO: 2912169 - RNA, 15 nt, Human
guggcauugaaauga

SEQ ID NO: 2912170 - RNA, 21 nt, Human
guggcaucuuugccuugggcu

SEQ ID NO: 2912171 - RNA, 16 nt, Human
guggcaugcaccugca

SEQ ID NO: 2912172 - RNA, 20 nt, Human
guggcaucuuugccuugggc

SEQ ID NO: 2912173 - RNA, 18 nt, Human
guggcaucuuugccuugg

SEQ ID NO: 2912174 - RNA, 15 nt, Human
guggccaucccugug

SEQ ID NO: 2912175 - RNA, 17 nt, Human
guggccaucccugugag

SEQ ID NO: 2912176 - RNA, 18 nt, Human
guggccaucccugugagg

SEQ ID NO: 2912177 - RNA, 23 nt, Human
guggccauucuuuuuuucuuggc

SEQ ID NO: 2912178 - RNA, 14 nt, Human
guggccacucagcu

SEQ ID NO: 2912179 - RNA, 13 nt, Human
guggccacucagc

SEQ ID NO: 2912180 - RNA, 23 nt, Human
guggccagagcugggaggcaugg

SEQ ID NO: 2912181 - RNA, 16 nt, Human
guggccacuuuaagag

SEQ ID NO: 2912182 - RNA, 17 nt, Human
guggccagagcugggag

SEQ ID NO: 2912183 - RNA, 21 nt, Human
guggccacuccagaccccugg

SEQ ID NO: 2912184 - RNA, 19 nt, Human
guggcagcugcuuuugucu

SEQ ID NO: 2912185 - RNA, 13 nt, Human
guggcagcugcuu

SEQ ID NO: 2912186 - RNA, 12 nt, Human
guggcagcugcu

SEQ ID NO: 2912187 - RNA, 23 nt, Human
guggcagcugcgguccacccagg

SEQ ID NO: 2912188 - RNA, 22 nt, Human
guggcagcugcgguccacccag

SEQ ID NO: 2912189 - RNA, 21 nt, Human
guggcagcugcgguccaccca

SEQ ID NO: 2912190 - RNA, 20 nt, Human
guggaugccugguggcagcu

SEQ ID NO: 2912191 - RNA, 19 nt, Human
guggcagcugcgguccacc

SEQ ID NO: 2912192 - RNA, 17 nt, Human
guggcagugggagcugc

SEQ ID NO: 2912193 - RNA, 16 nt, Human
guggcagugggagcug

SEQ ID NO: 2912194 - RNA, 15 nt, Human
guggcagugggagcu

SEQ ID NO: 2912195 - RNA, 16 nt, Human
uauuugcacuguagcc

SEQ ID NO: 2912196 - RNA, 22 nt, Human
uauuugcaggucuuuaaaucau

SEQ ID NO: 2912197 - RNA, 18 nt, Human
uauuugcaguucaccugc

SEQ ID NO: 2912198 - RNA, 23 nt, Human
uauuugcaguucaccugcacuua

SEQ ID NO: 2912199 - RNA, 14 nt, Human
uauuugcaacauuu

SEQ ID NO: 2912200 - RNA, 16 nt, Human
uauuugcaacauuuac

SEQ ID NO: 2912201 - RNA, 17 nt, Human
uauuugcaacauuuaca

SEQ ID NO: 2912202 - RNA, 17 nt, Human
uauuugacuugcaugaa

SEQ ID NO: 2912203 - RNA, 19 nt, Human
uauuugacuugcaugaaga

SEQ ID NO: 2912204 - RNA, 22 nt, Human
uauuugacuugcaugaagagaa

SEQ ID NO: 2912205 - RNA, 20 nt, Human
uauuugacuuuaauuuaugu

SEQ ID NO: 2912206 - RNA, 19 nt, Human
uauuugaauuuuaaaucua

SEQ ID NO: 2912207 - RNA, 21 nt, Human
uauuugaauuuuaaaucuaaa

SEQ ID NO: 2912208 - RNA, 17 nt, Human
uauuugauucaaaauau

SEQ ID NO: 2912209 - RNA, 21 nt, Human
uauuugauucaaaauauuuaa

SEQ ID NO: 2912210 - RNA, 12 nt, Human
uauuugaauuuu

SEQ ID NO: 2912211 - RNA, 18 nt, Human
uauuugaauuuuaaaucu

SEQ ID NO: 2912212 - RNA, 14 nt, Human
uauuugaauuaaaa

SEQ ID NO: 2912213 - RNA, 15 nt, Human
uauuugaauuaaaac

SEQ ID NO: 2912214 - RNA, 16 nt, Human
uauuugaauuaaaacu

SEQ ID NO: 2912215 - RNA, 17 nt, Human
uauuugaauuaaaacuu

SEQ ID NO: 2912216 - RNA, 18 nt, Human
uauuugaauuaaaacuuc

SEQ ID NO: 2912217 - RNA, 21 nt, Human
uauuugaauuaaaacuucuua

SEQ ID NO: 2912218 - RNA, 23 nt, Human
uauuugaauuaaaacuucuuaaa

SEQ ID NO: 2912219 - RNA, 17 nt, Human
ucaaacaugagaugugu

SEQ ID NO: 2912220 - RNA, 22 nt, Human
ucaaacaugaaguguguuuccu

SEQ ID NO: 2912221 - RNA, 16 nt, Human
uauuugccaugggcuu

SEQ ID NO: 2912222 - RNA, 17 nt, Human
uauuugccaugggcuuc

SEQ ID NO: 2912223 - RNA, 21 nt, Human
uauuugcuaaucaaagccagg

SEQ ID NO: 2912224 - RNA, 15 nt, Human
uauuugcuaauuaaa

SEQ ID NO: 2912225 - RNA, 23 nt, Human
uauuugcuaauuaaaaaguuaau

SEQ ID NO: 2912226 - RNA, 19 nt, Human
ucaaaccccgaccaccugc

SEQ ID NO: 2912227 - RNA, 20 nt, Human
ucaaaccccgaccaccugcc

SEQ ID NO: 2912228 - RNA, 19 nt, Human
ucaaacuggggccuccaga

SEQ ID NO: 2912229 - RNA, 20 nt, Human
ucaaacuggggccuccagaa

SEQ ID NO: 2912230 - RNA, 22 nt, Human
ucaaacuggggccuccagaacu

SEQ ID NO: 2912231 - RNA, 23 nt, Human
ucaaacuggggccuccagaacuc

SEQ ID NO: 2912232 - RNA, 14 nt, Human
ucaaacuggggccu

SEQ ID NO: 2912233 - RNA, 16 nt, Human
ucaaacuggggccucc

SEQ ID NO: 2912234 - RNA, 23 nt, Human
ucaaaccccgaccaccugcccaa

SEQ ID NO: 2912235 - RNA, 22 nt, Human
ucaaacccacgauuuucuccag

SEQ ID NO: 2912236 - RNA, 16 nt, Human
ucaaaucuccaguauu

SEQ ID NO: 2912237 - RNA, 23 nt, Human
ucaaaucuuggcaauauuccuua

SEQ ID NO: 2912238 - RNA, 21 nt, Human
ucaaaugguaggcauuuccua

SEQ ID NO: 2912239 - RNA, 20 nt, Human
ucaaaugguaggcauuuccu

SEQ ID NO: 2912240 - RNA, 15 nt, Human
ucaaaugggugauau

SEQ ID NO: 2912241 - RNA, 15 nt, Human
ucaaagagagaaaau

SEQ ID NO: 2912242 - RNA, 20 nt, Human
ucaaagagagaaaauaaaga

SEQ ID NO: 2912243 - RNA, 16 nt, Human
ucaaagagaguuuuua

SEQ ID NO: 2912244 - RNA, 12 nt, Human
ucaaacuguaaa

SEQ ID NO: 2912245 - RNA, 18 nt, Human
ucaaacugugaagcauuu

SEQ ID NO: 2912246 - RNA, 15 nt, Human
ucaaacuuacuauuu

SEQ ID NO: 2912247 - RNA, 16 nt, Human
ucaaacuuacuauuuu

SEQ ID NO: 2912248 - RNA, 17 nt, Human
ucaaacuuacuauuuug

SEQ ID NO: 2912249 - RNA, 19 nt, Human
ucaaacuucuggcucccuc

SEQ ID NO: 2912250 - RNA, 20 nt, Human
ucaaacuucuggcucccucu

SEQ ID NO: 2912251 - RNA, 19 nt, Human
ucaaccucuucuggcucaa

SEQ ID NO: 2912252 - RNA, 22 nt, Human
ucaacucccugccccccagccc

SEQ ID NO: 2912253 - RNA, 21 nt, Human
ucaacucccugccccccagcc

SEQ ID NO: 2912254 - RNA, 15 nt, Human
ucaacucccugcccc

SEQ ID NO: 2912255 - RNA, 14 nt, Human
ucaacucccugccc

SEQ ID NO: 2912256 - RNA, 22 nt, Human
uauuucuucaaauccuuccaaa

SEQ ID NO: 2912257 - RNA, 18 nt, Human
ucaacucccuccuuuagu

SEQ ID NO: 2912258 - RNA, 19 nt, Human
ucaacuccucgacaucacu

SEQ ID NO: 2912259 - RNA, 16 nt, Human
ucaacucuucgaagcc

SEQ ID NO: 2912260 - RNA, 18 nt, Human
ucaacugaccagccucca

SEQ ID NO: 2912261 - RNA, 19 nt, Human
ucaaccccuucgcuccugu

SEQ ID NO: 2912262 - RNA, 18 nt, Human
ucaaccccuucgcuccug

SEQ ID NO: 2912263 - RNA, 13 nt, Human
ucaaauguucuaa

SEQ ID NO: 2912264 - RNA, 14 nt, Human
ucaaauguucuaag

SEQ ID NO: 2912265 - RNA, 15 nt, Human
ucaaauguucuaagu

SEQ ID NO: 2912266 - RNA, 19 nt, Human
ucaaauguucuaaguuucu

SEQ ID NO: 2912267 - RNA, 20 nt, Human
ucaaauguucuaaguuucua

SEQ ID NO: 2912268 - RNA, 21 nt, Human
ucaaauguucuaaguuucuaa

SEQ ID NO: 2912269 - RNA, 22 nt, Human
ucaaauguucuaaguuucuaag

SEQ ID NO: 2912270 - RNA, 23 nt, Human
ucaaauguucuaaguuucuaaga

SEQ ID NO: 2912271 - RNA, 15 nt, Human
ucaaccuccugggcu

SEQ ID NO: 2912272 - RNA, 20 nt, Human
ucaaccccuucgcuccugug

SEQ ID NO: 2912273 - RNA, 16 nt, Human
ucaaccuccugggcua

SEQ ID NO: 2912274 - RNA, 17 nt, Human
ucaaccucuucuggcuc

SEQ ID NO: 2912275 - RNA, 18 nt, Human
ucaaccucuucuggcuca

SEQ ID NO: 2912276 - RNA, 15 nt, Human
ucaaccuccugugga

SEQ ID NO: 2912277 - RNA, 18 nt, Human
ucaaccuccuguggaacc

SEQ ID NO: 2912278 - RNA, 22 nt, Human
ucaaggacucugguuucucauu

SEQ ID NO: 2912279 - RNA, 19 nt, Human
ucaagcgauucuucugcuu

SEQ ID NO: 2912280 - RNA, 18 nt, Human
ucaagcgauucuucugcu

SEQ ID NO: 2912281 - RNA, 21 nt, Human
ucaagcgauucuucugcuuca

SEQ ID NO: 2912282 - RNA, 18 nt, Human
ucaaggaauaaugggcuu

SEQ ID NO: 2912283 - RNA, 17 nt, Human
ucaaggaacuugaaaaa

SEQ ID NO: 2912284 - RNA, 18 nt, Human
ucaaggaacuugaaaaau

SEQ ID NO: 2912285 - RNA, 20 nt, Human
ucaaggaacuugaaaaauac

SEQ ID NO: 2912286 - RNA, 22 nt, Human
ucaaggaacuugaaaaauacuu

SEQ ID NO: 2912287 - RNA, 18 nt, Human
ucaaggaagguucaugua

SEQ ID NO: 2912288 - RNA, 17 nt, Human
ucaagcgauucuucugc

SEQ ID NO: 2912289 - RNA, 19 nt, Human
ucaagccagcaacacagag

SEQ ID NO: 2912290 - RNA, 21 nt, Human
ucaagccagcaacacagagca

SEQ ID NO: 2912291 - RNA, 16 nt, Human
ucaagccauguauaaa

SEQ ID NO: 2912292 - RNA, 20 nt, Human
ucaagccauguauaaaugug

SEQ ID NO: 2912293 - RNA, 22 nt, Human
ucaagccauguauaaaugugau

SEQ ID NO: 2912294 - RNA, 14 nt, Human
ucacauuuauucug

SEQ ID NO: 2912295 - RNA, 13 nt, Human
ucaccaagcccag

SEQ ID NO: 2912296 - RNA, 16 nt, Human
ucaccacaugugcaca

SEQ ID NO: 2912297 - RNA, 11 nt, Human
ucacauuguuu

SEQ ID NO: 2912298 - RNA, 18 nt, Human
ucacauuguuugcugcua

SEQ ID NO: 2912299 - RNA, 19 nt, Human
ucacauuguuugcugcuau

SEQ ID NO: 2912300 - RNA, 23 nt, Human
ucacauuguaacugaacuucagg

SEQ ID NO: 2912301 - RNA, 15 nt, Human
ucaccacuccauucc

SEQ ID NO: 2912302 - RNA, 16 nt, Human
ucaccacuccauuccc

SEQ ID NO: 2912303 - RNA, 14 nt, Human
ucaccccuguccuc

SEQ ID NO: 2912304 - RNA, 16 nt, Human
ucaccccuguccucac

SEQ ID NO: 2912305 - RNA, 17 nt, Human
ucaccccuguccucacu

SEQ ID NO: 2912306 - RNA, 20 nt, Human
ucaccccuguccucacugcu

SEQ ID NO: 2912307 - RNA, 18 nt, Human
ucaccagaauugugcaaa

SEQ ID NO: 2912308 - RNA, 13 nt, Human
ucaccccuguccu

SEQ ID NO: 2912309 - RNA, 20 nt, Human
ucacccguacaggcaauucc

SEQ ID NO: 2912310 - RNA, 17 nt, Human
ucacccuuggacaagac

SEQ ID NO: 2912311 - RNA, 17 nt, Human
ucacccuuaacccaagg

SEQ ID NO: 2912312 - RNA, 18 nt, Human
ucacccuuaacccaagga

SEQ ID NO: 2912313 - RNA, 19 nt, Human
ucacccuuaacccaaggag

SEQ ID NO: 2912314 - RNA, 22 nt, Human
ucacccuuaacccaaggagcac

SEQ ID NO: 2912315 - RNA, 23 nt, Human
ucacccuuaacccaaggagcaca

SEQ ID NO: 2912316 - RNA, 20 nt, Human
ucacccuggggcuaggaaau

SEQ ID NO: 2912317 - RNA, 15 nt, Human
ucacccuaccugugc

SEQ ID NO: 2912318 - RNA, 17 nt, Human
ucacccuaccugugccu

SEQ ID NO: 2912319 - RNA, 15 nt, Human
ucacccuagcccucu

SEQ ID NO: 2912320 - RNA, 17 nt, Human
ucacccuagcccucucc

SEQ ID NO: 2912321 - RNA, 21 nt, Human
ucacccuagcccucucccucu

SEQ ID NO: 2912322 - RNA, 18 nt, Human
ucacccucuuccugugau

SEQ ID NO: 2912323 - RNA, 20 nt, Human
ucacccuccaccucuucacc

SEQ ID NO: 2912324 - RNA, 13 nt, Human
ucacccuccaccu

SEQ ID NO: 2912325 - RNA, 14 nt, Human
ucacccuccaccuc

SEQ ID NO: 2912326 - RNA, 15 nt, Human
ucacccuccaccucu

SEQ ID NO: 2912327 - RNA, 16 nt, Human
ucaccgagugggggca

SEQ ID NO: 2912328 - RNA, 17 nt, Human
ucaccgacgcgucuccu

SEQ ID NO: 2912329 - RNA, 16 nt, Human
ucaauucccauugcau

SEQ ID NO: 2912330 - RNA, 13 nt, Human
ucaauucaacacu

SEQ ID NO: 2912331 - RNA, 17 nt, Human
ucaauucaacacucccu

SEQ ID NO: 2912332 - RNA, 15 nt, Human
ucaauucaauuugga

SEQ ID NO: 2912333 - RNA, 18 nt, Human
ucaauuauaguuucugag

SEQ ID NO: 2912334 - RNA, 14 nt, Human
ucacacacauagau

SEQ ID NO: 2912335 - RNA, 12 nt, Human
ucacacacaugg

SEQ ID NO: 2912336 - RNA, 15 nt, Human
ucacacacccugagg

SEQ ID NO: 2912337 - RNA, 16 nt, Human
ucacacacccugaggu

SEQ ID NO: 2912338 - RNA, 14 nt, Human
ucaaggagaggagg

SEQ ID NO: 2912339 - RNA, 21 nt, Human
ucaauguuuaugcaaggaagg

SEQ ID NO: 2912340 - RNA, 23 nt, Human
ucaauguuuaugcaaggaaggaa

SEQ ID NO: 2912341 - RNA, 22 nt, Human
ucaauguuuaugcaaggaagga

SEQ ID NO: 2912342 - RNA, 11 nt, Human
ucaauguuuga

SEQ ID NO: 2912343 - RNA, 22 nt, Human
ucaauguuugaggagcauguuu

SEQ ID NO: 2912344 - RNA, 23 nt, Human
ucaauguuugaggagcauguuuu

SEQ ID NO: 2912345 - RNA, 14 nt, Human
ucaauuauaguuuc

SEQ ID NO: 2912346 - RNA, 15 nt, Human
ucaauuauaguuucu

SEQ ID NO: 2912347 - RNA, 16 nt, Human
ucaauuauaguuucug

SEQ ID NO: 2912348 - RNA, 17 nt, Human
ucaauuauaguuucuga

SEQ ID NO: 2912349 - RNA, 19 nt, Human
ucaauuauaguuucugagg

SEQ ID NO: 2912350 - RNA, 15 nt, Human
ucacacacuuuggcu

SEQ ID NO: 2912351 - RNA, 12 nt, Human
ucacacacugau

SEQ ID NO: 2912352 - RNA, 11 nt, Human
ucacaccagcc

SEQ ID NO: 2912353 - RNA, 21 nt, Human
ucacaccaggcuugccugcag

SEQ ID NO: 2912354 - RNA, 22 nt, Human
ucacaccaggcuugccugcagg

SEQ ID NO: 2912355 - RNA, 12 nt, Human
ucacaccagcca

SEQ ID NO: 2912356 - RNA, 16 nt, Human
ucacaggacucugccu

SEQ ID NO: 2912357 - RNA, 17 nt, Human
ucacaggacucugccuc

SEQ ID NO: 2912358 - RNA, 18 nt, Human
ucacaggacucugccucc

SEQ ID NO: 2912359 - RNA, 20 nt, Human
ucacauugagcugauauaaa

SEQ ID NO: 2912360 - RNA, 21 nt, Human
ucacauugagcugauauaaau

SEQ ID NO: 2912361 - RNA, 23 nt, Human
ucacauugagcugauauaaauuc

SEQ ID NO: 2912362 - RNA, 12 nt, Human
ucacauugcauu

SEQ ID NO: 2912363 - RNA, 15 nt, Human
ucacauugcauucua

SEQ ID NO: 2912364 - RNA, 16 nt, Human
ucacauugcauucuau

SEQ ID NO: 2912365 - RNA, 17 nt, Human
ucacauugcauucuauu

SEQ ID NO: 2912366 - RNA, 20 nt, Human
ucacauugcauucuauugcc

SEQ ID NO: 2912367 - RNA, 21 nt, Human
ucacauugcauucuauugccu

SEQ ID NO: 2912368 - RNA, 22 nt, Human
ucacauugcauucuauugccuu

SEQ ID NO: 2912369 - RNA, 18 nt, Human
ucacaguagagccagcuu

SEQ ID NO: 2912370 - RNA, 17 nt, Human
ucacaguagagccagcu

SEQ ID NO: 2912371 - RNA, 16 nt, Human
ucacaguagagccagc

SEQ ID NO: 2912372 - RNA, 15 nt, Human
ucacaguagagccag

SEQ ID NO: 2912373 - RNA, 20 nt, Human
ucacaguagagccagcuugg

SEQ ID NO: 2912374 - RNA, 19 nt, Human
ucacaguagagccagcuug

SEQ ID NO: 2912375 - RNA, 21 nt, Human
ucacaguagagccagcuuggg

SEQ ID NO: 2912376 - RNA, 14 nt, Human
ucacaguagagcca

SEQ ID NO: 2912377 - RNA, 17 nt, Human
ucacaguacagcaugug

SEQ ID NO: 2912378 - RNA, 18 nt, Human
ucacaguacagcaugugc

SEQ ID NO: 2912379 - RNA, 19 nt, Human
ucacaguacagcaugugcc

SEQ ID NO: 2912380 - RNA, 20 nt, Human
ucacaguacagcaugugccu

SEQ ID NO: 2912381 - RNA, 20 nt, Human
ucacaggugucagccauugc

SEQ ID NO: 2912382 - RNA, 18 nt, Human
ucacaggugugguguaau

SEQ ID NO: 2912383 - RNA, 19 nt, Human
ucacaggugugguguaauu

SEQ ID NO: 2912384 - RNA, 21 nt, Human
ucacaggugugguguaauuua

SEQ ID NO: 2912385 - RNA, 18 nt, Human
ucacagguuggaagagaa

SEQ ID NO: 2912386 - RNA, 20 nt, Human
ucacagguuggaagagaauc

SEQ ID NO: 2912387 - RNA, 21 nt, Human
ucacagguuggaagagaauca

SEQ ID NO: 2912388 - RNA, 22 nt, Human
ucacagguuggaagagaaucac

SEQ ID NO: 2912389 - RNA, 19 nt, Human
ucacaggagggagggggaa

SEQ ID NO: 2912390 - RNA, 19 nt, Human
ucacaggacucugccuccu

SEQ ID NO: 2912391 - RNA, 23 nt, Human
ucacaggacucugccuccucuuc

SEQ ID NO: 2912392 - RNA, 17 nt, Human
ucacaggguugggccca

SEQ ID NO: 2912393 - RNA, 16 nt, Human
ucacaggguugggccc

SEQ ID NO: 2912394 - RNA, 14 nt, Human
ucacaggguugggc

SEQ ID NO: 2912395 - RNA, 13 nt, Human
ucacaccagccau

SEQ ID NO: 2912396 - RNA, 23 nt, Human
ucacaggguugggcccagaucug

SEQ ID NO: 2912397 - RNA, 19 nt, Human
ucacaggguugggcccaga

SEQ ID NO: 2912398 - RNA, 24 nt, Human
ucacaggguugggcccagaucugg

SEQ ID NO: 2912399 - RNA, 20 nt, Human
uauuguugacaacugugacu

SEQ ID NO: 2912400 - RNA, 23 nt, Human
uauuguugacaacugugacugua

SEQ ID NO: 2912401 - RNA, 14 nt, Human
uauuguuguauaau

SEQ ID NO: 2912402 - RNA, 19 nt, Human
uauuguugacaacugugac

SEQ ID NO: 2912403 - RNA, 18 nt, Human
uauuguggauaacaaaga

SEQ ID NO: 2912404 - RNA, 20 nt, Human
uauugugggacuuauuacaa

SEQ ID NO: 2912405 - RNA, 22 nt, Human
uauugugggacuuauuacaauu

SEQ ID NO: 2912406 - RNA, 22 nt, Human
uauugugguaggccuuuuaaca

SEQ ID NO: 2912407 - RNA, 23 nt, Human
uauugugguaggccuuuuaacau

SEQ ID NO: 2912408 - RNA, 13 nt, Human
uauugugguauug

SEQ ID NO: 2912409 - RNA, 23 nt, Human
uauugugguauugaauauugugu

SEQ ID NO: 2912410 - RNA, 14 nt, Human
uauuguguuccuuu

SEQ ID NO: 2912411 - RNA, 15 nt, Human
uauugcccacgcugg

SEQ ID NO: 2912412 - RNA, 13 nt, Human
uauugcccagguu

SEQ ID NO: 2912413 - RNA, 15 nt, Human
uauugcccaggcugg

SEQ ID NO: 2912414 - RNA, 20 nt, Human
uauugcccaggcuggucuug

SEQ ID NO: 2912415 - RNA, 14 nt, Human
uauugcccacgcug

SEQ ID NO: 2912416 - RNA, 13 nt, Human
uauugcccacgcu

SEQ ID NO: 2912417 - RNA, 11 nt, Human
uauugcugggg

SEQ ID NO: 2912418 - RNA, 12 nt, Human
uauugcuggggu

SEQ ID NO: 2912419 - RNA, 19 nt, Human
uauugcuguccuugaaugc

SEQ ID NO: 2912420 - RNA, 15 nt, Human
uauugcuguugcuug

SEQ ID NO: 2912421 - RNA, 16 nt, Human
uauugcuguugcuuga

SEQ ID NO: 2912422 - RNA, 17 nt, Human
uauugcuguugcuugaa

SEQ ID NO: 2912423 - RNA, 18 nt, Human
uauugcuguugcuugaau

SEQ ID NO: 2912424 - RNA, 16 nt, Human
uauugcuuaguaaaau

SEQ ID NO: 2912425 - RNA, 17 nt, Human
uauugcuuaguaaaauu

SEQ ID NO: 2912426 - RNA, 18 nt, Human
uauugcuuaguaaaauuu

SEQ ID NO: 2912427 - RNA, 19 nt, Human
uauugcuuaguaaaauuua

SEQ ID NO: 2912428 - RNA, 21 nt, Human
uauugcuuauugcuuaguaaa

SEQ ID NO: 2912429 - RNA, 16 nt, Human
uauugcugauuuuaau

SEQ ID NO: 2912430 - RNA, 22 nt, Human
uauugaguuuguagguaaaaug

SEQ ID NO: 2912431 - RNA, 14 nt, Human
uauugauaguacuc

SEQ ID NO: 2912432 - RNA, 15 nt, Human
uauugauaguacucu

SEQ ID NO: 2912433 - RNA, 13 nt, Human
uauugauauauau

SEQ ID NO: 2912434 - RNA, 14 nt, Human
uauugauauauauu

SEQ ID NO: 2912435 - RNA, 18 nt, Human
uauugauauauauuauaa

SEQ ID NO: 2912436 - RNA, 14 nt, Human
uauucaugcuucuu

SEQ ID NO: 2912437 - RNA, 15 nt, Human
uauucaucucaagga

SEQ ID NO: 2912438 - RNA, 20 nt, Human
uauucaugaagcggucacag

SEQ ID NO: 2912439 - RNA, 17 nt, Human
uauuauguuguuagaga

SEQ ID NO: 2912440 - RNA, 13 nt, Human
uauuauuuugggg

SEQ ID NO: 2912441 - RNA, 18 nt, Human
uauuauuuuggggucucu

SEQ ID NO: 2912442 - RNA, 21 nt, Human
uauuauuuuggggucucuuuu

SEQ ID NO: 2912443 - RNA, 23 nt, Human
uauucauucauggaccacuguuu

SEQ ID NO: 2912444 - RNA, 19 nt, Human
uauucauucugcauugcua

SEQ ID NO: 2912445 - RNA, 20 nt, Human
uauucauucugugaucauuu

SEQ ID NO: 2912446 - RNA, 22 nt, Human
uauucauucugugaucauuuau

SEQ ID NO: 2912447 - RNA, 12 nt, Human
uauucauuuagu

SEQ ID NO: 2912448 - RNA, 21 nt, Human
uauuccaaaaagguugcuguu

SEQ ID NO: 2912449 - RNA, 18 nt, Human
uauucauuaaauguuuga

SEQ ID NO: 2912450 - RNA, 17 nt, Human
uauugcauuuauaugua

SEQ ID NO: 2912451 - RNA, 13 nt, Human
uauugcauuuaua

SEQ ID NO: 2912452 - RNA, 14 nt, Human
uauugcacauuguu

SEQ ID NO: 2912453 - RNA, 15 nt, Human
uauugcacauuguuc

SEQ ID NO: 2912454 - RNA, 20 nt, Human
uauugcagcaauuaaaaauu

SEQ ID NO: 2912455 - RNA, 14 nt, Human
uauuccaaaugucu

SEQ ID NO: 2912456 - RNA, 15 nt, Human
uauuuauguacuuuu

SEQ ID NO: 2912457 - RNA, 18 nt, Human
uauuuauguaaugaagua

SEQ ID NO: 2912458 - RNA, 12 nt, Human
uauuuaugaagu

SEQ ID NO: 2912459 - RNA, 14 nt, Human
uauuuaugaaguuu

SEQ ID NO: 2912460 - RNA, 15 nt, Human
uauuuaugaaguuua

SEQ ID NO: 2912461 - RNA, 16 nt, Human
uauuuaugaaguuuaa

SEQ ID NO: 2912462 - RNA, 19 nt, Human
uauuuaugaaguuuaaaac

SEQ ID NO: 2912463 - RNA, 22 nt, Human
uauuuaugaaguuuaaaacagu

SEQ ID NO: 2912464 - RNA, 13 nt, Human
uauuuauguuugc

SEQ ID NO: 2912465 - RNA, 13 nt, Human
uauuuauuaaaua

SEQ ID NO: 2912466 - RNA, 15 nt, Human
uauuuauuaaauaaa

SEQ ID NO: 2912467 - RNA, 17 nt, Human
uauuuauuaaauaaaau

SEQ ID NO: 2912468 - RNA, 14 nt, Human
uauuuaugugugag

SEQ ID NO: 2912469 - RNA, 15 nt, Human
uauuuauguuaaaag

SEQ ID NO: 2912470 - RNA, 21 nt, Human
uauuuaugucuauuuaagccu

SEQ ID NO: 2912471 - RNA, 19 nt, Human
uauuuauuaugcuuuauug

SEQ ID NO: 2912472 - RNA, 20 nt, Human
uauuuauuaugcuuuauugg

SEQ ID NO: 2912473 - RNA, 14 nt, Human
uauuuauuauuuau

SEQ ID NO: 2912474 - RNA, 19 nt, Human
uauuucuucguucuuuuua

SEQ ID NO: 2912475 - RNA, 13 nt, Human
uauuucuuuguua

SEQ ID NO: 2912476 - RNA, 22 nt, Human
uauuucuuuauauuuauccacu

SEQ ID NO: 2912477 - RNA, 14 nt, Human
uauuucuuuguuau

SEQ ID NO: 2912478 - RNA, 16 nt, Human
uauuugaaaaaaacuu

SEQ ID NO: 2912479 - RNA, 23 nt, Human
uauuugaaaaaaacuucauucuc

SEQ ID NO: 2912480 - RNA, 19 nt, Human
uauuugaagguuuuaagug

SEQ ID NO: 2912481 - RNA, 19 nt, Human
uauuugaaacugaauguuu

SEQ ID NO: 2912482 - RNA, 12 nt, Human
uauuugaaacuu

SEQ ID NO: 2912483 - RNA, 13 nt, Human
uauuguuuaugua

SEQ ID NO: 2912484 - RNA, 14 nt, Human
uauuguuuauguaa

SEQ ID NO: 2912485 - RNA, 16 nt, Human
uauuuaaaugggaaua

SEQ ID NO: 2912486 - RNA, 14 nt, Human
uauuuaaagacagg

SEQ ID NO: 2912487 - RNA, 22 nt, Human
uauuuaaagacagggaagagca

SEQ ID NO: 2912488 - RNA, 13 nt, Human
uauuuaaagcauu

SEQ ID NO: 2912489 - RNA, 15 nt, Human
uauuuaacaagaucu

SEQ ID NO: 2912490 - RNA, 17 nt, Human
uauuuauauauuuauaa

SEQ ID NO: 2912491 - RNA, 19 nt, Human
uauuuauauauuuauaacu

SEQ ID NO: 2912492 - RNA, 18 nt, Human
uauuuauauauuuauaac

SEQ ID NO: 2912493 - RNA, 13 nt, Human
uauuuaugccuug

SEQ ID NO: 2912494 - RNA, 19 nt, Human
uauuuaugccuugaugauu

SEQ ID NO: 2912495 - RNA, 21 nt, Human
uauuuaugccuugaugauuua

SEQ ID NO: 2912496 - RNA, 22 nt, Human
uauuuaugccuugaugauuuaa

SEQ ID NO: 2912497 - RNA, 19 nt, Human
uauuuauggaugcaacacg

SEQ ID NO: 2912498 - RNA, 16 nt, Human
uauuuaucugauuaag

SEQ ID NO: 2912499 - RNA, 21 nt, Human
uauuuaucugauuaaguuguc

SEQ ID NO: 2912500 - RNA, 15 nt, Human
uauuuaucugauuaa

SEQ ID NO: 2912501 - RNA, 16 nt, Human
uauuuaucucuauuua

SEQ ID NO: 2912502 - RNA, 20 nt, Human
uauuuaucugugcaaauccu

SEQ ID NO: 2912503 - RNA, 17 nt, Human
uauuuaucucuauuuaa

SEQ ID NO: 2912504 - RNA, 12 nt, Human
uauuuaucuuua

SEQ ID NO: 2912505 - RNA, 17 nt, Human
uauuuauauguacuguu

SEQ ID NO: 2912506 - RNA, 16 nt, Human
uauuuauauguacugu

SEQ ID NO: 2912507 - RNA, 15 nt, Human
uauuuauauguacug

SEQ ID NO: 2912508 - RNA, 17 nt, Human
uauuuauauguacauga

SEQ ID NO: 2912509 - RNA, 13 nt, Human
uauuuauauauuu

SEQ ID NO: 2912510 - RNA, 15 nt, Human
uauuuauauguacau

SEQ ID NO: 2912511 - RNA, 15 nt, Human
uauuuauccauuugu

SEQ ID NO: 2912512 - RNA, 20 nt, Human
uauuuauccaaaauguguau

SEQ ID NO: 2912513 - RNA, 15 nt, Human
uauuauguaguuguu

SEQ ID NO: 2912514 - RNA, 15 nt, Human
uauuauuuauaauuc

SEQ ID NO: 2912515 - RNA, 15 nt, Human
uauuauuuauuucug

SEQ ID NO: 2912516 - RNA, 12 nt, Human
uauuauguguuu

SEQ ID NO: 2912517 - RNA, 16 nt, Human
uauuauugaaauugua

SEQ ID NO: 2912518 - RNA, 16 nt, Human
uauuauugcuguugcu

SEQ ID NO: 2912519 - RNA, 18 nt, Human
uauuauugcuguugcuug

SEQ ID NO: 2912520 - RNA, 19 nt, Human
uauuauugcuguugcuuga

SEQ ID NO: 2912521 - RNA, 20 nt, Human
uauuauugugguaggccuuu

SEQ ID NO: 2912522 - RNA, 21 nt, Human
uauuauugugguaggccuuuu

SEQ ID NO: 2912523 - RNA, 22 nt, Human
uauuauugugguaggccuuuua

SEQ ID NO: 2912524 - RNA, 12 nt, Human
uauuauuucuau

SEQ ID NO: 2912525 - RNA, 14 nt, Human
uauuauuucuauua

SEQ ID NO: 2912526 - RNA, 12 nt, Human
uauuauuuggca

SEQ ID NO: 2912527 - RNA, 14 nt, Human
uauuauuuggcagu

SEQ ID NO: 2912528 - RNA, 23 nt, Human
uauuauuuggcaguuugguauuu

SEQ ID NO: 2912529 - RNA, 14 nt, Human
uauuauuuguguuu

SEQ ID NO: 2912530 - RNA, 12 nt, Human
uauuaucuuuaa

SEQ ID NO: 2912531 - RNA, 20 nt, Human
uauuauagguaaucaaugaa

SEQ ID NO: 2912532 - RNA, 21 nt, Human
uauuauccuagauuauaucaa

SEQ ID NO: 2912533 - RNA, 23 nt, Human
uauuauccuagauuauaucaaag

SEQ ID NO: 2912534 - RNA, 19 nt, Human
uauuaugcuuuauuggaaa

SEQ ID NO: 2912535 - RNA, 13 nt, Human
uauuaugcggaaa

SEQ ID NO: 2912536 - RNA, 13 nt, Human
uauuauauauaua

SEQ ID NO: 2912537 - RNA, 16 nt, Human
uauuauauauauaaua

SEQ ID NO: 2912538 - RNA, 16 nt, Human
uauuaaggauguagcu

SEQ ID NO: 2912539 - RNA, 18 nt, Human
uauuaaggauguagcuuu

SEQ ID NO: 2912540 - RNA, 20 nt, Human
uauuaaggauguagcuuuuc

SEQ ID NO: 2912541 - RNA, 17 nt, Human
uauuaagggauuuagua

SEQ ID NO: 2912542 - RNA, 15 nt, Human
uauuauaauuuaaug

SEQ ID NO: 2912543 - RNA, 12 nt, Human
uauuauaauuua

SEQ ID NO: 2912544 - RNA, 13 nt, Human
uauuauaagcauu

SEQ ID NO: 2912545 - RNA, 17 nt, Human
uauuauaagcauugaaa

SEQ ID NO: 2912546 - RNA, 20 nt, Human
uauuauaagcauugaaauua

SEQ ID NO: 2912547 - RNA, 21 nt, Human
uauuauaagcauugaaauuau

SEQ ID NO: 2912548 - RNA, 14 nt, Human
uauuaauaaauaga

SEQ ID NO: 2912549 - RNA, 17 nt, Human
uauuaauaaauagagca

SEQ ID NO: 2912550 - RNA, 21 nt, Human
uauuaauaaauagagcaauua

SEQ ID NO: 2912551 - RNA, 20 nt, Human
uauuauaacaagugugucuu

SEQ ID NO: 2912552 - RNA, 14 nt, Human
uauguuauaucaac

SEQ ID NO: 2912553 - RNA, 12 nt, Human
uauguuacuauu

SEQ ID NO: 2912554 - RNA, 15 nt, Human
uauguuacuauuuuc

SEQ ID NO: 2912555 - RNA, 16 nt, Human
uauguuacuauuuucu

SEQ ID NO: 2912556 - RNA, 13 nt, Human
uauguguuuacuu

SEQ ID NO: 2912557 - RNA, 16 nt, Human
uauguguuuacuuuaa

SEQ ID NO: 2912558 - RNA, 16 nt, Human
uauguguugaaaacca

SEQ ID NO: 2912559 - RNA, 17 nt, Human
uauguguugaaaaccaa

SEQ ID NO: 2912560 - RNA, 18 nt, Human
uauguguugaaaaccaaa

SEQ ID NO: 2912561 - RNA, 19 nt, Human
uauguguugaaaaccaaaa

SEQ ID NO: 2912562 - RNA, 23 nt, Human
uauguguugaaaaccaaaaugac

SEQ ID NO: 2912563 - RNA, 22 nt, Human
uauguuaagcagcuaaauuuuc

SEQ ID NO: 2912564 - RNA, 18 nt, Human
uauggacagggcugucuc

SEQ ID NO: 2912565 - RNA, 15 nt, Human
uauguuaaaagauuu

SEQ ID NO: 2912566 - RNA, 17 nt, Human
uauggagcucagagagg

SEQ ID NO: 2912567 - RNA, 18 nt, Human
uauggagcucagagaggg

SEQ ID NO: 2912568 - RNA, 18 nt, Human
uauggaggaacaacucuc

SEQ ID NO: 2912569 - RNA, 12 nt, Human
uauggacucugc

SEQ ID NO: 2912570 - RNA, 16 nt, Human
uauggacucugcacau

SEQ ID NO: 2912571 - RNA, 16 nt, Human
uauggagaauugcuga

SEQ ID NO: 2912572 - RNA, 17 nt, Human
uauggagaauugcugaa

SEQ ID NO: 2912573 - RNA, 18 nt, Human
uauggagaauugcugaag

SEQ ID NO: 2912574 - RNA, 16 nt, Human
uauggacggugcucca

SEQ ID NO: 2912575 - RNA, 21 nt, Human
uauggacggugcuccaggcag

SEQ ID NO: 2912576 - RNA, 15 nt, Human
uauggacucugcaca

SEQ ID NO: 2912577 - RNA, 13 nt, Human
uauggagccuggc

SEQ ID NO: 2912578 - RNA, 21 nt, Human
uauggagcagccuggagaccc

SEQ ID NO: 2912579 - RNA, 13 nt, Human
uauguucauuugu

SEQ ID NO: 2912580 - RNA, 14 nt, Human
uauguucauuuguu

SEQ ID NO: 2912581 - RNA, 17 nt, Human
uauguucauuuguuugu

SEQ ID NO: 2912582 - RNA, 21 nt, Human
uauguugcccaggcaggucuu

SEQ ID NO: 2912583 - RNA, 17 nt, Human
uauguugaagccuuugu

SEQ ID NO: 2912584 - RNA, 15 nt, Human
uauguugaauacuuu

SEQ ID NO: 2912585 - RNA, 12 nt, Human
uauguugaauac

SEQ ID NO: 2912586 - RNA, 14 nt, Human
uauguugccuuuau

SEQ ID NO: 2912587 - RNA, 18 nt, Human
uauguugccuuuaugguu

SEQ ID NO: 2912588 - RNA, 20 nt, Human
uauguugccuuuaugguuuc

SEQ ID NO: 2912589 - RNA, 16 nt, Human
uauguuguccaauugu

SEQ ID NO: 2912590 - RNA, 21 nt, Human
uauguuguccaauuguugaca

SEQ ID NO: 2912591 - RNA, 12 nt, Human
uauuaacuacau

SEQ ID NO: 2912592 - RNA, 15 nt, Human
uauuaacuacauuua

SEQ ID NO: 2912593 - RNA, 16 nt, Human
uauuaacuacauuuau

SEQ ID NO: 2912594 - RNA, 18 nt, Human
uauuaacuacauuuauga

SEQ ID NO: 2912595 - RNA, 23 nt, Human
uauuaacaacaauaacacugucu

SEQ ID NO: 2912596 - RNA, 12 nt, Human
uauuaaauaguu

SEQ ID NO: 2912597 - RNA, 23 nt, Human
uauuaacaaacaucacucugcug

SEQ ID NO: 2912598 - RNA, 13 nt, Human
uauuaacaaaagu

SEQ ID NO: 2912599 - RNA, 14 nt, Human
uauuaacaaaaguu

SEQ ID NO: 2912600 - RNA, 18 nt, Human
uauuaacaaaaguucccu

SEQ ID NO: 2912601 - RNA, 17 nt, Human
uauguuguuagagaaaa

SEQ ID NO: 2912602 - RNA, 19 nt, Human
uauguuguuagagaaaaau

SEQ ID NO: 2912603 - RNA, 17 nt, Human
uauccuuucuaacaaaa

SEQ ID NO: 2912604 - RNA, 15 nt, Human
uauccugcauuguua

SEQ ID NO: 2912605 - RNA, 23 nt, Human
uauccugacuucuaauaucauuc

SEQ ID NO: 2912606 - RNA, 13 nt, Human
uauccuucaucuu

SEQ ID NO: 2912607 - RNA, 16 nt, Human
uauccuucaucuuuua

SEQ ID NO: 2912608 - RNA, 20 nt, Human
uauccuucaucuuuuaaaga

SEQ ID NO: 2912609 - RNA, 22 nt, Human
uauccuucaucuuuuaaagaaa

SEQ ID NO: 2912610 - RNA, 16 nt, Human
uauccuuccucuccuu

SEQ ID NO: 2912611 - RNA, 17 nt, Human
uauccuuccucuccuuc

SEQ ID NO: 2912612 - RNA, 17 nt, Human
uaucggggaagccagac

SEQ ID NO: 2912613 - RNA, 18 nt, Human
uaucggggaagccagacg

SEQ ID NO: 2912614 - RNA, 21 nt, Human
uaucguaaccagccagauccu

SEQ ID NO: 2912615 - RNA, 19 nt, Human
uauauguuuuaagaggcag

SEQ ID NO: 2912616 - RNA, 15 nt, Human
uauauguguugaaaa

SEQ ID NO: 2912617 - RNA, 16 nt, Human
uauauguguugaaaac

SEQ ID NO: 2912618 - RNA, 14 nt, Human
uauccugaaauuuc

SEQ ID NO: 2912619 - RNA, 17 nt, Human
uauccugaaauuucaga

SEQ ID NO: 2912620 - RNA, 16 nt, Human
uauccugaaauuucag

SEQ ID NO: 2912621 - RNA, 21 nt, Human
uaucuacccaagggcagaaag

SEQ ID NO: 2912622 - RNA, 22 nt, Human
uaucuacccaagggcagaaagu

SEQ ID NO: 2912623 - RNA, 21 nt, Human
uaucuaauauauaugaauaaa

SEQ ID NO: 2912624 - RNA, 21 nt, Human
uaucuacaucuuuuuucacaa

SEQ ID NO: 2912625 - RNA, 16 nt, Human
uaucuacaucuuuuuu

SEQ ID NO: 2912626 - RNA, 17 nt, Human
uaucuaauauauaugaa

SEQ ID NO: 2912627 - RNA, 20 nt, Human
uaucuaauaccucugugugc

SEQ ID NO: 2912628 - RNA, 18 nt, Human
uaucuaauauauaugaau

SEQ ID NO: 2912629 - RNA, 20 nt, Human
uaucuaauauauaugaauaa

SEQ ID NO: 2912630 - RNA, 13 nt, Human
uaucuaaugacau

SEQ ID NO: 2912631 - RNA, 14 nt, Human
uaucuaaugacaug

SEQ ID NO: 2912632 - RNA, 21 nt, Human
uaucuaauauguaacaagcca

SEQ ID NO: 2912633 - RNA, 16 nt, Human
uaucuaauaccucugu

SEQ ID NO: 2912634 - RNA, 15 nt, Human
uaucuaauaccucug

SEQ ID NO: 2912635 - RNA, 13 nt, Human
uaucuaagaauac

SEQ ID NO: 2912636 - RNA, 18 nt, Human
uaucuaagaauacagcuu

SEQ ID NO: 2912637 - RNA, 19 nt, Human
uaucuaagaauacagcuuu

SEQ ID NO: 2912638 - RNA, 20 nt, Human
uaucuaagaauacagcuuuc

SEQ ID NO: 2912639 - RNA, 23 nt, Human
uaucuaagaauacagcuuucuga

SEQ ID NO: 2912640 - RNA, 14 nt, Human
uaucugaguugcca

SEQ ID NO: 2912641 - RNA, 17 nt, Human
uaucugaguugccaaga

SEQ ID NO: 2912642 - RNA, 18 nt, Human
uaucugaguugccaagac

SEQ ID NO: 2912643 - RNA, 19 nt, Human
uaucugaguugccaagaca

SEQ ID NO: 2912644 - RNA, 21 nt, Human
uaucugaguugccaagacaaa

SEQ ID NO: 2912645 - RNA, 23 nt, Human
uaucugaguugccaagacaaauc

SEQ ID NO: 2912646 - RNA, 16 nt, Human
uaucugauuuugugca

SEQ ID NO: 2912647 - RNA, 22 nt, Human
uaucugauuuugugcaaaagcu

SEQ ID NO: 2912648 - RNA, 22 nt, Human
uaucuggccccagguagaaacu

SEQ ID NO: 2912649 - RNA, 23 nt, Human
uaucuggcccucgacacucacca

SEQ ID NO: 2912650 - RNA, 18 nt, Human
uaucuggccuaaaaucuu

SEQ ID NO: 2912651 - RNA, 19 nt, Human
uaucuggccuaaaaucuug

SEQ ID NO: 2912652 - RNA, 20 nt, Human
uaucuggaggccuuccagcu

SEQ ID NO: 2912653 - RNA, 23 nt, Human
uaucuggaggccuuccagcugcu

SEQ ID NO: 2912654 - RNA, 12 nt, Human
uaucuaaauuaa

SEQ ID NO: 2912655 - RNA, 19 nt, Human
uaucuggccauauuuacua

SEQ ID NO: 2912656 - RNA, 19 nt, Human
uaucuggaaguaaccauuu

SEQ ID NO: 2912657 - RNA, 16 nt, Human
uaucuggaaugagccu

SEQ ID NO: 2912658 - RNA, 20 nt, Human
uaucugcuucaguggagaau

SEQ ID NO: 2912659 - RNA, 15 nt, Human
uaugaauuuaaauau

SEQ ID NO: 2912660 - RNA, 20 nt, Human
uaugaauguacugcauguua

SEQ ID NO: 2912661 - RNA, 23 nt, Human
uaugaauguacugcauguuacca

SEQ ID NO: 2912662 - RNA, 19 nt, Human
uaucuuagauguuucacac

SEQ ID NO: 2912663 - RNA, 23 nt, Human
uaugaaucugcucacuuuaaacc

SEQ ID NO: 2912664 - RNA, 21 nt, Human
uaugaauauauggcauuugca

SEQ ID NO: 2912665 - RNA, 23 nt, Human
uaugaaucagugggcaggauaaa

SEQ ID NO: 2912666 - RNA, 12 nt, Human
uaugaauaaagu

SEQ ID NO: 2912667 - RNA, 22 nt, Human
uaucuucucaaguucuaagauu

SEQ ID NO: 2912668 - RNA, 15 nt, Human
uaugaauacagcagc

SEQ ID NO: 2912669 - RNA, 16 nt, Human
uaugaauacagcagca

SEQ ID NO: 2912670 - RNA, 17 nt, Human
uaugaauacagcagcaa

SEQ ID NO: 2912671 - RNA, 20 nt, Human
uaugaauacagcagcaagaa

SEQ ID NO: 2912672 - RNA, 22 nt, Human
uaugaauacagcagcaagaaaa

SEQ ID NO: 2912673 - RNA, 19 nt, Human
uaugacaucacuuguacaa

SEQ ID NO: 2912674 - RNA, 19 nt, Human
uaugaccacacuccagcug

SEQ ID NO: 2912675 - RNA, 14 nt, Human
uaugaccacacucc

SEQ ID NO: 2912676 - RNA, 24 nt, Human
uaugacaucacuuguacaaaauaa

SEQ ID NO: 2912677 - RNA, 14 nt, Human
uaugacauucaugc

SEQ ID NO: 2912678 - RNA, 19 nt, Human
uaugacauucaugccuggc

SEQ ID NO: 2912679 - RNA, 23 nt, Human
uaugacaucacuuguacaaaaua

SEQ ID NO: 2912680 - RNA, 20 nt, Human
uaugacaucacuuguacaaa

SEQ ID NO: 2912681 - RNA, 23 nt, Human
uaugaauuuaaauauaauucugu

SEQ ID NO: 2912682 - RNA, 17 nt, Human
uaugaauuuaaauauaa

SEQ ID NO: 2912683 - RNA, 19 nt, Human
uaugaauuuaaauauaauu

SEQ ID NO: 2912684 - RNA, 20 nt, Human
uaugaauuuaaauauaauuc

SEQ ID NO: 2912685 - RNA, 21 nt, Human
uaugaauuuaaauauaauucu

SEQ ID NO: 2912686 - RNA, 19 nt, Human
uaucugugaaaugcuggca

SEQ ID NO: 2912687 - RNA, 14 nt, Human
uaucugugcucagg

SEQ ID NO: 2912688 - RNA, 22 nt, Human
uaucugugcucaggacucagaa

SEQ ID NO: 2912689 - RNA, 13 nt, Human
uaucuguggucuu

SEQ ID NO: 2912690 - RNA, 23 nt, Human
uaucugucauuugagcagggcuc

SEQ ID NO: 2912691 - RNA, 21 nt, Human
uaucugucauuugagcagggc

SEQ ID NO: 2912692 - RNA, 20 nt, Human
uaucugucauuugagcaggg

SEQ ID NO: 2912693 - RNA, 14 nt, Human
uaucugggccuggg

SEQ ID NO: 2912694 - RNA, 16 nt, Human
uaucugggccugggcu

SEQ ID NO: 2912695 - RNA, 18 nt, Human
uaucuguuuaaagcauau

SEQ ID NO: 2912696 - RNA, 12 nt, Human
uaucuguucuug

SEQ ID NO: 2912697 - RNA, 18 nt, Human
uaucuuauacuguacaau

SEQ ID NO: 2912698 - RNA, 14 nt, Human
uaucuuaaauuuga

SEQ ID NO: 2912699 - RNA, 15 nt, Human
uaucuuaaagaaaca

SEQ ID NO: 2912700 - RNA, 18 nt, Human
uaucuuaaagaaacagcu

SEQ ID NO: 2912701 - RNA, 20 nt, Human
uaucuuaaagaaacagcuuu

SEQ ID NO: 2912702 - RNA, 23 nt, Human
uaucuuaaagaaacagcuuucaa

SEQ ID NO: 2912703 - RNA, 18 nt, Human
uaugaauaaagacaccua

SEQ ID NO: 2912704 - RNA, 18 nt, Human
uaugaaguuuaaaacagu

SEQ ID NO: 2912705 - RNA, 21 nt, Human
uaugaaguuuaaaacaguauu

SEQ ID NO: 2912706 - RNA, 22 nt, Human
uaugaaguuuaaaacaguauuu

SEQ ID NO: 2912707 - RNA, 15 nt, Human
uaucuucucaaguuc

SEQ ID NO: 2912708 - RNA, 13 nt, Human
uaucuuccaaaug

SEQ ID NO: 2912709 - RNA, 14 nt, Human
uaucuuccauauuu

SEQ ID NO: 2912710 - RNA, 17 nt, Human
uaucuuccauauuugga

SEQ ID NO: 2912711 - RNA, 17 nt, Human
uaucuucucaaguucua

SEQ ID NO: 2912712 - RNA, 18 nt, Human
uaucuucucaaguucuaa

SEQ ID NO: 2912713 - RNA, 20 nt, Human
uaucuucucaaguucuaaga

SEQ ID NO: 2912714 - RNA, 21 nt, Human
uaucuucucaaguucuaagau

SEQ ID NO: 2912715 - RNA, 12 nt, Human
uaucuucacaua

SEQ ID NO: 2912716 - RNA, 14 nt, Human
uaucuucacauagu

SEQ ID NO: 2912717 - RNA, 15 nt, Human
uaucuucacauaguu

SEQ ID NO: 2912718 - RNA, 18 nt, Human
uaucuucagcucuuuuug

SEQ ID NO: 2912719 - RNA, 14 nt, Human
uaugauuuucauaa

SEQ ID NO: 2912720 - RNA, 16 nt, Human
uaugauuuucauaacu

SEQ ID NO: 2912721 - RNA, 19 nt, Human
uaugauuuucauaacuuau

SEQ ID NO: 2912722 - RNA, 16 nt, Human
uaugauuuuuuaaaag

SEQ ID NO: 2912723 - RNA, 17 nt, Human
uaugauuuuuuaaaaga

SEQ ID NO: 2912724 - RNA, 18 nt, Human
uaugauuuuuuaaaagaa

SEQ ID NO: 2912725 - RNA, 20 nt, Human
uaugauuuuuuaaaagaaau

SEQ ID NO: 2912726 - RNA, 21 nt, Human
uaugauuuuuuaaaagaaauu

SEQ ID NO: 2912727 - RNA, 18 nt, Human
uaugauuuggaaaauaaa

SEQ ID NO: 2912728 - RNA, 15 nt, Human
uaugauuuggaaaau

SEQ ID NO: 2912729 - RNA, 17 nt, Human
uaugauuuggaaaauaa

SEQ ID NO: 2912730 - RNA, 14 nt, Human
uaugauuuauaguu

SEQ ID NO: 2912731 - RNA, 15 nt, Human
uaugauuuauaguuu

SEQ ID NO: 2912732 - RNA, 18 nt, Human
uaugauuuauaguuugua

SEQ ID NO: 2912733 - RNA, 21 nt, Human
uaugauuucacuagaaaagcu

SEQ ID NO: 2912734 - RNA, 22 nt, Human
uaugauuucacuagaaaagcug

SEQ ID NO: 2912735 - RNA, 17 nt, Human
uaugauuuauaaacaga

SEQ ID NO: 2912736 - RNA, 19 nt, Human
uaugauuuauaaacagaca

SEQ ID NO: 2912737 - RNA, 20 nt, Human
uaugauuuauaaacagacaa

SEQ ID NO: 2912738 - RNA, 17 nt, Human
uaugauuuaauaaaaua

SEQ ID NO: 2912739 - RNA, 18 nt, Human
uaugauuuaauaaaauaa

SEQ ID NO: 2912740 - RNA, 14 nt, Human
uaugauuuaaaaca

SEQ ID NO: 2912741 - RNA, 17 nt, Human
uaugauuuaaaacaugu

SEQ ID NO: 2912742 - RNA, 18 nt, Human
uaugauuuaaaacaugua

SEQ ID NO: 2912743 - RNA, 14 nt, Human
uaugauuuaauaaa

SEQ ID NO: 2912744 - RNA, 13 nt, Human
uaugcaaaaugga

SEQ ID NO: 2912745 - RNA, 14 nt, Human
uaugcaaaauggaa

SEQ ID NO: 2912746 - RNA, 20 nt, Human
uaugcaaggaaggaaagaaa

SEQ ID NO: 2912747 - RNA, 12 nt, Human
uaugcaauaaaa

SEQ ID NO: 2912748 - RNA, 21 nt, Human
uaugcaauaaaauuauuugca

SEQ ID NO: 2912749 - RNA, 17 nt, Human
uaugcaaggaaggaaag

SEQ ID NO: 2912750 - RNA, 16 nt, Human
uaugcaauuuccuuuu

SEQ ID NO: 2912751 - RNA, 17 nt, Human
uaugcaauggauuuuca

SEQ ID NO: 2912752 - RNA, 22 nt, Human
uaugcaauggauuuucaaccag

SEQ ID NO: 2912753 - RNA, 13 nt, Human
uaugcacauaugg

SEQ ID NO: 2912754 - RNA, 21 nt, Human
uaugauucagauuguuaucua

SEQ ID NO: 2912755 - RNA, 13 nt, Human
uaugagcagaagg

SEQ ID NO: 2912756 - RNA, 15 nt, Human
uaugagcagaaggaa

SEQ ID NO: 2912757 - RNA, 13 nt, Human
uaugagcauccug

SEQ ID NO: 2912758 - RNA, 17 nt, Human
uaugagcauccugagcc

SEQ ID NO: 2912759 - RNA, 18 nt, Human
uaugagcauccugagccc

SEQ ID NO: 2912760 - RNA, 20 nt, Human
uaugagcauccugagccccg

SEQ ID NO: 2912761 - RNA, 22 nt, Human
uaugagcauccugagccccgcc

SEQ ID NO: 2912762 - RNA, 12 nt, Human
uaugagaaaugu

SEQ ID NO: 2912763 - RNA, 13 nt, Human
uaugagaaaugua

SEQ ID NO: 2912764 - RNA, 14 nt, Human
uaugagaaauguaa

SEQ ID NO: 2912765 - RNA, 16 nt, Human
uaugagaaauguaaug

SEQ ID NO: 2912766 - RNA, 14 nt, Human
uaugagaagaauag

SEQ ID NO: 2912767 - RNA, 20 nt, Human
uaugagccgugaacugugca

SEQ ID NO: 2912768 - RNA, 21 nt, Human
uaugagccgugaacugugcau

SEQ ID NO: 2912769 - RNA, 17 nt, Human
uaugacuauguaaacua

SEQ ID NO: 2912770 - RNA, 16 nt, Human
uaugacuauguaaacu

SEQ ID NO: 2912771 - RNA, 15 nt, Human
uaugacgcugauaca

SEQ ID NO: 2912772 - RNA, 16 nt, Human
uaugacgcugauacau

SEQ ID NO: 2912773 - RNA, 17 nt, Human
uaugacgcugauacaua

SEQ ID NO: 2912774 - RNA, 18 nt, Human
uaugacgcugauacauaa

SEQ ID NO: 2912775 - RNA, 22 nt, Human
uaugacgcugauacauaacuaa

SEQ ID NO: 2912776 - RNA, 23 nt, Human
uaugacgcugauacauaacuaaa

SEQ ID NO: 2912777 - RNA, 20 nt, Human
uaugacauucaugccuggcu

SEQ ID NO: 2912778 - RNA, 17 nt, Human
uaugacugcuccccagc

SEQ ID NO: 2912779 - RNA, 18 nt, Human
uaugacuauguaaacuac

SEQ ID NO: 2912780 - RNA, 18 nt, Human
uaugacugcuccccagcc

SEQ ID NO: 2912781 - RNA, 22 nt, Human
uaugacugcuccccagcccugg

SEQ ID NO: 2912782 - RNA, 15 nt, Human
uaugcacuaaauaug

SEQ ID NO: 2912783 - RNA, 16 nt, Human
uaugcacuaaauauga

SEQ ID NO: 2912784 - RNA, 14 nt, Human
uaugcaccuugugu

SEQ ID NO: 2912785 - RNA, 21 nt, Human
uaugauuguuucucaaaucuu

SEQ ID NO: 2912786 - RNA, 19 nt, Human
uaugcacauauggacucug

SEQ ID NO: 2912787 - RNA, 20 nt, Human
uaugcacauauggacucugc

SEQ ID NO: 2912788 - RNA, 18 nt, Human
uaugcaccuugugucugu

SEQ ID NO: 2912789 - RNA, 19 nt, Human
uaugcaccuugugucugua

SEQ ID NO: 2912790 - RNA, 20 nt, Human
uaugcaccuugugucuguac

SEQ ID NO: 2912791 - RNA, 22 nt, Human
uaugcaccuugugucuguacac

SEQ ID NO: 2912792 - RNA, 19 nt, Human
uaugcagugauauggcaga

SEQ ID NO: 2912793 - RNA, 22 nt, Human
uaugcagugauauggcagaaga

SEQ ID NO: 2912794 - RNA, 14 nt, Human
uaugcagaauguuu

SEQ ID NO: 2912795 - RNA, 18 nt, Human
uaugcagagguccacaac

SEQ ID NO: 2912796 - RNA, 16 nt, Human
uauggaaaaucagcug

SEQ ID NO: 2912797 - RNA, 14 nt, Human
uauggaaacccgag

SEQ ID NO: 2912798 - RNA, 17 nt, Human
uauggaaacccgagggu

SEQ ID NO: 2912799 - RNA, 16 nt, Human
uauggaaauaaaugua

SEQ ID NO: 2912800 - RNA, 21 nt, Human
uauggaaaaaccauuugaagu

SEQ ID NO: 2912801 - RNA, 17 nt, Human
uaugcagauagaaucaa

SEQ ID NO: 2912802 - RNA, 13 nt, Human
uaugcuugcucua

SEQ ID NO: 2912803 - RNA, 17 nt, Human
uauggaaauaaauguau

SEQ ID NO: 2912804 - RNA, 13 nt, Human
uauggaacucucu

SEQ ID NO: 2912805 - RNA, 17 nt, Human
uauggaacucucuccac

SEQ ID NO: 2912806 - RNA, 13 nt, Human
uauggaacuucua

SEQ ID NO: 2912807 - RNA, 15 nt, Human
uauggaacuucuaau

SEQ ID NO: 2912808 - RNA, 17 nt, Human
uauggaacuucuaauau

SEQ ID NO: 2912809 - RNA, 20 nt, Human
uauggaacuucuaauauauu

SEQ ID NO: 2912810 - RNA, 19 nt, Human
uauggaaggguuuguggcu

SEQ ID NO: 2912811 - RNA, 22 nt, Human
uauggaaggguuuguggcuggg

SEQ ID NO: 2912812 - RNA, 18 nt, Human
uauggaauugauuugcau

SEQ ID NO: 2912813 - RNA, 18 nt, Human
uauggaaguugcauaauu

SEQ ID NO: 2912814 - RNA, 14 nt, Human
uauggacacagggu

SEQ ID NO: 2912815 - RNA, 13 nt, Human
uauggaaucaauu

SEQ ID NO: 2912816 - RNA, 15 nt, Human
uauggaaucaauuca

SEQ ID NO: 2912817 - RNA, 14 nt, Human
uauggaauuacaug

SEQ ID NO: 2912818 - RNA, 18 nt, Human
uauggaauuacauguaaa

SEQ ID NO: 2912819 - RNA, 22 nt, Human
uauggaauuacauguaaaacau

SEQ ID NO: 2912820 - RNA, 11 nt, Human
uauggaauuga

SEQ ID NO: 2912821 - RNA, 19 nt, Human
uauggaauugauuugcauu

SEQ ID NO: 2912822 - RNA, 19 nt, Human
uauggaauuuauaauucag

SEQ ID NO: 2912823 - RNA, 20 nt, Human
uauggaauuuauaauucagu

SEQ ID NO: 2912824 - RNA, 22 nt, Human
uauggaauuuauaauucaguau

SEQ ID NO: 2912825 - RNA, 12 nt, Human
uauaucugaaaa

SEQ ID NO: 2912826 - RNA, 16 nt, Human
uauaucugaaaacugg

SEQ ID NO: 2912827 - RNA, 17 nt, Human
uauaucugaaaacugga

SEQ ID NO: 2912828 - RNA, 18 nt, Human
uauaucugaaaacuggaa

SEQ ID NO: 2912829 - RNA, 14 nt, Human
uauauguguaugua

SEQ ID NO: 2912830 - RNA, 14 nt, Human
uauauguguauaua

SEQ ID NO: 2912831 - RNA, 17 nt, Human
uauauguguauauauac

SEQ ID NO: 2912832 - RNA, 18 nt, Human
uauauguguauauauaca

SEQ ID NO: 2912833 - RNA, 19 nt, Human
uauauguguauauauacau

SEQ ID NO: 2912834 - RNA, 20 nt, Human
uauauguguauauauacaua

SEQ ID NO: 2912835 - RNA, 16 nt, Human
uauauguauuauuuau

SEQ ID NO: 2912836 - RNA, 12 nt, Human
uauauguauuuu

SEQ ID NO: 2912837 - RNA, 17 nt, Human
uauauguauuuuuauau

SEQ ID NO: 2912838 - RNA, 22 nt, Human
uauaugugaauccucuucuuua

SEQ ID NO: 2912839 - RNA, 12 nt, Human
uauaugugagga

SEQ ID NO: 2912840 - RNA, 19 nt, Human
uauauguauuauuuauaau

SEQ ID NO: 2912841 - RNA, 11 nt, Human
uauauguauuu

SEQ ID NO: 2912842 - RNA, 18 nt, Human
uauauaaauguaaaaaua

SEQ ID NO: 2912843 - RNA, 22 nt, Human
uauauaaauguaaaaauaauaa

SEQ ID NO: 2912844 - RNA, 14 nt, Human
uauauaaaugggaa

SEQ ID NO: 2912845 - RNA, 17 nt, Human
uauauaaaugggaacau

SEQ ID NO: 2912846 - RNA, 14 nt, Human
uauauaaaguauag

SEQ ID NO: 2912847 - RNA, 17 nt, Human
uauaguuaggauagcau

SEQ ID NO: 2912848 - RNA, 21 nt, Human
uauaguguaaaauaagaauga

SEQ ID NO: 2912849 - RNA, 13 nt, Human
uauaguguaaaau

SEQ ID NO: 2912850 - RNA, 18 nt, Human
uauaguguaaaauaagaa

SEQ ID NO: 2912851 - RNA, 16 nt, Human
uauagugcacaaaaug

SEQ ID NO: 2912852 - RNA, 17 nt, Human
uauagugcacaaaauga

SEQ ID NO: 2912853 - RNA, 18 nt, Human
uauagugcacaaaaugaa

SEQ ID NO: 2912854 - RNA, 20 nt, Human
uauagugcuauauauauaaa

SEQ ID NO: 2912855 - RNA, 15 nt, Human
uauaguggaaaaaca

SEQ ID NO: 2912856 - RNA, 18 nt, Human
uauaguggaaaaacacau

SEQ ID NO: 2912857 - RNA, 17 nt, Human
uauaguuccuaagaagc

SEQ ID NO: 2912858 - RNA, 22 nt, Human
uauaguuccuaagaagcuucua

SEQ ID NO: 2912859 - RNA, 23 nt, Human
uauaguuccuaagaagcuucuaa

SEQ ID NO: 2912860 - RNA, 18 nt, Human
uauaguuaggauagcauu

SEQ ID NO: 2912861 - RNA, 19 nt, Human
uauaguuaggauagcauuu

SEQ ID NO: 2912862 - RNA, 13 nt, Human
uauaguucuaggc

SEQ ID NO: 2912863 - RNA, 13 nt, Human
uauaguugcuuuu

SEQ ID NO: 2912864 - RNA, 14 nt, Human
uauaguugucagua

SEQ ID NO: 2912865 - RNA, 21 nt, Human
uauaguugucaguauuauucu

SEQ ID NO: 2912866 - RNA, 12 nt, Human
uauaguucuaga

SEQ ID NO: 2912867 - RNA, 13 nt, Human
uauaguucuagac

SEQ ID NO: 2912868 - RNA, 15 nt, Human
uauaguucuagacau

SEQ ID NO: 2912869 - RNA, 12 nt, Human
uauaguucuagg

SEQ ID NO: 2912870 - RNA, 13 nt, Human
uauaguuucagau

SEQ ID NO: 2912871 - RNA, 19 nt, Human
uauaguuuauugacaauaa

SEQ ID NO: 2912872 - RNA, 14 nt, Human
uauaguuuaaaaca

SEQ ID NO: 2912873 - RNA, 18 nt, Human
uauaguuuaaaacacauu

SEQ ID NO: 2912874 - RNA, 19 nt, Human
uauaguuuaaaacacauug

SEQ ID NO: 2912875 - RNA, 15 nt, Human
uauaguuuguacaug

SEQ ID NO: 2912876 - RNA, 18 nt, Human
uauaguuuguacaugcau

SEQ ID NO: 2912877 - RNA, 22 nt, Human
uauaguuucagauauauaucau

SEQ ID NO: 2912878 - RNA, 14 nt, Human
uauaguuucugagg

SEQ ID NO: 2912879 - RNA, 22 nt, Human
uauaguuucugaggcuuuauga

SEQ ID NO: 2912880 - RNA, 15 nt, Human
uauaguuugggcuuc

SEQ ID NO: 2912881 - RNA, 17 nt, Human
uauaguuugggcuucag

SEQ ID NO: 2912882 - RNA, 15 nt, Human
uauacgcuuuucuuu

SEQ ID NO: 2912883 - RNA, 17 nt, Human
uauacgaacaaaacaca

SEQ ID NO: 2912884 - RNA, 15 nt, Human
uauacgaacaaaaca

SEQ ID NO: 2912885 - RNA, 16 nt, Human
uauaccuuugccuugg

SEQ ID NO: 2912886 - RNA, 17 nt, Human
uauacugauuaugucuu

SEQ ID NO: 2912887 - RNA, 20 nt, Human
uauacugauuaugucuuuua

SEQ ID NO: 2912888 - RNA, 14 nt, Human
uauaauucuguaaa

SEQ ID NO: 2912889 - RNA, 15 nt, Human
uauaauucuguaaau

SEQ ID NO: 2912890 - RNA, 13 nt, Human
uauaauucuguaa

SEQ ID NO: 2912891 - RNA, 16 nt, Human
uauaauucuguaaaug

SEQ ID NO: 2912892 - RNA, 19 nt, Human
uauaccugugccucggcuu

SEQ ID NO: 2912893 - RNA, 15 nt, Human
uauaccugugccucg

SEQ ID NO: 2912894 - RNA, 13 nt, Human
uauaaucugucaa

SEQ ID NO: 2912895 - RNA, 14 nt, Human
uauaaucugucaaa

SEQ ID NO: 2912896 - RNA, 19 nt, Human
uauaaucugucaaaacacu

SEQ ID NO: 2912897 - RNA, 20 nt, Human
uauaaucugucaaaacacug

SEQ ID NO: 2912898 - RNA, 21 nt, Human
uauaaucugucaaaacacugu

SEQ ID NO: 2912899 - RNA, 22 nt, Human
uauaaucugucaaaacacugug

SEQ ID NO: 2912900 - RNA, 23 nt, Human
uauaaucugucaaaacacugugg

SEQ ID NO: 2912901 - RNA, 18 nt, Human
uauaaucccagcacuuug

SEQ ID NO: 2912902 - RNA, 15 nt, Human
uauaaagaauauaua

SEQ ID NO: 2912903 - RNA, 14 nt, Human
uauaaugaaaacau

SEQ ID NO: 2912904 - RNA, 12 nt, Human
uauaaugugugu

SEQ ID NO: 2912905 - RNA, 13 nt, Human
uauaaugugugua

SEQ ID NO: 2912906 - RNA, 14 nt, Human
uauaauguguguau

SEQ ID NO: 2912907 - RNA, 15 nt, Human
uauaauguguguaug

SEQ ID NO: 2912908 - RNA, 17 nt, Human
uauaauguguguaugug

SEQ ID NO: 2912909 - RNA, 19 nt, Human
uauaauguguguaugugua

SEQ ID NO: 2912910 - RNA, 20 nt, Human
uauaauguguguauguguau

SEQ ID NO: 2912911 - RNA, 22 nt, Human
uauaauguguguauguguauuu

SEQ ID NO: 2912912 - RNA, 22 nt, Human
uaguugcguggacucugcacau

SEQ ID NO: 2912913 - RNA, 18 nt, Human
uauaaagaagaacuugca

SEQ ID NO: 2912914 - RNA, 17 nt, Human
uaguugcaauagaacag

SEQ ID NO: 2912915 - RNA, 13 nt, Human
uaguugauauguu

SEQ ID NO: 2912916 - RNA, 21 nt, Human
uaguugccaaaucuggcuccu

SEQ ID NO: 2912917 - RNA, 12 nt, Human
uauaaaugagca

SEQ ID NO: 2912918 - RNA, 13 nt, Human
uauaaaugagcaa

SEQ ID NO: 2912919 - RNA, 17 nt, Human
uauaaagauggcugacu

SEQ ID NO: 2912920 - RNA, 21 nt, Human
uauaaagcgauauacagauga

SEQ ID NO: 2912921 - RNA, 22 nt, Human
uauaaagcgauauacagaugaa

SEQ ID NO: 2912922 - RNA, 23 nt, Human
uauaaagcgauauacagaugaaa

SEQ ID NO: 2912923 - RNA, 16 nt, Human
uauaaagcuagaugcu

SEQ ID NO: 2912924 - RNA, 19 nt, Human
uauaaagaagaacuugcau

SEQ ID NO: 2912925 - RNA, 17 nt, Human
uauaaagagaagacgaa

SEQ ID NO: 2912926 - RNA, 16 nt, Human
uauaaauguauauaca

SEQ ID NO: 2912927 - RNA, 18 nt, Human
uauaaauguauauacaca

SEQ ID NO: 2912928 - RNA, 19 nt, Human
uauaaauguauauacacau

SEQ ID NO: 2912929 - RNA, 20 nt, Human
uauaaauguauauacacaua

SEQ ID NO: 2912930 - RNA, 23 nt, Human
uauaaauguauauacacauauac

SEQ ID NO: 2912931 - RNA, 15 nt, Human
uauaaaugggaacau

SEQ ID NO: 2912932 - RNA, 17 nt, Human
uauaaaugggaacauuu

SEQ ID NO: 2912933 - RNA, 15 nt, Human
uauaaaugugauaug

SEQ ID NO: 2912934 - RNA, 14 nt, Human
uauaauaaaaugug

SEQ ID NO: 2912935 - RNA, 20 nt, Human
uauaauaaaauguguugaaa

SEQ ID NO: 2912936 - RNA, 12 nt, Human
uauaauaaacau

SEQ ID NO: 2912937 - RNA, 14 nt, Human
uauaauaaacauaa

SEQ ID NO: 2912938 - RNA, 14 nt, Human
uauaauaaaggacu

SEQ ID NO: 2912939 - RNA, 22 nt, Human
uauaauaaaggacuguaaucuu

SEQ ID NO: 2912940 - RNA, 19 nt, Human
uauaauaaaggacuguaau

SEQ ID NO: 2912941 - RNA, 15 nt, Human
uauaauauauuugug

SEQ ID NO: 2912942 - RNA, 14 nt, Human
uauaauauauauau

SEQ ID NO: 2912943 - RNA, 20 nt, Human
uauaauauauauauauauca

SEQ ID NO: 2912944 - RNA, 16 nt, Human
uauaauauauuugugu

SEQ ID NO: 2912945 - RNA, 22 nt, Human
uauaauauauuuguguauuuaa

SEQ ID NO: 2912946 - RNA, 15 nt, Human
uauaauauccuuugu

SEQ ID NO: 2912947 - RNA, 14 nt, Human
uauaauaucuaaag

SEQ ID NO: 2912948 - RNA, 20 nt, Human
uauaauaucuaaaguuauau

SEQ ID NO: 2912949 - RNA, 17 nt, Human
uauaauagcaacuuuug

SEQ ID NO: 2912950 - RNA, 14 nt, Human
uauaauacucuguu

SEQ ID NO: 2912951 - RNA, 17 nt, Human
uauaauacucuguugua

SEQ ID NO: 2912952 - RNA, 18 nt, Human
uaguauaccggaauuacu

SEQ ID NO: 2912953 - RNA, 16 nt, Human
uaguauaaagaaaagu

SEQ ID NO: 2912954 - RNA, 14 nt, Human
uaguauaaagaaaa

SEQ ID NO: 2912955 - RNA, 14 nt, Human
uaguaguucucuug

SEQ ID NO: 2912956 - RNA, 14 nt, Human
uaguaguuuuuaca

SEQ ID NO: 2912957 - RNA, 13 nt, Human
uaguaucaguguu

SEQ ID NO: 2912958 - RNA, 16 nt, Human
uaguaucaguguuuua

SEQ ID NO: 2912959 - RNA, 17 nt, Human
uaguaucaguguuuuaa

SEQ ID NO: 2912960 - RNA, 19 nt, Human
uaguaucaguguuuuaaau

SEQ ID NO: 2912961 - RNA, 21 nt, Human
uaguaucaguguuuuaaauuc

SEQ ID NO: 2912962 - RNA, 22 nt, Human
uaguaucaguguuuuaaauucu

SEQ ID NO: 2912963 - RNA, 23 nt, Human
uaggugacagagugagacucugu

SEQ ID NO: 2912964 - RNA, 21 nt, Human
uaggugauccacucgccuuca

SEQ ID NO: 2912965 - RNA, 15 nt, Human
uaggugagaaaaaaa

SEQ ID NO: 2912966 - RNA, 22 nt, Human
uaggugauguuugcucuuguuu

SEQ ID NO: 2912967 - RNA, 18 nt, Human
uaguaguaugaugauaca

SEQ ID NO: 2912968 - RNA, 22 nt, Human
uaggugcaauuucaagguucua

SEQ ID NO: 2912969 - RNA, 13 nt, Human
uaguauuuuuauc

SEQ ID NO: 2912970 - RNA, 15 nt, Human
uaguauuuuuaucca

SEQ ID NO: 2912971 - RNA, 12 nt, Human
uaguauuugaau

SEQ ID NO: 2912972 - RNA, 13 nt, Human
uaguauuugaauu

SEQ ID NO: 2912973 - RNA, 14 nt, Human
uaguauuugaauua

SEQ ID NO: 2912974 - RNA, 18 nt, Human
uaguauuugaauuaaaac

SEQ ID NO: 2912975 - RNA, 21 nt, Human
uaguauuugaauuaaaacuuc

SEQ ID NO: 2912976 - RNA, 12 nt, Human
uaguauuugauu

SEQ ID NO: 2912977 - RNA, 17 nt, Human
uaguauuugauucaaaa

SEQ ID NO: 2912978 - RNA, 20 nt, Human
uaguauuugauucaaaauau

SEQ ID NO: 2912979 - RNA, 23 nt, Human
uaguauuugauucaaaauauuua

SEQ ID NO: 2912980 - RNA, 19 nt, Human
uaguaugacgcugauacau

SEQ ID NO: 2912981 - RNA, 20 nt, Human
uaguaugacgcugauacaua

SEQ ID NO: 2912982 - RNA, 16 nt, Human
uagucaaauuauguau

SEQ ID NO: 2912983 - RNA, 15 nt, Human
uagugcacaaaauga

SEQ ID NO: 2912984 - RNA, 17 nt, Human
uagugcccuccacagcc

SEQ ID NO: 2912985 - RNA, 22 nt, Human
uagugcauccaguuaaccaagu

SEQ ID NO: 2912986 - RNA, 16 nt, Human
uagugcaucuuugccu

SEQ ID NO: 2912987 - RNA, 19 nt, Human
uagugcaucuuugccucuc

SEQ ID NO: 2912988 - RNA, 20 nt, Human
uagugcauuguuucuguggg

SEQ ID NO: 2912989 - RNA, 21 nt, Human
uagugcauuguuucugugggc

SEQ ID NO: 2912990 - RNA, 20 nt, Human
uagugccagaauuuuaggaa

SEQ ID NO: 2912991 - RNA, 21 nt, Human
uagugccagaauuuuaggaac

SEQ ID NO: 2912992 - RNA, 23 nt, Human
uagugcccuccacagccgcagcc

SEQ ID NO: 2912993 - RNA, 19 nt, Human
uaguguccauuuugugaag

SEQ ID NO: 2912994 - RNA, 23 nt, Human
uaguguccauuuugugaagcccu

SEQ ID NO: 2912995 - RNA, 14 nt, Human
uaguguccuaugca

SEQ ID NO: 2912996 - RNA, 16 nt, Human
uaguguccuaugcaau

SEQ ID NO: 2912997 - RNA, 17 nt, Human
uaguguccuaugcaaua

SEQ ID NO: 2912998 - RNA, 17 nt, Human
uagugugggaggcuccu

SEQ ID NO: 2912999 - RNA, 22 nt, Human
uagugugggaggcuccuguuag

SEQ ID NO: 2913000 - RNA, 18 nt, Human
uaggaauuaaguuaucuu

SEQ ID NO: 2913001 - RNA, 17 nt, Human
uaggaauucaucuuuug

SEQ ID NO: 2913002 - RNA, 18 nt, Human
uaggaauucaucuuuuga

SEQ ID NO: 2913003 - RNA, 17 nt, Human
uaggaaugugaaagcac

SEQ ID NO: 2913004 - RNA, 14 nt, Human
uaggaaucagcaag

SEQ ID NO: 2913005 - RNA, 15 nt, Human
uaggaaucagcaaga

SEQ ID NO: 2913006 - RNA, 18 nt, Human
guggcugaggaggccucc

SEQ ID NO: 2913007 - RNA, 17 nt, Human
guggcugaggaggccuc

SEQ ID NO: 2913008 - RNA, 21 nt, Human
guggcucugaggugccugucc

SEQ ID NO: 2913009 - RNA, 12 nt, Human
uaggaaucagca

SEQ ID NO: 2913010 - RNA, 19 nt, Human
uaggaccaugguuaagagu

SEQ ID NO: 2913011 - RNA, 23 nt, Human
uaggaccaugguuaagaguccaa

SEQ ID NO: 2913012 - RNA, 15 nt, Human
uaggaccacucagcc

SEQ ID NO: 2913013 - RNA, 16 nt, Human
uaggaccacucagccc

SEQ ID NO: 2913014 - RNA, 17 nt, Human
uaggaccacucagcccc

SEQ ID NO: 2913015 - RNA, 18 nt, Human
uaggaccacucagccccu

SEQ ID NO: 2913016 - RNA, 19 nt, Human
uaggaccacucagccccua

SEQ ID NO: 2913017 - RNA, 21 nt, Human
uaggaccacucagccccuagg

SEQ ID NO: 2913018 - RNA, 16 nt, Human
uaggaccaggauccag

SEQ ID NO: 2913019 - RNA, 20 nt, Human
uaggaccaggauccagccuc

SEQ ID NO: 2913020 - RNA, 13 nt, Human
uaggaccuugggc

SEQ ID NO: 2913021 - RNA, 14 nt, Human
uaggaccuugggcc

SEQ ID NO: 2913022 - RNA, 13 nt, Human
uaggcccacacac

SEQ ID NO: 2913023 - RNA, 14 nt, Human
uaggcccacacaca

SEQ ID NO: 2913024 - RNA, 15 nt, Human
uaggcccacacacag

SEQ ID NO: 2913025 - RNA, 16 nt, Human
uaggcccacacacagg

SEQ ID NO: 2913026 - RNA, 17 nt, Human
uaggcccacacacaggu

SEQ ID NO: 2913027 - RNA, 15 nt, Human
uaggccuggccagau

SEQ ID NO: 2913028 - RNA, 19 nt, Human
uaggcccggagcugccccu

SEQ ID NO: 2913029 - RNA, 18 nt, Human
uaggccuggccagaugca

SEQ ID NO: 2913030 - RNA, 21 nt, Human
uaggccuuccucucuccagau

SEQ ID NO: 2913031 - RNA, 18 nt, Human
uaggacaaaguauuugaa

SEQ ID NO: 2913032 - RNA, 19 nt, Human
uaggccggugugccugacu

SEQ ID NO: 2913033 - RNA, 18 nt, Human
uagguacuuuuugugaag

SEQ ID NO: 2913034 - RNA, 14 nt, Human
uagguagaaaaagg

SEQ ID NO: 2913035 - RNA, 16 nt, Human
uagguagaaaaagggu

SEQ ID NO: 2913036 - RNA, 18 nt, Human
uagguagaaaaaggguca

SEQ ID NO: 2913037 - RNA, 20 nt, Human
uagguaaucaaugaauauug

SEQ ID NO: 2913038 - RNA, 14 nt, Human
uagguacacagcuc

SEQ ID NO: 2913039 - RNA, 14 nt, Human
uagguauuucaaaa

SEQ ID NO: 2913040 - RNA, 20 nt, Human
uagguauaaguggugugugu

SEQ ID NO: 2913041 - RNA, 12 nt, Human
uaggcucugccu

SEQ ID NO: 2913042 - RNA, 23 nt, Human
uaggccuuccucucuccagaugu

SEQ ID NO: 2913043 - RNA, 19 nt, Human
uaggcucagagaugugcac

SEQ ID NO: 2913044 - RNA, 22 nt, Human
uaggcuccugccaguguggaac

SEQ ID NO: 2913045 - RNA, 21 nt, Human
ucauuguacuaccuguguaua

SEQ ID NO: 2913046 - RNA, 13 nt, Human
ucauuagcuguga

SEQ ID NO: 2913047 - RNA, 17 nt, Human
ucauuagcugugauuuu

SEQ ID NO: 2913048 - RNA, 18 nt, Human
ucauuagcugugauuuuu

SEQ ID NO: 2913049 - RNA, 23 nt, Human
ucaugguggguucaggggacuca

SEQ ID NO: 2913050 - RNA, 13 nt, Human
ucaugguguaaua

SEQ ID NO: 2913051 - RNA, 14 nt, Human
ucaugguguaauaa

SEQ ID NO: 2913052 - RNA, 19 nt, Human
ucauggugaaaauguacug

SEQ ID NO: 2913053 - RNA, 14 nt, Human
ucauggugaaaaug

SEQ ID NO: 2913054 - RNA, 19 nt, Human
ucaugguguaauaagacau

SEQ ID NO: 2913055 - RNA, 10 nt, Human
ucauuagaac

SEQ ID NO: 2913056 - RNA, 15 nt, Human
ucaugguguaauaag

SEQ ID NO: 2913057 - RNA, 16 nt, Human
ucaugguguaauaaga

SEQ ID NO: 2913058 - RNA, 17 nt, Human
ucaugguguaauaagac

SEQ ID NO: 2913059 - RNA, 18 nt, Human
ucaugguguaauaagaca

SEQ ID NO: 2913060 - RNA, 13 nt, Human
ucauuagagcagg

SEQ ID NO: 2913061 - RNA, 15 nt, Human
ucauuagagcaggcg

SEQ ID NO: 2913062 - RNA, 12 nt, Human
ucauuagagcag

SEQ ID NO: 2913063 - RNA, 13 nt, Human
ucauuagacuccu

SEQ ID NO: 2913064 - RNA, 18 nt, Human
ucauuagacuccuccucc

SEQ ID NO: 2913065 - RNA, 23 nt, Human
ucauuuaaguuucaaacuuacua

SEQ ID NO: 2913066 - RNA, 22 nt, Human
ucauuuaacugaagauguugag

SEQ ID NO: 2913067 - RNA, 12 nt, Human
ucauuguuuuga

SEQ ID NO: 2913068 - RNA, 13 nt, Human
ucauuguuuugaa

SEQ ID NO: 2913069 - RNA, 17 nt, Human
ucauuguuuugaauauu

SEQ ID NO: 2913070 - RNA, 23 nt, Human
ucauuguaugauguguugugaua

SEQ ID NO: 2913071 - RNA, 15 nt, Human
ucauuguauguuauu

SEQ ID NO: 2913072 - RNA, 13 nt, Human
ucauugucccucu

SEQ ID NO: 2913073 - RNA, 16 nt, Human
ucauugucccucuuca

SEQ ID NO: 2913074 - RNA, 20 nt, Human
ucauugucccucuucacucc

SEQ ID NO: 2913075 - RNA, 21 nt, Human
ucauugucccucuucacuccc

SEQ ID NO: 2913076 - RNA, 22 nt, Human
ucauugucucucacagauguga

SEQ ID NO: 2913077 - RNA, 14 nt, Human
ucauuguaugaugu

SEQ ID NO: 2913078 - RNA, 15 nt, Human
ucauuguaugaugug

SEQ ID NO: 2913079 - RNA, 17 nt, Human
ucauuguaugauguguu

SEQ ID NO: 2913080 - RNA, 18 nt, Human
ucauuguaugauguguug

SEQ ID NO: 2913081 - RNA, 12 nt, Human
ucauuuagaacu

SEQ ID NO: 2913082 - RNA, 16 nt, Human
ucauuuagaacuugca

SEQ ID NO: 2913083 - RNA, 22 nt, Human
ucauuuagaacuugcagcugau

SEQ ID NO: 2913084 - RNA, 19 nt, Human
ucauuuagauugaaaacuu

SEQ ID NO: 2913085 - RNA, 17 nt, Human
ucauuuagugaguuauu

SEQ ID NO: 2913086 - RNA, 23 nt, Human
ucauuuagugaguuauuccuuga

SEQ ID NO: 2913087 - RNA, 15 nt, Human
ucauuuacuaaacau

SEQ ID NO: 2913088 - RNA, 16 nt, Human
ucauuuacuaaacaua

SEQ ID NO: 2913089 - RNA, 22 nt, Human
ucauuuacuaaacauaugauuu

SEQ ID NO: 2913090 - RNA, 15 nt, Human
uccaaacauguauuu

SEQ ID NO: 2913091 - RNA, 19 nt, Human
uccaaacauguauuuaugu

SEQ ID NO: 2913092 - RNA, 20 nt, Human
uccaaacauguauuuaugua

SEQ ID NO: 2913093 - RNA, 19 nt, Human
uccaaagaggcugccccuc

SEQ ID NO: 2913094 - RNA, 20 nt, Human
uccaaagaguagaauugcau

SEQ ID NO: 2913095 - RNA, 21 nt, Human
uccaaaggccauggagagcug

SEQ ID NO: 2913096 - RNA, 22 nt, Human
uccaaaggccauggagagcugg

SEQ ID NO: 2913097 - RNA, 23 nt, Human
uccaaaggccauggagagcugga

SEQ ID NO: 2913098 - RNA, 14 nt, Human
uccaaaggcccccu

SEQ ID NO: 2913099 - RNA, 18 nt, Human
uccaaagaggcugccccu

SEQ ID NO: 2913100 - RNA, 16 nt, Human
uccaaagaggcugccc

SEQ ID NO: 2913101 - RNA, 15 nt, Human
uccaaagaggcugcc

SEQ ID NO: 2913102 - RNA, 14 nt, Human
uccaaagaggcugc

SEQ ID NO: 2913103 - RNA, 13 nt, Human
uccaaagaggcug

SEQ ID NO: 2913104 - RNA, 12 nt, Human
uccaaagaaugu

SEQ ID NO: 2913105 - RNA, 13 nt, Human
uccaaagaauguu

SEQ ID NO: 2913106 - RNA, 20 nt, Human
uccaaagaauguuagagcac

SEQ ID NO: 2913107 - RNA, 23 nt, Human
uccaaagaauguuagagcacagu

SEQ ID NO: 2913108 - RNA, 15 nt, Human
ucauuuaucccucaa

SEQ ID NO: 2913109 - RNA, 19 nt, Human
ucauuuauaucgcuggcca

SEQ ID NO: 2913110 - RNA, 18 nt, Human
ucauuuauuguuuaugua

SEQ ID NO: 2913111 - RNA, 22 nt, Human
ucauuuauuguuuauguaaaug

SEQ ID NO: 2913112 - RNA, 20 nt, Human
ucauuuauuuuaaaaaauga

SEQ ID NO: 2913113 - RNA, 16 nt, Human
ucauuuauuuuaagca

SEQ ID NO: 2913114 - RNA, 18 nt, Human
ucauuucaaaaugcuuca

SEQ ID NO: 2913115 - RNA, 22 nt, Human
uccaaaaagauuuucagaaaau

SEQ ID NO: 2913116 - RNA, 19 nt, Human
uccaaaaagcuccuggggc

SEQ ID NO: 2913117 - RNA, 14 nt, Human
ucauuucacauuaa

SEQ ID NO: 2913118 - RNA, 19 nt, Human
ucauuucacauuaaugguc

SEQ ID NO: 2913119 - RNA, 13 nt, Human
uccaaaaauuauu

SEQ ID NO: 2913120 - RNA, 14 nt, Human
uccaaaaauuauua

SEQ ID NO: 2913121 - RNA, 22 nt, Human
uccaaaaauuauuauaagcauu

SEQ ID NO: 2913122 - RNA, 16 nt, Human
uccaaaccaaauaaaa

SEQ ID NO: 2913123 - RNA, 14 nt, Human
uccaaaauuuuuca

SEQ ID NO: 2913124 - RNA, 15 nt, Human
uccaaaauuuuucaa

SEQ ID NO: 2913125 - RNA, 19 nt, Human
uccaaaauuuuucaacccc

SEQ ID NO: 2913126 - RNA, 21 nt, Human
uccaaaauuuuucaaccccac

SEQ ID NO: 2913127 - RNA, 12 nt, Human
uccaaaauucuu

SEQ ID NO: 2913128 - RNA, 23 nt, Human
ucauagaaauguaacuuuuguaa

SEQ ID NO: 2913129 - RNA, 17 nt, Human
ucaucaaggcacugccu

SEQ ID NO: 2913130 - RNA, 14 nt, Human
ucauagagauuugu

SEQ ID NO: 2913131 - RNA, 20 nt, Human
ucauagagauuugucuaauu

SEQ ID NO: 2913132 - RNA, 19 nt, Human
ucaguguaccauuugccuc

SEQ ID NO: 2913133 - RNA, 18 nt, Human
ucaguguaccauuugccu

SEQ ID NO: 2913134 - RNA, 14 nt, Human
ucaguguaguuaau

SEQ ID NO: 2913135 - RNA, 15 nt, Human
ucaguguaguuaauu

SEQ ID NO: 2913136 - RNA, 17 nt, Human
ucaguguaguuaauuua

SEQ ID NO: 2913137 - RNA, 18 nt, Human
ucaguguaguuaauuuau

SEQ ID NO: 2913138 - RNA, 22 nt, Human
ucaguguauggaaauaaaugua

SEQ ID NO: 2913139 - RNA, 15 nt, Human
ucaguguauuucagu

SEQ ID NO: 2913140 - RNA, 16 nt, Human
ucaguguauuucaguu

SEQ ID NO: 2913141 - RNA, 17 nt, Human
ucaguguauuucaguuc

SEQ ID NO: 2913142 - RNA, 21 nt, Human
ucaguguauggaaauaaaugu

SEQ ID NO: 2913143 - RNA, 13 nt, Human
ucaucaaucaaau

SEQ ID NO: 2913144 - RNA, 21 nt, Human
ucaguccuccccucacagccu

SEQ ID NO: 2913145 - RNA, 21 nt, Human
ucaucaauaguguccuaugca

SEQ ID NO: 2913146 - RNA, 21 nt, Human
ucaucaaucaaauaaguauuu

SEQ ID NO: 2913147 - RNA, 23 nt, Human
ucaucaaucaaauaaguauuuau

SEQ ID NO: 2913148 - RNA, 18 nt, Human
ucaucaaggcacugccug

SEQ ID NO: 2913149 - RNA, 19 nt, Human
ucaucaaggcacugccuga

SEQ ID NO: 2913150 - RNA, 21 nt, Human
ucaucaaggcacugccugaug

SEQ ID NO: 2913151 - RNA, 21 nt, Human
ucaucaagggugcgucuggga

SEQ ID NO: 2913152 - RNA, 12 nt, Human
ucaucacacaca

SEQ ID NO: 2913153 - RNA, 13 nt, Human
ucaucacacacau

SEQ ID NO: 2913154 - RNA, 14 nt, Human
ucaucacacacaug

SEQ ID NO: 2913155 - RNA, 15 nt, Human
ucaucacacacaugg

SEQ ID NO: 2913156 - RNA, 12 nt, Human
ucaucaauuccc

SEQ ID NO: 2913157 - RNA, 15 nt, Human
ucaucaauucccauu

SEQ ID NO: 2913158 - RNA, 17 nt, Human
ucaucauuccuugagaa

SEQ ID NO: 2913159 - RNA, 14 nt, Human
ucaucauuccuuga

SEQ ID NO: 2913160 - RNA, 16 nt, Human
ucauccaccccauccc

SEQ ID NO: 2913161 - RNA, 20 nt, Human
ucauccaccccaucccuccc

SEQ ID NO: 2913162 - RNA, 12 nt, Human
ucaucaugcagc

SEQ ID NO: 2913163 - RNA, 13 nt, Human
ucaucaugcagcu

SEQ ID NO: 2913164 - RNA, 19 nt, Human
ucaucaugcagcucaacuu

SEQ ID NO: 2913165 - RNA, 20 nt, Human
ucaucauggaggucauacau

SEQ ID NO: 2913166 - RNA, 14 nt, Human
ucaucauucccucu

SEQ ID NO: 2913167 - RNA, 15 nt, Human
ucaucauucccucuc

SEQ ID NO: 2913168 - RNA, 13 nt, Human
ucaugcuuuaaag

SEQ ID NO: 2913169 - RNA, 19 nt, Human
ucaugcuuuaaaguguaau

SEQ ID NO: 2913170 - RNA, 20 nt, Human
ucaugcuuuaaaguguaaua

SEQ ID NO: 2913171 - RNA, 22 nt, Human
ucaugcuuuaaaguguaauaau

SEQ ID NO: 2913172 - RNA, 23 nt, Human
ucaugcuuuaaaguguaauaaua

SEQ ID NO: 2913173 - RNA, 17 nt, Human
ucauggaacacaaacac

SEQ ID NO: 2913174 - RNA, 18 nt, Human
ucauggaacacaaacaca

SEQ ID NO: 2913175 - RNA, 19 nt, Human
ucauggaacacaaacacau

SEQ ID NO: 2913176 - RNA, 23 nt, Human
ucauggaacacaaacacauuguu

SEQ ID NO: 2913177 - RNA, 17 nt, Human
ucaugcuucuuccuuac

SEQ ID NO: 2913178 - RNA, 17 nt, Human
ucauggaauggacaucc

SEQ ID NO: 2913179 - RNA, 18 nt, Human
ucauggaauggacauccu

SEQ ID NO: 2913180 - RNA, 20 nt, Human
ucauggaauggacauccugu

SEQ ID NO: 2913181 - RNA, 17 nt, Human
ucauggguuauguguau

SEQ ID NO: 2913182 - RNA, 14 nt, Human
ucaugggguccaag

SEQ ID NO: 2913183 - RNA, 22 nt, Human
ucauggguuauguguaugugcc

SEQ ID NO: 2913184 - RNA, 15 nt, Human
ucaucuuguguuuua

SEQ ID NO: 2913185 - RNA, 13 nt, Human
ucaucuugugaaa

SEQ ID NO: 2913186 - RNA, 14 nt, Human
ucaucuugugaaau

SEQ ID NO: 2913187 - RNA, 15 nt, Human
ucaucuugugaaaug

SEQ ID NO: 2913188 - RNA, 22 nt, Human
ucaucuugugaaauggccagga

SEQ ID NO: 2913189 - RNA, 17 nt, Human
ucauccacugugccaug

SEQ ID NO: 2913190 - RNA, 14 nt, Human
ucauccacugugcc

SEQ ID NO: 2913191 - RNA, 18 nt, Human
ucauccacugugccaugu

SEQ ID NO: 2913192 - RNA, 20 nt, Human
ucaucucaggccucccucaa

SEQ ID NO: 2913193 - RNA, 16 nt, Human
ucaucucagguagaag

SEQ ID NO: 2913194 - RNA, 16 nt, Human
ucaucucauucaaacc

SEQ ID NO: 2913195 - RNA, 13 nt, Human
ucagcuuaucucu

SEQ ID NO: 2913196 - RNA, 19 nt, Human
ucagcuuaucucuuuuaua

SEQ ID NO: 2913197 - RNA, 20 nt, Human
ucagcuuaucucuuuuauau

SEQ ID NO: 2913198 - RNA, 23 nt, Human
ucagcuucagaauggcauuguac

SEQ ID NO: 2913199 - RNA, 16 nt, Human
ucagcuucauuugugu

SEQ ID NO: 2913200 - RNA, 18 nt, Human
ucagcuucauuuguguca

SEQ ID NO: 2913201 - RNA, 21 nt, Human
ucagcuucauuugugucaaug

SEQ ID NO: 2913202 - RNA, 17 nt, Human
ucagcugucuguggcuu

SEQ ID NO: 2913203 - RNA, 17 nt, Human
ucagcuguacuucgucu

SEQ ID NO: 2913204 - RNA, 13 nt, Human
ucagcuguccucc

SEQ ID NO: 2913205 - RNA, 14 nt, Human
ucagcuguccuccc

SEQ ID NO: 2913206 - RNA, 17 nt, Human
ucagcuguccucccucc

SEQ ID NO: 2913207 - RNA, 18 nt, Human
ucagcuguccucccucca

SEQ ID NO: 2913208 - RNA, 19 nt, Human
ucagcuguccucccuccac

SEQ ID NO: 2913209 - RNA, 17 nt, Human
ucagcuuaaaauaaaca

SEQ ID NO: 2913210 - RNA, 18 nt, Human
ucagcuuaaaauaaacag

SEQ ID NO: 2913211 - RNA, 21 nt, Human
ucagcuuaaaauaaacaguug

SEQ ID NO: 2913212 - RNA, 22 nt, Human
ucagcuuacaucccugagcagg

SEQ ID NO: 2913213 - RNA, 14 nt, Human
ucagcucucuguau

SEQ ID NO: 2913214 - RNA, 15 nt, Human
ucagcucucuguaua

SEQ ID NO: 2913215 - RNA, 20 nt, Human
ucagcucucuguauaaacau

SEQ ID NO: 2913216 - RNA, 12 nt, Human
ucagcuguacuu

SEQ ID NO: 2913217 - RNA, 19 nt, Human
ucagcucuucaucugccca

SEQ ID NO: 2913218 - RNA, 20 nt, Human
ucagcucuucaucugcccaa

SEQ ID NO: 2913219 - RNA, 24 nt, Human
ucagcuccagcucaccagccccag

SEQ ID NO: 2913220 - RNA, 23 nt, Human
ucagcuccagcucaccagcccca

SEQ ID NO: 2913221 - RNA, 23 nt, Human
ucagcuccagggaauccaagccu

SEQ ID NO: 2913222 - RNA, 14 nt, Human
ucagcuccaggugg

SEQ ID NO: 2913223 - RNA, 19 nt, Human
ucagcuccagguggcucug

SEQ ID NO: 2913224 - RNA, 22 nt, Human
ucagcuccagggaauccaagcc

SEQ ID NO: 2913225 - RNA, 19 nt, Human
ucaccuaagucucugugaa

SEQ ID NO: 2913226 - RNA, 19 nt, Human
ucaccgcuucccuccugcc

SEQ ID NO: 2913227 - RNA, 19 nt, Human
ucaccggccgauggagaca

SEQ ID NO: 2913228 - RNA, 21 nt, Human
ucaccguggauucgcuugagu

SEQ ID NO: 2913229 - RNA, 17 nt, Human
ucaccuaagucucugug

SEQ ID NO: 2913230 - RNA, 17 nt, Human
ucaccuaagagauucug

SEQ ID NO: 2913231 - RNA, 22 nt, Human
ucaccuaagagauucugauuug

SEQ ID NO: 2913232 - RNA, 22 nt, Human
ucaggccuauaaccccagcucc

SEQ ID NO: 2913233 - RNA, 18 nt, Human
ucaggccuauaaccccag

SEQ ID NO: 2913234 - RNA, 13 nt, Human
ucaggccugugug

SEQ ID NO: 2913235 - RNA, 20 nt, Human
ucaggcgauccaccugucuc

SEQ ID NO: 2913236 - RNA, 18 nt, Human
ucaggccucccucucucu

SEQ ID NO: 2913237 - RNA, 17 nt, Human
ucaggccucccucucuc

SEQ ID NO: 2913238 - RNA, 21 nt, Human
ucaggcgauccaccugucuca

SEQ ID NO: 2913239 - RNA, 15 nt, Human
ucaggcuacuagaau

SEQ ID NO: 2913240 - RNA, 15 nt, Human
ucaggcucuucuccu

SEQ ID NO: 2913241 - RNA, 20 nt, Human
ucaggaucaaaccccgacca

SEQ ID NO: 2913242 - RNA, 22 nt, Human
ucaggauauccuuaucagagcu

SEQ ID NO: 2913243 - RNA, 23 nt, Human
ucaggauauccuuaucagagcua

SEQ ID NO: 2913244 - RNA, 20 nt, Human
ucaggauccaagcuaagcac

SEQ ID NO: 2913245 - RNA, 22 nt, Human
ucaggauccaagcuaagcacug

SEQ ID NO: 2913246 - RNA, 15 nt, Human
ucagcuuccuaccca

SEQ ID NO: 2913247 - RNA, 19 nt, Human
ucagcuuccuacccacacc

SEQ ID NO: 2913248 - RNA, 10 nt, Human
ucaggagcag

SEQ ID NO: 2913249 - RNA, 21 nt, Human
ucaggagcagccucagaacaa

SEQ ID NO: 2913250 - RNA, 22 nt, Human
ucaggagcagccucagaacaaa

SEQ ID NO: 2913251 - RNA, 19 nt, Human
ucagguggggcagcuugag

SEQ ID NO: 2913252 - RNA, 18 nt, Human
ucagguggggcagcuuga

SEQ ID NO: 2913253 - RNA, 23 nt, Human
ucaggugauccacccaccucagc

SEQ ID NO: 2913254 - RNA, 15 nt, Human
ucaggugacauguga

SEQ ID NO: 2913255 - RNA, 19 nt, Human
ucaggucucccacguggga

SEQ ID NO: 2913256 - RNA, 16 nt, Human
ucaggugacaugugaa

SEQ ID NO: 2913257 - RNA, 16 nt, Human
ucaggugauccaccca

SEQ ID NO: 2913258 - RNA, 23 nt, Human
ucaggucacauaaaacuuuguau

SEQ ID NO: 2913259 - RNA, 16 nt, Human
ucagguccucagagaa

SEQ ID NO: 2913260 - RNA, 12 nt, Human
ucaggucccugc

SEQ ID NO: 2913261 - RNA, 21 nt, Human
ucaggucucccacgugggaga

SEQ ID NO: 2913262 - RNA, 13 nt, Human
ucaggugaaaaug

SEQ ID NO: 2913263 - RNA, 14 nt, Human
ucaggugaaaaugu

SEQ ID NO: 2913264 - RNA, 17 nt, Human
ucaggugaaaauguuca

SEQ ID NO: 2913265 - RNA, 18 nt, Human
ucaggugaaaauguucau

SEQ ID NO: 2913266 - RNA, 12 nt, Human
ucaggcugcagc

SEQ ID NO: 2913267 - RNA, 19 nt, Human
ucaggcugcagcuggacag

SEQ ID NO: 2913268 - RNA, 20 nt, Human
ucaggcugcagcuggacaga

SEQ ID NO: 2913269 - RNA, 22 nt, Human
ucaggcugcagcuggacagagg

SEQ ID NO: 2913270 - RNA, 20 nt, Human
ucaggcugccuaagacaugu

SEQ ID NO: 2913271 - RNA, 16 nt, Human
ucaggcucuucuccuu

SEQ ID NO: 2913272 - RNA, 21 nt, Human
ucaggcucuucuccuuucaca

SEQ ID NO: 2913273 - RNA, 16 nt, Human
ucaggucaggaguucg

SEQ ID NO: 2913274 - RNA, 18 nt, Human
ucaggucacauaaaacuu

SEQ ID NO: 2913275 - RNA, 21 nt, Human
ucagguauguugccuuuaugg

SEQ ID NO: 2913276 - RNA, 15 nt, Human
ucagggacaggauga

SEQ ID NO: 2913277 - RNA, 14 nt, Human
ucagggacagagcc

SEQ ID NO: 2913278 - RNA, 15 nt, Human
ucagggacagagcca

SEQ ID NO: 2913279 - RNA, 22 nt, Human
ucagggaauuucaggaacuaga

SEQ ID NO: 2913280 - RNA, 23 nt, Human
ucagucugauucccaagcucugc

SEQ ID NO: 2913281 - RNA, 22 nt, Human
ucagucugauucccaagcucug

SEQ ID NO: 2913282 - RNA, 21 nt, Human
ucagucugauucccaagcucu

SEQ ID NO: 2913283 - RNA, 17 nt, Human
ucagugcaaccucugcu

SEQ ID NO: 2913284 - RNA, 19 nt, Human
ucagugauguaccaugaaa

SEQ ID NO: 2913285 - RNA, 22 nt, Human
ucagucuuucuuagugccugug

SEQ ID NO: 2913286 - RNA, 12 nt, Human
ucagucuuuuuc

SEQ ID NO: 2913287 - RNA, 15 nt, Human
ucagucuuuuucugu

SEQ ID NO: 2913288 - RNA, 20 nt, Human
ucagucuuuuucuguuguaa

SEQ ID NO: 2913289 - RNA, 21 nt, Human
ucagucuuuuucuguuguaac

SEQ ID NO: 2913290 - RNA, 21 nt, Human
ucagugaauaugccuguaauu

SEQ ID NO: 2913291 - RNA, 20 nt, Human
ucagguggggcagcuugagg

SEQ ID NO: 2913292 - RNA, 14 nt, Human
ucaggugcagagga

SEQ ID NO: 2913293 - RNA, 15 nt, Human
ucaggugcagaggaa

SEQ ID NO: 2913294 - RNA, 16 nt, Human
ucaggugcagaggaag

SEQ ID NO: 2913295 - RNA, 14 nt, Human
ucaguauuucagug

SEQ ID NO: 2913296 - RNA, 15 nt, Human
ucaguauuucagugu

SEQ ID NO: 2913297 - RNA, 19 nt, Human
ucaguauuuuggagaaauu

SEQ ID NO: 2913298 - RNA, 20 nt, Human
ucaguauuuuggagaaauua

SEQ ID NO: 2913299 - RNA, 22 nt, Human
ucaguauuuuggagaaauuauu

SEQ ID NO: 2913300 - RNA, 23 nt, Human
ucaguauuuuggagaaauuauuu

SEQ ID NO: 2913301 - RNA, 22 nt, Human
ucaguccuccccucacagccuc

SEQ ID NO: 2913302 - RNA, 23 nt, Human
ucaguccuccccucacagccucu

SEQ ID NO: 2913303 - RNA, 16 nt, Human
ucaguccugcuccaga

SEQ ID NO: 2913304 - RNA, 18 nt, Human
ucaguccuguaguuuuau

SEQ ID NO: 2913305 - RNA, 22 nt, Human
ucaguccuguaguuuuauuuua

SEQ ID NO: 2913306 - RNA, 16 nt, Human
ucagucaauauuuuua

SEQ ID NO: 2913307 - RNA, 16 nt, Human
ucagucacacacacau

SEQ ID NO: 2913308 - RNA, 14 nt, Human
ucagucucaggagc

SEQ ID NO: 2913309 - RNA, 16 nt, Human
ucagucucccucccuu

SEQ ID NO: 2913310 - RNA, 15 nt, Human
uccaaaguaaaauug

SEQ ID NO: 2913311 - RNA, 18 nt, Human
uccagaaaaccccagcau

SEQ ID NO: 2913312 - RNA, 20 nt, Human
uccacuuuuuuuuguauguu

SEQ ID NO: 2913313 - RNA, 15 nt, Human
uccagaucacugcca

SEQ ID NO: 2913314 - RNA, 17 nt, Human
uccagcagaagacaaaa

SEQ ID NO: 2913315 - RNA, 23 nt, Human
uccagcagaagacaaaaagacaa

SEQ ID NO: 2913316 - RNA, 17 nt, Human
uccagaucacugccaca

SEQ ID NO: 2913317 - RNA, 16 nt, Human
uccagaucacugccac

SEQ ID NO: 2913318 - RNA, 22 nt, Human
uccagcaauucuccugccucag

SEQ ID NO: 2913319 - RNA, 21 nt, Human
uccagcaauucuccugccuca

SEQ ID NO: 2913320 - RNA, 14 nt, Human
uccagcacaaacac

SEQ ID NO: 2913321 - RNA, 15 nt, Human
uccagcacaaacaca

SEQ ID NO: 2913322 - RNA, 17 nt, Human
uccagcacaaacacaag

SEQ ID NO: 2913323 - RNA, 19 nt, Human
uccagcacaaacacaaggu

SEQ ID NO: 2913324 - RNA, 14 nt, Human
uccagcugcaccag

SEQ ID NO: 2913325 - RNA, 16 nt, Human
uccagcugcaccagag

SEQ ID NO: 2913326 - RNA, 17 nt, Human
uccagcugcaccagagc

SEQ ID NO: 2913327 - RNA, 18 nt, Human
uccagcucuaauaaaaca

SEQ ID NO: 2913328 - RNA, 22 nt, Human
uccagcucuaauaaaacagcug

SEQ ID NO: 2913329 - RNA, 23 nt, Human
uccagcuccucauccagggcucu

SEQ ID NO: 2913330 - RNA, 13 nt, Human
uccagcuccugua

SEQ ID NO: 2913331 - RNA, 14 nt, Human
uccacuuguucagg

SEQ ID NO: 2913332 - RNA, 18 nt, Human
uccagggggaaggccaag

SEQ ID NO: 2913333 - RNA, 19 nt, Human
uccagggggaaggccaagg

SEQ ID NO: 2913334 - RNA, 17 nt, Human
uccaugggauacaaccu

SEQ ID NO: 2913335 - RNA, 13 nt, Human
uccaugcuccuca

SEQ ID NO: 2913336 - RNA, 20 nt, Human
uccaugcuccucacugcccg

SEQ ID NO: 2913337 - RNA, 21 nt, Human
uccaugcuccucacugcccgc

SEQ ID NO: 2913338 - RNA, 22 nt, Human
uccaugcuccucacugcccgca

SEQ ID NO: 2913339 - RNA, 14 nt, Human
uccaugcugccucc

SEQ ID NO: 2913340 - RNA, 15 nt, Human
uccaugcugccucca

SEQ ID NO: 2913341 - RNA, 23 nt, Human
uccaugcuucucaucuugugaaa

SEQ ID NO: 2913342 - RNA, 12 nt, Human
uccauaccagcu

SEQ ID NO: 2913343 - RNA, 15 nt, Human
uccauaccagcucgc

SEQ ID NO: 2913344 - RNA, 22 nt, Human
uccauaccagcucgcacccccc

SEQ ID NO: 2913345 - RNA, 21 nt, Human
uccauaaucuggacuccucug

SEQ ID NO: 2913346 - RNA, 23 nt, Human
uccaucacccucuuccugugauc

SEQ ID NO: 2913347 - RNA, 13 nt, Human
uccaucagccagg

SEQ ID NO: 2913348 - RNA, 14 nt, Human
uccaucaggccacu

SEQ ID NO: 2913349 - RNA, 17 nt, Human
uccaucaguuagagcug

SEQ ID NO: 2913350 - RNA, 18 nt, Human
uccaucaguuagagcuga

SEQ ID NO: 2913351 - RNA, 12 nt, Human
uccauauuuuca

SEQ ID NO: 2913352 - RNA, 13 nt, Human
uccauauuuucac

SEQ ID NO: 2913353 - RNA, 18 nt, Human
uccauauuuucacaggug

SEQ ID NO: 2913354 - RNA, 14 nt, Human
uccauauuuauuca

SEQ ID NO: 2913355 - RNA, 13 nt, Human
uccauauuuggaa

SEQ ID NO: 2913356 - RNA, 14 nt, Human
uccauauuuggaag

SEQ ID NO: 2913357 - RNA, 15 nt, Human
uccauauuuggaaga

SEQ ID NO: 2913358 - RNA, 17 nt, Human
uccauauuuggaagaaa

SEQ ID NO: 2913359 - RNA, 17 nt, Human
uccaucacccucuuccu

SEQ ID NO: 2913360 - RNA, 17 nt, Human
uccagguaccuugaccu

SEQ ID NO: 2913361 - RNA, 18 nt, Human
uccagguaccuugaccuu

SEQ ID NO: 2913362 - RNA, 23 nt, Human
uccagguaccuugaccuuuguac

SEQ ID NO: 2913363 - RNA, 15 nt, Human
uccagguacgcacag

SEQ ID NO: 2913364 - RNA, 16 nt, Human
uccagguacgcacaga

SEQ ID NO: 2913365 - RNA, 17 nt, Human
uccagguacgcacagac

SEQ ID NO: 2913366 - RNA, 18 nt, Human
uccagguacgcacagaca

SEQ ID NO: 2913367 - RNA, 19 nt, Human
uccagguacgcacagacag

SEQ ID NO: 2913368 - RNA, 20 nt, Human
uccagguacgcacagacagg

SEQ ID NO: 2913369 - RNA, 16 nt, Human
uccaggucucacgggc

SEQ ID NO: 2913370 - RNA, 15 nt, Human
uccaggucaacagaa

SEQ ID NO: 2913371 - RNA, 16 nt, Human
uccaggucaacagaau

SEQ ID NO: 2913372 - RNA, 17 nt, Human
uccaggucaacagaaug

SEQ ID NO: 2913373 - RNA, 18 nt, Human
uccaggucaacagaauga

SEQ ID NO: 2913374 - RNA, 19 nt, Human
uccaggucaacagaaugaa

SEQ ID NO: 2913375 - RNA, 21 nt, Human
uccaggucaacagaaugaaaa

SEQ ID NO: 2913376 - RNA, 22 nt, Human
uccaggucaacagaaugaaaaa

SEQ ID NO: 2913377 - RNA, 15 nt, Human
uccauaaaaaaaaau

SEQ ID NO: 2913378 - RNA, 19 nt, Human
uccauaaaaaaaaauagau

SEQ ID NO: 2913379 - RNA, 23 nt, Human
uccauaaacagacuguuaauuau

SEQ ID NO: 2913380 - RNA, 14 nt, Human
uccaguuaaccaag

SEQ ID NO: 2913381 - RNA, 17 nt, Human
uccaguuaaccaaguca

SEQ ID NO: 2913382 - RNA, 22 nt, Human
uccaguuaaggaccguggcccu

SEQ ID NO: 2913383 - RNA, 16 nt, Human
uccaguucaugagaau

SEQ ID NO: 2913384 - RNA, 19 nt, Human
uccaguucaugagaaucua

SEQ ID NO: 2913385 - RNA, 18 nt, Human
uccccagauugcaacagg

SEQ ID NO: 2913386 - RNA, 13 nt, Human
uccccagauugca

SEQ ID NO: 2913387 - RNA, 13 nt, Human
ucccaugugcaua

SEQ ID NO: 2913388 - RNA, 10 nt, Human
ucccaugugg

SEQ ID NO: 2913389 - RNA, 20 nt, Human
ucccauuaaucauuucccca

SEQ ID NO: 2913390 - RNA, 21 nt, Human
ucccauuaaucauuuccccau

SEQ ID NO: 2913391 - RNA, 20 nt, Human
ucccaugagccucagcaucc

SEQ ID NO: 2913392 - RNA, 22 nt, Human
ucccauguagcccccuggccuc

SEQ ID NO: 2913393 - RNA, 13 nt, Human
ucccauguaugga

SEQ ID NO: 2913394 - RNA, 22 nt, Human
ucccauguauuuaucucuauuu

SEQ ID NO: 2913395 - RNA, 22 nt, Human
uccccagcaagugagagcuggg

SEQ ID NO: 2913396 - RNA, 18 nt, Human
uccccagaguuccccaug

SEQ ID NO: 2913397 - RNA, 20 nt, Human
uccccagaguuccccaugca

SEQ ID NO: 2913398 - RNA, 19 nt, Human
uccccagaguccucuauga

SEQ ID NO: 2913399 - RNA, 17 nt, Human
uccccagaguuccccau

SEQ ID NO: 2913400 - RNA, 21 nt, Human
uccccagcaagugagagcugg

SEQ ID NO: 2913401 - RNA, 20 nt, Human
uccccagcaagugagagcug

SEQ ID NO: 2913402 - RNA, 23 nt, Human
uccccagauugcaacaggcuggg

SEQ ID NO: 2913403 - RNA, 22 nt, Human
uccccagauugcaacaggcugg

SEQ ID NO: 2913404 - RNA, 20 nt, Human
uccccagauugcaacaggcu

SEQ ID NO: 2913405 - RNA, 19 nt, Human
uccccagauugcaacaggc

SEQ ID NO: 2913406 - RNA, 21 nt, Human
uccccccacucuccccacacu

SEQ ID NO: 2913407 - RNA, 12 nt, Human
uccccccacucu

SEQ ID NO: 2913408 - RNA, 21 nt, Human
uccccagccccuagcccagga

SEQ ID NO: 2913409 - RNA, 15 nt, Human
uccccagcccuggcu

SEQ ID NO: 2913410 - RNA, 18 nt, Human
uccccagcccuggcucug

SEQ ID NO: 2913411 - RNA, 16 nt, Human
uccccagcccuucaca

SEQ ID NO: 2913412 - RNA, 13 nt, Human
uccccagcccugg

SEQ ID NO: 2913413 - RNA, 19 nt, Human
uccccagccccuagcccag

SEQ ID NO: 2913414 - RNA, 20 nt, Human
uccccagccccuagcccagg

SEQ ID NO: 2913415 - RNA, 11 nt, Human
uccccagcccc

SEQ ID NO: 2913416 - RNA, 13 nt, Human
uccccagccccua

SEQ ID NO: 2913417 - RNA, 15 nt, Human
uccccagccccuagc

SEQ ID NO: 2913418 - RNA, 16 nt, Human
uccccagccccuagcc

SEQ ID NO: 2913419 - RNA, 15 nt, Human
uccccagcccagggu

SEQ ID NO: 2913420 - RNA, 14 nt, Human
uccccagcccaggg

SEQ ID NO: 2913421 - RNA, 13 nt, Human
uccccagcccagg

SEQ ID NO: 2913422 - RNA, 18 nt, Human
uccccagcaucacucccc

SEQ ID NO: 2913423 - RNA, 19 nt, Human
uccccagcaucacucccca

SEQ ID NO: 2913424 - RNA, 12 nt, Human
uccccagcccag

SEQ ID NO: 2913425 - RNA, 10 nt, Human
uccccagccc

SEQ ID NO: 2913426 - RNA, 18 nt, Human
ucccaccucugugaccuc

SEQ ID NO: 2913427 - RNA, 20 nt, Human
ucccaccucugugaccucag

SEQ ID NO: 2913428 - RNA, 21 nt, Human
ucccaccucugugaccucagg

SEQ ID NO: 2913429 - RNA, 22 nt, Human
ucccaccucugugaccucaggc

SEQ ID NO: 2913430 - RNA, 10 nt, Human
uccauuccca

SEQ ID NO: 2913431 - RNA, 20 nt, Human
uccauucccaacuagacauu

SEQ ID NO: 2913432 - RNA, 11 nt, Human
ucccaccucug

SEQ ID NO: 2913433 - RNA, 13 nt, Human
ucccaccucugug

SEQ ID NO: 2913434 - RNA, 13 nt, Human
ucccaccuuggcu

SEQ ID NO: 2913435 - RNA, 18 nt, Human
ucccaccuuggcugcagg

SEQ ID NO: 2913436 - RNA, 20 nt, Human
ucccagcugugcucuggaca

SEQ ID NO: 2913437 - RNA, 17 nt, Human
ucccaccuuggcugcag

SEQ ID NO: 2913438 - RNA, 16 nt, Human
ucccaccuuggcugca

SEQ ID NO: 2913439 - RNA, 20 nt, Human
uccaugugggcuaguugggc

SEQ ID NO: 2913440 - RNA, 19 nt, Human
uccauguuggucaggcugg

SEQ ID NO: 2913441 - RNA, 24 nt, Human
uccauguuggucaggcuggucuca

SEQ ID NO: 2913442 - RNA, 18 nt, Human
uccaugugguucuucaaa

SEQ ID NO: 2913443 - RNA, 19 nt, Human
uccauguuuguaaaacuac

SEQ ID NO: 2913444 - RNA, 19 nt, Human
uccauuaaagucugaauca

SEQ ID NO: 2913445 - RNA, 13 nt, Human
uccauguuuguaa

SEQ ID NO: 2913446 - RNA, 16 nt, Human
uccauguuuguaaaac

SEQ ID NO: 2913447 - RNA, 19 nt, Human
ucccaugagccucagcauc

SEQ ID NO: 2913448 - RNA, 18 nt, Human
ucccaugagccucagcau

SEQ ID NO: 2913449 - RNA, 11 nt, Human
ucccaugaagc

SEQ ID NO: 2913450 - RNA, 12 nt, Human
ucccaugaagcc

SEQ ID NO: 2913451 - RNA, 13 nt, Human
ucccaugaagccu

SEQ ID NO: 2913452 - RNA, 14 nt, Human
ucccaugaagccuu

SEQ ID NO: 2913453 - RNA, 15 nt, Human
ucccaugaagccuuu

SEQ ID NO: 2913454 - RNA, 16 nt, Human
ucccaugaagccuuuu

SEQ ID NO: 2913455 - RNA, 17 nt, Human
ucccaugaagccuuuug

SEQ ID NO: 2913456 - RNA, 19 nt, Human
ucccaugaagccuuuugaa

SEQ ID NO: 2913457 - RNA, 21 nt, Human
ucccaugaagccuuuugaaag

SEQ ID NO: 2913458 - RNA, 16 nt, Human
ucccaggcgccccuuc

SEQ ID NO: 2913459 - RNA, 22 nt, Human
ucccagcugugcucuggacagg

SEQ ID NO: 2913460 - RNA, 21 nt, Human
ucccagcugugcucuggacag

SEQ ID NO: 2913461 - RNA, 23 nt, Human
ucccagcugugcucuggacaggc

SEQ ID NO: 2913462 - RNA, 16 nt, Human
ucccaggaacugggcc

SEQ ID NO: 2913463 - RNA, 11 nt, Human
ucccaggaacu

SEQ ID NO: 2913464 - RNA, 18 nt, Human
ucccagcuuguaggagcu

SEQ ID NO: 2913465 - RNA, 19 nt, Human
ucccagcuuguaggagcug

SEQ ID NO: 2913466 - RNA, 15 nt, Human
ucccaggacaccaca

SEQ ID NO: 2913467 - RNA, 18 nt, Human
ucccaggacaccacaccc

SEQ ID NO: 2913468 - RNA, 19 nt, Human
ucccaggacaccacaccca

SEQ ID NO: 2913469 - RNA, 21 nt, Human
ucccaggacaccacacccagc

SEQ ID NO: 2913470 - RNA, 22 nt, Human
ucccaggacaccacacccagcc

SEQ ID NO: 2913471 - RNA, 23 nt, Human
ucccaggacaccacacccagccu

SEQ ID NO: 2913472 - RNA, 19 nt, Human
uccuaucaccuauuuccau

SEQ ID NO: 2913473 - RNA, 13 nt, Human
uccuagugaaccu

SEQ ID NO: 2913474 - RNA, 20 nt, Human
uccuagugaaccucaccccg

SEQ ID NO: 2913475 - RNA, 16 nt, Human
uccuacaggcagucuc

SEQ ID NO: 2913476 - RNA, 17 nt, Human
uccuacaggcagucucu

SEQ ID NO: 2913477 - RNA, 19 nt, Human
uccuacaggcagucucucu

SEQ ID NO: 2913478 - RNA, 22 nt, Human
uccuacaggcagucucucucuu

SEQ ID NO: 2913479 - RNA, 13 nt, Human
uccuacagcacua

SEQ ID NO: 2913480 - RNA, 15 nt, Human
uccuacagcacuacu

SEQ ID NO: 2913481 - RNA, 20 nt, Human
uccuacagcacuacugggug

SEQ ID NO: 2913482 - RNA, 21 nt, Human
uccuacagcacuacugggugu

SEQ ID NO: 2913483 - RNA, 13 nt, Human
uccuaaggaaccu

SEQ ID NO: 2913484 - RNA, 19 nt, Human
uccuacaagagcagccugu

SEQ ID NO: 2913485 - RNA, 23 nt, Human
uccuaagggucgaaagcucuaga

SEQ ID NO: 2913486 - RNA, 18 nt, Human
uccuacaagagcagccug

SEQ ID NO: 2913487 - RNA, 16 nt, Human
uccuaagggucgaaag

SEQ ID NO: 2913488 - RNA, 18 nt, Human
uccuaagggucgaaagcu

SEQ ID NO: 2913489 - RNA, 20 nt, Human
uccuaagggucgaaagcucu

SEQ ID NO: 2913490 - RNA, 21 nt, Human
uccuaagggucgaaagcucua

SEQ ID NO: 2913491 - RNA, 23 nt, Human
uccuacaagagcagccuguggca

SEQ ID NO: 2913492 - RNA, 17 nt, Human
uccuacaagauuuagaa

SEQ ID NO: 2913493 - RNA, 18 nt, Human
uccuacaagauuuagaaa

SEQ ID NO: 2913494 - RNA, 19 nt, Human
uccuacaagauuuagaaaa

SEQ ID NO: 2913495 - RNA, 20 nt, Human
uccuacaagauuuagaaaaa

SEQ ID NO: 2913496 - RNA, 21 nt, Human
uccuacaagauuuagaaaaaa

SEQ ID NO: 2913497 - RNA, 22 nt, Human
uccuacaagagcagccuguggc

SEQ ID NO: 2913498 - RNA, 20 nt, Human
uccuacaagagcagccugug

SEQ ID NO: 2913499 - RNA, 17 nt, Human
uccuccaaaggcccccu

SEQ ID NO: 2913500 - RNA, 15 nt, Human
uccucauuucuccag

SEQ ID NO: 2913501 - RNA, 16 nt, Human
uccucauuucuccaga

SEQ ID NO: 2913502 - RNA, 15 nt, Human
uccucauucaaaggg

SEQ ID NO: 2913503 - RNA, 17 nt, Human
uccuaucagaaguuucu

SEQ ID NO: 2913504 - RNA, 13 nt, Human
uccuccaacagcu

SEQ ID NO: 2913505 - RNA, 18 nt, Human
uccuccaaaggcccccua

SEQ ID NO: 2913506 - RNA, 23 nt, Human
uccuccaaaggcccccuacgcca

SEQ ID NO: 2913507 - RNA, 14 nt, Human
uccuccaagccagc

SEQ ID NO: 2913508 - RNA, 12 nt, Human
uccuccaagcca

SEQ ID NO: 2913509 - RNA, 15 nt, Human
uccuccaccaccgcc

SEQ ID NO: 2913510 - RNA, 20 nt, Human
uccuccaccaccgcccgucu

SEQ ID NO: 2913511 - RNA, 21 nt, Human
uccuccaccaccgcccgucug

SEQ ID NO: 2913512 - RNA, 22 nt, Human
uccuccaccaccgcccgucugu

SEQ ID NO: 2913513 - RNA, 12 nt, Human
uccucccaccuc

SEQ ID NO: 2913514 - RNA, 21 nt, Human
uccuccuccaaaggcccccua

SEQ ID NO: 2913515 - RNA, 13 nt, Human
uccuccuccacca

SEQ ID NO: 2913516 - RNA, 14 nt, Human
uccuccuccaccac

SEQ ID NO: 2913517 - RNA, 15 nt, Human
uccuccuccaccacc

SEQ ID NO: 2913518 - RNA, 18 nt, Human
uccuccuccaccaccgcc

SEQ ID NO: 2913519 - RNA, 17 nt, Human
uccuccagggugauuuu

SEQ ID NO: 2913520 - RNA, 22 nt, Human
uccuccagggugauuuuaugau

SEQ ID NO: 2913521 - RNA, 21 nt, Human
uccuccagggaugaucaacag

SEQ ID NO: 2913522 - RNA, 13 nt, Human
uccuccagcugca

SEQ ID NO: 2913523 - RNA, 14 nt, Human
uccuccagcugcac

SEQ ID NO: 2913524 - RNA, 15 nt, Human
uccuccagcugcacc

SEQ ID NO: 2913525 - RNA, 21 nt, Human
uccuccagcugcaccagagca

SEQ ID NO: 2913526 - RNA, 14 nt, Human
ucccuucaccuccu

SEQ ID NO: 2913527 - RNA, 12 nt, Human
ucccuucagccc

SEQ ID NO: 2913528 - RNA, 13 nt, Human
ucccuucagcccc

SEQ ID NO: 2913529 - RNA, 14 nt, Human
ucccuucagccccc

SEQ ID NO: 2913530 - RNA, 17 nt, Human
ucccuucagcccccagc

SEQ ID NO: 2913531 - RNA, 18 nt, Human
ucccuucagcccccagcc

SEQ ID NO: 2913532 - RNA, 19 nt, Human
ucccuucagcccccagccc

SEQ ID NO: 2913533 - RNA, 21 nt, Human
ucccuucagcccccagccccu

SEQ ID NO: 2913534 - RNA, 22 nt, Human
ucccuucaaccauuccccaugg

SEQ ID NO: 2913535 - RNA, 23 nt, Human
ucccccugggcucugccccagcu

SEQ ID NO: 2913536 - RNA, 10 nt, Human
ucccccuggg

SEQ ID NO: 2913537 - RNA, 16 nt, Human
ucccccugguugggug

SEQ ID NO: 2913538 - RNA, 22 nt, Human
ucccccugggcucugccccagc

SEQ ID NO: 2913539 - RNA, 20 nt, Human
ucccccugggcucugcccca

SEQ ID NO: 2913540 - RNA, 15 nt, Human
ucccccugggcucug

SEQ ID NO: 2913541 - RNA, 14 nt, Human
ucccccugggcucu

SEQ ID NO: 2913542 - RNA, 12 nt, Human
ucccccugggcu

SEQ ID NO: 2913543 - RNA, 16 nt, Human
uccccccccuguauag

SEQ ID NO: 2913544 - RNA, 17 nt, Human
uccccccccuguauagu

SEQ ID NO: 2913545 - RNA, 15 nt, Human
ucccuugcuuuuccc

SEQ ID NO: 2913546 - RNA, 18 nt, Human
ucccuugcuuuucccucu

SEQ ID NO: 2913547 - RNA, 19 nt, Human
ucccuugcuuuucccucuu

SEQ ID NO: 2913548 - RNA, 21 nt, Human
ucccuugcuuuucccucuuuu

SEQ ID NO: 2913549 - RNA, 22 nt, Human
ucccuugcuuuucccucuuuuc

SEQ ID NO: 2913550 - RNA, 23 nt, Human
ucccuugcuuuucccucuuuucu

SEQ ID NO: 2913551 - RNA, 12 nt, Human
ucccuuccucuu

SEQ ID NO: 2913552 - RNA, 13 nt, Human
ucccuuccucuuc

SEQ ID NO: 2913553 - RNA, 14 nt, Human
ucccuuccucuucg

SEQ ID NO: 2913554 - RNA, 17 nt, Human
ucccuuccucuucggcc

SEQ ID NO: 2913555 - RNA, 20 nt, Human
ucccuuccccucccuggcuc

SEQ ID NO: 2913556 - RNA, 17 nt, Human
ucccuucccuuccacug

SEQ ID NO: 2913557 - RNA, 16 nt, Human
ucccuuccgacccucu

SEQ ID NO: 2913558 - RNA, 20 nt, Human
ucccuuccgacccucuggga

SEQ ID NO: 2913559 - RNA, 21 nt, Human
ucccuuccgacccucugggaa

SEQ ID NO: 2913560 - RNA, 22 nt, Human
ucccuuccgacccucugggaac

SEQ ID NO: 2913561 - RNA, 21 nt, Human
ucccuuccccucccuggcucc

SEQ ID NO: 2913562 - RNA, 20 nt, Human
ucccuucccuaaagugaugg

SEQ ID NO: 2913563 - RNA, 12 nt, Human
ucccuuccccuc

SEQ ID NO: 2913564 - RNA, 22 nt, Human
ucccuucccaugacccaggcug

SEQ ID NO: 2913565 - RNA, 20 nt, Human
ucccccuuccaaauaauaaa

SEQ ID NO: 2913566 - RNA, 16 nt, Human
ucccuucaguacccuc

SEQ ID NO: 2913567 - RNA, 18 nt, Human
ucccuucaguacccucuc

SEQ ID NO: 2913568 - RNA, 19 nt, Human
ucccuucaguacccucuca

SEQ ID NO: 2913569 - RNA, 20 nt, Human
ucccuucaguacccucucag

SEQ ID NO: 2913570 - RNA, 21 nt, Human
ucccuucaguacccucucagc

SEQ ID NO: 2913571 - RNA, 23 nt, Human
ucccuucaguacccucucagcuc

SEQ ID NO: 2913572 - RNA, 14 nt, Human
uccgccucuugggu

SEQ ID NO: 2913573 - RNA, 13 nt, Human
uccgccucugucc

SEQ ID NO: 2913574 - RNA, 19 nt, Human
uccgcccuuagucccccaa

SEQ ID NO: 2913575 - RNA, 21 nt, Human
uccgcccuuagucccccaacu

SEQ ID NO: 2913576 - RNA, 18 nt, Human
uccgccaaugcacggccu

SEQ ID NO: 2913577 - RNA, 15 nt, Human
uccgcagaagcccug

SEQ ID NO: 2913578 - RNA, 15 nt, Human
uccgaugaauucuua

SEQ ID NO: 2913579 - RNA, 20 nt, Human
uccgauggaugaaucuccca

SEQ ID NO: 2913580 - RNA, 15 nt, Human
uccgcacuuuccacu

SEQ ID NO: 2913581 - RNA, 16 nt, Human
uccgcacuuuccacuu

SEQ ID NO: 2913582 - RNA, 22 nt, Human
uccgcacuuuccacuucuuccu

SEQ ID NO: 2913583 - RNA, 23 nt, Human
uccgcacuuuccacuucuuccuu

SEQ ID NO: 2913584 - RNA, 20 nt, Human
uccgcuuucuacccagcgag

SEQ ID NO: 2913585 - RNA, 18 nt, Human
uccgcuuucuacccagcg

SEQ ID NO: 2913586 - RNA, 16 nt, Human
uccgcuuucuacccag

SEQ ID NO: 2913587 - RNA, 12 nt, Human
uccgcucucuuc

SEQ ID NO: 2913588 - RNA, 13 nt, Human
uccgcucucuucc

SEQ ID NO: 2913589 - RNA, 15 nt, Human
uccgcucucuuccug

SEQ ID NO: 2913590 - RNA, 17 nt, Human
uccgcucucuuccugcc

SEQ ID NO: 2913591 - RNA, 18 nt, Human
uccgcucucuuccugccc

SEQ ID NO: 2913592 - RNA, 14 nt, Human
uccgcugccgugcc

SEQ ID NO: 2913593 - RNA, 12 nt, Human
uccgcugcuccu

SEQ ID NO: 2913594 - RNA, 13 nt, Human
uccgcugcuccuu

SEQ ID NO: 2913595 - RNA, 16 nt, Human
uccgcugcuccuuggc

SEQ ID NO: 2913596 - RNA, 17 nt, Human
uccgccuucacuccggu

SEQ ID NO: 2913597 - RNA, 13 nt, Human
uccgccuuuugua

SEQ ID NO: 2913598 - RNA, 14 nt, Human
uccgccuuuuguau

SEQ ID NO: 2913599 - RNA, 18 nt, Human
uccgccuuuuguauacau

SEQ ID NO: 2913600 - RNA, 12 nt, Human
uccgcgaaaaua

SEQ ID NO: 2913601 - RNA, 19 nt, Human
uccgcgaaaauaguuuguu

SEQ ID NO: 2913602 - RNA, 11 nt, Human
uccgccuucac

SEQ ID NO: 2913603 - RNA, 17 nt, Human
uccgccuucacauuccc

SEQ ID NO: 2913604 - RNA, 12 nt, Human
uccugccccucu

SEQ ID NO: 2913605 - RNA, 15 nt, Human
uccugccccucuuuc

SEQ ID NO: 2913606 - RNA, 16 nt, Human
uccugccccucuuucu

SEQ ID NO: 2913607 - RNA, 17 nt, Human
uccugccccucuuucuc

SEQ ID NO: 2913608 - RNA, 18 nt, Human
uccugccccucuuucucu

SEQ ID NO: 2913609 - RNA, 19 nt, Human
uccugccccucuuucucuu

SEQ ID NO: 2913610 - RNA, 10 nt, Human
uccugcccug

SEQ ID NO: 2913611 - RNA, 20 nt, Human
uccugcccgcagaccucugg

SEQ ID NO: 2913612 - RNA, 21 nt, Human
uccugcccgcagaccucugga

SEQ ID NO: 2913613 - RNA, 22 nt, Human
uccugcccgccacacagaccac

SEQ ID NO: 2913614 - RNA, 20 nt, Human
uccugcccacugcugcagua

SEQ ID NO: 2913615 - RNA, 17 nt, Human
uccugccaguguggaac

SEQ ID NO: 2913616 - RNA, 13 nt, Human
uccugccagcccc

SEQ ID NO: 2913617 - RNA, 14 nt, Human
uccugccagcccca

SEQ ID NO: 2913618 - RNA, 15 nt, Human
uccugccagccccac

SEQ ID NO: 2913619 - RNA, 21 nt, Human
uccugccagccccacacagcu

SEQ ID NO: 2913620 - RNA, 22 nt, Human
uccugccagccccacacagcua

SEQ ID NO: 2913621 - RNA, 11 nt, Human
uccugccaaaa

SEQ ID NO: 2913622 - RNA, 18 nt, Human
uccugccacauuagaacu

SEQ ID NO: 2913623 - RNA, 19 nt, Human
uccugccacauuagaacuu

SEQ ID NO: 2913624 - RNA, 20 nt, Human
uccugccacauuagaacuuc

SEQ ID NO: 2913625 - RNA, 16 nt, Human
uccugcauuugugaaa

SEQ ID NO: 2913626 - RNA, 16 nt, Human
uccugccacccuguag

SEQ ID NO: 2913627 - RNA, 16 nt, Human
uccugccaccacgccc

SEQ ID NO: 2913628 - RNA, 11 nt, Human
uccugccacca

SEQ ID NO: 2913629 - RNA, 17 nt, Human
uccucuguccugcuucu

SEQ ID NO: 2913630 - RNA, 19 nt, Human
uccucuguccugcuucuga

SEQ ID NO: 2913631 - RNA, 12 nt, Human
uccucugucugc

SEQ ID NO: 2913632 - RNA, 14 nt, Human
uccucugucugccc

SEQ ID NO: 2913633 - RNA, 22 nt, Human
uccucuguccaggcacugcugc

SEQ ID NO: 2913634 - RNA, 22 nt, Human
uccucuguuucuccuucugaaa

SEQ ID NO: 2913635 - RNA, 13 nt, Human
uccucuguggugu

SEQ ID NO: 2913636 - RNA, 18 nt, Human
uccucuguggugucugcc

SEQ ID NO: 2913637 - RNA, 21 nt, Human
uccucuguggugucugccugu

SEQ ID NO: 2913638 - RNA, 22 nt, Human
uccucuguggugucugccuguu

SEQ ID NO: 2913639 - RNA, 15 nt, Human
uccucugucugcccu

SEQ ID NO: 2913640 - RNA, 18 nt, Human
uccucugucugcccuuca

SEQ ID NO: 2913641 - RNA, 14 nt, Human
uccuccuccagggu

SEQ ID NO: 2913642 - RNA, 15 nt, Human
uccuccuccagggug

SEQ ID NO: 2913643 - RNA, 12 nt, Human
uccuccuccagg

SEQ ID NO: 2913644 - RNA, 13 nt, Human
uccuccuccaggg

SEQ ID NO: 2913645 - RNA, 15 nt, Human
uccuccucccccaga

SEQ ID NO: 2913646 - RNA, 12 nt, Human
uccuccucuuuc

SEQ ID NO: 2913647 - RNA, 13 nt, Human
uccuccucuuucu

SEQ ID NO: 2913648 - RNA, 14 nt, Human
uccuccucuuucuc

SEQ ID NO: 2913649 - RNA, 15 nt, Human
uccuccucuuucucu

SEQ ID NO: 2913650 - RNA, 16 nt, Human
uccuccucuuucucuc

SEQ ID NO: 2913651 - RNA, 17 nt, Human
uccuccucuuucucucc

SEQ ID NO: 2913652 - RNA, 19 nt, Human
uccuccucuuucucucccc

SEQ ID NO: 2913653 - RNA, 20 nt, Human
uccuccaucccaacagccau

SEQ ID NO: 2913654 - RNA, 22 nt, Human
uccuccucggaaccgcucaccu

SEQ ID NO: 2913655 - RNA, 23 nt, Human
uccuccucggaaccgcucaccua

SEQ ID NO: 2913656 - RNA, 13 nt, Human
uccugagaagcau

SEQ ID NO: 2913657 - RNA, 13 nt, Human
uccugacuucuaa

SEQ ID NO: 2913658 - RNA, 13 nt, Human
uccugacuuuuaa

SEQ ID NO: 2913659 - RNA, 13 nt, Human
uccugacuguaac

SEQ ID NO: 2913660 - RNA, 22 nt, Human
uccugacuguaacauauucugu

SEQ ID NO: 2913661 - RNA, 23 nt, Human
uccugacugucucccgggacuac

SEQ ID NO: 2913662 - RNA, 16 nt, Human
uccugacucugccccc

SEQ ID NO: 2913663 - RNA, 17 nt, Human
uccugacucugcccccu

SEQ ID NO: 2913664 - RNA, 22 nt, Human
uccugacucugcccccugcugg

SEQ ID NO: 2913665 - RNA, 23 nt, Human
uccugacucugcccccugcuggc

SEQ ID NO: 2913666 - RNA, 22 nt, Human
uccugacuccuaccugcccugg

SEQ ID NO: 2913667 - RNA, 23 nt, Human
uccugacuccuaccugcccugga

SEQ ID NO: 2913668 - RNA, 14 nt, Human
uccugacucugccc

SEQ ID NO: 2913669 - RNA, 15 nt, Human
uccugacucugcccc

SEQ ID NO: 2913670 - RNA, 20 nt, Human
uccucuucaccccggcaggc

SEQ ID NO: 2913671 - RNA, 18 nt, Human
uccugacgucugaagcuu

SEQ ID NO: 2913672 - RNA, 20 nt, Human
uccugacgucugaagcuuga

SEQ ID NO: 2913673 - RNA, 17 nt, Human
uccugacuauuauguug

SEQ ID NO: 2913674 - RNA, 18 nt, Human
uccugacuauuauguugu

SEQ ID NO: 2913675 - RNA, 22 nt, Human
uccugacuauuauguuguuaga

SEQ ID NO: 2913676 - RNA, 23 nt, Human
uccugagccagugucaggaggaa

SEQ ID NO: 2913677 - RNA, 23 nt, Human
uccugagaauaagaaaguuucac

SEQ ID NO: 2913678 - RNA, 16 nt, Human
uccugagaccacagag

SEQ ID NO: 2913679 - RNA, 13 nt, Human
uccugagcuuuau

SEQ ID NO: 2913680 - RNA, 15 nt, Human
uccugagcuuuaugg

SEQ ID NO: 2913681 - RNA, 12 nt, Human
uccugagccccg

SEQ ID NO: 2913682 - RNA, 13 nt, Human
uccugagccccgc

SEQ ID NO: 2913683 - RNA, 14 nt, Human
uccugagccccgcc

SEQ ID NO: 2913684 - RNA, 18 nt, Human
uccugagccccgcccucu

SEQ ID NO: 2913685 - RNA, 22 nt, Human
uccugagccccgcccucuuccu

SEQ ID NO: 2913686 - RNA, 23 nt, Human
uccugagccccgcccucuuccug

SEQ ID NO: 2913687 - RNA, 15 nt, Human
uccugucucuggccu

SEQ ID NO: 2913688 - RNA, 13 nt, Human
uccuggccucaga

SEQ ID NO: 2913689 - RNA, 14 nt, Human
uccuggccucagac

SEQ ID NO: 2913690 - RNA, 15 nt, Human
uccuggccucagacu

SEQ ID NO: 2913691 - RNA, 17 nt, Human
uccuggccucagacugc

SEQ ID NO: 2913692 - RNA, 22 nt, Human
uccuggccucagacugcaccca

SEQ ID NO: 2913693 - RNA, 21 nt, Human
uccuguagagguuuuguuguu

SEQ ID NO: 2913694 - RNA, 15 nt, Human
uccuggccuugcuga

SEQ ID NO: 2913695 - RNA, 12 nt, Human
uccuggccucaa

SEQ ID NO: 2913696 - RNA, 14 nt, Human
uccuggccccucaa

SEQ ID NO: 2913697 - RNA, 18 nt, Human
uccuggccccucaaccuc

SEQ ID NO: 2913698 - RNA, 14 nt, Human
uccuggaguugcau

SEQ ID NO: 2913699 - RNA, 16 nt, Human
uccuggaguugcauug

SEQ ID NO: 2913700 - RNA, 14 nt, Human
uccuggaugucuga

SEQ ID NO: 2913701 - RNA, 18 nt, Human
uccuggauguugugugua

SEQ ID NO: 2913702 - RNA, 17 nt, Human
uccuggauguuuggaaa

SEQ ID NO: 2913703 - RNA, 23 nt, Human
uccuggcacccggccccugcugg

SEQ ID NO: 2913704 - RNA, 21 nt, Human
uccuggagggaagcacugccu

SEQ ID NO: 2913705 - RNA, 18 nt, Human
uccuggagcagaccaccc

SEQ ID NO: 2913706 - RNA, 19 nt, Human
uccuggagcagaccacccc

SEQ ID NO: 2913707 - RNA, 18 nt, Human
uccuggagcaaucacaga

SEQ ID NO: 2913708 - RNA, 20 nt, Human
uccuggagcaaucacagaug

SEQ ID NO: 2913709 - RNA, 19 nt, Human
uccugccuaaggcugaacu

SEQ ID NO: 2913710 - RNA, 16 nt, Human
uccugccuaaggcuga

SEQ ID NO: 2913711 - RNA, 21 nt, Human
uccugcccugggaggcaguga

SEQ ID NO: 2913712 - RNA, 15 nt, Human
uccugcccugggagg

SEQ ID NO: 2913713 - RNA, 14 nt, Human
uccugcccugggag

SEQ ID NO: 2913714 - RNA, 12 nt, Human
uccugcccuggg

SEQ ID NO: 2913715 - RNA, 11 nt, Human
uccugcccugg

SEQ ID NO: 2913716 - RNA, 16 nt, Human
uccugccggagaggaa

SEQ ID NO: 2913717 - RNA, 17 nt, Human
uccugccggagaggaag

SEQ ID NO: 2913718 - RNA, 19 nt, Human
uccugccggagaggaagag

SEQ ID NO: 2913719 - RNA, 22 nt, Human
uccugccggagaggaagagaca

SEQ ID NO: 2913720 - RNA, 23 nt, Human
uccugccggagaggaagagacac

SEQ ID NO: 2913721 - RNA, 14 nt, Human
ucuaucagagaaaa

SEQ ID NO: 2913722 - RNA, 17 nt, Human
ucuaucaagucaaucau

SEQ ID NO: 2913723 - RNA, 18 nt, Human
ucuaucaagucaaucauu

SEQ ID NO: 2913724 - RNA, 22 nt, Human
ucuaucaagucaaucauuucuc

SEQ ID NO: 2913725 - RNA, 23 nt, Human
ucuaucaagucaaucauuucuca

SEQ ID NO: 2913726 - RNA, 14 nt, Human
ucuaucaccaagga

SEQ ID NO: 2913727 - RNA, 15 nt, Human
ucuaguggucuuugu

SEQ ID NO: 2913728 - RNA, 16 nt, Human
ucuaguggucuuugua

SEQ ID NO: 2913729 - RNA, 17 nt, Human
ucuaguggucuuuguaa

SEQ ID NO: 2913730 - RNA, 18 nt, Human
ucuaguggucuuuguaag

SEQ ID NO: 2913731 - RNA, 19 nt, Human
ucuaguggucuuuguaaga

SEQ ID NO: 2913732 - RNA, 14 nt, Human
ucuagugcccucca

SEQ ID NO: 2913733 - RNA, 20 nt, Human
ucuagugcccuccacagccg

SEQ ID NO: 2913734 - RNA, 19 nt, Human
ucuacgguguaugguucug

SEQ ID NO: 2913735 - RNA, 17 nt, Human
ucuacgcucuccuuucu

SEQ ID NO: 2913736 - RNA, 18 nt, Human
ucuacggaucaucaacaa

SEQ ID NO: 2913737 - RNA, 21 nt, Human
ucuacggaucaucaacaagau

SEQ ID NO: 2913738 - RNA, 16 nt, Human
ucuacgcucuccuuuc

SEQ ID NO: 2913739 - RNA, 15 nt, Human
ucuacgcucuccuuu

SEQ ID NO: 2913740 - RNA, 23 nt, Human
ucuacuguguaauauaaaagauc

SEQ ID NO: 2913741 - RNA, 16 nt, Human
ucuacuggucuugugg

SEQ ID NO: 2913742 - RNA, 23 nt, Human
ucuacuggucuuguggaauuggg

SEQ ID NO: 2913743 - RNA, 20 nt, Human
ucuacuggucuuguggaauu

SEQ ID NO: 2913744 - RNA, 16 nt, Human
ucuacagaggccaugg

SEQ ID NO: 2913745 - RNA, 15 nt, Human
ucuacagaggccaug

SEQ ID NO: 2913746 - RNA, 18 nt, Human
ucuacacagugggaacuc

SEQ ID NO: 2913747 - RNA, 23 nt, Human
ucuacacagugggaacucugaca

SEQ ID NO: 2913748 - RNA, 13 nt, Human
ucuacaaagcacu

SEQ ID NO: 2913749 - RNA, 23 nt, Human
ucuacaaagcacuagagaaugca

SEQ ID NO: 2913750 - RNA, 13 nt, Human
ucuacaaauaauu

SEQ ID NO: 2913751 - RNA, 19 nt, Human
ucuacaaauaauuuuagug

SEQ ID NO: 2913752 - RNA, 18 nt, Human
ucuacaaauauaagauuu

SEQ ID NO: 2913753 - RNA, 19 nt, Human
ucuacaaauauaagauuuu

SEQ ID NO: 2913754 - RNA, 16 nt, Human
ucuaauuuuuaagcaa

SEQ ID NO: 2913755 - RNA, 18 nt, Human
ucggacuuagcugggaga

SEQ ID NO: 2913756 - RNA, 20 nt, Human
uccuuagagguccucuggag

SEQ ID NO: 2913757 - RNA, 17 nt, Human
uccuuagaccuuccaua

SEQ ID NO: 2913758 - RNA, 13 nt, Human
ucgugacaacacu

SEQ ID NO: 2913759 - RNA, 14 nt, Human
ucgugaacaucccc

SEQ ID NO: 2913760 - RNA, 19 nt, Human
ucgugaacauccccuccca

SEQ ID NO: 2913761 - RNA, 19 nt, Human
ucggauaugauuguuucuc

SEQ ID NO: 2913762 - RNA, 16 nt, Human
ucggcauuucaaaugu

SEQ ID NO: 2913763 - RNA, 18 nt, Human
ucggcaacuaagcagucc

SEQ ID NO: 2913764 - RNA, 14 nt, Human
ucuaaagguccaca

SEQ ID NO: 2913765 - RNA, 16 nt, Human
ucguguccccuauccu

SEQ ID NO: 2913766 - RNA, 15 nt, Human
ucuaaagguccacag

SEQ ID NO: 2913767 - RNA, 17 nt, Human
ucuaaagguccacaggu

SEQ ID NO: 2913768 - RNA, 22 nt, Human
ucuaaagguccacaggucuaga

SEQ ID NO: 2913769 - RNA, 23 nt, Human
ucuaaagguccacaggucuagac

SEQ ID NO: 2913770 - RNA, 12 nt, Human
ucuaaaguuaua

SEQ ID NO: 2913771 - RNA, 14 nt, Human
ucuaaaguuauauu

SEQ ID NO: 2913772 - RNA, 17 nt, Human
ucuaaaguuauauuuca

SEQ ID NO: 2913773 - RNA, 11 nt, Human
ucuaaaguucu

SEQ ID NO: 2913774 - RNA, 12 nt, Human
ucuaaaguucua

SEQ ID NO: 2913775 - RNA, 13 nt, Human
ucuaaaguucuaa

SEQ ID NO: 2913776 - RNA, 14 nt, Human
ucuaaaguucuaag

SEQ ID NO: 2913777 - RNA, 15 nt, Human
ucuaaaguucuaaga

SEQ ID NO: 2913778 - RNA, 16 nt, Human
ucuaaaguucuaagau

SEQ ID NO: 2913779 - RNA, 21 nt, Human
ucuaaaguucuaagauucuga

SEQ ID NO: 2913780 - RNA, 17 nt, Human
ucuaaaguucuaagauu

SEQ ID NO: 2913781 - RNA, 18 nt, Human
ucuaaaguucuaagauuc

SEQ ID NO: 2913782 - RNA, 19 nt, Human
ucuaaaguucuaagauucu

SEQ ID NO: 2913783 - RNA, 20 nt, Human
ucuaaaguucuaagauucug

SEQ ID NO: 2913784 - RNA, 22 nt, Human
ucguggguguguguagccaagg

SEQ ID NO: 2913785 - RNA, 15 nt, Human
ucgugggugugugua

SEQ ID NO: 2913786 - RNA, 21 nt, Human
ucguggcagauaaucagccuc

SEQ ID NO: 2913787 - RNA, 20 nt, Human
ucguggcagauaaucagccu

SEQ ID NO: 2913788 - RNA, 15 nt, Human
ucguguaaauuaugu

SEQ ID NO: 2913789 - RNA, 20 nt, Human
ucguguaauuacuuaucccu

SEQ ID NO: 2913790 - RNA, 22 nt, Human
ucgugguccccaacagcgacau

SEQ ID NO: 2913791 - RNA, 23 nt, Human
ucucagucaugcauaaauaugca

SEQ ID NO: 2913792 - RNA, 20 nt, Human
ucucagucaugcauaaauau

SEQ ID NO: 2913793 - RNA, 21 nt, Human
ucucagucaugcauaaauaug

SEQ ID NO: 2913794 - RNA, 15 nt, Human
ucucauaccucugac

SEQ ID NO: 2913795 - RNA, 16 nt, Human
ucucauaccucugacc

SEQ ID NO: 2913796 - RNA, 19 nt, Human
ucucauaccucugaccaac

SEQ ID NO: 2913797 - RNA, 13 nt, Human
ucuaugggacuca

SEQ ID NO: 2913798 - RNA, 12 nt, Human
ucuaugggacuc

SEQ ID NO: 2913799 - RNA, 19 nt, Human
ucuaugggacucaaugcac

SEQ ID NO: 2913800 - RNA, 15 nt, Human
ucuaugagucuagau

SEQ ID NO: 2913801 - RNA, 14 nt, Human
ucuaugagucuaga

SEQ ID NO: 2913802 - RNA, 21 nt, Human
ucuauggacagggcugucucu

SEQ ID NO: 2913803 - RNA, 19 nt, Human
ucucagucaugcauaaaua

SEQ ID NO: 2913804 - RNA, 16 nt, Human
ucucagucaugcauaa

SEQ ID NO: 2913805 - RNA, 13 nt, Human
ucucauccugcag

SEQ ID NO: 2913806 - RNA, 15 nt, Human
ucucauccugcaggc

SEQ ID NO: 2913807 - RNA, 16 nt, Human
uccuggagaagccucg

SEQ ID NO: 2913808 - RNA, 21 nt, Human
ucucauacucccccacaguuu

SEQ ID NO: 2913809 - RNA, 13 nt, Human
ucucaucugaggc

SEQ ID NO: 2913810 - RNA, 13 nt, Human
ucucaucugcacc

SEQ ID NO: 2913811 - RNA, 15 nt, Human
ucucaucugcacccu

SEQ ID NO: 2913812 - RNA, 16 nt, Human
ucucaucugcacccuu

SEQ ID NO: 2913813 - RNA, 19 nt, Human
ucucaucugcacccuucuu

SEQ ID NO: 2913814 - RNA, 22 nt, Human
ucucaucugcacccuucuuuuc

SEQ ID NO: 2913815 - RNA, 23 nt, Human
ucucaucugcacccuucuuuucu

SEQ ID NO: 2913816 - RNA, 14 nt, Human
ucucaucuugugaa

SEQ ID NO: 2913817 - RNA, 15 nt, Human
ucucaucuugugaaa

SEQ ID NO: 2913818 - RNA, 13 nt, Human
ucuccacuccaga

SEQ ID NO: 2913819 - RNA, 16 nt, Human
ucuccacccugcucuc

SEQ ID NO: 2913820 - RNA, 14 nt, Human
ucuccacccugcuc

SEQ ID NO: 2913821 - RNA, 17 nt, Human
ucuccacccugcucucc

SEQ ID NO: 2913822 - RNA, 13 nt, Human
ucuccacccugcu

SEQ ID NO: 2913823 - RNA, 19 nt, Human
ucucaugccucagccuccu

SEQ ID NO: 2913824 - RNA, 16 nt, Human
ucucaugccucagccu

SEQ ID NO: 2913825 - RNA, 14 nt, Human
ucucaugaaucugc

SEQ ID NO: 2913826 - RNA, 18 nt, Human
ucucaugaaucugcaaug

SEQ ID NO: 2913827 - RNA, 13 nt, Human
ucucaugccucag

SEQ ID NO: 2913828 - RNA, 11 nt, Human
ucuccagcugg

SEQ ID NO: 2913829 - RNA, 17 nt, Human
ucuccagcugggcucug

SEQ ID NO: 2913830 - RNA, 19 nt, Human
ucuccagcugggcucugca

SEQ ID NO: 2913831 - RNA, 21 nt, Human
ucuccagccugggaggcacag

SEQ ID NO: 2913832 - RNA, 23 nt, Human
ucuccagccugggaggcacagca

SEQ ID NO: 2913833 - RNA, 16 nt, Human
ucuccagcucagaacc

SEQ ID NO: 2913834 - RNA, 17 nt, Human
ucuccagcucagaaccc

SEQ ID NO: 2913835 - RNA, 20 nt, Human
ucuccagcucagaacccagg

SEQ ID NO: 2913836 - RNA, 21 nt, Human
ucuccagcucagaacccaggg

SEQ ID NO: 2913837 - RNA, 22 nt, Human
ucuccagcucagaacccagggc

SEQ ID NO: 2913838 - RNA, 23 nt, Human
ucuccagcucagaacccagggcu

SEQ ID NO: 2913839 - RNA, 19 nt, Human
ucuccacugugccuuugca

SEQ ID NO: 2913840 - RNA, 12 nt, Human
ucuccacugugc

SEQ ID NO: 2913841 - RNA, 14 nt, Human
ucuccacugccuuc

SEQ ID NO: 2913842 - RNA, 19 nt, Human
ucuccagauguuuccagac

SEQ ID NO: 2913843 - RNA, 14 nt, Human
ucuccagauuuuua

SEQ ID NO: 2913844 - RNA, 16 nt, Human
ucuccagauuuuuaau

SEQ ID NO: 2913845 - RNA, 21 nt, Human
ucuccagauuuuucggaggcc

SEQ ID NO: 2913846 - RNA, 15 nt, Human
ucuccagauguuucc

SEQ ID NO: 2913847 - RNA, 18 nt, Human
ucuccagauguuuccaga

SEQ ID NO: 2913848 - RNA, 14 nt, Human
ucuccagauguuuc

SEQ ID NO: 2913849 - RNA, 12 nt, Human
ucuccccuccag

SEQ ID NO: 2913850 - RNA, 14 nt, Human
ucuccccuccagcc

SEQ ID NO: 2913851 - RNA, 15 nt, Human
ucuccccuccagccu

SEQ ID NO: 2913852 - RNA, 16 nt, Human
ucuccccuccagccuu

SEQ ID NO: 2913853 - RNA, 18 nt, Human
ucuccccucagagugcaa

SEQ ID NO: 2913854 - RNA, 13 nt, Human
ucuccccucagag

SEQ ID NO: 2913855 - RNA, 20 nt, Human
ucucccccugggcucugccc

SEQ ID NO: 2913856 - RNA, 18 nt, Human
ucucccccuuaccccaca

SEQ ID NO: 2913857 - RNA, 19 nt, Human
ucuccccgcuaaggaagau

SEQ ID NO: 2913858 - RNA, 22 nt, Human
ucuccccgcuaaggaagauauc

SEQ ID NO: 2913859 - RNA, 13 nt, Human
ucuccaggaccaa

SEQ ID NO: 2913860 - RNA, 14 nt, Human
ucuccaggaccaau

SEQ ID NO: 2913861 - RNA, 21 nt, Human
ucuccagcugggcucugcaau

SEQ ID NO: 2913862 - RNA, 17 nt, Human
ucuccaggcaccaucuc

SEQ ID NO: 2913863 - RNA, 19 nt, Human
ucuccaggcaccaucuccc

SEQ ID NO: 2913864 - RNA, 12 nt, Human
ucuccccagugu

SEQ ID NO: 2913865 - RNA, 14 nt, Human
ucucccugccagag

SEQ ID NO: 2913866 - RNA, 15 nt, Human
ucucccugccagagg

SEQ ID NO: 2913867 - RNA, 18 nt, Human
ucucccuccccugccauu

SEQ ID NO: 2913868 - RNA, 12 nt, Human
ucucccuccccu

SEQ ID NO: 2913869 - RNA, 14 nt, Human
ucucccucccuugg

SEQ ID NO: 2913870 - RNA, 13 nt, Human
ugacaagcagaua

SEQ ID NO: 2913871 - RNA, 20 nt, Human
ugacaagcagauacugcugu

SEQ ID NO: 2913872 - RNA, 22 nt, Human
ugacaagcagauacugcugugu

SEQ ID NO: 2913873 - RNA, 11 nt, Human
ugacaagagcc

SEQ ID NO: 2913874 - RNA, 14 nt, Human
ugacaagagccuga

SEQ ID NO: 2913875 - RNA, 22 nt, Human
ugacaagagccugaucucuucc

SEQ ID NO: 2913876 - RNA, 23 nt, Human
ugacaagagccugaucucuuccu

SEQ ID NO: 2913877 - RNA, 16 nt, Human
ugaauugcguuggucu

SEQ ID NO: 2913878 - RNA, 22 nt, Human
ugaauugcguuggucucugcau

SEQ ID NO: 2913879 - RNA, 18 nt, Human
ugacaaggauugcuacug

SEQ ID NO: 2913880 - RNA, 20 nt, Human
ugacagaaggugccacuuua

SEQ ID NO: 2913881 - RNA, 17 nt, Human
ugacagaaggugccacu

SEQ ID NO: 2913882 - RNA, 15 nt, Human
ugacagaaggugcca

SEQ ID NO: 2913883 - RNA, 13 nt, Human
ugacagaaagcag

SEQ ID NO: 2913884 - RNA, 16 nt, Human
ugacagaaggaccagc

SEQ ID NO: 2913885 - RNA, 20 nt, Human
ugacagaaggaccagcccuu

SEQ ID NO: 2913886 - RNA, 14 nt, Human
ugacaauaauuuca

SEQ ID NO: 2913887 - RNA, 18 nt, Human
ugacaauaauauuguugu

SEQ ID NO: 2913888 - RNA, 19 nt, Human
ugacaauaauauuguugua

SEQ ID NO: 2913889 - RNA, 20 nt, Human
ugacaauaauauuguuguau

SEQ ID NO: 2913890 - RNA, 22 nt, Human
ugacaauaauauuguuguauaa

SEQ ID NO: 2913891 - RNA, 17 nt, Human
ugacaauaauuucaggu

SEQ ID NO: 2913892 - RNA, 16 nt, Human
ugacacaaaccugccu

SEQ ID NO: 2913893 - RNA, 13 nt, Human
ugacaauugucac

SEQ ID NO: 2913894 - RNA, 17 nt, Human
ugacagaggcagcccca

SEQ ID NO: 2913895 - RNA, 16 nt, Human
ugacagaggcagcccc

SEQ ID NO: 2913896 - RNA, 15 nt, Human
ugacagaggcagccc

SEQ ID NO: 2913897 - RNA, 14 nt, Human
ugacagaggcagcc

SEQ ID NO: 2913898 - RNA, 23 nt, Human
ugacagacacaggcccggcucca

SEQ ID NO: 2913899 - RNA, 20 nt, Human
ugacagacacaggcccggcu

SEQ ID NO: 2913900 - RNA, 13 nt, Human
ugacagaggcagc

SEQ ID NO: 2913901 - RNA, 16 nt, Human
ugacagacagcccucc

SEQ ID NO: 2913902 - RNA, 17 nt, Human
ugacagagugagacucu

SEQ ID NO: 2913903 - RNA, 14 nt, Human
ugacagagugagac

SEQ ID NO: 2913904 - RNA, 23 nt, Human
ugacagaggcagccccauucugc

SEQ ID NO: 2913905 - RNA, 18 nt, Human
ugacagaggcagccccau

SEQ ID NO: 2913906 - RNA, 19 nt, Human
ugacagagugagacucugu

SEQ ID NO: 2913907 - RNA, 18 nt, Human
ugacagaccacaucuuua

SEQ ID NO: 2913908 - RNA, 17 nt, Human
ugacagaccacaucuuu

SEQ ID NO: 2913909 - RNA, 17 nt, Human
ugacauaacagugcagg

SEQ ID NO: 2913910 - RNA, 12 nt, Human
ugacaugugaaa

SEQ ID NO: 2913911 - RNA, 23 nt, Human
ugaccaccaccccaacaaaccau

SEQ ID NO: 2913912 - RNA, 15 nt, Human
ugacauaccuuuuau

SEQ ID NO: 2913913 - RNA, 16 nt, Human
ugacauaccuuuuauu

SEQ ID NO: 2913914 - RNA, 16 nt, Human
ugacauaauauauucu

SEQ ID NO: 2913915 - RNA, 14 nt, Human
ugacccuggggcug

SEQ ID NO: 2913916 - RNA, 15 nt, Human
ugacccuggggcugg

SEQ ID NO: 2913917 - RNA, 17 nt, Human
ugacccuggggcuggcu

SEQ ID NO: 2913918 - RNA, 18 nt, Human
ugacccuggggcuggcuu

SEQ ID NO: 2913919 - RNA, 23 nt, Human
ugacccugcgaaggggcccuggu

SEQ ID NO: 2913920 - RNA, 22 nt, Human
ugacccugcgaaggggcccugg

SEQ ID NO: 2913921 - RNA, 21 nt, Human
ugacccugcgaaggggcccug

SEQ ID NO: 2913922 - RNA, 20 nt, Human
ugacccuuccagacauacga

SEQ ID NO: 2913923 - RNA, 21 nt, Human
ugacccuuccagacauacgaa

SEQ ID NO: 2913924 - RNA, 19 nt, Human
ugacccuucccaaucagca

SEQ ID NO: 2913925 - RNA, 21 nt, Human
ugacccuucccaaucagcacu

SEQ ID NO: 2913926 - RNA, 22 nt, Human
ugacccuucccaaucagcacug

SEQ ID NO: 2913927 - RNA, 23 nt, Human
ugacccuucccaaucagcacuga

SEQ ID NO: 2913928 - RNA, 16 nt, Human
ugaccauacugaggga

SEQ ID NO: 2913929 - RNA, 21 nt, Human
ugaccaguuuaaccugaugca

SEQ ID NO: 2913930 - RNA, 23 nt, Human
ugaccaguuuaaccugaugcagu

SEQ ID NO: 2913931 - RNA, 20 nt, Human
ugaccaguuuaaccugaugc

SEQ ID NO: 2913932 - RNA, 12 nt, Human
ugaccaggccug

SEQ ID NO: 2913933 - RNA, 20 nt, Human
ugaccaggccugggccagag

SEQ ID NO: 2913934 - RNA, 13 nt, Human
ugaccaggccugg

SEQ ID NO: 2913935 - RNA, 15 nt, Human
ugaccaggccugggc

SEQ ID NO: 2913936 - RNA, 23 nt, Human
ugaccagccuccaugcugccucc

SEQ ID NO: 2913937 - RNA, 21 nt, Human
ugaagucacugcacagugcau

SEQ ID NO: 2913938 - RNA, 16 nt, Human
ugaaggaauacaauau

SEQ ID NO: 2913939 - RNA, 18 nt, Human
ugaaggcagagaaaggga

SEQ ID NO: 2913940 - RNA, 17 nt, Human
ugaagugagcacagccu

SEQ ID NO: 2913941 - RNA, 13 nt, Human
ugaagugcgugaa

SEQ ID NO: 2913942 - RNA, 16 nt, Human
ugaagugcgugaaugu

SEQ ID NO: 2913943 - RNA, 17 nt, Human
ugaagugcgugaaugua

SEQ ID NO: 2913944 - RNA, 21 nt, Human
ugaagugcgugaauguaugua

SEQ ID NO: 2913945 - RNA, 16 nt, Human
ugaaguguaccugugu

SEQ ID NO: 2913946 - RNA, 17 nt, Human
ugaaguguaccugugua

SEQ ID NO: 2913947 - RNA, 22 nt, Human
ugaaguguaccuguguacauaa

SEQ ID NO: 2913948 - RNA, 18 nt, Human
ugaagugagcacagccua

SEQ ID NO: 2913949 - RNA, 16 nt, Human
ugaaguguguuuccuu

SEQ ID NO: 2913950 - RNA, 22 nt, Human
ugaaguguguuuccuucagugc

SEQ ID NO: 2913951 - RNA, 18 nt, Human
ugaaguguguuuccuuca

SEQ ID NO: 2913952 - RNA, 20 nt, Human
ugaaguguuuuguucuuucu

SEQ ID NO: 2913953 - RNA, 16 nt, Human
ugaaguuacuuuaugu

SEQ ID NO: 2913954 - RNA, 15 nt, Human
ugaaguuacuuucuu

SEQ ID NO: 2913955 - RNA, 19 nt, Human
ugaaguuacuuucuuaaug

SEQ ID NO: 2913956 - RNA, 19 nt, Human
ugaaguuagguucuuaaaa

SEQ ID NO: 2913957 - RNA, 21 nt, Human
ugaaguuagguucuuaaaagu

SEQ ID NO: 2913958 - RNA, 22 nt, Human
ugaaguuagguucuuaaaagug

SEQ ID NO: 2913959 - RNA, 14 nt, Human
ugaaguucuccuga

SEQ ID NO: 2913960 - RNA, 14 nt, Human
ugaaguuuaaaaca

SEQ ID NO: 2913961 - RNA, 14 nt, Human
ugaauaaaagugca

SEQ ID NO: 2913962 - RNA, 15 nt, Human
ugaauaaaagugcac

SEQ ID NO: 2913963 - RNA, 16 nt, Human
ugaauaaaagugcaca

SEQ ID NO: 2913964 - RNA, 19 nt, Human
ugaauaaaaauauguacaa

SEQ ID NO: 2913965 - RNA, 20 nt, Human
ugaaggacauugcggacagc

SEQ ID NO: 2913966 - RNA, 19 nt, Human
ugaaggacauugcggacag

SEQ ID NO: 2913967 - RNA, 22 nt, Human
ugaaggacauugcggacagcca

SEQ ID NO: 2913968 - RNA, 14 nt, Human
ugaaggcaaugcca

SEQ ID NO: 2913969 - RNA, 18 nt, Human
ugaaggcaaaauugcaaa

SEQ ID NO: 2913970 - RNA, 16 nt, Human
ugaaggagagcccuuc

SEQ ID NO: 2913971 - RNA, 16 nt, Human
ugaacucugaacuuug

SEQ ID NO: 2913972 - RNA, 18 nt, Human
ugaacucugaacuuugga

SEQ ID NO: 2913973 - RNA, 16 nt, Human
ugaacucugggcucaa

SEQ ID NO: 2913974 - RNA, 17 nt, Human
ugaacuccuggccucaa

SEQ ID NO: 2913975 - RNA, 16 nt, Human
ugaacucugacaacag

SEQ ID NO: 2913976 - RNA, 18 nt, Human
ugaaccaagaucuauaaa

SEQ ID NO: 2913977 - RNA, 14 nt, Human
ugaacauuugugau

SEQ ID NO: 2913978 - RNA, 16 nt, Human
ugaacauuugugauau

SEQ ID NO: 2913979 - RNA, 20 nt, Human
ugaaggaagccaaauuuauc

SEQ ID NO: 2913980 - RNA, 22 nt, Human
ugaaggaagccaaauuuaucaa

SEQ ID NO: 2913981 - RNA, 23 nt, Human
ugaaggaagccaaauuuaucaaa

SEQ ID NO: 2913982 - RNA, 20 nt, Human
ugaaggaauaaauugcuccu

SEQ ID NO: 2913983 - RNA, 14 nt, Human
ugaaugaaagauua

SEQ ID NO: 2913984 - RNA, 16 nt, Human
ugaaugaaagauuaaa

SEQ ID NO: 2913985 - RNA, 19 nt, Human
ugaaugaaagauuaaacag

SEQ ID NO: 2913986 - RNA, 22 nt, Human
ugaaugaaagauuaaacagaug

SEQ ID NO: 2913987 - RNA, 15 nt, Human
ugaaugacaacagaa

SEQ ID NO: 2913988 - RNA, 17 nt, Human
ugaaugacaacagaagc

SEQ ID NO: 2913989 - RNA, 14 nt, Human
ugaaugagaaucua

SEQ ID NO: 2913990 - RNA, 19 nt, Human
ugaaugaggauuauuauaa

SEQ ID NO: 2913991 - RNA, 19 nt, Human
ugaaugaggucccaggcag

SEQ ID NO: 2913992 - RNA, 18 nt, Human
ugaaugaggucccaggca

SEQ ID NO: 2913993 - RNA, 17 nt, Human
ugaaugaggucccaggc

SEQ ID NO: 2913994 - RNA, 21 nt, Human
ugaaugagucuguuguguguc

SEQ ID NO: 2913995 - RNA, 18 nt, Human
ugaaugagucuguugugu

SEQ ID NO: 2913996 - RNA, 22 nt, Human
ugaaugaggucccaggcagaga

SEQ ID NO: 2913997 - RNA, 23 nt, Human
ugaaugagucuguugugugucau

SEQ ID NO: 2913998 - RNA, 14 nt, Human
ugaaugaugagccu

SEQ ID NO: 2913999 - RNA, 23 nt, Human
ugaauguuauuuguuauuuucag

SEQ ID NO: 2914000 - RNA, 14 nt, Human
ugaauguuauuugu

SEQ ID NO: 2914001 - RNA, 15 nt, Human
ugaauguuauuuguu

SEQ ID NO: 2914002 - RNA, 14 nt, Human
ugaauguuaagaau

SEQ ID NO: 2914003 - RNA, 17 nt, Human
ugaauguuaagaauuga

SEQ ID NO: 2914004 - RNA, 16 nt, Human
ugaauguuaauuuuuu

SEQ ID NO: 2914005 - RNA, 20 nt, Human
ugaaucccacccacauguga

SEQ ID NO: 2914006 - RNA, 14 nt, Human
ugaauaaagacacc

SEQ ID NO: 2914007 - RNA, 15 nt, Human
ugaauaaagacaccu

SEQ ID NO: 2914008 - RNA, 13 nt, Human
ugaauaaacuuca

SEQ ID NO: 2914009 - RNA, 14 nt, Human
ugaauaaacuucag

SEQ ID NO: 2914010 - RNA, 15 nt, Human
ugaauaaacuucagc

SEQ ID NO: 2914011 - RNA, 16 nt, Human
ugaauaaacuucagca

SEQ ID NO: 2914012 - RNA, 17 nt, Human
ugaauaaacuucagcac

SEQ ID NO: 2914013 - RNA, 18 nt, Human
ugaauaaacuucagcacc

SEQ ID NO: 2914014 - RNA, 19 nt, Human
ugaauaaacuucagcacca

SEQ ID NO: 2914015 - RNA, 21 nt, Human
ugaauuaggggacacugucuu

SEQ ID NO: 2914016 - RNA, 17 nt, Human
ugaauucuuaugcuuau

SEQ ID NO: 2914017 - RNA, 13 nt, Human
ugaauugacuacc

SEQ ID NO: 2914018 - RNA, 15 nt, Human
ugaauucuuuugcca

SEQ ID NO: 2914019 - RNA, 16 nt, Human
ugaauuccuagaauua

SEQ ID NO: 2914020 - RNA, 18 nt, Human
ugaauuccuagaauuaaa

SEQ ID NO: 2914021 - RNA, 22 nt, Human
ugaaagggagcuaucaggaaca

SEQ ID NO: 2914022 - RNA, 20 nt, Human
ugaaagggagcuaucaggaa

SEQ ID NO: 2914023 - RNA, 19 nt, Human
ugaaagguuacccuguaac

SEQ ID NO: 2914024 - RNA, 16 nt, Human
ugaaagggaucaucau

SEQ ID NO: 2914025 - RNA, 17 nt, Human
ugaaagggaucaucaug

SEQ ID NO: 2914026 - RNA, 23 nt, Human
ugaaagggcaauaugaaguuacu

SEQ ID NO: 2914027 - RNA, 13 nt, Human
ugaaagguacuau

SEQ ID NO: 2914028 - RNA, 14 nt, Human
ugaaagguacuaua

SEQ ID NO: 2914029 - RNA, 15 nt, Human
ugaaagguacuauau

SEQ ID NO: 2914030 - RNA, 18 nt, Human
ugaaagguacuauauuug

SEQ ID NO: 2914031 - RNA, 19 nt, Human
ugaaagguacuauauuugc

SEQ ID NO: 2914032 - RNA, 13 nt, Human
ugaaagggcccag

SEQ ID NO: 2914033 - RNA, 22 nt, Human
ugaaagccuuagggaagcuggc

SEQ ID NO: 2914034 - RNA, 17 nt, Human
ugaaagcucuguugcaa

SEQ ID NO: 2914035 - RNA, 14 nt, Human
ugaaagcugagaac

SEQ ID NO: 2914036 - RNA, 19 nt, Human
ugaaagcugagaacuccug

SEQ ID NO: 2914037 - RNA, 20 nt, Human
ugaaagcugagaacuccuga

SEQ ID NO: 2914038 - RNA, 21 nt, Human
ugaaagcugagaacuccugac

SEQ ID NO: 2914039 - RNA, 22 nt, Human
ugaaagcugagaacuccugacu

SEQ ID NO: 2914040 - RNA, 15 nt, Human
ugaaacccuggacca

SEQ ID NO: 2914041 - RNA, 17 nt, Human
ugaaagaugauuugcaa

SEQ ID NO: 2914042 - RNA, 18 nt, Human
ugaaagaugauuugcaau

SEQ ID NO: 2914043 - RNA, 22 nt, Human
ugaaagaugauuugcaauggga

SEQ ID NO: 2914044 - RNA, 11 nt, Human
ugaaagaugau

SEQ ID NO: 2914045 - RNA, 21 nt, Human
ugaaacccuggaccagugguc

SEQ ID NO: 2914046 - RNA, 17 nt, Human
ugaaagccuuagggaag

SEQ ID NO: 2914047 - RNA, 18 nt, Human
ugaaagauggcugugccu

SEQ ID NO: 2914048 - RNA, 14 nt, Human
ugaaacaaagcugc

SEQ ID NO: 2914049 - RNA, 18 nt, Human
ugaaacaaauaaucacau

SEQ ID NO: 2914050 - RNA, 19 nt, Human
ugaaacaaauaaucacauu

SEQ ID NO: 2914051 - RNA, 22 nt, Human
ugaaacaaauaaucacauugac

SEQ ID NO: 2914052 - RNA, 17 nt, Human
ugaaaagcuauuagcca

SEQ ID NO: 2914053 - RNA, 19 nt, Human
ugaaaagcuauuagccagg

SEQ ID NO: 2914054 - RNA, 20 nt, Human
ugaaaagcuauuagccagga

SEQ ID NO: 2914055 - RNA, 23 nt, Human
ugaaaagcuauuagccaggauca

SEQ ID NO: 2914056 - RNA, 20 nt, Human
ugaaacacaaacaauaguaa

SEQ ID NO: 2914057 - RNA, 13 nt, Human
ugaaacacaaaca

SEQ ID NO: 2914058 - RNA, 13 nt, Human
ugaaacacagcug

SEQ ID NO: 2914059 - RNA, 14 nt, Human
ugaaacacagcugu

SEQ ID NO: 2914060 - RNA, 15 nt, Human
ugaaacacagcuguu

SEQ ID NO: 2914061 - RNA, 17 nt, Human
ugaaacacagcuguucu

SEQ ID NO: 2914062 - RNA, 18 nt, Human
ugaaacacagcuguucuu

SEQ ID NO: 2914063 - RNA, 19 nt, Human
ugaaacacagcuguucuuc

SEQ ID NO: 2914064 - RNA, 21 nt, Human
ugaaacacagcuguucuucug

SEQ ID NO: 2914065 - RNA, 21 nt, Human
ugaaacaccaagaugucuguc

SEQ ID NO: 2914066 - RNA, 22 nt, Human
ugaaacaccaagaugucugucu

SEQ ID NO: 2914067 - RNA, 14 nt, Human
ugaaaagauucuuc

SEQ ID NO: 2914068 - RNA, 17 nt, Human
ugaaaagauuuaagcac

SEQ ID NO: 2914069 - RNA, 13 nt, Human
ugaaaagcuauua

SEQ ID NO: 2914070 - RNA, 22 nt, Human
ucuuuucacauagcugucuaga

SEQ ID NO: 2914071 - RNA, 13 nt, Human
ugaaaagauguac

SEQ ID NO: 2914072 - RNA, 16 nt, Human
ugaaaagauguaccug

SEQ ID NO: 2914073 - RNA, 22 nt, Human
ugaaaagauguaccugguggau

SEQ ID NO: 2914074 - RNA, 17 nt, Human
ugaaaucaguuacucuu

SEQ ID NO: 2914075 - RNA, 16 nt, Human
ugaaaucaguuacucu

SEQ ID NO: 2914076 - RNA, 21 nt, Human
ugaaauauuuuuuaauuuaaa

SEQ ID NO: 2914077 - RNA, 19 nt, Human
ugaaaucaaugcaagagug

SEQ ID NO: 2914078 - RNA, 22 nt, Human
ugaaaucaaugcaagagugauu

SEQ ID NO: 2914079 - RNA, 13 nt, Human
ugaaauauugcug

SEQ ID NO: 2914080 - RNA, 17 nt, Human
ugaaauauugcuguaua

SEQ ID NO: 2914081 - RNA, 11 nt, Human
ugaaauauuuu

SEQ ID NO: 2914082 - RNA, 17 nt, Human
ugaaaugugguuuuccu

SEQ ID NO: 2914083 - RNA, 19 nt, Human
ugaaaugugguuuuccuga

SEQ ID NO: 2914084 - RNA, 17 nt, Human
ugaaauggauacuacau

SEQ ID NO: 2914085 - RNA, 19 nt, Human
ugaaauggauacuacaucu

SEQ ID NO: 2914086 - RNA, 22 nt, Human
ugaaaugucacguacugucuga

SEQ ID NO: 2914087 - RNA, 13 nt, Human
ugaaauucuaaag

SEQ ID NO: 2914088 - RNA, 23 nt, Human
ugaaauucuaaagagcacuuacu

SEQ ID NO: 2914089 - RNA, 12 nt, Human
ugaaauuccaaa

SEQ ID NO: 2914090 - RNA, 14 nt, Human
ugaaauuccaaagu

SEQ ID NO: 2914091 - RNA, 15 nt, Human
ugaaauuccaaaguc

SEQ ID NO: 2914092 - RNA, 19 nt, Human
ugaaauuccaaagucucua

SEQ ID NO: 2914093 - RNA, 16 nt, Human
ugaaauuccaaagucu

SEQ ID NO: 2914094 - RNA, 17 nt, Human
ugaaauuccaaagucuc

SEQ ID NO: 2914095 - RNA, 22 nt, Human
ugaaauuaugugacauuuuaca

SEQ ID NO: 2914096 - RNA, 20 nt, Human
ugaaauuaugugacauuuua

SEQ ID NO: 2914097 - RNA, 23 nt, Human
ugaaauuaagaaggcaaaaaugu

SEQ ID NO: 2914098 - RNA, 19 nt, Human
ugaaauuacuuaucaucca

SEQ ID NO: 2914099 - RNA, 22 nt, Human
ugaaauuacuuaucauccacau

SEQ ID NO: 2914100 - RNA, 13 nt, Human
ugaaauuauaguu

SEQ ID NO: 2914101 - RNA, 18 nt, Human
ugaaauuauaguuucaag

SEQ ID NO: 2914102 - RNA, 21 nt, Human
ugaaauuauaguuucaagcca

SEQ ID NO: 2914103 - RNA, 14 nt, Human
ugaaauuauaucug

SEQ ID NO: 2914104 - RNA, 15 nt, Human
ugaaauuauaucugu

SEQ ID NO: 2914105 - RNA, 21 nt, Human
ugaaauguuagucauuguuau

SEQ ID NO: 2914106 - RNA, 21 nt, Human
ugaaauuaagaaggcaaaaau

SEQ ID NO: 2914107 - RNA, 19 nt, Human
ugaaauuaagaaggcaaaa

SEQ ID NO: 2914108 - RNA, 18 nt, Human
ugaacaaguuuuaaugua

SEQ ID NO: 2914109 - RNA, 19 nt, Human
ugaacaaguuuuaauguau

SEQ ID NO: 2914110 - RNA, 18 nt, Human
ugaacacaaacuguaaau

SEQ ID NO: 2914111 - RNA, 15 nt, Human
ugaaaggcuuuuaaa

SEQ ID NO: 2914112 - RNA, 18 nt, Human
ugaacaagaauuggaagc

SEQ ID NO: 2914113 - RNA, 11 nt, Human
ugaacaagaau

SEQ ID NO: 2914114 - RNA, 14 nt, Human
ugaacaagaauugg

SEQ ID NO: 2914115 - RNA, 12 nt, Human
ugaacaagaauu

SEQ ID NO: 2914116 - RNA, 21 nt, Human
ugaacaauugucgaaaagagu

SEQ ID NO: 2914117 - RNA, 20 nt, Human
ugaacagcauggcacucccu

SEQ ID NO: 2914118 - RNA, 23 nt, Human
ugaacagcauggcacucccucca

SEQ ID NO: 2914119 - RNA, 16 nt, Human
ugaacuccuggccuca

SEQ ID NO: 2914120 - RNA, 20 nt, Human
ugaaccaccacacccagccc

SEQ ID NO: 2914121 - RNA, 17 nt, Human
ugaaccaccacacccag

SEQ ID NO: 2914122 - RNA, 23 nt, Human
ugaaccacaucuugcucugcuga

SEQ ID NO: 2914123 - RNA, 15 nt, Human
ugaacauuuacuaca

SEQ ID NO: 2914124 - RNA, 20 nt, Human
ugaacauuuacuacaguuuu

SEQ ID NO: 2914125 - RNA, 22 nt, Human
ugaacauuuacuacaguuuuua

SEQ ID NO: 2914126 - RNA, 18 nt, Human
ucuuucaacuugcaucca

SEQ ID NO: 2914127 - RNA, 14 nt, Human
ucuuucaagaauga

SEQ ID NO: 2914128 - RNA, 15 nt, Human
ucuuucaacuugcau

SEQ ID NO: 2914129 - RNA, 15 nt, Human
ucuuguuuuuauuaa

SEQ ID NO: 2914130 - RNA, 17 nt, Human
ucuuguuuuuauuaauu

SEQ ID NO: 2914131 - RNA, 20 nt, Human
ucuuguuuuuauuaauuuau

SEQ ID NO: 2914132 - RNA, 21 nt, Human
ucuuguuuuuauuaauuuaua

SEQ ID NO: 2914133 - RNA, 14 nt, Human
ucuuguuuuguuug

SEQ ID NO: 2914134 - RNA, 15 nt, Human
ucuuguuuuguuugu

SEQ ID NO: 2914135 - RNA, 16 nt, Human
ucuuguuuuguuuguc

SEQ ID NO: 2914136 - RNA, 17 nt, Human
ucuuguuuuguuugucu

SEQ ID NO: 2914137 - RNA, 22 nt, Human
ucuuguuuuguuugucucuccu

SEQ ID NO: 2914138 - RNA, 23 nt, Human
ucuuguuuuguuugucucuccuu

SEQ ID NO: 2914139 - RNA, 12 nt, Human
ucuuucaaacuc

SEQ ID NO: 2914140 - RNA, 12 nt, Human
ucuugcuuguac

SEQ ID NO: 2914141 - RNA, 13 nt, Human
ucuugcuuguacc

SEQ ID NO: 2914142 - RNA, 15 nt, Human
ucuuguguuguccuu

SEQ ID NO: 2914143 - RNA, 15 nt, Human
ucuuguuccaaggcc

SEQ ID NO: 2914144 - RNA, 13 nt, Human
ucuuguuucucca

SEQ ID NO: 2914145 - RNA, 21 nt, Human
ucuuguuucuccagauuuuua

SEQ ID NO: 2914146 - RNA, 14 nt, Human
ucuuguuuucaguu

SEQ ID NO: 2914147 - RNA, 22 nt, Human
ucuuguuucuuuucacauagcu

SEQ ID NO: 2914148 - RNA, 20 nt, Human
ucuuguuuauaccuuugccu

SEQ ID NO: 2914149 - RNA, 13 nt, Human
ucuuguuuauuga

SEQ ID NO: 2914150 - RNA, 11 nt, Human
ucuuguugcuu

SEQ ID NO: 2914151 - RNA, 13 nt, Human
ucuuguugcuuug

SEQ ID NO: 2914152 - RNA, 14 nt, Human
ucuuguugcuuugu

SEQ ID NO: 2914153 - RNA, 19 nt, Human
ucuuguugcuuuguugcac

SEQ ID NO: 2914154 - RNA, 13 nt, Human
ucuuguucuguca

SEQ ID NO: 2914155 - RNA, 15 nt, Human
ucuuguucugucacu

SEQ ID NO: 2914156 - RNA, 15 nt, Human
ucuuguuagaaaaca

SEQ ID NO: 2914157 - RNA, 17 nt, Human
ucuuguuagaaaacaaa

SEQ ID NO: 2914158 - RNA, 17 nt, Human
ucuugcgaauccaagcu

SEQ ID NO: 2914159 - RNA, 19 nt, Human
ucuugcgaauccaagcucc

SEQ ID NO: 2914160 - RNA, 20 nt, Human
ucuugcgaauccaagcuccc

SEQ ID NO: 2914161 - RNA, 21 nt, Human
ucuugcgaauccaagcucccu

SEQ ID NO: 2914162 - RNA, 23 nt, Human
ucuugcgaauccaagcucccugc

SEQ ID NO: 2914163 - RNA, 16 nt, Human
ucuugcauccuuccua

SEQ ID NO: 2914164 - RNA, 18 nt, Human
ucuugcauccuuccuaua

SEQ ID NO: 2914165 - RNA, 21 nt, Human
ucuugcauccuuccuauaacu

SEQ ID NO: 2914166 - RNA, 22 nt, Human
ucuugcauccuuccuauaacuu

SEQ ID NO: 2914167 - RNA, 23 nt, Human
ucuugcauccuuccuauaacuug

SEQ ID NO: 2914168 - RNA, 18 nt, Human
ucuugcuauauugcccag

SEQ ID NO: 2914169 - RNA, 19 nt, Human
ucuugcuauauugcccagg

SEQ ID NO: 2914170 - RNA, 20 nt, Human
ucuugcuaucggggaagcca

SEQ ID NO: 2914171 - RNA, 21 nt, Human
ucuugcuaucggggaagccag

SEQ ID NO: 2914172 - RNA, 10 nt, Human
ucuugcugcu

SEQ ID NO: 2914173 - RNA, 13 nt, Human
ucuugcugcuaga

SEQ ID NO: 2914174 - RNA, 14 nt, Human
ucuugcugcuagaa

SEQ ID NO: 2914175 - RNA, 15 nt, Human
ucuugcugcuagaac

SEQ ID NO: 2914176 - RNA, 16 nt, Human
ucuugcugcuagaacu

SEQ ID NO: 2914177 - RNA, 17 nt, Human
ucuugcugcuagaacuu

SEQ ID NO: 2914178 - RNA, 18 nt, Human
ucuugcugcuagaacuuu

SEQ ID NO: 2914179 - RNA, 19 nt, Human
ucuugcugcuagaacuuuu

SEQ ID NO: 2914180 - RNA, 20 nt, Human
ucuugcugcuagaacuuuuu

SEQ ID NO: 2914181 - RNA, 22 nt, Human
ucuugcugcuagaacuuuuuua

SEQ ID NO: 2914182 - RNA, 13 nt, Human
ucuugcugucucu

SEQ ID NO: 2914183 - RNA, 14 nt, Human
ucuugcugucucug

SEQ ID NO: 2914184 - RNA, 16 nt, Human
ucuugcugucucugcu

SEQ ID NO: 2914185 - RNA, 17 nt, Human
ucuugcugucucugcuc

SEQ ID NO: 2914186 - RNA, 19 nt, Human
ucuugcugucucugcucgc

SEQ ID NO: 2914187 - RNA, 14 nt, Human
ucuugcuguugaca

SEQ ID NO: 2914188 - RNA, 15 nt, Human
ucuugcuguugacau

SEQ ID NO: 2914189 - RNA, 18 nt, Human
ucuugcuguugacauauu

SEQ ID NO: 2914190 - RNA, 19 nt, Human
ucuugcuguugacauauuu

SEQ ID NO: 2914191 - RNA, 21 nt, Human
ucuugcuguugacauauuuaa

SEQ ID NO: 2914192 - RNA, 19 nt, Human
ucuugcuuaccuugacugu

SEQ ID NO: 2914193 - RNA, 21 nt, Human
ucuugcuuaccuugacuguug

SEQ ID NO: 2914194 - RNA, 12 nt, Human
ucucccuuaccc

SEQ ID NO: 2914195 - RNA, 13 nt, Human
ucuccucuugcca

SEQ ID NO: 2914196 - RNA, 16 nt, Human
ucuccucuugccacug

SEQ ID NO: 2914197 - RNA, 23 nt, Human
ucuugcaauggcagccuuggcaa

SEQ ID NO: 2914198 - RNA, 17 nt, Human
ucuccucuugccacugc

SEQ ID NO: 2914199 - RNA, 12 nt, Human
ucuuucuuccuu

SEQ ID NO: 2914200 - RNA, 13 nt, Human
ucuuucuuccuuu

SEQ ID NO: 2914201 - RNA, 15 nt, Human
ucuuucuuccuuuac

SEQ ID NO: 2914202 - RNA, 22 nt, Human
ucuuucuuuugauucuuccuaa

SEQ ID NO: 2914203 - RNA, 12 nt, Human
ucuuucuuuaaa

SEQ ID NO: 2914204 - RNA, 13 nt, Human
ucuuucuuuaaau

SEQ ID NO: 2914205 - RNA, 16 nt, Human
ucuuucuuuaaauguu

SEQ ID NO: 2914206 - RNA, 18 nt, Human
ucuuucuuuaaauguuuu

SEQ ID NO: 2914207 - RNA, 17 nt, Human
ucuuucagcuaucagua

SEQ ID NO: 2914208 - RNA, 18 nt, Human
ucuuucagcuaucaguag

SEQ ID NO: 2914209 - RNA, 18 nt, Human
ucuuucagacuugccaug

SEQ ID NO: 2914210 - RNA, 21 nt, Human
ucuuucagacuugccauguga

SEQ ID NO: 2914211 - RNA, 23 nt, Human
ucuuucagacuugccaugugacu

SEQ ID NO: 2914212 - RNA, 22 nt, Human
ucuuucagauuuuuugaaccau

SEQ ID NO: 2914213 - RNA, 20 nt, Human
ucuuugauucuccuuuuaug

SEQ ID NO: 2914214 - RNA, 21 nt, Human
ucuuugauucuccuuuuaugu

SEQ ID NO: 2914215 - RNA, 22 nt, Human
ucuuugauucuccuuuuaugug

SEQ ID NO: 2914216 - RNA, 13 nt, Human
ucuuugauaaugu

SEQ ID NO: 2914217 - RNA, 14 nt, Human
ucuuugauaauguu

SEQ ID NO: 2914218 - RNA, 21 nt, Human
ucuuugauaauguuaaauuug

SEQ ID NO: 2914219 - RNA, 16 nt, Human
ucuuugauaauguuaa

SEQ ID NO: 2914220 - RNA, 17 nt, Human
ucuuugauaauguuaaa

SEQ ID NO: 2914221 - RNA, 21 nt, Human
ucuuugaaauagucuguguga

SEQ ID NO: 2914222 - RNA, 21 nt, Human
ucuuugaaagacuuccaaaga

SEQ ID NO: 2914223 - RNA, 22 nt, Human
ucuuugaaagacuuccaaagaa

SEQ ID NO: 2914224 - RNA, 23 nt, Human
ucuuugaaagacuuccaaagaau

SEQ ID NO: 2914225 - RNA, 22 nt, Human
ucuuugaaauagucugugugaa

SEQ ID NO: 2914226 - RNA, 22 nt, Human
ucuuugaagaagguggaccuuu

SEQ ID NO: 2914227 - RNA, 23 nt, Human
ucuuugaagaagguggaccuuuu

SEQ ID NO: 2914228 - RNA, 18 nt, Human
ucuuuggaaaaauguuug

SEQ ID NO: 2914229 - RNA, 19 nt, Human
ucuuuggaaaaauguuugu

SEQ ID NO: 2914230 - RNA, 17 nt, Human
ucuuugcuuugcccagc

SEQ ID NO: 2914231 - RNA, 13 nt, Human
ucuuugcuuugcc

SEQ ID NO: 2914232 - RNA, 19 nt, Human
ucuuuuauaacuaguccuu

SEQ ID NO: 2914233 - RNA, 22 nt, Human
ucuuuuauaacuaguccuuuac

SEQ ID NO: 2914234 - RNA, 20 nt, Human
ucuuuuauaguggaaaaaca

SEQ ID NO: 2914235 - RNA, 21 nt, Human
ucuuuuauaguggaaaaacac

SEQ ID NO: 2914236 - RNA, 13 nt, Human
ucuuuuauauuug

SEQ ID NO: 2914237 - RNA, 14 nt, Human
ucuuuuauauuugu

SEQ ID NO: 2914238 - RNA, 16 nt, Human
ucuuuuauauuuguau

SEQ ID NO: 2914239 - RNA, 17 nt, Human
ucuuuuauauuuguauc

SEQ ID NO: 2914240 - RNA, 18 nt, Human
ucuuuuauauuuguaucg

SEQ ID NO: 2914241 - RNA, 22 nt, Human
ucuuuuauauuuguaucgaugu

SEQ ID NO: 2914242 - RNA, 12 nt, Human
ucuuuuaucugu

SEQ ID NO: 2914243 - RNA, 14 nt, Human
ucuuuuaucuguuu

SEQ ID NO: 2914244 - RNA, 15 nt, Human
ucuuuuaucuguuua

SEQ ID NO: 2914245 - RNA, 21 nt, Human
ucuuuuaucuguuuaaagcau

SEQ ID NO: 2914246 - RNA, 13 nt, Human
ucuuuuauguuug

SEQ ID NO: 2914247 - RNA, 15 nt, Human
ucuuuuauguuugaa

SEQ ID NO: 2914248 - RNA, 16 nt, Human
ucuuuuauguuugaau

SEQ ID NO: 2914249 - RNA, 21 nt, Human
ucuuuuauguuugaauaugga

SEQ ID NO: 2914250 - RNA, 17 nt, Human
ucuuuuagcugaugaac

SEQ ID NO: 2914251 - RNA, 15 nt, Human
ugauguuggcuggga

SEQ ID NO: 2914252 - RNA, 16 nt, Human
ugauguuggcugggaa

SEQ ID NO: 2914253 - RNA, 13 nt, Human
ugauguuggaaga

SEQ ID NO: 2914254 - RNA, 14 nt, Human
ugauguuggcuggg

SEQ ID NO: 2914255 - RNA, 22 nt, Human
ugauguucuaaggcucugagag

SEQ ID NO: 2914256 - RNA, 18 nt, Human
ugauguucuaaggcucug

SEQ ID NO: 2914257 - RNA, 19 nt, Human
ugauguucuaaggcucuga

SEQ ID NO: 2914258 - RNA, 20 nt, Human
ugauguucuaaggcucugag

SEQ ID NO: 2914259 - RNA, 21 nt, Human
ugauguucuaaggcucugaga

SEQ ID NO: 2914260 - RNA, 12 nt, Human
ugauguucuaag

SEQ ID NO: 2914261 - RNA, 14 nt, Human
ugauguucuaaggc

SEQ ID NO: 2914262 - RNA, 15 nt, Human
ugauguucuaaggcu

SEQ ID NO: 2914263 - RNA, 17 nt, Human
ugauguucuaaggcucu

SEQ ID NO: 2914264 - RNA, 15 nt, Human
ugauuagcagaagaa

SEQ ID NO: 2914265 - RNA, 19 nt, Human
ugauuaguuuucuuguugc

SEQ ID NO: 2914266 - RNA, 11 nt, Human
ugauuagauga

SEQ ID NO: 2914267 - RNA, 14 nt, Human
ugauuagcuuugug

SEQ ID NO: 2914268 - RNA, 15 nt, Human
ugauuagcuuugugu

SEQ ID NO: 2914269 - RNA, 16 nt, Human
ugauuagcuuuguguu

SEQ ID NO: 2914270 - RNA, 18 nt, Human
ugauuagcuuuguguuug

SEQ ID NO: 2914271 - RNA, 19 nt, Human
ugauuagcuuuguguuugg

SEQ ID NO: 2914272 - RNA, 16 nt, Human
ugauuauuuauuauuu

SEQ ID NO: 2914273 - RNA, 14 nt, Human
ugauuauugcagaa

SEQ ID NO: 2914274 - RNA, 22 nt, Human
ugauuaugucuuuuauauuugu

SEQ ID NO: 2914275 - RNA, 13 nt, Human
ugauucaaaauau

SEQ ID NO: 2914276 - RNA, 14 nt, Human
ugauucaaaauauu

SEQ ID NO: 2914277 - RNA, 17 nt, Human
ugauucaaaauauuuaa

SEQ ID NO: 2914278 - RNA, 19 nt, Human
ugauucaaaauauuuaaaa

SEQ ID NO: 2914279 - RNA, 23 nt, Human
ugauucaaaauauuuaaaaaugu

SEQ ID NO: 2914280 - RNA, 11 nt, Human
ugauucaaaug

SEQ ID NO: 2914281 - RNA, 13 nt, Human
ugauucaaauggg

SEQ ID NO: 2914282 - RNA, 20 nt, Human
ugauuauuuucauuacaaug

SEQ ID NO: 2914283 - RNA, 21 nt, Human
ugauuauuuucauuacaaugg

SEQ ID NO: 2914284 - RNA, 13 nt, Human
ugauuauuuucuu

SEQ ID NO: 2914285 - RNA, 19 nt, Human
ugauuauuuucuucaucca

SEQ ID NO: 2914286 - RNA, 12 nt, Human
ugauucaauuca

SEQ ID NO: 2914287 - RNA, 17 nt, Human
ugauucacugcauggcu

SEQ ID NO: 2914288 - RNA, 14 nt, Human
ugauucagaaauug

SEQ ID NO: 2914289 - RNA, 22 nt, Human
ugauucacccccaaacagugac

SEQ ID NO: 2914290 - RNA, 12 nt, Human
ugauucacugca

SEQ ID NO: 2914291 - RNA, 13 nt, Human
ugauucacugcau

SEQ ID NO: 2914292 - RNA, 16 nt, Human
ugauguugccuuaaua

SEQ ID NO: 2914293 - RNA, 24 nt, Human
ugauucaccaaaauagucuucuca

SEQ ID NO: 2914294 - RNA, 12 nt, Human
ugauucacagug

SEQ ID NO: 2914295 - RNA, 21 nt, Human
ugauucaauucaacacucccu

SEQ ID NO: 2914296 - RNA, 18 nt, Human
ugauucuuuuuaaagugu

SEQ ID NO: 2914297 - RNA, 23 nt, Human
ugauucuuuuuaaaguguuucug

SEQ ID NO: 2914298 - RNA, 17 nt, Human
ugauucugcuugagaau

SEQ ID NO: 2914299 - RNA, 18 nt, Human
ugauucugcuugagaaua

SEQ ID NO: 2914300 - RNA, 16 nt, Human
ugauucagaaauugga

SEQ ID NO: 2914301 - RNA, 19 nt, Human
ugauucuccuuuuaugugu

SEQ ID NO: 2914302 - RNA, 22 nt, Human
ugauucugcaguaaaucuuuua

SEQ ID NO: 2914303 - RNA, 16 nt, Human
ugauucugcaguaaau

SEQ ID NO: 2914304 - RNA, 18 nt, Human
ugauugccaagcucagga

SEQ ID NO: 2914305 - RNA, 12 nt, Human
ugauugcagcuu

SEQ ID NO: 2914306 - RNA, 14 nt, Human
ugauugcagcuuua

SEQ ID NO: 2914307 - RNA, 15 nt, Human
ugauugaccugcucc

SEQ ID NO: 2914308 - RNA, 16 nt, Human
ugauugaccugcuccg

SEQ ID NO: 2914309 - RNA, 13 nt, Human
ugauugagaaguu

SEQ ID NO: 2914310 - RNA, 20 nt, Human
ugauugagaaguucauuguc

SEQ ID NO: 2914311 - RNA, 14 nt, Human
ugauugauuugaag

SEQ ID NO: 2914312 - RNA, 15 nt, Human
ugauugcacauuguu

SEQ ID NO: 2914313 - RNA, 12 nt, Human
ugauugauuuga

SEQ ID NO: 2914314 - RNA, 21 nt, Human
ugauucuccugccucagccuc

SEQ ID NO: 2914315 - RNA, 17 nt, Human
ugauuggaccaggccau

SEQ ID NO: 2914316 - RNA, 19 nt, Human
ugauuggaauagcuucugg

SEQ ID NO: 2914317 - RNA, 22 nt, Human
ugauuggacaggcaugggugca

SEQ ID NO: 2914318 - RNA, 16 nt, Human
ugauuggaccaggcca

SEQ ID NO: 2914319 - RNA, 16 nt, Human
ugauuggcuuguagaa

SEQ ID NO: 2914320 - RNA, 21 nt, Human
ugauuggcuuguagaauuguu

SEQ ID NO: 2914321 - RNA, 23 nt, Human
ugauuggcuuguagaauuguuau

SEQ ID NO: 2914322 - RNA, 20 nt, Human
ugauuggcaggaguuggaag

SEQ ID NO: 2914323 - RNA, 15 nt, Human
ugauugggacagagg

SEQ ID NO: 2914324 - RNA, 17 nt, Human
ugauugggacagagguu

SEQ ID NO: 2914325 - RNA, 21 nt, Human
ugauuguggaauggagauuca

SEQ ID NO: 2914326 - RNA, 16 nt, Human
ugauuguuugcucuga

SEQ ID NO: 2914327 - RNA, 14 nt, Human
ugauuuaaaacaug

SEQ ID NO: 2914328 - RNA, 15 nt, Human
ugauuuaaaacaugu

SEQ ID NO: 2914329 - RNA, 16 nt, Human
ugauuuaaaacaugua

SEQ ID NO: 2914330 - RNA, 15 nt, Human
ugauuuaaacacaca

SEQ ID NO: 2914331 - RNA, 16 nt, Human
ugauuuaaacacacag

SEQ ID NO: 2914332 - RNA, 19 nt, Human
ugauuggggaauuaaaagu

SEQ ID NO: 2914333 - RNA, 12 nt, Human
ugauuguaaaau

SEQ ID NO: 2914334 - RNA, 14 nt, Human
ugauuguaaaauag

SEQ ID NO: 2914335 - RNA, 17 nt, Human
ugauuguaaaauagcuu

SEQ ID NO: 2914336 - RNA, 23 nt, Human
ugauuguaaaauagcuuguauag

SEQ ID NO: 2914337 - RNA, 21 nt, Human
ugauuggugcaacccuuaccc

SEQ ID NO: 2914338 - RNA, 19 nt, Human
ugauuggugcaacccuuac

SEQ ID NO: 2914339 - RNA, 17 nt, Human
ugauuggugcaacccuu

SEQ ID NO: 2914340 - RNA, 21 nt, Human
ugauuguccuuuaaaaaagaa

SEQ ID NO: 2914341 - RNA, 18 nt, Human
ugauuguggaauggagau

SEQ ID NO: 2914342 - RNA, 14 nt, Human
ugauuguggaaugg

SEQ ID NO: 2914343 - RNA, 18 nt, Human
ugaugcuguucucuucuu

SEQ ID NO: 2914344 - RNA, 14 nt, Human
ugaugguuccccug

SEQ ID NO: 2914345 - RNA, 18 nt, Human
ugauguguuuauuuauag

SEQ ID NO: 2914346 - RNA, 14 nt, Human
ugauguguuuauuu

SEQ ID NO: 2914347 - RNA, 23 nt, Human
ugauguguugugauagcuaacau

SEQ ID NO: 2914348 - RNA, 19 nt, Human
ugaugucccaacuuguaaa

SEQ ID NO: 2914349 - RNA, 13 nt, Human
ugaugucaugugu

SEQ ID NO: 2914350 - RNA, 14 nt, Human
ugaugucauguguu

SEQ ID NO: 2914351 - RNA, 15 nt, Human
ugaugucauguguuc

SEQ ID NO: 2914352 - RNA, 17 nt, Human
ugaugucauuaaugugu

SEQ ID NO: 2914353 - RNA, 20 nt, Human
ugaugccugugaacugaacu

SEQ ID NO: 2914354 - RNA, 15 nt, Human
ugaugccugugaacu

SEQ ID NO: 2914355 - RNA, 20 nt, Human
ugaugcugggaguucuaaca

SEQ ID NO: 2914356 - RNA, 12 nt, Human
ugaugcugggau

SEQ ID NO: 2914357 - RNA, 21 nt, Human
ugaugccugugaacugaacuc

SEQ ID NO: 2914358 - RNA, 16 nt, Human
ugaucuuugcagacag

SEQ ID NO: 2914359 - RNA, 16 nt, Human
ugaugaugugccuggg

SEQ ID NO: 2914360 - RNA, 11 nt, Human
ugaugcaugug

SEQ ID NO: 2914361 - RNA, 21 nt, Human
ugaugcaugugguuugguucc

SEQ ID NO: 2914362 - RNA, 18 nt, Human
ugaugcccugcuccaggg

SEQ ID NO: 2914363 - RNA, 19 nt, Human
ugaugcccugcuccaggga

SEQ ID NO: 2914364 - RNA, 20 nt, Human
ugaugcccugcuccagggag

SEQ ID NO: 2914365 - RNA, 15 nt, Human
ugaugccgugauccu

SEQ ID NO: 2914366 - RNA, 13 nt, Human
ugaugcacagaga

SEQ ID NO: 2914367 - RNA, 16 nt, Human
ugaugcacagagaagc

SEQ ID NO: 2914368 - RNA, 17 nt, Human
ugaugcacagagaagcu

SEQ ID NO: 2914369 - RNA, 18 nt, Human
ugaugcacagagaagcug

SEQ ID NO: 2914370 - RNA, 20 nt, Human
ugaugcacagagaagcuggg

SEQ ID NO: 2914371 - RNA, 12 nt, Human
ugaugcagcauu

SEQ ID NO: 2914372 - RNA, 13 nt, Human
ugaugcagcauuu

SEQ ID NO: 2914373 - RNA, 14 nt, Human
ugaugcagcauuug

SEQ ID NO: 2914374 - RNA, 15 nt, Human
ugaugcagcauuuga

SEQ ID NO: 2914375 - RNA, 18 nt, Human
ugaugcagcauuugauaa

SEQ ID NO: 2914376 - RNA, 19 nt, Human
ugaugcagcauuugauaau

SEQ ID NO: 2914377 - RNA, 23 nt, Human
ugaugcagcauuugauaaugaua

SEQ ID NO: 2914378 - RNA, 19 nt, Human
ugaugcaggauuuguucuc

SEQ ID NO: 2914379 - RNA, 22 nt, Human
ugaugcaggauuuguucucugu

SEQ ID NO: 2914380 - RNA, 13 nt, Human
ugaugcaggcacu

SEQ ID NO: 2914381 - RNA, 21 nt, Human
ugaugcaggcacuuauuguaa

SEQ ID NO: 2914382 - RNA, 14 nt, Human
ugaugcagucuccu

SEQ ID NO: 2914383 - RNA, 15 nt, Human
ugaugcagucuccuc

SEQ ID NO: 2914384 - RNA, 21 nt, Human
ugaugcagucuccucuuuaaa

SEQ ID NO: 2914385 - RNA, 21 nt, Human
ugaucuuggcuuacugcagcc

SEQ ID NO: 2914386 - RNA, 19 nt, Human
ugaucuucugggagcagga

SEQ ID NO: 2914387 - RNA, 20 nt, Human
ugaucuucugggagcaggaa

SEQ ID NO: 2914388 - RNA, 22 nt, Human
ugaucuguauauacaauaacau

SEQ ID NO: 2914389 - RNA, 19 nt, Human
ugaucuguauauacaauaa

SEQ ID NO: 2914390 - RNA, 15 nt, Human
ugaucuguauauaca

SEQ ID NO: 2914391 - RNA, 13 nt, Human
ugaucuguauaua

SEQ ID NO: 2914392 - RNA, 20 nt, Human
ugaucugugauaguucaccc

SEQ ID NO: 2914393 - RNA, 21 nt, Human
ugaucugugauaguucacccc

SEQ ID NO: 2914394 - RNA, 13 nt, Human
ugaucugucuugu

SEQ ID NO: 2914395 - RNA, 14 nt, Human
ugaucugucuugua

SEQ ID NO: 2914396 - RNA, 15 nt, Human
ugaucugucuuguaa

SEQ ID NO: 2914397 - RNA, 16 nt, Human
ugaucugucuuguaau

SEQ ID NO: 2914398 - RNA, 17 nt, Human
ugaucugucuuguaaua

SEQ ID NO: 2914399 - RNA, 19 nt, Human
ugaucugucuuguaauauu

SEQ ID NO: 2914400 - RNA, 15 nt, Human
ugaucugugggcaca

SEQ ID NO: 2914401 - RNA, 15 nt, Human
ugaucuguuuuucac

SEQ ID NO: 2914402 - RNA, 16 nt, Human
ugaucuuaagaggcug

SEQ ID NO: 2914403 - RNA, 18 nt, Human
ugaucuuaauauauuuga

SEQ ID NO: 2914404 - RNA, 15 nt, Human
ugaucuuauuuuucu

SEQ ID NO: 2914405 - RNA, 16 nt, Human
ugaucuuauuuuucua

SEQ ID NO: 2914406 - RNA, 17 nt, Human
ugaucuuauuuuucuaa

SEQ ID NO: 2914407 - RNA, 19 nt, Human
ugaucuuauuuuucuaaac

SEQ ID NO: 2914408 - RNA, 20 nt, Human
ugaucuuauuuuucuaaacg

SEQ ID NO: 2914409 - RNA, 19 nt, Human
ugauccacccaccucagcc

SEQ ID NO: 2914410 - RNA, 18 nt, Human
ugauccacccaccucagc

SEQ ID NO: 2914411 - RNA, 17 nt, Human
ugauccacccaccucag

SEQ ID NO: 2914412 - RNA, 18 nt, Human
ugaucucgaacuccuaac

SEQ ID NO: 2914413 - RNA, 19 nt, Human
ugaucagcuuucaaagcau

SEQ ID NO: 2914414 - RNA, 20 nt, Human
ugaucagcuuucaaagcauu

SEQ ID NO: 2914415 - RNA, 21 nt, Human
ugaucagcuuucaaagcauuu

SEQ ID NO: 2914416 - RNA, 12 nt, Human
ugauagauuuga

SEQ ID NO: 2914417 - RNA, 17 nt, Human
ugauagauuugaccucc

SEQ ID NO: 2914418 - RNA, 18 nt, Human
ugauagauuugaccuccu

SEQ ID NO: 2914419 - RNA, 19 nt, Human
ugauagauuugaccuccuc

SEQ ID NO: 2914420 - RNA, 16 nt, Human
ugauccacccaccuca

SEQ ID NO: 2914421 - RNA, 15 nt, Human
ugauccaagcugguc

SEQ ID NO: 2914422 - RNA, 14 nt, Human
ugauccaagcuggu

SEQ ID NO: 2914423 - RNA, 13 nt, Human
ugauccaagcugg

SEQ ID NO: 2914424 - RNA, 16 nt, Human
ugaucaucgccagagg

SEQ ID NO: 2914425 - RNA, 18 nt, Human
ugaucaucgccagaggug

SEQ ID NO: 2914426 - RNA, 20 nt, Human
ugaucaucgccagaggugcu

SEQ ID NO: 2914427 - RNA, 17 nt, Human
ugaucauuuucccccca

SEQ ID NO: 2914428 - RNA, 16 nt, Human
ugaucauuuucccccc

SEQ ID NO: 2914429 - RNA, 16 nt, Human
ugaucauguuguuaaa

SEQ ID NO: 2914430 - RNA, 14 nt, Human
ugaucauucuggag

SEQ ID NO: 2914431 - RNA, 13 nt, Human
ugaucauuuauuu

SEQ ID NO: 2914432 - RNA, 20 nt, Human
ugaucauuuauuuuaagcac

SEQ ID NO: 2914433 - RNA, 23 nt, Human
ugaucauuuauuuuaagcacucu

SEQ ID NO: 2914434 - RNA, 22 nt, Human
ugaucauuuuccccccacucuc

SEQ ID NO: 2914435 - RNA, 21 nt, Human
ugaucauuuuccccccacucu

SEQ ID NO: 2914436 - RNA, 20 nt, Human
ugaucauuuuccccccacuc

SEQ ID NO: 2914437 - RNA, 19 nt, Human
ugaucauuuuccccccacu

SEQ ID NO: 2914438 - RNA, 18 nt, Human
ugaucauuuuccccccac

SEQ ID NO: 2914439 - RNA, 13 nt, Human
ugagagucuagau

SEQ ID NO: 2914440 - RNA, 14 nt, Human
ugagagucuagauu

SEQ ID NO: 2914441 - RNA, 15 nt, Human
ugagagucuagauuc

SEQ ID NO: 2914442 - RNA, 16 nt, Human
ugagagugucucugau

SEQ ID NO: 2914443 - RNA, 21 nt, Human
ugagagugucucugauaaaag

SEQ ID NO: 2914444 - RNA, 16 nt, Human
ugagagucuagauucu

SEQ ID NO: 2914445 - RNA, 17 nt, Human
ugagagucuagauucuc

SEQ ID NO: 2914446 - RNA, 19 nt, Human
ugagagucuagcacucauu

SEQ ID NO: 2914447 - RNA, 21 nt, Human
ugagagucuagcacucauuuu

SEQ ID NO: 2914448 - RNA, 15 nt, Human
ugagcagggcucagc

SEQ ID NO: 2914449 - RNA, 14 nt, Human
ugagcagggcucag

SEQ ID NO: 2914450 - RNA, 13 nt, Human
ugagcagggcuca

SEQ ID NO: 2914451 - RNA, 12 nt, Human
ugagcagggcuc

SEQ ID NO: 2914452 - RNA, 21 nt, Human
ugaccucaggugauccaccca

SEQ ID NO: 2914453 - RNA, 20 nt, Human
ugaccucaggugauccaccc

SEQ ID NO: 2914454 - RNA, 19 nt, Human
ugaccgcgacuaauuucaa

SEQ ID NO: 2914455 - RNA, 16 nt, Human
ugaccucagcuuugau

SEQ ID NO: 2914456 - RNA, 18 nt, Human
ugaccucaggcacuagcc

SEQ ID NO: 2914457 - RNA, 22 nt, Human
ugaccucagcuuugauauuuca

SEQ ID NO: 2914458 - RNA, 16 nt, Human
ugagaacacugugaaa

SEQ ID NO: 2914459 - RNA, 12 nt, Human
ugagaacacugu

SEQ ID NO: 2914460 - RNA, 14 nt, Human
ugagaacacuguga

SEQ ID NO: 2914461 - RNA, 19 nt, Human
ugaccucaggcacuagccu

SEQ ID NO: 2914462 - RNA, 16 nt, Human
ugagaaauuucuguga

SEQ ID NO: 2914463 - RNA, 19 nt, Human
ugagaaauuucugugaaac

SEQ ID NO: 2914464 - RNA, 12 nt, Human
ugagaacaaagc

SEQ ID NO: 2914465 - RNA, 15 nt, Human
ugagaacaaagcugu

SEQ ID NO: 2914466 - RNA, 16 nt, Human
ugagaacaaagcuguu

SEQ ID NO: 2914467 - RNA, 19 nt, Human
ugagaacaaagcuguuaaa

SEQ ID NO: 2914468 - RNA, 20 nt, Human
ugagaacaaagcuguuaaac

SEQ ID NO: 2914469 - RNA, 22 nt, Human
ugagaacaaagcuguuaaacug

SEQ ID NO: 2914470 - RNA, 23 nt, Human
ugagaacaaagcuguuaaacugu

SEQ ID NO: 2914471 - RNA, 23 nt, Human
ugagacguuuuuggaagaguagu

SEQ ID NO: 2914472 - RNA, 14 nt, Human
ugagacuauuuaaa

SEQ ID NO: 2914473 - RNA, 17 nt, Human
ugagacucacaggaagg

SEQ ID NO: 2914474 - RNA, 18 nt, Human
ugagacucacaggaagga

SEQ ID NO: 2914475 - RNA, 16 nt, Human
ugagacccccacaccu

SEQ ID NO: 2914476 - RNA, 15 nt, Human
ugagacccccacacc

SEQ ID NO: 2914477 - RNA, 14 nt, Human
ugagacccccacac

SEQ ID NO: 2914478 - RNA, 17 nt, Human
ugagaccagccugggca

SEQ ID NO: 2914479 - RNA, 21 nt, Human
ugagaccaguugaauaaaagu

SEQ ID NO: 2914480 - RNA, 13 nt, Human
ugagacccccaca

SEQ ID NO: 2914481 - RNA, 21 nt, Human
ugagacccauuccuauuucuu

SEQ ID NO: 2914482 - RNA, 12 nt, Human
ugagacccagga

SEQ ID NO: 2914483 - RNA, 13 nt, Human
ugagacccaggac

SEQ ID NO: 2914484 - RNA, 14 nt, Human
ugagacccaggacu

SEQ ID NO: 2914485 - RNA, 16 nt, Human
ugagacccaggacucc

SEQ ID NO: 2914486 - RNA, 13 nt, Human
ugagaccagccug

SEQ ID NO: 2914487 - RNA, 14 nt, Human
ugagaccagccugg

SEQ ID NO: 2914488 - RNA, 21 nt, Human
ugagaccacagagagagggga

SEQ ID NO: 2914489 - RNA, 13 nt, Human
ugagaccacagag

SEQ ID NO: 2914490 - RNA, 21 nt, Human
ugagaacguaaagaacuuuuu

SEQ ID NO: 2914491 - RNA, 16 nt, Human
ugagccccgcagaccu

SEQ ID NO: 2914492 - RNA, 17 nt, Human
ugagccccgcagaccuc

SEQ ID NO: 2914493 - RNA, 23 nt, Human
ugagccccgcagaccuccccagc

SEQ ID NO: 2914494 - RNA, 14 nt, Human
ugagccccgcccuc

SEQ ID NO: 2914495 - RNA, 19 nt, Human
ugagccccgcccucuuccu

SEQ ID NO: 2914496 - RNA, 20 nt, Human
ugagccccgcccucuuccug

SEQ ID NO: 2914497 - RNA, 21 nt, Human
ugagccccgcccucuuccuga

SEQ ID NO: 2914498 - RNA, 22 nt, Human
ugagccccgcccucuuccugac

SEQ ID NO: 2914499 - RNA, 22 nt, Human
ugagccccgcagaccuccccag

SEQ ID NO: 2914500 - RNA, 18 nt, Human
ugagccccagggugccca

SEQ ID NO: 2914501 - RNA, 19 nt, Human
ugagccccagggugcccag

SEQ ID NO: 2914502 - RNA, 20 nt, Human
ugagccccagggugcccaga

SEQ ID NO: 2914503 - RNA, 21 nt, Human
ugagccccagggugcccagaa

SEQ ID NO: 2914504 - RNA, 23 nt, Human
ugagccccagggugcccagaacu

SEQ ID NO: 2914505 - RNA, 12 nt, Human
ugagccccaucu

SEQ ID NO: 2914506 - RNA, 14 nt, Human
ugagccccaucuuc

SEQ ID NO: 2914507 - RNA, 16 nt, Human
ugagccccaucuucac

SEQ ID NO: 2914508 - RNA, 21 nt, Human
ugagccccaucuucacccagg

SEQ ID NO: 2914509 - RNA, 22 nt, Human
ugagcauacaucuuaaaucuuu

SEQ ID NO: 2914510 - RNA, 17 nt, Human
ugagcagggcucagcgg

SEQ ID NO: 2914511 - RNA, 16 nt, Human
ugagcagggcucagcg

SEQ ID NO: 2914512 - RNA, 19 nt, Human
ugagcagggcucagcgggg

SEQ ID NO: 2914513 - RNA, 15 nt, Human
ugagcagugagcaga

SEQ ID NO: 2914514 - RNA, 22 nt, Human
ugagcucuacccagggccugca

SEQ ID NO: 2914515 - RNA, 19 nt, Human
ugagcucuacccagggccu

SEQ ID NO: 2914516 - RNA, 18 nt, Human
ugagcucuacccagggcc

SEQ ID NO: 2914517 - RNA, 17 nt, Human
ugagcucuacccagggc

SEQ ID NO: 2914518 - RNA, 19 nt, Human
ugagcugcugacugccaau

SEQ ID NO: 2914519 - RNA, 10 nt, Human
ugagcuggcc

SEQ ID NO: 2914520 - RNA, 18 nt, Human
ugagcuggccucucuagc

SEQ ID NO: 2914521 - RNA, 12 nt, Human
ugagccucugcu

SEQ ID NO: 2914522 - RNA, 14 nt, Human
ugagccucugcucc

SEQ ID NO: 2914523 - RNA, 16 nt, Human
ugagccucugcucccc

SEQ ID NO: 2914524 - RNA, 17 nt, Human
ugagccucugcucccca

SEQ ID NO: 2914525 - RNA, 18 nt, Human
ugagccucugcuccccag

SEQ ID NO: 2914526 - RNA, 17 nt, Human
ugagccucagcauccug

SEQ ID NO: 2914527 - RNA, 21 nt, Human
ugagccgagaucacgccacug

SEQ ID NO: 2914528 - RNA, 19 nt, Human
ugagccgagaucacgccac

SEQ ID NO: 2914529 - RNA, 18 nt, Human
ugagcccuguccugccua

SEQ ID NO: 2914530 - RNA, 22 nt, Human
ugagcccucagaacccuuggcu

SEQ ID NO: 2914531 - RNA, 13 nt, Human
ugagcccucccca

SEQ ID NO: 2914532 - RNA, 14 nt, Human
ugagcccuccccag

SEQ ID NO: 2914533 - RNA, 16 nt, Human
ugagcccuccccagga

SEQ ID NO: 2914534 - RNA, 20 nt, Human
ugagcccucagaacccuugg

SEQ ID NO: 2914535 - RNA, 21 nt, Human
ugagccucagcauccuggcac

SEQ ID NO: 2914536 - RNA, 18 nt, Human
ugagccucagcauccugg

SEQ ID NO: 2914537 - RNA, 22 nt, Human
ugagccucagcauccuggcacc

SEQ ID NO: 2914538 - RNA, 14 nt, Human
ugagccucagucuc

SEQ ID NO: 2914539 - RNA, 21 nt, Human
ugauaacuguuuauauguguu

SEQ ID NO: 2914540 - RNA, 22 nt, Human
ugauaacuguuuauauguguug

SEQ ID NO: 2914541 - RNA, 16 nt, Human
ugauaacagaacuuuu

SEQ ID NO: 2914542 - RNA, 17 nt, Human
ugaguuuucuucuguga

SEQ ID NO: 2914543 - RNA, 23 nt, Human
ugaguuuucucuuuguggggcuu

SEQ ID NO: 2914544 - RNA, 19 nt, Human
ugaguuuuugauagcuuua

SEQ ID NO: 2914545 - RNA, 18 nt, Human
ugaguuuuugauagcuuu

SEQ ID NO: 2914546 - RNA, 13 nt, Human
ugaguuuuugaua

SEQ ID NO: 2914547 - RNA, 18 nt, Human
ugaguuuucuucugugau

SEQ ID NO: 2914548 - RNA, 22 nt, Human
ugaguucuacauaaguaauuca

SEQ ID NO: 2914549 - RNA, 22 nt, Human
ugaguuugcccugguuucacug

SEQ ID NO: 2914550 - RNA, 14 nt, Human
ugaguuugcccugg

SEQ ID NO: 2914551 - RNA, 22 nt, Human
ugaguuugggccccagaggcug

SEQ ID NO: 2914552 - RNA, 23 nt, Human
ugaguuugggccccagaggcugg

SEQ ID NO: 2914553 - RNA, 13 nt, Human
ugaguuugcuuau

SEQ ID NO: 2914554 - RNA, 22 nt, Human
ugaguuugcuuauguaaucuca

SEQ ID NO: 2914555 - RNA, 18 nt, Human
ugaguuuggucuggacug

SEQ ID NO: 2914556 - RNA, 16 nt, Human
ugaguuuguagguaaa

SEQ ID NO: 2914557 - RNA, 18 nt, Human
ugaguuuguagguaaaau

SEQ ID NO: 2914558 - RNA, 21 nt, Human
ugaguuuguagguaaaaugua

SEQ ID NO: 2914559 - RNA, 15 nt, Human
ugagucuguugugug

SEQ ID NO: 2914560 - RNA, 16 nt, Human
ugagucuuugguucua

SEQ ID NO: 2914561 - RNA, 17 nt, Human
ugagucuuugguucuaa

SEQ ID NO: 2914562 - RNA, 18 nt, Human
ugagucuuugguucuaag

SEQ ID NO: 2914563 - RNA, 20 nt, Human
ugagucuuugguucuaagga

SEQ ID NO: 2914564 - RNA, 21 nt, Human
ugagucuuugguucuaaggac

SEQ ID NO: 2914565 - RNA, 21 nt, Human
ugagguggccuccuugcuugu

SEQ ID NO: 2914566 - RNA, 23 nt, Human
ugagugagaggcgacaggaguau

SEQ ID NO: 2914567 - RNA, 19 nt, Human
ugagucgaggacagggagg

SEQ ID NO: 2914568 - RNA, 18 nt, Human
ugagucgaggacagggag

SEQ ID NO: 2914569 - RNA, 18 nt, Human
ugagucgucaucacuuuu

SEQ ID NO: 2914570 - RNA, 14 nt, Human
ugagucucuggggc

SEQ ID NO: 2914571 - RNA, 22 nt, Human
ugagucucuggggcaggcugcu

SEQ ID NO: 2914572 - RNA, 15 nt, Human
ugagucuagauguuu

SEQ ID NO: 2914573 - RNA, 15 nt, Human
ugagucccaggcuga

SEQ ID NO: 2914574 - RNA, 21 nt, Human
ugaggcucugacccagugaga

SEQ ID NO: 2914575 - RNA, 22 nt, Human
ugagggacgucagacuuggcuc

SEQ ID NO: 2914576 - RNA, 13 nt, Human
ugagggacucuga

SEQ ID NO: 2914577 - RNA, 16 nt, Human
ugagggacugccucug

SEQ ID NO: 2914578 - RNA, 19 nt, Human
ugagggacugccucugcca

SEQ ID NO: 2914579 - RNA, 14 nt, Human
ugagggagauccca

SEQ ID NO: 2914580 - RNA, 15 nt, Human
ugaggucccaggcag

SEQ ID NO: 2914581 - RNA, 13 nt, Human
ugaggucccaggc

SEQ ID NO: 2914582 - RNA, 23 nt, Human
ugagggaggacaggcgggaggag

SEQ ID NO: 2914583 - RNA, 15 nt, Human
ugagggaggaccugg

SEQ ID NO: 2914584 - RNA, 19 nt, Human
ugagggaggaccuggggca

SEQ ID NO: 2914585 - RNA, 20 nt, Human
ugagggaggaccuggggcac

SEQ ID NO: 2914586 - RNA, 22 nt, Human
ugagggaggaccuggggcacag

SEQ ID NO: 2914587 - RNA, 23 nt, Human
ugagggaggaccuggggcacagu

SEQ ID NO: 2914588 - RNA, 19 nt, Human
ugaggucccaggcagagaa

SEQ ID NO: 2914589 - RNA, 17 nt, Human
ugaggucccaggcagag

SEQ ID NO: 2914590 - RNA, 15 nt, Human
ugaggcauccagcag

SEQ ID NO: 2914591 - RNA, 17 nt, Human
ugaggcaugaguuacug

SEQ ID NO: 2914592 - RNA, 22 nt, Human
ugaggcaugaguuacugugcau

SEQ ID NO: 2914593 - RNA, 23 nt, Human
ugaggcaucgcaauguaagacuc

SEQ ID NO: 2914594 - RNA, 21 nt, Human
ugagcuggccucucuagcaca

SEQ ID NO: 2914595 - RNA, 14 nt, Human
ugagcugggcaugg

SEQ ID NO: 2914596 - RNA, 14 nt, Human
ugagcugggccgga

SEQ ID NO: 2914597 - RNA, 18 nt, Human
ugagcugggccggagggu

SEQ ID NO: 2914598 - RNA, 22 nt, Human
ugagcuggggaccugguacccu

SEQ ID NO: 2914599 - RNA, 16 nt, Human
ugaggagcugcuggcu

SEQ ID NO: 2914600 - RNA, 15 nt, Human
ugaggagcugcuggc

SEQ ID NO: 2914601 - RNA, 14 nt, Human
ugaggagcugcugg

SEQ ID NO: 2914602 - RNA, 13 nt, Human
ugaggagcugcug

SEQ ID NO: 2914603 - RNA, 17 nt, Human
ugaggagcugcuggcuu

SEQ ID NO: 2914604 - RNA, 16 nt, Human
ugaggaggccuccauc

SEQ ID NO: 2914605 - RNA, 14 nt, Human
ugaggaggccucca

SEQ ID NO: 2914606 - RNA, 13 nt, Human
ugaggaggaggcu

SEQ ID NO: 2914607 - RNA, 20 nt, Human
ugaggaggaugucccugggc

SEQ ID NO: 2914608 - RNA, 22 nt, Human
ugaggaggaugucccugggcca

SEQ ID NO: 2914609 - RNA, 23 nt, Human
ugaggaggaugucccugggccag

SEQ ID NO: 2914610 - RNA, 20 nt, Human
ugcuaggaugcggaaauccc

SEQ ID NO: 2914611 - RNA, 17 nt, Human
ugcucacauaucuguca

SEQ ID NO: 2914612 - RNA, 13 nt, Human
ugcucagacagaa

SEQ ID NO: 2914613 - RNA, 15 nt, Human
ugcucacuuuaaacc

SEQ ID NO: 2914614 - RNA, 14 nt, Human
ugcucagaccagcu

SEQ ID NO: 2914615 - RNA, 12 nt, Human
ugcucaggcugc

SEQ ID NO: 2914616 - RNA, 18 nt, Human
ugcucaggcugcagcugg

SEQ ID NO: 2914617 - RNA, 19 nt, Human
ugcucaggcugcagcugga

SEQ ID NO: 2914618 - RNA, 20 nt, Human
ugcucaggcugcagcuggac

SEQ ID NO: 2914619 - RNA, 21 nt, Human
ugcucaggcugcagcuggaca

SEQ ID NO: 2914620 - RNA, 22 nt, Human
ugcucaggcugcagcuggacag

SEQ ID NO: 2914621 - RNA, 23 nt, Human
ugcucaggcugcagcuggacaga

SEQ ID NO: 2914622 - RNA, 16 nt, Human
ugcucuagaugagcug

SEQ ID NO: 2914623 - RNA, 18 nt, Human
ugcucuagaugagcuggg

SEQ ID NO: 2914624 - RNA, 19 nt, Human
ugcucuagaugagcugggc

SEQ ID NO: 2914625 - RNA, 20 nt, Human
ugcucuagaugagcugggcc

SEQ ID NO: 2914626 - RNA, 21 nt, Human
ugcucuagaugagcugggccg

SEQ ID NO: 2914627 - RNA, 13 nt, Human
ugcucuaggaaga

SEQ ID NO: 2914628 - RNA, 15 nt, Human
ugcucuaggaagaca

SEQ ID NO: 2914629 - RNA, 19 nt, Human
ugcucuaggaagacauuuu

SEQ ID NO: 2914630 - RNA, 17 nt, Human
ugcucaccaugcuucca

SEQ ID NO: 2914631 - RNA, 23 nt, Human
ugcucaguucagaaucacuucug

SEQ ID NO: 2914632 - RNA, 12 nt, Human
ugcucaguugcu

SEQ ID NO: 2914633 - RNA, 13 nt, Human
ugcucaguugcua

SEQ ID NO: 2914634 - RNA, 14 nt, Human
ugcucaguugcuaa

SEQ ID NO: 2914635 - RNA, 19 nt, Human
ugcucaguugcuaaacacu

SEQ ID NO: 2914636 - RNA, 20 nt, Human
ugcucaguugcuaaacacug

SEQ ID NO: 2914637 - RNA, 17 nt, Human
ugcucaguucagaauca

SEQ ID NO: 2914638 - RNA, 18 nt, Human
ugcucaguucagaaucac

SEQ ID NO: 2914639 - RNA, 19 nt, Human
ugcucauacuacauugagu

SEQ ID NO: 2914640 - RNA, 23 nt, Human
ugcucuccgaccagacaccuuga

SEQ ID NO: 2914641 - RNA, 15 nt, Human
ugcucuccccugccc

SEQ ID NO: 2914642 - RNA, 17 nt, Human
ugcucuccccugcccug

SEQ ID NO: 2914643 - RNA, 16 nt, Human
ugcucuccccugcccu

SEQ ID NO: 2914644 - RNA, 20 nt, Human
ugcucuccccugcccugcug

SEQ ID NO: 2914645 - RNA, 12 nt, Human
ugcucuccucuu

SEQ ID NO: 2914646 - RNA, 18 nt, Human
ugcucuuguccuagcuug

SEQ ID NO: 2914647 - RNA, 18 nt, Human
ugcucuuucaucucugcu

SEQ ID NO: 2914648 - RNA, 19 nt, Human
ugcucuuguccuagcuugg

SEQ ID NO: 2914649 - RNA, 15 nt, Human
ugcucuuguuuuuau

SEQ ID NO: 2914650 - RNA, 18 nt, Human
ugcucuuguuuuuauuaa

SEQ ID NO: 2914651 - RNA, 23 nt, Human
ugcucuuguuuuuauuaauuuau

SEQ ID NO: 2914652 - RNA, 14 nt, Human
ugcucuuguagccc

SEQ ID NO: 2914653 - RNA, 19 nt, Human
ugcucuuguagcccaggcu

SEQ ID NO: 2914654 - RNA, 14 nt, Human
ugcucuugucccac

SEQ ID NO: 2914655 - RNA, 16 nt, Human
ugcucuugucccacgu

SEQ ID NO: 2914656 - RNA, 21 nt, Human
ugcucuugucccacgugucuu

SEQ ID NO: 2914657 - RNA, 22 nt, Human
ugcucuugucccacgugucuuc

SEQ ID NO: 2914658 - RNA, 23 nt, Human
ugcucuugucccacgugucuucc

SEQ ID NO: 2914659 - RNA, 14 nt, Human
ugcgccugugacca

SEQ ID NO: 2914660 - RNA, 18 nt, Human
ugcgccugugaugcuggg

SEQ ID NO: 2914661 - RNA, 19 nt, Human
ugcgccugugaugcugggc

SEQ ID NO: 2914662 - RNA, 23 nt, Human
ugcgcgugcacguggagagcugg

SEQ ID NO: 2914663 - RNA, 19 nt, Human
ugcgcaggcuggcccugcc

SEQ ID NO: 2914664 - RNA, 17 nt, Human
ugcgcgcacaauaguaa

SEQ ID NO: 2914665 - RNA, 16 nt, Human
ugcgcugggcacuucc

SEQ ID NO: 2914666 - RNA, 17 nt, Human
ugcgcugggcacuuccc

SEQ ID NO: 2914667 - RNA, 18 nt, Human
ugcgcugggcacuucccu

SEQ ID NO: 2914668 - RNA, 20 nt, Human
ugcgcugggcacuucccugc

SEQ ID NO: 2914669 - RNA, 13 nt, Human
ugccuuggcucag

SEQ ID NO: 2914670 - RNA, 16 nt, Human
ugccuuggcucagaca

SEQ ID NO: 2914671 - RNA, 17 nt, Human
ugccuuggcucagacau

SEQ ID NO: 2914672 - RNA, 19 nt, Human
ugccuuggcucagacaugu

SEQ ID NO: 2914673 - RNA, 18 nt, Human
ugccuuggaaguugcaug

SEQ ID NO: 2914674 - RNA, 12 nt, Human
ugccuugccuuu

SEQ ID NO: 2914675 - RNA, 13 nt, Human
ugccuugccuuua

SEQ ID NO: 2914676 - RNA, 22 nt, Human
ugccuugcuguuggucaugugg

SEQ ID NO: 2914677 - RNA, 17 nt, Human
ugccuuggccucccaag

SEQ ID NO: 2914678 - RNA, 15 nt, Human
ugccuugggcugcuc

SEQ ID NO: 2914679 - RNA, 11 nt, Human
ugccuugggcu

SEQ ID NO: 2914680 - RNA, 21 nt, Human
ugcgcaggcuggcccugcccu

SEQ ID NO: 2914681 - RNA, 23 nt, Human
ugcgcaggcuggcccugcccugg

SEQ ID NO: 2914682 - RNA, 22 nt, Human
ugcgcaggcuggcccugcccug

SEQ ID NO: 2914683 - RNA, 15 nt, Human
ugccuugaugauuua

SEQ ID NO: 2914684 - RNA, 14 nt, Human
ugccuugcagaacu

SEQ ID NO: 2914685 - RNA, 15 nt, Human
ugccuugcagaacug

SEQ ID NO: 2914686 - RNA, 16 nt, Human
ugccuugcagaacugc

SEQ ID NO: 2914687 - RNA, 19 nt, Human
ugccuugcagaacugccau

SEQ ID NO: 2914688 - RNA, 20 nt, Human
ugccuugcagaacugccauu

SEQ ID NO: 2914689 - RNA, 21 nt, Human
ugccucggcuuuucucagcug

SEQ ID NO: 2914690 - RNA, 20 nt, Human
ugccucggcuuuucucagcu

SEQ ID NO: 2914691 - RNA, 24 nt, Human
ugccucggcuuuucucagcuggau

SEQ ID NO: 2914692 - RNA, 22 nt, Human
ugcuacuguccuacccacccuc

SEQ ID NO: 2914693 - RNA, 21 nt, Human
ugcuacuguccuacccacccu

SEQ ID NO: 2914694 - RNA, 22 nt, Human
ugcuacugucucacugaaacau

SEQ ID NO: 2914695 - RNA, 18 nt, Human
ugcuacugucuuuggaaa

SEQ ID NO: 2914696 - RNA, 13 nt, Human
ugcuacuguacau

SEQ ID NO: 2914697 - RNA, 22 nt, Human
ugcuacuguacauaaacaauga

SEQ ID NO: 2914698 - RNA, 10 nt, Human
ugcuagaacu

SEQ ID NO: 2914699 - RNA, 18 nt, Human
ugcuacuaaguucacauu

SEQ ID NO: 2914700 - RNA, 16 nt, Human
ugcgcuuuauuuucuu

SEQ ID NO: 2914701 - RNA, 14 nt, Human
ugcggaaucagcuu

SEQ ID NO: 2914702 - RNA, 14 nt, Human
ugcggaaagguauu

SEQ ID NO: 2914703 - RNA, 15 nt, Human
ugcggaaagguauuu

SEQ ID NO: 2914704 - RNA, 22 nt, Human
ugcggaaagguauuugggaaac

SEQ ID NO: 2914705 - RNA, 23 nt, Human
ugcggaaagguauuugggaaacu

SEQ ID NO: 2914706 - RNA, 12 nt, Human
ugcguguguaga

SEQ ID NO: 2914707 - RNA, 15 nt, Human
ugcggaaucagcuuc

SEQ ID NO: 2914708 - RNA, 14 nt, Human
ugcguguguagagu

SEQ ID NO: 2914709 - RNA, 19 nt, Human
ugcguguguagaguuaaga

SEQ ID NO: 2914710 - RNA, 20 nt, Human
ugcguguguagaguuaagaa

SEQ ID NO: 2914711 - RNA, 21 nt, Human
ugcguguguagaguuaagaag

SEQ ID NO: 2914712 - RNA, 13 nt, Human
ugcguuacuaauu

SEQ ID NO: 2914713 - RNA, 24 nt, Human
ugcguguguagaguuaagaagcug

SEQ ID NO: 2914714 - RNA, 13 nt, Human
ugcguuuuggaag

SEQ ID NO: 2914715 - RNA, 17 nt, Human
ugcguuccaugaugcug

SEQ ID NO: 2914716 - RNA, 16 nt, Human
ugcguucugcaagcau

SEQ ID NO: 2914717 - RNA, 13 nt, Human
ugcguuggucucu

SEQ ID NO: 2914718 - RNA, 17 nt, Human
ugcguuggucucugcau

SEQ ID NO: 2914719 - RNA, 12 nt, Human
ugcuaaacacug

SEQ ID NO: 2914720 - RNA, 13 nt, Human
ugcuaaacacugc

SEQ ID NO: 2914721 - RNA, 22 nt, Human
ugcuaaacacugcgcuuuauuu

SEQ ID NO: 2914722 - RNA, 12 nt, Human
ugcuaacugaac

SEQ ID NO: 2914723 - RNA, 15 nt, Human
ugcuaacugaacuuu

SEQ ID NO: 2914724 - RNA, 23 nt, Human
ugcuaaccacgucugucuucaca

SEQ ID NO: 2914725 - RNA, 20 nt, Human
ugcugggggcaacuggccau

SEQ ID NO: 2914726 - RNA, 19 nt, Human
ugcugggggcaacuggcca

SEQ ID NO: 2914727 - RNA, 15 nt, Human
ugcugggggcaacug

SEQ ID NO: 2914728 - RNA, 14 nt, Human
ugcugggggaauga

SEQ ID NO: 2914729 - RNA, 15 nt, Human
ugcugggggaaugag

SEQ ID NO: 2914730 - RNA, 20 nt, Human
ugcugggggaaugagcccag

SEQ ID NO: 2914731 - RNA, 21 nt, Human
ugcugggggaaugagcccaga

SEQ ID NO: 2914732 - RNA, 22 nt, Human
ugcugggggaaugagcccagag

SEQ ID NO: 2914733 - RNA, 23 nt, Human
ugcugggggaaugagcccagaga

SEQ ID NO: 2914734 - RNA, 18 nt, Human
ugcuggggcaagucccug

SEQ ID NO: 2914735 - RNA, 23 nt, Human
ugcuggggcaagucccugacucu

SEQ ID NO: 2914736 - RNA, 15 nt, Human
ugcuggggccucaga

SEQ ID NO: 2914737 - RNA, 17 nt, Human
ugcuggggccucagacg

SEQ ID NO: 2914738 - RNA, 18 nt, Human
ugcuggggccucagacga

SEQ ID NO: 2914739 - RNA, 16 nt, Human
ugcuggguaaacugug

SEQ ID NO: 2914740 - RNA, 16 nt, Human
ugcuggucacagccuc

SEQ ID NO: 2914741 - RNA, 17 nt, Human
ugcuggucacagccucc

SEQ ID NO: 2914742 - RNA, 19 nt, Human
ugcuggucacagccuccuc

SEQ ID NO: 2914743 - RNA, 20 nt, Human
ugcuggucacagccuccucu

SEQ ID NO: 2914744 - RNA, 18 nt, Human
ugcuguguuaaauaaacc

SEQ ID NO: 2914745 - RNA, 11 nt, Human
ugcuguguuaa

SEQ ID NO: 2914746 - RNA, 11 nt, Human
ugcugugugcc

SEQ ID NO: 2914747 - RNA, 19 nt, Human
ugcuguguaaugguuacac

SEQ ID NO: 2914748 - RNA, 19 nt, Human
ugcuguuaugucuguuuaa

SEQ ID NO: 2914749 - RNA, 20 nt, Human
ugcuguuaugucuguuuaag

SEQ ID NO: 2914750 - RNA, 22 nt, Human
ugcuguucucuugggaacugaa

SEQ ID NO: 2914751 - RNA, 13 nt, Human
ugcuguugaaagc

SEQ ID NO: 2914752 - RNA, 14 nt, Human
ugcuguugaaagca

SEQ ID NO: 2914753 - RNA, 16 nt, Human
ugcuguugaaagcaaa

SEQ ID NO: 2914754 - RNA, 17 nt, Human
ugcuguugaaagcaaaa

SEQ ID NO: 2914755 - RNA, 21 nt, Human
ugcuguugaaagcaaaaaugc

SEQ ID NO: 2914756 - RNA, 22 nt, Human
ugcuguugaaagcaaaaaugcu

SEQ ID NO: 2914757 - RNA, 15 nt, Human
ugcuguugacauauu

SEQ ID NO: 2914758 - RNA, 18 nt, Human
ugcuguugacauauuuaa

SEQ ID NO: 2914759 - RNA, 21 nt, Human
ugcuguugacauauuuaaugu

SEQ ID NO: 2914760 - RNA, 16 nt, Human
ugcuguguuuaauuug

SEQ ID NO: 2914761 - RNA, 14 nt, Human
ugcuguuacuguua

SEQ ID NO: 2914762 - RNA, 20 nt, Human
ugcuguuacuguuaaccauu

SEQ ID NO: 2914763 - RNA, 13 nt, Human
ugcugguuuucua

SEQ ID NO: 2914764 - RNA, 17 nt, Human
ugcuguaacuuaaaaua

SEQ ID NO: 2914765 - RNA, 14 nt, Human
ugcugccugaaucc

SEQ ID NO: 2914766 - RNA, 14 nt, Human
ugcugccugaguca

SEQ ID NO: 2914767 - RNA, 21 nt, Human
ugcugccugcccgcacagcag

SEQ ID NO: 2914768 - RNA, 23 nt, Human
ugcugccugcccgcacagcagcc

SEQ ID NO: 2914769 - RNA, 19 nt, Human
ugcugcauuugugucaucu

SEQ ID NO: 2914770 - RNA, 19 nt, Human
ugcugcuauccugccaaaa

SEQ ID NO: 2914771 - RNA, 20 nt, Human
ugcugccuucugacggcccu

SEQ ID NO: 2914772 - RNA, 21 nt, Human
ugcugccuucugacggcccug

SEQ ID NO: 2914773 - RNA, 22 nt, Human
ugcugccuucugacggcccugc

SEQ ID NO: 2914774 - RNA, 23 nt, Human
ugcugccuucugacggcccugca

SEQ ID NO: 2914775 - RNA, 13 nt, Human
ugcugccuggcca

SEQ ID NO: 2914776 - RNA, 14 nt, Human
ugcugccuggccac

SEQ ID NO: 2914777 - RNA, 18 nt, Human
ugcugccuggccacugcu

SEQ ID NO: 2914778 - RNA, 23 nt, Human
ugcucuuucccccuuccaucucu

SEQ ID NO: 2914779 - RNA, 20 nt, Human
ugcugggauuacagguguga

SEQ ID NO: 2914780 - RNA, 20 nt, Human
ugcugcuuccgguagggagg

SEQ ID NO: 2914781 - RNA, 15 nt, Human
ugcugcugcgcccuu

SEQ ID NO: 2914782 - RNA, 16 nt, Human
ugcugcugcugcgccc

SEQ ID NO: 2914783 - RNA, 13 nt, Human
ugcugcugccugg

SEQ ID NO: 2914784 - RNA, 16 nt, Human
ugcugcugccuggcca

SEQ ID NO: 2914785 - RNA, 19 nt, Human
ugcugcugccuggccacug

SEQ ID NO: 2914786 - RNA, 13 nt, Human
ugcaucaaggggu

SEQ ID NO: 2914787 - RNA, 13 nt, Human
ugcauagugcugg

SEQ ID NO: 2914788 - RNA, 14 nt, Human
ugcauagugcuggg

SEQ ID NO: 2914789 - RNA, 16 nt, Human
ugcauagugcugggau

SEQ ID NO: 2914790 - RNA, 19 nt, Human
ugcauauguugaauacuuu

SEQ ID NO: 2914791 - RNA, 20 nt, Human
ugcaguucuaguuugcauuc

SEQ ID NO: 2914792 - RNA, 18 nt, Human
ugcaguucuaguuugcau

SEQ ID NO: 2914793 - RNA, 19 nt, Human
ugcaguucuaguuugcauu

SEQ ID NO: 2914794 - RNA, 18 nt, Human
ugcaguuuaagagcagaa

SEQ ID NO: 2914795 - RNA, 19 nt, Human
ugcaguuuaagagcagaac

SEQ ID NO: 2914796 - RNA, 13 nt, Human
ugcagggaguccg

SEQ ID NO: 2914797 - RNA, 19 nt, Human
ugauuguuucucaaaucuu

SEQ ID NO: 2914798 - RNA, 14 nt, Human
ugcagggagccgag

SEQ ID NO: 2914799 - RNA, 19 nt, Human
ugcaggcugagccacucuc

SEQ ID NO: 2914800 - RNA, 13 nt, Human
ugcaggcuggcca

SEQ ID NO: 2914801 - RNA, 14 nt, Human
ugcaggcuggccag

SEQ ID NO: 2914802 - RNA, 15 nt, Human
ugcaggcuggccagc

SEQ ID NO: 2914803 - RNA, 16 nt, Human
ugcaggcuggccagcc

SEQ ID NO: 2914804 - RNA, 17 nt, Human
ugcaggcuggccagccg

SEQ ID NO: 2914805 - RNA, 18 nt, Human
ugcaggcuggccagccgc

SEQ ID NO: 2914806 - RNA, 19 nt, Human
ugcaggcuggccagccgcu

SEQ ID NO: 2914807 - RNA, 22 nt, Human
ugcaggcuggccagccgcucuc

SEQ ID NO: 2914808 - RNA, 16 nt, Human
ugcaggcuuaauaaaa

SEQ ID NO: 2914809 - RNA, 13 nt, Human
ugauuuaauaaaa

SEQ ID NO: 2914810 - RNA, 14 nt, Human
ugauuuaauaaaau

SEQ ID NO: 2914811 - RNA, 15 nt, Human
ugauuuaauaaaaua

SEQ ID NO: 2914812 - RNA, 17 nt, Human
ugauuuaauaaaauaau

SEQ ID NO: 2914813 - RNA, 19 nt, Human
ugauuuaauaaaauaauuc

SEQ ID NO: 2914814 - RNA, 20 nt, Human
ugauuuaauaaaauaauucu

SEQ ID NO: 2914815 - RNA, 21 nt, Human
ugauuuaauaaaauaauucua

SEQ ID NO: 2914816 - RNA, 22 nt, Human
ugauuuaauaaaauaauucuaa

SEQ ID NO: 2914817 - RNA, 23 nt, Human
ugauuuaauaaaauaauucuaaa

SEQ ID NO: 2914818 - RNA, 11 nt, Human
ugcaggcccuu

SEQ ID NO: 2914819 - RNA, 22 nt, Human
ugcaggcccuuugaagccucag

SEQ ID NO: 2914820 - RNA, 14 nt, Human
ugauuuaauaugga

SEQ ID NO: 2914821 - RNA, 15 nt, Human
ugauuuaauauggau

SEQ ID NO: 2914822 - RNA, 16 nt, Human
ugcaguguucgcuugg

SEQ ID NO: 2914823 - RNA, 17 nt, Human
ugcaguguucgcuuggc

SEQ ID NO: 2914824 - RNA, 18 nt, Human
ugcaguguucgcuuggcu

SEQ ID NO: 2914825 - RNA, 13 nt, Human
ugcagggccagga

SEQ ID NO: 2914826 - RNA, 15 nt, Human
ugcagggccaggacu

SEQ ID NO: 2914827 - RNA, 23 nt, Human
ugcagggccaggacugagccccg

SEQ ID NO: 2914828 - RNA, 17 nt, Human
ugcaguucuaguuugca

SEQ ID NO: 2914829 - RNA, 19 nt, Human
ugcaguucagcaccacccu

SEQ ID NO: 2914830 - RNA, 18 nt, Human
ugcaguucagcaccaccc

SEQ ID NO: 2914831 - RNA, 15 nt, Human
ugcaguucagcacca

SEQ ID NO: 2914832 - RNA, 21 nt, Human
ugcaguggugcgaucuggguu

SEQ ID NO: 2914833 - RNA, 20 nt, Human
ugcaguggugcgaucugggu

SEQ ID NO: 2914834 - RNA, 12 nt, Human
ugcagggccagg

SEQ ID NO: 2914835 - RNA, 24 nt, Human
ugcagggaggagguggcagcccug

SEQ ID NO: 2914836 - RNA, 20 nt, Human
ugcagggagggcaguuuucu

SEQ ID NO: 2914837 - RNA, 19 nt, Human
ugcagggauugcugccacu

SEQ ID NO: 2914838 - RNA, 22 nt, Human
ugcagggcaaaauauucacugg

SEQ ID NO: 2914839 - RNA, 12 nt, Human
ugcagggcagcc

SEQ ID NO: 2914840 - RNA, 13 nt, Human
ugcagggcagccc

SEQ ID NO: 2914841 - RNA, 14 nt, Human
ugcagggcagcccc

SEQ ID NO: 2914842 - RNA, 20 nt, Human
ugcagggcagccccacaacu

SEQ ID NO: 2914843 - RNA, 20 nt, Human
ugcauggcuccagaaauguc

SEQ ID NO: 2914844 - RNA, 22 nt, Human
ugcauggcuccagaaaugucua

SEQ ID NO: 2914845 - RNA, 16 nt, Human
ugcaugggccagcccc

SEQ ID NO: 2914846 - RNA, 17 nt, Human
ugcaugggccagccccu

SEQ ID NO: 2914847 - RNA, 21 nt, Human
ugcaugggccagccccuccau

SEQ ID NO: 2914848 - RNA, 17 nt, Human
ugcauggggaaagagau

SEQ ID NO: 2914849 - RNA, 23 nt, Human
ugcauggggugggguagggcuga

SEQ ID NO: 2914850 - RNA, 16 nt, Human
ugcaucaccucuguaa

SEQ ID NO: 2914851 - RNA, 21 nt, Human
ugcauuuggaauuuuugcuug

SEQ ID NO: 2914852 - RNA, 16 nt, Human
ugcauuuguaaaugcu

SEQ ID NO: 2914853 - RNA, 18 nt, Human
ugcauuuguaaaugcugu

SEQ ID NO: 2914854 - RNA, 19 nt, Human
ugccaaaaucauuuuaaug

SEQ ID NO: 2914855 - RNA, 22 nt, Human
ugccaaagcuaggguggcccuu

SEQ ID NO: 2914856 - RNA, 21 nt, Human
ugccaaagcuaggguggcccu

SEQ ID NO: 2914857 - RNA, 20 nt, Human
ugccaaagcuaggguggccc

SEQ ID NO: 2914858 - RNA, 18 nt, Human
ugccaaagggaaauauca

SEQ ID NO: 2914859 - RNA, 14 nt, Human
ugccaaagggaaau

SEQ ID NO: 2914860 - RNA, 17 nt, Human
ugccaaagucucccuuc

SEQ ID NO: 2914861 - RNA, 14 nt, Human
ugccaaaucuggcu

SEQ ID NO: 2914862 - RNA, 12 nt, Human
ugccaaaugcuc

SEQ ID NO: 2914863 - RNA, 13 nt, Human
ugccaggacacgc

SEQ ID NO: 2914864 - RNA, 14 nt, Human
ugccacguuccaca

SEQ ID NO: 2914865 - RNA, 15 nt, Human
ugccacguuccacag

SEQ ID NO: 2914866 - RNA, 16 nt, Human
ugccacguuccacagu

SEQ ID NO: 2914867 - RNA, 19 nt, Human
ugccacguuccacaguugc

SEQ ID NO: 2914868 - RNA, 20 nt, Human
ugccacguuccacaguugcc

SEQ ID NO: 2914869 - RNA, 20 nt, Human
ugccacccuggggagaaagu

SEQ ID NO: 2914870 - RNA, 15 nt, Human
ugccaacaagaaugc

SEQ ID NO: 2914871 - RNA, 16 nt, Human
ugccaacaagaaugca

SEQ ID NO: 2914872 - RNA, 18 nt, Human
ugccaacaagaaugcauu

SEQ ID NO: 2914873 - RNA, 19 nt, Human
ugccaacaagaaugcauug

SEQ ID NO: 2914874 - RNA, 20 nt, Human
ugccaacaagaaugcauuga

SEQ ID NO: 2914875 - RNA, 23 nt, Human
ugccaacaagaaugcauugauau

SEQ ID NO: 2914876 - RNA, 20 nt, Human
ugccaacacucaagaagcag

SEQ ID NO: 2914877 - RNA, 18 nt, Human
ugccaacaccacagaaau

SEQ ID NO: 2914878 - RNA, 21 nt, Human
ugccaacaccacagaaauggg

SEQ ID NO: 2914879 - RNA, 21 nt, Human
ugccaacacucaagaagcagg

SEQ ID NO: 2914880 - RNA, 22 nt, Human
ugccaacacucaagaagcaggc

SEQ ID NO: 2914881 - RNA, 23 nt, Human
ugccaacacucaagaagcaggcu

SEQ ID NO: 2914882 - RNA, 14 nt, Human
ugccaccucccuga

SEQ ID NO: 2914883 - RNA, 20 nt, Human
ugccuaaauuuaaugcugcc

SEQ ID NO: 2914884 - RNA, 21 nt, Human
ugccuaaauuuaaugcugccu

SEQ ID NO: 2914885 - RNA, 20 nt, Human
ugccuauaugagaagaauag

SEQ ID NO: 2914886 - RNA, 21 nt, Human
ugccuauaugagaagaauagc

SEQ ID NO: 2914887 - RNA, 13 nt, Human
ugccuaguuuuua

SEQ ID NO: 2914888 - RNA, 16 nt, Human
ugccuaguuuuuagua

SEQ ID NO: 2914889 - RNA, 15 nt, Human
ugccuauccugcugu

SEQ ID NO: 2914890 - RNA, 17 nt, Human
ugccuauccugcuguuc

SEQ ID NO: 2914891 - RNA, 23 nt, Human
ugccuauccugcuguucuagcac

SEQ ID NO: 2914892 - RNA, 14 nt, Human
ugccuccuguguac

SEQ ID NO: 2914893 - RNA, 20 nt, Human
ugccucggccucccaaagug

SEQ ID NO: 2914894 - RNA, 14 nt, Human
ugccuccucuucaa

SEQ ID NO: 2914895 - RNA, 16 nt, Human
ugccuccucuucaacu

SEQ ID NO: 2914896 - RNA, 14 nt, Human
ugccuccugccugc

SEQ ID NO: 2914897 - RNA, 18 nt, Human
ugccuccugccugccccu

SEQ ID NO: 2914898 - RNA, 13 nt, Human
ugccuccuguggg

SEQ ID NO: 2914899 - RNA, 14 nt, Human
ugccuccugugggg

SEQ ID NO: 2914900 - RNA, 18 nt, Human
ugccuccuguggggaaag

SEQ ID NO: 2914901 - RNA, 16 nt, Human
ugccuccucguuccuu

SEQ ID NO: 2914902 - RNA, 20 nt, Human
ugccuccucguuccuuucuc

SEQ ID NO: 2914903 - RNA, 13 nt, Human
ugcccugggccac

SEQ ID NO: 2914904 - RNA, 23 nt, Human
ugcccugguuuccugcccuggga

SEQ ID NO: 2914905 - RNA, 20 nt, Human
ugcccugguuuccugcccug

SEQ ID NO: 2914906 - RNA, 19 nt, Human
ugcccugguuuccugcccu

SEQ ID NO: 2914907 - RNA, 18 nt, Human
ugcccugguccagggaag

SEQ ID NO: 2914908 - RNA, 12 nt, Human
ugcccuggugcu

SEQ ID NO: 2914909 - RNA, 14 nt, Human
ugcccuggugcugc

SEQ ID NO: 2914910 - RNA, 16 nt, Human
ugcccuggugcugcca

SEQ ID NO: 2914911 - RNA, 21 nt, Human
ugcccugguccagggaagcug

SEQ ID NO: 2914912 - RNA, 15 nt, Human
ugcccugguuuccug

SEQ ID NO: 2914913 - RNA, 17 nt, Human
ugcccuggugcugccac

SEQ ID NO: 2914914 - RNA, 18 nt, Human
ugcccugguuuccugccc

SEQ ID NO: 2914915 - RNA, 17 nt, Human
ugcccugguuuccugcc

SEQ ID NO: 2914916 - RNA, 20 nt, Human
ugcccggcuaauuuuuguaa

SEQ ID NO: 2914917 - RNA, 21 nt, Human
ugcccgggaaggucaccagca

SEQ ID NO: 2914918 - RNA, 13 nt, Human
ugcccugggaggc

SEQ ID NO: 2914919 - RNA, 13 nt, Human
ugcccugggaaac

SEQ ID NO: 2914920 - RNA, 18 nt, Human
ugcccugggaggcaguga

SEQ ID NO: 2914921 - RNA, 17 nt, Human
ugcccugggaggcagug

SEQ ID NO: 2914922 - RNA, 15 nt, Human
ugcccugggaggcag

SEQ ID NO: 2914923 - RNA, 20 nt, Human
ugcccaggcuggcgugcagu

SEQ ID NO: 2914924 - RNA, 23 nt, Human
ugccaggaaggggugagcacaga

SEQ ID NO: 2914925 - RNA, 20 nt, Human
ugccccaaacaaauaugcaa

SEQ ID NO: 2914926 - RNA, 20 nt, Human
ugccccaaauaacuucaguc

SEQ ID NO: 2914927 - RNA, 21 nt, Human
ugccccaaauaacuucagucc

SEQ ID NO: 2914928 - RNA, 22 nt, Human
ugccccaaauaacuucaguccu

SEQ ID NO: 2914929 - RNA, 23 nt, Human
ugccccaaauaacuucaguccug

SEQ ID NO: 2914930 - RNA, 12 nt, Human
ugcccauuucau

SEQ ID NO: 2914931 - RNA, 21 nt, Human
ugcccauuucauauucuuuca

SEQ ID NO: 2914932 - RNA, 22 nt, Human
ugcccauuucauauucuuucaa

SEQ ID NO: 2914933 - RNA, 18 nt, Human
ugcccauucaccaaaauu

SEQ ID NO: 2914934 - RNA, 19 nt, Human
ugcccauucaccaaaauua

SEQ ID NO: 2914935 - RNA, 14 nt, Human
ugccccaaacaaau

SEQ ID NO: 2914936 - RNA, 21 nt, Human
ugcccauucugcccuguggga

SEQ ID NO: 2914937 - RNA, 23 nt, Human
ugccccagagcuguuuauggccu

SEQ ID NO: 2914938 - RNA, 17 nt, Human
ugccccagagcuguuua

SEQ ID NO: 2914939 - RNA, 15 nt, Human
ugccccagagcuguu

SEQ ID NO: 2914940 - RNA, 14 nt, Human
ugccccagagcugu

SEQ ID NO: 2914941 - RNA, 13 nt, Human
ugccccagagcug

SEQ ID NO: 2914942 - RNA, 16 nt, Human
ugccccaaccugcuga

SEQ ID NO: 2914943 - RNA, 19 nt, Human
ugcccaggcuggcgugcag

SEQ ID NO: 2914944 - RNA, 18 nt, Human
ugcccaggcuggcgugca

SEQ ID NO: 2914945 - RNA, 18 nt, Human
ugcccagagggcccaggc

SEQ ID NO: 2914946 - RNA, 11 nt, Human
ugccaggcccc

SEQ ID NO: 2914947 - RNA, 17 nt, Human
ugccaggcccccaccac

SEQ ID NO: 2914948 - RNA, 19 nt, Human
ugccaggcccccaccacac

SEQ ID NO: 2914949 - RNA, 20 nt, Human
ugccaggcccccaccacaca

SEQ ID NO: 2914950 - RNA, 21 nt, Human
ugccaggcccccaccacacau

SEQ ID NO: 2914951 - RNA, 22 nt, Human
ugccaggcccccaccacacauc

SEQ ID NO: 2914952 - RNA, 14 nt, Human
ugcccggcugcgga

SEQ ID NO: 2914953 - RNA, 12 nt, Human
ugcccggcugcg

SEQ ID NO: 2914954 - RNA, 17 nt, Human
ugcccggauucugggag

SEQ ID NO: 2914955 - RNA, 16 nt, Human
ugcccggauucuggga

SEQ ID NO: 2914956 - RNA, 15 nt, Human
ugcccggauucuggg

SEQ ID NO: 2914957 - RNA, 23 nt, Human
ugcccggagauuggacggccuga

SEQ ID NO: 2914958 - RNA, 22 nt, Human
ugcccggauucugggaggaagc

SEQ ID NO: 2914959 - RNA, 18 nt, Human
ugcccggauucugggagg

SEQ ID NO: 2914960 - RNA, 19 nt, Human
ugccccugcugcugucacc

SEQ ID NO: 2914961 - RNA, 21 nt, Human
ugcccggagauuggacggccu

SEQ ID NO: 2914962 - RNA, 12 nt, Human
ugcccgccugcc

SEQ ID NO: 2914963 - RNA, 14 nt, Human
ugcccgccugccca

SEQ ID NO: 2914964 - RNA, 15 nt, Human
ugcccgccugcccac

SEQ ID NO: 2914965 - RNA, 17 nt, Human
ugcccgccugcccaccu

SEQ ID NO: 2914966 - RNA, 18 nt, Human
ugcccgccugcccaccug

SEQ ID NO: 2914967 - RNA, 19 nt, Human
ugcccgccugcccaccugc

SEQ ID NO: 2914968 - RNA, 16 nt, Human
ugcccgcacacccuca

SEQ ID NO: 2914969 - RNA, 22 nt, Human
ugcccgcacacccucacucugc

SEQ ID NO: 2914970 - RNA, 13 nt, Human
ugcccgcacagca

SEQ ID NO: 2914971 - RNA, 14 nt, Human
ugcccgcacagcag

SEQ ID NO: 2914972 - RNA, 15 nt, Human
ugcccgcacagcagc

SEQ ID NO: 2914973 - RNA, 17 nt, Human
ugcccgcacagcagccu

SEQ ID NO: 2914974 - RNA, 19 nt, Human
ugcccgcacagcagccugc

SEQ ID NO: 2914975 - RNA, 20 nt, Human
ugcccgcacagcagccugcu

SEQ ID NO: 2914976 - RNA, 17 nt, Human
ugcccgcagaccucugg

SEQ ID NO: 2914977 - RNA, 18 nt, Human
ugcccgcagaccucugga

SEQ ID NO: 2914978 - RNA, 11 nt, Human
ugccccugcug

SEQ ID NO: 2914979 - RNA, 12 nt, Human
ugccccugcugc

SEQ ID NO: 2914980 - RNA, 15 nt, Human
ugccccucuccuucu

SEQ ID NO: 2914981 - RNA, 20 nt, Human
ugccccucuccuucuuagcu

SEQ ID NO: 2914982 - RNA, 12 nt, Human
ugccccucucug

SEQ ID NO: 2914983 - RNA, 13 nt, Human
ugccccucucugg

SEQ ID NO: 2914984 - RNA, 14 nt, Human
ugccccucucuggg

SEQ ID NO: 2914985 - RNA, 16 nt, Human
ugccccucucugggcc

SEQ ID NO: 2914986 - RNA, 21 nt, Human
ugccccucucugggccucaga

SEQ ID NO: 2914987 - RNA, 13 nt, Human
ugccccucuuucu

SEQ ID NO: 2914988 - RNA, 14 nt, Human
ugccccucuuucuc

SEQ ID NO: 2914989 - RNA, 15 nt, Human
ugccccucuuucucu

SEQ ID NO: 2914990 - RNA, 16 nt, Human
ugccccucuuucucuu

SEQ ID NO: 2914991 - RNA, 17 nt, Human
ugccccucuuucucuuu

SEQ ID NO: 2914992 - RNA, 21 nt, Human
ugccccucuuucucuuucuuc

SEQ ID NO: 2914993 - RNA, 22 nt, Human
ugccccucuuucucuuucuucc

SEQ ID NO: 2914994 - RNA, 14 nt, Human
ugccccucucacca

SEQ ID NO: 2914995 - RNA, 12 nt, Human
ugccccucucac

SEQ ID NO: 2914996 - RNA, 15 nt, Human
ugccccucucaccaa

SEQ ID NO: 2914997 - RNA, 20 nt, Human
ugccccuccucucugcccua

SEQ ID NO: 2914998 - RNA, 19 nt, Human
ugccccuccucucugcccu

SEQ ID NO: 2914999 - RNA, 13 nt, Human
ugccccucccuuc

SEQ ID NO: 2915000 - RNA, 18 nt, Human
ugccccagcucuggcuuc

SEQ ID NO: 2915001 - RNA, 16 nt, Human
ugccccagcucuggcu

SEQ ID NO: 2915002 - RNA, 14 nt, Human
ugccccagcucugg

SEQ ID NO: 2915003 - RNA, 13 nt, Human
ugccccagcucug

SEQ ID NO: 2915004 - RNA, 15 nt, Human
ugccccucccuucaa

SEQ ID NO: 2915005 - RNA, 16 nt, Human
ugccccucccuucaac

SEQ ID NO: 2915006 - RNA, 18 nt, Human
ugccccuccucucugccc

SEQ ID NO: 2915007 - RNA, 17 nt, Human
ugccccuccucucugcc

SEQ ID NO: 2915008 - RNA, 23 nt, Human
uggcaaggcugugcucccugguu

SEQ ID NO: 2915009 - RNA, 22 nt, Human
uggcaaguuuugauaugaguau

SEQ ID NO: 2915010 - RNA, 23 nt, Human
uggcaaguuuugauaugaguaua

SEQ ID NO: 2915011 - RNA, 17 nt, Human
uggcaaggguucaccug

SEQ ID NO: 2915012 - RNA, 15 nt, Human
uggcaagucacaugc

SEQ ID NO: 2915013 - RNA, 16 nt, Human
uggcaagucacaugcg

SEQ ID NO: 2915014 - RNA, 22 nt, Human
uggcagaagacaccagagcaga

SEQ ID NO: 2915015 - RNA, 20 nt, Human
uggcagaauaaucuuugggu

SEQ ID NO: 2915016 - RNA, 19 nt, Human
uggcagaauaaucuuuggg

SEQ ID NO: 2915017 - RNA, 22 nt, Human
uggcacuaacguugagccccug

SEQ ID NO: 2915018 - RNA, 23 nt, Human
uggcagaagacaccagagcagau

SEQ ID NO: 2915019 - RNA, 18 nt, Human
uggcagaagggagcagca

SEQ ID NO: 2915020 - RNA, 21 nt, Human
uggcagaagggagcagcacac

SEQ ID NO: 2915021 - RNA, 15 nt, Human
uggcaaaagccuugu

SEQ ID NO: 2915022 - RNA, 16 nt, Human
uggcaaaagccuugug

SEQ ID NO: 2915023 - RNA, 17 nt, Human
uggcaaaagccuugugu

SEQ ID NO: 2915024 - RNA, 19 nt, Human
uggcaaaagccuuguguau

SEQ ID NO: 2915025 - RNA, 21 nt, Human
uggcaaaagccuuguguauau

SEQ ID NO: 2915026 - RNA, 17 nt, Human
uggcaaaaauggcuaga

SEQ ID NO: 2915027 - RNA, 20 nt, Human
uggcaaggcugugcucccug

SEQ ID NO: 2915028 - RNA, 21 nt, Human
uggauaacuuagguggcaagc

SEQ ID NO: 2915029 - RNA, 16 nt, Human
uggaguuucuaagguc

SEQ ID NO: 2915030 - RNA, 17 nt, Human
uggaguuucuaaggucc

SEQ ID NO: 2915031 - RNA, 21 nt, Human
uggaguuuuuguuuggagagc

SEQ ID NO: 2915032 - RNA, 22 nt, Human
uggaguuuuuguuuggagagca

SEQ ID NO: 2915033 - RNA, 23 nt, Human
uggaguuuuuguuuggagagcac

SEQ ID NO: 2915034 - RNA, 17 nt, Human
uggauaaaauaaugcug

SEQ ID NO: 2915035 - RNA, 19 nt, Human
uggauaaaauaaugcugca

SEQ ID NO: 2915036 - RNA, 14 nt, Human
uggauaacaaagau

SEQ ID NO: 2915037 - RNA, 16 nt, Human
uggauaacaaagauau

SEQ ID NO: 2915038 - RNA, 17 nt, Human
uggauaacaaagauauc

SEQ ID NO: 2915039 - RNA, 18 nt, Human
uggauaacaaagauaucu

SEQ ID NO: 2915040 - RNA, 20 nt, Human
uggauaacaaagauaucuuu

SEQ ID NO: 2915041 - RNA, 13 nt, Human
uggaggauugcua

SEQ ID NO: 2915042 - RNA, 17 nt, Human
uggaggaucaguuuuuu

SEQ ID NO: 2915043 - RNA, 21 nt, Human
uggaguuucauguacaagaug

SEQ ID NO: 2915044 - RNA, 13 nt, Human
uggaguuucuaag

SEQ ID NO: 2915045 - RNA, 14 nt, Human
uggaguuucuaagg

SEQ ID NO: 2915046 - RNA, 14 nt, Human
uggagacugucuca

SEQ ID NO: 2915047 - RNA, 20 nt, Human
uggagacuggggggcuugaa

SEQ ID NO: 2915048 - RNA, 19 nt, Human
uggagacugguccugugug

SEQ ID NO: 2915049 - RNA, 20 nt, Human
uggagacugguccugugugc

SEQ ID NO: 2915050 - RNA, 13 nt, Human
uggaggaaggauu

SEQ ID NO: 2915051 - RNA, 18 nt, Human
uggaggaaggauuguaaa

SEQ ID NO: 2915052 - RNA, 19 nt, Human
uggaggaaggauuguaaaa

SEQ ID NO: 2915053 - RNA, 20 nt, Human
uggaggaaggauuguaaaaa

SEQ ID NO: 2915054 - RNA, 19 nt, Human
uggaccaauuauugauaua

SEQ ID NO: 2915055 - RNA, 20 nt, Human
uggaccaauuauugauauau

SEQ ID NO: 2915056 - RNA, 21 nt, Human
uggaccaauuauugauauaua

SEQ ID NO: 2915057 - RNA, 22 nt, Human
uggaccaauuauugauauauau

SEQ ID NO: 2915058 - RNA, 19 nt, Human
uggacauagauauuuucac

SEQ ID NO: 2915059 - RNA, 22 nt, Human
uggacauagauauuuucacaau

SEQ ID NO: 2915060 - RNA, 17 nt, Human
uggacaguccugggaga

SEQ ID NO: 2915061 - RNA, 17 nt, Human
uggacagucugcucuag

SEQ ID NO: 2915062 - RNA, 18 nt, Human
uggacaguucacacccug

SEQ ID NO: 2915063 - RNA, 19 nt, Human
uggacaguucacacccugc

SEQ ID NO: 2915064 - RNA, 20 nt, Human
uggacaguucacacccugca

SEQ ID NO: 2915065 - RNA, 21 nt, Human
uggacaguucacacccugcaa

SEQ ID NO: 2915066 - RNA, 22 nt, Human
uggacaguucacacccugcaag

SEQ ID NO: 2915067 - RNA, 16 nt, Human
uggacaguccugggag

SEQ ID NO: 2915068 - RNA, 15 nt, Human
uggacaguccuggga

SEQ ID NO: 2915069 - RNA, 16 nt, Human
uggacacucagaccug

SEQ ID NO: 2915070 - RNA, 17 nt, Human
uggacacuccagugcca

SEQ ID NO: 2915071 - RNA, 19 nt, Human
uggacacuccagugccagc

SEQ ID NO: 2915072 - RNA, 23 nt, Human
uggacacuuaauacuaccuugaa

SEQ ID NO: 2915073 - RNA, 14 nt, Human
uggacacuguacaa

SEQ ID NO: 2915074 - RNA, 21 nt, Human
uggacacuccagugccagcaa

SEQ ID NO: 2915075 - RNA, 23 nt, Human
uggacaggcauguucucugagga

SEQ ID NO: 2915076 - RNA, 14 nt, Human
uggacaguccuggg

SEQ ID NO: 2915077 - RNA, 13 nt, Human
uggacaguccugg

SEQ ID NO: 2915078 - RNA, 12 nt, Human
uggacaguccug

SEQ ID NO: 2915079 - RNA, 13 nt, Human
uggacagucacug

SEQ ID NO: 2915080 - RNA, 20 nt, Human
uggacagucacugccacuuu

SEQ ID NO: 2915081 - RNA, 13 nt, Human
ugcuguuucacaa

SEQ ID NO: 2915082 - RNA, 18 nt, Human
ugcuguuucacaauaccu

SEQ ID NO: 2915083 - RNA, 12 nt, Human
ugcuguuuccuu

SEQ ID NO: 2915084 - RNA, 11 nt, Human
ugcuguuuccu

SEQ ID NO: 2915085 - RNA, 14 nt, Human
ugcuguuuccuuuu

SEQ ID NO: 2915086 - RNA, 13 nt, Human
ugcuguuugacaa

SEQ ID NO: 2915087 - RNA, 16 nt, Human
ugcuguuuguagugaa

SEQ ID NO: 2915088 - RNA, 15 nt, Human
uggacacucagaccu

SEQ ID NO: 2915089 - RNA, 18 nt, Human
uggacaccuuuagguucu

SEQ ID NO: 2915090 - RNA, 22 nt, Human
ugcuguucuagcacuucaucug

SEQ ID NO: 2915091 - RNA, 13 nt, Human
ugcuguugcuuga

SEQ ID NO: 2915092 - RNA, 14 nt, Human
ugcuguugcuugaa

SEQ ID NO: 2915093 - RNA, 15 nt, Human
ugcuguugcuugaau

SEQ ID NO: 2915094 - RNA, 18 nt, Human
ugcuguugcuugaauagc

SEQ ID NO: 2915095 - RNA, 14 nt, Human
ugcuguuggucaug

SEQ ID NO: 2915096 - RNA, 16 nt, Human
ugcuguuggucaugug

SEQ ID NO: 2915097 - RNA, 15 nt, Human
uggagaauguggaga

SEQ ID NO: 2915098 - RNA, 18 nt, Human
uggagacuccuaggcagg

SEQ ID NO: 2915099 - RNA, 19 nt, Human
uggagacuccuaggcagga

SEQ ID NO: 2915100 - RNA, 22 nt, Human
uggagacuccuaggcaggacau

SEQ ID NO: 2915101 - RNA, 19 nt, Human
uggagacucuguggggccu

SEQ ID NO: 2915102 - RNA, 14 nt, Human
uggagacucugugg

SEQ ID NO: 2915103 - RNA, 14 nt, Human
uggagaauuauaua

SEQ ID NO: 2915104 - RNA, 17 nt, Human
uggagaauugcugaagg

SEQ ID NO: 2915105 - RNA, 18 nt, Human
uggagaauugcugaaggg

SEQ ID NO: 2915106 - RNA, 19 nt, Human
uggagaauugcugaagggc

SEQ ID NO: 2915107 - RNA, 22 nt, Human
uggagaauugcugaagggcauu

SEQ ID NO: 2915108 - RNA, 16 nt, Human
uggagacaaugucugc

SEQ ID NO: 2915109 - RNA, 22 nt, Human
uggagacguggaaccucugucu

SEQ ID NO: 2915110 - RNA, 23 nt, Human
uggagacguggaaccucugucuc

SEQ ID NO: 2915111 - RNA, 24 nt, Human
uggagacguggaaccucugucuca

SEQ ID NO: 2915112 - RNA, 13 nt, Human
uggacugcagaag

SEQ ID NO: 2915113 - RNA, 14 nt, Human
uggacugcagaagc

SEQ ID NO: 2915114 - RNA, 19 nt, Human
uggacugcagaagcaaggg

SEQ ID NO: 2915115 - RNA, 14 nt, Human
uggacuggaagggg

SEQ ID NO: 2915116 - RNA, 21 nt, Human
uggagaagcucccugaaguaa

SEQ ID NO: 2915117 - RNA, 14 nt, Human
uggacuccggcccu

SEQ ID NO: 2915118 - RNA, 13 nt, Human
uggacuccucugu

SEQ ID NO: 2915119 - RNA, 22 nt, Human
uggacugaaugggaucaugaaa

SEQ ID NO: 2915120 - RNA, 14 nt, Human
uggacugacagcau

SEQ ID NO: 2915121 - RNA, 21 nt, Human
uggacugacagcaugugcccu

SEQ ID NO: 2915122 - RNA, 22 nt, Human
uggacugacagcaugugcccuc

SEQ ID NO: 2915123 - RNA, 23 nt, Human
uggacugacagcaugugcccucc

SEQ ID NO: 2915124 - RNA, 17 nt, Human
uggacuccggcccuccu

SEQ ID NO: 2915125 - RNA, 14 nt, Human
uggacaggcucugc

SEQ ID NO: 2915126 - RNA, 12 nt, Human
uggacucagaga

SEQ ID NO: 2915127 - RNA, 19 nt, Human
uggaccacugggcaaugau

SEQ ID NO: 2915128 - RNA, 14 nt, Human
uggaccacuguuuc

SEQ ID NO: 2915129 - RNA, 15 nt, Human
uggaccacuguuucu

SEQ ID NO: 2915130 - RNA, 18 nt, Human
uggaccacuguuucuugc

SEQ ID NO: 2915131 - RNA, 19 nt, Human
uggaccacuguuucuugcu

SEQ ID NO: 2915132 - RNA, 20 nt, Human
uggaccacuguuucuugcuu

SEQ ID NO: 2915133 - RNA, 21 nt, Human
uggaccacuguuucuugcuug

SEQ ID NO: 2915134 - RNA, 22 nt, Human
uggaccacuguuucuugcuugu

SEQ ID NO: 2915135 - RNA, 23 nt, Human
uggaccacuguuucuugcuugua

SEQ ID NO: 2915136 - RNA, 15 nt, Human
uggaccacugggcaa

SEQ ID NO: 2915137 - RNA, 12 nt, Human
uggaccacugca

SEQ ID NO: 2915138 - RNA, 20 nt, Human
uggaccacugcaugagcuuu

SEQ ID NO: 2915139 - RNA, 19 nt, Human
uggccagaugcaccagccc

SEQ ID NO: 2915140 - RNA, 12 nt, Human
uggccagccgcu

SEQ ID NO: 2915141 - RNA, 14 nt, Human
uggccagccgcucu

SEQ ID NO: 2915142 - RNA, 17 nt, Human
uggccagccgcucuccu

SEQ ID NO: 2915143 - RNA, 18 nt, Human
uggccagccgcucuccug

SEQ ID NO: 2915144 - RNA, 20 nt, Human
uggccagccgcucuccugcc

SEQ ID NO: 2915145 - RNA, 21 nt, Human
uggccagccgcucuccugcca

SEQ ID NO: 2915146 - RNA, 23 nt, Human
uggccagccgcucuccugccaca

SEQ ID NO: 2915147 - RNA, 24 nt, Human
uggccagccgcucuccugccacau

SEQ ID NO: 2915148 - RNA, 20 nt, Human
uggccaggcugaucucgaac

SEQ ID NO: 2915149 - RNA, 17 nt, Human
uggccaggcugcucuug

SEQ ID NO: 2915150 - RNA, 16 nt, Human
uggccaggcugcucuu

SEQ ID NO: 2915151 - RNA, 13 nt, Human
uggccagccuaca

SEQ ID NO: 2915152 - RNA, 15 nt, Human
uggccagccuggggc

SEQ ID NO: 2915153 - RNA, 18 nt, Human
uggccagccuggggccug

SEQ ID NO: 2915154 - RNA, 19 nt, Human
uggccagccuggggccugg

SEQ ID NO: 2915155 - RNA, 20 nt, Human
uggccagccuggggccuggc

SEQ ID NO: 2915156 - RNA, 21 nt, Human
uggccagccuggggccuggca

SEQ ID NO: 2915157 - RNA, 22 nt, Human
uggccagccuggggccuggcag

SEQ ID NO: 2915158 - RNA, 23 nt, Human
uggccagccuggggccuggcagg

SEQ ID NO: 2915159 - RNA, 12 nt, Human
uggcagaggagg

SEQ ID NO: 2915160 - RNA, 13 nt, Human
uggcagagcuucu

SEQ ID NO: 2915161 - RNA, 22 nt, Human
uggcagagcuuggacuggaugc

SEQ ID NO: 2915162 - RNA, 15 nt, Human
uggcagacuguguaa

SEQ ID NO: 2915163 - RNA, 17 nt, Human
uggcagacuguguaaaa

SEQ ID NO: 2915164 - RNA, 12 nt, Human
uggcagagagag

SEQ ID NO: 2915165 - RNA, 13 nt, Human
uggcagagagaga

SEQ ID NO: 2915166 - RNA, 18 nt, Human
uggcagagagagagaaag

SEQ ID NO: 2915167 - RNA, 18 nt, Human
uggccagaugcaccagcc

SEQ ID NO: 2915168 - RNA, 17 nt, Human
uggccagaugcaccagc

SEQ ID NO: 2915169 - RNA, 13 nt, Human
uggccaggcuggu

SEQ ID NO: 2915170 - RNA, 20 nt, Human
uggccaggcugcucuugaac

SEQ ID NO: 2915171 - RNA, 13 nt, Human
uggccccgccgcc

SEQ ID NO: 2915172 - RNA, 15 nt, Human
uggccccgccgccug

SEQ ID NO: 2915173 - RNA, 20 nt, Human
uggccccgccgccugguacu

SEQ ID NO: 2915174 - RNA, 20 nt, Human
uggcccauagaaacaugaca

SEQ ID NO: 2915175 - RNA, 22 nt, Human
uggcccauagaaacaugacacu

SEQ ID NO: 2915176 - RNA, 23 nt, Human
uggcccauagaaacaugacacug

SEQ ID NO: 2915177 - RNA, 24 nt, Human
uggcccauagaaacaugacacuga

SEQ ID NO: 2915178 - RNA, 15 nt, Human
uggcccaguccucuc

SEQ ID NO: 2915179 - RNA, 19 nt, Human
uggcccaguccucucccaa

SEQ ID NO: 2915180 - RNA, 16 nt, Human
uggccccugcccggcu

SEQ ID NO: 2915181 - RNA, 15 nt, Human
uggccccugcccggc

SEQ ID NO: 2915182 - RNA, 14 nt, Human
uggccccugcccgg

SEQ ID NO: 2915183 - RNA, 21 nt, Human
uggccccgccgccugguacuc

SEQ ID NO: 2915184 - RNA, 20 nt, Human
uggccccugcccggcugcgg

SEQ ID NO: 2915185 - RNA, 13 nt, Human
uggccuaucuccu

SEQ ID NO: 2915186 - RNA, 15 nt, Human
uggccuaucuccuag

SEQ ID NO: 2915187 - RNA, 16 nt, Human
uggccuaucuccuagg

SEQ ID NO: 2915188 - RNA, 17 nt, Human
uggccuaucuccuaggg

SEQ ID NO: 2915189 - RNA, 21 nt, Human
uggccccucaaaucguccagc

SEQ ID NO: 2915190 - RNA, 12 nt, Human
uggccccucaac

SEQ ID NO: 2915191 - RNA, 20 nt, Human
uggccuaugcacauauggac

SEQ ID NO: 2915192 - RNA, 13 nt, Human
uggccuaugcaca

SEQ ID NO: 2915193 - RNA, 14 nt, Human
uggccuaugcacau

SEQ ID NO: 2915194 - RNA, 15 nt, Human
uggccuaugcacaua

SEQ ID NO: 2915195 - RNA, 17 nt, Human
uggccuaugcacauaug

SEQ ID NO: 2915196 - RNA, 18 nt, Human
uggccucccacagacuca

SEQ ID NO: 2915197 - RNA, 19 nt, Human
uggccucagcugccucacu

SEQ ID NO: 2915198 - RNA, 18 nt, Human
uggccucagcugccucac

SEQ ID NO: 2915199 - RNA, 17 nt, Human
uggccucagcugccuca

SEQ ID NO: 2915200 - RNA, 16 nt, Human
uggccucagcugccuc

SEQ ID NO: 2915201 - RNA, 14 nt, Human
uggccucagcugcc

SEQ ID NO: 2915202 - RNA, 17 nt, Human
uggccucagaauucaca

SEQ ID NO: 2915203 - RNA, 12 nt, Human
uggccucagacu

SEQ ID NO: 2915204 - RNA, 14 nt, Human
uggccucagacugc

SEQ ID NO: 2915205 - RNA, 17 nt, Human
uggccucagacugcacc

SEQ ID NO: 2915206 - RNA, 19 nt, Human
uggccucagacugcaccca

SEQ ID NO: 2915207 - RNA, 20 nt, Human
uggccucagacugcacccag

SEQ ID NO: 2915208 - RNA, 21 nt, Human
uggccucagacugcacccagg

SEQ ID NO: 2915209 - RNA, 22 nt, Human
uggccucagacugcacccagga

SEQ ID NO: 2915210 - RNA, 23 nt, Human
uggccucagacugcacccaggag

SEQ ID NO: 2915211 - RNA, 24 nt, Human
uggccucagacugcacccaggagg

SEQ ID NO: 2915212 - RNA, 13 nt, Human
uggccucagcugc

SEQ ID NO: 2915213 - RNA, 18 nt, Human
uggccucagcugaaugcc

SEQ ID NO: 2915214 - RNA, 22 nt, Human
uggccucagcugaaugccuccu

SEQ ID NO: 2915215 - RNA, 15 nt, Human
uggcugggggccuca

SEQ ID NO: 2915216 - RNA, 12 nt, Human
uggcugcugccc

SEQ ID NO: 2915217 - RNA, 11 nt, Human
uggcugcugcc

SEQ ID NO: 2915218 - RNA, 19 nt, Human
uggcgagugaaugccagug

SEQ ID NO: 2915219 - RNA, 14 nt, Human
uggcuccugagggg

SEQ ID NO: 2915220 - RNA, 15 nt, Human
uggcuccucuguggu

SEQ ID NO: 2915221 - RNA, 21 nt, Human
uggcuccucuguggugucugc

SEQ ID NO: 2915222 - RNA, 22 nt, Human
uggcuccucuguggugucugcc

SEQ ID NO: 2915223 - RNA, 23 nt, Human
uggcuccucuguggugucugccu

SEQ ID NO: 2915224 - RNA, 18 nt, Human
uggcuccucccggugccc

SEQ ID NO: 2915225 - RNA, 19 nt, Human
uggcuccucccggugccca

SEQ ID NO: 2915226 - RNA, 14 nt, Human
uggcucccaugacc

SEQ ID NO: 2915227 - RNA, 14 nt, Human
uggcuccucccggu

SEQ ID NO: 2915228 - RNA, 16 nt, Human
uggcuccucccggugc

SEQ ID NO: 2915229 - RNA, 14 nt, Human
uggcggccccagca

SEQ ID NO: 2915230 - RNA, 14 nt, Human
uggcucccacaggc

SEQ ID NO: 2915231 - RNA, 16 nt, Human
uggcucccacaggagu

SEQ ID NO: 2915232 - RNA, 17 nt, Human
uggcucccacaggcccu

SEQ ID NO: 2915233 - RNA, 20 nt, Human
uggcucccacaggcccuucc

SEQ ID NO: 2915234 - RNA, 21 nt, Human
uggucaaacaaacucucugaa

SEQ ID NO: 2915235 - RNA, 16 nt, Human
uggucaaacaaacucu

SEQ ID NO: 2915236 - RNA, 19 nt, Human
ugggucacacacggaggca

SEQ ID NO: 2915237 - RNA, 14 nt, Human
uggguaucaagaca

SEQ ID NO: 2915238 - RNA, 18 nt, Human
uggguaucaagacauagc

SEQ ID NO: 2915239 - RNA, 20 nt, Human
uggguaucaagacauagcau

SEQ ID NO: 2915240 - RNA, 14 nt, Human
uggguauguguagg

SEQ ID NO: 2915241 - RNA, 17 nt, Human
uggguauguguaggcag

SEQ ID NO: 2915242 - RNA, 21 nt, Human
uggguauuugcaauauuccuu

SEQ ID NO: 2915243 - RNA, 19 nt, Human
ugguaugugacaccaaagc

SEQ ID NO: 2915244 - RNA, 19 nt, Human
ugguauggaacucucucca

SEQ ID NO: 2915245 - RNA, 16 nt, Human
ugguauggcugcaguc

SEQ ID NO: 2915246 - RNA, 18 nt, Human
uggucacaggacucugcc

SEQ ID NO: 2915247 - RNA, 22 nt, Human
uggucaaacaaacucucugaac

SEQ ID NO: 2915248 - RNA, 17 nt, Human
uggucaaaagcuggauu

SEQ ID NO: 2915249 - RNA, 19 nt, Human
uggucacaggacucugccu

SEQ ID NO: 2915250 - RNA, 13 nt, Human
uggucccacucag

SEQ ID NO: 2915251 - RNA, 22 nt, Human
uggucccuccagaaccaccccg

SEQ ID NO: 2915252 - RNA, 17 nt, Human
ugggggaguuuuccucu

SEQ ID NO: 2915253 - RNA, 13 nt, Human
uggucccugccuu

SEQ ID NO: 2915254 - RNA, 16 nt, Human
ugguccggacacuccu

SEQ ID NO: 2915255 - RNA, 19 nt, Human
ugguccggacacuccuaga

SEQ ID NO: 2915256 - RNA, 16 nt, Human
ugguccuaaaagcaaa

SEQ ID NO: 2915257 - RNA, 17 nt, Human
ugguccuaaaagcaaaa

SEQ ID NO: 2915258 - RNA, 21 nt, Human
ugguccuaaaagcaaaauaaa

SEQ ID NO: 2915259 - RNA, 22 nt, Human
ugguccuaaaagcaaaauaaaa

SEQ ID NO: 2915260 - RNA, 23 nt, Human
ugguccuaaaagcaaaauaaaaa

SEQ ID NO: 2915261 - RNA, 12 nt, Human
uggugacuuccu

SEQ ID NO: 2915262 - RNA, 23 nt, Human
uggugacuuccucgccucuccca

SEQ ID NO: 2915263 - RNA, 22 nt, Human
uggugaccucugccugaaguca

SEQ ID NO: 2915264 - RNA, 17 nt, Human
uggugaccucugccuga

SEQ ID NO: 2915265 - RNA, 16 nt, Human
uggugaccucugccug

SEQ ID NO: 2915266 - RNA, 15 nt, Human
uggugaccucugccu

SEQ ID NO: 2915267 - RNA, 21 nt, Human
uggugaucucccaagcuaucu

SEQ ID NO: 2915268 - RNA, 15 nt, Human
uggugauaaggacau

SEQ ID NO: 2915269 - RNA, 15 nt, Human
uggugauauagaauu

SEQ ID NO: 2915270 - RNA, 13 nt, Human
uggugaggagcac

SEQ ID NO: 2915271 - RNA, 19 nt, Human
ugguccucauucaaaggga

SEQ ID NO: 2915272 - RNA, 15 nt, Human
uggugcauagaacug

SEQ ID NO: 2915273 - RNA, 18 nt, Human
uggugcauagaacugggu

SEQ ID NO: 2915274 - RNA, 17 nt, Human
uggugcauagcagaugg

SEQ ID NO: 2915275 - RNA, 15 nt, Human
uggugcacuuuguaa

SEQ ID NO: 2915276 - RNA, 17 nt, Human
uggugcacuuuguaaau

SEQ ID NO: 2915277 - RNA, 19 nt, Human
uggugcacuuuguaaauuc

SEQ ID NO: 2915278 - RNA, 13 nt, Human
uggugcagacaga

SEQ ID NO: 2915279 - RNA, 15 nt, Human
uggugcagacagaag

SEQ ID NO: 2915280 - RNA, 22 nt, Human
uggugcagacagaagucuccuc

SEQ ID NO: 2915281 - RNA, 14 nt, Human
uggugaccucugcc

SEQ ID NO: 2915282 - RNA, 13 nt, Human
uggugaccucugc

SEQ ID NO: 2915283 - RNA, 12 nt, Human
uggucuaaaacu

SEQ ID NO: 2915284 - RNA, 17 nt, Human
uggucuaacacuggcau

SEQ ID NO: 2915285 - RNA, 23 nt, Human
uggucuaacacuggcauguucaa

SEQ ID NO: 2915286 - RNA, 18 nt, Human
uggucuaaaaauaaacca

SEQ ID NO: 2915287 - RNA, 15 nt, Human
uggucgcccaggaga

SEQ ID NO: 2915288 - RNA, 16 nt, Human
ugguccuguccccgca

SEQ ID NO: 2915289 - RNA, 19 nt, Human
ugguccuggggcucugugc

SEQ ID NO: 2915290 - RNA, 16 nt, Human
ugguccuggggcucug

SEQ ID NO: 2915291 - RNA, 14 nt, Human
ugguccuggggcuc

SEQ ID NO: 2915292 - RNA, 11 nt, Human
ugguccugggg

SEQ ID NO: 2915293 - RNA, 12 nt, Human
ugguccugacuu

SEQ ID NO: 2915294 - RNA, 20 nt, Human
ugguccugaggguccccacc

SEQ ID NO: 2915295 - RNA, 14 nt, Human
uggucgcccaggag

SEQ ID NO: 2915296 - RNA, 13 nt, Human
uggucgcccagga

SEQ ID NO: 2915297 - RNA, 23 nt, Human
ugguccuuccaggcccccaccac

SEQ ID NO: 2915298 - RNA, 20 nt, Human
ugguccugugugcagugaag

SEQ ID NO: 2915299 - RNA, 23 nt, Human
ugggcaggacucagcuccccaga

SEQ ID NO: 2915300 - RNA, 21 nt, Human
ugggauuacaggcaugugcca

SEQ ID NO: 2915301 - RNA, 21 nt, Human
ugggauuacaggcgugagcca

SEQ ID NO: 2915302 - RNA, 21 nt, Human
ugggcagggucuguuuggacu

SEQ ID NO: 2915303 - RNA, 18 nt, Human
ugggcagagcccccagga

SEQ ID NO: 2915304 - RNA, 11 nt, Human
ugggcccugca

SEQ ID NO: 2915305 - RNA, 12 nt, Human
ugggcccugcau

SEQ ID NO: 2915306 - RNA, 13 nt, Human
ugggcccugcaug

SEQ ID NO: 2915307 - RNA, 14 nt, Human
ugggcccugcaugu

SEQ ID NO: 2915308 - RNA, 11 nt, Human
ugggccuucag

SEQ ID NO: 2915309 - RNA, 16 nt, Human
ugggccugggcuaggg

SEQ ID NO: 2915310 - RNA, 18 nt, Human
ugggccugggcuagggga

SEQ ID NO: 2915311 - RNA, 17 nt, Human
ugggauuacaggcguga

SEQ ID NO: 2915312 - RNA, 22 nt, Human
ugggauuacaagcgugagccac

SEQ ID NO: 2915313 - RNA, 14 nt, Human
ugggaucaugaaag

SEQ ID NO: 2915314 - RNA, 18 nt, Human
ugggaucaugaaaguaga

SEQ ID NO: 2915315 - RNA, 20 nt, Human
ugggaugugguuuucuuaag

SEQ ID NO: 2915316 - RNA, 19 nt, Human
ugggaucccugucuuuccu

SEQ ID NO: 2915317 - RNA, 22 nt, Human
ugggaucccugucuuuccuaag

SEQ ID NO: 2915318 - RNA, 23 nt, Human
ugggaucccugucuuuccuaaga

SEQ ID NO: 2915319 - RNA, 16 nt, Human
ugggauggugggcuuc

SEQ ID NO: 2915320 - RNA, 20 nt, Human
ugggauggugggcuucaggg

SEQ ID NO: 2915321 - RNA, 21 nt, Human
ugggauguaugaauacagcag

SEQ ID NO: 2915322 - RNA, 23 nt, Human
ugggauguaugaauacagcagca

SEQ ID NO: 2915323 - RNA, 17 nt, Human
uggcugggggccucagu

SEQ ID NO: 2915324 - RNA, 16 nt, Human
uggcugggggccucag

SEQ ID NO: 2915325 - RNA, 20 nt, Human
uggcugggggccucagugcc

SEQ ID NO: 2915326 - RNA, 14 nt, Human
uggcugcugcccag

SEQ ID NO: 2915327 - RNA, 19 nt, Human
ugggaucacauguggacuu

SEQ ID NO: 2915328 - RNA, 23 nt, Human
uggggaugagaaagguugaagca

SEQ ID NO: 2915329 - RNA, 15 nt, Human
uggggaugagaaagg

SEQ ID NO: 2915330 - RNA, 18 nt, Human
uggggaucaaaguucugc

SEQ ID NO: 2915331 - RNA, 17 nt, Human
uggggauaaaggagaag

SEQ ID NO: 2915332 - RNA, 13 nt, Human
ugggcuugauucu

SEQ ID NO: 2915333 - RNA, 14 nt, Human
ugggcuugauucug

SEQ ID NO: 2915334 - RNA, 16 nt, Human
uggggauaaaaugacu

SEQ ID NO: 2915335 - RNA, 20 nt, Human
uggggauaaaaugacuacuu

SEQ ID NO: 2915336 - RNA, 21 nt, Human
uggggauaaaaugacuacuua

SEQ ID NO: 2915337 - RNA, 23 nt, Human
ugggcuucccaguggcugcugcc

SEQ ID NO: 2915338 - RNA, 12 nt, Human
ugggcuucccag

SEQ ID NO: 2915339 - RNA, 19 nt, Human
ugggcuucccaguggcugc

SEQ ID NO: 2915340 - RNA, 21 nt, Human
ugggcuucccaguggcugcug

SEQ ID NO: 2915341 - RNA, 22 nt, Human
ugggcuucccaguggcugcugc

SEQ ID NO: 2915342 - RNA, 12 nt, Human
ugggccuucagg

SEQ ID NO: 2915343 - RNA, 16 nt, Human
ugggccuuagugggcc

SEQ ID NO: 2915344 - RNA, 18 nt, Human
ugggccuuagugggccag

SEQ ID NO: 2915345 - RNA, 19 nt, Human
ugggccuuagugggccagg

SEQ ID NO: 2915346 - RNA, 23 nt, Human
ugggccuuagugggccagggcug

SEQ ID NO: 2915347 - RNA, 21 nt, Human
ugggggaguagaucuuucuag

SEQ ID NO: 2915348 - RNA, 23 nt, Human
ugggggaaugagcccagagaaca

SEQ ID NO: 2915349 - RNA, 17 nt, Human
ugggggacguuucucau

SEQ ID NO: 2915350 - RNA, 18 nt, Human
ugggggucaggcagccag

SEQ ID NO: 2915351 - RNA, 19 nt, Human
ugggggucaggcagccagu

SEQ ID NO: 2915352 - RNA, 19 nt, Human
uggggggguguuaauuuau

SEQ ID NO: 2915353 - RNA, 20 nt, Human
uggggguaaaaaauauagcc

SEQ ID NO: 2915354 - RNA, 18 nt, Human
uggguacuuguggacaca

SEQ ID NO: 2915355 - RNA, 17 nt, Human
uggguacuuguggacac

SEQ ID NO: 2915356 - RNA, 15 nt, Human
uggggguucuuucuu

SEQ ID NO: 2915357 - RNA, 19 nt, Human
uggggguucuuucuuccuc

SEQ ID NO: 2915358 - RNA, 20 nt, Human
uggguaauuuagauuguaaa

SEQ ID NO: 2915359 - RNA, 22 nt, Human
uggguaauccaggcacagcuga

SEQ ID NO: 2915360 - RNA, 23 nt, Human
uggguaauccaggcacagcugag

SEQ ID NO: 2915361 - RNA, 20 nt, Human
uggggguucuuucuuccucu

SEQ ID NO: 2915362 - RNA, 22 nt, Human
uggggguucuuucuuccucugc

SEQ ID NO: 2915363 - RNA, 17 nt, Human
uuaaaagccacauagag

SEQ ID NO: 2915364 - RNA, 15 nt, Human
uuaaaaggauaguau

SEQ ID NO: 2915365 - RNA, 17 nt, Human
uuaaaaggauuuuuauc

SEQ ID NO: 2915366 - RNA, 20 nt, Human
uuaaaaggauuuuuaucuuu

SEQ ID NO: 2915367 - RNA, 22 nt, Human
uuaaaaggauuuuuaucuuucg

SEQ ID NO: 2915368 - RNA, 16 nt, Human
uuaaaagauucauuuu

SEQ ID NO: 2915369 - RNA, 17 nt, Human
uuaaaagauucauuuuu

SEQ ID NO: 2915370 - RNA, 21 nt, Human
uuaaaagauucauuuuuaauc

SEQ ID NO: 2915371 - RNA, 11 nt, Human
uuaaagaaagu

SEQ ID NO: 2915372 - RNA, 15 nt, Human
uuaaaauagaaauaa

SEQ ID NO: 2915373 - RNA, 22 nt, Human
uuaaaauagcaacacucuauau

SEQ ID NO: 2915374 - RNA, 20 nt, Human
uuaaaagucacaauguucuu

SEQ ID NO: 2915375 - RNA, 16 nt, Human
uuaaacucagggacag

SEQ ID NO: 2915376 - RNA, 20 nt, Human
uuaaacucagggacagagcc

SEQ ID NO: 2915377 - RNA, 22 nt, Human
uuaaacucagggacagagccau

SEQ ID NO: 2915378 - RNA, 22 nt, Human
uuaaacucgagauacagcuuuu

SEQ ID NO: 2915379 - RNA, 22 nt, Human
uguuuuuuucuuuuuuuauaaa

SEQ ID NO: 2915380 - RNA, 18 nt, Human
uguuuuuuuuuuccacuu

SEQ ID NO: 2915381 - RNA, 19 nt, Human
uguuuuuuuuuuccacuua

SEQ ID NO: 2915382 - RNA, 19 nt, Human
uuaaaaaaaaaaaaaagcu

SEQ ID NO: 2915383 - RNA, 12 nt, Human
uuaaaagaaauu

SEQ ID NO: 2915384 - RNA, 16 nt, Human
uuaaaagaaauuuauu

SEQ ID NO: 2915385 - RNA, 22 nt, Human
uguuuuaagaggcagggucuca

SEQ ID NO: 2915386 - RNA, 13 nt, Human
uguuuugugcauu

SEQ ID NO: 2915387 - RNA, 15 nt, Human
uguuuugugcauuug

SEQ ID NO: 2915388 - RNA, 13 nt, Human
uguuuuguauaca

SEQ ID NO: 2915389 - RNA, 14 nt, Human
uguuuuguauacaa

SEQ ID NO: 2915390 - RNA, 16 nt, Human
uguuuuguauacaaau

SEQ ID NO: 2915391 - RNA, 17 nt, Human
uguuuuguauacaaaua

SEQ ID NO: 2915392 - RNA, 22 nt, Human
uguuuuguauacaaauauauug

SEQ ID NO: 2915393 - RNA, 18 nt, Human
uguuuuguacauagauuu

SEQ ID NO: 2915394 - RNA, 13 nt, Human
uguuuuguuuguc

SEQ ID NO: 2915395 - RNA, 14 nt, Human
uguuuuguuugucu

SEQ ID NO: 2915396 - RNA, 16 nt, Human
uguuuuguuugucucu

SEQ ID NO: 2915397 - RNA, 23 nt, Human
uguuuuguuugucucuccuuuuc

SEQ ID NO: 2915398 - RNA, 12 nt, Human
uguuuuguuaau

SEQ ID NO: 2915399 - RNA, 17 nt, Human
uguuuuguuuggagaca

SEQ ID NO: 2915400 - RNA, 21 nt, Human
uggugccauccccagggggca

SEQ ID NO: 2915401 - RNA, 16 nt, Human
uggugccauccccagg

SEQ ID NO: 2915402 - RNA, 14 nt, Human
uggugccaucccca

SEQ ID NO: 2915403 - RNA, 18 nt, Human
uggugccaucauugcugu

SEQ ID NO: 2915404 - RNA, 22 nt, Human
uggugccaucauugcugucugc

SEQ ID NO: 2915405 - RNA, 17 nt, Human
uggugccacaaauaaaa

SEQ ID NO: 2915406 - RNA, 18 nt, Human
uggugccacaaauaaaau

SEQ ID NO: 2915407 - RNA, 20 nt, Human
uggugccacaaauaaaaugg

SEQ ID NO: 2915408 - RNA, 15 nt, Human
uguuucaaacuguaa

SEQ ID NO: 2915409 - RNA, 10 nt, Human
uguuucaaga

SEQ ID NO: 2915410 - RNA, 16 nt, Human
uguuucaagaaccugg

SEQ ID NO: 2915411 - RNA, 19 nt, Human
uguuucaagaaccuggaaa

SEQ ID NO: 2915412 - RNA, 22 nt, Human
uguuucagguucaguauuaugu

SEQ ID NO: 2915413 - RNA, 10 nt, Human
uguuucagug

SEQ ID NO: 2915414 - RNA, 21 nt, Human
uguuucagugaauaugccugu

SEQ ID NO: 2915415 - RNA, 18 nt, Human
uguuucacgaaguuuguu

SEQ ID NO: 2915416 - RNA, 15 nt, Human
uguuucagauuuuuu

SEQ ID NO: 2915417 - RNA, 17 nt, Human
uguuucagcuaagggaa

SEQ ID NO: 2915418 - RNA, 19 nt, Human
uguuucagcuaagggaaga

SEQ ID NO: 2915419 - RNA, 21 nt, Human
uguuucagcuaagggaagaca

SEQ ID NO: 2915420 - RNA, 22 nt, Human
uguuucagcuaagggaagacau

SEQ ID NO: 2915421 - RNA, 23 nt, Human
uguuucagcuaagggaagacauu

SEQ ID NO: 2915422 - RNA, 24 nt, Human
uguuucagcuaagggaagacauuu

SEQ ID NO: 2915423 - RNA, 14 nt, Human
uguuucaaucacug

SEQ ID NO: 2915424 - RNA, 15 nt, Human
uguuucaaucacugu

SEQ ID NO: 2915425 - RNA, 16 nt, Human
uguuucaaucacuguc

SEQ ID NO: 2915426 - RNA, 23 nt, Human
uguuucacaccggaagguuuuua

SEQ ID NO: 2915427 - RNA, 20 nt, Human
uguuucaaggcacucuagau

SEQ ID NO: 2915428 - RNA, 21 nt, Human
uguuucaaggcacucuagauu

SEQ ID NO: 2915429 - RNA, 15 nt, Human
uguuucaaggcacuc

SEQ ID NO: 2915430 - RNA, 19 nt, Human
uguuucaaggcacucuaga

SEQ ID NO: 2915431 - RNA, 20 nt, Human
uguuuuaagaggcagggucu

SEQ ID NO: 2915432 - RNA, 19 nt, Human
uguuugucuuuuaaugcuu

SEQ ID NO: 2915433 - RNA, 19 nt, Human
uguuugucuguuuguuuca

SEQ ID NO: 2915434 - RNA, 20 nt, Human
uguuugucuguuuguuucaa

SEQ ID NO: 2915435 - RNA, 15 nt, Human
uguuugucucuccuu

SEQ ID NO: 2915436 - RNA, 16 nt, Human
uguuugucucuccuuu

SEQ ID NO: 2915437 - RNA, 17 nt, Human
uguuugucucuccuuuu

SEQ ID NO: 2915438 - RNA, 18 nt, Human
uguuugucucuccuuuuc

SEQ ID NO: 2915439 - RNA, 19 nt, Human
uguuugucucuccuuuucu

SEQ ID NO: 2915440 - RNA, 16 nt, Human
uguuuguagugaaaua

SEQ ID NO: 2915441 - RNA, 19 nt, Human
uguuuggugcauagaacug

SEQ ID NO: 2915442 - RNA, 22 nt, Human
uguuuggugcauagaacugggu

SEQ ID NO: 2915443 - RNA, 18 nt, Human
uguuuggugcucauuuaa

SEQ ID NO: 2915444 - RNA, 14 nt, Human
uguuugguuuacau

SEQ ID NO: 2915445 - RNA, 15 nt, Human
uguuugguuuacauu

SEQ ID NO: 2915446 - RNA, 16 nt, Human
uguuugguuuacauuu

SEQ ID NO: 2915447 - RNA, 20 nt, Human
uguuuccagacuuccuugag

SEQ ID NO: 2915448 - RNA, 15 nt, Human
uguuuccuucagugc

SEQ ID NO: 2915449 - RNA, 12 nt, Human
uguuuccuucag

SEQ ID NO: 2915450 - RNA, 23 nt, Human
uguuuccuuguuuaucagauaca

SEQ ID NO: 2915451 - RNA, 23 nt, Human
uguuuccagacuuccuugagaca

SEQ ID NO: 2915452 - RNA, 18 nt, Human
uguuuccagcagaagaca

SEQ ID NO: 2915453 - RNA, 20 nt, Human
uguuuccagcagaagacaaa

SEQ ID NO: 2915454 - RNA, 21 nt, Human
uguuuccagcagaagacaaaa

SEQ ID NO: 2915455 - RNA, 18 nt, Human
uguuuccaaccuggagua

SEQ ID NO: 2915456 - RNA, 22 nt, Human
uguuucauguuuugugacuaua

SEQ ID NO: 2915457 - RNA, 19 nt, Human
uguuucauguuuugugacu

SEQ ID NO: 2915458 - RNA, 21 nt, Human
uguuucauguuuugugacuau

SEQ ID NO: 2915459 - RNA, 13 nt, Human
uguuucauguuuu

SEQ ID NO: 2915460 - RNA, 14 nt, Human
uguuucauguuuug

SEQ ID NO: 2915461 - RNA, 18 nt, Human
uguuugggggacguuucu

SEQ ID NO: 2915462 - RNA, 19 nt, Human
uguuugggggacguuucuc

SEQ ID NO: 2915463 - RNA, 20 nt, Human
uguuugggggacguuucuca

SEQ ID NO: 2915464 - RNA, 21 nt, Human
uguuugggggacguuucucau

SEQ ID NO: 2915465 - RNA, 24 nt, Human
uguuugggggacguuucucauuug

SEQ ID NO: 2915466 - RNA, 19 nt, Human
uguuuggggaugagaaagg

SEQ ID NO: 2915467 - RNA, 11 nt, Human
uguuuccuuuu

SEQ ID NO: 2915468 - RNA, 19 nt, Human
uuaauauauguauuauuua

SEQ ID NO: 2915469 - RNA, 18 nt, Human
uuaauauauuugaaaaaa

SEQ ID NO: 2915470 - RNA, 20 nt, Human
uuaauauaucccagaaauua

SEQ ID NO: 2915471 - RNA, 19 nt, Human
uuaauauaucccagaaauu

SEQ ID NO: 2915472 - RNA, 21 nt, Human
uuaaugauaaguaaaugcuag

SEQ ID NO: 2915473 - RNA, 17 nt, Human
uuaaugauaaguaaaug

SEQ ID NO: 2915474 - RNA, 15 nt, Human
uuaauauauguauua

SEQ ID NO: 2915475 - RNA, 21 nt, Human
uuaauauuaccuaaugaaagu

SEQ ID NO: 2915476 - RNA, 16 nt, Human
uuaauauuauuacugu

SEQ ID NO: 2915477 - RNA, 15 nt, Human
uuaauauucuauuaa

SEQ ID NO: 2915478 - RNA, 21 nt, Human
uuaagccucauauuuaaagac

SEQ ID NO: 2915479 - RNA, 16 nt, Human
uuaagccuuuggaaac

SEQ ID NO: 2915480 - RNA, 15 nt, Human
uuaagccuuuggaaa

SEQ ID NO: 2915481 - RNA, 22 nt, Human
uuaagcagcuaaauuuucugaa

SEQ ID NO: 2915482 - RNA, 22 nt, Human
uuaagccucauauuuaaagaca

SEQ ID NO: 2915483 - RNA, 17 nt, Human
uuaauguauuuguucau

SEQ ID NO: 2915484 - RNA, 21 nt, Human
uuaauguauuuguucauguuu

SEQ ID NO: 2915485 - RNA, 23 nt, Human
uuaauguauuuguucauguuugg

SEQ ID NO: 2915486 - RNA, 22 nt, Human
uuaauguguugggaaaaaggcc

SEQ ID NO: 2915487 - RNA, 19 nt, Human
uuaaugugaacuuguagcu

SEQ ID NO: 2915488 - RNA, 23 nt, Human
uuaaugugaccuagcaauaggca

SEQ ID NO: 2915489 - RNA, 11 nt, Human
uuaaugugagu

SEQ ID NO: 2915490 - RNA, 13 nt, Human
uuaaugugaguuu

SEQ ID NO: 2915491 - RNA, 13 nt, Human
uuaaugugaugau

SEQ ID NO: 2915492 - RNA, 20 nt, Human
uuaaugugaugauguaauug

SEQ ID NO: 2915493 - RNA, 22 nt, Human
uuaaugcaguugcuuacuaaag

SEQ ID NO: 2915494 - RNA, 19 nt, Human
uuaaugccauuaucccuga

SEQ ID NO: 2915495 - RNA, 20 nt, Human
uuaaugcauguuaggaaaau

SEQ ID NO: 2915496 - RNA, 18 nt, Human
uuaaugcauuaaaccugu

SEQ ID NO: 2915497 - RNA, 19 nt, Human
uuaaugcauuaaaccuguc

SEQ ID NO: 2915498 - RNA, 20 nt, Human
uuaaugcauuaaaccugucu

SEQ ID NO: 2915499 - RNA, 22 nt, Human
uuaaugcauuaaaccugucucc

SEQ ID NO: 2915500 - RNA, 23 nt, Human
uuaaugcauuaaaccugucucca

SEQ ID NO: 2915501 - RNA, 15 nt, Human
uuaauggucuaaaaa

SEQ ID NO: 2915502 - RNA, 22 nt, Human
uuaauggucuaaaaauaaacca

SEQ ID NO: 2915503 - RNA, 18 nt, Human
uuaauguaaucugauggc

SEQ ID NO: 2915504 - RNA, 20 nt, Human
uuacaagcgugagccacugc

SEQ ID NO: 2915505 - RNA, 17 nt, Human
uuacaagcccccccuuc

SEQ ID NO: 2915506 - RNA, 14 nt, Human
uuaauuaaaaacua

SEQ ID NO: 2915507 - RNA, 19 nt, Human
uuaauuaaaaacuaguagu

SEQ ID NO: 2915508 - RNA, 20 nt, Human
uuaauuaaaaacuaguaguu

SEQ ID NO: 2915509 - RNA, 19 nt, Human
uuacaagcccccccuucca

SEQ ID NO: 2915510 - RNA, 20 nt, Human
uuacaagcccccccuuccac

SEQ ID NO: 2915511 - RNA, 10 nt, Human
uuaauguuuu

SEQ ID NO: 2915512 - RNA, 16 nt, Human
uuaauguuuuaaaugu

SEQ ID NO: 2915513 - RNA, 18 nt, Human
uuaauguuuuaaauguac

SEQ ID NO: 2915514 - RNA, 23 nt, Human
uuaauguuuuaaauguacagaca

SEQ ID NO: 2915515 - RNA, 16 nt, Human
uuaaugugguugaaga

SEQ ID NO: 2915516 - RNA, 14 nt, Human
uuaauguguaaaga

SEQ ID NO: 2915517 - RNA, 13 nt, Human
uuaauguucugug

SEQ ID NO: 2915518 - RNA, 14 nt, Human
uuaauguucuguga

SEQ ID NO: 2915519 - RNA, 21 nt, Human
uuacaagcgugagccacugca

SEQ ID NO: 2915520 - RNA, 21 nt, Human
uuacaagaaguuuauucucau

SEQ ID NO: 2915521 - RNA, 17 nt, Human
uuacaaguauacuuaua

SEQ ID NO: 2915522 - RNA, 19 nt, Human
uuacaauuuguucauccua

SEQ ID NO: 2915523 - RNA, 20 nt, Human
uuaacgugggauucagagaa

SEQ ID NO: 2915524 - RNA, 13 nt, Human
uuaacuacauuua

SEQ ID NO: 2915525 - RNA, 14 nt, Human
uuaacuacauuuau

SEQ ID NO: 2915526 - RNA, 16 nt, Human
uuaacuacauuuauga

SEQ ID NO: 2915527 - RNA, 16 nt, Human
uuaacuacccuuaauu

SEQ ID NO: 2915528 - RNA, 20 nt, Human
uuaacuacccuuaauuacuu

SEQ ID NO: 2915529 - RNA, 21 nt, Human
uuaacuacccuuaauuacuua

SEQ ID NO: 2915530 - RNA, 18 nt, Human
uuaacuacuauauugauu

SEQ ID NO: 2915531 - RNA, 19 nt, Human
uuaacuacuauauugauug

SEQ ID NO: 2915532 - RNA, 20 nt, Human
uuaacuacuauauugauugu

SEQ ID NO: 2915533 - RNA, 13 nt, Human
uuaaccugaugca

SEQ ID NO: 2915534 - RNA, 17 nt, Human
uuaaccccauguccuca

SEQ ID NO: 2915535 - RNA, 20 nt, Human
uuaaccgaugcuuuaccaaa

SEQ ID NO: 2915536 - RNA, 17 nt, Human
uuaaccaaacaauuauu

SEQ ID NO: 2915537 - RNA, 21 nt, Human
uuaaccaaacaauuauuuaaa

SEQ ID NO: 2915538 - RNA, 14 nt, Human
uuaaccauuuaagu

SEQ ID NO: 2915539 - RNA, 13 nt, Human
uuaacccaaggag

SEQ ID NO: 2915540 - RNA, 18 nt, Human
uuaacccaaggagcacag

SEQ ID NO: 2915541 - RNA, 16 nt, Human
uuaaccaguuguggug

SEQ ID NO: 2915542 - RNA, 12 nt, Human
uuaacauuugcc

SEQ ID NO: 2915543 - RNA, 13 nt, Human
uuaacauuugccu

SEQ ID NO: 2915544 - RNA, 23 nt, Human
uuaacauuugccuugcagaacug

SEQ ID NO: 2915545 - RNA, 14 nt, Human
uuaacauuuuguuc

SEQ ID NO: 2915546 - RNA, 16 nt, Human
uuaacauuuuguucuu

SEQ ID NO: 2915547 - RNA, 17 nt, Human
uuaacauuuuguucuua

SEQ ID NO: 2915548 - RNA, 22 nt, Human
uuaacauuuuguucuuacacau

SEQ ID NO: 2915549 - RNA, 11 nt, Human
uuaaauguuug

SEQ ID NO: 2915550 - RNA, 12 nt, Human
uuaaauguuuga

SEQ ID NO: 2915551 - RNA, 17 nt, Human
uuaaauguuuuauaagu

SEQ ID NO: 2915552 - RNA, 22 nt, Human
uuaaauguuuuauaaguucaca

SEQ ID NO: 2915553 - RNA, 12 nt, Human
uuaaagacagag

SEQ ID NO: 2915554 - RNA, 11 nt, Human
uuaaagacaga

SEQ ID NO: 2915555 - RNA, 17 nt, Human
uuaacuuauuuagagau

SEQ ID NO: 2915556 - RNA, 21 nt, Human
uuaagcagauggaaugcugug

SEQ ID NO: 2915557 - RNA, 20 nt, Human
uuaacuggugcacuuuguaa

SEQ ID NO: 2915558 - RNA, 21 nt, Human
uuaacuggugcacuuuguaaa

SEQ ID NO: 2915559 - RNA, 22 nt, Human
uuaacuggugcacuuuguaaau

SEQ ID NO: 2915560 - RNA, 23 nt, Human
uuaacuggugcacuuuguaaauu

SEQ ID NO: 2915561 - RNA, 22 nt, Human
uuaacuuaaauuuuaauuuauu

SEQ ID NO: 2915562 - RNA, 13 nt, Human
uuaacucuacugu

SEQ ID NO: 2915563 - RNA, 17 nt, Human
uuaacucuacuguguaa

SEQ ID NO: 2915564 - RNA, 16 nt, Human
uuaacugaacaauggc

SEQ ID NO: 2915565 - RNA, 21 nt, Human
uuaacugaacaauggcccugu

SEQ ID NO: 2915566 - RNA, 19 nt, Human
uuaacugaagauguugaga

SEQ ID NO: 2915567 - RNA, 21 nt, Human
uuaacugaagauguugagaaa

SEQ ID NO: 2915568 - RNA, 22 nt, Human
uuaacuauugcauuuauaugua

SEQ ID NO: 2915569 - RNA, 21 nt, Human
uuaacuauugcauuuauaugu

SEQ ID NO: 2915570 - RNA, 14 nt, Human
uuaacuauugcauu

SEQ ID NO: 2915571 - RNA, 17 nt, Human
uuaacuagacacagaua

SEQ ID NO: 2915572 - RNA, 15 nt, Human
uuaacuauaaauaug

SEQ ID NO: 2915573 - RNA, 21 nt, Human
uuaggaguucgagaccagccu

SEQ ID NO: 2915574 - RNA, 22 nt, Human
uuaggagugggugacaagagcc

SEQ ID NO: 2915575 - RNA, 15 nt, Human
uuaggagcuaaggcu

SEQ ID NO: 2915576 - RNA, 17 nt, Human
uuaggagcuaaggcucu

SEQ ID NO: 2915577 - RNA, 17 nt, Human
uuaggaggcucaacaau

SEQ ID NO: 2915578 - RNA, 18 nt, Human
uuaggaggcucaacaaua

SEQ ID NO: 2915579 - RNA, 19 nt, Human
uuaggaugcucaguugcua

SEQ ID NO: 2915580 - RNA, 17 nt, Human
uuaggaugguaaaguua

SEQ ID NO: 2915581 - RNA, 16 nt, Human
uuaggagcuaaggcuc

SEQ ID NO: 2915582 - RNA, 20 nt, Human
uuaggcaaggcuaugugauu

SEQ ID NO: 2915583 - RNA, 22 nt, Human
uuaggaaguugacuuauaguac

SEQ ID NO: 2915584 - RNA, 23 nt, Human
uuaggaaguugacuuauaguaca

SEQ ID NO: 2915585 - RNA, 17 nt, Human
uuaggaaguuuucugua

SEQ ID NO: 2915586 - RNA, 14 nt, Human
uuaggaaugagaag

SEQ ID NO: 2915587 - RNA, 15 nt, Human
uuaggaaugagaagu

SEQ ID NO: 2915588 - RNA, 19 nt, Human
uuaggaauuaaguuaucuu

SEQ ID NO: 2915589 - RNA, 23 nt, Human
uuaggaauuaaguuaucuuuaaa

SEQ ID NO: 2915590 - RNA, 17 nt, Human
uuaggcugcugggaugg

SEQ ID NO: 2915591 - RNA, 14 nt, Human
uuaggcuuucagcu

SEQ ID NO: 2915592 - RNA, 17 nt, Human
uuaguagagacaggguu

SEQ ID NO: 2915593 - RNA, 16 nt, Human
uuaggccuuccucucu

SEQ ID NO: 2915594 - RNA, 14 nt, Human
uuaggccuaccuga

SEQ ID NO: 2915595 - RNA, 16 nt, Human
uuaggccacaugggag

SEQ ID NO: 2915596 - RNA, 22 nt, Human
uuaggccaaaaaaauguaagau

SEQ ID NO: 2915597 - RNA, 13 nt, Human
uuaguuaauauau

SEQ ID NO: 2915598 - RNA, 13 nt, Human
uuaguuaauggau

SEQ ID NO: 2915599 - RNA, 14 nt, Human
uuaguuaauggauu

SEQ ID NO: 2915600 - RNA, 17 nt, Human
uuaguguuuuaagaaau

SEQ ID NO: 2915601 - RNA, 14 nt, Human
uuaguuaaguuuua

SEQ ID NO: 2915602 - RNA, 16 nt, Human
uuaguuauagaugucu

SEQ ID NO: 2915603 - RNA, 13 nt, Human
uuaguuauaguuu

SEQ ID NO: 2915604 - RNA, 15 nt, Human
uuaguuauaguuuca

SEQ ID NO: 2915605 - RNA, 18 nt, Human
uuaguuauaguuucagau

SEQ ID NO: 2915606 - RNA, 22 nt, Human
uuaguuauaguuucagauauau

SEQ ID NO: 2915607 - RNA, 18 nt, Human
uuagucucuaaagaguuu

SEQ ID NO: 2915608 - RNA, 14 nt, Human
uuagucucuuuauu

SEQ ID NO: 2915609 - RNA, 22 nt, Human
uuagucucaguuugugugucuu

SEQ ID NO: 2915610 - RNA, 23 nt, Human
uuagucucaguuugugugucuua

SEQ ID NO: 2915611 - RNA, 12 nt, Human
uuagucucaguu

SEQ ID NO: 2915612 - RNA, 21 nt, Human
uuagucucaguuugugugucu

SEQ ID NO: 2915613 - RNA, 19 nt, Human
uuaguaugacgcugauaca

SEQ ID NO: 2915614 - RNA, 22 nt, Human
uuaguaugacgcugauacauaa

SEQ ID NO: 2915615 - RNA, 15 nt, Human
uuaguaucaguguuu

SEQ ID NO: 2915616 - RNA, 19 nt, Human
uuaguaucaguguuuuaaa

SEQ ID NO: 2915617 - RNA, 14 nt, Human
uuaguauucauucu

SEQ ID NO: 2915618 - RNA, 15 nt, Human
uuaguauucauucug

SEQ ID NO: 2915619 - RNA, 17 nt, Human
uuaguauucauucugca

SEQ ID NO: 2915620 - RNA, 19 nt, Human
uuaguauuuauuuauguac

SEQ ID NO: 2915621 - RNA, 20 nt, Human
uuaguauuuauuuauguacu

SEQ ID NO: 2915622 - RNA, 22 nt, Human
uuagucccccaacucugagccc

SEQ ID NO: 2915623 - RNA, 21 nt, Human
uuagcuaaacggauuccaaag

SEQ ID NO: 2915624 - RNA, 12 nt, Human
uuagcuaaagga

SEQ ID NO: 2915625 - RNA, 14 nt, Human
uuagcuaggauuug

SEQ ID NO: 2915626 - RNA, 18 nt, Human
uuagcuaggauuugaaca

SEQ ID NO: 2915627 - RNA, 14 nt, Human
uuagauauaacacu

SEQ ID NO: 2915628 - RNA, 17 nt, Human
uuagauauaacacuaug

SEQ ID NO: 2915629 - RNA, 24 nt, Human
uuagauaacgcuuaaaggaaguca

SEQ ID NO: 2915630 - RNA, 17 nt, Human
uuagauagcugcaugug

SEQ ID NO: 2915631 - RNA, 20 nt, Human
uuagagcaguuucuguccug

SEQ ID NO: 2915632 - RNA, 18 nt, Human
uuagagggaggagaauga

SEQ ID NO: 2915633 - RNA, 21 nt, Human
uuagagcugacacaaaccugc

SEQ ID NO: 2915634 - RNA, 21 nt, Human
uuagagcuuccgagaauagcu

SEQ ID NO: 2915635 - RNA, 13 nt, Human
uuagaguuucugu

SEQ ID NO: 2915636 - RNA, 15 nt, Human
uuagaguuucuguuu

SEQ ID NO: 2915637 - RNA, 16 nt, Human
uuagaguuucuguuug

SEQ ID NO: 2915638 - RNA, 17 nt, Human
uuagaguuucuguuuga

SEQ ID NO: 2915639 - RNA, 18 nt, Human
uuagaguuucuguuugau

SEQ ID NO: 2915640 - RNA, 14 nt, Human
uuagagucagccuu

SEQ ID NO: 2915641 - RNA, 15 nt, Human
uuagaguaagaaauu

SEQ ID NO: 2915642 - RNA, 19 nt, Human
uuagaguaagaaauuucag

SEQ ID NO: 2915643 - RNA, 16 nt, Human
uuagcuggcauuacag

SEQ ID NO: 2915644 - RNA, 12 nt, Human
uuagcugggaga

SEQ ID NO: 2915645 - RNA, 15 nt, Human
uuagcugucugcuca

SEQ ID NO: 2915646 - RNA, 17 nt, Human
uuagcugucugcucaga

SEQ ID NO: 2915647 - RNA, 16 nt, Human
uuagcucccucccgca

SEQ ID NO: 2915648 - RNA, 15 nt, Human
uuagcucuauugaua

SEQ ID NO: 2915649 - RNA, 23 nt, Human
uuagcugaugaacuuauucugua

SEQ ID NO: 2915650 - RNA, 17 nt, Human
uuagcuugcaccuuguc

SEQ ID NO: 2915651 - RNA, 15 nt, Human
uuagcuuggggccag

SEQ ID NO: 2915652 - RNA, 20 nt, Human
uuagcuuggggccagggaag

SEQ ID NO: 2915653 - RNA, 12 nt, Human
uuagcuuccuua

SEQ ID NO: 2915654 - RNA, 13 nt, Human
uuagcuuccuuaa

SEQ ID NO: 2915655 - RNA, 15 nt, Human
uuagcuuugcucugc

SEQ ID NO: 2915656 - RNA, 19 nt, Human
uuaggaaauaaaaccuuuc

SEQ ID NO: 2915657 - RNA, 18 nt, Human
uuaggaaauaaaaccuuu

SEQ ID NO: 2915658 - RNA, 17 nt, Human
uuaggaaauaaaaccuu

SEQ ID NO: 2915659 - RNA, 15 nt, Human
uuaggaaauaaaacc

SEQ ID NO: 2915660 - RNA, 21 nt, Human
uuaggaaauaaaaccuuucaa

SEQ ID NO: 2915661 - RNA, 20 nt, Human
uuaggaaauaaaaccuuuca

SEQ ID NO: 2915662 - RNA, 17 nt, Human
uuaggaacuucagagau

SEQ ID NO: 2915663 - RNA, 12 nt, Human
uuaggaaauaaa

SEQ ID NO: 2915664 - RNA, 11 nt, Human
uuaggaaauaa

SEQ ID NO: 2915665 - RNA, 18 nt, Human
uuagcuuuuuaauuguug

SEQ ID NO: 2915666 - RNA, 17 nt, Human
uuagcuuuuucaucccc

SEQ ID NO: 2915667 - RNA, 18 nt, Human
uuagcuuuuucauccccu

SEQ ID NO: 2915668 - RNA, 18 nt, Human
uuaggaaaaucacuuugu

SEQ ID NO: 2915669 - RNA, 21 nt, Human
uuaggaaaaucacuuugucua

SEQ ID NO: 2915670 - RNA, 18 nt, Human
uuaggaaaggaugaucaa

SEQ ID NO: 2915671 - RNA, 19 nt, Human
uuagcuuugcucugccaac

SEQ ID NO: 2915672 - RNA, 16 nt, Human
uuagcuuuuuaauugu

SEQ ID NO: 2915673 - RNA, 17 nt, Human
uuagcuuuuuaauuguu

SEQ ID NO: 2915674 - RNA, 12 nt, Human
uuagcuuugugu

SEQ ID NO: 2915675 - RNA, 13 nt, Human
uuagcuuuguguu

SEQ ID NO: 2915676 - RNA, 20 nt, Human
uuagcuuuguguuugguuua

SEQ ID NO: 2915677 - RNA, 22 nt, Human
uuagcuuuguguuugguuuaca

SEQ ID NO: 2915678 - RNA, 18 nt, Human
uuagcuuuuuaaaacauu

SEQ ID NO: 2915679 - RNA, 20 nt, Human
uuagcuuuuuaaaacauuag

SEQ ID NO: 2915680 - RNA, 17 nt, Human
uuagaaaaauuccuaag

SEQ ID NO: 2915681 - RNA, 15 nt, Human
uuagaaaacaaaauu

SEQ ID NO: 2915682 - RNA, 14 nt, Human
uuacuuuguguuca

SEQ ID NO: 2915683 - RNA, 17 nt, Human
uuacuuuuaaacaguga

SEQ ID NO: 2915684 - RNA, 21 nt, Human
uuacuuuuauuugcaacauuu

SEQ ID NO: 2915685 - RNA, 23 nt, Human
uuacuuuuauuugcaacauuuac

SEQ ID NO: 2915686 - RNA, 22 nt, Human
uuacuuuuuuuuuuuuuuggua

SEQ ID NO: 2915687 - RNA, 23 nt, Human
uuacuuuuuuuuuuuuuugguag

SEQ ID NO: 2915688 - RNA, 15 nt, Human
uuagaaaaaaauuac

SEQ ID NO: 2915689 - RNA, 16 nt, Human
uuagaaaaaaauuacu

SEQ ID NO: 2915690 - RNA, 23 nt, Human
uuagaaaaaaguuuacaacauaa

SEQ ID NO: 2915691 - RNA, 18 nt, Human
uuacuuuaaaaggagcca

SEQ ID NO: 2915692 - RNA, 17 nt, Human
uuacuuuaaaaggagcc

SEQ ID NO: 2915693 - RNA, 14 nt, Human
uuacuucuugcccu

SEQ ID NO: 2915694 - RNA, 13 nt, Human
uuacuuucuuaau

SEQ ID NO: 2915695 - RNA, 15 nt, Human
uuacuuucuuaaugu

SEQ ID NO: 2915696 - RNA, 21 nt, Human
uuacuuuccuuuccccagccc

SEQ ID NO: 2915697 - RNA, 23 nt, Human
uuacuguuuugaaaucaaugcaa

SEQ ID NO: 2915698 - RNA, 16 nt, Human
uuacuuuaaacuuguc

SEQ ID NO: 2915699 - RNA, 15 nt, Human
uuacuuuaucacuuu

SEQ ID NO: 2915700 - RNA, 16 nt, Human
uuacuuuaucacuuuu

SEQ ID NO: 2915701 - RNA, 15 nt, Human
uuacuuuauguuugu

SEQ ID NO: 2915702 - RNA, 11 nt, Human
uuacuuucccu

SEQ ID NO: 2915703 - RNA, 17 nt, Human
uuacuuucccuugcuuu

SEQ ID NO: 2915704 - RNA, 23 nt, Human
uuacuuucccuugcuuuucccuc

SEQ ID NO: 2915705 - RNA, 14 nt, Human
uuagagaacugaaa

SEQ ID NO: 2915706 - RNA, 19 nt, Human
uuagagaacugaaaagaga

SEQ ID NO: 2915707 - RNA, 21 nt, Human
uuagagaacugaaaagagagc

SEQ ID NO: 2915708 - RNA, 19 nt, Human
uuagagagggaccaugugu

SEQ ID NO: 2915709 - RNA, 12 nt, Human
uuagagaaaaua

SEQ ID NO: 2915710 - RNA, 21 nt, Human
uuagacucaucaaucaaauaa

SEQ ID NO: 2915711 - RNA, 18 nt, Human
uuagacuacauuuagaga

SEQ ID NO: 2915712 - RNA, 14 nt, Human
uuagacuacauuua

SEQ ID NO: 2915713 - RNA, 19 nt, Human
uuagacucaucuuacugua

SEQ ID NO: 2915714 - RNA, 21 nt, Human
uuagacucaugguguguuaca

SEQ ID NO: 2915715 - RNA, 22 nt, Human
uuagacucaugguguguuacac

SEQ ID NO: 2915716 - RNA, 13 nt, Human
uuagacuccuccu

SEQ ID NO: 2915717 - RNA, 15 nt, Human
uuagacuuacuauua

SEQ ID NO: 2915718 - RNA, 14 nt, Human
uuagacuguagccu

SEQ ID NO: 2915719 - RNA, 20 nt, Human
uuagacuguagccuggauau

SEQ ID NO: 2915720 - RNA, 17 nt, Human
uuagaccccauacaagu

SEQ ID NO: 2915721 - RNA, 12 nt, Human
uuagaccaagga

SEQ ID NO: 2915722 - RNA, 13 nt, Human
uuagaccaaggaa

SEQ ID NO: 2915723 - RNA, 15 nt, Human
uuagaccgcucucuu

SEQ ID NO: 2915724 - RNA, 16 nt, Human
uuagaccgcucucuuu

SEQ ID NO: 2915725 - RNA, 18 nt, Human
uuagaccgcucucuuuuc

SEQ ID NO: 2915726 - RNA, 22 nt, Human
uuagaccgcucucuuuucugua

SEQ ID NO: 2915727 - RNA, 13 nt, Human
uuagacauaacaa

SEQ ID NO: 2915728 - RNA, 12 nt, Human
uuagaaaaugug

SEQ ID NO: 2915729 - RNA, 13 nt, Human
uuagaaaaugugu

SEQ ID NO: 2915730 - RNA, 13 nt, Human
uuacuaugccugu

SEQ ID NO: 2915731 - RNA, 21 nt, Human
uuacuaucaugucaaacguga

SEQ ID NO: 2915732 - RNA, 19 nt, Human
uuacuaucaugucaaacgu

SEQ ID NO: 2915733 - RNA, 13 nt, Human
uuacuaccuuauc

SEQ ID NO: 2915734 - RNA, 21 nt, Human
uuacuacuucucucuguauuu

SEQ ID NO: 2915735 - RNA, 20 nt, Human
uuacuagcaccugccaggga

SEQ ID NO: 2915736 - RNA, 15 nt, Human
uuacuagcuuuucaa

SEQ ID NO: 2915737 - RNA, 14 nt, Human
uuacuacaguuuuu

SEQ ID NO: 2915738 - RNA, 15 nt, Human
uuacuacaguuuuua

SEQ ID NO: 2915739 - RNA, 22 nt, Human
uuacuacaguuuuuaacucuac

SEQ ID NO: 2915740 - RNA, 16 nt, Human
uuacuaauguaaaaug

SEQ ID NO: 2915741 - RNA, 21 nt, Human
uuacuaagccacaagaaauuu

SEQ ID NO: 2915742 - RNA, 22 nt, Human
uuacuaagccacaagaaauuug

SEQ ID NO: 2915743 - RNA, 21 nt, Human
uuacuaagcauagcaaacaga

SEQ ID NO: 2915744 - RNA, 17 nt, Human
uuacuaagccacaagaa

SEQ ID NO: 2915745 - RNA, 18 nt, Human
uuacuaagccacaagaaa

SEQ ID NO: 2915746 - RNA, 20 nt, Human
uuacuaagccacaagaaauu

SEQ ID NO: 2915747 - RNA, 18 nt, Human
uuacacaaugguuuuuaa

SEQ ID NO: 2915748 - RNA, 20 nt, Human
uuacacaaugguuuuuaaau

SEQ ID NO: 2915749 - RNA, 22 nt, Human
uuacacaaugguuuuuaaauuu

SEQ ID NO: 2915750 - RNA, 22 nt, Human
uuacuaaagaaaauaucugaaa

SEQ ID NO: 2915751 - RNA, 20 nt, Human
uuacacaaaggggaucauaa

SEQ ID NO: 2915752 - RNA, 23 nt, Human
uuacuaaagaaaauaucugaaau

SEQ ID NO: 2915753 - RNA, 16 nt, Human
uuacuguggaggaagg

SEQ ID NO: 2915754 - RNA, 17 nt, Human
uuacuguggaggaagga

SEQ ID NO: 2915755 - RNA, 18 nt, Human
uuacuguggaggaaggau

SEQ ID NO: 2915756 - RNA, 20 nt, Human
uuacuguggaggaaggauug

SEQ ID NO: 2915757 - RNA, 14 nt, Human
uuacugugaaacug

SEQ ID NO: 2915758 - RNA, 21 nt, Human
uuacugugcauugggauuuua

SEQ ID NO: 2915759 - RNA, 14 nt, Human
uuacuguggaggaa

SEQ ID NO: 2915760 - RNA, 14 nt, Human
uuacuauauauaua

SEQ ID NO: 2915761 - RNA, 22 nt, Human
uuacuauauauauaugccuuuu

SEQ ID NO: 2915762 - RNA, 18 nt, Human
uuacuaugccugugucuu

SEQ ID NO: 2915763 - RNA, 14 nt, Human
uuacuaugccugug

SEQ ID NO: 2915764 - RNA, 14 nt, Human
uuacuguguuuuau

SEQ ID NO: 2915765 - RNA, 23 nt, Human
uuacuguggaggaaggauuguaa

SEQ ID NO: 2915766 - RNA, 20 nt, Human
uuacuguguuuuauaaaaua

SEQ ID NO: 2915767 - RNA, 15 nt, Human
uuacuguuaaccauu

SEQ ID NO: 2915768 - RNA, 11 nt, Human
uuacuguucuu

SEQ ID NO: 2915769 - RNA, 12 nt, Human
uuacuguucuug

SEQ ID NO: 2915770 - RNA, 13 nt, Human
uuacuguucuugc

SEQ ID NO: 2915771 - RNA, 14 nt, Human
uuacuguucuugcu

SEQ ID NO: 2915772 - RNA, 15 nt, Human
uuacuguucuugcug

SEQ ID NO: 2915773 - RNA, 16 nt, Human
uuacuguucuugcugc

SEQ ID NO: 2915774 - RNA, 17 nt, Human
uuacuguucuugcugcu

SEQ ID NO: 2915775 - RNA, 18 nt, Human
uuacuguucuugcugcua

SEQ ID NO: 2915776 - RNA, 19 nt, Human
uuacuguucuugcugcuag

SEQ ID NO: 2915777 - RNA, 20 nt, Human
uuacuguucuugcugcuaga

SEQ ID NO: 2915778 - RNA, 21 nt, Human
uuacuguucuugcugcuagaa

SEQ ID NO: 2915779 - RNA, 22 nt, Human
uuacuguucuugcugcuagaac

SEQ ID NO: 2915780 - RNA, 14 nt, Human
uuacuguugauaau

SEQ ID NO: 2915781 - RNA, 21 nt, Human
uuacuguugauaauucuuauu

SEQ ID NO: 2915782 - RNA, 15 nt, Human
uuacuguuuauuucu

SEQ ID NO: 2915783 - RNA, 16 nt, Human
uuacuguuuauuucug

SEQ ID NO: 2915784 - RNA, 18 nt, Human
uuacuguuuauuucuguu

SEQ ID NO: 2915785 - RNA, 12 nt, Human
uuacuucugcua

SEQ ID NO: 2915786 - RNA, 11 nt, Human
uuacuucugcu

SEQ ID NO: 2915787 - RNA, 23 nt, Human
uuacuuaucauccacauuguuuu

SEQ ID NO: 2915788 - RNA, 17 nt, Human
uuacuuaucccugccca

SEQ ID NO: 2915789 - RNA, 21 nt, Human
uuacuucacuauacaaacaaa

SEQ ID NO: 2915790 - RNA, 17 nt, Human
uuacuuaucauccacau

SEQ ID NO: 2915791 - RNA, 13 nt, Human
uuacuuaaagauu

SEQ ID NO: 2915792 - RNA, 14 nt, Human
uuacuuaaagauuu

SEQ ID NO: 2915793 - RNA, 19 nt, Human
uuacuuaaagauuuaucaa

SEQ ID NO: 2915794 - RNA, 20 nt, Human
uuacuuaaagauuuaucaaa

SEQ ID NO: 2915795 - RNA, 22 nt, Human
uuacuuaaagauuuaucaaauc

SEQ ID NO: 2915796 - RNA, 13 nt, Human
uucccuucucuca

SEQ ID NO: 2915797 - RNA, 20 nt, Human
uucccuggggaaaacuugca

SEQ ID NO: 2915798 - RNA, 15 nt, Human
uucccuucccuucca

SEQ ID NO: 2915799 - RNA, 17 nt, Human
uucccuuccuccauccu

SEQ ID NO: 2915800 - RNA, 12 nt, Human
uucccuuccucu

SEQ ID NO: 2915801 - RNA, 13 nt, Human
uucccuuccucuu

SEQ ID NO: 2915802 - RNA, 17 nt, Human
uucccuuccucuucggc

SEQ ID NO: 2915803 - RNA, 19 nt, Human
uucccugcauuucugaguu

SEQ ID NO: 2915804 - RNA, 19 nt, Human
uucccugcgccugugaugc

SEQ ID NO: 2915805 - RNA, 12 nt, Human
uucccugcacua

SEQ ID NO: 2915806 - RNA, 22 nt, Human
uucccugcacuaaagccagccu

SEQ ID NO: 2915807 - RNA, 19 nt, Human
uucccugauugaccugcuc

SEQ ID NO: 2915808 - RNA, 21 nt, Human
uucccugaaacacgaaacuug

SEQ ID NO: 2915809 - RNA, 22 nt, Human
uucccugaaacacgaaacuugu

SEQ ID NO: 2915810 - RNA, 23 nt, Human
uucccugaaacacgaaacuuguu

SEQ ID NO: 2915811 - RNA, 20 nt, Human
uucccucuuuggcuccccug

SEQ ID NO: 2915812 - RNA, 13 nt, Human
uucccucuuuucu

SEQ ID NO: 2915813 - RNA, 14 nt, Human
uucccucuuuucuu

SEQ ID NO: 2915814 - RNA, 15 nt, Human
uucccucuuuucuua

SEQ ID NO: 2915815 - RNA, 17 nt, Human
uucccucuuuucuuacu

SEQ ID NO: 2915816 - RNA, 19 nt, Human
uucccucuuuucuuacucc

SEQ ID NO: 2915817 - RNA, 23 nt, Human
uucccucuuuucuuacuccuccu

SEQ ID NO: 2915818 - RNA, 13 nt, Human
uucccucugcuca

SEQ ID NO: 2915819 - RNA, 14 nt, Human
uucccucugcucag

SEQ ID NO: 2915820 - RNA, 15 nt, Human
uucccucugcucagc

SEQ ID NO: 2915821 - RNA, 17 nt, Human
uucccucugcucagcca

SEQ ID NO: 2915822 - RNA, 20 nt, Human
uucccucuuucuuauaauac

SEQ ID NO: 2915823 - RNA, 14 nt, Human
uucccucuuuggcu

SEQ ID NO: 2915824 - RNA, 16 nt, Human
uucccucuuuggcucc

SEQ ID NO: 2915825 - RNA, 15 nt, Human
uucccugaauguauu

SEQ ID NO: 2915826 - RNA, 14 nt, Human
uucccucucccugu

SEQ ID NO: 2915827 - RNA, 14 nt, Human
uucccucucaucuc

SEQ ID NO: 2915828 - RNA, 14 nt, Human
uuccuauauccugu

SEQ ID NO: 2915829 - RNA, 22 nt, Human
uuccuauauaguuuauugacaa

SEQ ID NO: 2915830 - RNA, 21 nt, Human
uuccuauauaguuuauugaca

SEQ ID NO: 2915831 - RNA, 20 nt, Human
uuccuauaacuugaugcaug

SEQ ID NO: 2915832 - RNA, 21 nt, Human
uuccuauaacuugaugcaugu

SEQ ID NO: 2915833 - RNA, 23 nt, Human
uucccuugaaauuuuaaacuaua

SEQ ID NO: 2915834 - RNA, 17 nt, Human
uucccuuuggagaugcu

SEQ ID NO: 2915835 - RNA, 14 nt, Human
uucccuuugucuuu

SEQ ID NO: 2915836 - RNA, 17 nt, Human
uucccuuugucuuucaa

SEQ ID NO: 2915837 - RNA, 19 nt, Human
uuccuauauaguuuauuga

SEQ ID NO: 2915838 - RNA, 21 nt, Human
uuccucacaccaggcuugccu

SEQ ID NO: 2915839 - RNA, 14 nt, Human
uuccucacaguccc

SEQ ID NO: 2915840 - RNA, 16 nt, Human
uuccuccagcugcacc

SEQ ID NO: 2915841 - RNA, 17 nt, Human
uuccuccagcugcacca

SEQ ID NO: 2915842 - RNA, 22 nt, Human
uuccuccagcugcaccagagca

SEQ ID NO: 2915843 - RNA, 13 nt, Human
uuccuccauccua

SEQ ID NO: 2915844 - RNA, 15 nt, Human
uuccucaaauguuga

SEQ ID NO: 2915845 - RNA, 17 nt, Human
uuccucaaauguugaca

SEQ ID NO: 2915846 - RNA, 19 nt, Human
uuccuauuuguuuucaugg

SEQ ID NO: 2915847 - RNA, 21 nt, Human
uuccuauuuguuuucauggug

SEQ ID NO: 2915848 - RNA, 15 nt, Human
uuccuauuucuuaua

SEQ ID NO: 2915849 - RNA, 18 nt, Human
uuccuauuugccaugggc

SEQ ID NO: 2915850 - RNA, 20 nt, Human
uuccuauuugccaugggcuu

SEQ ID NO: 2915851 - RNA, 22 nt, Human
uuccuauuugccaugggcuuca

SEQ ID NO: 2915852 - RNA, 23 nt, Human
uuccuauuugccaugggcuucac

SEQ ID NO: 2915853 - RNA, 24 nt, Human
uuccuugagacacggagcccagcc

SEQ ID NO: 2915854 - RNA, 15 nt, Human
uuccuuggcuggugc

SEQ ID NO: 2915855 - RNA, 13 nt, Human
uuccuuggcuggu

SEQ ID NO: 2915856 - RNA, 16 nt, Human
uucggcucuggguggg

SEQ ID NO: 2915857 - RNA, 18 nt, Human
uucggcucugggugggca

SEQ ID NO: 2915858 - RNA, 18 nt, Human
uucgggcgucugugugcg

SEQ ID NO: 2915859 - RNA, 15 nt, Human
uucuaaagauggaaa

SEQ ID NO: 2915860 - RNA, 13 nt, Human
uucuaaaagaaua

SEQ ID NO: 2915861 - RNA, 14 nt, Human
uucuaaaagaauau

SEQ ID NO: 2915862 - RNA, 13 nt, Human
uucuaaagaugga

SEQ ID NO: 2915863 - RNA, 12 nt, Human
uucuaaagauuc

SEQ ID NO: 2915864 - RNA, 13 nt, Human
uucuaaagauucu

SEQ ID NO: 2915865 - RNA, 14 nt, Human
uucuaaagauucua

SEQ ID NO: 2915866 - RNA, 23 nt, Human
uucuaaagauucuauaguucuag

SEQ ID NO: 2915867 - RNA, 16 nt, Human
uucuaaagauucuaua

SEQ ID NO: 2915868 - RNA, 22 nt, Human
uucuaaagauucuauaguucua

SEQ ID NO: 2915869 - RNA, 14 nt, Human
uucuaaaaagauua

SEQ ID NO: 2915870 - RNA, 17 nt, Human
uucuaaaaagauuagca

SEQ ID NO: 2915871 - RNA, 13 nt, Human
uucuaaaaaacag

SEQ ID NO: 2915872 - RNA, 14 nt, Human
uucguucuuuuuaa

SEQ ID NO: 2915873 - RNA, 14 nt, Human
uucguuucuguaua

SEQ ID NO: 2915874 - RNA, 16 nt, Human
uucguuucuguauaca

SEQ ID NO: 2915875 - RNA, 20 nt, Human
uuccugauaugauuuaaaac

SEQ ID NO: 2915876 - RNA, 21 nt, Human
uuccuccccauuagagucagc

SEQ ID NO: 2915877 - RNA, 15 nt, Human
uuccugcauuuguga

SEQ ID NO: 2915878 - RNA, 16 nt, Human
uuccugcauuugugaa

SEQ ID NO: 2915879 - RNA, 18 nt, Human
uuccugcauuugugaaau

SEQ ID NO: 2915880 - RNA, 13 nt, Human
uuccuggaugucu

SEQ ID NO: 2915881 - RNA, 15 nt, Human
uuccuggaugucuga

SEQ ID NO: 2915882 - RNA, 19 nt, Human
uuccuggacacucagaccu

SEQ ID NO: 2915883 - RNA, 22 nt, Human
uuccuugagacacggagcccag

SEQ ID NO: 2915884 - RNA, 17 nt, Human
uuccuugagaaaaacaa

SEQ ID NO: 2915885 - RNA, 15 nt, Human
uuccuugaccuuccu

SEQ ID NO: 2915886 - RNA, 18 nt, Human
uuccuugaccuuccucug

SEQ ID NO: 2915887 - RNA, 19 nt, Human
uuccuugaccuuccucugg

SEQ ID NO: 2915888 - RNA, 12 nt, Human
uuccuucuuuga

SEQ ID NO: 2915889 - RNA, 13 nt, Human
uuccuucuuugau

SEQ ID NO: 2915890 - RNA, 14 nt, Human
uuccuucuuugaua

SEQ ID NO: 2915891 - RNA, 19 nt, Human
uuccuucuuugauaauguu

SEQ ID NO: 2915892 - RNA, 22 nt, Human
uuccuucuuugauaauguuaaa

SEQ ID NO: 2915893 - RNA, 21 nt, Human
uuccagagaguggcuccuccc

SEQ ID NO: 2915894 - RNA, 17 nt, Human
uuccagagaguggcucc

SEQ ID NO: 2915895 - RNA, 18 nt, Human
uuccagagaguggcuccu

SEQ ID NO: 2915896 - RNA, 19 nt, Human
uuccagagaguggcuccuc

SEQ ID NO: 2915897 - RNA, 20 nt, Human
uuccagagaguggcuccucc

SEQ ID NO: 2915898 - RNA, 16 nt, Human
uuccacucugauagaa

SEQ ID NO: 2915899 - RNA, 18 nt, Human
uuccacucugauagaauu

SEQ ID NO: 2915900 - RNA, 16 nt, Human
uuccacugaaguagug

SEQ ID NO: 2915901 - RNA, 17 nt, Human
uuccaaaugcaauuuga

SEQ ID NO: 2915902 - RNA, 21 nt, Human
uuccaaaauaauuuuaagaaa

SEQ ID NO: 2915903 - RNA, 13 nt, Human
uuccaaaauaauu

SEQ ID NO: 2915904 - RNA, 13 nt, Human
uuccaaaauucuu

SEQ ID NO: 2915905 - RNA, 14 nt, Human
uuccaaaauucuua

SEQ ID NO: 2915906 - RNA, 16 nt, Human
uuccaaaauucuuauu

SEQ ID NO: 2915907 - RNA, 20 nt, Human
uuccaaaauucuuauuuuuc

SEQ ID NO: 2915908 - RNA, 21 nt, Human
uuccaaacaacagaaagucau

SEQ ID NO: 2915909 - RNA, 19 nt, Human
uuccaaauaauaaagucua

SEQ ID NO: 2915910 - RNA, 21 nt, Human
uuccaaagaguagaauugcau

SEQ ID NO: 2915911 - RNA, 13 nt, Human
uuccaaagaaugu

SEQ ID NO: 2915912 - RNA, 20 nt, Human
uuccaaagaauguuagagca

SEQ ID NO: 2915913 - RNA, 21 nt, Human
uuccaaagaauguuagagcac

SEQ ID NO: 2915914 - RNA, 15 nt, Human
uuccaaagaauucuu

SEQ ID NO: 2915915 - RNA, 16 nt, Human
uuccaaagaauucuua

SEQ ID NO: 2915916 - RNA, 16 nt, Human
uucauuuccugugucu

SEQ ID NO: 2915917 - RNA, 15 nt, Human
uucauuuccuguguc

SEQ ID NO: 2915918 - RNA, 12 nt, Human
uuccaaaauaau

SEQ ID NO: 2915919 - RNA, 16 nt, Human
uucaggaacaccccca

SEQ ID NO: 2915920 - RNA, 18 nt, Human
uucauuugagaaguaaac

SEQ ID NO: 2915921 - RNA, 16 nt, Human
uucaucuuuuaaagaa

SEQ ID NO: 2915922 - RNA, 21 nt, Human
uucaucuuuugaggcuucugu

SEQ ID NO: 2915923 - RNA, 22 nt, Human
uucaucuuuugaggcuucuguu

SEQ ID NO: 2915924 - RNA, 23 nt, Human
uuccccauaacucaauggccuaa

SEQ ID NO: 2915925 - RNA, 15 nt, Human
uuccccagcccaggg

SEQ ID NO: 2915926 - RNA, 15 nt, Human
uuccccaucuggguc

SEQ ID NO: 2915927 - RNA, 19 nt, Human
uuccccaugucucgacuca

SEQ ID NO: 2915928 - RNA, 11 nt, Human
uuccccauggg

SEQ ID NO: 2915929 - RNA, 18 nt, Human
uuccccaucuucuaaacc

SEQ ID NO: 2915930 - RNA, 17 nt, Human
uuccccaucuucuaaac

SEQ ID NO: 2915931 - RNA, 21 nt, Human
uuccccccacucuccccacac

SEQ ID NO: 2915932 - RNA, 21 nt, Human
uuccccccauguuguaaugcu

SEQ ID NO: 2915933 - RNA, 19 nt, Human
uuccccccacucuccccac

SEQ ID NO: 2915934 - RNA, 18 nt, Human
uuccccccacucucccca

SEQ ID NO: 2915935 - RNA, 18 nt, Human
uucccccaccgguccagc

SEQ ID NO: 2915936 - RNA, 22 nt, Human
uucccccaccgguccagcuggc

SEQ ID NO: 2915937 - RNA, 23 nt, Human
uucccccaccgguccagcuggcc

SEQ ID NO: 2915938 - RNA, 14 nt, Human
uucccccacuaccg

SEQ ID NO: 2915939 - RNA, 18 nt, Human
uuccccauuccuacccac

SEQ ID NO: 2915940 - RNA, 14 nt, Human
uucccccauagcca

SEQ ID NO: 2915941 - RNA, 17 nt, Human
uucccccauagccaccc

SEQ ID NO: 2915942 - RNA, 15 nt, Human
uucccccauagccac

SEQ ID NO: 2915943 - RNA, 18 nt, Human
uucccccauagccacccc

SEQ ID NO: 2915944 - RNA, 12 nt, Human
uuccccccacuc

SEQ ID NO: 2915945 - RNA, 17 nt, Human
uucccauguagcccccu

SEQ ID NO: 2915946 - RNA, 14 nt, Human
uucccauucuugca

SEQ ID NO: 2915947 - RNA, 20 nt, Human
uucccauugcaucaccucug

SEQ ID NO: 2915948 - RNA, 23 nt, Human
uucccauugcaucaccucuguaa

SEQ ID NO: 2915949 - RNA, 16 nt, Human
uucccaucuuuacucc

SEQ ID NO: 2915950 - RNA, 15 nt, Human
uucccaucgcuguca

SEQ ID NO: 2915951 - RNA, 20 nt, Human
uucccaugacccaggcuggg

SEQ ID NO: 2915952 - RNA, 18 nt, Human
uucccaugacccaggcug

SEQ ID NO: 2915953 - RNA, 19 nt, Human
uucccaugacccaggcugg

SEQ ID NO: 2915954 - RNA, 16 nt, Human
uuccauuccauuguuu

SEQ ID NO: 2915955 - RNA, 21 nt, Human
uuccauugcuuugaaaaaguu

SEQ ID NO: 2915956 - RNA, 16 nt, Human
uuccauugguccaaga

SEQ ID NO: 2915957 - RNA, 20 nt, Human
uuccauucuggauuuuguca

SEQ ID NO: 2915958 - RNA, 21 nt, Human
uucccauaccacccaaugcug

SEQ ID NO: 2915959 - RNA, 17 nt, Human
uuccauugguccaagau

SEQ ID NO: 2915960 - RNA, 19 nt, Human
uuccauugguccaagauuc

SEQ ID NO: 2915961 - RNA, 14 nt, Human
uucccaucgcuguc

SEQ ID NO: 2915962 - RNA, 14 nt, Human
uuccagaugugaug

SEQ ID NO: 2915963 - RNA, 22 nt, Human
uuccagcaauucuccugccuca

SEQ ID NO: 2915964 - RNA, 21 nt, Human
uuccagcaauucuccugccuc

SEQ ID NO: 2915965 - RNA, 20 nt, Human
uuccagcaauucuccugccu

SEQ ID NO: 2915966 - RNA, 16 nt, Human
uucaacgcagcccugc

SEQ ID NO: 2915967 - RNA, 19 nt, Human
uucaacgcagcccugcuuu

SEQ ID NO: 2915968 - RNA, 15 nt, Human
uucaacguuucuuca

SEQ ID NO: 2915969 - RNA, 18 nt, Human
uucaacguuucuucacuu

SEQ ID NO: 2915970 - RNA, 11 nt, Human
uucaacuauuu

SEQ ID NO: 2915971 - RNA, 12 nt, Human
uucaacuauuuu

SEQ ID NO: 2915972 - RNA, 17 nt, Human
uucaacuauuuuauuau

SEQ ID NO: 2915973 - RNA, 18 nt, Human
uucaacuauuuuauuauc

SEQ ID NO: 2915974 - RNA, 20 nt, Human
uucaacgcagcccugcuuug

SEQ ID NO: 2915975 - RNA, 17 nt, Human
uucaacugaccagccuc

SEQ ID NO: 2915976 - RNA, 15 nt, Human
uucaacgcagcccug

SEQ ID NO: 2915977 - RNA, 15 nt, Human
uucaaauccuuccaa

SEQ ID NO: 2915978 - RNA, 16 nt, Human
uucaaauccuuccaaa

SEQ ID NO: 2915979 - RNA, 17 nt, Human
uucaaauccuuccaaaa

SEQ ID NO: 2915980 - RNA, 23 nt, Human
uucaaauccuuccaaaaauuauu

SEQ ID NO: 2915981 - RNA, 12 nt, Human
uuauuuuaugag

SEQ ID NO: 2915982 - RNA, 14 nt, Human
uuauuuuaugagaa

SEQ ID NO: 2915983 - RNA, 16 nt, Human
uuauuuuaugagaaau

SEQ ID NO: 2915984 - RNA, 18 nt, Human
uuauuuuaugagaaaugu

SEQ ID NO: 2915985 - RNA, 19 nt, Human
uuauuuuaugagaaaugua

SEQ ID NO: 2915986 - RNA, 20 nt, Human
uuauuuuaugagaaauguaa

SEQ ID NO: 2915987 - RNA, 23 nt, Human
uuauuuuaugagaaauguaaugc

SEQ ID NO: 2915988 - RNA, 19 nt, Human
uuauuuuacacagaaacac

SEQ ID NO: 2915989 - RNA, 14 nt, Human
uuauuuuauguuua

SEQ ID NO: 2915990 - RNA, 18 nt, Human
uuauuuuauguuuagaua

SEQ ID NO: 2915991 - RNA, 22 nt, Human
uucaaagcuuuuuccagaggcu

SEQ ID NO: 2915992 - RNA, 22 nt, Human
uuauugugaaugauucauguua

SEQ ID NO: 2915993 - RNA, 21 nt, Human
uucaaagguucuagguuucaa

SEQ ID NO: 2915994 - RNA, 12 nt, Human
uucaaagguucu

SEQ ID NO: 2915995 - RNA, 16 nt, Human
uucaaagguucuaggu

SEQ ID NO: 2915996 - RNA, 12 nt, Human
uuauuuuaagac

SEQ ID NO: 2915997 - RNA, 20 nt, Human
uuauuuuaagcauugugagu

SEQ ID NO: 2915998 - RNA, 17 nt, Human
uuauuuuacacagaaac

SEQ ID NO: 2915999 - RNA, 16 nt, Human
uuauuuuacacagaaa

SEQ ID NO: 2916000 - RNA, 14 nt, Human
uuauuguauaaacu

SEQ ID NO: 2916001 - RNA, 21 nt, Human
uuauuguauaaacuaucaguu

SEQ ID NO: 2916002 - RNA, 22 nt, Human
uuauuguauaaacuaucaguuu

SEQ ID NO: 2916003 - RNA, 14 nt, Human
uuauuguggauaac

SEQ ID NO: 2916004 - RNA, 19 nt, Human
uuauuguggauaacaaaga

SEQ ID NO: 2916005 - RNA, 20 nt, Human
uuauuguggauaacaaagau

SEQ ID NO: 2916006 - RNA, 21 nt, Human
uuauuguggauaacaaagaua

SEQ ID NO: 2916007 - RNA, 23 nt, Human
uuauuguggauaacaaagauauc

SEQ ID NO: 2916008 - RNA, 20 nt, Human
uuauugugguaggccuuuua

SEQ ID NO: 2916009 - RNA, 13 nt, Human
uuauugcuuuuau

SEQ ID NO: 2916010 - RNA, 14 nt, Human
uuauugaguuugua

SEQ ID NO: 2916011 - RNA, 19 nt, Human
uuauuggccugaaaugauc

SEQ ID NO: 2916012 - RNA, 15 nt, Human
uuauugcuguugcuu

SEQ ID NO: 2916013 - RNA, 15 nt, Human
uuauugcuuaguaaa

SEQ ID NO: 2916014 - RNA, 17 nt, Human
uuauugcuuaguaaaau

SEQ ID NO: 2916015 - RNA, 17 nt, Human
uuauugcuuauugcuua

SEQ ID NO: 2916016 - RNA, 20 nt, Human
uuauugcuuauugcuuagua

SEQ ID NO: 2916017 - RNA, 15 nt, Human
uuauugcgcugcuac

SEQ ID NO: 2916018 - RNA, 14 nt, Human
uuauugcuaguauu

SEQ ID NO: 2916019 - RNA, 16 nt, Human
uuauugcuaguauuug

SEQ ID NO: 2916020 - RNA, 17 nt, Human
uuauugcuaguauuuga

SEQ ID NO: 2916021 - RNA, 18 nt, Human
uuauugcuaguauuugaa

SEQ ID NO: 2916022 - RNA, 19 nt, Human
uuauugcuaguauuugaau

SEQ ID NO: 2916023 - RNA, 20 nt, Human
uuauugcuaguauuugaauu

SEQ ID NO: 2916024 - RNA, 13 nt, Human
uuauugcugauuu

SEQ ID NO: 2916025 - RNA, 17 nt, Human
uuauugcugauuuuaau

SEQ ID NO: 2916026 - RNA, 18 nt, Human
uuauugcugauuuuaaug

SEQ ID NO: 2916027 - RNA, 19 nt, Human
uuauuguacagcuguuuaa

SEQ ID NO: 2916028 - RNA, 12 nt, Human
uuauuguaaauu

SEQ ID NO: 2916029 - RNA, 23 nt, Human
uucagagcugacacaggaugaag

SEQ ID NO: 2916030 - RNA, 15 nt, Human
uucagagaggccuuu

SEQ ID NO: 2916031 - RNA, 23 nt, Human
uucagagauuuauauaaauguaa

SEQ ID NO: 2916032 - RNA, 19 nt, Human
uucacucuccuaugccuuu

SEQ ID NO: 2916033 - RNA, 14 nt, Human
uucagaguuuucug

SEQ ID NO: 2916034 - RNA, 16 nt, Human
uucagaguuuucuggg

SEQ ID NO: 2916035 - RNA, 18 nt, Human
uucagaguuuucugggua

SEQ ID NO: 2916036 - RNA, 24 nt, Human
uucacuccggugugccugcagccc

SEQ ID NO: 2916037 - RNA, 23 nt, Human
uucacuccggugugccugcagcc

SEQ ID NO: 2916038 - RNA, 14 nt, Human
uucacucacuguca

SEQ ID NO: 2916039 - RNA, 19 nt, Human
uucacucacugucaaugau

SEQ ID NO: 2916040 - RNA, 13 nt, Human
uucacuccagccu

SEQ ID NO: 2916041 - RNA, 17 nt, Human
uucacucccccuaaacc

SEQ ID NO: 2916042 - RNA, 22 nt, Human
uucacuccggugugccugcagc

SEQ ID NO: 2916043 - RNA, 21 nt, Human
uucacuccggugugccugcag

SEQ ID NO: 2916044 - RNA, 14 nt, Human
uucacucaagcacu

SEQ ID NO: 2916045 - RNA, 15 nt, Human
uucacucaagcacug

SEQ ID NO: 2916046 - RNA, 17 nt, Human
uucacuacuuuaauaaa

SEQ ID NO: 2916047 - RNA, 13 nt, Human
uucacuagcuuug

SEQ ID NO: 2916048 - RNA, 23 nt, Human
uucacuagugaccccuucccugu

SEQ ID NO: 2916049 - RNA, 14 nt, Human
uucacuaaagcagu

SEQ ID NO: 2916050 - RNA, 13 nt, Human
uucacuaaagcag

SEQ ID NO: 2916051 - RNA, 14 nt, Human
uucacgugcagcuc

SEQ ID NO: 2916052 - RNA, 13 nt, Human
uucaccuuuguag

SEQ ID NO: 2916053 - RNA, 23 nt, Human
uucaccuucguuuacuaugccug

SEQ ID NO: 2916054 - RNA, 15 nt, Human
uucacaaacuuuuau

SEQ ID NO: 2916055 - RNA, 16 nt, Human
uucaccuccuucaauu

SEQ ID NO: 2916056 - RNA, 12 nt, Human
uucaccugagca

SEQ ID NO: 2916057 - RNA, 22 nt, Human
uucaaagggacggucaguuugg

SEQ ID NO: 2916058 - RNA, 21 nt, Human
uucaacuccucgacaucacug

SEQ ID NO: 2916059 - RNA, 15 nt, Human
uucacaaaauuucca

SEQ ID NO: 2916060 - RNA, 14 nt, Human
uucaauuuuaaaga

SEQ ID NO: 2916061 - RNA, 15 nt, Human
uucaauuuuaaagac

SEQ ID NO: 2916062 - RNA, 14 nt, Human
uuauucuacuauac

SEQ ID NO: 2916063 - RNA, 19 nt, Human
uuauucucuuuuaucuguu

SEQ ID NO: 2916064 - RNA, 17 nt, Human
uuauuccuguauguugu

SEQ ID NO: 2916065 - RNA, 19 nt, Human
uuauucuaaacagacucau

SEQ ID NO: 2916066 - RNA, 22 nt, Human
uuauuaauuguuuugcacuuuu

SEQ ID NO: 2916067 - RNA, 23 nt, Human
uuauuacagggcauucaaauggg

SEQ ID NO: 2916068 - RNA, 13 nt, Human
uuauuccuguaug

SEQ ID NO: 2916069 - RNA, 15 nt, Human
uuauuccuguauguu

SEQ ID NO: 2916070 - RNA, 19 nt, Human
uuauuccuguauguugucc

SEQ ID NO: 2916071 - RNA, 16 nt, Human
uuauuccuugaucauu

SEQ ID NO: 2916072 - RNA, 12 nt, Human
uuauuacaauuu

SEQ ID NO: 2916073 - RNA, 14 nt, Human
uuauuaaaaugauu

SEQ ID NO: 2916074 - RNA, 19 nt, Human
uuauuaaaaugauuguaaa

SEQ ID NO: 2916075 - RNA, 20 nt, Human
uuauuaaaaugauuguaaaa

SEQ ID NO: 2916076 - RNA, 21 nt, Human
uuauuaaaaugauuguaaaau

SEQ ID NO: 2916077 - RNA, 17 nt, Human
uuauggccacagcccau

SEQ ID NO: 2916078 - RNA, 11 nt, Human
uuauggccuca

SEQ ID NO: 2916079 - RNA, 18 nt, Human
uuauggccucagcugccu

SEQ ID NO: 2916080 - RNA, 15 nt, Human
uuauggccucagcug

SEQ ID NO: 2916081 - RNA, 13 nt, Human
uuauggccucagc

SEQ ID NO: 2916082 - RNA, 12 nt, Human
uuauggccucag

SEQ ID NO: 2916083 - RNA, 17 nt, Human
uuauuaaaguucuguaa

SEQ ID NO: 2916084 - RNA, 12 nt, Human
uuauuaaauaaa

SEQ ID NO: 2916085 - RNA, 15 nt, Human
uuauuaaauaaaauc

SEQ ID NO: 2916086 - RNA, 16 nt, Human
uuauuaaauaaaauca

SEQ ID NO: 2916087 - RNA, 19 nt, Human
uuauuaaauaaaaucaauu

SEQ ID NO: 2916088 - RNA, 20 nt, Human
uuauuaaauaaaaucaauuu

SEQ ID NO: 2916089 - RNA, 21 nt, Human
uuauuaaauaaaaucaauuuu

SEQ ID NO: 2916090 - RNA, 11 nt, Human
uuauucugcuc

SEQ ID NO: 2916091 - RNA, 13 nt, Human
uuauucuggaguu

SEQ ID NO: 2916092 - RNA, 20 nt, Human
uuauucuguagauucugugg

SEQ ID NO: 2916093 - RNA, 13 nt, Human
uuauucuucuaga

SEQ ID NO: 2916094 - RNA, 14 nt, Human
uuauucuucuagag

SEQ ID NO: 2916095 - RNA, 18 nt, Human
uuauucuugaaagaagaa

SEQ ID NO: 2916096 - RNA, 13 nt, Human
uuauugaagaaac

SEQ ID NO: 2916097 - RNA, 22 nt, Human
uuauugaagaaacagauaccau

SEQ ID NO: 2916098 - RNA, 22 nt, Human
uuauugaaggaagccaaauuua

SEQ ID NO: 2916099 - RNA, 23 nt, Human
uuauugaaggaagccaaauuuau

SEQ ID NO: 2916100 - RNA, 22 nt, Human
uuauugacaauaauuucagguu

SEQ ID NO: 2916101 - RNA, 14 nt, Human
uuauugacacagaa

SEQ ID NO: 2916102 - RNA, 23 nt, Human
uuauugacacagaaaauguugag

SEQ ID NO: 2916103 - RNA, 19 nt, Human
uuauugacacagaaaaugu

SEQ ID NO: 2916104 - RNA, 18 nt, Human
uuauugaaucuauuuaag

SEQ ID NO: 2916105 - RNA, 20 nt, Human
uuauugaaucuauuuaagua

SEQ ID NO: 2916106 - RNA, 18 nt, Human
uuauugacaauaauuuca

SEQ ID NO: 2916107 - RNA, 14 nt, Human
uuauugacaauaau

SEQ ID NO: 2916108 - RNA, 15 nt, Human
uuauugcccacgcug

SEQ ID NO: 2916109 - RNA, 13 nt, Human
uuauugcauuaua

SEQ ID NO: 2916110 - RNA, 15 nt, Human
uuauugcacauuguu

SEQ ID NO: 2916111 - RNA, 17 nt, Human
uuauugcacauuguuca

SEQ ID NO: 2916112 - RNA, 21 nt, Human
uuauugcaaaauagcauuugu

SEQ ID NO: 2916113 - RNA, 14 nt, Human
uuauugauauauau

SEQ ID NO: 2916114 - RNA, 23 nt, Human
uuauugagauuguccucauuucu

SEQ ID NO: 2916115 - RNA, 16 nt, Human
uuaugcuaacuguaga

SEQ ID NO: 2916116 - RNA, 15 nt, Human
uuaugcuauuaaagu

SEQ ID NO: 2916117 - RNA, 14 nt, Human
uuaugcucaggguc

SEQ ID NO: 2916118 - RNA, 20 nt, Human
uuaugcucuuuuuuacucau

SEQ ID NO: 2916119 - RNA, 21 nt, Human
uuaugcucuuuuuuacucauu

SEQ ID NO: 2916120 - RNA, 22 nt, Human
uuaugcaugaagauaauguaaa

SEQ ID NO: 2916121 - RNA, 20 nt, Human
uuaugcaauuagguuuuucc

SEQ ID NO: 2916122 - RNA, 23 nt, Human
uuaugcaauuagguuuuuccuua

SEQ ID NO: 2916123 - RNA, 19 nt, Human
uuaugcacuaaauaugaac

SEQ ID NO: 2916124 - RNA, 22 nt, Human
uuaugcacuaaauaugaacccu

SEQ ID NO: 2916125 - RNA, 16 nt, Human
uuaugcacuuauaagg

SEQ ID NO: 2916126 - RNA, 19 nt, Human
uuaugcacuuauaaggugu

SEQ ID NO: 2916127 - RNA, 18 nt, Human
uuaugcagauagaaucaa

SEQ ID NO: 2916128 - RNA, 22 nt, Human
uuaguugccuaagcauugccug

SEQ ID NO: 2916129 - RNA, 17 nt, Human
uuaucuuucgugauaaa

SEQ ID NO: 2916130 - RNA, 24 nt, Human
uuaucuuucgugauaaacuuugcu

SEQ ID NO: 2916131 - RNA, 22 nt, Human
uuaugcaaggaaggaaagaaag

SEQ ID NO: 2916132 - RNA, 18 nt, Human
uuaugcaaggaaggaaag

SEQ ID NO: 2916133 - RNA, 17 nt, Human
uuaugcaaggaaggaaa

SEQ ID NO: 2916134 - RNA, 15 nt, Human
uuaugcaaaauggaa

SEQ ID NO: 2916135 - RNA, 16 nt, Human
uuaucuuuacuuuuaa

SEQ ID NO: 2916136 - RNA, 14 nt, Human
uuaucucucugugc

SEQ ID NO: 2916137 - RNA, 12 nt, Human
uuaucucugugu

SEQ ID NO: 2916138 - RNA, 19 nt, Human
uuaucucuuuuauauuugu

SEQ ID NO: 2916139 - RNA, 20 nt, Human
uuaucucuuuuauauuugua

SEQ ID NO: 2916140 - RNA, 19 nt, Human
uuaucucuauuuaauauuu

SEQ ID NO: 2916141 - RNA, 12 nt, Human
uuaucuguccca

SEQ ID NO: 2916142 - RNA, 20 nt, Human
uuaucugggcauagaugcag

SEQ ID NO: 2916143 - RNA, 18 nt, Human
uuaucugagcugagccag

SEQ ID NO: 2916144 - RNA, 17 nt, Human
uuaguuuacaaucagcc

SEQ ID NO: 2916145 - RNA, 20 nt, Human
uuaguuuacccgguuucuuu

SEQ ID NO: 2916146 - RNA, 13 nt, Human
uuaguucccuguc

SEQ ID NO: 2916147 - RNA, 19 nt, Human
uuaguucccugucucuuga

SEQ ID NO: 2916148 - RNA, 14 nt, Human
uuuaauaaacuacu

SEQ ID NO: 2916149 - RNA, 15 nt, Human
uuuaauauaaagccu

SEQ ID NO: 2916150 - RNA, 15 nt, Human
uuuaaccaucugaua

SEQ ID NO: 2916151 - RNA, 20 nt, Human
uuuaaccauggcagggugcu

SEQ ID NO: 2916152 - RNA, 13 nt, Human
uuuaacauuugcc

SEQ ID NO: 2916153 - RNA, 21 nt, Human
uuuaacauuugccuugcagaa

SEQ ID NO: 2916154 - RNA, 22 nt, Human
uuuaacauuugccuugcagaac

SEQ ID NO: 2916155 - RNA, 11 nt, Human
uuuaacauuuu

SEQ ID NO: 2916156 - RNA, 16 nt, Human
uuuaacauuuuguucu

SEQ ID NO: 2916157 - RNA, 17 nt, Human
uuuaacauuuuguucuu

SEQ ID NO: 2916158 - RNA, 22 nt, Human
uuuaacauuuuguucuuacaca

SEQ ID NO: 2916159 - RNA, 23 nt, Human
uuuaacauuuuguucuuacacau

SEQ ID NO: 2916160 - RNA, 17 nt, Human
uuuaaccaaacaauuau

SEQ ID NO: 2916161 - RNA, 19 nt, Human
uuuaaccaaacaauuauuu

SEQ ID NO: 2916162 - RNA, 15 nt, Human
uuuaauauuaccuaa

SEQ ID NO: 2916163 - RNA, 24 nt, Human
uuuaauauuaccuaaugaaaguga

SEQ ID NO: 2916164 - RNA, 17 nt, Human
uuuaauauuauuacugu

SEQ ID NO: 2916165 - RNA, 12 nt, Human
uuuaauauuuaa

SEQ ID NO: 2916166 - RNA, 18 nt, Human
uuuaauauuuaaacagca

SEQ ID NO: 2916167 - RNA, 19 nt, Human
uuuaaucaaguuguaacuu

SEQ ID NO: 2916168 - RNA, 12 nt, Human
uuuaaucacuua

SEQ ID NO: 2916169 - RNA, 21 nt, Human
uuuaaucacuuaacauuccua

SEQ ID NO: 2916170 - RNA, 14 nt, Human
uuuaauauuuugca

SEQ ID NO: 2916171 - RNA, 13 nt, Human
uuuaauauuuaaa

SEQ ID NO: 2916172 - RNA, 15 nt, Human
uuuaauauuuaaaca

SEQ ID NO: 2916173 - RNA, 13 nt, Human
uuuaauaucuuca

SEQ ID NO: 2916174 - RNA, 15 nt, Human
uuuaauaucuucagc

SEQ ID NO: 2916175 - RNA, 14 nt, Human
uuuaccagcuuuua

SEQ ID NO: 2916176 - RNA, 19 nt, Human
uuuaccagcuuuuaaccau

SEQ ID NO: 2916177 - RNA, 18 nt, Human
uuuaccagggauguagau

SEQ ID NO: 2916178 - RNA, 19 nt, Human
uuuaccaguuaauuacuca

SEQ ID NO: 2916179 - RNA, 20 nt, Human
uuuaccaguuaauuacucag

SEQ ID NO: 2916180 - RNA, 20 nt, Human
uuuacaugcaauuuauuaaa

SEQ ID NO: 2916181 - RNA, 15 nt, Human
uuuaccauacauuua

SEQ ID NO: 2916182 - RNA, 19 nt, Human
uuuacccacacacagauaa

SEQ ID NO: 2916183 - RNA, 18 nt, Human
uuuacccaaaaacuaaau

SEQ ID NO: 2916184 - RNA, 17 nt, Human
uuuacagaugaauguau

SEQ ID NO: 2916185 - RNA, 20 nt, Human
uuuacagcucugacuuuaca

SEQ ID NO: 2916186 - RNA, 22 nt, Human
uuuacagcucugacuuuacacu

SEQ ID NO: 2916187 - RNA, 22 nt, Human
uuuacagccagugggagauguu

SEQ ID NO: 2916188 - RNA, 23 nt, Human
uuuacagccagugggagauguua

SEQ ID NO: 2916189 - RNA, 13 nt, Human
uuuacagcugccu

SEQ ID NO: 2916190 - RNA, 14 nt, Human
uuuacauaacugcc

SEQ ID NO: 2916191 - RNA, 15 nt, Human
uuuacauaacugccu

SEQ ID NO: 2916192 - RNA, 16 nt, Human
uuuacauaacugccuu

SEQ ID NO: 2916193 - RNA, 19 nt, Human
uuuacauaacugccuugaa

SEQ ID NO: 2916194 - RNA, 23 nt, Human
uuuacauaacugccuugaaccug

SEQ ID NO: 2916195 - RNA, 16 nt, Human
uuuauacaauaucauc

SEQ ID NO: 2916196 - RNA, 22 nt, Human
uuuauaaauauaagccuuuuau

SEQ ID NO: 2916197 - RNA, 24 nt, Human
uuuauaaaguacccaucuaguacu

SEQ ID NO: 2916198 - RNA, 20 nt, Human
uuuauaaagugcuuguguaa

SEQ ID NO: 2916199 - RNA, 20 nt, Human
uuuauaaauaaacuguugcu

SEQ ID NO: 2916200 - RNA, 12 nt, Human
uuuauaaaugag

SEQ ID NO: 2916201 - RNA, 15 nt, Human
uuuauaaaugagcaa

SEQ ID NO: 2916202 - RNA, 14 nt, Human
uuuaguuauaguuu

SEQ ID NO: 2916203 - RNA, 15 nt, Human
uuuaguuauaguuuc

SEQ ID NO: 2916204 - RNA, 22 nt, Human
uuuagacucaucaaucaaauaa

SEQ ID NO: 2916205 - RNA, 13 nt, Human
uuuaguuauaguu

SEQ ID NO: 2916206 - RNA, 15 nt, Human
uuuagacuguagccu

SEQ ID NO: 2916207 - RNA, 11 nt, Human
uuuagaccaag

SEQ ID NO: 2916208 - RNA, 13 nt, Human
uuuagaccaagga

SEQ ID NO: 2916209 - RNA, 14 nt, Human
uuuagaccaaggaa

SEQ ID NO: 2916210 - RNA, 15 nt, Human
uuuagaccaaggaac

SEQ ID NO: 2916211 - RNA, 18 nt, Human
uuuagaccaaggaacaaa

SEQ ID NO: 2916212 - RNA, 20 nt, Human
uuuagacagucucacuuugu

SEQ ID NO: 2916213 - RNA, 16 nt, Human
uuuagacagucucacu

SEQ ID NO: 2916214 - RNA, 16 nt, Human
uuuacccaccuagaac

SEQ ID NO: 2916215 - RNA, 15 nt, Human
uuuacccaugaagau

SEQ ID NO: 2916216 - RNA, 16 nt, Human
uuuaccccaucccugu

SEQ ID NO: 2916217 - RNA, 16 nt, Human
uuuacccuaaugucuu

SEQ ID NO: 2916218 - RNA, 19 nt, Human
uuuacccuaaugucuucau

SEQ ID NO: 2916219 - RNA, 22 nt, Human
uuuacccuaaugucuucauaaa

SEQ ID NO: 2916220 - RNA, 13 nt, Human
uuuauacauuagu

SEQ ID NO: 2916221 - RNA, 16 nt, Human
uuuauacauuaguaaa

SEQ ID NO: 2916222 - RNA, 17 nt, Human
uuuauacauuaguaaau

SEQ ID NO: 2916223 - RNA, 21 nt, Human
uuuauacauuaguaaaugucu

SEQ ID NO: 2916224 - RNA, 16 nt, Human
uuuauaccauucagau

SEQ ID NO: 2916225 - RNA, 10 nt, Human
uuuauaccuc

SEQ ID NO: 2916226 - RNA, 21 nt, Human
uuuauaccucaaacuaucugg

SEQ ID NO: 2916227 - RNA, 16 nt, Human
uuuauacucuuucugu

SEQ ID NO: 2916228 - RNA, 14 nt, Human
uuuauccacaggaa

SEQ ID NO: 2916229 - RNA, 20 nt, Human
uuuauccacaggaaaguguu

SEQ ID NO: 2916230 - RNA, 15 nt, Human
uuuauccauuuguaa

SEQ ID NO: 2916231 - RNA, 16 nt, Human
uuuauccauuuguaau

SEQ ID NO: 2916232 - RNA, 16 nt, Human
uuuauccaaaaugugu

SEQ ID NO: 2916233 - RNA, 17 nt, Human
uuuauccaaaaugugua

SEQ ID NO: 2916234 - RNA, 18 nt, Human
uuuauccaaaauguguau

SEQ ID NO: 2916235 - RNA, 20 nt, Human
uuuauccaaaauguguauuu

SEQ ID NO: 2916236 - RNA, 22 nt, Human
uuuauccaaaauguguauuucu

SEQ ID NO: 2916237 - RNA, 20 nt, Human
uuuauacugauuaugucuuu

SEQ ID NO: 2916238 - RNA, 19 nt, Human
uuuauacuccaguguacau

SEQ ID NO: 2916239 - RNA, 20 nt, Human
uuuauacucuuucuguauau

SEQ ID NO: 2916240 - RNA, 18 nt, Human
uuuauacucuuucuguau

SEQ ID NO: 2916241 - RNA, 20 nt, Human
uuuaugaaugaaaaaacagu

SEQ ID NO: 2916242 - RNA, 13 nt, Human
uuuaucuguucuu

SEQ ID NO: 2916243 - RNA, 13 nt, Human
uuuaucuguuuaa

SEQ ID NO: 2916244 - RNA, 13 nt, Human
uuuaucugauuaa

SEQ ID NO: 2916245 - RNA, 13 nt, Human
uuuaucucuauuu

SEQ ID NO: 2916246 - RNA, 17 nt, Human
uuuaucuggccccaggu

SEQ ID NO: 2916247 - RNA, 14 nt, Human
uuuaucucuauuua

SEQ ID NO: 2916248 - RNA, 17 nt, Human
uuuaucucuauuuaaua

SEQ ID NO: 2916249 - RNA, 18 nt, Human
uuuauccugaaauuucag

SEQ ID NO: 2916250 - RNA, 19 nt, Human
uuuauccugaaauuucaga

SEQ ID NO: 2916251 - RNA, 20 nt, Human
uuuaaaaguuucaaugugau

SEQ ID NO: 2916252 - RNA, 20 nt, Human
uuuaaaaggauuuuuaucuu

SEQ ID NO: 2916253 - RNA, 19 nt, Human
uuuaaaagguauuuugaau

SEQ ID NO: 2916254 - RNA, 20 nt, Human
uuuaaaagguauuuugaaua

SEQ ID NO: 2916255 - RNA, 21 nt, Human
uuuaaaagguauuuugaauac

SEQ ID NO: 2916256 - RNA, 22 nt, Human
uuuaaaagguauuuugaauacc

SEQ ID NO: 2916257 - RNA, 17 nt, Human
uuuaaaaguuucaaugu

SEQ ID NO: 2916258 - RNA, 16 nt, Human
uuuaaaauauuuaucu

SEQ ID NO: 2916259 - RNA, 15 nt, Human
uuuaaaaucaacuua

SEQ ID NO: 2916260 - RNA, 12 nt, Human
uuuaaaagaaau

SEQ ID NO: 2916261 - RNA, 16 nt, Human
uuuaaaagaaauuuau

SEQ ID NO: 2916262 - RNA, 14 nt, Human
uuuaaaagagacaa

SEQ ID NO: 2916263 - RNA, 16 nt, Human
uuuaaaagagacaaac

SEQ ID NO: 2916264 - RNA, 21 nt, Human
uuuaaaagagagagagagaaa

SEQ ID NO: 2916265 - RNA, 22 nt, Human
uuuaaaagagagagagagaaaa

SEQ ID NO: 2916266 - RNA, 23 nt, Human
uuuaaaagagagagagagaaaaa

SEQ ID NO: 2916267 - RNA, 14 nt, Human
uuuaaaagauucau

SEQ ID NO: 2916268 - RNA, 13 nt, Human
uuuaaaagaucuu

SEQ ID NO: 2916269 - RNA, 16 nt, Human
uuuaaaagaucuucaa

SEQ ID NO: 2916270 - RNA, 16 nt, Human
uuuaaaagauucauuu

SEQ ID NO: 2916271 - RNA, 20 nt, Human
uuuaaaaugguuuguccuga

SEQ ID NO: 2916272 - RNA, 20 nt, Human
uuuaaacaaaauagaagcug

SEQ ID NO: 2916273 - RNA, 15 nt, Human
uuuaaacaaacauug

SEQ ID NO: 2916274 - RNA, 17 nt, Human
uuuaaacaaacauugug

SEQ ID NO: 2916275 - RNA, 18 nt, Human
uuuaaacaaacauugugu

SEQ ID NO: 2916276 - RNA, 23 nt, Human
uuuaaacaaacauuguguugaca

SEQ ID NO: 2916277 - RNA, 12 nt, Human
uuuaaacaaauu

SEQ ID NO: 2916278 - RNA, 18 nt, Human
uuuaaaauugcuauguua

SEQ ID NO: 2916279 - RNA, 23 nt, Human
uuuaaaauugcuauguuacuauu

SEQ ID NO: 2916280 - RNA, 19 nt, Human
uuuaaaauuuaaguaucuu

SEQ ID NO: 2916281 - RNA, 19 nt, Human
uuuaacacaaguccuguga

SEQ ID NO: 2916282 - RNA, 23 nt, Human
uuuaacaauuuccuuuauauuua

SEQ ID NO: 2916283 - RNA, 16 nt, Human
uuuaaacuacagguag

SEQ ID NO: 2916284 - RNA, 12 nt, Human
uuuaaacuagau

SEQ ID NO: 2916285 - RNA, 16 nt, Human
uuuaaacuagaugacc

SEQ ID NO: 2916286 - RNA, 19 nt, Human
uuuaaacuagaugaccuca

SEQ ID NO: 2916287 - RNA, 21 nt, Human
uuuaaacuagaugaccucauu

SEQ ID NO: 2916288 - RNA, 13 nt, Human
uuuaaacagcagu

SEQ ID NO: 2916289 - RNA, 14 nt, Human
uuuaaacaccuccu

SEQ ID NO: 2916290 - RNA, 14 nt, Human
uuuaaacaaauuca

SEQ ID NO: 2916291 - RNA, 23 nt, Human
uuuaaacaaauucauauucuguc

SEQ ID NO: 2916292 - RNA, 13 nt, Human
uuuaaacacacag

SEQ ID NO: 2916293 - RNA, 23 nt, Human
uuuaaacacacagauacacacac

SEQ ID NO: 2916294 - RNA, 17 nt, Human
uuuaaacaguauuucau

SEQ ID NO: 2916295 - RNA, 13 nt, Human
uuuaaacauuaaa

SEQ ID NO: 2916296 - RNA, 14 nt, Human
uuuaaacauuaaaa

SEQ ID NO: 2916297 - RNA, 16 nt, Human
uuuaaacauuaaaaau

SEQ ID NO: 2916298 - RNA, 19 nt, Human
uuuaaacauuaaaaaugga

SEQ ID NO: 2916299 - RNA, 23 nt, Human
uuuaaacauuaaaaauggaacug

SEQ ID NO: 2916300 - RNA, 14 nt, Human
uuguucaaacaaua

SEQ ID NO: 2916301 - RNA, 16 nt, Human
uuguucaaacaauauc

SEQ ID NO: 2916302 - RNA, 17 nt, Human
uuguucaaacaauauca

SEQ ID NO: 2916303 - RNA, 13 nt, Human
uuguucaacuauu

SEQ ID NO: 2916304 - RNA, 13 nt, Human
uuguucaaguuuu

SEQ ID NO: 2916305 - RNA, 15 nt, Human
uuguuauuuuggaaa

SEQ ID NO: 2916306 - RNA, 19 nt, Human
uuguucaauaauaaauauu

SEQ ID NO: 2916307 - RNA, 13 nt, Human
uuguuauuuucag

SEQ ID NO: 2916308 - RNA, 16 nt, Human
uuguuuaaugugaacu

SEQ ID NO: 2916309 - RNA, 17 nt, Human
uuguuuaaugugaacuu

SEQ ID NO: 2916310 - RNA, 20 nt, Human
uuguuuaaugugaacuugua

SEQ ID NO: 2916311 - RNA, 23 nt, Human
uuguuuaaugugaacuuguagcu

SEQ ID NO: 2916312 - RNA, 16 nt, Human
uuguuuacuuaaagau

SEQ ID NO: 2916313 - RNA, 18 nt, Human
uuguuuacuuaaagauuu

SEQ ID NO: 2916314 - RNA, 13 nt, Human
uugucuuucagga

SEQ ID NO: 2916315 - RNA, 13 nt, Human
uugucuugaaaga

SEQ ID NO: 2916316 - RNA, 14 nt, Human
uugucuugaaagau

SEQ ID NO: 2916317 - RNA, 15 nt, Human
uugucuugaaugucu

SEQ ID NO: 2916318 - RNA, 22 nt, Human
uugucuugaaugucuuuugaau

SEQ ID NO: 2916319 - RNA, 18 nt, Human
uugucuugccuuauuaaa

SEQ ID NO: 2916320 - RNA, 15 nt, Human
uugucuuauauauau

SEQ ID NO: 2916321 - RNA, 15 nt, Human
uugucuuaucuggcc

SEQ ID NO: 2916322 - RNA, 13 nt, Human
uugucuuauauau

SEQ ID NO: 2916323 - RNA, 17 nt, Human
uugucuucaaacuguga

SEQ ID NO: 2916324 - RNA, 11 nt, Human
uuguuauugug

SEQ ID NO: 2916325 - RNA, 12 nt, Human
uuguuauuguga

SEQ ID NO: 2916326 - RNA, 13 nt, Human
uuguuauugugaa

SEQ ID NO: 2916327 - RNA, 16 nt, Human
uuguuugucucuccuu

SEQ ID NO: 2916328 - RNA, 18 nt, Human
uuguuugucucuccuuuu

SEQ ID NO: 2916329 - RNA, 19 nt, Human
uuguuugucucuccuuuuc

SEQ ID NO: 2916330 - RNA, 20 nt, Human
uuguuugucucuccuuuucu

SEQ ID NO: 2916331 - RNA, 12 nt, Human
uuguuugucugu

SEQ ID NO: 2916332 - RNA, 15 nt, Human
uuguuugucuguuug

SEQ ID NO: 2916333 - RNA, 15 nt, Human
uuguuucuuucuagu

SEQ ID NO: 2916334 - RNA, 12 nt, Human
uuguuuuacaau

SEQ ID NO: 2916335 - RNA, 13 nt, Human
uuuaaaacacaug

SEQ ID NO: 2916336 - RNA, 23 nt, Human
uuuaaaacacauguuuuuauaca

SEQ ID NO: 2916337 - RNA, 16 nt, Human
uuuaaaacacauguuu

SEQ ID NO: 2916338 - RNA, 15 nt, Human
uuuaaaacaguauuu

SEQ ID NO: 2916339 - RNA, 14 nt, Human
uuuaaaacauguaa

SEQ ID NO: 2916340 - RNA, 15 nt, Human
uuuaaaacauguaau

SEQ ID NO: 2916341 - RNA, 16 nt, Human
uuuaaaacauguaaua

SEQ ID NO: 2916342 - RNA, 13 nt, Human
uuguuuuaaucug

SEQ ID NO: 2916343 - RNA, 14 nt, Human
uuguuuuaaucuga

SEQ ID NO: 2916344 - RNA, 15 nt, Human
uuguuuguuuuugcu

SEQ ID NO: 2916345 - RNA, 21 nt, Human
uuguuuguuucucccccuggg

SEQ ID NO: 2916346 - RNA, 13 nt, Human
uuguuuguuucuu

SEQ ID NO: 2916347 - RNA, 14 nt, Human
uuguuuguuucuuu

SEQ ID NO: 2916348 - RNA, 12 nt, Human
uuguuuguuucu

SEQ ID NO: 2916349 - RNA, 18 nt, Human
uuguuucugagaaaagaa

SEQ ID NO: 2916350 - RNA, 14 nt, Human
uuguuucugugggc

SEQ ID NO: 2916351 - RNA, 13 nt, Human
uuguuuauugagu

SEQ ID NO: 2916352 - RNA, 15 nt, Human
uuguuuauugaguuu

SEQ ID NO: 2916353 - RNA, 17 nt, Human
uuguuucucccccuggg

SEQ ID NO: 2916354 - RNA, 17 nt, Human
uuguuucucuguuguaa

SEQ ID NO: 2916355 - RNA, 12 nt, Human
uuguuuauguaa

SEQ ID NO: 2916356 - RNA, 20 nt, Human
uuguuuauguaaauguuugu

SEQ ID NO: 2916357 - RNA, 15 nt, Human
uuguuuauuagauga

SEQ ID NO: 2916358 - RNA, 24 nt, Human
uuguuuauuagaugaauuauccua

SEQ ID NO: 2916359 - RNA, 18 nt, Human
uuguuuauaccuuugccu

SEQ ID NO: 2916360 - RNA, 19 nt, Human
uuguuuaucagauacauca

SEQ ID NO: 2916361 - RNA, 21 nt, Human
uuguuuaucagauacaucacu

SEQ ID NO: 2916362 - RNA, 22 nt, Human
uuguuuaucagauacaucacug

SEQ ID NO: 2916363 - RNA, 23 nt, Human
uuguuuacuuaaagauuuaucaa

SEQ ID NO: 2916364 - RNA, 20 nt, Human
uuguuuggggaugagaaagg

SEQ ID NO: 2916365 - RNA, 16 nt, Human
uuguuuggauguaauu

SEQ ID NO: 2916366 - RNA, 18 nt, Human
uuguuuggauguaauuua

SEQ ID NO: 2916367 - RNA, 11 nt, Human
uuguuuggauu

SEQ ID NO: 2916368 - RNA, 16 nt, Human
uuguuuggcaaggaaa

SEQ ID NO: 2916369 - RNA, 17 nt, Human
uuguuuggcaaggaaag

SEQ ID NO: 2916370 - RNA, 18 nt, Human
uuguuuggcaaggaaagg

SEQ ID NO: 2916371 - RNA, 14 nt, Human
uuguuuggcuuccu

SEQ ID NO: 2916372 - RNA, 13 nt, Human
uuguuucuuguuu

SEQ ID NO: 2916373 - RNA, 17 nt, Human
uuguuucuuguuuauug

SEQ ID NO: 2916374 - RNA, 18 nt, Human
uuguuucuuguuuauuga

SEQ ID NO: 2916375 - RNA, 19 nt, Human
uuugaacacgaaagaaaug

SEQ ID NO: 2916376 - RNA, 20 nt, Human
uuugaacacgaaagaaaugu

SEQ ID NO: 2916377 - RNA, 21 nt, Human
uuugaacacgaaagaaaugua

SEQ ID NO: 2916378 - RNA, 12 nt, Human
uuugaacacugg

SEQ ID NO: 2916379 - RNA, 14 nt, Human
uuugaacacuggcu

SEQ ID NO: 2916380 - RNA, 23 nt, Human
uuugaacacuggcuaaagauaau

SEQ ID NO: 2916381 - RNA, 16 nt, Human
uuucuuguugcuuugu

SEQ ID NO: 2916382 - RNA, 21 nt, Human
uuucuuguugcuuuguugcac

SEQ ID NO: 2916383 - RNA, 12 nt, Human
uuucuuguuuau

SEQ ID NO: 2916384 - RNA, 15 nt, Human
uuugaacucagaucu

SEQ ID NO: 2916385 - RNA, 16 nt, Human
uuugaagcaguugugu

SEQ ID NO: 2916386 - RNA, 18 nt, Human
uuugaagcaguuguguca

SEQ ID NO: 2916387 - RNA, 15 nt, Human
uuugaacuaagaaac

SEQ ID NO: 2916388 - RNA, 17 nt, Human
uuugaacuaagaaacuu

SEQ ID NO: 2916389 - RNA, 19 nt, Human
uuugaacuaagaaacuuuu

SEQ ID NO: 2916390 - RNA, 21 nt, Human
uuugaacuaagaaacuuuugu

SEQ ID NO: 2916391 - RNA, 22 nt, Human
uuugaacuaagaaacuuuugua

SEQ ID NO: 2916392 - RNA, 16 nt, Human
uuugaagcuacugugu

SEQ ID NO: 2916393 - RNA, 18 nt, Human
uuugaagcuacugugugu

SEQ ID NO: 2916394 - RNA, 11 nt, Human
uuugaagcuga

SEQ ID NO: 2916395 - RNA, 18 nt, Human
uuugaagcugaaaauaua

SEQ ID NO: 2916396 - RNA, 13 nt, Human
uuugaaggcaaaa

SEQ ID NO: 2916397 - RNA, 12 nt, Human
uuugaaggcaaa

SEQ ID NO: 2916398 - RNA, 13 nt, Human
uuugaaggaaaca

SEQ ID NO: 2916399 - RNA, 20 nt, Human
uuugaaggaaacaguuaaua

SEQ ID NO: 2916400 - RNA, 21 nt, Human
uuugaaggaauacaauauaua

SEQ ID NO: 2916401 - RNA, 17 nt, Human
uuucuuaaccaguugug

SEQ ID NO: 2916402 - RNA, 21 nt, Human
uuucuuaaccaguuguggugu

SEQ ID NO: 2916403 - RNA, 16 nt, Human
uuucuugcucccuuca

SEQ ID NO: 2916404 - RNA, 19 nt, Human
uuucuugcucccuucagcc

SEQ ID NO: 2916405 - RNA, 13 nt, Human
uuucuugcucccu

SEQ ID NO: 2916406 - RNA, 12 nt, Human
uuucuugcuugu

SEQ ID NO: 2916407 - RNA, 14 nt, Human
uuucuugcuuguac

SEQ ID NO: 2916408 - RNA, 15 nt, Human
uuucuugcuuguacc

SEQ ID NO: 2916409 - RNA, 16 nt, Human
uuucuugcuuguaccu

SEQ ID NO: 2916410 - RNA, 22 nt, Human
uuucuugcuuguaccucuggcu

SEQ ID NO: 2916411 - RNA, 19 nt, Human
uuucuuggcaaaagccuug

SEQ ID NO: 2916412 - RNA, 22 nt, Human
uuucuuggcaaaagccuugugu

SEQ ID NO: 2916413 - RNA, 19 nt, Human
uuucuuggcccccuuccca

SEQ ID NO: 2916414 - RNA, 23 nt, Human
uuucugaucugaugcaagcaaga

SEQ ID NO: 2916415 - RNA, 12 nt, Human
uuucuuaaauaa

SEQ ID NO: 2916416 - RNA, 21 nt, Human
uuucuuaaauaaugcuucaga

SEQ ID NO: 2916417 - RNA, 22 nt, Human
uuucuuaaauaaugcuucagau

SEQ ID NO: 2916418 - RNA, 23 nt, Human
uuucuuaaauaaugcuucagaua

SEQ ID NO: 2916419 - RNA, 13 nt, Human
uuugaagucuugu

SEQ ID NO: 2916420 - RNA, 14 nt, Human
uuugaagucuugua

SEQ ID NO: 2916421 - RNA, 15 nt, Human
uuugaagucuuguau

SEQ ID NO: 2916422 - RNA, 16 nt, Human
uuugaagucuuguaua

SEQ ID NO: 2916423 - RNA, 17 nt, Human
uuugaagguuuuaagug

SEQ ID NO: 2916424 - RNA, 23 nt, Human
uuugaaguaguuuguauaacuuc

SEQ ID NO: 2916425 - RNA, 20 nt, Human
uuugaaguguaccuguguac

SEQ ID NO: 2916426 - RNA, 13 nt, Human
uuugaaguuuaca

SEQ ID NO: 2916427 - RNA, 15 nt, Human
uuugaaguuuacauu

SEQ ID NO: 2916428 - RNA, 16 nt, Human
uuugaaguuuacauuu

SEQ ID NO: 2916429 - RNA, 17 nt, Human
uuugaaguuuacauuuu

SEQ ID NO: 2916430 - RNA, 19 nt, Human
uuugaaguuuacauuuuua

SEQ ID NO: 2916431 - RNA, 16 nt, Human
uuugagaguucuaaau

SEQ ID NO: 2916432 - RNA, 14 nt, Human
uuugagaguucuaa

SEQ ID NO: 2916433 - RNA, 16 nt, Human
uuugaauaccauuaaa

SEQ ID NO: 2916434 - RNA, 22 nt, Human
uuugaauaccauuaaaacugcu

SEQ ID NO: 2916435 - RNA, 23 nt, Human
uuugaauaccauuaaaacugcuu

SEQ ID NO: 2916436 - RNA, 13 nt, Human
uuugaguucuaca

SEQ ID NO: 2916437 - RNA, 19 nt, Human
uuugaguugauugagaaga

SEQ ID NO: 2916438 - RNA, 15 nt, Human
uuugagguaaagaua

SEQ ID NO: 2916439 - RNA, 18 nt, Human
uuugauaaaguuucucag

SEQ ID NO: 2916440 - RNA, 19 nt, Human
uuugauaaaguuucucaga

SEQ ID NO: 2916441 - RNA, 13 nt, Human
uuugauaaaguuu

SEQ ID NO: 2916442 - RNA, 15 nt, Human
uuugauaaaguuucu

SEQ ID NO: 2916443 - RNA, 14 nt, Human
uuugauaaugauaa

SEQ ID NO: 2916444 - RNA, 15 nt, Human
uuugauaaugauaaa

SEQ ID NO: 2916445 - RNA, 14 nt, Human
uuugauaacuguuu

SEQ ID NO: 2916446 - RNA, 15 nt, Human
uuugauaacuguuua

SEQ ID NO: 2916447 - RNA, 20 nt, Human
uuugauaacuguuuauaugu

SEQ ID NO: 2916448 - RNA, 22 nt, Human
uuugauaacuguuuauaugugu

SEQ ID NO: 2916449 - RNA, 18 nt, Human
uuugagauuaagaaugcc

SEQ ID NO: 2916450 - RNA, 16 nt, Human
uuugaggagcauguuu

SEQ ID NO: 2916451 - RNA, 17 nt, Human
uuugaggagcauguuuu

SEQ ID NO: 2916452 - RNA, 15 nt, Human
uuugaggcugcagcg

SEQ ID NO: 2916453 - RNA, 18 nt, Human
uuugagggacugccucug

SEQ ID NO: 2916454 - RNA, 20 nt, Human
uuugagggacugccucugcc

SEQ ID NO: 2916455 - RNA, 21 nt, Human
uuugagggacugccucugcca

SEQ ID NO: 2916456 - RNA, 16 nt, Human
uuugaggggaaaacac

SEQ ID NO: 2916457 - RNA, 23 nt, Human
uuugaggggaggaguuccacaga

SEQ ID NO: 2916458 - RNA, 23 nt, Human
uuugguacuuuugagugugugug

SEQ ID NO: 2916459 - RNA, 14 nt, Human
uuugguagauuaaa

SEQ ID NO: 2916460 - RNA, 13 nt, Human
uuugguacaaaaa

SEQ ID NO: 2916461 - RNA, 16 nt, Human
uuugguacaaaaauaa

SEQ ID NO: 2916462 - RNA, 15 nt, Human
uuuggguuacaguau

SEQ ID NO: 2916463 - RNA, 22 nt, Human
uuuggagaaauuauuuaauaaa

SEQ ID NO: 2916464 - RNA, 11 nt, Human
uuugguucuaa

SEQ ID NO: 2916465 - RNA, 13 nt, Human
uuugguucuaagg

SEQ ID NO: 2916466 - RNA, 20 nt, Human
uuugguucauuaauucuaua

SEQ ID NO: 2916467 - RNA, 13 nt, Human
uuugguuccucuc

SEQ ID NO: 2916468 - RNA, 15 nt, Human
uuugguuccucucug

SEQ ID NO: 2916469 - RNA, 16 nt, Human
uuugguuccucucugg

SEQ ID NO: 2916470 - RNA, 17 nt, Human
uuugguuccucucuggu

SEQ ID NO: 2916471 - RNA, 12 nt, Human
uuugguuuacau

SEQ ID NO: 2916472 - RNA, 14 nt, Human
uuugguuuacauuu

SEQ ID NO: 2916473 - RNA, 15 nt, Human
uuugguuuacauuua

SEQ ID NO: 2916474 - RNA, 21 nt, Human
uuugguuuauauuuuuucagu

SEQ ID NO: 2916475 - RNA, 20 nt, Human
uuugguucuucucaaaagaa

SEQ ID NO: 2916476 - RNA, 16 nt, Human
uuuguaaacucaaaau

SEQ ID NO: 2916477 - RNA, 22 nt, Human
uuuguaaacucaaaauauuugu

SEQ ID NO: 2916478 - RNA, 16 nt, Human
uuuguaaacuggaauu

SEQ ID NO: 2916479 - RNA, 17 nt, Human
uuuguaaacucaaaaua

SEQ ID NO: 2916480 - RNA, 15 nt, Human
uuuguaaaucacauc

SEQ ID NO: 2916481 - RNA, 12 nt, Human
uuuguaaauguu

SEQ ID NO: 2916482 - RNA, 14 nt, Human
uuuguaaauguuau

SEQ ID NO: 2916483 - RNA, 18 nt, Human
uuuguaaauguuauuucu

SEQ ID NO: 2916484 - RNA, 19 nt, Human
uuuguaaauguuauuucug

SEQ ID NO: 2916485 - RNA, 20 nt, Human
uuuguaaauguuauuucugc

SEQ ID NO: 2916486 - RNA, 22 nt, Human
uuuguaaauuaaacauaaaaca

SEQ ID NO: 2916487 - RNA, 17 nt, Human
uuugcuuguuauauuaa

SEQ ID NO: 2916488 - RNA, 13 nt, Human
uuuguaaagaaau

SEQ ID NO: 2916489 - RNA, 18 nt, Human
uuuguaaagaaauuuacu

SEQ ID NO: 2916490 - RNA, 21 nt, Human
uuuguaaagaaauuuacuaua

SEQ ID NO: 2916491 - RNA, 22 nt, Human
uuuguaaagaaauuuacuauau

SEQ ID NO: 2916492 - RNA, 23 nt, Human
uuuguaaagaaauuuacuauaua

SEQ ID NO: 2916493 - RNA, 16 nt, Human
uuuguaaagugaagaa

SEQ ID NO: 2916494 - RNA, 13 nt, Human
uuuguaugugugu

SEQ ID NO: 2916495 - RNA, 16 nt, Human
uuuguaugcacuuugu

SEQ ID NO: 2916496 - RNA, 13 nt, Human
uuuguauucaaaa

SEQ ID NO: 2916497 - RNA, 15 nt, Human
uuuguggccucagaa

SEQ ID NO: 2916498 - RNA, 18 nt, Human
uuuguauguuuuuuuucu

SEQ ID NO: 2916499 - RNA, 14 nt, Human
uuuguauuauugcu

SEQ ID NO: 2916500 - RNA, 15 nt, Human
uuuguauuauugcug

SEQ ID NO: 2916501 - RNA, 20 nt, Human
uuuguauuauugcuguugcu

SEQ ID NO: 2916502 - RNA, 23 nt, Human
uuuguauuauugcuguugcuuga

SEQ ID NO: 2916503 - RNA, 10 nt, Human
uuuguauguu

SEQ ID NO: 2916504 - RNA, 12 nt, Human
uuuguauguuuu

SEQ ID NO: 2916505 - RNA, 18 nt, Human
uuuggacuccaucucuca

SEQ ID NO: 2916506 - RNA, 19 nt, Human
uuuggagacucuguggggc

SEQ ID NO: 2916507 - RNA, 14 nt, Human
uuuggagacuuucu

SEQ ID NO: 2916508 - RNA, 15 nt, Human
uuuggagacuuucuu

SEQ ID NO: 2916509 - RNA, 15 nt, Human
uuuggacuuuguaua

SEQ ID NO: 2916510 - RNA, 21 nt, Human
uuuggacuuuguauacuuuaa

SEQ ID NO: 2916511 - RNA, 20 nt, Human
uuugcuucauaaaugaagca

SEQ ID NO: 2916512 - RNA, 14 nt, Human
uuugcauuuggaau

SEQ ID NO: 2916513 - RNA, 20 nt, Human
uuugcuucauuguacuaccu

SEQ ID NO: 2916514 - RNA, 19 nt, Human
uuugcuugcucauaugcau

SEQ ID NO: 2916515 - RNA, 21 nt, Human
uuugcuugcucauaugcaugu

SEQ ID NO: 2916516 - RNA, 15 nt, Human
uuugauaauguuaaa

SEQ ID NO: 2916517 - RNA, 15 nt, Human
uuugauaugaguaua

SEQ ID NO: 2916518 - RNA, 18 nt, Human
uuugauaugaguauacaa

SEQ ID NO: 2916519 - RNA, 19 nt, Human
uuugauaugaguauacaau

SEQ ID NO: 2916520 - RNA, 12 nt, Human
uuugauaauguu

SEQ ID NO: 2916521 - RNA, 14 nt, Human
uuugauaauguuaa

SEQ ID NO: 2916522 - RNA, 18 nt, Human
uuugccacuaauuuuagu

SEQ ID NO: 2916523 - RNA, 20 nt, Human
uuugccacuaauuuuaguau

SEQ ID NO: 2916524 - RNA, 21 nt, Human
uuugccacuaauuuuaguauu

SEQ ID NO: 2916525 - RNA, 22 nt, Human
uuugccacuaauuuuaguauuc

SEQ ID NO: 2916526 - RNA, 19 nt, Human
uuugccacugauauucaga

SEQ ID NO: 2916527 - RNA, 20 nt, Human
uuucucuccagccugacuug

SEQ ID NO: 2916528 - RNA, 19 nt, Human
uuucucucagccuuacauu

SEQ ID NO: 2916529 - RNA, 21 nt, Human
uuucucucagccuuacauuug

SEQ ID NO: 2916530 - RNA, 22 nt, Human
uuucucuaacuucaaggcccau

SEQ ID NO: 2916531 - RNA, 18 nt, Human
uuucuacccagcgagccc

SEQ ID NO: 2916532 - RNA, 15 nt, Human
uuucuacccagcgag

SEQ ID NO: 2916533 - RNA, 22 nt, Human
uuucuacccagcgagcccuggu

SEQ ID NO: 2916534 - RNA, 15 nt, Human
uuucuacauuauugc

SEQ ID NO: 2916535 - RNA, 17 nt, Human
uuucuacauuauugcuu

SEQ ID NO: 2916536 - RNA, 20 nt, Human
uuucuacauuauugcuuauu

SEQ ID NO: 2916537 - RNA, 16 nt, Human
uuucuaccauuucaga

SEQ ID NO: 2916538 - RNA, 21 nt, Human
uuucuacccaacggcccugca

SEQ ID NO: 2916539 - RNA, 23 nt, Human
uuucucuuuguggggcuuggcgu

SEQ ID NO: 2916540 - RNA, 15 nt, Human
uuucucuuuucuaaa

SEQ ID NO: 2916541 - RNA, 15 nt, Human
uuucucuuuucuagu

SEQ ID NO: 2916542 - RNA, 17 nt, Human
uuucucuuuucuaguuu

SEQ ID NO: 2916543 - RNA, 15 nt, Human
uuucucuuuuuaguu

SEQ ID NO: 2916544 - RNA, 14 nt, Human
uuucugaaaagaaa

SEQ ID NO: 2916545 - RNA, 16 nt, Human
uuucugaaaagaaaua

SEQ ID NO: 2916546 - RNA, 13 nt, Human
uuucucucuuccc

SEQ ID NO: 2916547 - RNA, 14 nt, Human
uuucucucuucccu

SEQ ID NO: 2916548 - RNA, 16 nt, Human
uuucucucuucccuca

SEQ ID NO: 2916549 - RNA, 17 nt, Human
uuucucucuucccucag

SEQ ID NO: 2916550 - RNA, 16 nt, Human
uuucucucuacagugc

SEQ ID NO: 2916551 - RNA, 18 nt, Human
uuucucucuacagugcca

SEQ ID NO: 2916552 - RNA, 20 nt, Human
uuucugaaaguuacccacug

SEQ ID NO: 2916553 - RNA, 15 nt, Human
uuuccuaauaucaaa

SEQ ID NO: 2916554 - RNA, 22 nt, Human
uuuccuaaucagaaauuuuuau

SEQ ID NO: 2916555 - RNA, 21 nt, Human
uuuccuacaggcagucucucu

SEQ ID NO: 2916556 - RNA, 18 nt, Human
uuuccucuauacaucucu

SEQ ID NO: 2916557 - RNA, 22 nt, Human
uuuccucuauacaucucucccc

SEQ ID NO: 2916558 - RNA, 15 nt, Human
uuuccuccuuuauca

SEQ ID NO: 2916559 - RNA, 16 nt, Human
uuuccuccuuuaucac

SEQ ID NO: 2916560 - RNA, 17 nt, Human
uuuccuccuuuaucaca

SEQ ID NO: 2916561 - RNA, 22 nt, Human
uuuccuccugaggcuuuggauu

SEQ ID NO: 2916562 - RNA, 21 nt, Human
uuuccuccugaggcuuuggau

SEQ ID NO: 2916563 - RNA, 22 nt, Human
uuuccucuuagucgagccaagu

SEQ ID NO: 2916564 - RNA, 21 nt, Human
uuucuaacaaaaaaauauauu

SEQ ID NO: 2916565 - RNA, 15 nt, Human
uuucuaaugugugaa

SEQ ID NO: 2916566 - RNA, 14 nt, Human
uuucuaauguuucu

SEQ ID NO: 2916567 - RNA, 13 nt, Human
uuucuaaauguuu

SEQ ID NO: 2916568 - RNA, 21 nt, Human
uuucuacaauuaauaguuugu

SEQ ID NO: 2916569 - RNA, 23 nt, Human
uuucuacaaagcacuagagaaug

SEQ ID NO: 2916570 - RNA, 20 nt, Human
uuucuacaaauaauuuuagu

SEQ ID NO: 2916571 - RNA, 17 nt, Human
uuucaguccuguaguuu

SEQ ID NO: 2916572 - RNA, 21 nt, Human
uuucaguauuuuggagaaauu

SEQ ID NO: 2916573 - RNA, 21 nt, Human
uuucaguacuucagcaagaga

SEQ ID NO: 2916574 - RNA, 22 nt, Human
uuucaguacuucagcaagagag

SEQ ID NO: 2916575 - RNA, 23 nt, Human
uuucaguacuucagcaagagaga

SEQ ID NO: 2916576 - RNA, 19 nt, Human
uuucauuugguucauuaau

SEQ ID NO: 2916577 - RNA, 17 nt, Human
uuucauuuuauuuuaau

SEQ ID NO: 2916578 - RNA, 14 nt, Human
uuucauuuuccaau

SEQ ID NO: 2916579 - RNA, 16 nt, Human
uuucauuucaaaaugc

SEQ ID NO: 2916580 - RNA, 21 nt, Human
uuucagguucaguauuaugua

SEQ ID NO: 2916581 - RNA, 14 nt, Human
uuucagguuuguca

SEQ ID NO: 2916582 - RNA, 19 nt, Human
uuucagguuuuguaaagau

SEQ ID NO: 2916583 - RNA, 18 nt, Human
uuucagguuuuguaaaga

SEQ ID NO: 2916584 - RNA, 16 nt, Human
uuucaggugacaugug

SEQ ID NO: 2916585 - RNA, 19 nt, Human
uuucaggugacaugugaaa

SEQ ID NO: 2916586 - RNA, 20 nt, Human
uuucaggugacaugugaaac

SEQ ID NO: 2916587 - RNA, 22 nt, Human
uuucaggugacaugugaaaccu

SEQ ID NO: 2916588 - RNA, 15 nt, Human
uuucagcuaucagua

SEQ ID NO: 2916589 - RNA, 16 nt, Human
uuucagcuaucaguag

SEQ ID NO: 2916590 - RNA, 13 nt, Human
uuucaggugacau

SEQ ID NO: 2916591 - RNA, 15 nt, Human
uuucaggugacaugu

SEQ ID NO: 2916592 - RNA, 11 nt, Human
uuucagcucuc

SEQ ID NO: 2916593 - RNA, 12 nt, Human
uuucagcucucu

SEQ ID NO: 2916594 - RNA, 16 nt, Human
uuucagcucucuguau

SEQ ID NO: 2916595 - RNA, 21 nt, Human
uuucagcucucuguauaaaca

SEQ ID NO: 2916596 - RNA, 12 nt, Human
uuuccacugaag

SEQ ID NO: 2916597 - RNA, 13 nt, Human
uuuccuaacaaaa

SEQ ID NO: 2916598 - RNA, 16 nt, Human
uuuccuaacaaaagau

SEQ ID NO: 2916599 - RNA, 23 nt, Human
uuuccuaacaaaagaugaaagca

SEQ ID NO: 2916600 - RNA, 15 nt, Human
uuuccacuucuuccu

SEQ ID NO: 2916601 - RNA, 16 nt, Human
uuuccacuucuuccuu

SEQ ID NO: 2916602 - RNA, 16 nt, Human
uuuccacuuguucuca

SEQ ID NO: 2916603 - RNA, 18 nt, Human
uuuccacuuguucucagg

SEQ ID NO: 2916604 - RNA, 20 nt, Human
uuucauuuuuugcaucagua

SEQ ID NO: 2916605 - RNA, 16 nt, Human
uuucacauagcugucu

SEQ ID NO: 2916606 - RNA, 18 nt, Human
uuucacauagcugucuag

SEQ ID NO: 2916607 - RNA, 20 nt, Human
uuucagcuaagggaagacau

SEQ ID NO: 2916608 - RNA, 21 nt, Human
uuucagcuaagggaagacauu

SEQ ID NO: 2916609 - RNA, 22 nt, Human
uuucagcuaagggaagacauuu

SEQ ID NO: 2916610 - RNA, 23 nt, Human
uuucagcuaagggaagacauuuc

SEQ ID NO: 2916611 - RNA, 20 nt, Human
uuucacaccggaagguuuuu

SEQ ID NO: 2916612 - RNA, 23 nt, Human
uuucaauuaauauuaauuuucua

SEQ ID NO: 2916613 - RNA, 14 nt, Human
uuucaauucucaaa

SEQ ID NO: 2916614 - RNA, 15 nt, Human
uuucaauucucaaaa

SEQ ID NO: 2916615 - RNA, 16 nt, Human
uuucaauucuguaggu

SEQ ID NO: 2916616 - RNA, 19 nt, Human
uuucacaguguguuuguga

SEQ ID NO: 2916617 - RNA, 13 nt, Human
uuucacagcuccu

SEQ ID NO: 2916618 - RNA, 20 nt, Human
uuucacaggugugguguaau

SEQ ID NO: 2916619 - RNA, 13 nt, Human
uuucacauaaaug

SEQ ID NO: 2916620 - RNA, 15 nt, Human
uuucacauaaaugca

SEQ ID NO: 2916621 - RNA, 21 nt, Human
uuucacauaaaugcagcccau

SEQ ID NO: 2916622 - RNA, 10 nt, Human
uuucaaugug

SEQ ID NO: 2916623 - RNA, 13 nt, Human
uuucaaugugauu

SEQ ID NO: 2916624 - RNA, 14 nt, Human
uuucaaugugauuc

SEQ ID NO: 2916625 - RNA, 20 nt, Human
uuucaaugugauucuaaugu

SEQ ID NO: 2916626 - RNA, 22 nt, Human
uuucaaugugauucuaaugucu

SEQ ID NO: 2916627 - RNA, 14 nt, Human
uuuaugcucuuuuu

SEQ ID NO: 2916628 - RNA, 20 nt, Human
uuuaugcucuuuuuuacuca

SEQ ID NO: 2916629 - RNA, 20 nt, Human
uuuaugcauuugcauuugcu

SEQ ID NO: 2916630 - RNA, 19 nt, Human
uuuaugccuucuuauugcu

SEQ ID NO: 2916631 - RNA, 18 nt, Human
uuuaugaguaacuauuau

SEQ ID NO: 2916632 - RNA, 20 nt, Human
uuuaugaguaacuauuauua

SEQ ID NO: 2916633 - RNA, 21 nt, Human
uuuaugaguaacuauuauuau

SEQ ID NO: 2916634 - RNA, 22 nt, Human
uuuaugaguaacuauuauuaua

SEQ ID NO: 2916635 - RNA, 12 nt, Human
uuuaugagaaau

SEQ ID NO: 2916636 - RNA, 13 nt, Human
uuuaugagaaaug

SEQ ID NO: 2916637 - RNA, 14 nt, Human
uuuaugagaaaugu

SEQ ID NO: 2916638 - RNA, 20 nt, Human
uuuaugagaaauguaaugcg

SEQ ID NO: 2916639 - RNA, 20 nt, Human
uuuaugagaugcugguuuuc

SEQ ID NO: 2916640 - RNA, 14 nt, Human
uuuaugagauggau

SEQ ID NO: 2916641 - RNA, 17 nt, Human
uuuaugauaauagauuc

SEQ ID NO: 2916642 - RNA, 18 nt, Human
uuuaugauaauagauucu

SEQ ID NO: 2916643 - RNA, 19 nt, Human
uuuaugauaauagauucuc

SEQ ID NO: 2916644 - RNA, 13 nt, Human
uucuuucccagug

SEQ ID NO: 2916645 - RNA, 16 nt, Human
uucuuucccagugagu

SEQ ID NO: 2916646 - RNA, 14 nt, Human
uucuuuagagaacu

SEQ ID NO: 2916647 - RNA, 17 nt, Human
uucuuuagagaacugaa

SEQ ID NO: 2916648 - RNA, 18 nt, Human
uucuuuagagaacugaaa

SEQ ID NO: 2916649 - RNA, 19 nt, Human
uucuuuagagaacugaaaa

SEQ ID NO: 2916650 - RNA, 20 nt, Human
uucuuuagagaacugaaaag

SEQ ID NO: 2916651 - RNA, 21 nt, Human
uucuuuagagaacugaaaaga

SEQ ID NO: 2916652 - RNA, 23 nt, Human
uucuuuagagaacugaaaagaga

SEQ ID NO: 2916653 - RNA, 19 nt, Human
uugaaaccaccuuuuauua

SEQ ID NO: 2916654 - RNA, 14 nt, Human
uugaaaccugcucu

SEQ ID NO: 2916655 - RNA, 16 nt, Human
uugaaaccugcucugu

SEQ ID NO: 2916656 - RNA, 14 nt, Human
uugaaaccuguaua

SEQ ID NO: 2916657 - RNA, 19 nt, Human
uugaaacacuuuuuugggg

SEQ ID NO: 2916658 - RNA, 15 nt, Human
uugaaaaucuugugu

SEQ ID NO: 2916659 - RNA, 21 nt, Human
uugaaaauaagaauagaaaua

SEQ ID NO: 2916660 - RNA, 15 nt, Human
uugaaaauuauuuua

SEQ ID NO: 2916661 - RNA, 19 nt, Human
uugaaaauuauuuuaaaca

SEQ ID NO: 2916662 - RNA, 20 nt, Human
uugaaaauuauuuuaaacaa

SEQ ID NO: 2916663 - RNA, 22 nt, Human
uugaaaauuauuuuaaacaaaa

SEQ ID NO: 2916664 - RNA, 18 nt, Human
uugaaaauucaaaaagug

SEQ ID NO: 2916665 - RNA, 20 nt, Human
uugaaaauucaaaaaguguu

SEQ ID NO: 2916666 - RNA, 21 nt, Human
uugaaaauucaaaaaguguuu

SEQ ID NO: 2916667 - RNA, 17 nt, Human
uugaaugacaacagaag

SEQ ID NO: 2916668 - RNA, 18 nt, Human
uugaaugacaacagaagc

SEQ ID NO: 2916669 - RNA, 17 nt, Human
uugaauguuaagcagau

SEQ ID NO: 2916670 - RNA, 14 nt, Human
uugaauguuaagca

SEQ ID NO: 2916671 - RNA, 13 nt, Human
uugaaugugucag

SEQ ID NO: 2916672 - RNA, 17 nt, Human
uugaaugucuuuugaau

SEQ ID NO: 2916673 - RNA, 22 nt, Human
uugaauguggcuugagaaauau

SEQ ID NO: 2916674 - RNA, 21 nt, Human
uugaauguggcuugagaaaua

SEQ ID NO: 2916675 - RNA, 19 nt, Human
uugaauguggcuugagaaa

SEQ ID NO: 2916676 - RNA, 20 nt, Human
uugaaugacaacagaagcuu

SEQ ID NO: 2916677 - RNA, 21 nt, Human
uugaaugacaacagaagcuuc

SEQ ID NO: 2916678 - RNA, 15 nt, Human
uugaagcaguugugu

SEQ ID NO: 2916679 - RNA, 16 nt, Human
uucuuaugcaaaaugg

SEQ ID NO: 2916680 - RNA, 17 nt, Human
uucuuaugcaaaaugga

SEQ ID NO: 2916681 - RNA, 18 nt, Human
uucuuaugcaaaauggaa

SEQ ID NO: 2916682 - RNA, 17 nt, Human
uucuuauacgcuuuucu

SEQ ID NO: 2916683 - RNA, 20 nt, Human
uucuuauacgcuuuucuuug

SEQ ID NO: 2916684 - RNA, 22 nt, Human
uucuuaguguugguuuaauauu

SEQ ID NO: 2916685 - RNA, 15 nt, Human
uucuuagcuuuuuaa

SEQ ID NO: 2916686 - RNA, 13 nt, Human
uucuuagugacuu

SEQ ID NO: 2916687 - RNA, 19 nt, Human
uucuuagcuuuuuaauugu

SEQ ID NO: 2916688 - RNA, 20 nt, Human
uucuuagcuuuuuaauuguu

SEQ ID NO: 2916689 - RNA, 17 nt, Human
uucuuauguugcccagu

SEQ ID NO: 2916690 - RNA, 19 nt, Human
uucuuauugcgcugcuacc

SEQ ID NO: 2916691 - RNA, 22 nt, Human
uucuuauggaauugauuugcau

SEQ ID NO: 2916692 - RNA, 18 nt, Human
uucuuauggaauugauuu

SEQ ID NO: 2916693 - RNA, 17 nt, Human
uucuuauggaauugauu

SEQ ID NO: 2916694 - RNA, 15 nt, Human
uucuuauggaauuga

SEQ ID NO: 2916695 - RNA, 23 nt, Human
uucuuaugccauguuaauuucau

SEQ ID NO: 2916696 - RNA, 14 nt, Human
uucuucagagauca

SEQ ID NO: 2916697 - RNA, 11 nt, Human
uucuucagaga

SEQ ID NO: 2916698 - RNA, 23 nt, Human
uucuucagccaccucucuuuuuc

SEQ ID NO: 2916699 - RNA, 18 nt, Human
uucuucagcguaaaaugg

SEQ ID NO: 2916700 - RNA, 19 nt, Human
uucuucagcguaaaauggu

SEQ ID NO: 2916701 - RNA, 20 nt, Human
uucuucagcguaaaauggug

SEQ ID NO: 2916702 - RNA, 22 nt, Human
uucuucagcguaaaauggugaa

SEQ ID NO: 2916703 - RNA, 23 nt, Human
uucuucaggcugccuaagacaug

SEQ ID NO: 2916704 - RNA, 24 nt, Human
uucuucaggcugccuaagacaugu

SEQ ID NO: 2916705 - RNA, 14 nt, Human
uucuucagccaccu

SEQ ID NO: 2916706 - RNA, 15 nt, Human
uucuucauauucuaa

SEQ ID NO: 2916707 - RNA, 20 nt, Human
uucuucauauucuaaaacca

SEQ ID NO: 2916708 - RNA, 18 nt, Human
uucuucaucugugacucc

SEQ ID NO: 2916709 - RNA, 22 nt, Human
uucuugugccauagucacaugg

SEQ ID NO: 2916710 - RNA, 14 nt, Human
uucuugugcuuuuc

SEQ ID NO: 2916711 - RNA, 22 nt, Human
uucuuuaaagaaguugaaguuu

SEQ ID NO: 2916712 - RNA, 13 nt, Human
uucuuuaaagaug

SEQ ID NO: 2916713 - RNA, 13 nt, Human
uucuuuaaauguu

SEQ ID NO: 2916714 - RNA, 14 nt, Human
uucuuuaaauguuu

SEQ ID NO: 2916715 - RNA, 12 nt, Human
uucuuuaaauua

SEQ ID NO: 2916716 - RNA, 13 nt, Human
uucuuuaaauuau

SEQ ID NO: 2916717 - RNA, 15 nt, Human
uucuuuaaauuaugu

SEQ ID NO: 2916718 - RNA, 13 nt, Human
uucuugucaaaaa

SEQ ID NO: 2916719 - RNA, 14 nt, Human
uucuugucaaaaaa

SEQ ID NO: 2916720 - RNA, 15 nt, Human
uucuugucagacaua

SEQ ID NO: 2916721 - RNA, 16 nt, Human
uucuugucagacauaa

SEQ ID NO: 2916722 - RNA, 17 nt, Human
uucuugucagacauaaa

SEQ ID NO: 2916723 - RNA, 19 nt, Human
uucuugucagacauaaagc

SEQ ID NO: 2916724 - RNA, 20 nt, Human
uucuugucagacauaaagcc

SEQ ID NO: 2916725 - RNA, 21 nt, Human
uucuugucagacauaaagcca

SEQ ID NO: 2916726 - RNA, 11 nt, Human
uucuugugaag

SEQ ID NO: 2916727 - RNA, 17 nt, Human
uucuugugaaggccaug

SEQ ID NO: 2916728 - RNA, 14 nt, Human
uucuugucuauagu

SEQ ID NO: 2916729 - RNA, 15 nt, Human
uucuugucuauaguu

SEQ ID NO: 2916730 - RNA, 23 nt, Human
uucuugucuauaguugucaguau

SEQ ID NO: 2916731 - RNA, 15 nt, Human
uucuaaagcucugac

SEQ ID NO: 2916732 - RNA, 16 nt, Human
uucuaaagcucugaca

SEQ ID NO: 2916733 - RNA, 17 nt, Human
uucuaaagcucugacau

SEQ ID NO: 2916734 - RNA, 20 nt, Human
uucuaagugaaauuucuagc

SEQ ID NO: 2916735 - RNA, 22 nt, Human
uucuaagugaaauuucuagccu

SEQ ID NO: 2916736 - RNA, 12 nt, Human
uucuaaguuucu

SEQ ID NO: 2916737 - RNA, 13 nt, Human
uucuaaguuucua

SEQ ID NO: 2916738 - RNA, 14 nt, Human
uucuaaguuucuaa

SEQ ID NO: 2916739 - RNA, 16 nt, Human
uucuaaguuucuaaga

SEQ ID NO: 2916740 - RNA, 15 nt, Human
uucuggcagaggagg

SEQ ID NO: 2916741 - RNA, 23 nt, Human
uucuggcaguuuugacaucagcc

SEQ ID NO: 2916742 - RNA, 17 nt, Human
uucuaaguuucuaagau

SEQ ID NO: 2916743 - RNA, 18 nt, Human
uucuaaguuucuaagauu

SEQ ID NO: 2916744 - RNA, 15 nt, Human
uucuggccucccaca

SEQ ID NO: 2916745 - RNA, 14 nt, Human
uucuggccucccac

SEQ ID NO: 2916746 - RNA, 13 nt, Human
uucuguauacaac

SEQ ID NO: 2916747 - RNA, 21 nt, Human
uucuguauacaacccuggcau

SEQ ID NO: 2916748 - RNA, 17 nt, Human
uucuggccuuuccucuc

SEQ ID NO: 2916749 - RNA, 20 nt, Human
uucuggccuuuccucucucc

SEQ ID NO: 2916750 - RNA, 21 nt, Human
uucuggccuuuccucucuccu

SEQ ID NO: 2916751 - RNA, 23 nt, Human
uucuguauacaacccuggcauua

SEQ ID NO: 2916752 - RNA, 24 nt, Human
uucuguauacaacccuggcauuau

SEQ ID NO: 2916753 - RNA, 15 nt, Human
uucuguauauacuuu

SEQ ID NO: 2916754 - RNA, 16 nt, Human
uucuguauauaaaugg

SEQ ID NO: 2916755 - RNA, 17 nt, Human
uucuguauauaaauggg

SEQ ID NO: 2916756 - RNA, 18 nt, Human
uucuguauauaaauggga

SEQ ID NO: 2916757 - RNA, 19 nt, Human
uucuguauauaaaugggaa

SEQ ID NO: 2916758 - RNA, 21 nt, Human
uucuguauauaaaugggaaca

SEQ ID NO: 2916759 - RNA, 17 nt, Human
uucuguauauacuuuuu

SEQ ID NO: 2916760 - RNA, 16 nt, Human
uucuguauauacuuuu

SEQ ID NO: 2916761 - RNA, 18 nt, Human
uucugugaugagcugauc

SEQ ID NO: 2916762 - RNA, 16 nt, Human
uucugugcccuacuca

SEQ ID NO: 2916763 - RNA, 17 nt, Human
uucugugaugagcugau

SEQ ID NO: 2916764 - RNA, 19 nt, Human
uucugugagacccccacac

SEQ ID NO: 2916765 - RNA, 17 nt, Human
uucugugaucauuuauu

SEQ ID NO: 2916766 - RNA, 20 nt, Human
uugccauggaguugugauca

SEQ ID NO: 2916767 - RNA, 21 nt, Human
uugccauccuaaaagccaccc

SEQ ID NO: 2916768 - RNA, 19 nt, Human
uugccauguuggccaggcu

SEQ ID NO: 2916769 - RNA, 18 nt, Human
uugccauguuggccaggc

SEQ ID NO: 2916770 - RNA, 17 nt, Human
uugccauguuggccagg

SEQ ID NO: 2916771 - RNA, 16 nt, Human
uugccauguuggccag

SEQ ID NO: 2916772 - RNA, 23 nt, Human
uugcagcuaaggaggggaaaaaa

SEQ ID NO: 2916773 - RNA, 15 nt, Human
uugccagaaguugug

SEQ ID NO: 2916774 - RNA, 18 nt, Human
uugccagaugcugcagag

SEQ ID NO: 2916775 - RNA, 14 nt, Human
uugcauaaagcaua

SEQ ID NO: 2916776 - RNA, 17 nt, Human
uugcagcucccauucua

SEQ ID NO: 2916777 - RNA, 22 nt, Human
uugcagcucccauucuaugugu

SEQ ID NO: 2916778 - RNA, 23 nt, Human
uugcagcucccauucuauguguc

SEQ ID NO: 2916779 - RNA, 16 nt, Human
uugcaguucagcacca

SEQ ID NO: 2916780 - RNA, 13 nt, Human
uugcaguucaccu

SEQ ID NO: 2916781 - RNA, 13 nt, Human
uugcaguucuuga

SEQ ID NO: 2916782 - RNA, 15 nt, Human
uugcagcccuuguga

SEQ ID NO: 2916783 - RNA, 21 nt, Human
uugcagcccuugugaugugau

SEQ ID NO: 2916784 - RNA, 17 nt, Human
uugcagcaauuaaaaau

SEQ ID NO: 2916785 - RNA, 23 nt, Human
uugcagacaggcaagcaccuccu

SEQ ID NO: 2916786 - RNA, 19 nt, Human
uugauucauaguaacuucu

SEQ ID NO: 2916787 - RNA, 20 nt, Human
uugcacuugugauuauuuau

SEQ ID NO: 2916788 - RNA, 17 nt, Human
uugcacuggaguucuau

SEQ ID NO: 2916789 - RNA, 12 nt, Human
uugcacuuugua

SEQ ID NO: 2916790 - RNA, 13 nt, Human
uugcacuuuguag

SEQ ID NO: 2916791 - RNA, 14 nt, Human
uugcacuuuguagu

SEQ ID NO: 2916792 - RNA, 17 nt, Human
uugcacuugugauuauu

SEQ ID NO: 2916793 - RNA, 14 nt, Human
uugauucagccugu

SEQ ID NO: 2916794 - RNA, 16 nt, Human
uugcacuccagccugg

SEQ ID NO: 2916795 - RNA, 19 nt, Human
uugcacugaaauggaauuc

SEQ ID NO: 2916796 - RNA, 14 nt, Human
uugaggcugcagcg

SEQ ID NO: 2916797 - RNA, 13 nt, Human
uugauaugaguau

SEQ ID NO: 2916798 - RNA, 16 nt, Human
uugauaugaguauaca

SEQ ID NO: 2916799 - RNA, 18 nt, Human
uugauaugaguauacaau

SEQ ID NO: 2916800 - RNA, 22 nt, Human
uugauauuuucaacgcagcccu

SEQ ID NO: 2916801 - RNA, 21 nt, Human
uugauauguuuuauuucauug

SEQ ID NO: 2916802 - RNA, 12 nt, Human
uugauauuguga

SEQ ID NO: 2916803 - RNA, 14 nt, Human
uugauauugugaac

SEQ ID NO: 2916804 - RNA, 17 nt, Human
uugauauugugaacauu

SEQ ID NO: 2916805 - RNA, 20 nt, Human
uugauauugugaacauuugu

SEQ ID NO: 2916806 - RNA, 23 nt, Human
uugaucauaaacugacuaucaua

SEQ ID NO: 2916807 - RNA, 14 nt, Human
uugaucacacuauu

SEQ ID NO: 2916808 - RNA, 17 nt, Human
uugaucacacuauuuua

SEQ ID NO: 2916809 - RNA, 18 nt, Human
uugaggauuuagaagugu

SEQ ID NO: 2916810 - RNA, 15 nt, Human
uugauauuuucuaua

SEQ ID NO: 2916811 - RNA, 14 nt, Human
uugaucauuucuug

SEQ ID NO: 2916812 - RNA, 17 nt, Human
uugaucauuucuuguga

SEQ ID NO: 2916813 - RNA, 18 nt, Human
uugaucauuuucccccca

SEQ ID NO: 2916814 - RNA, 22 nt, Human
uugaucauuuuccccccacucu

SEQ ID NO: 2916815 - RNA, 19 nt, Human
uugaucauuuuccccccac

SEQ ID NO: 2916816 - RNA, 18 nt, Human
uugauccauccagcuugc

SEQ ID NO: 2916817 - RNA, 21 nt, Human
uugauccauccagcuugccag

SEQ ID NO: 2916818 - RNA, 18 nt, Human
uugaagauaguaacugua

SEQ ID NO: 2916819 - RNA, 16 nt, Human
uugaauguuaagaauu

SEQ ID NO: 2916820 - RNA, 17 nt, Human
uugaauguuaagaauug

SEQ ID NO: 2916821 - RNA, 23 nt, Human
uugaauguuauuuguuauuuuca

SEQ ID NO: 2916822 - RNA, 12 nt, Human
uugaauuaaaac

SEQ ID NO: 2916823 - RNA, 14 nt, Human
uugaauuaaaacuu

SEQ ID NO: 2916824 - RNA, 16 nt, Human
uugaauuaaaacuucu

SEQ ID NO: 2916825 - RNA, 17 nt, Human
uugaauuaaaacuucuu

SEQ ID NO: 2916826 - RNA, 20 nt, Human
uugagcgugaaucuguaucu

SEQ ID NO: 2916827 - RNA, 15 nt, Human
uugagcuauugcugu

SEQ ID NO: 2916828 - RNA, 13 nt, Human
uugagcucagccc

SEQ ID NO: 2916829 - RNA, 13 nt, Human
uugaggccaggag

SEQ ID NO: 2916830 - RNA, 13 nt, Human
uugaggcaagugu

SEQ ID NO: 2916831 - RNA, 18 nt, Human
uugaggcaagugugggcc

SEQ ID NO: 2916832 - RNA, 16 nt, Human
uugagcugauauaaau

SEQ ID NO: 2916833 - RNA, 12 nt, Human
uugaggagcccc

SEQ ID NO: 2916834 - RNA, 15 nt, Human
uugaggagcauguuu

SEQ ID NO: 2916835 - RNA, 16 nt, Human
uugaggagcauguuuu

SEQ ID NO: 2916836 - RNA, 18 nt, Human
uugaggagcauguuuugu

SEQ ID NO: 2916837 - RNA, 21 nt, Human
uugaggagcauguuuuguaua

SEQ ID NO: 2916838 - RNA, 23 nt, Human
uugaggagcauguuuuguauaca

SEQ ID NO: 2916839 - RNA, 16 nt, Human
uugaggagccccagcu

SEQ ID NO: 2916840 - RNA, 20 nt, Human
uuggucugacccacugcuuu

SEQ ID NO: 2916841 - RNA, 13 nt, Human
uuggucuggacug

SEQ ID NO: 2916842 - RNA, 17 nt, Human
uuggucuggacugacag

SEQ ID NO: 2916843 - RNA, 14 nt, Human
uuggucucuauuuc

SEQ ID NO: 2916844 - RNA, 18 nt, Human
uuggucucuauuucauuu

SEQ ID NO: 2916845 - RNA, 17 nt, Human
uuggucuaauuuauuca

SEQ ID NO: 2916846 - RNA, 14 nt, Human
uugguccugucccc

SEQ ID NO: 2916847 - RNA, 17 nt, Human
uugguccuguccccgca

SEQ ID NO: 2916848 - RNA, 12 nt, Human
uugguaaugugu

SEQ ID NO: 2916849 - RNA, 14 nt, Human
uugguaagagacag

SEQ ID NO: 2916850 - RNA, 18 nt, Human
uugguaagagacagaaug

SEQ ID NO: 2916851 - RNA, 13 nt, Human
uugguacaaaaau

SEQ ID NO: 2916852 - RNA, 14 nt, Human
uugguacaaaaaua

SEQ ID NO: 2916853 - RNA, 15 nt, Human
uugguacaaaaauaa

SEQ ID NO: 2916854 - RNA, 14 nt, Human
uugguacacaacua

SEQ ID NO: 2916855 - RNA, 20 nt, Human
uugguacauggccaguguga

SEQ ID NO: 2916856 - RNA, 22 nt, Human
uugggaucgcauugcauaccuu

SEQ ID NO: 2916857 - RNA, 16 nt, Human
uugggauuuuagaaca

SEQ ID NO: 2916858 - RNA, 19 nt, Human
uugguaacacaaauuuuca

SEQ ID NO: 2916859 - RNA, 16 nt, Human
uugggauacugcaggg

SEQ ID NO: 2916860 - RNA, 15 nt, Human
uugggaggcugaggc

SEQ ID NO: 2916861 - RNA, 19 nt, Human
uugggagggaaaagggaag

SEQ ID NO: 2916862 - RNA, 12 nt, Human
uugggaguccag

SEQ ID NO: 2916863 - RNA, 14 nt, Human
uugggaguccaggc

SEQ ID NO: 2916864 - RNA, 15 nt, Human
uugggaguccaggca

SEQ ID NO: 2916865 - RNA, 17 nt, Human
uugggaguccaggcaca

SEQ ID NO: 2916866 - RNA, 18 nt, Human
uugggaguccaggcacag

SEQ ID NO: 2916867 - RNA, 20 nt, Human
uugggaguccaggcacagga

SEQ ID NO: 2916868 - RNA, 18 nt, Human
uugggaguuuugaauguu

SEQ ID NO: 2916869 - RNA, 17 nt, Human
uugggagcuugggaaug

SEQ ID NO: 2916870 - RNA, 11 nt, Human
uugggagcagg

SEQ ID NO: 2916871 - RNA, 14 nt, Human
uugggagccucugg

SEQ ID NO: 2916872 - RNA, 20 nt, Human
uuggcagugagugagccugg

SEQ ID NO: 2916873 - RNA, 16 nt, Human
uuggcagguccuggcc

SEQ ID NO: 2916874 - RNA, 20 nt, Human
uuggcagguccuggccagau

SEQ ID NO: 2916875 - RNA, 19 nt, Human
uuggcaguguuuugagaac

SEQ ID NO: 2916876 - RNA, 14 nt, Human
uuggcaguuuggua

SEQ ID NO: 2916877 - RNA, 15 nt, Human
uuggcaguuugguau

SEQ ID NO: 2916878 - RNA, 17 nt, Human
uuggcuuacugcagccu

SEQ ID NO: 2916879 - RNA, 23 nt, Human
uuggcagugagugagccuggcuc

SEQ ID NO: 2916880 - RNA, 11 nt, Human
uuggcuucugu

SEQ ID NO: 2916881 - RNA, 21 nt, Human
uuggcuuccaugaugguuauu

SEQ ID NO: 2916882 - RNA, 22 nt, Human
uuggcuucugugaugagcugau

SEQ ID NO: 2916883 - RNA, 14 nt, Human
uuggcuugacucag

SEQ ID NO: 2916884 - RNA, 18 nt, Human
uuggcuuguagaauuguu

SEQ ID NO: 2916885 - RNA, 21 nt, Human
uuggcuuguagaauuguuaua

SEQ ID NO: 2916886 - RNA, 20 nt, Human
uugggacccugcuuuagagc

SEQ ID NO: 2916887 - RNA, 22 nt, Human
uugggacccugcuuuagagcua

SEQ ID NO: 2916888 - RNA, 15 nt, Human
uugggagagccccug

SEQ ID NO: 2916889 - RNA, 16 nt, Human
uugggagagccccugg

SEQ ID NO: 2916890 - RNA, 18 nt, Human
uugggaauggauccugga

SEQ ID NO: 2916891 - RNA, 21 nt, Human
uugggaaggggacccccgccc

SEQ ID NO: 2916892 - RNA, 19 nt, Human
uugggaauauccauguacu

SEQ ID NO: 2916893 - RNA, 14 nt, Human
uuguaaacaaacuc

SEQ ID NO: 2916894 - RNA, 15 nt, Human
uuguaaacaaacucu

SEQ ID NO: 2916895 - RNA, 16 nt, Human
uuguaaacaaacucuu

SEQ ID NO: 2916896 - RNA, 19 nt, Human
uuguaaaauguucucuuau

SEQ ID NO: 2916897 - RNA, 14 nt, Human
uuguaaacaugugu

SEQ ID NO: 2916898 - RNA, 15 nt, Human
uuguaaacauguguu

SEQ ID NO: 2916899 - RNA, 16 nt, Human
uuguaaacucaaaaua

SEQ ID NO: 2916900 - RNA, 22 nt, Human
uuguaaacucaaaauauuugua

SEQ ID NO: 2916901 - RNA, 20 nt, Human
uuguacauuuaugauuuaau

SEQ ID NO: 2916902 - RNA, 14 nt, Human
uuguaccucuggcu

SEQ ID NO: 2916903 - RNA, 21 nt, Human
uuguaccuguaggacucucau

SEQ ID NO: 2916904 - RNA, 23 nt, Human
uuguaccuuuuuuguuuuuucaa

SEQ ID NO: 2916905 - RNA, 23 nt, Human
uuguacauuuaugauuuaauaaa

SEQ ID NO: 2916906 - RNA, 17 nt, Human
uuguacuguuuaauguu

SEQ ID NO: 2916907 - RNA, 24 nt, Human
uuguacuguuuaauguucugugau

SEQ ID NO: 2916908 - RNA, 14 nt, Human
uuguaucuuaaauu

SEQ ID NO: 2916909 - RNA, 19 nt, Human
uuguagcagauuguuuccu

SEQ ID NO: 2916910 - RNA, 22 nt, Human
uuguagcagauuguuuccucuu

SEQ ID NO: 2916911 - RNA, 23 nt, Human
uuguagcauauaggugauguuug

SEQ ID NO: 2916912 - RNA, 20 nt, Human
uugucuaugggacucaaugc

SEQ ID NO: 2916913 - RNA, 13 nt, Human
uugucaacauugu

SEQ ID NO: 2916914 - RNA, 14 nt, Human
uugucaacauugug

SEQ ID NO: 2916915 - RNA, 15 nt, Human
uugucaacauuguga

SEQ ID NO: 2916916 - RNA, 19 nt, Human
uugucucuaugccagcuca

SEQ ID NO: 2916917 - RNA, 12 nt, Human
uugucucuccuu

SEQ ID NO: 2916918 - RNA, 13 nt, Human
uugucucuccuuu

SEQ ID NO: 2916919 - RNA, 14 nt, Human
uugucucuccuuuu

SEQ ID NO: 2916920 - RNA, 16 nt, Human
uugucucuccuuuucu

SEQ ID NO: 2916921 - RNA, 21 nt, Human
uugucucuccuuuucuuuugu

SEQ ID NO: 2916922 - RNA, 22 nt, Human
uugucucuccuuuucuuuuguu

SEQ ID NO: 2916923 - RNA, 14 nt, Human
uugucucucuucag

SEQ ID NO: 2916924 - RNA, 15 nt, Human
uugucucucuucaga

SEQ ID NO: 2916925 - RNA, 19 nt, Human
uugucucucuucagacucu

SEQ ID NO: 2916926 - RNA, 17 nt, Human
uugucuccuacuccuga

SEQ ID NO: 2916927 - RNA, 18 nt, Human
uugucuccuacuccugac

SEQ ID NO: 2916928 - RNA, 17 nt, Human
uugucucguuugugauu

SEQ ID NO: 2916929 - RNA, 14 nt, Human
uugucucuacuuuu

SEQ ID NO: 2916930 - RNA, 12 nt, Human
uugucuauuuau

SEQ ID NO: 2916931 - RNA, 11 nt, Human
uugucuauuuu

SEQ ID NO: 2916932 - RNA, 12 nt, Human
uugucuauuuua

SEQ ID NO: 2916933 - RNA, 13 nt, Human
uugucuauuuuaa

SEQ ID NO: 2916934 - RNA, 16 nt, Human
uugucuauuuuaaaau

SEQ ID NO: 2916935 - RNA, 20 nt, Human
uugucuauaguugucaguau

SEQ ID NO: 2916936 - RNA, 16 nt, Human
uugucuauuuuugucu

SEQ ID NO: 2916937 - RNA, 17 nt, Human
uugucuauuuuugucuu

SEQ ID NO: 2916938 - RNA, 15 nt, Human
uuguaugcaauggau

SEQ ID NO: 2916939 - RNA, 18 nt, Human
uugucuauuuuugucuua

SEQ ID NO: 2916940 - RNA, 18 nt, Human
uugucugaagucacugca

SEQ ID NO: 2916941 - RNA, 17 nt, Human
uugucugaagucacugc

SEQ ID NO: 2916942 - RNA, 14 nt, Human
uugucuaugggacu

SEQ ID NO: 2916943 - RNA, 23 nt, Human
uuguauuuugugugaccaacugu

SEQ ID NO: 2916944 - RNA, 20 nt, Human
uuguaugauguguugugaua

SEQ ID NO: 2916945 - RNA, 21 nt, Human
uuguaugauguguugugauag

SEQ ID NO: 2916946 - RNA, 13 nt, Human
uuguaugaugugu

SEQ ID NO: 2916947 - RNA, 14 nt, Human
uuguaugauguguu

SEQ ID NO: 2916948 - RNA, 16 nt, Human
uuguaugauguguugu

SEQ ID NO: 2916949 - RNA, 18 nt, Human
uuguaugauguguuguga

SEQ ID NO: 2916950 - RNA, 20 nt, Human
uuguaugauccuaaugaaug

SEQ ID NO: 2916951 - RNA, 22 nt, Human
uuguaugaaagauggcugugcc

SEQ ID NO: 2916952 - RNA, 21 nt, Human
uugcugccugaagaacaguaa

SEQ ID NO: 2916953 - RNA, 21 nt, Human
uugcggccaguauuagacugg

SEQ ID NO: 2916954 - RNA, 12 nt, Human
uugcuaacugaa

SEQ ID NO: 2916955 - RNA, 13 nt, Human
uugcuaacugaac

SEQ ID NO: 2916956 - RNA, 15 nt, Human
uugcuaacugaacuu

SEQ ID NO: 2916957 - RNA, 16 nt, Human
uugcuaacugaacuuu

SEQ ID NO: 2916958 - RNA, 19 nt, Human
uugcuaacugaacuuugaa

SEQ ID NO: 2916959 - RNA, 21 nt, Human
uugcuaacugaacuuugaaga

SEQ ID NO: 2916960 - RNA, 13 nt, Human
uugcugcuagaac

SEQ ID NO: 2916961 - RNA, 14 nt, Human
uugcugcuagaacu

SEQ ID NO: 2916962 - RNA, 15 nt, Human
uugcugcuagaacuu

SEQ ID NO: 2916963 - RNA, 16 nt, Human
uugcugcuagaacuuu

SEQ ID NO: 2916964 - RNA, 17 nt, Human
uugcugcuagaacuuuu

SEQ ID NO: 2916965 - RNA, 18 nt, Human
uugcugcuagaacuuuuu

SEQ ID NO: 2916966 - RNA, 23 nt, Human
uugcugcuagaacuuuuuuaaau

SEQ ID NO: 2916967 - RNA, 15 nt, Human
uugcuguccuaggcc

SEQ ID NO: 2916968 - RNA, 16 nt, Human
uugcuguccugaucug

SEQ ID NO: 2916969 - RNA, 20 nt, Human
uugcuguccugaucugugau

SEQ ID NO: 2916970 - RNA, 11 nt, Human
uugcugucucu

SEQ ID NO: 2916971 - RNA, 12 nt, Human
uugcugucucug

SEQ ID NO: 2916972 - RNA, 14 nt, Human
uugcugucucugcu

SEQ ID NO: 2916973 - RNA, 15 nt, Human
uugcugucucugcuc

SEQ ID NO: 2916974 - RNA, 16 nt, Human
uugcugucucugcucg

SEQ ID NO: 2916975 - RNA, 14 nt, Human
uugcugucugcagc

SEQ ID NO: 2916976 - RNA, 18 nt, Human
uugcugucugcagccuug

SEQ ID NO: 2916977 - RNA, 18 nt, Human
uugcugugaacaauuguc

SEQ ID NO: 2916978 - RNA, 14 nt, Human
uugcugugaacuga

SEQ ID NO: 2916979 - RNA, 11 nt, Human
uugcuguccua

SEQ ID NO: 2916980 - RNA, 20 nt, Human
uugcugugagcaagaaguca

SEQ ID NO: 2916981 - RNA, 11 nt, Human
uugcuggcuug

SEQ ID NO: 2916982 - RNA, 23 nt, Human
uugcuggacugucauagaaauua

SEQ ID NO: 2916983 - RNA, 21 nt, Human
uugcuggacggggacugggga

SEQ ID NO: 2916984 - RNA, 23 nt, Human
uugcuggacggggacuggggaug

SEQ ID NO: 2916985 - RNA, 17 nt, Human
uugccuuuuucauuuuc

SEQ ID NO: 2916986 - RNA, 20 nt, Human
uugccuuuuucauuuuccaa

SEQ ID NO: 2916987 - RNA, 22 nt, Human
uugccuuuuucauuuuccaaua

SEQ ID NO: 2916988 - RNA, 19 nt, Human
uugcgaauccaagcucccu

SEQ ID NO: 2916989 - RNA, 20 nt, Human
uugcgaauccaagcucccug

SEQ ID NO: 2916990 - RNA, 19 nt, Human
uugcgauagagucucacug

SEQ ID NO: 2916991 - RNA, 16 nt, Human
uugccuuugaauguua

SEQ ID NO: 2916992 - RNA, 17 nt, Human
uugccuuugaauguuaa

SEQ ID NO: 2916993 - RNA, 20 nt, Human
uugccuugggcugcuccuca

SEQ ID NO: 2916994 - RNA, 22 nt, Human
uugccuuuagugaucacagcag

SEQ ID NO: 2916995 - RNA, 23 nt, Human
uugccuuuagugaucacagcagc

SEQ ID NO: 2916996 - RNA, 17 nt, Human
uugccuuuguuuugaug

SEQ ID NO: 2916997 - RNA, 21 nt, Human
uugccauguuggccaggcugg

SEQ ID NO: 2916998 - RNA, 20 nt, Human
uugccauguuggccaggcug

SEQ ID NO: 2916999 - RNA, 17 nt, Human
uugccauuggacaguug

SEQ ID NO: 2917000 - RNA, 18 nt, Human
uugccauuggacaguugu

SEQ ID NO: 2917001 - RNA, 13 nt, Human
uugccauuuagcg

SEQ ID NO: 2917002 - RNA, 13 nt, Human
uugccauuugaua

SEQ ID NO: 2917003 - RNA, 18 nt, Human
uugccauuugauaccccu

SEQ ID NO: 2917004 - RNA, 21 nt, Human
uugccauuugauaccccuggg

SEQ ID NO: 2917005 - RNA, 20 nt, Human
uugccaugggcuucacugua

SEQ ID NO: 2917006 - RNA, 21 nt, Human
uugccaugggcuucacuguau

SEQ ID NO: 2917007 - RNA, 22 nt, Human
uugccaugggcuucacuguaua

SEQ ID NO: 2917008 - RNA, 14 nt, Human
uugccauguguuuu

SEQ ID NO: 2917009 - RNA, 14 nt, Human
uugccauguugcca

SEQ ID NO: 2917010 - RNA, 15 nt, Human
uugccuuccuaagcc

SEQ ID NO: 2917011 - RNA, 22 nt, Human
uugccuuccuaagccuguggcu

SEQ ID NO: 2917012 - RNA, 20 nt, Human
uugccuuccuuucuccagga

SEQ ID NO: 2917013 - RNA, 22 nt, Human
uugccuuccuuucuccaggacc

SEQ ID NO: 2917014 - RNA, 23 nt, Human
uugccuuccuuucuccaggacca

SEQ ID NO: 2917015 - RNA, 14 nt, Human
uugccuucuuugaa

SEQ ID NO: 2917016 - RNA, 16 nt, Human
uugccuucuuugaaga

SEQ ID NO: 2917017 - RNA, 17 nt, Human
uugccuucuuugaagaa

SEQ ID NO: 2917018 - RNA, 18 nt, Human
uugccuucuuugaagaag

SEQ ID NO: 2917019 - RNA, 15 nt, Human
uugccuugcagaacu

SEQ ID NO: 2917020 - RNA, 17 nt, Human
uugccuugcagaacugc

SEQ ID NO: 2917021 - RNA, 19 nt, Human
uugccuugcagaacugcca

SEQ ID NO: 2917022 - RNA, 20 nt, Human
uugccuugcagaacugccau

SEQ ID NO: 2917023 - RNA, 16 nt, Human
uugccuuaaagaaagu

SEQ ID NO: 2917024 - RNA, 17 nt, Human
uugccuuauuaaaguuc

SEQ ID NO: 2917025 - RNA, 14 nt, Human
uuggaagaggaaaa

SEQ ID NO: 2917026 - RNA, 19 nt, Human
uuggaagauccugugagga

SEQ ID NO: 2917027 - RNA, 21 nt, Human
uuggaagauccugugaggagc

SEQ ID NO: 2917028 - RNA, 15 nt, Human
uuggaagauucagcu

SEQ ID NO: 2917029 - RNA, 19 nt, Human
uuggaagauuuucagucua

SEQ ID NO: 2917030 - RNA, 13 nt, Human
uuggaagagaaag

SEQ ID NO: 2917031 - RNA, 13 nt, Human
uuggaagagaauc

SEQ ID NO: 2917032 - RNA, 15 nt, Human
uuggaagagaaucac

SEQ ID NO: 2917033 - RNA, 19 nt, Human
uuggaagcuccgcuuucua

SEQ ID NO: 2917034 - RNA, 17 nt, Human
uuggaagcucugaaguc

SEQ ID NO: 2917035 - RNA, 15 nt, Human
uugcuguguuuaauu

SEQ ID NO: 2917036 - RNA, 17 nt, Human
uugcuguguuuaauuug

SEQ ID NO: 2917037 - RNA, 18 nt, Human
uugcuguguuuaauuuga

SEQ ID NO: 2917038 - RNA, 21 nt, Human
uugcuguguuuaauuugacuu

SEQ ID NO: 2917039 - RNA, 22 nt, Human
uugcuguuaugucuguuuaaga

SEQ ID NO: 2917040 - RNA, 15 nt, Human
uugcuguugaaagca

SEQ ID NO: 2917041 - RNA, 16 nt, Human
uugcuguugaaagcaa

SEQ ID NO: 2917042 - RNA, 17 nt, Human
uugcuguugaaagcaaa

SEQ ID NO: 2917043 - RNA, 21 nt, Human
uugcuguugaaagcaaaaaug

SEQ ID NO: 2917044 - RNA, 22 nt, Human
uugcuguugaaagcaaaaaugc

SEQ ID NO: 2917045 - RNA, 23 nt, Human
uugcuguugaaagcaaaaaugcu

SEQ ID NO: 2917046 - RNA, 12 nt, Human
uugcuguugaca

SEQ ID NO: 2917047 - RNA, 20 nt, Human
uugcuguugacauauuuaau

SEQ ID NO: 2917048 - RNA, 14 nt, Human
uugcuguugcuuga

SEQ ID NO: 2917049 - RNA, 15 nt, Human
uugcuguugcuugaa

SEQ ID NO: 2917050 - RNA, 13 nt, Human
uugcuguuuccuu

SEQ ID NO: 2917051 - RNA, 15 nt, Human
uugcuguuuccuuuu

SEQ ID NO: 2917052 - RNA, 18 nt, Human
uuggaaugggcagcucau

SEQ ID NO: 2917053 - RNA, 17 nt, Human
uuggaaugggcagcuca

SEQ ID NO: 2917054 - RNA, 15 nt, Human
uuggaauugucuuua

SEQ ID NO: 2917055 - RNA, 13 nt, Human
uuggaauuuacca

SEQ ID NO: 2917056 - RNA, 13 nt, Human
uuggaauacuuuu

SEQ ID NO: 2917057 - RNA, 15 nt, Human
uuggaauaggaauaa

SEQ ID NO: 2917058 - RNA, 16 nt, Human
uuggacauagauauuu

SEQ ID NO: 2917059 - RNA, 17 nt, Human
uuggacauagauauuuu

SEQ ID NO: 2917060 - RNA, 23 nt, Human
uuggacauagauauuuucacaau

SEQ ID NO: 2917061 - RNA, 23 nt, Human
uuggacaaucaugaaauaugcau

SEQ ID NO: 2917062 - RNA, 19 nt, Human
uuggacaccuuuagguucu

SEQ ID NO: 2917063 - RNA, 15 nt, Human
uuggacacuguacaa

SEQ ID NO: 2917064 - RNA, 15 nt, Human
uuggacaaaugugaa

SEQ ID NO: 2917065 - RNA, 17 nt, Human
uuggacaaaugugaaga

SEQ ID NO: 2917066 - RNA, 19 nt, Human
uuggacaaaugugaagaug

SEQ ID NO: 2917067 - RNA, 21 nt, Human
uuggacaaaugugaagaugca

SEQ ID NO: 2917068 - RNA, 22 nt, Human
uuggacaaaugugaagaugcau

SEQ ID NO: 2917069 - RNA, 22 nt, Human
uuggauuugacauugcguuuga

SEQ ID NO: 2917070 - RNA, 14 nt, Human
uuggauuugacauu

SEQ ID NO: 2917071 - RNA, 14 nt, Human
uuggauuuguuuaa

SEQ ID NO: 2917072 - RNA, 18 nt, Human
uuggauuuguuuaaaagg

SEQ ID NO: 2917073 - RNA, 21 nt, Human
uuggauuuuuaauuaaaaacu

SEQ ID NO: 2917074 - RNA, 20 nt, Human
uuggcaauaguuugcauaga

SEQ ID NO: 2917075 - RNA, 16 nt, Human
uuggcaauauuccuua

SEQ ID NO: 2917076 - RNA, 16 nt, Human
uuggcaauaguuugca

SEQ ID NO: 2917077 - RNA, 11 nt, Human
uuggcaccaaa

SEQ ID NO: 2917078 - RNA, 12 nt, Human
uuggcaccaaag

SEQ ID NO: 2917079 - RNA, 18 nt, Human
uuggcaccaaagaugcag

SEQ ID NO: 2917080 - RNA, 23 nt, Human
uuggcaccaaagaugcagccgcc

SEQ ID NO: 2917081 - RNA, 15 nt, Human
uuggcagcaccuguc

SEQ ID NO: 2917082 - RNA, 19 nt, Human
uuuguguaauagaaaacug

SEQ ID NO: 2917083 - RNA, 12 nt, Human
uuuguggcuggg

SEQ ID NO: 2917084 - RNA, 14 nt, Human
uuugugggaauuua

SEQ ID NO: 2917085 - RNA, 17 nt, Human
uuugugggaauuuaaga

SEQ ID NO: 2917086 - RNA, 22 nt, Human
uuugugguacgaccuuuagauu

SEQ ID NO: 2917087 - RNA, 16 nt, Human
uuuguggugauauaga

SEQ ID NO: 2917088 - RNA, 20 nt, Human
uuuguggggcuuggcgugga

SEQ ID NO: 2917089 - RNA, 16 nt, Human
uuugugguuuuaugga

SEQ ID NO: 2917090 - RNA, 16 nt, Human
uuuguguaaugaaaau

SEQ ID NO: 2917091 - RNA, 13 nt, Human
caagcgccuggag

SEQ ID NO: 2917092 - RNA, 21 nt, Human
cuguccucccauccccuggac

SEQ ID NO: 2917093 - RNA, 15 nt, Human
caguccagccuggag

SEQ ID NO: 2917094 - RNA, 21 nt, Human
guguccuguaguugcguggac

SEQ ID NO: 2917095 - RNA, 20 nt, Human
guuugcacuguaugcuggac

SEQ ID NO: 2917096 - RNA, 15 nt, Human
gccuggcagccuggc

SEQ ID NO: 2917097 - RNA, 18 nt, Human
uuguaaaaagaaaaacca

SEQ ID NO: 2917098 - RNA, 21 nt, Human
gcuuuaaagggccugccuggc

SEQ ID NO: 2917099 - RNA, 15 nt, Human
gcucgugugccuggc

SEQ ID NO: 2917100 - RNA, 17 nt, Human
gccuguccagccugggc

SEQ ID NO: 2917101 - RNA, 18 nt, Human
cuguccaucagccaggac

SEQ ID NO: 2917102 - RNA, 13 nt, Human
guugcagcuggac

SEQ ID NO: 2917103 - RNA, 15 nt, Human
guuugaagccuggaa

SEQ ID NO: 2917104 - RNA, 23 nt, Human
uagaccaaggaacaaaaaaacca

SEQ ID NO: 2917105 - RNA, 23 nt, Human
gcugaguauggagcagccuggag

SEQ ID NO: 2917106 - RNA, 20 nt, Human
gcugcaucggaggccaggac

SEQ ID NO: 2917107 - RNA, 20 nt, Human
gcugcccugagcgccuggau

SEQ ID NO: 2917108 - RNA, 13 nt, Human
gcugcugccuggc

SEQ ID NO: 2917109 - RNA, 20 nt, Human
gcuccuccuuggugccuggc

SEQ ID NO: 2917110 - RNA, 12 nt, Human
gcuugccuggag

SEQ ID NO: 2917111 - RNA, 18 nt, Human
gcugugaggccccuggac

SEQ ID NO: 2917112 - RNA, 20 nt, Human
gcugugcagcgcagcuggac

SEQ ID NO: 2917113 - RNA, 14 nt, Human
gcuguggccugggc

SEQ ID NO: 2917114 - RNA, 13 nt, Human
gcugcagcuggac

SEQ ID NO: 2917115 - RNA, 15 nt, Human
gcucagugccuggac

SEQ ID NO: 2917116 - RNA, 11 nt, Human
ggcgccuggag

SEQ ID NO: 2917117 - RNA, 19 nt, Human
gcaugugaucacgccuggc

SEQ ID NO: 2917118 - RNA, 14 nt, Human
gcaggugccuggac

SEQ ID NO: 2917119 - RNA, 16 nt, Human
gccaguccugccuggc

SEQ ID NO: 2917120 - RNA, 19 nt, Human
gccuggccagggccuggaa

SEQ ID NO: 2917121 - RNA, 16 nt, Human
gccggcaggccuggac

SEQ ID NO: 2917122 - RNA, 20 nt, Human
gcugcaccugccagccuggc

SEQ ID NO: 2917123 - RNA, 17 nt, Human
gcugccaggccugggac

SEQ ID NO: 2917124 - RNA, 14 nt, Human
gcuauagccuggac

SEQ ID NO: 2917125 - RNA, 17 nt, Human
gcuggcugggcauggac

SEQ ID NO: 2917126 - RNA, 18 nt, Human
cuuucucuccagccugac

SEQ ID NO: 2917127 - RNA, 16 nt, Human
cuucucagccugguac

SEQ ID NO: 2917128 - RNA, 21 nt, Human
uugccuguguauggaaaaacc

SEQ ID NO: 2917129 - RNA, 17 nt, Human
uguacaauuaaaaaccu

SEQ ID NO: 2917130 - RNA, 23 nt, Human
uguacauaacucuguaaaaacac

SEQ ID NO: 2917131 - RNA, 16 nt, Human T-lymphotropic virus 1
cugcagcucucuccug

SEQ ID NO: 2917132 - RNA, 17 nt, Human T-lymphotropic virus 1
ucagcccacuucccagg

SEQ ID NO: 2917133 - RNA, 23 nt, Human T-lymphotropic virus 1
cuccaggauaugaccccaucugg

SEQ ID NO: 2917134 - RNA, 14 nt, Human T-lymphotropic virus 1
acuuggcacguccu

SEQ ID NO: 2917135 - RNA, 13 nt, Human T-lymphotropic virus 1
cagcaaccuccuc

SEQ ID NO: 2917136 - RNA, 21 nt, Human T-lymphotropic virus 1
uggcccugccuauauuuccca

SEQ ID NO: 2917137 - RNA, 13 nt, Human T-lymphotropic virus 1
ucauucccccuuc

SEQ ID NO: 2917138 - RNA, 16 nt, Human T-lymphotropic virus 1
cagcucagcaccagcu

SEQ ID NO: 2917139 - RNA, 21 nt, Human T-lymphotropic virus 1
caggagccgucuccagccccu

SEQ ID NO: 2917140 - RNA, 21 nt, Human T-lymphotropic virus 1
ucacgcccuacuggccaccug

SEQ ID NO: 2917141 - RNA, 22 nt, Human T-lymphotropic virus 1
acccuguucgaaaugcagcugg

SEQ ID NO: 2917142 - RNA, 14 nt, Human T-lymphotropic virus 1
ccugcagcccauuc

SEQ ID NO: 2917143 - RNA, 23 nt, Human T-lymphotropic virus 1
cgcguucugccgccucccgccug

SEQ ID NO: 2917144 - RNA, 13 nt, Human T-lymphotropic virus 1
ccucuccagcgcc

SEQ ID NO: 2917145 - RNA, 19 nt, Human T-lymphotropic virus 1
auacaguacucuuccuuuc

SEQ ID NO: 2917146 - RNA, 14 nt, Human T-lymphotropic virus 1
ucucuacugugccu

SEQ ID NO: 2917147 - RNA, 23 nt, Human T-lymphotropic virus 1
aguauucccaguuaaaaaagcca

SEQ ID NO: 2917148 - RNA, 19 nt, Human T-lymphotropic virus 1
cagacggauccaccuccca

SEQ ID NO: 2917149 - RNA, 13 nt, Human T-lymphotropic virus 1
uucuccuggcaag

SEQ ID NO: 2917150 - RNA, 17 nt, Human T-lymphotropic virus 1
uacuacaguccuccucc

SEQ ID NO: 2917151 - RNA, 18 nt, Human T-lymphotropic virus 1
ccuaccuuacgccagccc

SEQ ID NO: 2917152 - RNA, 22 nt, Human T-lymphotropic virus 1
ggagccuaccuagacucagccg

SEQ ID NO: 2917153 - RNA, 14 nt, Human T-lymphotropic virus 1
ccuccuuccuccag

SEQ ID NO: 2917154 - RNA, 13 nt, Human T-lymphotropic virus 1
ucgagcccucuau

SEQ ID NO: 2917155 - RNA, 11 nt, Human T-lymphotropic virus 1
acagcucagca

SEQ ID NO: 2917156 - RNA, 19 nt, Human T-lymphotropic virus 1
cuccugugaaagcccuuau

SEQ ID NO: 2917157 - RNA, 18 nt, Human T-lymphotropic virus 1
ccccaacauuccacccuc

SEQ ID NO: 2917158 - RNA, 20 nt, Human T-lymphotropic virus 1
cuagaacaccucccaaggcc

SEQ ID NO: 2917159 - RNA, 16 nt, Human T-lymphotropic virus 1
cagcaccagcucaggc

SEQ ID NO: 2917160 - RNA, 13 nt, Human T-lymphotropic virus 1
uuuaacucuuccu

SEQ ID NO: 2917161 - RNA, 19 nt, Human T-lymphotropic virus 1
cugccaacuacacuagccc

SEQ ID NO: 2917162 - RNA, 14 nt, Human T-lymphotropic virus 1
cagcaaaccccugg

SEQ ID NO: 2917163 - RNA, 23 nt, Human T-lymphotropic virus 1
uguauuaaccaacugccacaaaa

SEQ ID NO: 2917164 - RNA, 23 nt, Human T-lymphotropic virus 1
cgggcccccugacuuguccagcc

SEQ ID NO: 2917165 - RNA, 16 nt, Human T-lymphotropic virus 1
cuacuggccaccuguc

SEQ ID NO: 2917166 - RNA, 20 nt, Human T-lymphotropic virus 1
uguucauggacccucgaccu

SEQ ID NO: 2917167 - RNA, 20 nt, Human T-lymphotropic virus 1
ccgcaguagacuaguccaaa

SEQ ID NO: 2917168 - RNA, 21 nt, Human T-lymphotropic virus 1
cucaccucaaaaaacuuuuca

SEQ ID NO: 2917169 - RNA, 21 nt, Human T-lymphotropic virus 1
cccacugcuuugacccccaga

SEQ ID NO: 2917170 - RNA, 22 nt, Human T-lymphotropic virus 1
ccgucacgcugacagccuggca

SEQ ID NO: 2917171 - RNA, 22 nt, Human T-lymphotropic virus 1
auacuacccauguccccuacaa

SEQ ID NO: 2917172 - RNA, 17 nt, Human T-lymphotropic virus 1
ggaggcuauuauucagc

SEQ ID NO: 2917173 - RNA, 18 nt, Human T-lymphotropic virus 1
uaauggcauucuuaaaac

SEQ ID NO: 2917174 - RNA, 19 nt, Human T-lymphotropic virus 1
gcucaccucccuuccugug

SEQ ID NO: 2917175 - RNA, 13 nt, Human T-lymphotropic virus 1
cuagacucagccg

SEQ ID NO: 2917176 - RNA, 21 nt, Human T-lymphotropic virus 1
aaaagcguggggacaguucag

SEQ ID NO: 2917177 - RNA, 12 nt, Human T-lymphotropic virus 1
uggccucuccag

SEQ ID NO: 2917178 - RNA, 19 nt, Human T-lymphotropic virus 1
cuucuaccccccuccuuua

SEQ ID NO: 2917179 - RNA, 21 nt, Human T-lymphotropic virus 1
aagacaaaucauaagcucaga

SEQ ID NO: 2917180 - RNA, 16 nt, Human T-lymphotropic virus 1
ggcagguccucucagg

SEQ ID NO: 2917181 - RNA, 20 nt, Human T-lymphotropic virus 1
cacggcgcuccugcucuucc

SEQ ID NO: 2917182 - RNA, 15 nt, Human T-lymphotropic virus 1
uccugcagcaaccuc

SEQ ID NO: 2917183 - RNA, 12 nt, Human T-lymphotropic virus 1
cgaacccagcca

SEQ ID NO: 2917184 - RNA, 19 nt, Human T-lymphotropic virus 1
auuauuucaagcuuccugg

SEQ ID NO: 2917185 - RNA, 16 nt, Human T-lymphotropic virus 1
accugaucccaucucc

SEQ ID NO: 2917186 - RNA, 18 nt, Human T-lymphotropic virus 1
cgaacccagccaacugcc

SEQ ID NO: 2917187 - RNA, 18 nt, Human T-lymphotropic virus 1
aggagccgucuccagccc

SEQ ID NO: 2917188 - RNA, 14 nt, Human T-lymphotropic virus 1
cguggaggcuccuc

SEQ ID NO: 2917189 - RNA, 16 nt, Human T-lymphotropic virus 1
accacucuaaacccug

SEQ ID NO: 2917190 - RNA, 13 nt, Human T-lymphotropic virus 1
ucagaccuccggg

SEQ ID NO: 2917191 - RNA, 18 nt, Human T-lymphotropic virus 1
cuuuaacucuuccuccaa

SEQ ID NO: 2917192 - RNA, 17 nt, Human T-lymphotropic virus 1
cacuuuaagcucaccuc

SEQ ID NO: 2917193 - RNA, 19 nt, Human T-lymphotropic virus 1
uuaagguccuuaccccgcc

SEQ ID NO: 2917194 - RNA, 20 nt, Human T-lymphotropic virus 1
ucagccucuuauucagaccc

SEQ ID NO: 2917195 - RNA, 22 nt, Human T-lymphotropic virus 1
cgcuuccucuucuccucagccc

SEQ ID NO: 2917196 - RNA, 14 nt, Human T-lymphotropic virus 1
gcuucaccacuccc

SEQ ID NO: 2917197 - RNA, 16 nt, Human T-lymphotropic virus 1
cuaccuuacgccagcc

SEQ ID NO: 2917198 - RNA, 19 nt, Human T-lymphotropic virus 1
gcgagcugcaugcccaaga

SEQ ID NO: 2917199 - RNA, 13 nt, Human T-lymphotropic virus 1
ucuccagccccua

SEQ ID NO: 2917200 - RNA, 13 nt, Human T-lymphotropic virus 1
aaaacaacugccc

SEQ ID NO: 2917201 - RNA, 15 nt, Human T-lymphotropic virus 1
cgccuccagccuccc

SEQ ID NO: 2917202 - RNA, 19 nt, Human T-lymphotropic virus 1
gacauucuccuggcaagcc

SEQ ID NO: 2917203 - RNA, 14 nt, Human T-lymphotropic virus 1
ucaaauccuccuuc

SEQ ID NO: 2917204 - RNA, 15 nt, Human T-lymphotropic virus 1
cugacgucucccccc

SEQ ID NO: 2917205 - RNA, 16 nt, Human T-lymphotropic virus 1
aaucauggaccugccc

SEQ ID NO: 2917206 - RNA, 15 nt, Human T-lymphotropic virus 1
cucuuugcuccaggc

SEQ ID NO: 2917207 - RNA, 14 nt, Human T-lymphotropic virus 1
ucaagccguccuca

SEQ ID NO: 2917208 - RNA, 19 nt, Human T-lymphotropic virus 1
gcagccuauauucucuggg

SEQ ID NO: 2917209 - RNA, 12 nt, Human T-lymphotropic virus 1
ccaguucugccc

SEQ ID NO: 2917210 - RNA, 14 nt, Human T-lymphotropic virus 1
ccuucaaccaauuc

SEQ ID NO: 2917211 - RNA, 19 nt, Human T-lymphotropic virus 1
cuaaacccugcaauccugc

SEQ ID NO: 2917212 - RNA, 21 nt, Human T-lymphotropic virus 1
ugcccaccacccuuuuccagc

SEQ ID NO: 2917213 - RNA, 13 nt, Human T-lymphotropic virus 1
cuccuucuccugc

SEQ ID NO: 2917214 - RNA, 18 nt, Human T-lymphotropic virus 1
gaacgccuccaggccuug

SEQ ID NO: 2917215 - RNA, 22 nt, Human T-lymphotropic virus 1
gacccaacaucuauucugccag

SEQ ID NO: 2917216 - RNA, 11 nt, Human T-lymphotropic virus 1
auccugcccag

SEQ ID NO: 2917217 - RNA, 16 nt, Human T-lymphotropic virus 1
cccucaaaaacacauc

SEQ ID NO: 2917218 - RNA, 13 nt, Human T-lymphotropic virus 1
cgccuucucagcc

SEQ ID NO: 2917219 - RNA, 20 nt, Human T-lymphotropic virus 1
gccgccuuaccugaggccgc

SEQ ID NO: 2917220 - RNA, 13 nt, Human T-lymphotropic virus 1
ugccccuccuagg

SEQ ID NO: 2917221 - RNA, 21 nt, Human T-lymphotropic virus 1
ccuuaauaccgaacccagcca

SEQ ID NO: 2917222 - RNA, 19 nt, Human T-lymphotropic virus 1
ccuacucccuaaccacauc

SEQ ID NO: 2917223 - RNA, 18 nt, Human T-lymphotropic virus 1
accuaaacaguuccagcc

SEQ ID NO: 2917224 - RNA, 15 nt, Human T-lymphotropic virus 1
cucagcaccagcuca

SEQ ID NO: 2917225 - RNA, 16 nt, Human T-lymphotropic virus 1
ugcauggccucuccag

SEQ ID NO: 2917226 - RNA, 18 nt, Human T-lymphotropic virus 1
gucugcauguaccucuac

SEQ ID NO: 2917227 - RNA, 22 nt, Human T-lymphotropic virus 1
ggcacguccuauacucucccaa

SEQ ID NO: 2917228 - RNA, 19 nt, Human T-lymphotropic virus 1
caucccuguaaaccaagca

SEQ ID NO: 2917229 - RNA, 17 nt, Human T-lymphotropic virus 1
uccacccuccuuccucc

SEQ ID NO: 2917230 - RNA, 15 nt, Human T-lymphotropic virus 1
aaagauggccagcca

SEQ ID NO: 2917231 - RNA, 18 nt, Human T-lymphotropic virus 1
cacaauggcuucccuaau

SEQ ID NO: 2917232 - RNA, 13 nt, Human T-lymphotropic virus 1
caguaugcugccc

SEQ ID NO: 2917233 - RNA, 19 nt, Human T-lymphotropic virus 1
cucagccggcucuccacgc

SEQ ID NO: 2917234 - RNA, 20 nt, Human T-lymphotropic virus 1
ucagcaaucugcuuuuccuc

SEQ ID NO: 2917235 - RNA, 15 nt, Human T-lymphotropic virus 1
ccuuccuccaggcca

SEQ ID NO: 2917236 - RNA, 17 nt, Human T-lymphotropic virus 1
cagcucuacaguuccuu

SEQ ID NO: 2917237 - RNA, 14 nt, Human T-lymphotropic virus 1
gcauucuuaaaacc

SEQ ID NO: 2917238 - RNA, 23 nt, Human T-lymphotropic virus 1
ccaggcagccuauauucucuggg

SEQ ID NO: 2917239 - RNA, 21 nt, Human T-lymphotropic virus 1
ugccaauaauuaaccucuccc

SEQ ID NO: 2917240 - RNA, 13 nt, Human T-lymphotropic virus 1
ucuguuccauccc

SEQ ID NO: 2917241 - RNA, 14 nt, Human T-lymphotropic virus 1
caggcuaggcccug

SEQ ID NO: 2917242 - RNA, 15 nt, Human T-lymphotropic virus 1
acuggugccccaucu

SEQ ID NO: 2917243 - RNA, 18 nt, Human T-lymphotropic virus 1
uuuguccggcgcucccuu

SEQ ID NO: 2917244 - RNA, 16 nt, Human T-lymphotropic virus 1
cugaacuucaagcccu

SEQ ID NO: 2917245 - RNA, 16 nt, Human T-lymphotropic virus 1
ucuccugcagcaaccu

SEQ ID NO: 2917246 - RNA, 16 nt, Human T-lymphotropic virus 1
uuuuuccuucucccuu

SEQ ID NO: 2917247 - RNA, 17 nt, Human T-lymphotropic virus 1
cucacggcgcuccugcu

SEQ ID NO: 2917248 - RNA, 16 nt, Human T-lymphotropic virus 1
cucuuugcuccaggcc

SEQ ID NO: 2917249 - RNA, 20 nt, Human T-lymphotropic virus 1
auggcagcuucaccacuccc

SEQ ID NO: 2917250 - RNA, 21 nt, Human T-lymphotropic virus 1
acucagccggcucuccacgcu

SEQ ID NO: 2917251 - RNA, 17 nt, Human T-lymphotropic virus 1
cucagaagcuauuuccu

SEQ ID NO: 2917252 - RNA, 23 nt, Human T-lymphotropic virus 1
caacacuugguccggaaggcccu

SEQ ID NO: 2917253 - RNA, 17 nt, Human T-lymphotropic virus 1
acucagcaaucugcuuu

SEQ ID NO: 2917254 - RNA, 22 nt, Human T-lymphotropic virus 1
acaagcucagaagcuauuuccu

SEQ ID NO: 2917255 - RNA, 18 nt, Human T-lymphotropic virus 1
cccaucaccuggccccuc

SEQ ID NO: 2917256 - RNA, 20 nt, Human T-lymphotropic virus 1
cccacugcuuugacccccag

SEQ ID NO: 2917257 - RNA, 19 nt, Human T-lymphotropic virus 1
ggacaaagauauuucccaa

SEQ ID NO: 2917258 - RNA, 21 nt, Human T-lymphotropic virus 1
uaaacccugcaauccugccca

SEQ ID NO: 2917259 - RNA, 20 nt, Human T-lymphotropic virus 1
ccaggcucaacgcucucaca

SEQ ID NO: 2917260 - RNA, 16 nt, Human T-lymphotropic virus 1
gccucucacagugggc

SEQ ID NO: 2917261 - RNA, 21 nt, Human T-lymphotropic virus 1
accacaucgccuccagccucc

SEQ ID NO: 2917262 - RNA, 13 nt, Human T-lymphotropic virus 1
agcugcaugccca

SEQ ID NO: 2917263 - RNA, 22 nt, Human T-lymphotropic virus 1
acccccaacauuccacccuccu

SEQ ID NO: 2917264 - RNA, 23 nt, Human T-lymphotropic virus 1
ggcacgccuaugauuuccgggcc

SEQ ID NO: 2917265 - RNA, 16 nt, Human T-lymphotropic virus 1
ccacucaacccucacc

SEQ ID NO: 2917266 - RNA, 17 nt, Human T-lymphotropic virus 1
uggccuacucccuaacc

SEQ ID NO: 2917267 - RNA, 18 nt, Human T-lymphotropic virus 1
gccuucuccucuuccuuc

SEQ ID NO: 2917268 - RNA, 22 nt, Human T-lymphotropic virus 1
cauuuaacuggacccacugcuu

SEQ ID NO: 2917269 - RNA, 17 nt, Human T-lymphotropic virus 1
aggacagcucagcacca

SEQ ID NO: 2917270 - RNA, 15 nt, Human T-lymphotropic virus 1
cuccuucuccugcag

SEQ ID NO: 2917271 - RNA, 21 nt, Human T-lymphotropic virus 1
gaagccaccgggaaccaccca

SEQ ID NO: 2917272 - RNA, 16 nt, Human T-lymphotropic virus 1
cuauggacuacucugc

SEQ ID NO: 2917273 - RNA, 21 nt, Human T-lymphotropic virus 1
ccgccuguggugccuccugaa

SEQ ID NO: 2917274 - RNA, 14 nt, Human T-lymphotropic virus 1
auucauucaaacau

SEQ ID NO: 2917275 - RNA, 20 nt, Human T-lymphotropic virus 1
ccaggauaugaccccaucug

SEQ ID NO: 2917276 - RNA, 18 nt, Human T-lymphotropic virus 1
ucuaccugaucccaucuc

SEQ ID NO: 2917277 - RNA, 20 nt, Human T-lymphotropic virus 1
acccucaccacuccaggccu

SEQ ID NO: 2917278 - RNA, 17 nt, Human T-lymphotropic virus 1
ccguggaggcuccucaa

SEQ ID NO: 2917279 - RNA, 16 nt, Human T-lymphotropic virus 1
cuacucugccaaacca

SEQ ID NO: 2917280 - RNA, 13 nt, Human T-lymphotropic virus 1
cgcugacagccug

SEQ ID NO: 2917281 - RNA, 14 nt, Human T-lymphotropic virus 1
ccuucuccucuucc

SEQ ID NO: 2917282 - RNA, 14 nt, Human T-lymphotropic virus 1
cagccuccccugcc

SEQ ID NO: 2917283 - RNA, 14 nt, Human T-lymphotropic virus 1
ucccaccgccccuc

SEQ ID NO: 2917284 - RNA, 13 nt, Human T-lymphotropic virus 1
cuacagccacccu

SEQ ID NO: 2917285 - RNA, 12 nt, Human T-lymphotropic virus 1
gcuccaggccau

SEQ ID NO: 2917286 - RNA, 16 nt, Human T-lymphotropic virus 1
acccuugcccuaggca

SEQ ID NO: 2917287 - RNA, 18 nt, Human T-lymphotropic virus 1
uccccccgacuccagccg

SEQ ID NO: 2917288 - RNA, 22 nt, Human T-lymphotropic virus 1
uguccuuuaacucuuccuccaa

SEQ ID NO: 2917289 - RNA, 15 nt, Human T-lymphotropic virus 1
uccuuccuccaggcc

SEQ ID NO: 2917290 - RNA, 20 nt, Human T-lymphotropic virus 1
gacccucacuggcaccacca

SEQ ID NO: 2917291 - RNA, 13 nt, Human T-lymphotropic virus 1
acccugccccucc

SEQ ID NO: 2917292 - RNA, 17 nt, Human T-lymphotropic virus 1
gacuccagccgauccca

SEQ ID NO: 2917293 - RNA, 23 nt, Human T-lymphotropic virus 1
gccaugcgcaaauacucccccuu

SEQ ID NO: 2917294 - RNA, 15 nt, Human T-lymphotropic virus 1
uggcccauauccugc

SEQ ID NO: 2917295 - RNA, 16 nt, Human T-lymphotropic virus 1
uacagccccagcugcu

SEQ ID NO: 2917296 - RNA, 20 nt, Human T-lymphotropic virus 1
cuccucuauaaaauuucccu

SEQ ID NO: 2917297 - RNA, 20 nt, Human T-lymphotropic virus 1
acagcucagcaccagcucag

SEQ ID NO: 2917298 - RNA, 16 nt, Human T-lymphotropic virus 1
ccuggccccuccugcc

SEQ ID NO: 2917299 - RNA, 20 nt, Human T-lymphotropic virus 1
cgcaaauacucccccuuccg

SEQ ID NO: 2917300 - RNA, 14 nt, Human T-lymphotropic virus 1
ucuccgcccuggcc

SEQ ID NO: 2917301 - RNA, 15 nt, Human T-lymphotropic virus 1
cauguaccucuacca

SEQ ID NO: 2917302 - RNA, 15 nt, Human T-lymphotropic virus 1
aacaauuaaguuccu

SEQ ID NO: 2917303 - RNA, 17 nt, Human T-lymphotropic virus 1
uccuccguucagccucc

SEQ ID NO: 2917304 - RNA, 13 nt, Human T-lymphotropic virus 1
ucagccuccaagg

SEQ ID NO: 2917305 - RNA, 17 nt, Human T-lymphotropic virus 1
ccugaucccaucuccag

SEQ ID NO: 2917306 - RNA, 17 nt, Human T-lymphotropic virus 1
guuugcccaccacccuu

SEQ ID NO: 2917307 - RNA, 19 nt, Human T-lymphotropic virus 1
uacaggagccgucuccagc

SEQ ID NO: 2917308 - RNA, 14 nt, Human T-lymphotropic virus 1
caccgccccuccuc

SEQ ID NO: 2917309 - RNA, 22 nt, Human T-lymphotropic virus 1
cugcauguaccucuaccagcuu

SEQ ID NO: 2917310 - RNA, 16 nt, Human T-lymphotropic virus 1
ccuucggacccuugcc

SEQ ID NO: 2917311 - RNA, 16 nt, Human T-lymphotropic virus 1
cccccaacuccugcau

SEQ ID NO: 2917312 - RNA, 20 nt, Human T-lymphotropic virus 1
cauccgccguggccuacucc

SEQ ID NO: 2917313 - RNA, 16 nt, Human T-lymphotropic virus 1
ccacccauuuccuccc

SEQ ID NO: 2917314 - RNA, 22 nt, Human T-lymphotropic virus 1
cucuauaaaauuucccuuacca

SEQ ID NO: 2917315 - RNA, 14 nt, Human T-lymphotropic virus 1
ccuucucagccccu

SEQ ID NO: 2917316 - RNA, 21 nt, Human T-lymphotropic virus 1
ccugggggcagcuacuugccu

SEQ ID NO: 2917317 - RNA, 11 nt, Human T-lymphotropic virus 1
uuuccuccucc

SEQ ID NO: 2917318 - RNA, 14 nt, Human T-lymphotropic virus 1
cgccguggccuacu

SEQ ID NO: 2917319 - RNA, 19 nt, Human T-lymphotropic virus 1
ccaaggauaauagcccguc

SEQ ID NO: 2917320 - RNA, 14 nt, Human T-lymphotropic virus 1
cuccaaggacucca

SEQ ID NO: 2917321 - RNA, 13 nt, Human T-lymphotropic virus 1
acagccccagcug

SEQ ID NO: 2917322 - RNA, 18 nt, Human T-lymphotropic virus 1
guuccuuaaaaugcccau

SEQ ID NO: 2917323 - RNA, 16 nt, Human T-lymphotropic virus 1
ccgugccuucuccucu

SEQ ID NO: 2917324 - RNA, 15 nt, Human T-lymphotropic virus 1
caagccguccucagg

SEQ ID NO: 2917325 - RNA, 21 nt, Human T-lymphotropic virus 1
ugucacagaacugccgcagua

SEQ ID NO: 2917326 - RNA, 22 nt, Human T-lymphotropic virus 1
agccuggcaaaacggccuccuu

SEQ ID NO: 2917327 - RNA, 19 nt, Human T-lymphotropic virus 1
gccccauuggcuccuguga

SEQ ID NO: 2917328 - RNA, 22 nt, Human T-lymphotropic virus 1
gccuggcaaaacggccuccuuc

SEQ ID NO: 2917329 - RNA, 17 nt, Human T-lymphotropic virus 1
ccaacgucucuguucca

SEQ ID NO: 2917330 - RNA, 19 nt, Human T-lymphotropic virus 1
aauccuccuucuccugcag

SEQ ID NO: 2917331 - RNA, 18 nt, Human T-lymphotropic virus 1
cagcuacgacaccucccc

SEQ ID NO: 2917332 - RNA, 18 nt, Human T-lymphotropic virus 1
augacauucuccuggcaa

SEQ ID NO: 2917333 - RNA, 15 nt, Human T-lymphotropic virus 1
ccauuuccuccccau

SEQ ID NO: 2917334 - RNA, 12 nt, Human T-lymphotropic virus 1
cagcaaccuccu

SEQ ID NO: 2917335 - RNA, 16 nt, Human T-lymphotropic virus 1
cccugccccuccuagg

SEQ ID NO: 2917336 - RNA, 13 nt, Human T-lymphotropic virus 1
cccgacuccagcc

SEQ ID NO: 2917337 - RNA, 16 nt, Human T-lymphotropic virus 1
aacaccucccaaggcc

SEQ ID NO: 2917338 - RNA, 11 nt, Human T-lymphotropic virus 1
ucccccuuccg

SEQ ID NO: 2917339 - RNA, 15 nt, Human T-lymphotropic virus 1
ggcgcuuuccccccu

SEQ ID NO: 2917340 - RNA, 17 nt, Human T-lymphotropic virus 1
ggcccuggaggcaggcc

SEQ ID NO: 2917341 - RNA, 15 nt, Human T-lymphotropic virus 1
ccggcucuccacgcu

SEQ ID NO: 2917342 - RNA, 23 nt, Human T-lymphotropic virus 1
cuuccuuuucaaauacucagcaa

SEQ ID NO: 2917343 - RNA, 22 nt, Human T-lymphotropic virus 1
ccugccuauauuucccaagacu

SEQ ID NO: 2917344 - RNA, 15 nt, Human T-lymphotropic virus 1
agcuacuugccucag

SEQ ID NO: 2917345 - RNA, 18 nt, Human T-lymphotropic virus 1
cagcccauucggcaagcc

SEQ ID NO: 2917346 - RNA, 13 nt, Human T-lymphotropic virus 1
cccgcuuccugcg

SEQ ID NO: 2917347 - RNA, 18 nt, Human T-lymphotropic virus 1
cuacacaguuucacccau

SEQ ID NO: 2917348 - RNA, 16 nt, Human T-lymphotropic virus 1
cugccuauauuuccca

SEQ ID NO: 2917349 - RNA, 20 nt, Human T-lymphotropic virus 1
cuccagcuaccaugccaccu

SEQ ID NO: 2917350 - RNA, 13 nt, Human T-lymphotropic virus 1
auucggcaagccu

SEQ ID NO: 2917351 - RNA, 11 nt, Human T-lymphotropic virus 1
uucauucaaac

SEQ ID NO: 2917352 - RNA, 21 nt, Human T-lymphotropic virus 1
ucccgccuguggugccuccug

SEQ ID NO: 2917353 - RNA, 16 nt, Human T-lymphotropic virus 1
uauucccaguuaaaaa

SEQ ID NO: 2917354 - RNA, 15 nt, Human T-lymphotropic virus 1
ccaccucccaggcag

SEQ ID NO: 2917355 - RNA, 14 nt, Human T-lymphotropic virus 1
cucucacacggccu

SEQ ID NO: 2917356 - RNA, 15 nt, Human T-lymphotropic virus 1
cuccguugucugcau

SEQ ID NO: 2917357 - RNA, 17 nt, Human T-lymphotropic virus 1
gcucgcaucucuccuuc

SEQ ID NO: 2917358 - RNA, 12 nt, Human T-lymphotropic virus 1
cucgagaagccu

SEQ ID NO: 2917359 - RNA, 20 nt, Human T-lymphotropic virus 1
ucuuaaaacaacugccccau

SEQ ID NO: 2917360 - RNA, 17 nt, Human T-lymphotropic virus 1
uccauccccuucuucua

SEQ ID NO: 2917361 - RNA, 22 nt, Human T-lymphotropic virus 1
cuacaucgucacgcccuacugg

SEQ ID NO: 2917362 - RNA, 13 nt, Human T-lymphotropic virus 1
ccucuuccuuccu

SEQ ID NO: 2917363 - RNA, 13 nt, Human T-lymphotropic virus 1
cgaccugcuggcc

SEQ ID NO: 2917364 - RNA, 17 nt, Human T-lymphotropic virus 1
acuccaccucgccuucc

SEQ ID NO: 2917365 - RNA, 16 nt, Human T-lymphotropic virus 1
cagcuacuugccucag

SEQ ID NO: 2917366 - RNA, 15 nt, Human T-lymphotropic virus 1
ccugacuuguccagc

SEQ ID NO: 2917367 - RNA, 21 nt, Human T-lymphotropic virus 1
ccuuguccuuuaacucuuccu

SEQ ID NO: 2917368 - RNA, 23 nt, Human T-lymphotropic virus 1
cauccccuucuucuaccccccuc

SEQ ID NO: 2917369 - RNA, 20 nt, Human T-lymphotropic virus 1
ccaaggcagguccucucagg

SEQ ID NO: 2917370 - RNA, 22 nt, Human T-lymphotropic virus 1
uggcacguccuauacucuccca

SEQ ID NO: 2917371 - RNA, 13 nt, Human T-lymphotropic virus 1
accuuggccucuc

SEQ ID NO: 2917372 - RNA, 18 nt, Human T-lymphotropic virus 1
cgcucuaauggcauucuu

SEQ ID NO: 2917373 - RNA, 19 nt, Human T-lymphotropic virus 1
guucauggacccucgaccu

SEQ ID NO: 2917374 - RNA, 17 nt, Human T-lymphotropic virus 1
ccccuuccgccaccgca

SEQ ID NO: 2917375 - RNA, 19 nt, Human T-lymphotropic virus 1
ugguguuccaguccaagca

SEQ ID NO: 2917376 - RNA, 12 nt, Human T-lymphotropic virus 1
ccuugccuguuu

SEQ ID NO: 2917377 - RNA, 21 nt, Human T-lymphotropic virus 1
ucuccuucacgcgcccgccgc

SEQ ID NO: 2917378 - RNA, 23 nt, Human T-lymphotropic virus 1
cccgguaagcgcuaguucugccc

SEQ ID NO: 2917379 - RNA, 16 nt, Human T-lymphotropic virus 1
gcaagccccucccaug

SEQ ID NO: 2917380 - RNA, 16 nt, Human T-lymphotropic virus 1
augacaguccuuccga

SEQ ID NO: 2917381 - RNA, 16 nt, Human T-lymphotropic virus 1
ccucuucuccucagcc

SEQ ID NO: 2917382 - RNA, 22 nt, Human T-lymphotropic virus 1
uguuuucagacggauccaccuc

SEQ ID NO: 2917383 - RNA, 17 nt, Human T-lymphotropic virus 1
agacccuuguuccuuaa

SEQ ID NO: 2917384 - RNA, 17 nt, Human T-lymphotropic virus 1
aacaucagaugccucaa

SEQ ID NO: 2917385 - RNA, 22 nt, Human T-lymphotropic virus 1
cccuacaauccaaccagcuccg

SEQ ID NO: 2917386 - RNA, 19 nt, Human T-lymphotropic virus 1
cccucaccacuccaggccu

SEQ ID NO: 2917387 - RNA, 13 nt, Human T-lymphotropic virus 1
caacuacacuagc

SEQ ID NO: 2917388 - RNA, 20 nt, Human T-lymphotropic virus 1
acacccagaccagccaccca

SEQ ID NO: 2917389 - RNA, 15 nt, Human T-lymphotropic virus 1
ccaauuccuccacca

SEQ ID NO: 2917390 - RNA, 18 nt, Human T-lymphotropic virus 1
agaccgggccuuuguccg

SEQ ID NO: 2917391 - RNA, 11 nt, Human T-lymphotropic virus 1
cuccucagccc

SEQ ID NO: 2917392 - RNA, 18 nt, Human T-lymphotropic virus 1
ucaggaaagagccuccua

SEQ ID NO: 2917393 - RNA, 14 nt, Human T-lymphotropic virus 1
gacacccagaccag

SEQ ID NO: 2917394 - RNA, 19 nt, Human T-lymphotropic virus 1
cgguuuuuccuucucccuu

SEQ ID NO: 2917395 - RNA, 16 nt, Human T-lymphotropic virus 1
cuuaaaacaacugccc

SEQ ID NO: 2917396 - RNA, 23 nt, Human T-lymphotropic virus 1
accugcgggccacuaacucucua

SEQ ID NO: 2917397 - RNA, 13 nt, Human T-lymphotropic virus 1
ccgacuccagccg

SEQ ID NO: 2917398 - RNA, 16 nt, Human T-lymphotropic virus 1
caggagccaucucagc

SEQ ID NO: 2917399 - RNA, 20 nt, Human T-lymphotropic virus 1
cugcaaggggcaaccacaac

SEQ ID NO: 2917400 - RNA, 15 nt, Human T-lymphotropic virus 1
ccuuggccucucaca

SEQ ID NO: 2917401 - RNA, 17 nt, Human T-lymphotropic virus 1
caggagccgucuccagc

SEQ ID NO: 2917402 - RNA, 20 nt, Human T-lymphotropic virus 1
auguauuaaccaacugccac

SEQ ID NO: 2917403 - RNA, 19 nt, Human T-lymphotropic virus 1
cuuuuccuugucaccuguu

SEQ ID NO: 2917404 - RNA, 22 nt, Human T-lymphotropic virus 1
uccuugggcuagaacaccuccc

SEQ ID NO: 2917405 - RNA, 18 nt, Human T-lymphotropic virus 1
uaguccaaacccugcccc

SEQ ID NO: 2917406 - RNA, 14 nt, Human T-lymphotropic virus 1
cccggaggacagcu

SEQ ID NO: 2917407 - RNA, 24 nt, Human T-lymphotropic virus 1
cucaacgcucucacagaugcccua

SEQ ID NO: 2917408 - RNA, 14 nt, Human T-lymphotropic virus 1
gccuccagccuccc

SEQ ID NO: 2917409 - RNA, 22 nt, Human T-lymphotropic virus 1
aggggcaaccacaacugaggcc

SEQ ID NO: 2917410 - RNA, 22 nt, Human T-lymphotropic virus 1
ggugccaaucauggaccugccc

SEQ ID NO: 2917411 - RNA, 13 nt, Human T-lymphotropic virus 1
agccguccucagg

SEQ ID NO: 2917412 - RNA, 18 nt, Human T-lymphotropic virus 1
cagccuauccacuuggca

SEQ ID NO: 2917413 - RNA, 18 nt, Human T-lymphotropic virus 1
guccugacuggcuggggc

SEQ ID NO: 2917414 - RNA, 15 nt, Human T-lymphotropic virus 1
gugauuacagcccca

SEQ ID NO: 2917415 - RNA, 16 nt, Human T-lymphotropic virus 1
cgaucgugccagccua

SEQ ID NO: 2917416 - RNA, 14 nt, Human T-lymphotropic virus 1
ccaaggacuccacc

SEQ ID NO: 2917417 - RNA, 14 nt, Human T-lymphotropic virus 1
gcccuacagccacc

SEQ ID NO: 2917418 - RNA, 19 nt, Human T-lymphotropic virus 1
gccucaggaaagagccucc

SEQ ID NO: 2917419 - RNA, 18 nt, Human T-lymphotropic virus 1
cccugucauaacucccuc

SEQ ID NO: 2917420 - RNA, 20 nt, Human T-lymphotropic virus 1
cccagcugcuguacucucac

SEQ ID NO: 2917421 - RNA, 19 nt, Human T-lymphotropic virus 1
cucgacuccccuccuuccc

SEQ ID NO: 2917422 - RNA, 18 nt, Human T-lymphotropic virus 1
cccuaaucucccaugggu

SEQ ID NO: 2917423 - RNA, 14 nt, Human T-lymphotropic virus 1
ucuuaaaacaacug

SEQ ID NO: 2917424 - RNA, 14 nt, Human T-lymphotropic virus 1
agccacccugcccu

SEQ ID NO: 2917425 - RNA, 20 nt, Human T-lymphotropic virus 1
cucuugccacgccugccgca

SEQ ID NO: 2917426 - RNA, 15 nt, Human T-lymphotropic virus 1
gccaccccggccagc

SEQ ID NO: 2917427 - RNA, 19 nt, Human T-lymphotropic virus 1
gacccugcuugcucaacuc

SEQ ID NO: 2917428 - RNA, 14 nt, Human T-lymphotropic virus 1
caucuccaggcuca

SEQ ID NO: 2917429 - RNA, 21 nt, Human T-lymphotropic virus 1
cuccaccagcagguccuccgg

SEQ ID NO: 2917430 - RNA, 13 nt, Human T-lymphotropic virus 1
cucuucuccucag

SEQ ID NO: 2917431 - RNA, 22 nt, Human T-lymphotropic virus 1
uccacccuccuuccuccaggcc

SEQ ID NO: 2917432 - RNA, 18 nt, Human T-lymphotropic virus 1
caguuggagucuccucau

SEQ ID NO: 2917433 - RNA, 14 nt, Human T-lymphotropic virus 1
cucuucuccucagc

SEQ ID NO: 2917434 - RNA, 16 nt, Human T-lymphotropic virus 1
gccccuugucuccacu

SEQ ID NO: 2917435 - RNA, 17 nt, Human T-lymphotropic virus 1
ugacauucuccuggcaa

SEQ ID NO: 2917436 - RNA, 16 nt, Human T-lymphotropic virus 1
ccugacgugucccccu

SEQ ID NO: 2917437 - RNA, 18 nt, Human T-lymphotropic virus 1
gcuacuugccucagcugu

SEQ ID NO: 2917438 - RNA, 14 nt, Human T-lymphotropic virus 1
cgggaaccacccau

SEQ ID NO: 2917439 - RNA, 16 nt, Human T-lymphotropic virus 1
cacccagaccagccac

SEQ ID NO: 2917440 - RNA, 16 nt, Human T-lymphotropic virus 1
gcgccgugccuucucc

SEQ ID NO: 2917441 - RNA, 13 nt, Human T-lymphotropic virus 1
cugccccuccuag

SEQ ID NO: 2917442 - RNA, 20 nt, Human T-lymphotropic virus 1
accuuccaaggcagguccuc

SEQ ID NO: 2917443 - RNA, 16 nt, Human T-lymphotropic virus 1
cucuaccagcuuuccc

SEQ ID NO: 2917444 - RNA, 18 nt, Human T-lymphotropic virus 1
uccugcgccgugccuucu

SEQ ID NO: 2917445 - RNA, 19 nt, Human T-lymphotropic virus 1
agacaaaucauaagcucag

SEQ ID NO: 2917446 - RNA, 17 nt, Human T-lymphotropic virus 1
uggacaaucaaccaccu

SEQ ID NO: 2917447 - RNA, 14 nt, Human T-lymphotropic virus 1
uccucgagcccucu

SEQ ID NO: 2917448 - RNA, 15 nt, Human T-lymphotropic virus 1
cugucauaacucccu

SEQ ID NO: 2917449 - RNA, 18 nt, Human T-lymphotropic virus 1
acccccauuacucucuua

SEQ ID NO: 2917450 - RNA, 18 nt, Human T-lymphotropic virus 1
gaucucucaucaucuucc

SEQ ID NO: 2917451 - RNA, 22 nt, Human T-lymphotropic virus 1
ggccuacucccuaaccacaucu

SEQ ID NO: 2917452 - RNA, 15 nt, Human T-lymphotropic virus 1
gcaucucuccuucac

SEQ ID NO: 2917453 - RNA, 17 nt, Human T-lymphotropic virus 1
gaagucagcggccuucu

SEQ ID NO: 2917454 - RNA, 15 nt, Human T-lymphotropic virus 1
cagaacgccuccagg

SEQ ID NO: 2917455 - RNA, 15 nt, Human T-lymphotropic virus 1
ccccaacauuccacc

SEQ ID NO: 2917456 - RNA, 18 nt, Human T-lymphotropic virus 1
ccauaccaaucuaccuga

SEQ ID NO: 2917457 - RNA, 13 nt, Human T-lymphotropic virus 1
acaaaacccagca

SEQ ID NO: 2917458 - RNA, 16 nt, Human T-lymphotropic virus 1
ccacguucgcagccau

SEQ ID NO: 2917459 - RNA, 15 nt, Human T-lymphotropic virus 1
ccuacuggccaccug

SEQ ID NO: 2917460 - RNA, 13 nt, Human T-lymphotropic virus 1
cccaacuccugca

SEQ ID NO: 2917461 - RNA, 21 nt, Human T-lymphotropic virus 1
uguccuugggcuagaacaccu

SEQ ID NO: 2917462 - RNA, 22 nt, Human T-lymphotropic virus 1
caucgccuccagccuccccugc

SEQ ID NO: 2917463 - RNA, 19 nt, Human T-lymphotropic virus 1
cucacggcgcuccugcucu

SEQ ID NO: 2917464 - RNA, 19 nt, Human T-lymphotropic virus 1
cuuacuccaccacagucac

SEQ ID NO: 2917465 - RNA, 19 nt, Human T-lymphotropic virus 1
cucaggcuaggcccugacg

SEQ ID NO: 2917466 - RNA, 20 nt, Human T-lymphotropic virus 1
acccuccuuccuccaggcca

SEQ ID NO: 2917467 - RNA, 18 nt, Human T-lymphotropic virus 1
uguauuaaccaacugcca

SEQ ID NO: 2917468 - RNA, 19 nt, Human T-lymphotropic virus 1
auaaguacuuuacugacaa

SEQ ID NO: 2917469 - RNA, 15 nt, Human T-lymphotropic virus 1
cgcgcuacuccuucu

SEQ ID NO: 2917470 - RNA, 21 nt, Human T-lymphotropic virus 1
cugcccuaaagauggccagcc

SEQ ID NO: 2917471 - RNA, 14 nt, Human T-lymphotropic virus 1
aucuaggcaagccu

SEQ ID NO: 2917472 - RNA, 14 nt, Human T-lymphotropic virus 1
cacaucgccuccag

SEQ ID NO: 2917473 - RNA, 16 nt, Human T-lymphotropic virus 1
cugcaauccugcccag

SEQ ID NO: 2917474 - RNA, 14 nt, Human T-lymphotropic virus 1
aucaaaacuccuga

SEQ ID NO: 2917475 - RNA, 17 nt, Human T-lymphotropic virus 1
cugcagcucucuccugc

SEQ ID NO: 2917476 - RNA, 23 nt, Human T-lymphotropic virus 1
ggaugacauucuccuggcaagcc

SEQ ID NO: 2917477 - RNA, 14 nt, Human T-lymphotropic virus 1
aggcccuccugccc

SEQ ID NO: 2917478 - RNA, 22 nt, Human T-lymphotropic virus 1
augcucuauccauagcccuaug

SEQ ID NO: 2917479 - RNA, 13 nt, Human T-lymphotropic virus 1
aagccccucccau

SEQ ID NO: 2917480 - RNA, 23 nt, Human T-lymphotropic virus 1
cccaugugauuuuuugccacccc

SEQ ID NO: 2917481 - RNA, 16 nt, Human T-lymphotropic virus 1
ccgaacccagccaacu

SEQ ID NO: 2917482 - RNA, 13 nt, Human T-lymphotropic virus 1
cucuccagcgccc

SEQ ID NO: 2917483 - RNA, 17 nt, Human T-lymphotropic virus 1
cacccuuuuccagccug

SEQ ID NO: 2917484 - RNA, 17 nt, Human T-lymphotropic virus 1
cugaacuucaagcccua

SEQ ID NO: 2917485 - RNA, 19 nt, Human T-lymphotropic virus 1
ccuuacgccagccccuuca

SEQ ID NO: 2917486 - RNA, 17 nt, Human T-lymphotropic virus 1
gcacgcauacggcucaa

SEQ ID NO: 2917487 - RNA, 22 nt, Human T-lymphotropic virus 1
uuguccuuuaacucuuccucca

SEQ ID NO: 2917488 - RNA, 13 nt, Human T-lymphotropic virus 1
uuccaguccaagc

SEQ ID NO: 2917489 - RNA, 17 nt, Human T-lymphotropic virus 1
uccaaggauaauagccc

SEQ ID NO: 2917490 - RNA, 13 nt, Human T-lymphotropic virus 1
uacacaguuucac

SEQ ID NO: 2917491 - RNA, 23 nt, Human T-lymphotropic virus 1
ugcccuaggcaccuuccaaggca

SEQ ID NO: 2917492 - RNA, 15 nt, Human T-lymphotropic virus 1
accgccccuccucua

SEQ ID NO: 2917493 - RNA, 22 nt, Human T-lymphotropic virus 1
gcacgcauacggcucaauaaaa

SEQ ID NO: 2917494 - RNA, 21 nt, Human T-lymphotropic virus 1
accuucggacccuugcccuag

SEQ ID NO: 2917495 - RNA, 18 nt, Human T-lymphotropic virus 1
uuuaagcucaccucccuu

SEQ ID NO: 2917496 - RNA, 16 nt, Human T-lymphotropic virus 1
ucacgcgcccgccgcc

SEQ ID NO: 2917497 - RNA, 15 nt, Human T-lymphotropic virus 1
cucagccccuugucu

SEQ ID NO: 2917498 - RNA, 15 nt, Human T-lymphotropic virus 1
cggaguggcuggcag

SEQ ID NO: 2917499 - RNA, 20 nt, Human T-lymphotropic virus 1
cuuccucuucuccucagccc

SEQ ID NO: 2917500 - RNA, 15 nt, Human T-lymphotropic virus 1
cacaggaggcucuuc

SEQ ID NO: 2917501 - RNA, 23 nt, Human T-lymphotropic virus 1
cucagcaaucugcuuuuccuccu

SEQ ID NO: 2917502 - RNA, 13 nt, Human T-lymphotropic virus 1
uccaccucccagg

SEQ ID NO: 2917503 - RNA, 20 nt, Human T-lymphotropic virus 1
ucauucccccuuccgccacc

SEQ ID NO: 2917504 - RNA, 20 nt, Human T-lymphotropic virus 1
uccucggugauuacagcccc

SEQ ID NO: 2917505 - RNA, 18 nt, Human T-lymphotropic virus 1
gucacaaagaucauuccc

SEQ ID NO: 2917506 - RNA, 13 nt, Human T-lymphotropic virus 1
aguuacuccagcu

SEQ ID NO: 2917507 - RNA, 15 nt, Human T-lymphotropic virus 1
cucuaccagcuuucc

SEQ ID NO: 2917508 - RNA, 14 nt, Human T-lymphotropic virus 1
ccaccgggaaccac

SEQ ID NO: 2917509 - RNA, 15 nt, Human T-lymphotropic virus 1
aucauaagcucagac

SEQ ID NO: 2917510 - RNA, 22 nt, Human T-lymphotropic virus 1
cuccuuguccuuuaacucuucc

SEQ ID NO: 2917511 - RNA, 22 nt, Human T-lymphotropic virus 1
cccauguuugucaagccguccu

SEQ ID NO: 2917512 - RNA, 21 nt, Human T-lymphotropic virus 1
aggccccccgaaaucagccag

SEQ ID NO: 2917513 - RNA, 15 nt, Human T-lymphotropic virus 1
auuaaccucucccau

SEQ ID NO: 2917514 - RNA, 16 nt, Human T-lymphotropic virus 1
acgcuuugccugaccc

SEQ ID NO: 2917515 - RNA, 18 nt, Human T-lymphotropic virus 1
cuccccuccuuccccacc

SEQ ID NO: 2917516 - RNA, 20 nt, Human T-lymphotropic virus 1
aaucugcuuuuccuccucuu

SEQ ID NO: 2917517 - RNA, 20 nt, Human T-lymphotropic virus 1
accuuggccucucacagugg

SEQ ID NO: 2917518 - RNA, 19 nt, Human T-lymphotropic virus 1
uaguacuacaguccuccuc

SEQ ID NO: 2917519 - RNA, 23 nt, Human T-lymphotropic virus 1
cacccuugggcagcaccucccaa

SEQ ID NO: 2917520 - RNA, 13 nt, Human T-lymphotropic virus 1
cauucccucagca

SEQ ID NO: 2917521 - RNA, 14 nt, Human T-lymphotropic virus 1
cuucuccucagccc

SEQ ID NO: 2917522 - RNA, 20 nt, Human T-lymphotropic virus 1
cucacaguuggagucuccuc

SEQ ID NO: 2917523 - RNA, 16 nt, Human T-lymphotropic virus 1
acccucgaccugcugg

SEQ ID NO: 2917524 - RNA, 18 nt, Human T-lymphotropic virus 1
acuggcaccaccacugug

SEQ ID NO: 2917525 - RNA, 21 nt, Human T-lymphotropic virus 1
ucguuagcgcuuccagccccc

SEQ ID NO: 2917526 - RNA, 18 nt, Human T-lymphotropic virus 1
accccaucugguuccuua

SEQ ID NO: 2917527 - RNA, 22 nt, Human T-lymphotropic virus 1
ccugaacuacguccgccgucua

SEQ ID NO: 2917528 - RNA, 18 nt, Human T-lymphotropic virus 1
ccucccaugcggaccugc

SEQ ID NO: 2917529 - RNA, 20 nt, Human T-lymphotropic virus 1
accagcuuuccccccccauc

SEQ ID NO: 2917530 - RNA, 16 nt, Human T-lymphotropic virus 1
cucaggcuaggcccug

SEQ ID NO: 2917531 - RNA, 14 nt, Human T-lymphotropic virus 1
gaucaccugggacc

SEQ ID NO: 2917532 - RNA, 16 nt, Human T-lymphotropic virus 1
auccaccucccaggca

SEQ ID NO: 2917533 - RNA, 18 nt, Human T-lymphotropic virus 1
agcugcuguacucucaca

SEQ ID NO: 2917534 - RNA, 19 nt, Human T-lymphotropic virus 1
cauauccucgagcccucua

SEQ ID NO: 2917535 - RNA, 16 nt, Human T-lymphotropic virus 1
uaaagauggccagcca

SEQ ID NO: 2917536 - RNA, 13 nt, Human T-lymphotropic virus 1
cuucucagccccu

SEQ ID NO: 2917537 - RNA, 17 nt, Human T-lymphotropic virus 1
ugcaauccugcccagcc

SEQ ID NO: 2917538 - RNA, 13 nt, Human T-lymphotropic virus 1
agguccucucagg

SEQ ID NO: 2917539 - RNA, 22 nt, Human T-lymphotropic virus 1
cccauugcggacagacggcccu

SEQ ID NO: 2917540 - RNA, 14 nt, Human T-lymphotropic virus 1
cugggcgcuaccug

SEQ ID NO: 2917541 - RNA, 21 nt, Human T-lymphotropic virus 1
cucaacccucaccacuccagg

SEQ ID NO: 2917542 - RNA, 23 nt, Human T-lymphotropic virus 1
auugacacccagaccagccaccc

SEQ ID NO: 2917543 - RNA, 23 nt, Human T-lymphotropic virus 1
cccaucaccuggccccuccugcc

SEQ ID NO: 2917544 - RNA, 15 nt, Human T-lymphotropic virus 1
uucaaauacucagca

SEQ ID NO: 2917545 - RNA, 15 nt, Human T-lymphotropic virus 1
cucuaaacccugcaa

SEQ ID NO: 2917546 - RNA, 14 nt, Human T-lymphotropic virus 1
ucaggcuaggcccu

SEQ ID NO: 2917547 - RNA, 22 nt, Human T-lymphotropic virus 1
uugcggacagacggcccucaca

SEQ ID NO: 2917548 - RNA, 15 nt, Human T-lymphotropic virus 1
gcacccgucacgcug

SEQ ID NO: 2917549 - RNA, 22 nt, Human T-lymphotropic virus 1
gcccaccacccuuuuccagccu

SEQ ID NO: 2917550 - RNA, 16 nt, Human T-lymphotropic virus 1
aggcccuccugccccg

SEQ ID NO: 2917551 - RNA, 15 nt, Human T-lymphotropic virus 1
cuacagccacccugc

SEQ ID NO: 2917552 - RNA, 20 nt, Human T-lymphotropic virus 1
uucagacggauccaccuccc

SEQ ID NO: 2917553 - RNA, 16 nt, Human T-lymphotropic virus 1
acagccccagcugcug

SEQ ID NO: 2917554 - RNA, 15 nt, Human T-lymphotropic virus 1
ucauggacccucgac

SEQ ID NO: 2917555 - RNA, 15 nt, Human T-lymphotropic virus 1
caccaauuccuccac

SEQ ID NO: 2917556 - RNA, 16 nt, Human T-lymphotropic virus 1
auagaaaaacuccucu

SEQ ID NO: 2917557 - RNA, 16 nt, Human T-lymphotropic virus 1
ggcucugacgucuccc

SEQ ID NO: 2917558 - RNA, 21 nt, Human T-lymphotropic virus 1
uauugcaaccacaucgccucc

SEQ ID NO: 2917559 - RNA, 17 nt, Human T-lymphotropic virus 1
gcucucuccugcagacc

SEQ ID NO: 2917560 - RNA, 12 nt, Human T-lymphotropic virus 1
cuacucucacac

SEQ ID NO: 2917561 - RNA, 21 nt, Human T-lymphotropic virus 1
auaccaaaaacaacugggcca

SEQ ID NO: 2917562 - RNA, 22 nt, Human T-lymphotropic virus 1
ucacaaauuucaaaccaaggcc

SEQ ID NO: 2917563 - RNA, 12 nt, Human T-lymphotropic virus 1
uuuuccagccug

SEQ ID NO: 2917564 - RNA, 13 nt, Human T-lymphotropic virus 1
ucaaauccuccuu

SEQ ID NO: 2917565 - RNA, 21 nt, Human T-lymphotropic virus 1
cucagccggcucuccacgcuu

SEQ ID NO: 2917566 - RNA, 18 nt, Human T-lymphotropic virus 1
guuucgccuucucagccc

SEQ ID NO: 2917567 - RNA, 16 nt, Human T-lymphotropic virus 1
ccguccaccaauuccu

SEQ ID NO: 2917568 - RNA, 14 nt, Human T-lymphotropic virus 1
ucgccuccagccuc

SEQ ID NO: 2917569 - RNA, 20 nt, Human T-lymphotropic virus 1
cacccuugggcagcaccucc

SEQ ID NO: 2917570 - RNA, 15 nt, Human T-lymphotropic virus 1
ugccuauauuuccca

SEQ ID NO: 2917571 - RNA, 18 nt, Human T-lymphotropic virus 1
aacucccucauccugccc

SEQ ID NO: 2917572 - RNA, 21 nt, Human T-lymphotropic virus 1
cugccggcgcugcucucaucc

SEQ ID NO: 2917573 - RNA, 13 nt, Human T-lymphotropic virus 1
accaugccaccua

SEQ ID NO: 2917574 - RNA, 16 nt, Human T-lymphotropic virus 1
cuccagccccuacugg

SEQ ID NO: 2917575 - RNA, 17 nt, Human T-lymphotropic virus 1
cuuucaggcccuccugc

SEQ ID NO: 2917576 - RNA, 22 nt, Human T-lymphotropic virus 1
accucuaccagcuuuccccccc

SEQ ID NO: 2917577 - RNA, 22 nt, Human T-lymphotropic virus 1
ucuguaucgaucgugccagccu

SEQ ID NO: 2917578 - RNA, 16 nt, Human T-lymphotropic virus 1
uccccauuucucuacu

SEQ ID NO: 2917579 - RNA, 16 nt, Human T-lymphotropic virus 1
cuuccuaaccaagacc

SEQ ID NO: 2917580 - RNA, 12 nt, Human T-lymphotropic virus 1
gucuccagcccc

SEQ ID NO: 2917581 - RNA, 16 nt, Human T-lymphotropic virus 1
auauccucgagcccuc

SEQ ID NO: 2917582 - RNA, 13 nt, Human T-lymphotropic virus 1
auuuaaauccuuc

SEQ ID NO: 2917583 - RNA, 18 nt, Human T-lymphotropic virus 1
cuaaucuaguaaguuacu

SEQ ID NO: 2917584 - RNA, 21 nt, Human T-lymphotropic virus 1
caccacuccccccgacuccag

SEQ ID NO: 2917585 - RNA, 20 nt, Human T-lymphotropic virus 1
acaucugaccaccccagugu

SEQ ID NO: 2917586 - RNA, 21 nt, Human T-lymphotropic virus 1
gguaagcgcuaguucugccca

SEQ ID NO: 2917587 - RNA, 21 nt, Human T-lymphotropic virus 1
ggaggcuauuauucagccucu

SEQ ID NO: 2917588 - RNA, 12 nt, Human T-lymphotropic virus 1
gggcccugcccu

SEQ ID NO: 2917589 - RNA, 19 nt, Human T-lymphotropic virus 1
ugguccggaaggcccugga

SEQ ID NO: 2917590 - RNA, 21 nt, Human T-lymphotropic virus 1
ggcgcucccuuggagccuacc

SEQ ID NO: 2917591 - RNA, 15 nt, Human T-lymphotropic virus 1
cucuucuccucagcc

SEQ ID NO: 2917592 - RNA, 19 nt, Human T-lymphotropic virus 1
agccacccugcccuaaucu

SEQ ID NO: 2917593 - RNA, 19 nt, Human T-lymphotropic virus 1
ccagcuuuccccccccauc

SEQ ID NO: 2917594 - RNA, 15 nt, Human T-lymphotropic virus 1
cuguacacccucugg

SEQ ID NO: 2917595 - RNA, 19 nt, Human T-lymphotropic virus 1
uuccucuuugcuccaggcc

SEQ ID NO: 2917596 - RNA, 17 nt, Human T-lymphotropic virus 1
agcccuacuuugcuuuc

SEQ ID NO: 2917597 - RNA, 17 nt, Human T-lymphotropic virus 1
uagccagugccccuggg

SEQ ID NO: 2917598 - RNA, 21 nt, Human T-lymphotropic virus 1
acuaauucccaugucucaaua

SEQ ID NO: 2917599 - RNA, 18 nt, Human T-lymphotropic virus 1
ucgacaaauacaccuugc

SEQ ID NO: 2917600 - RNA, 14 nt, Human T-lymphotropic virus 1
ucuuauaaacccug

SEQ ID NO: 2917601 - RNA, 13 nt, Human T-lymphotropic virus 1
gcccucacacugc

SEQ ID NO: 2917602 - RNA, 19 nt, Human T-lymphotropic virus 1
cacguccuauacucuccca

SEQ ID NO: 2917603 - RNA, 18 nt, Human T-lymphotropic virus 1
cuccuggcaagccccucc

SEQ ID NO: 2917604 - RNA, 15 nt, Human T-lymphotropic virus 1
uguggugccuccuga

SEQ ID NO: 2917605 - RNA, 14 nt, Human T-lymphotropic virus 1
ccuuaugccagugu

SEQ ID NO: 2917606 - RNA, 13 nt, Human T-lymphotropic virus 1
agcucaccucccu

SEQ ID NO: 2917607 - RNA, 14 nt, Human T-lymphotropic virus 1
ucgacgcuccagga

SEQ ID NO: 2917608 - RNA, 17 nt, Human T-lymphotropic virus 1
ggaugacauucuccugg

SEQ ID NO: 2917609 - RNA, 13 nt, Human T-lymphotropic virus 1
acaguccuccucc

SEQ ID NO: 2917610 - RNA, 22 nt, Human T-lymphotropic virus 1
ugcccaagacccgucggaggcc

SEQ ID NO: 2917611 - RNA, 21 nt, Human T-lymphotropic virus 1
cuccuucacgcgcccgccgcc

SEQ ID NO: 2917612 - RNA, 13 nt, Human T-lymphotropic virus 1
accagcuuucccc

SEQ ID NO: 2917613 - RNA, 20 nt, Human T-lymphotropic virus 1
ccccauuggcuccugugaaa

SEQ ID NO: 2917614 - RNA, 15 nt, Human T-lymphotropic virus 1
cgucuccagccccua

SEQ ID NO: 2917615 - RNA, 22 nt, Human T-lymphotropic virus 1
acagacgaggccuugaucuccu

SEQ ID NO: 2917616 - RNA, 13 nt, Human T-lymphotropic virus 1
cagaccagccacc

SEQ ID NO: 2917617 - RNA, 17 nt, Human T-lymphotropic virus 1
aaggcagguccucucag

SEQ ID NO: 2917618 - RNA, 14 nt, Human T-lymphotropic virus 1
ccucuacucuccca

SEQ ID NO: 2917619 - RNA, 20 nt, Human T-lymphotropic virus 1
cccugacuuguccagccugc

SEQ ID NO: 2917620 - RNA, 15 nt, Human T-lymphotropic virus 1
cucucuuauaaaccc

SEQ ID NO: 2917621 - RNA, 19 nt, Human T-lymphotropic virus 1
uacgccagccccuucacag

SEQ ID NO: 2917622 - RNA, 13 nt, Human T-lymphotropic virus 1
ccauagaucucuc

SEQ ID NO: 2917623 - RNA, 20 nt, Human T-lymphotropic virus 1
ccucuauaaaauuucccuua

SEQ ID NO: 2917624 - RNA, 13 nt, Human T-lymphotropic virus 1
gugccagccuauc

SEQ ID NO: 2917625 - RNA, 17 nt, Human T-lymphotropic virus 1
aucauggaccugccccu

SEQ ID NO: 2917626 - RNA, 19 nt, Human T-lymphotropic virus 1
gaaaggaccacaggaggcu

SEQ ID NO: 2917627 - RNA, 16 nt, Human T-lymphotropic virus 1
ccugucuuuuccagac

SEQ ID NO: 2917628 - RNA, 15 nt, Human T-lymphotropic virus 1
ucuucuccucagccc

SEQ ID NO: 2917629 - RNA, 13 nt, Human T-lymphotropic virus 1
uagucccacccug

SEQ ID NO: 2917630 - RNA, 19 nt, Human T-lymphotropic virus 1
ccccaacauuccacccucc

SEQ ID NO: 2917631 - RNA, 15 nt, Human T-lymphotropic virus 1
ugacuuguccagccu

SEQ ID NO: 2917632 - RNA, 19 nt, Human T-lymphotropic virus 1
uucagacggauccaccucc

SEQ ID NO: 2917633 - RNA, 12 nt, Human T-lymphotropic virus 1
acagaacugccg

SEQ ID NO: 2917634 - RNA, 16 nt, Human T-lymphotropic virus 1
cuaccuagacucagcc

SEQ ID NO: 2917635 - RNA, 12 nt, Human T-lymphotropic virus 1
aaugccaaggcg

SEQ ID NO: 2917636 - RNA, 14 nt, Human T-lymphotropic virus 1
ccagccugccaacu

SEQ ID NO: 2917637 - RNA, 15 nt, Human T-lymphotropic virus 1
cucaccucccuuccu

SEQ ID NO: 2917638 - RNA, 20 nt, Human T-lymphotropic virus 1
ucaggcccuacagccacccu

SEQ ID NO: 2917639 - RNA, 14 nt, Human T-lymphotropic virus 1
gcaucagaucaccu

SEQ ID NO: 2917640 - RNA, 18 nt, Human T-lymphotropic virus 1
ggggccuuaacugggacc

SEQ ID NO: 2917641 - RNA, 20 nt, Human T-lymphotropic virus 1
cuguuucgccuucucagccc

SEQ ID NO: 2917642 - RNA, 22 nt, Human T-lymphotropic virus 1
ccuuuucaggagccaucucagc

SEQ ID NO: 2917643 - RNA, 20 nt, Human T-lymphotropic virus 1
cuuccagccccccaccugac

SEQ ID NO: 2917644 - RNA, 23 nt, Human T-lymphotropic virus 1
gcggcaggcccugucacagaacu

SEQ ID NO: 2917645 - RNA, 15 nt, Human T-lymphotropic virus 1
uaccucccugaggca

SEQ ID NO: 2917646 - RNA, 19 nt, Human T-lymphotropic virus 1
gcagcccauucggcaagcc

SEQ ID NO: 2917647 - RNA, 20 nt, Human T-lymphotropic virus 1
cuacaugccccccuacccca

SEQ ID NO: 2917648 - RNA, 16 nt, Human T-lymphotropic virus 1
gcaauccugcccagcc

SEQ ID NO: 2917649 - RNA, 21 nt, Human T-lymphotropic virus 1
guugacgacaaccccucaccu

SEQ ID NO: 2917650 - RNA, 16 nt, Human T-lymphotropic virus 1
cccucgacuccccucc

SEQ ID NO: 2917651 - RNA, 13 nt, Human T-lymphotropic virus 1
acuccaccucgcc

SEQ ID NO: 2917652 - RNA, 17 nt, Human T-lymphotropic virus 1
ccuugaucuccuguucu

SEQ ID NO: 2917653 - RNA, 22 nt, Human T-lymphotropic virus 1
uaaccaugcuuauuaucagccc

SEQ ID NO: 2917654 - RNA, 19 nt, Human T-lymphotropic virus 1
gccccgccgaucccaaaga

SEQ ID NO: 2917655 - RNA, 16 nt, Human T-lymphotropic virus 1
ccacccuccuuccucc

SEQ ID NO: 2917656 - RNA, 13 nt, Human T-lymphotropic virus 1
cgccgccuuaccu

SEQ ID NO: 2917657 - RNA, 21 nt, Human T-lymphotropic virus 1
cccggcacuagauacgccugg

SEQ ID NO: 2917658 - RNA, 12 nt, Human T-lymphotropic virus 1
gagucuccucau

SEQ ID NO: 2917659 - RNA, 12 nt, Human T-lymphotropic virus 1
aucaaaaagcca

SEQ ID NO: 2917660 - RNA, 22 nt, Human T-lymphotropic virus 1
agcggccuucuccuccgcccgc

SEQ ID NO: 2917661 - RNA, 18 nt, Human T-lymphotropic virus 1
cuagucgacgcuccagga

SEQ ID NO: 2917662 - RNA, 15 nt, Human T-lymphotropic virus 1
ccuaccaccccucau

SEQ ID NO: 2917663 - RNA, 13 nt, Human T-lymphotropic virus 1
ucuuuuccagacc

SEQ ID NO: 2917664 - RNA, 15 nt, Human T-lymphotropic virus 1
gucaccgauucaaaa

SEQ ID NO: 2917665 - RNA, 15 nt, Human T-lymphotropic virus 1
cgacauuacccauuu

SEQ ID NO: 2917666 - RNA, 14 nt, Human T-lymphotropic virus 1
cuaggcaccuucca

SEQ ID NO: 2917667 - RNA, 23 nt, Human T-lymphotropic virus 1
agccuggcaaaacggccuccuuc

SEQ ID NO: 2917668 - RNA, 19 nt, Human T-lymphotropic virus 1
ccuggccccuccugcccca

SEQ ID NO: 2917669 - RNA, 15 nt, Human T-lymphotropic virus 1
cuacuggccaccugu

SEQ ID NO: 2917670 - RNA, 19 nt, Human T-lymphotropic virus 1
ugcccuaggcaccuuccaa

SEQ ID NO: 2917671 - RNA, 18 nt, Human T-lymphotropic virus 1
gugauuacagccccagcu

SEQ ID NO: 2917672 - RNA, 18 nt, Human T-lymphotropic virus 1
gucauaacucccucaucc

SEQ ID NO: 2917673 - RNA, 13 nt, Human T-lymphotropic virus 1
ucuacucucccac

SEQ ID NO: 2917674 - RNA, 16 nt, Human T-lymphotropic virus 1
ccacccuugggcagca

SEQ ID NO: 2917675 - RNA, 20 nt, Human T-lymphotropic virus 1
cuccucuuccuuccuuuuca

SEQ ID NO: 2917676 - RNA, 15 nt, Human T-lymphotropic virus 1
ggaggacagcucagc

SEQ ID NO: 2917677 - RNA, 19 nt, Human T-lymphotropic virus 1
acuggcuggggccuuaacu

SEQ ID NO: 2917678 - RNA, 14 nt, Human T-lymphotropic virus 1
agaccuacacaguu

SEQ ID NO: 2917679 - RNA, 22 nt, Human T-lymphotropic virus 1
agcagaucaggcccuacagcca

SEQ ID NO: 2917680 - RNA, 17 nt, Human T-lymphotropic virus 1
uacucaagaaguuucac

SEQ ID NO: 2917681 - RNA, 13 nt, Human T-lymphotropic virus 1
cauaacucccuca

SEQ ID NO: 2917682 - RNA, 16 nt, Human T-lymphotropic virus 1
uccuccguucagccuc

SEQ ID NO: 2917683 - RNA, 23 nt, Human T-lymphotropic virus 1
ccugggggcagcuacuugccuca

SEQ ID NO: 2917684 - RNA, 20 nt, Human T-lymphotropic virus 1
ucaaacaucugaccacccca

SEQ ID NO: 2917685 - RNA, 16 nt, Human T-lymphotropic virus 1
ccaguucugcccccuc

SEQ ID NO: 2917686 - RNA, 21 nt, Human T-lymphotropic virus 1
ccuguucgaaaugcagcuggc

SEQ ID NO: 2917687 - RNA, 19 nt, Human T-lymphotropic virus 1
ucacuuaugaugcaguccc

SEQ ID NO: 2917688 - RNA, 13 nt, Human T-lymphotropic virus 1
ucauaagcucaga

SEQ ID NO: 2917689 - RNA, 22 nt, Human T-lymphotropic virus 1
ccccuuucaggcccuccugccc

SEQ ID NO: 2917690 - RNA, 15 nt, Human T-lymphotropic virus 1
uuucacaaauuucaa

SEQ ID NO: 2917691 - RNA, 14 nt, Human T-lymphotropic virus 1
cccugcuugcucaa

SEQ ID NO: 2917692 - RNA, 11 nt, Human T-lymphotropic virus 1
cucauuucuac

SEQ ID NO: 2917693 - RNA, 20 nt, Human T-lymphotropic virus 1
cgucacgcccuacuggccac

SEQ ID NO: 2917694 - RNA, 18 nt, Human T-lymphotropic virus 1
cgccgccuuaccugaggc

SEQ ID NO: 2917695 - RNA, 13 nt, Human T-lymphotropic virus 1
augcugcccagaa

SEQ ID NO: 2917696 - RNA, 18 nt, Human T-lymphotropic virus 1
caugcuuauuaucagccc

SEQ ID NO: 2917697 - RNA, 16 nt, Human T-lymphotropic virus 1
cuccuucuccugcagc

SEQ ID NO: 2917698 - RNA, 16 nt, Human T-lymphotropic virus 1
cuaccaugccaccuau

SEQ ID NO: 2917699 - RNA, 19 nt, Human T-lymphotropic virus 1
cccaacccugucuuuucca

SEQ ID NO: 2917700 - RNA, 20 nt, Human T-lymphotropic virus 1
cccgggggcuuagagccucu

SEQ ID NO: 2917701 - RNA, 13 nt, Human T-lymphotropic virus 1
cucauaccacucu

SEQ ID NO: 2917702 - RNA, 18 nt, Human T-lymphotropic virus 1
caagaaguuucacaccuc

SEQ ID NO: 2917703 - RNA, 22 nt, Human T-lymphotropic virus 1
ccguuccacucaacccucacca

SEQ ID NO: 2917704 - RNA, 22 nt, Human T-lymphotropic virus 1
gccgucuccagccccuacugga

SEQ ID NO: 2917705 - RNA, 12 nt, Human T-lymphotropic virus 1
gcuucccuaauc

SEQ ID NO: 2917706 - RNA, 23 nt, Human T-lymphotropic virus 1
gauucaaaaauuuaggugcccag

SEQ ID NO: 2917707 - RNA, 16 nt, Human T-lymphotropic virus 1
uccgcccgcuuccugc

SEQ ID NO: 2917708 - RNA, 19 nt, Human T-lymphotropic virus 1
uuaauaccgaacccagcca

SEQ ID NO: 2917709 - RNA, 16 nt, Human T-lymphotropic virus 1
cauauccucgagcccu

SEQ ID NO: 2917710 - RNA, 15 nt, Human T-lymphotropic virus 1
uccuccuccuugucc

SEQ ID NO: 2917711 - RNA, 20 nt, Human T-lymphotropic virus 1
caaccuccuccguucagccu

SEQ ID NO: 2917712 - RNA, 21 nt, Human T-lymphotropic virus 1
ggacuguuugcccaccacccu

SEQ ID NO: 2917713 - RNA, 21 nt, Human T-lymphotropic virus 1
gauccaccucccaggcagccu

SEQ ID NO: 2917714 - RNA, 23 nt, Human T-lymphotropic virus 1
ggccacaauggcuucccuaaucu

SEQ ID NO: 2917715 - RNA, 15 nt, Human T-lymphotropic virus 1
ccucaccacuccagg

SEQ ID NO: 2917716 - RNA, 14 nt, Human T-lymphotropic virus 1
gcaauccugcccag

SEQ ID NO: 2917717 - RNA, 22 nt, Human T-lymphotropic virus 1
aaccacaucgccuccagccucc

SEQ ID NO: 2917718 - RNA, 22 nt, Human T-lymphotropic virus 1
cuccugcagaccuacacaguuu

SEQ ID NO: 2917719 - RNA, 23 nt, Human T-lymphotropic virus 1
gccguggccuacucccuaaccac

SEQ ID NO: 2917720 - RNA, 13 nt, Human T-lymphotropic virus 1
uacacccucuggg

SEQ ID NO: 2917721 - RNA, 23 nt, Human T-lymphotropic virus 1
ggcuucccuaaucucccaugggu

SEQ ID NO: 2917722 - RNA, 18 nt, Human T-lymphotropic virus 1
uacaauccaaccagcucc

SEQ ID NO: 2917723 - RNA, 22 nt, Human T-lymphotropic virus 1
ccauuggcuccugugaaagccc

SEQ ID NO: 2917724 - RNA, 13 nt, Human T-lymphotropic virus 1
auggaccugcccc

SEQ ID NO: 2917725 - RNA, 20 nt, Human T-lymphotropic virus 1
gauacauggaacccacccuu

SEQ ID NO: 2917726 - RNA, 17 nt, Human T-lymphotropic virus 1
cucucaggcccccuuuc

SEQ ID NO: 2917727 - RNA, 14 nt, Human T-lymphotropic virus 1
gaggccgccaucca

SEQ ID NO: 2917728 - RNA, 15 nt, Human T-lymphotropic virus 1
cggaaggcccuggag

SEQ ID NO: 2917729 - RNA, 15 nt, Human T-lymphotropic virus 1
ccaagcagcaguggc

SEQ ID NO: 2917730 - RNA, 14 nt, Human T-lymphotropic virus 1
acuccccuccuucc

SEQ ID NO: 2917731 - RNA, 15 nt, Human T-lymphotropic virus 1
gagccgucuccagcc

SEQ ID NO: 2917732 - RNA, 19 nt, Human T-lymphotropic virus 1
cacgcuaggaucccgcucc

SEQ ID NO: 2917733 - RNA, 19 nt, Human T-lymphotropic virus 1
aaaccuguacacccucugg

SEQ ID NO: 2917734 - RNA, 14 nt, Human T-lymphotropic virus 1
ccuccaggccaugc

SEQ ID NO: 2917735 - RNA, 15 nt, Human T-lymphotropic virus 1
ccuuuuccagccugc

SEQ ID NO: 2917736 - RNA, 16 nt, Human T-lymphotropic virus 1
ccggaggacagcucag

SEQ ID NO: 2917737 - RNA, 14 nt, Human T-lymphotropic virus 1
ggagccaucucagc

SEQ ID NO: 2917738 - RNA, 17 nt, Human T-lymphotropic virus 1
cagaacgccuccaggcc

SEQ ID NO: 2917739 - RNA, 19 nt, Human T-lymphotropic virus 1
cuucuuuucggauacccag

SEQ ID NO: 2917740 - RNA, 18 nt, Human T-lymphotropic virus 1
accugcaacuacucucag

SEQ ID NO: 2917741 - RNA, 20 nt, Human T-lymphotropic virus 1
caaacaucugaccaccccag

SEQ ID NO: 2917742 - RNA, 17 nt, Human T-lymphotropic virus 1
acgacaccuccccucgc

SEQ ID NO: 2917743 - RNA, 22 nt, Human T-lymphotropic virus 1
uccgucagcuacgacaccuccc

SEQ ID NO: 2917744 - RNA, 12 nt, Human T-lymphotropic virus 1
cgucuccagccc

SEQ ID NO: 2917745 - RNA, 15 nt, Human T-lymphotropic virus 1
cuacaguccuccucc

SEQ ID NO: 2917746 - RNA, 15 nt, Human T-lymphotropic virus 1
gucuccagccccuac

SEQ ID NO: 2917747 - RNA, 16 nt, Human T-lymphotropic virus 1
aucauuagugcagcug

SEQ ID NO: 2917748 - RNA, 19 nt, Human T-lymphotropic virus 1
cccguggaggcuccucaag

SEQ ID NO: 2917749 - RNA, 13 nt, Human T-lymphotropic virus 1
auccugcccagcc

SEQ ID NO: 2917750 - RNA, 18 nt, Human T-lymphotropic virus 1
ccugucauaacucccuca

SEQ ID NO: 2917751 - RNA, 20 nt, Human T-lymphotropic virus 1
gagguggcgcuuuccccccu

SEQ ID NO: 2917752 - RNA, 15 nt, Human T-lymphotropic virus 1
caaucugcuuuuccu

SEQ ID NO: 2917753 - RNA, 18 nt, Human T-lymphotropic virus 1
aggcccuacagccacccu

SEQ ID NO: 2917754 - RNA, 20 nt, Human T-lymphotropic virus 1
ggcccugacgugucccccua

SEQ ID NO: 2917755 - RNA, 23 nt, Human T-lymphotropic virus 1
ugacacccagaccagccacccaa

SEQ ID NO: 2917756 - RNA, 21 nt, Human T-lymphotropic virus 1
gccagcucggggccuuccuca

SEQ ID NO: 2917757 - RNA, 19 nt, Human T-lymphotropic virus 1
gugccagccuauccacuug

SEQ ID NO: 2917758 - RNA, 18 nt, Human T-lymphotropic virus 1
acccagccaacugccucc

SEQ ID NO: 2917759 - RNA, 15 nt, Human T-lymphotropic virus 1
cucaccucaaaaaac

SEQ ID NO: 2917760 - RNA, 16 nt, Human T-lymphotropic virus 1
uucuccucagcccguc

SEQ ID NO: 2917761 - RNA, 18 nt, Human T-lymphotropic virus 1
ggcgcucccuuggagccu

SEQ ID NO: 2917762 - RNA, 17 nt, Human T-lymphotropic virus 1
uccaccaauuccuccac

SEQ ID NO: 2917763 - RNA, 15 nt, Human T-lymphotropic virus 1
uaacuggacccacug

SEQ ID NO: 2917764 - RNA, 19 nt, Human T-lymphotropic virus 1
accacaaaaaucugcucaa

SEQ ID NO: 2917765 - RNA, 20 nt, Human T-lymphotropic virus 1
ccuacaauccaaccagcucc

SEQ ID NO: 2917766 - RNA, 19 nt, Human T-lymphotropic virus 1
uggggccuuaacugggacc

SEQ ID NO: 2917767 - RNA, 18 nt, Human T-lymphotropic virus 1
agacuaguccaaacccug

SEQ ID NO: 2917768 - RNA, 18 nt, Human T-lymphotropic virus 1
ugacauucuccuggcaag

SEQ ID NO: 2917769 - RNA, 19 nt, Human T-lymphotropic virus 1
uaccaaaaacaacugggcc

SEQ ID NO: 2917770 - RNA, 23 nt, Human T-lymphotropic virus 1
ggugccaaucauggaccugcccc

SEQ ID NO: 2917771 - RNA, 20 nt, Human T-lymphotropic virus 1
cgucagcuacgacaccuccc

SEQ ID NO: 2917772 - RNA, 11 nt, Human T-lymphotropic virus 1
aucucuccuuc

SEQ ID NO: 2917773 - RNA, 14 nt, Human T-lymphotropic virus 1
ccacuugcgcucac

SEQ ID NO: 2917774 - RNA, 13 nt, Human T-lymphotropic virus 1
acaaucaaccacc

SEQ ID NO: 2917775 - RNA, 22 nt, Human T-lymphotropic virus 1
cuccugaacuacguccgccguc

SEQ ID NO: 2917776 - RNA, 16 nt, Human T-lymphotropic virus 1
uacugauccccgagac

SEQ ID NO: 2917777 - RNA, 24 nt, Human T-lymphotropic virus 1
ccuuaauaccgaacccagccaacu

SEQ ID NO: 2917778 - RNA, 18 nt, Human T-lymphotropic virus 1
cgcguuaucggcucagcu

SEQ ID NO: 2917779 - RNA, 17 nt, Human T-lymphotropic virus 1
caucaacccccaacucc

SEQ ID NO: 2917780 - RNA, 16 nt, Human T-lymphotropic virus 1
uggccccuccugcccc

SEQ ID NO: 2917781 - RNA, 13 nt, Human T-lymphotropic virus 1
uccaguccaagca

SEQ ID NO: 2917782 - RNA, 16 nt, Human T-lymphotropic virus 1
ucaggcccccuuucag

SEQ ID NO: 2917783 - RNA, 17 nt, Human T-lymphotropic virus 1
cacccuugucgcgcuac

SEQ ID NO: 2917784 - RNA, 19 nt, Human T-lymphotropic virus 1
caauaauuaaccucuccca

SEQ ID NO: 2917785 - RNA, 14 nt, Human T-lymphotropic virus 1
cauacggcucaaua

SEQ ID NO: 2917786 - RNA, 14 nt, Human T-lymphotropic virus 1
ccugcuuucuccgg

SEQ ID NO: 2917787 - RNA, 15 nt, Human T-lymphotropic virus 1
cuccccuccuucccc

SEQ ID NO: 2917788 - RNA, 20 nt, Human T-lymphotropic virus 1
cugacuuguccagccugcca

SEQ ID NO: 2917789 - RNA, 23 nt, Human T-lymphotropic virus 1
ucuccacgcuuugccugacccug

SEQ ID NO: 2917790 - RNA, 22 nt, Human T-lymphotropic virus 1
uaaaagcguggggacaguucag

SEQ ID NO: 2917791 - RNA, 22 nt, Human T-lymphotropic virus 1
caacauauuucuagacuccaag

SEQ ID NO: 2917792 - RNA, 19 nt, Human T-lymphotropic virus 1
gauuuccgggcccugcccu

SEQ ID NO: 2917793 - RNA, 22 nt, Human T-lymphotropic virus 1
ucaucuucccccgggcccccug

SEQ ID NO: 2917794 - RNA, 17 nt, Human T-lymphotropic virus 1
cuggcaagccccuccca

SEQ ID NO: 2917795 - RNA, 20 nt, Human T-lymphotropic virus 1
gacguuaccauuuaacugga

SEQ ID NO: 2917796 - RNA, 14 nt, Human T-lymphotropic virus 1
cuuuccccugugau

SEQ ID NO: 2917797 - RNA, 13 nt, Human T-lymphotropic virus 1
ccgucuccagccc

SEQ ID NO: 2917798 - RNA, 20 nt, Human T-lymphotropic virus 1
caugcuuauuaucagcccac

SEQ ID NO: 2917799 - RNA, 20 nt, Human T-lymphotropic virus 1
cuucccccgggcccccugac

SEQ ID NO: 2917800 - RNA, 18 nt, Human T-lymphotropic virus 1
cuuuucaaauacucagca

SEQ ID NO: 2917801 - RNA, 21 nt, Human T-lymphotropic virus 1
cuaugauuuccgggcccugcc

SEQ ID NO: 2917802 - RNA, 17 nt, Human T-lymphotropic virus 1
cugucacagaacugccg

SEQ ID NO: 2917803 - RNA, 15 nt, Human T-lymphotropic virus 1
ccuugcaacacuugg

SEQ ID NO: 2917804 - RNA, 18 nt, Human T-lymphotropic virus 1
caucaucuucccccgggc

SEQ ID NO: 2917805 - RNA, 15 nt, Human T-lymphotropic virus 1
gcauguaccucuacc

SEQ ID NO: 2917806 - RNA, 18 nt, Human T-lymphotropic virus 1
cuccagccuccccugcca

SEQ ID NO: 2917807 - RNA, 14 nt, Human T-lymphotropic virus 1
ugcuguacucucac

SEQ ID NO: 2917808 - RNA, 23 nt, Human T-lymphotropic virus 1
aacacagacaauggcccugccua

SEQ ID NO: 2917809 - RNA, 20 nt, Human T-lymphotropic virus 1
cucccaucaaauccuccuuc

SEQ ID NO: 2917810 - RNA, 16 nt, Human T-lymphotropic virus 1
accggcuccauguccc

SEQ ID NO: 2917811 - RNA, 21 nt, Human T-lymphotropic virus 1
cccagccaacugccucccacc

SEQ ID NO: 2917812 - RNA, 14 nt, Human T-lymphotropic virus 1
gcaccagcucaggc

SEQ ID NO: 2917813 - RNA, 17 nt, Human T-lymphotropic virus 1
uuggacagagucuucuu

SEQ ID NO: 2917814 - RNA, 18 nt, Human T-lymphotropic virus 1
gcucuuccugcuuucucc

SEQ ID NO: 2917815 - RNA, 15 nt, Human T-lymphotropic virus 1
ggagccgucuccagc

SEQ ID NO: 2917816 - RNA, 18 nt, Human T-lymphotropic virus 1
aauagaaaaacuccucua

SEQ ID NO: 2917817 - RNA, 12 nt, Human T-lymphotropic virus 1
ucugccgccucc

SEQ ID NO: 2917818 - RNA, 18 nt, Human T-lymphotropic virus 1
gacaaaucauaagcucag

SEQ ID NO: 2917819 - RNA, 15 nt, Human T-lymphotropic virus 1
cugacagccuggcaa

SEQ ID NO: 2917820 - RNA, 14 nt, Human T-lymphotropic virus 1
aaauugcacaguau

SEQ ID NO: 2917821 - RNA, 14 nt, Human T-lymphotropic virus 1
ccgccauccacgcc

SEQ ID NO: 2917822 - RNA, 13 nt, Human T-lymphotropic virus 1
acuacccaugucc

SEQ ID NO: 2917823 - RNA, 15 nt, Human T-lymphotropic virus 1
ugccaccuauucccu

SEQ ID NO: 2917824 - RNA, 13 nt, Human T-lymphotropic virus 1
ccgccccuccucu

SEQ ID NO: 2917825 - RNA, 14 nt, Human T-lymphotropic virus 1
ucauggaccugccc

SEQ ID NO: 2917826 - RNA, 23 nt, Human T-lymphotropic virus 1
ccucuggggaggcuccguugucu

SEQ ID NO: 2917827 - RNA, 22 nt, Human T-lymphotropic virus 1
cuggcaaaacggccuccuuccg

SEQ ID NO: 2917828 - RNA, 15 nt, Human T-lymphotropic virus 1
cagcagaucaggccc

SEQ ID NO: 2917829 - RNA, 22 nt, Human T-lymphotropic virus 1
ccacgccgguugagucgcguuc

SEQ ID NO: 2917830 - RNA, 17 nt, Human T-lymphotropic virus 1
caaacuggaaucacccu

SEQ ID NO: 2917831 - RNA, 13 nt, Human T-lymphotropic virus 1
cagcaccucccaa

SEQ ID NO: 2917832 - RNA, 16 nt, Human T-lymphotropic virus 1
ucauuucuacucucac

SEQ ID NO: 2917833 - RNA, 15 nt, Human T-lymphotropic virus 1
acagacggcccucac

SEQ ID NO: 2917834 - RNA, 22 nt, Human T-lymphotropic virus 1
cacgcccuacuggccaccuguc

SEQ ID NO: 2917835 - RNA, 13 nt, Human T-lymphotropic virus 1
cagcucucuccug

SEQ ID NO: 2917836 - RNA, 22 nt, Human T-lymphotropic virus 1
cccugacuuguccagccugcca

SEQ ID NO: 2917837 - RNA, 17 nt, Human T-lymphotropic virus 1
cauggacccucgaccug

SEQ ID NO: 2917838 - RNA, 17 nt, Human T-lymphotropic virus 1
ccugacuuguccagccu

SEQ ID NO: 2917839 - RNA, 12 nt, Human T-lymphotropic virus 1
ucaaaacuccug

SEQ ID NO: 2917840 - RNA, 13 nt, Human T-lymphotropic virus 1
cuucaccacuccc

SEQ ID NO: 2917841 - RNA, 15 nt, Human T-lymphotropic virus 1
ccagcuaccaugcca

SEQ ID NO: 2917842 - RNA, 13 nt, Human T-lymphotropic virus 1
accgccccuccuc

SEQ ID NO: 2917843 - RNA, 16 nt, Human T-lymphotropic virus 1
cagcucaggcuaggcc

SEQ ID NO: 2917844 - RNA, 16 nt, Human T-lymphotropic virus 1
cacuccccccgacucc

SEQ ID NO: 2917845 - RNA, 21 nt, Human T-lymphotropic virus 1
agcuggcccauauccugcagc

SEQ ID NO: 2917846 - RNA, 19 nt, Human T-lymphotropic virus 1
caccuggccccuccugccc

SEQ ID NO: 2917847 - RNA, 22 nt, Human T-lymphotropic virus 1
uguucucaaguaauacuccccu

SEQ ID NO: 2917848 - RNA, 13 nt, Human T-lymphotropic virus 1
uggcccuuucagc

SEQ ID NO: 2917849 - RNA, 23 nt, Human T-lymphotropic virus 1
uagaccuuaaagacgccuuuuuc

SEQ ID NO: 2917850 - RNA, 19 nt, Human T-lymphotropic virus 1
aucccucgacuccccuccu

SEQ ID NO: 2917851 - RNA, 12 nt, Human T-lymphotropic virus 1
ucugcccagugg

SEQ ID NO: 2917852 - RNA, 17 nt, Human T-lymphotropic virus 1
gcuacgacaccuccccu

SEQ ID NO: 2917853 - RNA, 13 nt, Human T-lymphotropic virus 1
gccccuccugccc

SEQ ID NO: 2917854 - RNA, 14 nt, Human T-lymphotropic virus 1
aguccaaacccugc

SEQ ID NO: 2917855 - RNA, 16 nt, Human T-lymphotropic virus 1
agcgcuaguucugccc

SEQ ID NO: 2917856 - RNA, 12 nt, Human T-lymphotropic virus 1
aguucugccccc

SEQ ID NO: 2917857 - RNA, 17 nt, Human T-lymphotropic virus 1
caccucccaacccuguc

SEQ ID NO: 2917858 - RNA, 17 nt, Human T-lymphotropic virus 1
cagcucggggccuuccu

SEQ ID NO: 2917859 - RNA, 22 nt, Human T-lymphotropic virus 1
cucauccugccccccuuuuccu

SEQ ID NO: 2917860 - RNA, 15 nt, Human T-lymphotropic virus 1
guccccaagguaccu

SEQ ID NO: 2917861 - RNA, 14 nt, Human T-lymphotropic virus 1
gcucucacagaugc

SEQ ID NO: 2917862 - RNA, 14 nt, Human T-lymphotropic virus 1
gaacaccucccaag

SEQ ID NO: 2917863 - RNA, 22 nt, Human T-lymphotropic virus 1
ccuguccagagcaucagaucac

SEQ ID NO: 2917864 - RNA, 21 nt, Human T-lymphotropic virus 1
ucacgcgcccgccgccuuacc

SEQ ID NO: 2917865 - RNA, 19 nt, Human T-lymphotropic virus 1
ccuaccuaaacaguuccag

SEQ ID NO: 2917866 - RNA, 15 nt, Human T-lymphotropic virus 1
cuucuccucagcccg

SEQ ID NO: 2917867 - RNA, 19 nt, Human T-lymphotropic virus 1
ccguucagccuccaaggac

SEQ ID NO: 2917868 - RNA, 20 nt, Human T-lymphotropic virus 1
auccuauggacuacucugcc

SEQ ID NO: 2917869 - RNA, 19 nt, Human T-lymphotropic virus 1
ccuuucaggcccuccugcc

SEQ ID NO: 2917870 - RNA, 20 nt, Human T-lymphotropic virus 1
caaaaauuuaggugcccaga

SEQ ID NO: 2917871 - RNA, 17 nt, Human T-lymphotropic virus 1
caucaccuggccccucc

SEQ ID NO: 2917872 - RNA, 19 nt, Human T-lymphotropic virus 1
caugcuuauuaucagccca

SEQ ID NO: 2917873 - RNA, 22 nt, Human T-lymphotropic virus 1
ccccauguuugucaagccgucc

SEQ ID NO: 2917874 - RNA, 15 nt, Human T-lymphotropic virus 1
aggcccuccugcccc

SEQ ID NO: 2917875 - RNA, 23 nt, Human T-lymphotropic virus 1
cgggaaccacccauuuccucccc

SEQ ID NO: 2917876 - RNA, 22 nt, Human T-lymphotropic virus 1
cuugcaggaccaugcauccucc

SEQ ID NO: 2917877 - RNA, 14 nt, Human T-lymphotropic virus 1
acacaguuucaccc

SEQ ID NO: 2917878 - RNA, 17 nt, Human T-lymphotropic virus 1
caaggacuccaccucgc

SEQ ID NO: 2917879 - RNA, 22 nt, Human T-lymphotropic virus 1
agacuaguccaaacccugcccc

SEQ ID NO: 2917880 - RNA, 22 nt, Human T-lymphotropic virus 1
agauucaagcuauagucuccuc

SEQ ID NO: 2917881 - RNA, 14 nt, Human T-lymphotropic virus 1
ggauccaccuccca

SEQ ID NO: 2917882 - RNA, 21 nt, Human T-lymphotropic virus 1
cuugaaaaucgaguccugacu

SEQ ID NO: 2917883 - RNA, 16 nt, Human T-lymphotropic virus 1
ugcucuauccauagcc

SEQ ID NO: 2917884 - RNA, 19 nt, Human T-lymphotropic virus 1
cguggccuacucccuaacc

SEQ ID NO: 2917885 - RNA, 15 nt, Human T-lymphotropic virus 1
agcucggggccuucc

SEQ ID NO: 2917886 - RNA, 19 nt, Human T-lymphotropic virus 1
ggccaggaaauaacccagu

SEQ ID NO: 2917887 - RNA, 12 nt, Human T-lymphotropic virus 1
cuagacucagcc

SEQ ID NO: 2917888 - RNA, 20 nt, Human T-lymphotropic virus 1
ccuucuagucgacgcuccag

SEQ ID NO: 2917889 - RNA, 23 nt, Human T-lymphotropic virus 1
agaucacuuuaagcucaccuccc

SEQ ID NO: 2917890 - RNA, 23 nt, Human T-lymphotropic virus 1
ucccaacccugucuuuuccagac

SEQ ID NO: 2917891 - RNA, 19 nt, Human T-lymphotropic virus 1
aucgccuccagccuccccu

SEQ ID NO: 2917892 - RNA, 19 nt, Human T-lymphotropic virus 1
caguccaagcagcaguggc

SEQ ID NO: 2917893 - RNA, 21 nt, Human T-lymphotropic virus 1
ucagcagaucaggcccuacag

SEQ ID NO: 2917894 - RNA, 20 nt, Human T-lymphotropic virus 1
ccuugggcuagaacaccucc

SEQ ID NO: 2917895 - RNA, 16 nt, Human T-lymphotropic virus 1
ccuaguugauaccaaa

SEQ ID NO: 2917896 - RNA, 15 nt, Human T-lymphotropic virus 1
agcacaguuuccucc

SEQ ID NO: 2917897 - RNA, 18 nt, Human T-lymphotropic virus 1
cacaguuggagucuccuc

SEQ ID NO: 2917898 - RNA, 13 nt, Human T-lymphotropic virus 1
cacagaacugccg

SEQ ID NO: 2917899 - RNA, 15 nt, Human T-lymphotropic virus 1
auccugcgcucuugc

SEQ ID NO: 2917900 - RNA, 13 nt, Human T-lymphotropic virus 1
caccagcucaggc

SEQ ID NO: 2917901 - RNA, 21 nt, Human T-lymphotropic virus 1
cccccuaccuaaacaguucca

SEQ ID NO: 2917902 - RNA, 18 nt, Human T-lymphotropic virus 1
caaaucccccuaccuaaa

SEQ ID NO: 2917903 - RNA, 23 nt, Human T-lymphotropic virus 1
auucaaacaucugaccaccccag

SEQ ID NO: 2917904 - RNA, 19 nt, Human T-lymphotropic virus 1
ccuacuggccaccugucca

SEQ ID NO: 2917905 - RNA, 15 nt, Human T-lymphotropic virus 1
uuacgccagccccuu

SEQ ID NO: 2917906 - RNA, 20 nt, Human T-lymphotropic virus 1
cucaagaaguuucacaccuc

SEQ ID NO: 2917907 - RNA, 19 nt, Human T-lymphotropic virus 1
aacucccucauccugcccc

SEQ ID NO: 2917908 - RNA, 15 nt, Human T-lymphotropic virus 1
uauuacucgacaaau

SEQ ID NO: 2917909 - RNA, 14 nt, Human T-lymphotropic virus 1
ugggucuccaaagg

SEQ ID NO: 2917910 - RNA, 18 nt, Human T-lymphotropic virus 1
cagccaacugccucccac

SEQ ID NO: 2917911 - RNA, 15 nt, Human T-lymphotropic virus 1
gccuuaccugaggcc

SEQ ID NO: 2917912 - RNA, 21 nt, Human T-lymphotropic virus 1
ccuacacaguuucacccauug

SEQ ID NO: 2917913 - RNA, 18 nt, Human T-lymphotropic virus 1
aucgccuccagccucccc

SEQ ID NO: 2917914 - RNA, 18 nt, Human T-lymphotropic virus 1
cacgcuaggaucccgcuc

SEQ ID NO: 2917915 - RNA, 18 nt, Human T-lymphotropic virus 1
aucauaagcucagaccuc

SEQ ID NO: 2917916 - RNA, 18 nt, Human T-lymphotropic virus 1
ugguguuccaguccaagc

SEQ ID NO: 2917917 - RNA, 12 nt, Human T-lymphotropic virus 1
acaucuccaccc

SEQ ID NO: 2917918 - RNA, 19 nt, Human T-lymphotropic virus 1
gcucucacagaugcccuac

SEQ ID NO: 2917919 - RNA, 18 nt, Human T-lymphotropic virus 1
cuccaggauaugacccca

SEQ ID NO: 2917920 - RNA, 16 nt, Human T-lymphotropic virus 1
uuccagccccccaccu

SEQ ID NO: 2917921 - RNA, 13 nt, Human T-lymphotropic virus 1
aaucugcucaaaa

SEQ ID NO: 2917922 - RNA, 14 nt, Human T-lymphotropic virus 1
caaggacuccaccu

SEQ ID NO: 2917923 - RNA, 20 nt, Human T-lymphotropic virus 1
ggccgcggcuuuccucuucu

SEQ ID NO: 2917924 - RNA, 18 nt, Human T-lymphotropic virus 1
ugcgcaaauacucccccu

SEQ ID NO: 2917925 - RNA, 22 nt, Human T-lymphotropic virus 1
cuucauguauggguagacaccu

SEQ ID NO: 2917926 - RNA, 16 nt, Human T-lymphotropic virus 1
aucaccugggacccca

SEQ ID NO: 2917927 - RNA, 12 nt, Human T-lymphotropic virus 1
agccuccaagga

SEQ ID NO: 2917928 - RNA, 16 nt, Human T-lymphotropic virus 1
ucgaccugcuggcccu

SEQ ID NO: 2917929 - RNA, 14 nt, Human T-lymphotropic virus 1
uguggugccuccug

SEQ ID NO: 2917930 - RNA, 22 nt, Human T-lymphotropic virus 1
uucaaaaauuuaggugcccaga

SEQ ID NO: 2917931 - RNA, 17 nt, Human T-lymphotropic virus 1
cagcuaccaugccaccu

SEQ ID NO: 2917932 - RNA, 18 nt, Human T-lymphotropic virus 1
acuuguccagccugccaa

SEQ ID NO: 2917933 - RNA, 21 nt, Human T-lymphotropic virus 1
ccacugugguguuccagucca

SEQ ID NO: 2917934 - RNA, 22 nt, Human T-lymphotropic virus 1
ccugcaauccugcccagccagu

SEQ ID NO: 2917935 - RNA, 13 nt, Human T-lymphotropic virus 1
ccguucagccucc

SEQ ID NO: 2917936 - RNA, 17 nt, Human T-lymphotropic virus 1
agaccccggacuccggc

SEQ ID NO: 2917937 - RNA, 18 nt, Human T-lymphotropic virus 1
uaccuucggacccuugcc

SEQ ID NO: 2917938 - RNA, 23 nt, Human T-lymphotropic virus 1
gccaucuuuaguacuacaguccu

SEQ ID NO: 2917939 - RNA, 11 nt, Human T-lymphotropic virus 1
ccgaacccagc

SEQ ID NO: 2917940 - RNA, 18 nt, Human T-lymphotropic virus 1
caccuggccccuccugcc

SEQ ID NO: 2917941 - RNA, 17 nt, Human T-lymphotropic virus 1
accugaacuucaagccc

SEQ ID NO: 2917942 - RNA, 18 nt, Human T-lymphotropic virus 1
cucccuuggagccuaccu

SEQ ID NO: 2917943 - RNA, 15 nt, Human T-lymphotropic virus 1
cugcuuuuccuccuc

SEQ ID NO: 2917944 - RNA, 12 nt, Human T-lymphotropic virus 1
ccgcccuggcca

SEQ ID NO: 2917945 - RNA, 15 nt, Human T-lymphotropic virus 1
accuauggauaaugc

SEQ ID NO: 2917946 - RNA, 17 nt, Human T-lymphotropic virus 1
cucuuugcuccaggcca

SEQ ID NO: 2917947 - RNA, 14 nt, Human T-lymphotropic virus 1
cagccacccaaaga

SEQ ID NO: 2917948 - RNA, 21 nt, Human T-lymphotropic virus 1
cuggcuugucuccgcccuggc

SEQ ID NO: 2917949 - RNA, 17 nt, Human T-lymphotropic virus 1
ugccaacuacacuagcc

SEQ ID NO: 2917950 - RNA, 19 nt, Human T-lymphotropic virus 1
ccugccaacuacacuagcc

SEQ ID NO: 2917951 - RNA, 17 nt, Human T-lymphotropic virus 1
uaccugaacuucaagcc

SEQ ID NO: 2917952 - RNA, 19 nt, Human T-lymphotropic virus 1
gcuccaugucccucgccuc

SEQ ID NO: 2917953 - RNA, 14 nt, Human T-lymphotropic virus 1
aucgugccagccua

SEQ ID NO: 2917954 - RNA, 21 nt, Human T-lymphotropic virus 1
aggagccaucucagcuaccca

SEQ ID NO: 2917955 - RNA, 17 nt, Human T-lymphotropic virus 1
ucacaaauuucaaacca

SEQ ID NO: 2917956 - RNA, 21 nt, Human T-lymphotropic virus 1
cggaggcuauuauucagccuc

SEQ ID NO: 2917957 - RNA, 16 nt, Human T-lymphotropic virus 1
ugcccccucauccucg

SEQ ID NO: 2917958 - RNA, 16 nt, Human T-lymphotropic virus 1
caaaacuccugacucu

SEQ ID NO: 2917959 - RNA, 18 nt, Human T-lymphotropic virus 1
uccuaucuuacuccacca

SEQ ID NO: 2917960 - RNA, 18 nt, Human T-lymphotropic virus 1
agcucggggccuuccuca

SEQ ID NO: 2917961 - RNA, 15 nt, Human T-lymphotropic virus 1
agccccuugucucca

SEQ ID NO: 2917962 - RNA, 17 nt, Human T-lymphotropic virus 1
gugaaaaacauuuccgu

SEQ ID NO: 2917963 - RNA, 21 nt, Human T-lymphotropic virus 1
gccuggcaaaacggccuccuu

SEQ ID NO: 2917964 - RNA, 18 nt, Human T-lymphotropic virus 1
uccaaggacuccaccucg

SEQ ID NO: 2917965 - RNA, 19 nt, Human T-lymphotropic virus 1
aguccaaacccugccccuc

SEQ ID NO: 2917966 - RNA, 18 nt, Human T-lymphotropic virus 1
uaggcaccuuccaaggca

SEQ ID NO: 2917967 - RNA, 21 nt, Human T-lymphotropic virus 1
guaagcgcuaguucugcccag

SEQ ID NO: 2917968 - RNA, 15 nt, Human T-lymphotropic virus 1
ucccaucuccaggcu

SEQ ID NO: 2917969 - RNA, 19 nt, Human T-lymphotropic virus 1
ucguuagcgcuuccagccc

SEQ ID NO: 2917970 - RNA, 16 nt, Human T-lymphotropic virus 1
accacccauuuccucc

SEQ ID NO: 2917971 - RNA, 16 nt, Human T-lymphotropic virus 1
aaacaucgaaacagcc

SEQ ID NO: 2917972 - RNA, 22 nt, Human T-lymphotropic virus 1
cuuaauaccgaacccagccaac

SEQ ID NO: 2917973 - RNA, 23 nt, Human T-lymphotropic virus 1
guaagcgcuaguucugcccagug

SEQ ID NO: 2917974 - RNA, 13 nt, Human T-lymphotropic virus 1
ccgugccuucucc

SEQ ID NO: 2917975 - RNA, 15 nt, Human T-lymphotropic virus 1
aucgccuccagccuc

SEQ ID NO: 2917976 - RNA, 23 nt, Human T-lymphotropic virus 1
ccccaguguuccuaucuuacucc

SEQ ID NO: 2917977 - RNA, 17 nt, Human T-lymphotropic virus 1
uccguuccacucaaccc

SEQ ID NO: 2917978 - RNA, 17 nt, Human T-lymphotropic virus 1
uccgccguggccuacuc

SEQ ID NO: 2917979 - RNA, 17 nt, Human T-lymphotropic virus 1
ccagcagguccuccggg

SEQ ID NO: 2917980 - RNA, 22 nt, Human T-lymphotropic virus 1
cuuuucuuaaaacaacugcccc

SEQ ID NO: 2917981 - RNA, 20 nt, Human T-lymphotropic virus 1
aggcccccuuucaggcccuc

SEQ ID NO: 2917982 - RNA, 21 nt, Human T-lymphotropic virus 1
gucggcccaacgggccgaacu

SEQ ID NO: 2917983 - RNA, 17 nt, Human T-lymphotropic virus 1
cgcaucucuccuucacg

SEQ ID NO: 2917984 - RNA, 11 nt, Human T-lymphotropic virus 1
aaagagccucc

SEQ ID NO: 2917985 - RNA, 16 nt, Human T-lymphotropic virus 1
acccagccaacugccu

SEQ ID NO: 2917986 - RNA, 15 nt, Human T-lymphotropic virus 1
uuccagccccccacc

SEQ ID NO: 2917987 - RNA, 19 nt, Human T-lymphotropic virus 1
caaggcgacuggugcccca

SEQ ID NO: 2917988 - RNA, 13 nt, Human T-lymphotropic virus 1
uagacaccuuuuc

SEQ ID NO: 2917989 - RNA, 15 nt, Human T-lymphotropic virus 1
cccgucggaggcccc

SEQ ID NO: 2917990 - RNA, 15 nt, Human T-lymphotropic virus 1
ucugagaaggucagg

SEQ ID NO: 2917991 - RNA, 23 nt, Human T-lymphotropic virus 1
gacccacugcuuugacccccaga

SEQ ID NO: 2917992 - RNA, 16 nt, Human T-lymphotropic virus 1
cguuaucggcucagcu

SEQ ID NO: 2917993 - RNA, 19 nt, Human T-lymphotropic virus 1
ccugucuuuuccagacccc

SEQ ID NO: 2917994 - RNA, 17 nt, Human T-lymphotropic virus 1
ugcagcaaccuccuccg

SEQ ID NO: 2917995 - RNA, 12 nt, Human T-lymphotropic virus 1
aagcucaccucc

SEQ ID NO: 2917996 - RNA, 19 nt, Human T-lymphotropic virus 1
caaaacccagcaaaccccu

SEQ ID NO: 2917997 - RNA, 15 nt, Human T-lymphotropic virus 1
gcagaucaggcccua

SEQ ID NO: 2917998 - RNA, 21 nt, Human T-lymphotropic virus 1
cagcuggcccauauccugcag

SEQ ID NO: 2917999 - RNA, 20 nt, Human T-lymphotropic virus 1
gacaguucaggagggggcuc

SEQ ID NO: 2918000 - RNA, 21 nt, Human T-lymphotropic virus 1
gcccaccacccuuuuccagcc

SEQ ID NO: 2918001 - RNA, 14 nt, Human T-lymphotropic virus 1
guccuuaccccgcc

SEQ ID NO: 2918002 - RNA, 16 nt, Human T-lymphotropic virus 1
gaccacaggaggcucu

SEQ ID NO: 2918003 - RNA, 16 nt, Human T-lymphotropic virus 1
ccucuacucucccacu

SEQ ID NO: 2918004 - RNA, 21 nt, Human T-lymphotropic virus 1
gccucaggaaagagccuccua

SEQ ID NO: 2918005 - RNA, 17 nt, Human T-lymphotropic virus 1
uuccuuuucaaauacuc

SEQ ID NO: 2918006 - RNA, 18 nt, Human T-lymphotropic virus 1
ccccccuuuuccuuguca

SEQ ID NO: 2918007 - RNA, 13 nt, Human T-lymphotropic virus 1
ccuccugccccgc

SEQ ID NO: 2918008 - RNA, 15 nt, Human T-lymphotropic virus 1
ugucaccuguuccca

SEQ ID NO: 2918009 - RNA, 19 nt, Human T-lymphotropic virus 1
aguccuuccgauagccuug

SEQ ID NO: 2918010 - RNA, 22 nt, Human T-lymphotropic virus 1
uccaccagcagguccuccgggc

SEQ ID NO: 2918011 - RNA, 21 nt, Human T-lymphotropic virus 1
cucacuggcaccaccacugug

SEQ ID NO: 2918012 - RNA, 17 nt, Human T-lymphotropic virus 1
cuacaguccuccuccuu

SEQ ID NO: 2918013 - RNA, 15 nt, Human T-lymphotropic virus 1
acccccaacuccugc

SEQ ID NO: 2918014 - RNA, 18 nt, Human T-lymphotropic virus 1
ugucuccgcccuggccau

SEQ ID NO: 2918015 - RNA, 22 nt, Human T-lymphotropic virus 1
cggcacuagauacgccuggaga

SEQ ID NO: 2918016 - RNA, 14 nt, Human T-lymphotropic virus 1
gcaaauacuccccc

SEQ ID NO: 2918017 - RNA, 15 nt, Human T-lymphotropic virus 1
uaguacuacaguccu

SEQ ID NO: 2918018 - RNA, 14 nt, Human T-lymphotropic virus 1
cuccuuccuccagg

SEQ ID NO: 2918019 - RNA, 23 nt, Human T-lymphotropic virus 1
accggcuccaugucccucgccuc

SEQ ID NO: 2918020 - RNA, 15 nt, Human T-lymphotropic virus 1
uccguucagccucca

SEQ ID NO: 2918021 - RNA, 15 nt, Human T-lymphotropic virus 1
ccccuguccugcagc

SEQ ID NO: 2918022 - RNA, 12 nt, Human T-lymphotropic virus 1
agccccuucaca

SEQ ID NO: 2918023 - RNA, 14 nt, Human T-lymphotropic virus 1
cugccucccaccgc

SEQ ID NO: 2918024 - RNA, 21 nt, Human T-lymphotropic virus 1
agcgcuaguucugcccagugg

SEQ ID NO: 2918025 - RNA, 17 nt, Human T-lymphotropic virus 1
agacgccuuuuuccaaa

SEQ ID NO: 2918026 - RNA, 20 nt, Human T-lymphotropic virus 1
uacaccaacauccccauuuc

SEQ ID NO: 2918027 - RNA, 19 nt, Human T-lymphotropic virus 1
cuuuaacucuuccuccaag

SEQ ID NO: 2918028 - RNA, 16 nt, Human T-lymphotropic virus 1
gauggccagccaucuu

SEQ ID NO: 2918029 - RNA, 19 nt, Human T-lymphotropic virus 1
cccucgacuccccuccuuc

SEQ ID NO: 2918030 - RNA, 13 nt, Human T-lymphotropic virus 1
cugcuagggcacc

SEQ ID NO: 2918031 - RNA, 15 nt, Human T-lymphotropic virus 1
cagccacccaaagac

SEQ ID NO: 2918032 - RNA, 14 nt, Human T-lymphotropic virus 1
cagccccuacugga

SEQ ID NO: 2918033 - RNA, 16 nt, Human T-lymphotropic virus 1
aguuucucgccacuuu

SEQ ID NO: 2918034 - RNA, 16 nt, Human T-lymphotropic virus 1
accugaggccgccauc

SEQ ID NO: 2918035 - RNA, 18 nt, Human T-lymphotropic virus 1
gauccaccucccaggcag

SEQ ID NO: 2918036 - RNA, 15 nt, Human T-lymphotropic virus 1
ucccucgacuccccu

SEQ ID NO: 2918037 - RNA, 16 nt, Human T-lymphotropic virus 1
ccugacuuguccagcc

SEQ ID NO: 2918038 - RNA, 19 nt, Human T-lymphotropic virus 1
ccuccagccuccccugcca

SEQ ID NO: 2918039 - RNA, 21 nt, Human T-lymphotropic virus 1
caccuuuucaggagccaucuc

SEQ ID NO: 2918040 - RNA, 20 nt, Human T-lymphotropic virus 1
ccagaccccggacuccggcc

SEQ ID NO: 2918041 - RNA, 12 nt, Human T-lymphotropic virus 1
auuauucagccu

SEQ ID NO: 2918042 - RNA, 15 nt, Human T-lymphotropic virus 1
cugacccucacuggc

SEQ ID NO: 2918043 - RNA, 18 nt, Human T-lymphotropic virus 1
acccucgaccugcuggcc

SEQ ID NO: 2918044 - RNA, 22 nt, Human T-lymphotropic virus 1
ccuucuagucgacgcuccagga

SEQ ID NO: 2918045 - RNA, 15 nt, Human T-lymphotropic virus 1
cagacaauggcccug

SEQ ID NO: 2918046 - RNA, 23 nt, Human T-lymphotropic virus 1
ucuccgggcgaagucagcggccu

SEQ ID NO: 2918047 - RNA, 15 nt, Human T-lymphotropic virus 1
cuaguucugcccagu

SEQ ID NO: 2918048 - RNA, 15 nt, Human T-lymphotropic virus 1
gaccugccccuauac

SEQ ID NO: 2918049 - RNA, 23 nt, Human T-lymphotropic virus 1
ccuucuccuccgcccgcuuccug

SEQ ID NO: 2918050 - RNA, 19 nt, Human T-lymphotropic virus 1
ccuaaccacaucuggcaag

SEQ ID NO: 2918051 - RNA, 21 nt, Human T-lymphotropic virus 1
cccuacuuugcuuucacuguc

SEQ ID NO: 2918052 - RNA, 15 nt, Human T-lymphotropic virus 1
cuucuccugcagcaa

SEQ ID NO: 2918053 - RNA, 15 nt, Human T-lymphotropic virus 1
ucccuaaucucccau

SEQ ID NO: 2918054 - RNA, 14 nt, Human T-lymphotropic virus 1
cgaucgugccagcc

SEQ ID NO: 2918055 - RNA, 20 nt, Human T-lymphotropic virus 1
gugcagcugcggcaggcccu

SEQ ID NO: 2918056 - RNA, 21 nt, Human T-lymphotropic virus 1
aauauccugcgcucuugccac

SEQ ID NO: 2918057 - RNA, 22 nt, Human T-lymphotropic virus 1
accggcuccaugucccucgccu

SEQ ID NO: 2918058 - RNA, 19 nt, Human T-lymphotropic virus 1
cugcagcccauucggcaag

SEQ ID NO: 2918059 - RNA, 23 nt, Human T-lymphotropic virus 1
gcgagguggcgcuuuccccccug

SEQ ID NO: 2918060 - RNA, 17 nt, Human T-lymphotropic virus 1
uuuccgggcccugcccu

SEQ ID NO: 2918061 - RNA, 14 nt, Human T-lymphotropic virus 1
gacuccccuccuuc

SEQ ID NO: 2918062 - RNA, 18 nt, Human T-lymphotropic virus 1
gcuggggccuuaacuggg

SEQ ID NO: 2918063 - RNA, 15 nt, Human T-lymphotropic virus 1
ucaccacuccaggcc

SEQ ID NO: 2918064 - RNA, 23 nt, Human T-lymphotropic virus 1
cucacggcgcuccugcucuuccu

SEQ ID NO: 2918065 - RNA, 19 nt, Human T-lymphotropic virus 1
ccucggugauuacagcccc

SEQ ID NO: 2918066 - RNA, 17 nt, Human T-lymphotropic virus 1
uccagccuccccugcca

SEQ ID NO: 2918067 - RNA, 22 nt, Human T-lymphotropic virus 1
ccagcucggggccuuccucacc

SEQ ID NO: 2918068 - RNA, 23 nt, Human T-lymphotropic virus 1
ugccccaugugauuuuuugccac

SEQ ID NO: 2918069 - RNA, 13 nt, Human T-lymphotropic virus 1
ccccuacuggaaa

SEQ ID NO: 2918070 - RNA, 19 nt, Human T-lymphotropic virus 1
cuccccccgacuccagccg

SEQ ID NO: 2918071 - RNA, 17 nt, Human T-lymphotropic virus 1
caaggcagguccucuca

SEQ ID NO: 2918072 - RNA, 14 nt, Human T-lymphotropic virus 1
acccugcccuaauc

SEQ ID NO: 2918073 - RNA, 21 nt, Human T-lymphotropic virus 1
aguucccuuuaaaccagaacg

SEQ ID NO: 2918074 - RNA, 18 nt, Human T-lymphotropic virus 1
uccuccuucuccugcagc

SEQ ID NO: 2918075 - RNA, 13 nt, Human T-lymphotropic virus 1
ccuucucagcccc

SEQ ID NO: 2918076 - RNA, 15 nt, Human T-lymphotropic virus 1
gccacccugcccuaa

SEQ ID NO: 2918077 - RNA, 16 nt, Human T-lymphotropic virus 1
cuuuuccuugucaccu

SEQ ID NO: 2918078 - RNA, 14 nt, Human T-lymphotropic virus 1
ggaggacagcucag

SEQ ID NO: 2918079 - RNA, 15 nt, Human T-lymphotropic virus 1
gccgccauccacgcc

SEQ ID NO: 2918080 - RNA, 22 nt, Human T-lymphotropic virus 1
caacuacacuagcccacuuaca

SEQ ID NO: 2918081 - RNA, 22 nt, Human T-lymphotropic virus 1
cauccgccguggccuacucccu

SEQ ID NO: 2918082 - RNA, 16 nt, Human T-lymphotropic virus 1
uaacuggacccacugc

SEQ ID NO: 2918083 - RNA, 19 nt, Human T-lymphotropic virus 1
uccagccgaucccagagac

SEQ ID NO: 2918084 - RNA, 22 nt, Human T-lymphotropic virus 1
uucaggagccaucucagcuacc

SEQ ID NO: 2918085 - RNA, 15 nt, Human T-lymphotropic virus 1
uccagccugccaacu

SEQ ID NO: 2918086 - RNA, 16 nt, Human T-lymphotropic virus 1
ucguggcgcugucuca

SEQ ID NO: 2918087 - RNA, 19 nt, Human T-lymphotropic virus 1
cccagaacagacgaggccu

SEQ ID NO: 2918088 - RNA, 19 nt, Human T-lymphotropic virus 1
cucccuuggagccuaccua

SEQ ID NO: 2918089 - RNA, 20 nt, Human T-lymphotropic virus 1
ugcaaccacaucgccuccag

SEQ ID NO: 2918090 - RNA, 22 nt, Human T-lymphotropic virus 1
aacacuuuucuuaaaacaacug

SEQ ID NO: 2918091 - RNA, 14 nt, Human T-lymphotropic virus 1
ucaucaucuucccc

SEQ ID NO: 2918092 - RNA, 22 nt, Human T-lymphotropic virus 1
aucauaaacaccgccccuugcc

SEQ ID NO: 2918093 - RNA, 16 nt, Human T-lymphotropic virus 1
ggugauuacagcccca

SEQ ID NO: 2918094 - RNA, 14 nt, Human T-lymphotropic virus 1
uccucuucuccuca

SEQ ID NO: 2918095 - RNA, 16 nt, Human T-lymphotropic virus 1
ccacagucaccgauuc

SEQ ID NO: 2918096 - RNA, 18 nt, Human T-lymphotropic virus 1
ggcccauauccugcagcc

SEQ ID NO: 2918097 - RNA, 21 nt, Human T-lymphotropic virus 1
ccauuacucucuuauaaaccc

SEQ ID NO: 2918098 - RNA, 20 nt, Human T-lymphotropic virus 1
aggcgacauuacccauuuca

SEQ ID NO: 2918099 - RNA, 22 nt, Human T-lymphotropic virus 1
aucaccccuguccugcagcucu

SEQ ID NO: 2918100 - RNA, 20 nt, Human T-lymphotropic virus 1
ccuccgcccgcuuccugcgc

SEQ ID NO: 2918101 - RNA, 22 nt, Human T-lymphotropic virus 1
cuggcccauauccugcagccca

SEQ ID NO: 2918102 - RNA, 18 nt, Human T-lymphotropic virus 1
gcucuccacgcuuugccu

SEQ ID NO: 2918103 - RNA, 17 nt, Human T-lymphotropic virus 1
cuggcccauauccugca

SEQ ID NO: 2918104 - RNA, 21 nt, Human T-lymphotropic virus 1
cgucagcuacgacaccucccc

SEQ ID NO: 2918105 - RNA, 14 nt, Human T-lymphotropic virus 1
gagcugcaugccca

SEQ ID NO: 2918106 - RNA, 15 nt, Human T-lymphotropic virus 1
ucauucaaacaucug

SEQ ID NO: 2918107 - RNA, 12 nt, Human T-lymphotropic virus 1
ggacccacugcu

SEQ ID NO: 2918108 - RNA, 21 nt, Human T-lymphotropic virus 1
ccauaccaaucuaccugaucc

SEQ ID NO: 2918109 - RNA, 15 nt, Human T-lymphotropic virus 1
uccucuucuccucag

SEQ ID NO: 2918110 - RNA, 18 nt, Human T-lymphotropic virus 1
auccccgagaccaaauau

SEQ ID NO: 2918111 - RNA, 17 nt, Human T-lymphotropic virus 1
cuccagcuaccaugcca

SEQ ID NO: 2918112 - RNA, 18 nt, Human T-lymphotropic virus 1
uccaguucugcccccuca

SEQ ID NO: 2918113 - RNA, 12 nt, Human T-lymphotropic virus 1
gucuuuuccaga

SEQ ID NO: 2918114 - RNA, 22 nt, Human T-lymphotropic virus 1
uccuaggggcuauuaugcugac

SEQ ID NO: 2918115 - RNA, 12 nt, Human T-lymphotropic virus 1
cuucucagcccc

SEQ ID NO: 2918116 - RNA, 22 nt, Human T-lymphotropic virus 1
ccaauaauuaaccucucccauc

SEQ ID NO: 2918117 - RNA, 21 nt, Human T-lymphotropic virus 1
cuggcuacaugccccccuacc

SEQ ID NO: 2918118 - RNA, 17 nt, Human T-lymphotropic virus 1
ugaucccaucuccaggc

SEQ ID NO: 2918119 - RNA, 22 nt, Human T-lymphotropic virus 1
ccaacauuccacccuccuuccu

SEQ ID NO: 2918120 - RNA, 13 nt, Human T-lymphotropic virus 1
ccuuaccugaggc

SEQ ID NO: 2918121 - RNA, 14 nt, Human T-lymphotropic virus 1
ccugcccagccagu

SEQ ID NO: 2918122 - RNA, 15 nt, Human T-lymphotropic virus 1
caauccugcccagcc

SEQ ID NO: 2918123 - RNA, 14 nt, Human T-lymphotropic virus 1
ccuaaccacaucug

SEQ ID NO: 2918124 - RNA, 14 nt, Human T-lymphotropic virus 1
ccuaaucaccucac

SEQ ID NO: 2918125 - RNA, 20 nt, Human T-lymphotropic virus 1
ccagcugcuguacucucaca

SEQ ID NO: 2918126 - RNA, 17 nt, Human T-lymphotropic virus 1
ucgaccugcuggcccuu

SEQ ID NO: 2918127 - RNA, 12 nt, Human T-lymphotropic virus 1
gcuuccucuucu

SEQ ID NO: 2918128 - RNA, 16 nt, Human T-lymphotropic virus 1
gcuuccucuucuccuc

SEQ ID NO: 2918129 - RNA, 16 nt, Human T-lymphotropic virus 1
cacaucgccuccagcc

SEQ ID NO: 2918130 - RNA, 22 nt, Human T-lymphotropic virus 1
cgauggcagcuucaccacuccc

SEQ ID NO: 2918131 - RNA, 14 nt, Human T-lymphotropic virus 1
accgccccuccucu

SEQ ID NO: 2918132 - RNA, 22 nt, Human T-lymphotropic virus 1
cagcaaucugcuuuuccuccuc

SEQ ID NO: 2918133 - RNA, 13 nt, Human T-lymphotropic virus 1
gcuaccaugccac

SEQ ID NO: 2918134 - RNA, 18 nt, Human T-lymphotropic virus 1
ucaagcacaguuuccucc

SEQ ID NO: 2918135 - RNA, 19 nt, Human T-lymphotropic virus 1
uguccccuacaauccaacc

SEQ ID NO: 2918136 - RNA, 14 nt, Human T-lymphotropic virus 1
ucugccgccucccg

SEQ ID NO: 2918137 - RNA, 19 nt, Human T-lymphotropic virus 1
aagcgcuaguucugcccag

SEQ ID NO: 2918138 - RNA, 22 nt, Human T-lymphotropic virus 1
acauucuccuggcaagccccuc

SEQ ID NO: 2918139 - RNA, 16 nt, Human T-lymphotropic virus 1
ccaaggacuccaccuc

SEQ ID NO: 2918140 - RNA, 18 nt, Human T-lymphotropic virus 1
gccgccuuaccugaggcc

SEQ ID NO: 2918141 - RNA, 20 nt, Human T-lymphotropic virus 1
ucaagaaguuucacaccuca

SEQ ID NO: 2918142 - RNA, 14 nt, Human T-lymphotropic virus 1
cuuauaaacccuga

SEQ ID NO: 2918143 - RNA, 21 nt, Human T-lymphotropic virus 1
uaaaccagaacgccuccaggc

SEQ ID NO: 2918144 - RNA, 13 nt, Human T-lymphotropic virus 1
agcaaccuccucc

SEQ ID NO: 2918145 - RNA, 16 nt, Human T-lymphotropic virus 1
cuauuauucagccucu

SEQ ID NO: 2918146 - RNA, 21 nt, Human T-lymphotropic virus 1
cucccccugucauaacucccu

SEQ ID NO: 2918147 - RNA, 24 nt, Human T-lymphotropic virus 1
uggaucccguggaggcuccucaag

SEQ ID NO: 2918148 - RNA, 17 nt, Human T-lymphotropic virus 1
accugaucccaucucca

SEQ ID NO: 2918149 - RNA, 22 nt, Human T-lymphotropic virus 1
ugcauuuuuucuuuccuagcac

SEQ ID NO: 2918150 - RNA, 20 nt, Human T-lymphotropic virus 1
cuaguccaaacccugccccu

SEQ ID NO: 2918151 - RNA, 20 nt, Human T-lymphotropic virus 1
cuccgucagcuacgacaccu

SEQ ID NO: 2918152 - RNA, 14 nt, Human T-lymphotropic virus 1
cuccgcccuggcca

SEQ ID NO: 2918153 - RNA, 13 nt, Human T-lymphotropic virus 1
uuucacaccucaa

SEQ ID NO: 2918154 - RNA, 18 nt, Human T-lymphotropic virus 1
caucgccuccagccuccc

SEQ ID NO: 2918155 - RNA, 23 nt, Human T-lymphotropic virus 1
caccacuccccccgacuccagcc

SEQ ID NO: 2918156 - RNA, 21 nt, Human T-lymphotropic virus 1
cagcuguguuauuacucgaca

SEQ ID NO: 2918157 - RNA, 12 nt, Human T-lymphotropic virus 1
ccacccugcccu

SEQ ID NO: 2918158 - RNA, 14 nt, Human T-lymphotropic virus 1
uggacccacugcuu

SEQ ID NO: 2918159 - RNA, 15 nt, Human T-lymphotropic virus 1
uaaggcucugacguc

SEQ ID NO: 2918160 - RNA, 22 nt, Human T-lymphotropic virus 1
gcaaguccuuccuaaccaagac

SEQ ID NO: 2918161 - RNA, 14 nt, Human T-lymphotropic virus 1
cucagaccuccggg

SEQ ID NO: 2918162 - RNA, 12 nt, Human T-lymphotropic virus 1
cagccccagcug

SEQ ID NO: 2918163 - RNA, 18 nt, Human T-lymphotropic virus 1
cacaucgccuccagccuc

SEQ ID NO: 2918164 - RNA, 22 nt, Human T-lymphotropic virus 1
ucggugauuacagccccagcug

SEQ ID NO: 2918165 - RNA, 19 nt, Human T-lymphotropic virus 1
caaacaucgaaacagcccu

SEQ ID NO: 2918166 - RNA, 17 nt, Human T-lymphotropic virus 1
cuaguccaaacccugcc

SEQ ID NO: 2918167 - RNA, 13 nt, Human T-lymphotropic virus 1
uuggccucucaca

SEQ ID NO: 2918168 - RNA, 23 nt, Human T-lymphotropic virus 1
ccaagcagcaguggccacuuguc

SEQ ID NO: 2918169 - RNA, 15 nt, Human T-lymphotropic virus 1
cuaccccacacuagc

SEQ ID NO: 2918170 - RNA, 14 nt, Human T-lymphotropic virus 1
uccugccccccuuu

SEQ ID NO: 2918171 - RNA, 20 nt, Human T-lymphotropic virus 1
ucauggaccugccccuauac

SEQ ID NO: 2918172 - RNA, 17 nt, Human T-lymphotropic virus 1
cccaucaccuggccccu

SEQ ID NO: 2918173 - RNA, 16 nt, Human T-lymphotropic virus 1
auacaggcgccagcug

SEQ ID NO: 2918174 - RNA, 20 nt, Human T-lymphotropic virus 1
cauccucggugauuacagcc

SEQ ID NO: 2918175 - RNA, 12 nt, Human T-lymphotropic virus 1
gcagcaccuccc

SEQ ID NO: 2918176 - RNA, 18 nt, Human T-lymphotropic virus 1
ucugccgccucccgccug

SEQ ID NO: 2918177 - RNA, 22 nt, Human T-lymphotropic virus 1
ugcaaccacaucgccuccagcc

SEQ ID NO: 2918178 - RNA, 15 nt, Human T-lymphotropic virus 1
ccacucuaaccuaga

SEQ ID NO: 2918179 - RNA, 13 nt, Human T-lymphotropic virus 1
acuccagcuacca

SEQ ID NO: 2918180 - RNA, 22 nt, Human T-lymphotropic virus 1
aauccuauggacuacucugcca

SEQ ID NO: 2918181 - RNA, 22 nt, Human T-lymphotropic virus 1
acgcguuaucggcucagcucua

SEQ ID NO: 2918182 - RNA, 16 nt, Human T-lymphotropic virus 1
gguccggaaggcccug

SEQ ID NO: 2918183 - RNA, 23 nt, Human T-lymphotropic virus 1
cagccaguuuguucauggacccu

SEQ ID NO: 2918184 - RNA, 22 nt, Human T-lymphotropic virus 1
cucuguuccauccccuucuucu

SEQ ID NO: 2918185 - RNA, 20 nt, Human T-lymphotropic virus 1
aggcccuggaggcaggccau

SEQ ID NO: 2918186 - RNA, 19 nt, Human T-lymphotropic virus 1
cagaacagacgaggccuug

SEQ ID NO: 2918187 - RNA, 16 nt, Human T-lymphotropic virus 1
acuccaaguaucuuua

SEQ ID NO: 2918188 - RNA, 20 nt, Human T-lymphotropic virus 1
ccaaucauggaccugccccu

SEQ ID NO: 2918189 - RNA, 17 nt, Human T-lymphotropic virus 1
gcccccuuucaggcccu

SEQ ID NO: 2918190 - RNA, 19 nt, Human T-lymphotropic virus 1
acuuugcuuucacuguccc

SEQ ID NO: 2918191 - RNA, 13 nt, Human T-lymphotropic virus 1
agaucaggcccua

SEQ ID NO: 2918192 - RNA, 22 nt, Human T-lymphotropic virus 1
ccauggaaaucaaaacuccuga

SEQ ID NO: 2918193 - RNA, 20 nt, Human T-lymphotropic virus 1
accaugccaccuauucccua

SEQ ID NO: 2918194 - RNA, 23 nt, Human T-lymphotropic virus 1
cccuugaaaaucgaguccugacu

SEQ ID NO: 2918195 - RNA, 14 nt, Human T-lymphotropic virus 1
cuucuccugcagca

SEQ ID NO: 2918196 - RNA, 15 nt, Human T-lymphotropic virus 1
agucagcggccuucu

SEQ ID NO: 2918197 - RNA, 19 nt, Human T-lymphotropic virus 1
cuuccagccccccaccuga

SEQ ID NO: 2918198 - RNA, 20 nt, Human T-lymphotropic virus 1
acccuguucgaaaugcagcu

SEQ ID NO: 2918199 - RNA, 15 nt, Human T-lymphotropic virus 1
accuggccccuccug

SEQ ID NO: 2918200 - RNA, 21 nt, Human T-lymphotropic virus 1
acaucgccuccagccuccccu

SEQ ID NO: 2918201 - RNA, 21 nt, Human T-lymphotropic virus 1
ucaacccucaccacuccaggc

SEQ ID NO: 2918202 - RNA, 18 nt, Human T-lymphotropic virus 1
uuugucaagccguccuca

SEQ ID NO: 2918203 - RNA, 22 nt, Human T-lymphotropic virus 1
cacuuacaaacuauagaccuua

SEQ ID NO: 2918204 - RNA, 23 nt, Human T-lymphotropic virus 1
aagcucuacuagauacaggagca

SEQ ID NO: 2918205 - RNA, 13 nt, Human T-lymphotropic virus 1
cuuuuccagccug

SEQ ID NO: 2918206 - RNA, 19 nt, Human T-lymphotropic virus 1
ugccccauuggcuccugug

SEQ ID NO: 2918207 - RNA, 22 nt, Human T-lymphotropic virus 1
auuugcaccacguucgcagcca

SEQ ID NO: 2918208 - RNA, 17 nt, Human T-lymphotropic virus 1
ccugcuuucuccgggcg

SEQ ID NO: 2918209 - RNA, 20 nt, Human T-lymphotropic virus 1
gucaagccguccucaggcgu

SEQ ID NO: 2918210 - RNA, 16 nt, Human T-lymphotropic virus 1
agccgucuccagcccc

SEQ ID NO: 2918211 - RNA, 17 nt, Human T-lymphotropic virus 1
uaaaaauagucccaccc

SEQ ID NO: 2918212 - RNA, 11 nt, Human T-lymphotropic virus 1
uaaucucccau

SEQ ID NO: 2918213 - RNA, 18 nt, Human T-lymphotropic virus 1
ugcaauccugcccagcca

SEQ ID NO: 2918214 - RNA, 14 nt, Human T-lymphotropic virus 1
ucaacccccaacuc

SEQ ID NO: 2918215 - RNA, 13 nt, Human T-lymphotropic virus 1
auuauucagccuc

SEQ ID NO: 2918216 - RNA, 16 nt, Human T-lymphotropic virus 1
gacccuugcccuaggc

SEQ ID NO: 2918217 - RNA, 23 nt, Human T-lymphotropic virus 1
ccgcaguagacuaguccaaaccc

SEQ ID NO: 2918218 - RNA, 13 nt, Human T-lymphotropic virus 1
aucaccuggcccc

SEQ ID NO: 2918219 - RNA, 20 nt, Human T-lymphotropic virus 1
auggaaaucaaaacuccuga

SEQ ID NO: 2918220 - RNA, 12 nt, Human T-lymphotropic virus 1
aagaagcugccg

SEQ ID NO: 2918221 - RNA, 15 nt, Human T-lymphotropic virus 1
ggccccuccugcccc

SEQ ID NO: 2918222 - RNA, 21 nt, Human T-lymphotropic virus 1
uguccugcagcucucuccugc

SEQ ID NO: 2918223 - RNA, 22 nt, Human T-lymphotropic virus 1
ccaugcuuauuaucagcccacu

SEQ ID NO: 2918224 - RNA, 16 nt, Human T-lymphotropic virus 1
cauaccaaucuaccug

SEQ ID NO: 2918225 - RNA, 15 nt, Human T-lymphotropic virus 1
caccacccuuuucca

SEQ ID NO: 2918226 - RNA, 19 nt, Human T-lymphotropic virus 1
cuaccugaacuucaagccc

SEQ ID NO: 2918227 - RNA, 13 nt, Human T-lymphotropic virus 1
agcgcuuccagcc

SEQ ID NO: 2918228 - RNA, 23 nt, Human T-lymphotropic virus 1
gccccuauacaggagccgucucc

SEQ ID NO: 2918229 - RNA, 15 nt, Human T-lymphotropic virus 1
ccagcaaaccccugg

SEQ ID NO: 2918230 - RNA, 19 nt, Human T-lymphotropic virus 1
uucuccuggcaagccccuc

SEQ ID NO: 2918231 - RNA, 14 nt, Human T-lymphotropic virus 1
cccguggaggcucc

SEQ ID NO: 2918232 - RNA, 14 nt, Human T-lymphotropic virus 1
cugcaauccugccc

SEQ ID NO: 2918233 - RNA, 17 nt, Human T-lymphotropic virus 1
cccucaccacuccaggc

SEQ ID NO: 2918234 - RNA, 22 nt, Human T-lymphotropic virus 1
cugccggcgcugcucucauccc

SEQ ID NO: 2918235 - RNA, 22 nt, Human T-lymphotropic virus 1
ugcagcucucuccugcagaccu

SEQ ID NO: 2918236 - RNA, 15 nt, Human T-lymphotropic virus 1
gccuucuccucuucc

SEQ ID NO: 2918237 - RNA, 20 nt, Human T-lymphotropic virus 1
caaccacaucgccuccagcc

SEQ ID NO: 2918238 - RNA, 23 nt, Human T-lymphotropic virus 1
uccacgcuuugccugacccugcu

SEQ ID NO: 2918239 - RNA, 22 nt, Human T-lymphotropic virus 1
uggcggaggcuauuauucagcc

SEQ ID NO: 2918240 - RNA, 23 nt, Human T-lymphotropic virus 1
cacgcccuacuggccaccugucc

SEQ ID NO: 2918241 - RNA, 12 nt, Human T-lymphotropic virus 1
uccuucuccugc

SEQ ID NO: 2918242 - RNA, 16 nt, Human T-lymphotropic virus 1
cuugggcagcaccucc

SEQ ID NO: 2918243 - RNA, 18 nt, Human T-lymphotropic virus 1
caauaaacaaacccauug

SEQ ID NO: 2918244 - RNA, 21 nt, Human T-lymphotropic virus 1
ccccaaaaccuguacacccuc

SEQ ID NO: 2918245 - RNA, 15 nt, Human T-lymphotropic virus 1
ucgccuucucagccc

SEQ ID NO: 2918246 - RNA, 21 nt, Human T-lymphotropic virus 1
ucagcaccagcucaggcuagg

SEQ ID NO: 2918247 - RNA, 14 nt, Human T-lymphotropic virus 1
aauccugcccagcc

SEQ ID NO: 2918248 - RNA, 21 nt, Human T-lymphotropic virus 1
auacaggagccgucuccagcc

SEQ ID NO: 2918249 - RNA, 19 nt, Human T-lymphotropic virus 1
uccugcagcaaccuccucc

SEQ ID NO: 2918250 - RNA, 21 nt, Human T-lymphotropic virus 1
ccugccaauaauuaaccucuc

SEQ ID NO: 2918251 - RNA, 23 nt, Human T-lymphotropic virus 1
accucucccaucaaauccuccuu

SEQ ID NO: 2918252 - RNA, 15 nt, Human T-lymphotropic virus 1
accuagacucagccg

SEQ ID NO: 2918253 - RNA, 18 nt, Human T-lymphotropic virus 1
ccauguccccuacaaucc

SEQ ID NO: 2918254 - RNA, 15 nt, Human T-lymphotropic virus 1
gcaccuuccaaggca

SEQ ID NO: 2918255 - RNA, 16 nt, Human T-lymphotropic virus 1
cgagcaguaccggugg

SEQ ID NO: 2918256 - RNA, 17 nt, Human T-lymphotropic virus 1
gcgcuccugcucuuccu

SEQ ID NO: 2918257 - RNA, 15 nt, Human T-lymphotropic virus 1
ggcagguccucucag

SEQ ID NO: 2918258 - RNA, 19 nt, Human T-lymphotropic virus 1
cuaccaccccucauuucua

SEQ ID NO: 2918259 - RNA, 13 nt, Human T-lymphotropic virus 1
ugcucuuccugcu

SEQ ID NO: 2918260 - RNA, 18 nt, Human T-lymphotropic virus 1
caaaacccgauggcagcu

SEQ ID NO: 2918261 - RNA, 13 nt, Human T-lymphotropic virus 1
caccccggccagc

SEQ ID NO: 2918262 - RNA, 12 nt, Human T-lymphotropic virus 1
ucagcaccagcu

SEQ ID NO: 2918263 - RNA, 23 nt, Human T-lymphotropic virus 1
gcucacggcgcuccugcucuucc

SEQ ID NO: 2918264 - RNA, 16 nt, Human T-lymphotropic virus 1
agcucagcaccagcuc

SEQ ID NO: 2918265 - RNA, 19 nt, Human T-lymphotropic virus 1
cagcuggcccauauccugc

SEQ ID NO: 2918266 - RNA, 16 nt, Human T-lymphotropic virus 1
ccaaucauggaccugc

SEQ ID NO: 2918267 - RNA, 19 nt, Human T-lymphotropic virus 1
cuuggagccuaccuagacu

SEQ ID NO: 2918268 - RNA, 14 nt, Human T-lymphotropic virus 1
caccgccccuugcc

SEQ ID NO: 2918269 - RNA, 16 nt, Human T-lymphotropic virus 1
auagccuuguucucaa

SEQ ID NO: 2918270 - RNA, 12 nt, Human T-lymphotropic virus 1
agccgccagugg

SEQ ID NO: 2918271 - RNA, 13 nt, Human T-lymphotropic virus 1
ccuauacucuccc

SEQ ID NO: 2918272 - RNA, 15 nt, Human T-lymphotropic virus 1
accccggccagcucg

SEQ ID NO: 2918273 - RNA, 21 nt, Human T-lymphotropic virus 1
gcccuuucagcagaucaggcc

SEQ ID NO: 2918274 - RNA, 15 nt, Human T-lymphotropic virus 1
aacccugccccuccu

SEQ ID NO: 2918275 - RNA, 23 nt, Human T-lymphotropic virus 1
ugcccaccacccuuuuccagccu

SEQ ID NO: 2918276 - RNA, 16 nt, Human T-lymphotropic virus 1
gccaccccggccagcu

SEQ ID NO: 2918277 - RNA, 15 nt, Human T-lymphotropic virus 1
ccggcuccauguccc

SEQ ID NO: 2918278 - RNA, 13 nt, Human T-lymphotropic virus 1
caggcccuccugc

SEQ ID NO: 2918279 - RNA, 20 nt, Human T-lymphotropic virus 1
ugcaaggggcaaccacaacu

SEQ ID NO: 2918280 - RNA, 13 nt, Human T-lymphotropic virus 1
ccuguaaucuugc

SEQ ID NO: 2918281 - RNA, 19 nt, Human T-lymphotropic virus 1
accucccaggcagccuaua

SEQ ID NO: 2918282 - RNA, 13 nt, Human T-lymphotropic virus 1
ugcccaccacccu

SEQ ID NO: 2918283 - RNA, 17 nt, Human T-lymphotropic virus 1
ccaauuccuccaccagc

SEQ ID NO: 2918284 - RNA, 21 nt, Human T-lymphotropic virus 1
agacaccuuuucaggagccau

SEQ ID NO: 2918285 - RNA, 20 nt, Human T-lymphotropic virus 1
cgcuuccagccccccaccug

SEQ ID NO: 2918286 - RNA, 19 nt, Human T-lymphotropic virus 1
ggcccuggaggcaggccau

SEQ ID NO: 2918287 - RNA, 12 nt, Human T-lymphotropic virus 1
cccauaccuagg

SEQ ID NO: 2918288 - RNA, 15 nt, Human T-lymphotropic virus 1
augccaaggcguccu

SEQ ID NO: 2918289 - RNA, 15 nt, Human T-lymphotropic virus 1
cagccacccugcccu

SEQ ID NO: 2918290 - RNA, 16 nt, Human T-lymphotropic virus 1
acugccucccaccgcc

SEQ ID NO: 2918291 - RNA, 12 nt, Human T-lymphotropic virus 1
guccugcagcuc

SEQ ID NO: 2918292 - RNA, 20 nt, Human T-lymphotropic virus 1
gcaaacaucgaaacagcccu

SEQ ID NO: 2918293 - RNA, 19 nt, Human T-lymphotropic virus 1
gccagcucggggccuuccu

SEQ ID NO: 2918294 - RNA, 15 nt, Human T-lymphotropic virus 1
ucccaaggccccccg

SEQ ID NO: 2918295 - RNA, 21 nt, Human T-lymphotropic virus 1
uacaguuccuuaucccucgac

SEQ ID NO: 2918296 - RNA, 21 nt, Human T-lymphotropic virus 1
caaggcguccuguaccucccu

SEQ ID NO: 2918297 - RNA, 16 nt, Human T-lymphotropic virus 1
uucagccuccaaggac

SEQ ID NO: 2918298 - RNA, 22 nt, Human T-lymphotropic virus 1
caaggcgacauuacccauuuca

SEQ ID NO: 2918299 - RNA, 20 nt, Human T-lymphotropic virus 1
ucggacuuuugcauggccuc

SEQ ID NO: 2918300 - RNA, 20 nt, Human T-lymphotropic virus 1
ucacuuuaagcucaccuccc

SEQ ID NO: 2918301 - RNA, 14 nt, Human T-lymphotropic virus 1
gcccuacuggccac

SEQ ID NO: 2918302 - RNA, 20 nt, Human T-lymphotropic virus 1
aguccuuccuaaccaagacc

SEQ ID NO: 2918303 - RNA, 20 nt, Human T-lymphotropic virus 1
auugcacaguaugcugccca

SEQ ID NO: 2918304 - RNA, 15 nt, Human T-lymphotropic virus 1
cagaagcuauuuccu

SEQ ID NO: 2918305 - RNA, 19 nt, Human T-lymphotropic virus 1
uaccugaucccaucuccag

SEQ ID NO: 2918306 - RNA, 21 nt, Human T-lymphotropic virus 1
gccuucuccuccgcccgcuuc

SEQ ID NO: 2918307 - RNA, 13 nt, Human T-lymphotropic virus 1
accagcucaggcu

SEQ ID NO: 2918308 - RNA, 19 nt, Human T-lymphotropic virus 1
ccuacaccgggccaggaaa

SEQ ID NO: 2918309 - RNA, 14 nt, Human T-lymphotropic virus 1
cagaccagccaccc

SEQ ID NO: 2918310 - RNA, 18 nt, Human T-lymphotropic virus 1
cuguaccucccugaggca

SEQ ID NO: 2918311 - RNA, 19 nt, Human T-lymphotropic virus 1
cuguccugcagcucucucc

SEQ ID NO: 2918312 - RNA, 16 nt, Human T-lymphotropic virus 1
cuaguccaaacccugc

SEQ ID NO: 2918313 - RNA, 17 nt, Human T-lymphotropic virus 1
ccucaggaaagagccuc

SEQ ID NO: 2918314 - RNA, 21 nt, Human T-lymphotropic virus 1
uccacccuccuuccuccaggc

SEQ ID NO: 2918315 - RNA, 15 nt, Human T-lymphotropic virus 1
cuccaggccuugcaa

SEQ ID NO: 2918316 - RNA, 18 nt, Human T-lymphotropic virus 1
gcaaaacggccuccuucc

SEQ ID NO: 2918317 - RNA, 16 nt, Human T-lymphotropic virus 1
agguggcgcuuucccc

SEQ ID NO: 2918318 - RNA, 23 nt, Human T-lymphotropic virus 1
ucgcuuccucuucuccucagccc

SEQ ID NO: 2918319 - RNA, 15 nt, Human T-lymphotropic virus 1
uccacgcuuugccug

SEQ ID NO: 2918320 - RNA, 12 nt, Human T-lymphotropic virus 1
ggugcccagacu

SEQ ID NO: 2918321 - RNA, 15 nt, Human T-lymphotropic virus 1
uaacaucuccaccca

SEQ ID NO: 2918322 - RNA, 15 nt, Human T-lymphotropic virus 1
acagccccagcugcu

SEQ ID NO: 2918323 - RNA, 19 nt, Human T-lymphotropic virus 1
aagucagcggccuucuccu

SEQ ID NO: 2918324 - RNA, 20 nt, Human T-lymphotropic virus 1
uccugugcuaauacgccucc

SEQ ID NO: 2918325 - RNA, 17 nt, Human T-lymphotropic virus 1
acaucauaacaucucca

SEQ ID NO: 2918326 - RNA, 15 nt, Human T-lymphotropic virus 1
ugccccaucucuggg

SEQ ID NO: 2918327 - RNA, 15 nt, Human T-lymphotropic virus 1
ucacagaacugccgc

SEQ ID NO: 2918328 - RNA, 18 nt, Human T-lymphotropic virus 1
acugccucccaccgcccc

SEQ ID NO: 2918329 - RNA, 13 nt, Human T-lymphotropic virus 1
uguuccuuaaaau

SEQ ID NO: 2918330 - RNA, 15 nt, Human T-lymphotropic virus 1
ccaacugccucccac

SEQ ID NO: 2918331 - RNA, 16 nt, Human T-lymphotropic virus 1
gcagcugcggcaggcc

SEQ ID NO: 2918332 - RNA, 14 nt, Human T-lymphotropic virus 1
uuucauaauuugca

SEQ ID NO: 2918333 - RNA, 18 nt, Human T-lymphotropic virus 1
gcgcaaauacucccccuu

SEQ ID NO: 2918334 - RNA, 22 nt, Human T-lymphotropic virus 1
gcccugucacagaacugccgca

SEQ ID NO: 2918335 - RNA, 19 nt, Human T-lymphotropic virus 1
gccaguucccuuuaaacca

SEQ ID NO: 2918336 - RNA, 13 nt, Human T-lymphotropic virus 1
aggcccugucaca

SEQ ID NO: 2918337 - RNA, 23 nt, Human T-lymphotropic virus 1
aggcagguccucucaggcccccu

SEQ ID NO: 2918338 - RNA, 17 nt, Human T-lymphotropic virus 1
ccuaccuagacucagcc

SEQ ID NO: 2918339 - RNA, 16 nt, Human T-lymphotropic virus 1
ccguuccacucaaccc

SEQ ID NO: 2918340 - RNA, 18 nt, Human T-lymphotropic virus 1
acccuccuuccuccaggc

SEQ ID NO: 2918341 - RNA, 23 nt, Human T-lymphotropic virus 1
cuccugugaaagcccuuaugcca

SEQ ID NO: 2918342 - RNA, 21 nt, Human T-lymphotropic virus 1
cccugcaauccugcccagcca

SEQ ID NO: 2918343 - RNA, 19 nt, Human T-lymphotropic virus 1
ccccuacuggaaauuucag

SEQ ID NO: 2918344 - RNA, 19 nt, Human T-lymphotropic virus 1
auccuccuucuccugcagc

SEQ ID NO: 2918345 - RNA, 15 nt, Human T-lymphotropic virus 1
caggcccuacagcca

SEQ ID NO: 2918346 - RNA, 19 nt, Human T-lymphotropic virus 1
uucuaccccccuccuuuac

SEQ ID NO: 2918347 - RNA, 23 nt, Human T-lymphotropic virus 1
ccaucaacccccaacuccugcau

SEQ ID NO: 2918348 - RNA, 13 nt, Human T-lymphotropic virus 1
agcagcaguggcc

SEQ ID NO: 2918349 - RNA, 18 nt, Human T-lymphotropic virus 1
ccagcuaccaugccaccu

SEQ ID NO: 2918350 - RNA, 14 nt, Human T-lymphotropic virus 1
auucuuccaguucu

SEQ ID NO: 2918351 - RNA, 13 nt, Human T-lymphotropic virus 1
ucauggaccugcc

SEQ ID NO: 2918352 - RNA, 19 nt, Human T-lymphotropic virus 1
caaaaauuuaggugcccag

SEQ ID NO: 2918353 - RNA, 23 nt, Human T-lymphotropic virus 1
ccccaugugauuuuuugccaccc

SEQ ID NO: 2918354 - RNA, 17 nt, Human T-lymphotropic virus 1
gacuccaccucgccuuc

SEQ ID NO: 2918355 - RNA, 14 nt, Human T-lymphotropic virus 1
caccuuccaaggca

SEQ ID NO: 2918356 - RNA, 15 nt, Human T-lymphotropic virus 1
agccgucuccagccc

SEQ ID NO: 2918357 - RNA, 16 nt, Human T-lymphotropic virus 1
gcggcuuuccucuucu

SEQ ID NO: 2918358 - RNA, 18 nt, Human T-lymphotropic virus 1
ucccccuuccgccaccgc

SEQ ID NO: 2918359 - RNA, 18 nt, Human T-lymphotropic virus 1
cucaagcgagcugcaugc

SEQ ID NO: 2918360 - RNA, 21 nt, Human T-lymphotropic virus 1
ucuaguauagccaucaacccc

SEQ ID NO: 2918361 - RNA, 21 nt, Human T-lymphotropic virus 1
acccacccuugggcagcaccu

SEQ ID NO: 2918362 - RNA, 20 nt, Human T-lymphotropic virus 1
guccugcagcucucuccugc

SEQ ID NO: 2918363 - RNA, 15 nt, Human T-lymphotropic virus 1
agccuccccugccaa

SEQ ID NO: 2918364 - RNA, 14 nt, Human T-lymphotropic virus 1
caauuccuccacca

SEQ ID NO: 2918365 - RNA, 19 nt, Human T-lymphotropic virus 1
guacuacaguccuccuccu

SEQ ID NO: 2918366 - RNA, 19 nt, Human T-lymphotropic virus 1
ccugucauaacucccucau

SEQ ID NO: 2918367 - RNA, 18 nt, Human T-lymphotropic virus 1
cguucugccgccucccgc

SEQ ID NO: 2918368 - RNA, 12 nt, Human T-lymphotropic virus 1
gcuuccagcccc

SEQ ID NO: 2918369 - RNA, 18 nt, Human T-lymphotropic virus 1
ccugcaauccugcccagc

SEQ ID NO: 2918370 - RNA, 16 nt, Human T-lymphotropic virus 1
cagcuggcccauaucc

SEQ ID NO: 2918371 - RNA, 19 nt, Human T-lymphotropic virus 1
ccaggcucaacgcucucac

SEQ ID NO: 2918372 - RNA, 15 nt, Human T-lymphotropic virus 1
cugcuggcccuuuca

SEQ ID NO: 2918373 - RNA, 21 nt, Human T-lymphotropic virus 1
cccugucauaacucccucauc

SEQ ID NO: 2918374 - RNA, 21 nt, Human T-lymphotropic virus 1
uccaggauaugaccccaucug

SEQ ID NO: 2918375 - RNA, 16 nt, Human T-lymphotropic virus 1
gucuggcuugucuccg

SEQ ID NO: 2918376 - RNA, 12 nt, Human T-lymphotropic virus 1
gacccuugcccu

SEQ ID NO: 2918377 - RNA, 22 nt, Human T-lymphotropic virus 1
uccuggcaagccccucccaugc

SEQ ID NO: 2918378 - RNA, 16 nt, Human T-lymphotropic virus 1
agcuaccaugccaccu

SEQ ID NO: 2918379 - RNA, 14 nt, Human T-lymphotropic virus 1
uacucccccuuccg

SEQ ID NO: 2918380 - RNA, 14 nt, Human T-lymphotropic virus 1
ccuucucccuucua

SEQ ID NO: 2918381 - RNA, 16 nt, Human T-lymphotropic virus 1
uccagccccccaccug

SEQ ID NO: 2918382 - RNA, 19 nt, Human T-lymphotropic virus 1
gcucagcaccagcucaggc

SEQ ID NO: 2918383 - RNA, 18 nt, Human T-lymphotropic virus 1
aucucucaucaucuuccc

SEQ ID NO: 2918384 - RNA, 23 nt, Human T-lymphotropic virus 1
gccuggcaaaacggccuccuucc

SEQ ID NO: 2918385 - RNA, 19 nt, Human T-lymphotropic virus 1
uccacccuccuuccuccag

SEQ ID NO: 2918386 - RNA, 14 nt, Human T-lymphotropic virus 1
cugcgcucuugcca

SEQ ID NO: 2918387 - RNA, 16 nt, Human T-lymphotropic virus 1
caucaaauccuccuuc

SEQ ID NO: 2918388 - RNA, 18 nt, Human T-lymphotropic virus 1
gagccaucucagcuaccc

SEQ ID NO: 2918389 - RNA, 19 nt, Human T-lymphotropic virus 1
ucuagucgacgcuccagga

SEQ ID NO: 2918390 - RNA, 16 nt, Human T-lymphotropic virus 1
gaguacuaccccaagg

SEQ ID NO: 2918391 - RNA, 16 nt, Human T-lymphotropic virus 1
uacaauccaaccagcu

SEQ ID NO: 2918392 - RNA, 12 nt, Human T-lymphotropic virus 1
ccugcucuuccu

SEQ ID NO: 2918393 - RNA, 20 nt, Human T-lymphotropic virus 1
ccacguucgcagccauacca

SEQ ID NO: 2918394 - RNA, 24 nt, Human T-lymphotropic virus 1
ucuaaacccugcaauccugcccag

SEQ ID NO: 2918395 - RNA, 14 nt, Human T-lymphotropic virus 1
uccugcccagccag

SEQ ID NO: 2918396 - RNA, 19 nt, Human T-lymphotropic virus 1
gcuuccucuucuccucagc

SEQ ID NO: 2918397 - RNA, 16 nt, Human T-lymphotropic virus 1
cggauccaccucccag

SEQ ID NO: 2918398 - RNA, 14 nt, Human T-lymphotropic virus 1
uaacucuuccucca

SEQ ID NO: 2918399 - RNA, 23 nt, Human T-lymphotropic virus 1
cccagauugacacccagaccagc

SEQ ID NO: 2918400 - RNA, 21 nt, Human T-lymphotropic virus 1
accuccuccguucagccucca

SEQ ID NO: 2918401 - RNA, 13 nt, Human T-lymphotropic virus 1
acuccccuccuuc

SEQ ID NO: 2918402 - RNA, 19 nt, Human T-lymphotropic virus 1
ugccagccuauccacuugg

SEQ ID NO: 2918403 - RNA, 12 nt, Human T-lymphotropic virus 1
acuccaggccuu

SEQ ID NO: 2918404 - RNA, 15 nt, Human T-lymphotropic virus 1
gccccgccgauccca

SEQ ID NO: 2918405 - RNA, 21 nt, Human T-lymphotropic virus 1
agccgucuccagccccuacug

SEQ ID NO: 2918406 - RNA, 15 nt, Human T-lymphotropic virus 1
uugcccuaggcaccu

SEQ ID NO: 2918407 - RNA, 14 nt, Human T-lymphotropic virus 1
ccuucuccuccgcc

SEQ ID NO: 2918408 - RNA, 15 nt, Human T-lymphotropic virus 1
ugggaccuuggccuc

SEQ ID NO: 2918409 - RNA, 18 nt, Human T-lymphotropic virus 1
cagccccuugucuccacu

SEQ ID NO: 2918410 - RNA, 15 nt, Human T-lymphotropic virus 1
agcuucaccacuccc

SEQ ID NO: 2918411 - RNA, 16 nt, Human T-lymphotropic virus 1
uccaccucgccuucca

SEQ ID NO: 2918412 - RNA, 21 nt, Human T-lymphotropic virus 1
gccaauacaggcgccagcugu

SEQ ID NO: 2918413 - RNA, 15 nt, Human T-lymphotropic virus 1
uucaccuaaucaccu

SEQ ID NO: 2918414 - RNA, 19 nt, Human T-lymphotropic virus 1
aggcuauuauucagccucu

SEQ ID NO: 2918415 - RNA, 20 nt, Human T-lymphotropic virus 1
cagacggauccaccucccag

SEQ ID NO: 2918416 - RNA, 16 nt, Human T-lymphotropic virus 1
guaaguuacuccagcu

SEQ ID NO: 2918417 - RNA, 16 nt, Human T-lymphotropic virus 1
acaguuggagucuccu

SEQ ID NO: 2918418 - RNA, 17 nt, Human T-lymphotropic virus 1
cggaggacagcucagca

SEQ ID NO: 2918419 - RNA, 18 nt, Human T-lymphotropic virus 1
cgacuggugccccaucuc

SEQ ID NO: 2918420 - RNA, 18 nt, Human T-lymphotropic virus 1
aguacucuuccuuucaua

SEQ ID NO: 2918421 - RNA, 13 nt, Human T-lymphotropic virus 1
ucaccuggccccu

SEQ ID NO: 2918422 - RNA, 16 nt, Human T-lymphotropic virus 1
cccguaauuaaagccc

SEQ ID NO: 2918423 - RNA, 13 nt, Human T-lymphotropic virus 1
cugcagaccuaca

SEQ ID NO: 2918424 - RNA, 23 nt, Human T-lymphotropic virus 1
guaccuauacggucccgcugggc

SEQ ID NO: 2918425 - RNA, 19 nt, Human T-lymphotropic virus 1
aagcuauagucuccucccc

SEQ ID NO: 2918426 - RNA, 21 nt, Human T-lymphotropic virus 1
ugcaggaccaugcauccuccg

SEQ ID NO: 2918427 - RNA, 16 nt, Human T-lymphotropic virus 1
cucccaccgccccucc

SEQ ID NO: 2918428 - RNA, 23 nt, Human T-lymphotropic virus 1
ccuuuaacucuuccuccaaggau

SEQ ID NO: 2918429 - RNA, 19 nt, Human T-lymphotropic virus 1
uggacaaagauauuuccca

SEQ ID NO: 2918430 - RNA, 15 nt, Human T-lymphotropic virus 1
cuccagcuaccaugc

SEQ ID NO: 2918431 - RNA, 15 nt, Human T-lymphotropic virus 1
cuuuggaacacuuuu

SEQ ID NO: 2918432 - RNA, 17 nt, Human T-lymphotropic virus 1
gccccuucacagucucu

SEQ ID NO: 2918433 - RNA, 17 nt, Human T-lymphotropic virus 1
ccccuggagggccccgu

SEQ ID NO: 2918434 - RNA, 14 nt, Human T-lymphotropic virus 1
caccugggacccca

SEQ ID NO: 2918435 - RNA, 16 nt, Human T-lymphotropic virus 1
cuccgggaagccaccg

SEQ ID NO: 2918436 - RNA, 20 nt, Human T-lymphotropic virus 1
uauggacaaucaaccaccua

SEQ ID NO: 2918437 - RNA, 17 nt, Human T-lymphotropic virus 1
cagcuacgacaccuccc

SEQ ID NO: 2918438 - RNA, 23 nt, Human T-lymphotropic virus 1
ccuauacaggagccgucuccagc

SEQ ID NO: 2918439 - RNA, 20 nt, Human T-lymphotropic virus 1
aagcccagauugacacccag

SEQ ID NO: 2918440 - RNA, 17 nt, Human T-lymphotropic virus 1
cugcaacuacucucaga

SEQ ID NO: 2918441 - RNA, 18 nt, Human T-lymphotropic virus 1
uauuuaaauccuucucaa

SEQ ID NO: 2918442 - RNA, 15 nt, Human T-lymphotropic virus 1
cucuugccacgccug

SEQ ID NO: 2918443 - RNA, 17 nt, Human T-lymphotropic virus 1
cucuacucucccacucu

SEQ ID NO: 2918444 - RNA, 14 nt, Human T-lymphotropic virus 1
auacaucauaacau

SEQ ID NO: 2918445 - RNA, 16 nt, Human T-lymphotropic virus 1
agagccuccuacauga

SEQ ID NO: 2918446 - RNA, 17 nt, Human T-lymphotropic virus 1
cuuuggaacacuuuucu

SEQ ID NO: 2918447 - RNA, 21 nt, Human T-lymphotropic virus 1
guucucaaguaauacuccccu

SEQ ID NO: 2918448 - RNA, 23 nt, Human T-lymphotropic virus 1
agaucauucccccuuccgccacc

SEQ ID NO: 2918449 - RNA, 22 nt, Human T-lymphotropic virus 1
cagacgaggccuugaucuccug

SEQ ID NO: 2918450 - RNA, 20 nt, Human T-lymphotropic virus 1
cucgacuccccuccuucccc

SEQ ID NO: 2918451 - RNA, 22 nt, Human T-lymphotropic virus 1
aguguuccuaucuuacuccacc

SEQ ID NO: 2918452 - RNA, 12 nt, Human T-lymphotropic virus 1
uccaccucccag

SEQ ID NO: 2918453 - RNA, 18 nt, Human T-lymphotropic virus 1
uccucucaggcccccuuu

SEQ ID NO: 2918454 - RNA, 18 nt, Human T-lymphotropic virus 1
uacaggcgccagcugucc

SEQ ID NO: 2918455 - RNA, 21 nt, Human T-lymphotropic virus 1
auugcacaguaugcugcccag

SEQ ID NO: 2918456 - RNA, 15 nt, Human T-lymphotropic virus 1
uccaccucccaggca

SEQ ID NO: 2918457 - RNA, 16 nt, Human T-lymphotropic virus 1
cuguuucgccuucuca

SEQ ID NO: 2918458 - RNA, 16 nt, Human T-lymphotropic virus 1
ugucuccgcccuggcc

SEQ ID NO: 2918459 - RNA, 18 nt, Human T-lymphotropic virus 1
ggccuaccaccccucauu

SEQ ID NO: 2918460 - RNA, 20 nt, Human T-lymphotropic virus 1
ccgccuguggugccuccuga

SEQ ID NO: 2918461 - RNA, 12 nt, Human T-lymphotropic virus 1
cucuuccuccaa

SEQ ID NO: 2918462 - RNA, 21 nt, Human T-lymphotropic virus 1
uccaauauccugcgcucuugc

SEQ ID NO: 2918463 - RNA, 22 nt, Human T-lymphotropic virus 1
cagcaaccuccuccguucagcc

SEQ ID NO: 2918464 - RNA, 17 nt, Human T-lymphotropic virus 1
ccauauccucgagcccu

SEQ ID NO: 2918465 - RNA, 19 nt, Human T-lymphotropic virus 1
guccuuuaacucuuccucc

SEQ ID NO: 2918466 - RNA, 17 nt, Human T-lymphotropic virus 1
gaaccacccauuuccuc

SEQ ID NO: 2918467 - RNA, 17 nt, Human T-lymphotropic virus 1
aggagccaucucagcua

SEQ ID NO: 2918468 - RNA, 20 nt, Human T-lymphotropic virus 1
ccugucacagaacugccgca

SEQ ID NO: 2918469 - RNA, 22 nt, Human T-lymphotropic virus 1
cagccuggcaaaacggccuccu

SEQ ID NO: 2918470 - RNA, 16 nt, Human T-lymphotropic virus 1
gcagcuacuugccuca

SEQ ID NO: 2918471 - RNA, 16 nt, Human T-lymphotropic virus 1
cccucgaccugcuggc

SEQ ID NO: 2918472 - RNA, 21 nt, Human T-lymphotropic virus 1
cccacccuugggcagcaccuc

SEQ ID NO: 2918473 - RNA, 13 nt, Human T-lymphotropic virus 1
caggagccaucuc

SEQ ID NO: 2918474 - RNA, 19 nt, Human T-lymphotropic virus 1
acaucgccuccagccuccc

SEQ ID NO: 2918475 - RNA, 19 nt, Human T-lymphotropic virus 1
cagcuucaccacucccccc

SEQ ID NO: 2918476 - RNA, 17 nt, Human T-lymphotropic virus 1
cacggcgcuccugcucu

SEQ ID NO: 2918477 - RNA, 12 nt, Human T-lymphotropic virus 1
aaaagaggcaga

SEQ ID NO: 2918478 - RNA, 14 nt, Human T-lymphotropic virus 1
ccuucuccugcagc

SEQ ID NO: 2918479 - RNA, 23 nt, Human T-lymphotropic virus 1
ggcacccgucacgcugacagccu

SEQ ID NO: 2918480 - RNA, 19 nt, Human T-lymphotropic virus 1
cgcucacggcgcuccugcu

SEQ ID NO: 2918481 - RNA, 19 nt, Human T-lymphotropic virus 1
acaccauggguaaguuucu

SEQ ID NO: 2918482 - RNA, 19 nt, Human T-lymphotropic virus 1
cuguuugcccaccacccuu

SEQ ID NO: 2918483 - RNA, 16 nt, Human T-lymphotropic virus 1
cucaacccucaccacu

SEQ ID NO: 2918484 - RNA, 17 nt, Human T-lymphotropic virus 1
accugcaacuacucuca

SEQ ID NO: 2918485 - RNA, 12 nt, Human T-lymphotropic virus 1
cccaccacccuu

SEQ ID NO: 2918486 - RNA, 16 nt, Human T-lymphotropic virus 1
ggcgcuuuccccccug

SEQ ID NO: 2918487 - RNA, 15 nt, Human T-lymphotropic virus 1
ccacccauuuccucc

SEQ ID NO: 2918488 - RNA, 17 nt, Human T-lymphotropic virus 1
gcuuccagccccccacc

SEQ ID NO: 2918489 - RNA, 13 nt, Human T-lymphotropic virus 1
uacaggcgccagc

SEQ ID NO: 2918490 - RNA, 19 nt, Human T-lymphotropic virus 1
uccuccgcccgcuuccugc

SEQ ID NO: 2918491 - RNA, 16 nt, Human T-lymphotropic virus 1
ucagcuacgacaccuc

SEQ ID NO: 2918492 - RNA, 22 nt, Human T-lymphotropic virus 1
ugucugcauguaccucuaccag

SEQ ID NO: 2918493 - RNA, 18 nt, Human T-lymphotropic virus 1
ccagaacgccuccaggcc

SEQ ID NO: 2918494 - RNA, 21 nt, Human T-lymphotropic virus 1
cugacaaacccgaccuaccua

SEQ ID NO: 2918495 - RNA, 24 nt, Human T-lymphotropic virus 1
cucggugauuacagccccagcugc

SEQ ID NO: 2918496 - RNA, 15 nt, Human T-lymphotropic virus 1
gccgucuccagcccc

SEQ ID NO: 2918497 - RNA, 15 nt, Human T-lymphotropic virus 1
ccuguggugccuccu

SEQ ID NO: 2918498 - RNA, 18 nt, Human T-lymphotropic virus 1
caaauaauuucaccuaau

SEQ ID NO: 2918499 - RNA, 17 nt, Human T-lymphotropic virus 1
gccccuauacaggagcc

SEQ ID NO: 2918500 - RNA, 23 nt, Human T-lymphotropic virus 1
cucucaggcccccuuucaggccc

SEQ ID NO: 2918501 - RNA, 16 nt, Human T-lymphotropic virus 1
ucaccucccuuccugu

SEQ ID NO: 2918502 - RNA, 14 nt, Human T-lymphotropic virus 1
cuucaagaagcugc

SEQ ID NO: 2918503 - RNA, 14 nt, Human T-lymphotropic virus 1
ccggcuccaugucc

SEQ ID NO: 2918504 - RNA, 20 nt, Human T-lymphotropic virus 1
agcuacgacaccuccccucg

SEQ ID NO: 2918505 - RNA, 12 nt, Human T-lymphotropic virus 1
gcgcuuccagcc

SEQ ID NO: 2918506 - RNA, 12 nt, Human T-lymphotropic virus 1
gccuccccugcc

SEQ ID NO: 2918507 - RNA, 16 nt, Human T-lymphotropic virus 1
cuggcaagccccuccc

SEQ ID NO: 2918508 - RNA, 17 nt, Human T-lymphotropic virus 1
cugcuuuuccuccucuu

SEQ ID NO: 2918509 - RNA, 23 nt, Human T-lymphotropic virus 1
uggcggaggcuauuauucagccu

SEQ ID NO: 2918510 - RNA, 23 nt, Human T-lymphotropic virus 1
ugcaaccacaucgccuccagccu

SEQ ID NO: 2918511 - RNA, 15 nt, Human T-lymphotropic virus 1
ucuuugcuccaggcc

SEQ ID NO: 2918512 - RNA, 22 nt, Human T-lymphotropic virus 1
ccugcccuaaagauggccagcc

SEQ ID NO: 2918513 - RNA, 14 nt, Human T-lymphotropic virus 1
uggaggcaggccau

SEQ ID NO: 2918514 - RNA, 21 nt, Human T-lymphotropic virus 1
gcagccggccgcggcuuuccu

SEQ ID NO: 2918515 - RNA, 14 nt, Human T-lymphotropic virus 1
guaugcugcccaga

SEQ ID NO: 2918516 - RNA, 19 nt, Human T-lymphotropic virus 1
ccugcaauccugcccagcc

SEQ ID NO: 2918517 - RNA, 20 nt, Human T-lymphotropic virus 1
acccuugggcagcaccuccc

SEQ ID NO: 2918518 - RNA, 18 nt, Human T-lymphotropic virus 1
acuuuaagcucaccuccc

SEQ ID NO: 2918519 - RNA, 15 nt, Human T-lymphotropic virus 1
cugccuauauuuccc

SEQ ID NO: 2918520 - RNA, 17 nt, Human T-lymphotropic virus 1
ccuccaauauccugcgc

SEQ ID NO: 2918521 - RNA, 19 nt, Human T-lymphotropic virus 1
cccaucaccuggccccucc

SEQ ID NO: 2918522 - RNA, 19 nt, Human T-lymphotropic virus 1
cuccugcagcaaccuccuc

SEQ ID NO: 2918523 - RNA, 17 nt, Human T-lymphotropic virus 1
uacagccccagcugcug

SEQ ID NO: 2918524 - RNA, 23 nt, Human T-lymphotropic virus 1
cccugcccuaaagauggccagcc

SEQ ID NO: 2918525 - RNA, 16 nt, Human T-lymphotropic virus 1
cucaccaauguucccu

SEQ ID NO: 2918526 - RNA, 14 nt, Human T-lymphotropic virus 1
ccaucaccuggccc

SEQ ID NO: 2918527 - RNA, 16 nt, Human T-lymphotropic virus 1
uucgccuucucagccc

SEQ ID NO: 2918528 - RNA, 17 nt, Human T-lymphotropic virus 1
augcgguuuuuccuucu

SEQ ID NO: 2918529 - RNA, 12 nt, Human T-lymphotropic virus 1
gccucucaguga

SEQ ID NO: 2918530 - RNA, 17 nt, Human T-lymphotropic virus 1
agcgcuaguucugccca

SEQ ID NO: 2918531 - RNA, 12 nt, Human T-lymphotropic virus 1
caggccauaucg

SEQ ID NO: 2918532 - RNA, 13 nt, Human T-lymphotropic virus 1
cagcucagcacca

SEQ ID NO: 2918533 - RNA, 16 nt, Human T-lymphotropic virus 1
cucagcaccagcucag

SEQ ID NO: 2918534 - RNA, 15 nt, Human T-lymphotropic virus 1
cgaucgugccagccu

SEQ ID NO: 2918535 - RNA, 13 nt, Human T-lymphotropic virus 1
cuccucuuccuuc

SEQ ID NO: 2918536 - RNA, 16 nt, Human T-lymphotropic virus 1
accugggaccccaucg

SEQ ID NO: 2918537 - RNA, 14 nt, Human T-lymphotropic virus 1
accugcgggccacu

SEQ ID NO: 2918538 - RNA, 14 nt, Human T-lymphotropic virus 1
cuuguccagccugc

SEQ ID NO: 2918539 - RNA, 23 nt, Human T-lymphotropic virus 1
agagacacauucccucagcaaua

SEQ ID NO: 2918540 - RNA, 18 nt, Human T-lymphotropic virus 1
gaggcuauuauucagccu

SEQ ID NO: 2918541 - RNA, 13 nt, Human T-lymphotropic virus 1
agaagucugagaa

SEQ ID NO: 2918542 - RNA, 13 nt, Human T-lymphotropic virus 1
gccuucucagccc

SEQ ID NO: 2918543 - RNA, 21 nt, Human T-lymphotropic virus 1
gggccaggaaauaacccagua

SEQ ID NO: 2918544 - RNA, 11 nt, Human T-lymphotropic virus 1
cucccccuucc

SEQ ID NO: 2918545 - RNA, 17 nt, Human T-lymphotropic virus 1
acuuaugaugcaguccc

SEQ ID NO: 2918546 - RNA, 18 nt, Human T-lymphotropic virus 1
cugacgucuccccccgga

SEQ ID NO: 2918547 - RNA, 18 nt, Human T-lymphotropic virus 1
ugcaggaccaugcauccu

SEQ ID NO: 2918548 - RNA, 12 nt, Human T-lymphotropic virus 1
gcccugcccuaa

SEQ ID NO: 2918549 - RNA, 14 nt, Human T-lymphotropic virus 1
agcgcuuccagccc

SEQ ID NO: 2918550 - RNA, 16 nt, Human T-lymphotropic virus 1
cccgaaaucagccagu

SEQ ID NO: 2918551 - RNA, 18 nt, Human T-lymphotropic virus 1
cguccuauacucucccaa

SEQ ID NO: 2918552 - RNA, 20 nt, Human T-lymphotropic virus 1
uccacccuccuuccuccagg

SEQ ID NO: 2918553 - RNA, 15 nt, Human T-lymphotropic virus 1
gccuugaucuccugu

SEQ ID NO: 2918554 - RNA, 11 nt, Human T-lymphotropic virus 1
gacccccccuu

SEQ ID NO: 2918555 - RNA, 20 nt, Human T-lymphotropic virus 1
gucuccccccggaggacagc

SEQ ID NO: 2918556 - RNA, 22 nt, Human T-lymphotropic virus 1
gcacguccuauacucucccaac

SEQ ID NO: 2918557 - RNA, 17 nt, Human T-lymphotropic virus 1
agcucuacaguuccuua

SEQ ID NO: 2918558 - RNA, 22 nt, Human T-lymphotropic virus 1
ucagaccuccgggaagccaccg

SEQ ID NO: 2918559 - RNA, 22 nt, Human T-lymphotropic virus 1
gggccuuaacugggaccuuggc

SEQ ID NO: 2918560 - RNA, 23 nt, Human T-lymphotropic virus 1
cucaauaaaauaacaggagucua

SEQ ID NO: 2918561 - RNA, 12 nt, Human T-lymphotropic virus 1
gcgcucuugcca

SEQ ID NO: 2918562 - RNA, 22 nt, Human T-lymphotropic virus 1
cggaaggcccuggaggcaggcc

SEQ ID NO: 2918563 - RNA, 21 nt, Human T-lymphotropic virus 1
ccucucccaucaaauccuccu

SEQ ID NO: 2918564 - RNA, 15 nt, Human T-lymphotropic virus 1
cccaagguaccuaua

SEQ ID NO: 2918565 - RNA, 18 nt, Human T-lymphotropic virus 1
ccuccagccuccccugcc

SEQ ID NO: 2918566 - RNA, 22 nt, Human T-lymphotropic virus 1
uuccaacugucuaguauagcca

SEQ ID NO: 2918567 - RNA, 22 nt, Human T-lymphotropic virus 1
cauucuccuggcaagccccucc

SEQ ID NO: 2918568 - RNA, 21 nt, Human T-lymphotropic virus 1
gucugagaaggucagggccca

SEQ ID NO: 2918569 - RNA, 17 nt, Human T-lymphotropic virus 1
cagccgaucccagagac

SEQ ID NO: 2918570 - RNA, 14 nt, Human T-lymphotropic virus 1
aguucugcccccuc

SEQ ID NO: 2918571 - RNA, 13 nt, Human T-lymphotropic virus 1
aacucccucaucc

SEQ ID NO: 2918572 - RNA, 15 nt, Human T-lymphotropic virus 1
ugcagcuggcccaua

SEQ ID NO: 2918573 - RNA, 14 nt, Human T-lymphotropic virus 1
aaacaguuccagcc

SEQ ID NO: 2918574 - RNA, 16 nt, Human T-lymphotropic virus 1
ccuuacgccagccccu

SEQ ID NO: 2918575 - RNA, 18 nt, Human T-lymphotropic virus 1
uucgccuucucagccccu

SEQ ID NO: 2918576 - RNA, 13 nt, Human T-lymphotropic virus 1
ucagcaccagcuc

SEQ ID NO: 2918577 - RNA, 23 nt, Human T-lymphotropic virus 1
ggacuccaccucgccuuccaacu

SEQ ID NO: 2918578 - RNA, 19 nt, Human T-lymphotropic virus 1
agccaucaacccccaacuc

SEQ ID NO: 2918579 - RNA, 16 nt, Human T-lymphotropic virus 1
ccagccaacugccucc

SEQ ID NO: 2918580 - RNA, 14 nt, Human T-lymphotropic virus 1
cacccuccuuccuc

SEQ ID NO: 2918581 - RNA, 15 nt, Human T-lymphotropic virus 1
acucaacccucacca

SEQ ID NO: 2918582 - RNA, 16 nt, Human T-lymphotropic virus 1
uaccgaacccagccaa

SEQ ID NO: 2918583 - RNA, 22 nt, Human T-lymphotropic virus 1
cucaggaaagagccuccuacau

SEQ ID NO: 2918584 - RNA, 13 nt, Human T-lymphotropic virus 1
ugcuccaggccau

SEQ ID NO: 2918585 - RNA, 21 nt, Human T-lymphotropic virus 1
cucaccucccuuccugugcua

SEQ ID NO: 2918586 - RNA, 21 nt, Human T-lymphotropic virus 1
caguucugcccccucauccuc

SEQ ID NO: 2918587 - RNA, 12 nt, Human T-lymphotropic virus 1
ugcucuuccugc

SEQ ID NO: 2918588 - RNA, 20 nt, Human T-lymphotropic virus 1
cuuccuuuucaaauacucag

SEQ ID NO: 2918589 - RNA, 20 nt, Human T-lymphotropic virus 1
ucaccccuguccugcagcuc

SEQ ID NO: 2918590 - RNA, 18 nt, Human T-lymphotropic virus 1
accuccuccguucagccu

SEQ ID NO: 2918591 - RNA, 13 nt, Human T-lymphotropic virus 1
ucugcuuuuccuc

SEQ ID NO: 2918592 - RNA, 15 nt, Human T-lymphotropic virus 1
cuccucccccuguca

SEQ ID NO: 2918593 - RNA, 22 nt, Human T-lymphotropic virus 1
cucacaguuggagucuccucau

SEQ ID NO: 2918594 - RNA, 23 nt, Human T-lymphotropic virus 1
acaccuuuucaggagccaucuca

SEQ ID NO: 2918595 - RNA, 18 nt, Human T-lymphotropic virus 1
cacagaugcccuacuaau

SEQ ID NO: 2918596 - RNA, 18 nt, Human T-lymphotropic virus 1
acgcccuacuggccaccu

SEQ ID NO: 2918597 - RNA, 13 nt, Human T-lymphotropic virus 1
gcaugcccaagac

SEQ ID NO: 2918598 - RNA, 17 nt, Human T-lymphotropic virus 1
cuacgacaccuccccuc

SEQ ID NO: 2918599 - RNA, 15 nt, Human T-lymphotropic virus 1
acagacgaggccuug

SEQ ID NO: 2918600 - RNA, 20 nt, Human T-lymphotropic virus 1
caaaucauaagcucagaccu

SEQ ID NO: 2918601 - RNA, 14 nt, Human T-lymphotropic virus 1
gcucugacgucucc

SEQ ID NO: 2918602 - RNA, 12 nt, Human T-lymphotropic virus 1
cggcaggcccug

SEQ ID NO: 2918603 - RNA, 14 nt, Human T-lymphotropic virus 1
acaaccccucaccu

SEQ ID NO: 2918604 - RNA, 13 nt, Human T-lymphotropic virus 1
ccaauuccuccac

SEQ ID NO: 2918605 - RNA, 23 nt, Human T-lymphotropic virus 1
cccgccaaucacucauacaaccc

SEQ ID NO: 2918606 - RNA, 21 nt, Human T-lymphotropic virus 1
uccgucagcuacgacaccucc

SEQ ID NO: 2918607 - RNA, 18 nt, Human T-lymphotropic virus 1
cuggcaagccccucccau

SEQ ID NO: 2918608 - RNA, 13 nt, Human T-lymphotropic virus 1
ccuccugaacuac

SEQ ID NO: 2918609 - RNA, 14 nt, Human T-lymphotropic virus 1
ccggaggacagcuc

SEQ ID NO: 2918610 - RNA, 15 nt, Human T-lymphotropic virus 1
aucugcuuuuccucc

SEQ ID NO: 2918611 - RNA, 15 nt, Human T-lymphotropic virus 1
uucugccgccucccg

SEQ ID NO: 2918612 - RNA, 14 nt, Human T-lymphotropic virus 1
gcccgcuuccugcg

SEQ ID NO: 2918613 - RNA, 20 nt, Human T-lymphotropic virus 1
cuccugcagcaaccuccucc

SEQ ID NO: 2918614 - RNA, 14 nt, Human T-lymphotropic virus 1
agccuccccugcca

SEQ ID NO: 2918615 - RNA, 22 nt, Human T-lymphotropic virus 1
ucagcucuacaguuccuuaucc

SEQ ID NO: 2918616 - RNA, 13 nt, Human T-lymphotropic virus 1
ccaccccggccag

SEQ ID NO: 2918617 - RNA, 15 nt, Human T-lymphotropic virus 1
cugcgcucuugccac

SEQ ID NO: 2918618 - RNA, 18 nt, Human T-lymphotropic virus 1
ggcuagaacaccucccaa

SEQ ID NO: 2918619 - RNA, 21 nt, Human T-lymphotropic virus 1
ccugccgcaaaaauaacccac

SEQ ID NO: 2918620 - RNA, 22 nt, Human T-lymphotropic virus 1
cgcuccaggauaugaccccauc

SEQ ID NO: 2918621 - RNA, 17 nt, Human T-lymphotropic virus 1
cguuaucggcucagcuc

SEQ ID NO: 2918622 - RNA, 18 nt, Human T-lymphotropic virus 1
auucuuaaaacccuauua

SEQ ID NO: 2918623 - RNA, 22 nt, Human T-lymphotropic virus 1
gcacuaugcuguuucgccuucu

SEQ ID NO: 2918624 - RNA, 22 nt, Human T-lymphotropic virus 1
uacauggaugacauucuccugg

SEQ ID NO: 2918625 - RNA, 24 nt, Human T-lymphotropic virus 1
gcuccucaagcgagcugcaugccc

SEQ ID NO: 2918626 - RNA, 20 nt, Human T-lymphotropic virus 1
caaauccuccuucuccugca

SEQ ID NO: 2918627 - RNA, 16 nt, Human T-lymphotropic virus 1
ucaagaagcugccggc

SEQ ID NO: 2918628 - RNA, 16 nt, Human T-lymphotropic virus 1
cccagaccagccaccc

SEQ ID NO: 2918629 - RNA, 18 nt, Human T-lymphotropic virus 1
aguuuccuccuccuccuu

SEQ ID NO: 2918630 - RNA, 18 nt, Human T-lymphotropic virus 1
cuauggacuacucugcca

SEQ ID NO: 2918631 - RNA, 23 nt, Human T-lymphotropic virus 1
auuuccucuuugcuccaggccau

SEQ ID NO: 2918632 - RNA, 21 nt, Human T-lymphotropic virus 1
cacgccugccgcaaaaauaac

SEQ ID NO: 2918633 - RNA, 18 nt, Human T-lymphotropic virus 1
gcacaguuuccuccuccu

SEQ ID NO: 2918634 - RNA, 22 nt, Human T-lymphotropic virus 1
accgccccuccucuacucuccc

SEQ ID NO: 2918635 - RNA, 21 nt, Human T-lymphotropic virus 1
cuccaaaggaacuccuaccuu

SEQ ID NO: 2918636 - RNA, 14 nt, Human T-lymphotropic virus 1
ucccacccuguucg

SEQ ID NO: 2918637 - RNA, 14 nt, Human T-lymphotropic virus 1
uaacaucuccaccc

SEQ ID NO: 2918638 - RNA, 18 nt, Human T-lymphotropic virus 1
gcaaccacaucgccucca

SEQ ID NO: 2918639 - RNA, 20 nt, Human T-lymphotropic virus 1
guuccuaucuuacuccacca

SEQ ID NO: 2918640 - RNA, 23 nt, Human T-lymphotropic virus 1
ucaggcguugacgacaaccccuc

SEQ ID NO: 2918641 - RNA, 19 nt, Human T-lymphotropic virus 1
cuucaccacuccccccgac

SEQ ID NO: 2918642 - RNA, 17 nt, Human T-lymphotropic virus 1
acacuuuucuuaaaaca

SEQ ID NO: 2918643 - RNA, 14 nt, Human T-lymphotropic virus 1
caaaacuccugacu

SEQ ID NO: 2918644 - RNA, 17 nt, Human T-lymphotropic virus 1
cuccgggaagccaccgg

SEQ ID NO: 2918645 - RNA, 13 nt, Human T-lymphotropic virus 1
aauaacccacaac

SEQ ID NO: 2918646 - RNA, 19 nt, Human T-lymphotropic virus 1
ccacccuccuuccuccagg

SEQ ID NO: 2918647 - RNA, 14 nt, Human T-lymphotropic virus 1
cccgacuccagccg

SEQ ID NO: 2918648 - RNA, 23 nt, Human T-lymphotropic virus 1
cagacgaggccuugaucuccugu

SEQ ID NO: 2918649 - RNA, 21 nt, Human T-lymphotropic virus 1
cccgcgagguggcgcuuuccc

SEQ ID NO: 2918650 - RNA, 18 nt, Human T-lymphotropic virus 1
ucccaguuaaaaaagcca

SEQ ID NO: 2918651 - RNA, 15 nt, Human T-lymphotropic virus 1
acucccucauccugc

SEQ ID NO: 2918652 - RNA, 16 nt, Human T-lymphotropic virus 1
cauggaacccacccuu

SEQ ID NO: 2918653 - RNA, 14 nt, Human T-lymphotropic virus 1
ggcccuccugcccc

SEQ ID NO: 2918654 - RNA, 14 nt, Human T-lymphotropic virus 1
aacaucuugccuag

SEQ ID NO: 2918655 - RNA, 13 nt, Human T-lymphotropic virus 1
caaugccaaggcg

SEQ ID NO: 2918656 - RNA, 14 nt, Human T-lymphotropic virus 1
cauucuuaaaaccc

SEQ ID NO: 2918657 - RNA, 13 nt, Human T-lymphotropic virus 1
cccucgccucagg

SEQ ID NO: 2918658 - RNA, 19 nt, Human T-lymphotropic virus 1
cgcaaaaauaacccacaac

SEQ ID NO: 2918659 - RNA, 20 nt, Human T-lymphotropic virus 1
ccuucuucuaccccccuccu

SEQ ID NO: 2918660 - RNA, 21 nt, Human T-lymphotropic virus 1
agugaaaaacauuuccgugaa

SEQ ID NO: 2918661 - RNA, 12 nt, Human T-lymphotropic virus 1
aaaacggccucc

SEQ ID NO: 2918662 - RNA, 14 nt, Human T-lymphotropic virus 1
cacagaugcccuac

SEQ ID NO: 2918663 - RNA, 20 nt, Human T-lymphotropic virus 1
ccaccacccuuuuccagccu

SEQ ID NO: 2918664 - RNA, 21 nt, Human T-lymphotropic virus 1
ggauacauggaacccacccuu

SEQ ID NO: 2918665 - RNA, 19 nt, Human T-lymphotropic virus 1
ccuuaacugggaccuuggc

SEQ ID NO: 2918666 - RNA, 20 nt, Human T-lymphotropic virus 1
ucaacccccaacuccugcau

SEQ ID NO: 2918667 - RNA, 18 nt, Human T-lymphotropic virus 1
gaccuccgggaagccacc

SEQ ID NO: 2918668 - RNA, 13 nt, Human T-lymphotropic virus 1
gccguccucaggc

SEQ ID NO: 2918669 - RNA, 16 nt, Human T-lymphotropic virus 1
cagccccccaccugac

SEQ ID NO: 2918670 - RNA, 18 nt, Human T-lymphotropic virus 1
cuguaaaccaagcacaca

SEQ ID NO: 2918671 - RNA, 20 nt, Human T-lymphotropic virus 1
acaaggcgacuggugcccca

SEQ ID NO: 2918672 - RNA, 18 nt, Human T-lymphotropic virus 1
aagcccuuaugccagugu

SEQ ID NO: 2918673 - RNA, 17 nt, Human T-lymphotropic virus 1
cucaacgcucucacaga

SEQ ID NO: 2918674 - RNA, 22 nt, Human T-lymphotropic virus 1
ccuaccuaaacaguuccagccc

SEQ ID NO: 2918675 - RNA, 19 nt, Human T-lymphotropic virus 1
uaccuaaacaguuccagcc

SEQ ID NO: 2918676 - RNA, 12 nt, Human T-lymphotropic virus 1
guccaaacccug

SEQ ID NO: 2918677 - RNA, 20 nt, Human T-lymphotropic virus 1
cacucaacccucaccacucc

SEQ ID NO: 2918678 - RNA, 17 nt, Human T-lymphotropic virus 1
aauccuccuucuccugc

SEQ ID NO: 2918679 - RNA, 19 nt, Human T-lymphotropic virus 1
uuccucaccaauguucccu

SEQ ID NO: 2918680 - RNA, 21 nt, Human T-lymphotropic virus 1
uccuaccuuacgccagccccu

SEQ ID NO: 2918681 - RNA, 12 nt, Human T-lymphotropic virus 1
ccaacugccaca

SEQ ID NO: 2918682 - RNA, 21 nt, Human T-lymphotropic virus 1
cuaccagcuuuccccccccau

SEQ ID NO: 2918683 - RNA, 22 nt, Human T-lymphotropic virus 1
ucaggcccccuuucaggcccuc

SEQ ID NO: 2918684 - RNA, 21 nt, Human T-lymphotropic virus 1
augauuuccgggcccugcccu

SEQ ID NO: 2918685 - RNA, 14 nt, Human T-lymphotropic virus 1
ugcccaccacccuu

SEQ ID NO: 2918686 - RNA, 23 nt, Human T-lymphotropic virus 1
aagacccaacaucuauucugcca

SEQ ID NO: 2918687 - RNA, 18 nt, Human T-lymphotropic virus 1
uucauucaaacaucugac

SEQ ID NO: 2918688 - RNA, 21 nt, Human T-lymphotropic virus 1
gcucuuuuuuucgcuuccucu

SEQ ID NO: 2918689 - RNA, 23 nt, Human T-lymphotropic virus 1
accaaucuaccugaucccaucuc

SEQ ID NO: 2918690 - RNA, 15 nt, Human T-lymphotropic virus 1
cccguggaggcuccu

SEQ ID NO: 2918691 - RNA, 11 nt, Human T-lymphotropic virus 1
agccccagcug

SEQ ID NO: 2918692 - RNA, 13 nt, Human T-lymphotropic virus 1
cacuaacucucua

SEQ ID NO: 2918693 - RNA, 18 nt, Human T-lymphotropic virus 1
gcagccuauauucucugg

SEQ ID NO: 2918694 - RNA, 18 nt, Human T-lymphotropic virus 1
auuauauaaguacuuuac

SEQ ID NO: 2918695 - RNA, 20 nt, Human T-lymphotropic virus 1
ccaacaucuauucugccagu

SEQ ID NO: 2918696 - RNA, 21 nt, Human T-lymphotropic virus 1
augacauucuccuggcaagcc

SEQ ID NO: 2918697 - RNA, 17 nt, Human T-lymphotropic virus 1
uuccagccccccaccug

SEQ ID NO: 2918698 - RNA, 13 nt, Human T-lymphotropic virus 1
gcugcaugcccaa

SEQ ID NO: 2918699 - RNA, 23 nt, Human T-lymphotropic virus 1
cuccaggccaugcgcaaauacuc

SEQ ID NO: 2918700 - RNA, 14 nt, Human T-lymphotropic virus 1
ccagaccagccacc

SEQ ID NO: 2918701 - RNA, 12 nt, Human T-lymphotropic virus 1
caguuccagccc

SEQ ID NO: 2918702 - RNA, 21 nt, Human T-lymphotropic virus 1
cccuugucgcgcuacuccuuc

SEQ ID NO: 2918703 - RNA, 22 nt, Human T-lymphotropic virus 1
cgcagccauaccaaucuaccug

SEQ ID NO: 2918704 - RNA, 23 nt, Human T-lymphotropic virus 1
ugugaucauaaacaccgccccuu

SEQ ID NO: 2918705 - RNA, 21 nt, Human T-lymphotropic virus 1
cggcuccaugucccucgccuc

SEQ ID NO: 2918706 - RNA, 19 nt, Human T-lymphotropic virus 1
ccugugcuaauacgccucc

SEQ ID NO: 2918707 - RNA, 18 nt, Human T-lymphotropic virus 1
acgacaaccccucaccuc

SEQ ID NO: 2918708 - RNA, 18 nt, Human T-lymphotropic virus 1
caauauguguaccucccu

SEQ ID NO: 2918709 - RNA, 22 nt, Human T-lymphotropic virus 1
uacaggagccgucuccagcccc

SEQ ID NO: 2918710 - RNA, 20 nt, Human T-lymphotropic virus 1
gguaaguuuagagcucaggu

SEQ ID NO: 2918711 - RNA, 18 nt, Human T-lymphotropic virus 1
ucagcccacuucccaggg

SEQ ID NO: 2918712 - RNA, 23 nt, Human T-lymphotropic virus 1
gcagguccucucaggcccccuuu

SEQ ID NO: 2918713 - RNA, 23 nt, Human T-lymphotropic virus 1
agcgcuuccagccccccaccuga

SEQ ID NO: 2918714 - RNA, 23 nt, Human T-lymphotropic virus 1
cagcagaucaggcccuacagcca

SEQ ID NO: 2918715 - RNA, 19 nt, Human T-lymphotropic virus 1
ccucacuggcaccaccacu

SEQ ID NO: 2918716 - RNA, 18 nt, Human T-lymphotropic virus 1
cacguccuauacucuccc

SEQ ID NO: 2918717 - RNA, 15 nt, Human T-lymphotropic virus 1
uucacagucucuacu

SEQ ID NO: 2918718 - RNA, 13 nt, Human T-lymphotropic virus 1
ccucauccugccc

SEQ ID NO: 2918719 - RNA, 22 nt, Human T-lymphotropic virus 1
ucauaacaucuccacccaaacc

SEQ ID NO: 2918720 - RNA, 14 nt, Human T-lymphotropic virus 1
ugccccccuuuucc

SEQ ID NO: 2918721 - RNA, 16 nt, Human T-lymphotropic virus 1
cguccuauacucuccc

SEQ ID NO: 2918722 - RNA, 14 nt, Human T-lymphotropic virus 1
uauuucccaagacu

SEQ ID NO: 2918723 - RNA, 19 nt, Human T-lymphotropic virus 1
uucaggagccaucucagcu

SEQ ID NO: 2918724 - RNA, 22 nt, Human T-lymphotropic virus 1
uucucagccccuugucuccacu

SEQ ID NO: 2918725 - RNA, 20 nt, Human T-lymphotropic virus 1
cucccuuggagccuaccuag

SEQ ID NO: 2918726 - RNA, 18 nt, Human T-lymphotropic virus 1
ugcagcucucuccugcag

SEQ ID NO: 2918727 - RNA, 17 nt, Human T-lymphotropic virus 1
ugcuuucacugucccac

SEQ ID NO: 2918728 - RNA, 19 nt, Human T-lymphotropic virus 1
ucagcggccuucuccuccg

SEQ ID NO: 2918729 - RNA, 21 nt, Human T-lymphotropic virus 1
cagccccuucacagucucuac

SEQ ID NO: 2918730 - RNA, 14 nt, Human T-lymphotropic virus 1
cuuugccugacccu

SEQ ID NO: 2918731 - RNA, 22 nt, Human T-lymphotropic virus 1
cagccuccaaggacuccaccuc

SEQ ID NO: 2918732 - RNA, 19 nt, Human T-lymphotropic virus 1
accugcaacuacucucaga

SEQ ID NO: 2918733 - RNA, 20 nt, Human T-lymphotropic virus 1
ugcaggaccaugcauccucc

SEQ ID NO: 2918734 - RNA, 19 nt, Human T-lymphotropic virus 1
cuucacagucucuacugug

SEQ ID NO: 2918735 - RNA, 19 nt, Human T-lymphotropic virus 1
aacagugcuguuuucuaaa

SEQ ID NO: 2918736 - RNA, 21 nt, Human T-lymphotropic virus 1
aguaaguuacuccagcuacca

SEQ ID NO: 2918737 - RNA, 22 nt, Human T-lymphotropic virus 1
cauguccccuacaauccaacca

SEQ ID NO: 2918738 - RNA, 20 nt, Human T-lymphotropic virus 1
acuacaagagagaccccccc

SEQ ID NO: 2918739 - RNA, 12 nt, Human T-lymphotropic virus 1
cccauauccugc

SEQ ID NO: 2918740 - RNA, 20 nt, Human T-lymphotropic virus 1
ccgccuuaccugaggccgcc

SEQ ID NO: 2918741 - RNA, 19 nt, Human T-lymphotropic virus 1
uguuucgccuucucagccc

SEQ ID NO: 2918742 - RNA, 20 nt, Human T-lymphotropic virus 1
auugucacaaagaucauucc

SEQ ID NO: 2918743 - RNA, 23 nt, Human T-lymphotropic virus 1
agccugccaacuacacuagccca

SEQ ID NO: 2918744 - RNA, 18 nt, Human T-lymphotropic virus 1
cuccugugaaagcccuua

SEQ ID NO: 2918745 - RNA, 15 nt, Human T-lymphotropic virus 1
ugcuguacucucaca

SEQ ID NO: 2918746 - RNA, 21 nt, Human T-lymphotropic virus 1
ggcccagaauaaggcucugac

SEQ ID NO: 2918747 - RNA, 17 nt, Human T-lymphotropic virus 1
gacccucgaccugcugg

SEQ ID NO: 2918748 - RNA, 14 nt, Human T-lymphotropic virus 1
accagcuuuccccc

SEQ ID NO: 2918749 - RNA, 22 nt, Human T-lymphotropic virus 1
gauagcaaaccgucaagcacag

SEQ ID NO: 2918750 - RNA, 13 nt, Human T-lymphotropic virus 1
aguccuccuccuu

SEQ ID NO: 2918751 - RNA, 17 nt, Human T-lymphotropic virus 1
augcuguuucgccuucu

SEQ ID NO: 2918752 - RNA, 16 nt, Human T-lymphotropic virus 1
cuggccaccuguccag

SEQ ID NO: 2918753 - RNA, 14 nt, Human T-lymphotropic virus 1
ucagaccuccggga

SEQ ID NO: 2918754 - RNA, 23 nt, Human T-lymphotropic virus 1
ggcccugccuauauuucccaaga

SEQ ID NO: 2918755 - RNA, 22 nt, Human T-lymphotropic virus 1
cuccaccagcagguccuccggg

SEQ ID NO: 2918756 - RNA, 18 nt, Human T-lymphotropic virus 1
cccccgaaaucagccagu

SEQ ID NO: 2918757 - RNA, 21 nt, Human T-lymphotropic virus 1
agccuggcaaaacggccuccu

SEQ ID NO: 2918758 - RNA, 22 nt, Human T-lymphotropic virus 1
ccuguccugcagcucucuccug

SEQ ID NO: 2918759 - RNA, 16 nt, Human T-lymphotropic virus 1
ucagcaccagcucagg

SEQ ID NO: 2918760 - RNA, 16 nt, Human T-lymphotropic virus 1
ccagcagguccuccgg

SEQ ID NO: 2918761 - RNA, 13 nt, Human T-lymphotropic virus 1
augcgcaaauacu

SEQ ID NO: 2918762 - RNA, 23 nt, Human T-lymphotropic virus 1
aucauuaccuucggacccuugcc

SEQ ID NO: 2918763 - RNA, 22 nt, Human T-lymphotropic virus 1
ggcccuacagccacccugcccu

SEQ ID NO: 2918764 - RNA, 16 nt, Human T-lymphotropic virus 1
uacgacaccuccccuc

SEQ ID NO: 2918765 - RNA, 15 nt, Human T-lymphotropic virus 1
gcaagccccucccau

SEQ ID NO: 2918766 - RNA, 14 nt, Human T-lymphotropic virus 1
uaccgaacccagcc

SEQ ID NO: 2918767 - RNA, 20 nt, Human T-lymphotropic virus 1
uccagcuaccaugccaccua

SEQ ID NO: 2918768 - RNA, 11 nt, Human T-lymphotropic virus 1
cgugccagccu

SEQ ID NO: 2918769 - RNA, 13 nt, Human T-lymphotropic virus 1
cccucauccucgg

SEQ ID NO: 2918770 - RNA, 22 nt, Human T-lymphotropic virus 1
ugcccuaggcaccuuccaaggc

SEQ ID NO: 2918771 - RNA, 21 nt, Human T-lymphotropic virus 1
ccuucuccuccgcccgcuucc

SEQ ID NO: 2918772 - RNA, 15 nt, Human T-lymphotropic virus 1
aaccacaacugaggc

SEQ ID NO: 2918773 - RNA, 18 nt, Human T-lymphotropic virus 1
uggacaaagauauuuccc

SEQ ID NO: 2918774 - RNA, 18 nt, Human T-lymphotropic virus 1
cggucuggcuugucuccg

SEQ ID NO: 2918775 - RNA, 19 nt, Human T-lymphotropic virus 1
gugauuacagccccagcug

SEQ ID NO: 2918776 - RNA, 18 nt, Human T-lymphotropic virus 1
ugucgcgcuacuccuucu

SEQ ID NO: 2918777 - RNA, 17 nt, Human T-lymphotropic virus 1
ucgcaucucuccuucac

SEQ ID NO: 2918778 - RNA, 15 nt, Human T-lymphotropic virus 1
cggaggacagcucag

SEQ ID NO: 2918779 - RNA, 19 nt, Human T-lymphotropic virus 1
agguaaguuuagagcucag

SEQ ID NO: 2918780 - RNA, 20 nt, Human T-lymphotropic virus 1
agcucggggccuuccucacc

SEQ ID NO: 2918781 - RNA, 18 nt, Human T-lymphotropic virus 1
aaaucgaguccugacugg

SEQ ID NO: 2918782 - RNA, 15 nt, Human T-lymphotropic virus 1
cuccuccuccuuguc

SEQ ID NO: 2918783 - RNA, 21 nt, Human T-lymphotropic virus 1
ccaugcuuauuaucagcccac

SEQ ID NO: 2918784 - RNA, 17 nt, Human T-lymphotropic virus 1
cugaucccaucuccagg

SEQ ID NO: 2918785 - RNA, 15 nt, Human T-lymphotropic virus 1
uccaaaucccccuac

SEQ ID NO: 2918786 - RNA, 13 nt, Human T-lymphotropic virus 1
acccuccuuccuc

SEQ ID NO: 2918787 - RNA, 21 nt, Human T-lymphotropic virus 1
ccccugacuuguccagccugc

SEQ ID NO: 2918788 - RNA, 21 nt, Human T-lymphotropic virus 1
gaaauaacccaguauucccag

SEQ ID NO: 2918789 - RNA, 10 nt, Human T-lymphotropic virus 1
gguuccuuaa

SEQ ID NO: 2918790 - RNA, 16 nt, Human T-lymphotropic virus 1
cacaaaaaucugcuca

SEQ ID NO: 2918791 - RNA, 14 nt, Human T-lymphotropic virus 1
ggagccgucuccag

SEQ ID NO: 2918792 - RNA, 23 nt, Human T-lymphotropic virus 1
acuuuucuuaaaacaacugcccc

SEQ ID NO: 2918793 - RNA, 16 nt, Human T-lymphotropic virus 1
uccaaggacuccaccu

SEQ ID NO: 2918794 - RNA, 17 nt, Human T-lymphotropic virus 1
ucucuacugugccuuac

SEQ ID NO: 2918795 - RNA, 12 nt, Human T-lymphotropic virus 1
ggccucuccagc

SEQ ID NO: 2918796 - RNA, 21 nt, Human T-lymphotropic virus 1
cgcuaguucugcccaguggau

SEQ ID NO: 2918797 - RNA, 18 nt, Human T-lymphotropic virus 1
uaaguuacuccagcuacc

SEQ ID NO: 2918798 - RNA, 13 nt, Human T-lymphotropic virus 1
ucaccacuccagg

SEQ ID NO: 2918799 - RNA, 13 nt, Human T-lymphotropic virus 1
uucucagccccuu

SEQ ID NO: 2918800 - RNA, 23 nt, Human T-lymphotropic virus 1
cccucccaugcggaccugcaacu

SEQ ID NO: 2918801 - RNA, 17 nt, Human T-lymphotropic virus 1
acguccuauacucuccc

SEQ ID NO: 2918802 - RNA, 23 nt, Human T-lymphotropic virus 1
gcccugccuauauuucccaagac

SEQ ID NO: 2918803 - RNA, 20 nt, Human T-lymphotropic virus 1
caugcgcaaauacucccccu

SEQ ID NO: 2918804 - RNA, 22 nt, Human T-lymphotropic virus 1
gacaaccccucaccucaaaaaa

SEQ ID NO: 2918805 - RNA, 14 nt, Human T-lymphotropic virus 1
ucaacgcucucaca

SEQ ID NO: 2918806 - RNA, 20 nt, Human T-lymphotropic virus 1
cauaccuagggugccaauca

SEQ ID NO: 2918807 - RNA, 22 nt, Human T-lymphotropic virus 1
cuccgucagcuacgacaccucc

SEQ ID NO: 2918808 - RNA, 13 nt, Human T-lymphotropic virus 1
uucuacucucaca

SEQ ID NO: 2918809 - RNA, 20 nt, Human T-lymphotropic virus 1
gcucaccucccuuccugugc

SEQ ID NO: 2918810 - RNA, 20 nt, Human T-lymphotropic virus 1
uaacucccucauccugcccc

SEQ ID NO: 2918811 - RNA, 12 nt, Human T-lymphotropic virus 1
ucggcccgccua

SEQ ID NO: 2918812 - RNA, 18 nt, Human T-lymphotropic virus 1
gccuaugauuuccgggcc

SEQ ID NO: 2918813 - RNA, 22 nt, Human T-lymphotropic virus 1
caauccuauggacuacucugcc

SEQ ID NO: 2918814 - RNA, 15 nt, Human T-lymphotropic virus 1
aaauccuccuucucc

SEQ ID NO: 2918815 - RNA, 22 nt, Human T-lymphotropic virus 1
gccccccuuuuccuugucaccu

SEQ ID NO: 2918816 - RNA, 10 nt, Human T-lymphotropic virus 1
aacugcccca

SEQ ID NO: 2918817 - RNA, 19 nt, Human T-lymphotropic virus 1
cuuguccagccugccaacu

SEQ ID NO: 2918818 - RNA, 15 nt, Human T-lymphotropic virus 1
cacaguuuccuccuc

SEQ ID NO: 2918819 - RNA, 15 nt, Human T-lymphotropic virus 1
ggauccaccucccag

SEQ ID NO: 2918820 - RNA, 22 nt, Human T-lymphotropic virus 1
cagacggcccucacacugcaag

SEQ ID NO: 2918821 - RNA, 22 nt, Human T-lymphotropic virus 1
ugcccaccacccuuuuccagcc

SEQ ID NO: 2918822 - RNA, 21 nt, Human T-lymphotropic virus 1
gcuuccucuucuccucagccc

SEQ ID NO: 2918823 - RNA, 22 nt, Human T-lymphotropic virus 1
augacaaugaccaugagcccca

SEQ ID NO: 2918824 - RNA, 19 nt, Human T-lymphotropic virus 1
ccucucaggcccccuuuca

SEQ ID NO: 2918825 - RNA, 17 nt, Human T-lymphotropic virus 1
cccuccuuccuccaggc

SEQ ID NO: 2918826 - RNA, 22 nt, Human T-lymphotropic virus 1
cgacuccccuccuuccccaccc

SEQ ID NO: 2918827 - RNA, 14 nt, Human T-lymphotropic virus 1
cucuuccugcuuuc

SEQ ID NO: 2918828 - RNA, 12 nt, Human T-lymphotropic virus 1
aguuuccuccuc

SEQ ID NO: 2918829 - RNA, 16 nt, Human T-lymphotropic virus 1
agaucaggcccuacag

SEQ ID NO: 2918830 - RNA, 18 nt, Human T-lymphotropic virus 1
acauggaugacauucucc

SEQ ID NO: 2918831 - RNA, 15 nt, Human T-lymphotropic virus 1
caucaccuggccccu

SEQ ID NO: 2918832 - RNA, 16 nt, Human T-lymphotropic virus 1
ucgccuccagccuccc

SEQ ID NO: 2918833 - RNA, 22 nt, Human T-lymphotropic virus 1
cacccgucacgcugacagccug

SEQ ID NO: 2918834 - RNA, 17 nt, Human T-lymphotropic virus 1
cccagccaacugccucc

SEQ ID NO: 2918835 - RNA, 21 nt, Human T-lymphotropic virus 1
cugcaauccugcccagccagu

SEQ ID NO: 2918836 - RNA, 16 nt, Human T-lymphotropic virus 1
ccaacaucuauucugc

SEQ ID NO: 2918837 - RNA, 16 nt, Human T-lymphotropic virus 1
uugggcagcaccuccc

SEQ ID NO: 2918838 - RNA, 12 nt, Human T-lymphotropic virus 1
ucgcuuccucuu

SEQ ID NO: 2918839 - RNA, 14 nt, Human T-lymphotropic virus 1
gcuugcucaacucu

SEQ ID NO: 2918840 - RNA, 16 nt, Human T-lymphotropic virus 1
cucggggccuuccuca

SEQ ID NO: 2918841 - RNA, 23 nt, Human T-lymphotropic virus 1
cuaccugaacuucaagcccuacu

SEQ ID NO: 2918842 - RNA, 20 nt, Human T-lymphotropic virus 1
uagaucucucaucaucuucc

SEQ ID NO: 2918843 - RNA, 20 nt, Human T-lymphotropic virus 1
ggccccccgaaaucagccag

SEQ ID NO: 2918844 - RNA, 20 nt, Human T-lymphotropic virus 1
cugacaaacccgaccuaccu

SEQ ID NO: 2918845 - RNA, 14 nt, Human T-lymphotropic virus 1
cacucauacaaccc

SEQ ID NO: 2918846 - RNA, 18 nt, Human T-lymphotropic virus 1
ccgggggcuuagagccuc

SEQ ID NO: 2918847 - RNA, 18 nt, Human T-lymphotropic virus 1
cucucaggcccccuuuca

SEQ ID NO: 2918848 - RNA, 17 nt, Human T-lymphotropic virus 1
ggcaagccuucccccaa

SEQ ID NO: 2918849 - RNA, 15 nt, Human T-lymphotropic virus 1
acacuagccagugcc

SEQ ID NO: 2918850 - RNA, 23 nt, Human T-lymphotropic virus 1
ggcagcaccucccaacccugucu

SEQ ID NO: 2918851 - RNA, 19 nt, Human T-lymphotropic virus 1
ucagcaauaaacaaaccca

SEQ ID NO: 2918852 - RNA, 16 nt, Human T-lymphotropic virus 1
accccuguccugcagc

SEQ ID NO: 2918853 - RNA, 16 nt, Human T-lymphotropic virus 1
uccuauacucucccaa

SEQ ID NO: 2918854 - RNA, 15 nt, Human T-lymphotropic virus 1
aucccaucuccaggc

SEQ ID NO: 2918855 - RNA, 12 nt, Human T-lymphotropic virus 1
ccacccaaaccu

SEQ ID NO: 2918856 - RNA, 20 nt, Human T-lymphotropic virus 1
gacaaaucauaagcucagac

SEQ ID NO: 2918857 - RNA, 22 nt, Human T-lymphotropic virus 1
aucccaaagaaaaagaccacca

SEQ ID NO: 2918858 - RNA, 14 nt, Human T-lymphotropic virus 1
aaacuccucuauaa

SEQ ID NO: 2918859 - RNA, 14 nt, Human T-lymphotropic virus 1
gcgccgugccuucu

SEQ ID NO: 2918860 - RNA, 11 nt, Human T-lymphotropic virus 1
ccgaaaacaaa

SEQ ID NO: 2918861 - RNA, 14 nt, Human T-lymphotropic virus 1
guccagagcaucag

SEQ ID NO: 2918862 - RNA, 16 nt, Human T-lymphotropic virus 1
acucagccggcucucc

SEQ ID NO: 2918863 - RNA, 23 nt, Human T-lymphotropic virus 1
ucccccuaccuaaacaguuccag

SEQ ID NO: 2918864 - RNA, 18 nt, Human T-lymphotropic virus 1
ccagccaacugccuccca

SEQ ID NO: 2918865 - RNA, 14 nt, Human T-lymphotropic virus 1
caagcucagaagcu

SEQ ID NO: 2918866 - RNA, 20 nt, Human T-lymphotropic virus 1
cugccccauuggcuccugug

SEQ ID NO: 2918867 - RNA, 16 nt, Human T-lymphotropic virus 1
cucuucaagaagcugc

SEQ ID NO: 2918868 - RNA, 14 nt, Human T-lymphotropic virus 1
agccgucuccagcc

SEQ ID NO: 2918869 - RNA, 16 nt, Human T-lymphotropic virus 1
gcagguccuccgggca

SEQ ID NO: 2918870 - RNA, 17 nt, Human T-lymphotropic virus 1
cagaggccacaauggcu

SEQ ID NO: 2918871 - RNA, 16 nt, Human T-lymphotropic virus 1
ccguggccuacucccu

SEQ ID NO: 2918872 - RNA, 13 nt, Human T-lymphotropic virus 1
cuccagccucccc

SEQ ID NO: 2918873 - RNA, 13 nt, Human T-lymphotropic virus 1
gcggcaggcccug

SEQ ID NO: 2918874 - RNA, 21 nt, Human T-lymphotropic virus 1
gugcagcugcggcaggcccug

SEQ ID NO: 2918875 - RNA, 16 nt, Human T-lymphotropic virus 1
uccuggcaagccccuc

SEQ ID NO: 2918876 - RNA, 19 nt, Human T-lymphotropic virus 1
cgcauacggcucaauaaaa

SEQ ID NO: 2918877 - RNA, 13 nt, Human T-lymphotropic virus 1
gcaccaccacugu

SEQ ID NO: 2918878 - RNA, 16 nt, Human T-lymphotropic virus 1
cuaucuuacuccacca

SEQ ID NO: 2918879 - RNA, 21 nt, Human T-lymphotropic virus 1
uggaucccguggaggcuccuc

SEQ ID NO: 2918880 - RNA, 22 nt, Human T-lymphotropic virus 1
uaauuaaccucucccaucaaau

SEQ ID NO: 2918881 - RNA, 21 nt, Human T-lymphotropic virus 1
cuuggccucucacagugggcu

SEQ ID NO: 2918882 - RNA, 19 nt, Human T-lymphotropic virus 1
ugcucaaaauugcacagua

SEQ ID NO: 2918883 - RNA, 15 nt, Human T-lymphotropic virus 1
gacuuguccagccug

SEQ ID NO: 2918884 - RNA, 16 nt, Human T-lymphotropic virus 1
cccuccuuccuccagg

SEQ ID NO: 2918885 - RNA, 23 nt, Human T-lymphotropic virus 1
gcuuccucuucuccucagcccgu

SEQ ID NO: 2918886 - RNA, 15 nt, Human T-lymphotropic virus 1
ucccucauccugccc

SEQ ID NO: 2918887 - RNA, 13 nt, Human T-lymphotropic virus 1
agacggcccucac

SEQ ID NO: 2918888 - RNA, 22 nt, Human T-lymphotropic virus 1
ccugcuggcccuuucagcagau

SEQ ID NO: 2918889 - RNA, 20 nt, Human T-lymphotropic virus 1
cccagccaacugccucccac

SEQ ID NO: 2918890 - RNA, 17 nt, Human T-lymphotropic virus 1
gcucuucaagaagcugc

SEQ ID NO: 2918891 - RNA, 23 nt, Human T-lymphotropic virus 1
cugccaauaauuaaccucuccca

SEQ ID NO: 2918892 - RNA, 16 nt, Human T-lymphotropic virus 1
cacaguuuccuccucc

SEQ ID NO: 2918893 - RNA, 15 nt, Human T-lymphotropic virus 1
cuggccaugggagcc

SEQ ID NO: 2918894 - RNA, 17 nt, Human T-lymphotropic virus 1
cacaucgccuccagccu

SEQ ID NO: 2918895 - RNA, 13 nt, Human T-lymphotropic virus 1
cccacuucccagg

SEQ ID NO: 2918896 - RNA, 17 nt, Human T-lymphotropic virus 1
uccuggcaagccccucc

SEQ ID NO: 2918897 - RNA, 20 nt, Human T-lymphotropic virus 1
ucauaaacaccgccccuugc

SEQ ID NO: 2918898 - RNA, 22 nt, Human T-lymphotropic virus 1
cgggccuuuguccggcgcuccc

SEQ ID NO: 2918899 - RNA, 22 nt, Human T-lymphotropic virus 1
gcuuuccccccuggagggcccc

SEQ ID NO: 2918900 - RNA, 22 nt, Human T-lymphotropic virus 1
aaaaugcgguuuuuccuucucc

SEQ ID NO: 2918901 - RNA, 16 nt, Human T-lymphotropic virus 1
uccacucaacccucac

SEQ ID NO: 2918902 - RNA, 19 nt, Human T-lymphotropic virus 1
ccaccaauuccuccaccag

SEQ ID NO: 2918903 - RNA, 12 nt, Human T-lymphotropic virus 1
cggaaggcccug

SEQ ID NO: 2918904 - RNA, 19 nt, Human T-lymphotropic virus 1
uagaacaccucccaaggcc

SEQ ID NO: 2918905 - RNA, 19 nt, Human T-lymphotropic virus 1
gcccuacuuugcuuucacu

SEQ ID NO: 2918906 - RNA, 20 nt, Human T-lymphotropic virus 1
ccucauacaguacucuuccu

SEQ ID NO: 2918907 - RNA, 20 nt, Human T-lymphotropic virus 1
aucaucuucccccgggcccc

SEQ ID NO: 2918908 - RNA, 16 nt, Human T-lymphotropic virus 1
ucaggcccuccugccc

SEQ ID NO: 2918909 - RNA, 15 nt, Human T-lymphotropic virus 1
aacccgaccuaccua

SEQ ID NO: 2918910 - RNA, 15 nt, Human T-lymphotropic virus 1
cagaucaccugggac

SEQ ID NO: 2918911 - RNA, 16 nt, Human T-lymphotropic virus 1
cccuacagccacccug

SEQ ID NO: 2918912 - RNA, 17 nt, Human T-lymphotropic virus 1
cggggccuuccucacca

SEQ ID NO: 2918913 - RNA, 13 nt, Human T-lymphotropic virus 1
agaguacuacccc

SEQ ID NO: 2918914 - RNA, 17 nt, Human T-lymphotropic virus 1
accaugcauccuccguc

SEQ ID NO: 2918915 - RNA, 20 nt, Human T-lymphotropic virus 1
cggaggacagcucagcacca

SEQ ID NO: 2918916 - RNA, 13 nt, Human T-lymphotropic virus 1
caacuacucucag

SEQ ID NO: 2918917 - RNA, 11 nt, Human T-lymphotropic virus 1
uccacccuccu

SEQ ID NO: 2918918 - RNA, 22 nt, Human T-lymphotropic virus 1
ccgcucuuuuuuucgcuuccuc

SEQ ID NO: 2918919 - RNA, 17 nt, Human T-lymphotropic virus 1
gggagccggaguggcug

SEQ ID NO: 2918920 - RNA, 22 nt, Human T-lymphotropic virus 1
cuugucuccgcccuggccaugg

SEQ ID NO: 2918921 - RNA, 15 nt, Human T-lymphotropic virus 1
ccucaagcgagcugc

SEQ ID NO: 2918922 - RNA, 12 nt, Human T-lymphotropic virus 1
ccuacagccacc

SEQ ID NO: 2918923 - RNA, 23 nt, Human T-lymphotropic virus 1
caugcuuauuaucagcccacuuc

SEQ ID NO: 2918924 - RNA, 23 nt, Human T-lymphotropic virus 1
cucauccucggugauuacagccc

SEQ ID NO: 2918925 - RNA, 20 nt, Human T-lymphotropic virus 1
aacucccucauccugccccc

SEQ ID NO: 2918926 - RNA, 13 nt, Human T-lymphotropic virus 1
uccuccuccuuua

SEQ ID NO: 2918927 - RNA, 18 nt, Human T-lymphotropic virus 1
uuccacucaacccucacc

SEQ ID NO: 2918928 - RNA, 14 nt, Human T-lymphotropic virus 1
cugcuuuuccuccu

SEQ ID NO: 2918929 - RNA, 13 nt, Human T-lymphotropic virus 1
ccucuucuccuca

SEQ ID NO: 2918930 - RNA, 12 nt, Human T-lymphotropic virus 1
gcccccucaucc

SEQ ID NO: 2918931 - RNA, 18 nt, Human T-lymphotropic virus 1
uuagcgcuuccagccccc

SEQ ID NO: 2918932 - RNA, 23 nt, Human T-lymphotropic virus 1
gucacaaagaucauucccccuuc

SEQ ID NO: 2918933 - RNA, 16 nt, Human T-lymphotropic virus 1
uuuccuccuccuccuu

SEQ ID NO: 2918934 - RNA, 18 nt, Human T-lymphotropic virus 1
aaacccugagucaucccu

SEQ ID NO: 2918935 - RNA, 16 nt, Human T-lymphotropic virus 1
gcagcuucaccacucc

SEQ ID NO: 2918936 - RNA, 22 nt, Human T-lymphotropic virus 1
agccggccgcggcuuuccucuu

SEQ ID NO: 2918937 - RNA, 13 nt, Human T-lymphotropic virus 1
cagccgaucccag

SEQ ID NO: 2918938 - RNA, 20 nt, Human T-lymphotropic virus 1
gcuaggaucccgcucccgcc

SEQ ID NO: 2918939 - RNA, 17 nt, Human T-lymphotropic virus 1
ucugcuuuuccuccucu

SEQ ID NO: 2918940 - RNA, 23 nt, Human T-lymphotropic virus 1
caagcuauagucuccucccccug

SEQ ID NO: 2918941 - RNA, 17 nt, Human T-lymphotropic virus 1
acggauccaccucccag

SEQ ID NO: 2918942 - RNA, 22 nt, Human T-lymphotropic virus 1
ggacccacugcuuugaccccca

SEQ ID NO: 2918943 - RNA, 15 nt, Human T-lymphotropic virus 1
uagacuaguccaaac

SEQ ID NO: 2918944 - RNA, 20 nt, Human T-lymphotropic virus 1
acauuacccauuucaaauau

SEQ ID NO: 2918945 - RNA, 13 nt, Human T-lymphotropic virus 1
gagagaccccccc

SEQ ID NO: 2918946 - RNA, 12 nt, Human T-lymphotropic virus 1
ucuccuccgccc

SEQ ID NO: 2918947 - RNA, 16 nt, Human T-lymphotropic virus 1
ugcucuuccugcuuuc

SEQ ID NO: 2918948 - RNA, 21 nt, Human T-lymphotropic virus 1
uagaucucucaucaucuuccc

SEQ ID NO: 2918949 - RNA, 19 nt, Human T-lymphotropic virus 1
cuuucagcagaucaggccc

SEQ ID NO: 2918950 - RNA, 17 nt, Human T-lymphotropic virus 1
aucugcuuuuccuccuc

SEQ ID NO: 2918951 - RNA, 18 nt, Human T-lymphotropic virus 1
cggcgcuccugcucuucc

SEQ ID NO: 2918952 - RNA, 18 nt, Human T-lymphotropic virus 1
auuacagcaaguccuucc

SEQ ID NO: 2918953 - RNA, 22 nt, Human T-lymphotropic virus 1
acaguuccuuaucccucgacuc

SEQ ID NO: 2918954 - RNA, 21 nt, Human T-lymphotropic virus 1
auccuucucaaguucaaucau

SEQ ID NO: 2918955 - RNA, 16 nt, Human T-lymphotropic virus 1
gcucaggcuaggcccu

SEQ ID NO: 2918956 - RNA, 18 nt, Human T-lymphotropic virus 1
cggacccuugcccuaggc

SEQ ID NO: 2918957 - RNA, 13 nt, Human T-lymphotropic virus 1
aguacucuuccuu

SEQ ID NO: 2918958 - RNA, 19 nt, Human T-lymphotropic virus 1
gagagacccccccuugaaa

SEQ ID NO: 2918959 - RNA, 19 nt, Human T-lymphotropic virus 1
cucuguuccauccccuucu

SEQ ID NO: 2918960 - RNA, 22 nt, Human T-lymphotropic virus 1
aaccaauucauucaaacaucug

SEQ ID NO: 2918961 - RNA, 21 nt, Human T-lymphotropic virus 1
cccuugcccuaggcaccuucc

SEQ ID NO: 2918962 - RNA, 20 nt, Human T-lymphotropic virus 1
ccuuuuuccaaaucccccua

SEQ ID NO: 2918963 - RNA, 12 nt, Human T-lymphotropic virus 1
uuuucuuaaaac

SEQ ID NO: 2918964 - RNA, 20 nt, Human T-lymphotropic virus 1
cggcucuccacgcuuugccu

SEQ ID NO: 2918965 - RNA, 19 nt, Human T-lymphotropic virus 1
cuccagccuccccugccaa

SEQ ID NO: 2918966 - RNA, 12 nt, Human T-lymphotropic virus 1
uccuuccuccag

SEQ ID NO: 2918967 - RNA, 16 nt, Human T-lymphotropic virus 1
cuguaaaccaagcaca

SEQ ID NO: 2918968 - RNA, 21 nt, Human T-lymphotropic virus 1
ccuuucauaauuugcaucucc

SEQ ID NO: 2918969 - RNA, 21 nt, Human T-lymphotropic virus 1
caacgucucuguuccaucccc

SEQ ID NO: 2918970 - RNA, 18 nt, Human T-lymphotropic virus 1
acaucgccuccagccucc

SEQ ID NO: 2918971 - RNA, 15 nt, Human T-lymphotropic virus 1
ccaccaacaccaugg

SEQ ID NO: 2918972 - RNA, 17 nt, Human T-lymphotropic virus 1
gccuaucuaggcaagcc

SEQ ID NO: 2918973 - RNA, 20 nt, Human T-lymphotropic virus 1
ucuggcuacaugccccccua

SEQ ID NO: 2918974 - RNA, 14 nt, Human T-lymphotropic virus 1
caccucccaaggcc

SEQ ID NO: 2918975 - RNA, 20 nt, Human T-lymphotropic virus 1
ucauccugccccccuuuucc

SEQ ID NO: 2918976 - RNA, 22 nt, Human T-lymphotropic virus 1
cccuucuagucgacgcuccagg

SEQ ID NO: 2918977 - RNA, 18 nt, Human T-lymphotropic virus 1
cccagcaaaccccuggaa

SEQ ID NO: 2918978 - RNA, 18 nt, Human T-lymphotropic virus 1
acuccccccgacuccagc

SEQ ID NO: 2918979 - RNA, 16 nt, Human T-lymphotropic virus 1
ccuccccucgcgcguc

SEQ ID NO: 2918980 - RNA, 15 nt, Human T-lymphotropic virus 1
cagggggccaaaccc

SEQ ID NO: 2918981 - RNA, 17 nt, Human T-lymphotropic virus 1
guaaguuuagagcucag

SEQ ID NO: 2918982 - RNA, 19 nt, Human T-lymphotropic virus 1
caaggacuccaccucgccu

SEQ ID NO: 2918983 - RNA, 19 nt, Human T-lymphotropic virus 1
ugccaacuacacuagccca

SEQ ID NO: 2918984 - RNA, 12 nt, Human T-lymphotropic virus 1
cucacagugggc

SEQ ID NO: 2918985 - RNA, 21 nt, Human T-lymphotropic virus 1
uccaccagcagguccuccggg

SEQ ID NO: 2918986 - RNA, 16 nt, Human T-lymphotropic virus 1
aaaaauuuaggugccc

SEQ ID NO: 2918987 - RNA, 18 nt, Human T-lymphotropic virus 1
cuuccaguucugcccccu

SEQ ID NO: 2918988 - RNA, 20 nt, Human T-lymphotropic virus 1
acacauucccucagcaauaa

SEQ ID NO: 2918989 - RNA, 19 nt, Human T-lymphotropic virus 1
cagacaauggcccugccua

SEQ ID NO: 2918990 - RNA, 14 nt, Human T-lymphotropic virus 1
cagccggcucucca

SEQ ID NO: 2918991 - RNA, 18 nt, Human T-lymphotropic virus 1
aagucagcggccuucucc

SEQ ID NO: 2918992 - RNA, 14 nt, Human T-lymphotropic virus 1
uccccccccaucac

SEQ ID NO: 2918993 - RNA, 20 nt, Human T-lymphotropic virus 1
agccuccaaggacuccaccu

SEQ ID NO: 2918994 - RNA, 20 nt, Human T-lymphotropic virus 1
auuuaacuggacccacugcu

SEQ ID NO: 2918995 - RNA, 12 nt, Human T-lymphotropic virus 1
gacccccccuug

SEQ ID NO: 2918996 - RNA, 20 nt, Human T-lymphotropic virus 1
caccgccccuccucuacucu

SEQ ID NO: 2918997 - RNA, 23 nt, Human T-lymphotropic virus 1
ccuugcuauucgccauacuaccc

SEQ ID NO: 2918998 - RNA, 17 nt, Human T-lymphotropic virus 1
aguguuuacucuuuccc

SEQ ID NO: 2918999 - RNA, 19 nt, Human T-lymphotropic virus 1
aaccacccauuuccucccc

SEQ ID NO: 2919000 - RNA, 19 nt, Human T-lymphotropic virus 1
uucaccuaaucaccucacu

SEQ ID NO: 2919001 - RNA, 21 nt, Human T-lymphotropic virus 1
cuaccuaaacaguuccagccc

SEQ ID NO: 2919002 - RNA, 22 nt, Human T-lymphotropic virus 1
cuccugcauuuuuucuuuccua

SEQ ID NO: 2919003 - RNA, 19 nt, Human T-lymphotropic virus 1
ugcaccacguucgcagcca

SEQ ID NO: 2919004 - RNA, 13 nt, Human T-lymphotropic virus 1
gauugacacccag

SEQ ID NO: 2919005 - RNA, 18 nt, Human T-lymphotropic virus 1
agguccucucaggccccc

SEQ ID NO: 2919006 - RNA, 17 nt, Human T-lymphotropic virus 1
ccgucggaggccccgcc

SEQ ID NO: 2919007 - RNA, 13 nt, Human T-lymphotropic virus 1
gccauacuaccca

SEQ ID NO: 2919008 - RNA, 13 nt, Human T-lymphotropic virus 1
uuuagagcucagg

SEQ ID NO: 2919009 - RNA, 16 nt, Human T-lymphotropic virus 1
ccgauggcagcuucac

SEQ ID NO: 2919010 - RNA, 17 nt, Human T-lymphotropic virus 1
uuaacuggacccacugc

SEQ ID NO: 2919011 - RNA, 22 nt, Human T-lymphotropic virus 1
cucauacaguacucuuccuuuc

SEQ ID NO: 2919012 - RNA, 15 nt, Human T-lymphotropic virus 1
aguacuuuacugaca

SEQ ID NO: 2919013 - RNA, 17 nt, Human T-lymphotropic virus 1
cuaccuagacucagccg

SEQ ID NO: 2919014 - RNA, 18 nt, Human T-lymphotropic virus 1
aucccucgacuccccucc

SEQ ID NO: 2919015 - RNA, 20 nt, Human T-lymphotropic virus 1
gcgcuccugcucuuccugcu

SEQ ID NO: 2919016 - RNA, 11 nt, Human T-lymphotropic virus 1
cgucaagcaca

SEQ ID NO: 2919017 - RNA, 19 nt, Human T-lymphotropic virus 1
cugcuuuuccuccucuuuc

SEQ ID NO: 2919018 - RNA, 16 nt, Human T-lymphotropic virus 1
uccuguaccucccuga

SEQ ID NO: 2919019 - RNA, 17 nt, Human T-lymphotropic virus 1
cgcggcuuuccucuucu

SEQ ID NO: 2919020 - RNA, 21 nt, Human T-lymphotropic virus 1
gugccccugggggcagcuacu

SEQ ID NO: 2919021 - RNA, 14 nt, Human T-lymphotropic virus 1
gagauucagugggu

SEQ ID NO: 2919022 - RNA, 19 nt, Human T-lymphotropic virus 1
gccaccgggaaccacccau

SEQ ID NO: 2919023 - RNA, 18 nt, Human T-lymphotropic virus 1
gucacagaacugccgcag

SEQ ID NO: 2919024 - RNA, 24 nt, Human T-lymphotropic virus 1
uuccuagggcaaauaauuucaccu

SEQ ID NO: 2919025 - RNA, 17 nt, Human T-lymphotropic virus 1
ccugcucuuccugcuuu

SEQ ID NO: 2919026 - RNA, 15 nt, Human T-lymphotropic virus 1
cacgcugacagccug

SEQ ID NO: 2919027 - RNA, 20 nt, Human T-lymphotropic virus 1
cgccccuccucuacucuccc

SEQ ID NO: 2919028 - RNA, 16 nt, Human T-lymphotropic virus 1
aucgccuccagccucc

SEQ ID NO: 2919029 - RNA, 15 nt, Human T-lymphotropic virus 1
ccaucaaauccuccu

SEQ ID NO: 2919030 - RNA, 13 nt, Human T-lymphotropic virus 1
uuaggugcccaga

SEQ ID NO: 2919031 - RNA, 19 nt, Human T-lymphotropic virus 1
gcccuaaagauggccagcc

SEQ ID NO: 2919032 - RNA, 16 nt, Human T-lymphotropic virus 1
acaucgccuccagccu

SEQ ID NO: 2919033 - RNA, 21 nt, Human T-lymphotropic virus 1
uguaucgaucgugccagccua

SEQ ID NO: 2919034 - RNA, 18 nt, Human T-lymphotropic virus 1
aaaaagaccaccaacacc

SEQ ID NO: 2919035 - RNA, 22 nt, Human T-lymphotropic virus 1
uuuucagacggauccaccuccc

SEQ ID NO: 2919036 - RNA, 20 nt, Human T-lymphotropic virus 1
uccccuccuuccccacccag

SEQ ID NO: 2919037 - RNA, 22 nt, Human T-lymphotropic virus 1
aguagacuaguccaaacccugc

SEQ ID NO: 2919038 - RNA, 15 nt, Human T-lymphotropic virus 1
ucauccugccccccu

SEQ ID NO: 2919039 - RNA, 21 nt, Human T-lymphotropic virus 1
gccgccuuaccugaggccgcc

SEQ ID NO: 2919040 - RNA, 18 nt, Human T-lymphotropic virus 1
ccacaucgccuccagccu

SEQ ID NO: 2919041 - RNA, 21 nt, Human T-lymphotropic virus 1
cccccugacuuguccagccug

SEQ ID NO: 2919042 - RNA, 13 nt, Human T-lymphotropic virus 1
cugcuggcccuuu

SEQ ID NO: 2919043 - RNA, 16 nt, Human T-lymphotropic virus 1
ucauccugccccccuu

SEQ ID NO: 2919044 - RNA, 21 nt, Human T-lymphotropic virus 1
ccacccuccuuccuccaggcc

SEQ ID NO: 2919045 - RNA, 11 nt, Human T-lymphotropic virus 1
auuccacccuc

SEQ ID NO: 2919046 - RNA, 23 nt, Human T-lymphotropic virus 1
aacgcucuaauggcauucuuaaa

SEQ ID NO: 2919047 - RNA, 15 nt, Human T-lymphotropic virus 1
caccccggccagcuc

SEQ ID NO: 2919048 - RNA, 15 nt, Human T-lymphotropic virus 1
cauauccugcagccc

SEQ ID NO: 2919049 - RNA, 21 nt, Human T-lymphotropic virus 1
uccaaacccugccccuccuag

SEQ ID NO: 2919050 - RNA, 16 nt, Human T-lymphotropic virus 1
ugcuguacucucacag

SEQ ID NO: 2919051 - RNA, 14 nt, Human T-lymphotropic virus 1
ccucuucuccucag

SEQ ID NO: 2919052 - RNA, 22 nt, Human T-lymphotropic virus 1
aucccccgggggcuuagagccu

SEQ ID NO: 2919053 - RNA, 12 nt, Human T-lymphotropic virus 1
ccaccucccagg

SEQ ID NO: 2919054 - RNA, 13 nt, Human T-lymphotropic virus 1
gcugcccagaaca

SEQ ID NO: 2919055 - RNA, 14 nt, Human T-lymphotropic virus 1
acccuuuuccagcc

SEQ ID NO: 2919056 - RNA, 18 nt, Human T-lymphotropic virus 1
cauguaccucuaccagcu

SEQ ID NO: 2919057 - RNA, 18 nt, Human T-lymphotropic virus 1
aacuccuaccuuacgcca

SEQ ID NO: 2919058 - RNA, 23 nt, Human T-lymphotropic virus 1
guuccuaucuuacuccaccacag

SEQ ID NO: 2919059 - RNA, 12 nt, Human T-lymphotropic virus 1
ccaccccagugu

SEQ ID NO: 2919060 - RNA, 22 nt, Human T-lymphotropic virus 1
auccgccguggccuacucccua

SEQ ID NO: 2919061 - RNA, 13 nt, Human T-lymphotropic virus 1
cgccuccaggccu

SEQ ID NO: 2919062 - RNA, 19 nt, Human T-lymphotropic virus 1
gaggacagcucagcaccag

SEQ ID NO: 2919063 - RNA, 18 nt, Human T-lymphotropic virus 1
uuaucccucgacuccccu

SEQ ID NO: 2919064 - RNA, 17 nt, Human T-lymphotropic virus 1
cuccucauaccacucua

SEQ ID NO: 2919065 - RNA, 19 nt, Human T-lymphotropic virus 1
uccagcuaccaugccaccu

SEQ ID NO: 2919066 - RNA, 23 nt, Human T-lymphotropic virus 1
cuagaccauauccucgagcccuc

SEQ ID NO: 2919067 - RNA, 22 nt, Human T-lymphotropic virus 1
cucagcaccagcucaggcuagg

SEQ ID NO: 2919068 - RNA, 13 nt, Human T-lymphotropic virus 1
ucaggagccaucu

SEQ ID NO: 2919069 - RNA, 12 nt, Human T-lymphotropic virus 1
uccaaacccugc

SEQ ID NO: 2919070 - RNA, 22 nt, Human T-lymphotropic virus 1
ccccuucuucuaccccccuccu

SEQ ID NO: 2919071 - RNA, 16 nt, Human T-lymphotropic virus 1
cggaggacagcucagc

SEQ ID NO: 2919072 - RNA, 18 nt, Human T-lymphotropic virus 1
gcacaguaugcugcccag

SEQ ID NO: 2919073 - RNA, 16 nt, Human T-lymphotropic virus 1
gcugggcgcuaccuga

SEQ ID NO: 2919074 - RNA, 11 nt, Human T-lymphotropic virus 1
aacucccucau

SEQ ID NO: 2919075 - RNA, 15 nt, Human T-lymphotropic virus 1
gcuaguucugcccag

SEQ ID NO: 2919076 - RNA, 18 nt, Human T-lymphotropic virus 1
cacccuugggcagcaccu

SEQ ID NO: 2919077 - RNA, 13 nt, Human T-lymphotropic virus 1
cccaucuccaggc

SEQ ID NO: 2919078 - RNA, 16 nt, Human T-lymphotropic virus 1
accuuggccucucaca

SEQ ID NO: 2919079 - RNA, 23 nt, Human T-lymphotropic virus 1
caccauggguaaguuucucgcca

SEQ ID NO: 2919080 - RNA, 20 nt, Human T-lymphotropic virus 1
ugcccuaggcaccuuccaag

SEQ ID NO: 2919081 - RNA, 22 nt, Human T-lymphotropic virus 1
ugcgcaaauacucccccuuccg

SEQ ID NO: 2919082 - RNA, 13 nt, Human T-lymphotropic virus 1
cgccuccagccuc

SEQ ID NO: 2919083 - RNA, 13 nt, Human T-lymphotropic virus 1
cgcuuccagcccc

SEQ ID NO: 2919084 - RNA, 18 nt, Human T-lymphotropic virus 1
ggaccuuggccucucaca

SEQ ID NO: 2919085 - RNA, 17 nt, Human T-lymphotropic virus 1
cucuguuccauccccuu

SEQ ID NO: 2919086 - RNA, 13 nt, Human T-lymphotropic virus 1
cuccugcucuucc

SEQ ID NO: 2919087 - RNA, 19 nt, Human T-lymphotropic virus 1
gaggcuauuauucagccuc

SEQ ID NO: 2919088 - RNA, 17 nt, Human T-lymphotropic virus 1
cgccgugccuucuccuc

SEQ ID NO: 2919089 - RNA, 17 nt, Human T-lymphotropic virus 1
caacaucuauucugcca

SEQ ID NO: 2919090 - RNA, 22 nt, Human T-lymphotropic virus 1
ucccaacgucucuguuccaucc

SEQ ID NO: 2919091 - RNA, 15 nt, Human T-lymphotropic virus 1
auuaaccaacugcca

SEQ ID NO: 2919092 - RNA, 13 nt, Human T-lymphotropic virus 1
uccagccugccaa

SEQ ID NO: 2919093 - RNA, 17 nt, Human T-lymphotropic virus 1
ugucgcgcuacuccuuc

SEQ ID NO: 2919094 - RNA, 23 nt, Human T-lymphotropic virus 1
ugcagcuggcccauauccugcag

SEQ ID NO: 2919095 - RNA, 14 nt, Human T-lymphotropic virus 1
gacucagccggcuc

SEQ ID NO: 2919096 - RNA, 16 nt, Human T-lymphotropic virus 1
acgaugcguuuccccg

SEQ ID NO: 2919097 - RNA, 11 nt, Human T-lymphotropic virus 1
ccaacugccac

SEQ ID NO: 2919098 - RNA, 16 nt, Human T-lymphotropic virus 1
aucugguuccuuaaua

SEQ ID NO: 2919099 - RNA, 15 nt, Human T-lymphotropic virus 1
aucccucgacucccc

SEQ ID NO: 2919100 - RNA, 17 nt, Human T-lymphotropic virus 1
cugacuuguccagccug

SEQ ID NO: 2919101 - RNA, 19 nt, Human T-lymphotropic virus 1
cgccuguggugccuccuga

SEQ ID NO: 2919102 - RNA, 20 nt, Human T-lymphotropic virus 1
cuugcccuaggcaccuucca

SEQ ID NO: 2919103 - RNA, 16 nt, Human T-lymphotropic virus 1
cuuguccuuuaacucu

SEQ ID NO: 2919104 - RNA, 18 nt, Human T-lymphotropic virus 1
acccugcaauccugccca

SEQ ID NO: 2919105 - RNA, 15 nt, Human T-lymphotropic virus 1
ccaccccggccagcu

SEQ ID NO: 2919106 - RNA, 12 nt, Human T-lymphotropic virus 1
ccugacuugucc

SEQ ID NO: 2919107 - RNA, 22 nt, Human T-lymphotropic virus 1
acugcaaggggcaaccacaacu

SEQ ID NO: 2919108 - RNA, 21 nt, Human T-lymphotropic virus 1
aucgucacgcccuacuggcca

SEQ ID NO: 2919109 - RNA, 21 nt, Human T-lymphotropic virus 1
cugcaacuacucucagaggcc

SEQ ID NO: 2919110 - RNA, 23 nt, Human T-lymphotropic virus 1
ugccaauaauuaaccucucccau

SEQ ID NO: 2919111 - RNA, 12 nt, Human T-lymphotropic virus 1
cuuuuccagccu

SEQ ID NO: 2919112 - RNA, 22 nt, Human T-lymphotropic virus 1
auccucggugauuacagcccca

SEQ ID NO: 2919113 - RNA, 20 nt, Human T-lymphotropic virus 1
agccauaccaaucuaccuga

SEQ ID NO: 2919114 - RNA, 12 nt, Human T-lymphotropic virus 1
aguaugcugccc

SEQ ID NO: 2919115 - RNA, 19 nt, Human T-lymphotropic virus 1
ccacccauuuccuccccau

SEQ ID NO: 2919116 - RNA, 16 nt, Human T-lymphotropic virus 1
cccuacuggccaccug

SEQ ID NO: 2919117 - RNA, 15 nt, Human T-lymphotropic virus 1
ucuacucucccacuc

SEQ ID NO: 2919118 - RNA, 15 nt, Human T-lymphotropic virus 1
caaaaagccaaaccg

SEQ ID NO: 2919119 - RNA, 13 nt, Human T-lymphotropic virus 1
accaugagcccca

SEQ ID NO: 2919120 - RNA, 23 nt, Human T-lymphotropic virus 1
accacuccccccgacuccagccg

SEQ ID NO: 2919121 - RNA, 15 nt, Human T-lymphotropic virus 1
ucagccuccaaggac

SEQ ID NO: 2919122 - RNA, 17 nt, Human T-lymphotropic virus 1
cuccaccucgccuucca

SEQ ID NO: 2919123 - RNA, 17 nt, Human T-lymphotropic virus 1
uccaaggacuccaccuc

SEQ ID NO: 2919124 - RNA, 19 nt, Human T-lymphotropic virus 1
gccgccuguaaucuugcca

SEQ ID NO: 2919125 - RNA, 19 nt, Human T-lymphotropic virus 1
acccuuaagguccuuaccc

SEQ ID NO: 2919126 - RNA, 17 nt, Human T-lymphotropic virus 1
acauuccacccuccuuc

SEQ ID NO: 2919127 - RNA, 13 nt, Human T-lymphotropic virus 1
uccaauauccugc

SEQ ID NO: 2919128 - RNA, 13 nt, Human T-lymphotropic virus 1
gcgcuccugcucu

SEQ ID NO: 2919129 - RNA, 13 nt, Human T-lymphotropic virus 1
cagccacccugcc

SEQ ID NO: 2919130 - RNA, 17 nt, Human T-lymphotropic virus 1
cgcccuacuggccaccu

SEQ ID NO: 2919131 - RNA, 23 nt, Human T-lymphotropic virus 1
ugaagaauacaccaacaucccca

SEQ ID NO: 2919132 - RNA, 21 nt, Human T-lymphotropic virus 1
aaaucauaagcucagaccucc

SEQ ID NO: 2919133 - RNA, 23 nt, Human T-lymphotropic virus 1
gaucaggcccuacagccacccug

SEQ ID NO: 2919134 - RNA, 22 nt, Human T-lymphotropic virus 1
ucagaagcuauuuccucuuugc

SEQ ID NO: 2919135 - RNA, 23 nt, Human T-lymphotropic virus 1
acccugcaauccugcccagccag

SEQ ID NO: 2919136 - RNA, 16 nt, Human T-lymphotropic virus 1
gcccauauccugcagc

SEQ ID NO: 2919137 - RNA, 22 nt, Human T-lymphotropic virus 1
agcaaccuccuccguucagccu

SEQ ID NO: 2919138 - RNA, 18 nt, Human T-lymphotropic virus 1
ucagcggccuucuccucc

SEQ ID NO: 2919139 - RNA, 16 nt, Human T-lymphotropic virus 1
gaacccacccuugggc

SEQ ID NO: 2919140 - RNA, 14 nt, Human T-lymphotropic virus 1
caccccggccagcu

SEQ ID NO: 2919141 - RNA, 19 nt, Human T-lymphotropic virus 1
cugucucaacauauuucua

SEQ ID NO: 2919142 - RNA, 19 nt, Human T-lymphotropic virus 1
uccugcagcucucuccugc

SEQ ID NO: 2919143 - RNA, 14 nt, Human T-lymphotropic virus 1
cuacaguccuccuc

SEQ ID NO: 2919144 - RNA, 21 nt, Human T-lymphotropic virus 1
cugccccccuuuuccuuguca

SEQ ID NO: 2919145 - RNA, 19 nt, Human T-lymphotropic virus 1
uuccucuucuccucagccc

SEQ ID NO: 2919146 - RNA, 14 nt, Human T-lymphotropic virus 1
auccaaccagcucc

SEQ ID NO: 2919147 - RNA, 12 nt, Human T-lymphotropic virus 1
uuuuugccaccc

SEQ ID NO: 2919148 - RNA, 19 nt, Human T-lymphotropic virus 1
cauacaguacucuuccuuu

SEQ ID NO: 2919149 - RNA, 22 nt, Human T-lymphotropic virus 1
cugcccuaaagauggccagcca

SEQ ID NO: 2919150 - RNA, 22 nt, Human T-lymphotropic virus 1
cuccuucuuguuauccuugcag

SEQ ID NO: 2919151 - RNA, 20 nt, Human T-lymphotropic virus 1
aucccguggaggcuccucaa

SEQ ID NO: 2919152 - RNA, 14 nt, Human T-lymphotropic virus 1
agccaucuuuagua

SEQ ID NO: 2919153 - RNA, 20 nt, Human T-lymphotropic virus 1
ucaagcacaguuuccuccuc

SEQ ID NO: 2919154 - RNA, 13 nt, Human T-lymphotropic virus 1
aucugaccacccc

SEQ ID NO: 2919155 - RNA, 19 nt, Human T-lymphotropic virus 1
agacccgucggaggccccg

SEQ ID NO: 2919156 - RNA, 13 nt, Human T-lymphotropic virus 1
caccgccccuccu

SEQ ID NO: 2919157 - RNA, 14 nt, Human T-lymphotropic virus 1
gauuuuauucuucc

SEQ ID NO: 2919158 - RNA, 12 nt, Human T-lymphotropic virus 1
caacauuccacc

SEQ ID NO: 2919159 - RNA, 22 nt, Human T-lymphotropic virus 1
cccgggggcuuagagccucuca

SEQ ID NO: 2919160 - RNA, 18 nt, Human T-lymphotropic virus 1
ccacucaacccucaccac

SEQ ID NO: 2919161 - RNA, 15 nt, Human T-lymphotropic virus 1
cugcaugcccaagac

SEQ ID NO: 2919162 - RNA, 18 nt, Human T-lymphotropic virus 1
ccugaucccaucuccagg

SEQ ID NO: 2919163 - RNA, 16 nt, Human T-lymphotropic virus 1
cacgcauacggcucaa

SEQ ID NO: 2919164 - RNA, 16 nt, Human T-lymphotropic virus 1
uaagcucaccucccuu

SEQ ID NO: 2919165 - RNA, 16 nt, Human T-lymphotropic virus 1
acuccugacucuuguc

SEQ ID NO: 2919166 - RNA, 19 nt, Human T-lymphotropic virus 1
cauaacucccucauccugc

SEQ ID NO: 2919167 - RNA, 19 nt, Human T-lymphotropic virus 1
ggagccuaccuagacucag

SEQ ID NO: 2919168 - RNA, 13 nt, Human T-lymphotropic virus 1
aucuauucccuca

SEQ ID NO: 2919169 - RNA, 19 nt, Human T-lymphotropic virus 1
cuaaacaguuccagcccua

SEQ ID NO: 2919170 - RNA, 20 nt, Human T-lymphotropic virus 1
ucuagucgacgcuccaggau

SEQ ID NO: 2919171 - RNA, 12 nt, Human T-lymphotropic virus 1
auuacagcccca

SEQ ID NO: 2919172 - RNA, 18 nt, Human T-lymphotropic virus 1
ccaccuguccagagcauc

SEQ ID NO: 2919173 - RNA, 20 nt, Human T-lymphotropic virus 1
cuagacucagccggcucucc

SEQ ID NO: 2919174 - RNA, 17 nt, Human T-lymphotropic virus 1
uuaugcugacccucacu

SEQ ID NO: 2919175 - RNA, 18 nt, Human T-lymphotropic virus 1
cuugucuccgcccuggcc

SEQ ID NO: 2919176 - RNA, 17 nt, Human T-lymphotropic virus 1
cccuaauaauucuaccc

SEQ ID NO: 2919177 - RNA, 21 nt, Human T-lymphotropic virus 1
cugccaacuacacuagcccac

SEQ ID NO: 2919178 - RNA, 24 nt, Human T-lymphotropic virus 1
cacccuccuuccuccaggccaugc

SEQ ID NO: 2919179 - RNA, 14 nt, Human T-lymphotropic virus 1
ugccccuccuaggg

SEQ ID NO: 2919180 - RNA, 19 nt, Human T-lymphotropic virus 1
aggcccuacagccacccug

SEQ ID NO: 2919181 - RNA, 14 nt, Human T-lymphotropic virus 1
ccuugaucuccugu

SEQ ID NO: 2919182 - RNA, 23 nt, Human T-lymphotropic virus 1
guuuucagacggauccaccuccc

SEQ ID NO: 2919183 - RNA, 22 nt, Human T-lymphotropic virus 1
caccagcucaggcuaggcccug

SEQ ID NO: 2919184 - RNA, 17 nt, Human T-lymphotropic virus 1
uucagacggauccaccu

SEQ ID NO: 2919185 - RNA, 17 nt, Human T-lymphotropic virus 1
cccguggaggcuccuca

SEQ ID NO: 2919186 - RNA, 16 nt, Human T-lymphotropic virus 1
ugaucccaucuccagg

SEQ ID NO: 2919187 - RNA, 23 nt, Human T-lymphotropic virus 1
cuauggacuacucugccaaacca

SEQ ID NO: 2919188 - RNA, 18 nt, Human T-lymphotropic virus 1
gauuacagccccagcugc

SEQ ID NO: 2919189 - RNA, 17 nt, Human T-lymphotropic virus 1
ugcauccuccgucagcu

SEQ ID NO: 2919190 - RNA, 11 nt, Human T-lymphotropic virus 1
cgccuccagcc

SEQ ID NO: 2919191 - RNA, 17 nt, Human T-lymphotropic virus 1
uccuugucaccuguucc

SEQ ID NO: 2919192 - RNA, 23 nt, Human T-lymphotropic virus 1
uccuucacgcgcccgccgccuua

SEQ ID NO: 2919193 - RNA, 13 nt, Human T-lymphotropic virus 1
aggcuaggcccug

SEQ ID NO: 2919194 - RNA, 21 nt, Human T-lymphotropic virus 1
cauugccuaucuaggcaagcc

SEQ ID NO: 2919195 - RNA, 18 nt, Human T-lymphotropic virus 1
ccaaaucccccuaccuaa

SEQ ID NO: 2919196 - RNA, 21 nt, Human T-lymphotropic virus 1
cagccuccaaggacuccaccu

SEQ ID NO: 2919197 - RNA, 14 nt, Human T-lymphotropic virus 1
uaagcucagaccuc

SEQ ID NO: 2919198 - RNA, 14 nt, Human T-lymphotropic virus 1
acccuccuuccucc

SEQ ID NO: 2919199 - RNA, 14 nt, Human T-lymphotropic virus 1
ucaccucccuuccu

SEQ ID NO: 2919200 - RNA, 19 nt, Human T-lymphotropic virus 1
gaacccuacaccgggccag

SEQ ID NO: 2919201 - RNA, 18 nt, Human T-lymphotropic virus 1
gccucccgccuguggugc

SEQ ID NO: 2919202 - RNA, 23 nt, Human T-lymphotropic virus 1
cagaucaggcccuacagccaccc

SEQ ID NO: 2919203 - RNA, 23 nt, Human T-lymphotropic virus 1
cuguccugcagcucucuccugca

SEQ ID NO: 2919204 - RNA, 13 nt, Human T-lymphotropic virus 1
caaggacacaucc

SEQ ID NO: 2919205 - RNA, 16 nt, Human T-lymphotropic virus 1
gccagugccccugggg

SEQ ID NO: 2919206 - RNA, 15 nt, Human T-lymphotropic virus 1
ucuccauuuuucaaa

SEQ ID NO: 2919207 - RNA, 20 nt, Human T-lymphotropic virus 1
cagaacgccuccaggccuug

SEQ ID NO: 2919208 - RNA, 19 nt, Human T-lymphotropic virus 1
cuaugcuguuucgccuucu

SEQ ID NO: 2919209 - RNA, 18 nt, Human T-lymphotropic virus 1
gggcuagaacaccuccca

SEQ ID NO: 2919210 - RNA, 12 nt, Human T-lymphotropic virus 1
acugccucccac

SEQ ID NO: 2919211 - RNA, 12 nt, Human T-lymphotropic virus 1
uaggugcccaga

SEQ ID NO: 2919212 - RNA, 19 nt, Human T-lymphotropic virus 1
accagaacgccuccaggcc

SEQ ID NO: 2919213 - RNA, 19 nt, Human T-lymphotropic virus 1
cuaucuaggcaagccuagc

SEQ ID NO: 2919214 - RNA, 19 nt, Human T-lymphotropic virus 1
acaaccccucaccucaaaa

SEQ ID NO: 2919215 - RNA, 16 nt, Human T-lymphotropic virus 1
cuccccucaaaaacac

SEQ ID NO: 2919216 - RNA, 23 nt, Human T-lymphotropic virus 1
aguguuccuaucuuacuccacca

SEQ ID NO: 2919217 - RNA, 15 nt, Human T-lymphotropic virus 1
gccuucucagccccu

SEQ ID NO: 2919218 - RNA, 15 nt, Human T-lymphotropic virus 1
caggcccuccugccc

SEQ ID NO: 2919219 - RNA, 17 nt, Human T-lymphotropic virus 1
aggcaccuuccaaggca

SEQ ID NO: 2919220 - RNA, 23 nt, Human T-lymphotropic virus 1
gacccuuguuccuuaaaaugccc

SEQ ID NO: 2919221 - RNA, 14 nt, Human T-lymphotropic virus 1
ccgcggcuuuccuc

SEQ ID NO: 2919222 - RNA, 14 nt, Human T-lymphotropic virus 1
aaguuacuccagcu

SEQ ID NO: 2919223 - RNA, 19 nt, Human T-lymphotropic virus 1
acacuuuucuuaaaacaac

SEQ ID NO: 2919224 - RNA, 14 nt, Human T-lymphotropic virus 1
cucucacagugggc

SEQ ID NO: 2919225 - RNA, 19 nt, Human T-lymphotropic virus 1
uacaugccccccuacccca

SEQ ID NO: 2919226 - RNA, 21 nt, Human T-lymphotropic virus 1
cucccuaaccacaucuggcaa

SEQ ID NO: 2919227 - RNA, 19 nt, Human T-lymphotropic virus 1
cuuccucuucuccucagcc

SEQ ID NO: 2919228 - RNA, 12 nt, Human T-lymphotropic virus 1
uagacucagccg

SEQ ID NO: 2919229 - RNA, 15 nt, Human T-lymphotropic virus 1
gcggcuuuccucuuc

SEQ ID NO: 2919230 - RNA, 22 nt, Human T-lymphotropic virus 1
uucuccugcagcaaccuccucc

SEQ ID NO: 2919231 - RNA, 22 nt, Human T-lymphotropic virus 1
agccgucuccagccccuacugg

SEQ ID NO: 2919232 - RNA, 15 nt, Human T-lymphotropic virus 1
ccuccuucuccugca

SEQ ID NO: 2919233 - RNA, 13 nt, Human T-lymphotropic virus 1
cgaaacagcccua

SEQ ID NO: 2919234 - RNA, 15 nt, Human T-lymphotropic virus 1
ucaggcccccuuuca

SEQ ID NO: 2919235 - RNA, 18 nt, Human T-lymphotropic virus 1
cgaggccuugaucuccug

SEQ ID NO: 2919236 - RNA, 18 nt, Human T-lymphotropic virus 1
acccucaccacuccaggc

SEQ ID NO: 2919237 - RNA, 20 nt, Human T-lymphotropic virus 1
uccaaggacuccaccucgcc

SEQ ID NO: 2919238 - RNA, 18 nt, Human T-lymphotropic virus 1
acgccuuuuuccaaaucc

SEQ ID NO: 2919239 - RNA, 15 nt, Human T-lymphotropic virus 1
cccagagacacauuc

SEQ ID NO: 2919240 - RNA, 13 nt, Human T-lymphotropic virus 1
ccucuacucuccc

SEQ ID NO: 2919241 - RNA, 23 nt, Human T-lymphotropic virus 1
cauccucggugauuacagcccca

SEQ ID NO: 2919242 - RNA, 11 nt, Human T-lymphotropic virus 1
gucuccucccc

SEQ ID NO: 2919243 - RNA, 14 nt, Human T-lymphotropic virus 1
aacgccuccaggcc

SEQ ID NO: 2919244 - RNA, 22 nt, Human T-lymphotropic virus 1
caacauuccacccuccuuccuc

SEQ ID NO: 2919245 - RNA, 17 nt, Human T-lymphotropic virus 1
aacucuuccuccaagga

SEQ ID NO: 2919246 - RNA, 21 nt, Human T-lymphotropic virus 1
ccagaacagacgaggccuuga

SEQ ID NO: 2919247 - RNA, 22 nt, Human T-lymphotropic virus 1
caaggcguccuguaccucccug

SEQ ID NO: 2919248 - RNA, 16 nt, Human T-lymphotropic virus 1
cauggccucuccagcg

SEQ ID NO: 2919249 - RNA, 23 nt, Human T-lymphotropic virus 1
agcaaccuccuccguucagccuc

SEQ ID NO: 2919250 - RNA, 19 nt, Human T-lymphotropic virus 1
ggcccagaauaaggcucug

SEQ ID NO: 2919251 - RNA, 21 nt, Human T-lymphotropic virus 1
cugccccauuggcuccuguga

SEQ ID NO: 2919252 - RNA, 17 nt, Human T-lymphotropic virus 1
uaauaccgaacccagcc

SEQ ID NO: 2919253 - RNA, 16 nt, Human T-lymphotropic virus 1
ugacuuguccagccug

SEQ ID NO: 2919254 - RNA, 13 nt, Human T-lymphotropic virus 1
cugccgccucccg

SEQ ID NO: 2919255 - RNA, 18 nt, Human T-lymphotropic virus 1
cacaguaugcugcccaga

SEQ ID NO: 2919256 - RNA, 15 nt, Human T-lymphotropic virus 1
aggcgacauuaccca

SEQ ID NO: 2919257 - RNA, 14 nt, Human T-lymphotropic virus 1
cuccuucuccugca

SEQ ID NO: 2919258 - RNA, 13 nt, Human T-lymphotropic virus 1
cuauacucuccca

SEQ ID NO: 2919259 - RNA, 23 nt, Human T-lymphotropic virus 1
cccaacccugucuuuuccagacc

SEQ ID NO: 2919260 - RNA, 20 nt, Human T-lymphotropic virus 1
guccaccaauuccuccacca

SEQ ID NO: 2919261 - RNA, 13 nt, Human T-lymphotropic virus 1
agccccccaccug

SEQ ID NO: 2919262 - RNA, 19 nt, Human T-lymphotropic virus 1
ucaagcacaguuuccuccu

SEQ ID NO: 2919263 - RNA, 14 nt, Human T-lymphotropic virus 1
aucagccaguuccc

SEQ ID NO: 2919264 - RNA, 14 nt, Human T-lymphotropic virus 1
uggccucuccagcg

SEQ ID NO: 2919265 - RNA, 17 nt, Human T-lymphotropic virus 1
ccuaucuuacuccacca

SEQ ID NO: 2919266 - RNA, 19 nt, Human T-lymphotropic virus 1
cuuuucuuaaaacaacugc

SEQ ID NO: 2919267 - RNA, 13 nt, Human T-lymphotropic virus 1
ccccaacauucca

SEQ ID NO: 2919268 - RNA, 15 nt, Human T-lymphotropic virus 1
uagaacaccucccaa

SEQ ID NO: 2919269 - RNA, 18 nt, Human T-lymphotropic virus 1
gcccauauccugcagccc

SEQ ID NO: 2919270 - RNA, 19 nt, Human T-lymphotropic virus 1
cacugugguguuccagucc

SEQ ID NO: 2919271 - RNA, 16 nt, Human T-lymphotropic virus 1
aagucagcggccuucu

SEQ ID NO: 2919272 - RNA, 19 nt, Human T-lymphotropic virus 1
agcucagcaccagcucagg

SEQ ID NO: 2919273 - RNA, 19 nt, Human T-lymphotropic virus 1
cagagacacauucccucag

SEQ ID NO: 2919274 - RNA, 19 nt, Human T-lymphotropic virus 1
aucaggcccuacagccacc

SEQ ID NO: 2919275 - RNA, 23 nt, Human T-lymphotropic virus 1
uacaggagccgucuccagccccu

SEQ ID NO: 2919276 - RNA, 21 nt, Human T-lymphotropic virus 1
ggggacuauguucggcccgcc

SEQ ID NO: 2919277 - RNA, 18 nt, Human T-lymphotropic virus 1
gcucagaagcuauuuccu

SEQ ID NO: 2919278 - RNA, 16 nt, Human T-lymphotropic virus 1
gcccgccgccuuaccu

SEQ ID NO: 2919279 - RNA, 19 nt, Human T-lymphotropic virus 1
accucaauauuaaucucca

SEQ ID NO: 2919280 - RNA, 18 nt, Human T-lymphotropic virus 1
cccuccucuacucuccca

SEQ ID NO: 2919281 - RNA, 21 nt, Human T-lymphotropic virus 1
ccugcccuaaagauggccagc

SEQ ID NO: 2919282 - RNA, 13 nt, Human T-lymphotropic virus 1
cucagccggcucu

SEQ ID NO: 2919283 - RNA, 14 nt, Human T-lymphotropic virus 1
ccuuccgccaccgc

SEQ ID NO: 2919284 - RNA, 15 nt, Human T-lymphotropic virus 1
uggaggcuccucaag

SEQ ID NO: 2919285 - RNA, 21 nt, Human T-lymphotropic virus 1
accugaucccaucuccaggcu

SEQ ID NO: 2919286 - RNA, 16 nt, Human T-lymphotropic virus 1
uccucuacucucccac

SEQ ID NO: 2919287 - RNA, 11 nt, Human T-lymphotropic virus 1
caucucuccuu

SEQ ID NO: 2919288 - RNA, 14 nt, Human T-lymphotropic virus 1
cgccuucucagccc

SEQ ID NO: 2919289 - RNA, 16 nt, Human T-lymphotropic virus 1
uacgccagccccuuca

SEQ ID NO: 2919290 - RNA, 21 nt, Human T-lymphotropic virus 1
gccucccaccgccccuccucu

SEQ ID NO: 2919291 - RNA, 19 nt, Human T-lymphotropic virus 1
uuauugcaaccacaucgcc

SEQ ID NO: 2919292 - RNA, 13 nt, Human T-lymphotropic virus 1
caugcccaagacc

SEQ ID NO: 2919293 - RNA, 15 nt, Human T-lymphotropic virus 1
gacaccuccccucgc

SEQ ID NO: 2919294 - RNA, 21 nt, Human T-lymphotropic virus 1
ucgccucaggaaagagccucc

SEQ ID NO: 2919295 - RNA, 18 nt, Human T-lymphotropic virus 1
aggcucaacgcucucaca

SEQ ID NO: 2919296 - RNA, 21 nt, Human T-lymphotropic virus 1
uuccaguucugcccccucauc

SEQ ID NO: 2919297 - RNA, 19 nt, Human T-lymphotropic virus 1
caugggagccggaguggcu

SEQ ID NO: 2919298 - RNA, 16 nt, Human T-lymphotropic virus 1
cagcuucaccacuccc

SEQ ID NO: 2919299 - RNA, 14 nt, Human T-lymphotropic virus 1
aucaaauccuccuu

SEQ ID NO: 2919300 - RNA, 16 nt, Human T-lymphotropic virus 1
ccucuuugcuccaggc

SEQ ID NO: 2919301 - RNA, 16 nt, Human T-lymphotropic virus 1
acaacugaggccucca

SEQ ID NO: 2919302 - RNA, 22 nt, Human T-lymphotropic virus 1
gcaauagucaaaaaccacaaaa

SEQ ID NO: 2919303 - RNA, 12 nt, Human T-lymphotropic virus 1
cucuacaguucc

SEQ ID NO: 2919304 - RNA, 20 nt, Human T-lymphotropic virus 1
uugucacaaagaucauuccc

SEQ ID NO: 2919305 - RNA, 23 nt, Human T-lymphotropic virus 1
cuaaacccugcaauccugcccag

SEQ ID NO: 2919306 - RNA, 22 nt, Human T-lymphotropic virus 1
gucuccaaaggaacuccuaccu

SEQ ID NO: 2919307 - RNA, 17 nt, Human T-lymphotropic virus 1
aucaccuggccccuccu

SEQ ID NO: 2919308 - RNA, 22 nt, Human T-lymphotropic virus 1
gaucaggcccuacagccacccu

SEQ ID NO: 2919309 - RNA, 19 nt, Human T-lymphotropic virus 1
ccacaucgccuccagccuc

SEQ ID NO: 2919310 - RNA, 16 nt, Human T-lymphotropic virus 1
auuacagccccagcug

SEQ ID NO: 2919311 - RNA, 14 nt, Human T-lymphotropic virus 1
acucucccacucua

SEQ ID NO: 2919312 - RNA, 17 nt, Human T-lymphotropic virus 1
gacucagccggcucucc

SEQ ID NO: 2919313 - RNA, 17 nt, Human T-lymphotropic virus 1
ccuauggacuacucugc

SEQ ID NO: 2919314 - RNA, 12 nt, Human T-lymphotropic virus 1
cagcggccuucu

SEQ ID NO: 2919315 - RNA, 21 nt, Human T-lymphotropic virus 1
caggcccccuuucaggcccuc

SEQ ID NO: 2919316 - RNA, 19 nt, Human T-lymphotropic virus 1
aggcagguccucucaggcc

SEQ ID NO: 2919317 - RNA, 13 nt, Human T-lymphotropic virus 1
ucgcaucucuccu

SEQ ID NO: 2919318 - RNA, 17 nt, Human T-lymphotropic virus 1
ccuguccugcagcucuc

SEQ ID NO: 2919319 - RNA, 14 nt, Human T-lymphotropic virus 1
cuggccccuccugc

SEQ ID NO: 2919320 - RNA, 19 nt, Human T-lymphotropic virus 1
gcucaggcuaggcccugac

SEQ ID NO: 2919321 - RNA, 18 nt, Human T-lymphotropic virus 1
ucagcuacgacaccuccc

SEQ ID NO: 2919322 - RNA, 13 nt, Human T-lymphotropic virus 1
ccuuccuccaggc

SEQ ID NO: 2919323 - RNA, 22 nt, Human T-lymphotropic virus 1
cuucacagucucuacugugccu

SEQ ID NO: 2919324 - RNA, 21 nt, Human T-lymphotropic virus 1
ucgaccugcuggcccuuucag

SEQ ID NO: 2919325 - RNA, 19 nt, Human T-lymphotropic virus 1
caauccaaccagcuccgga

SEQ ID NO: 2919326 - RNA, 19 nt, Human T-lymphotropic virus 1
aacccugcaauccugccca

SEQ ID NO: 2919327 - RNA, 17 nt, Human T-lymphotropic virus 1
uccaaacccugccccuc

SEQ ID NO: 2919328 - RNA, 14 nt, Human T-lymphotropic virus 1
cagacggcccucac

SEQ ID NO: 2919329 - RNA, 18 nt, Human T-lymphotropic virus 1
cgcucuugccacgccugc

SEQ ID NO: 2919330 - RNA, 16 nt, Human T-lymphotropic virus 1
caguaugcugcccaga

SEQ ID NO: 2919331 - RNA, 16 nt, Human T-lymphotropic virus 1
cuagacucagccggcu

SEQ ID NO: 2919332 - RNA, 20 nt, Human T-lymphotropic virus 1
ccuaccuuacgccagccccu

SEQ ID NO: 2919333 - RNA, 14 nt, Human T-lymphotropic virus 1
cagaacgccuccag

SEQ ID NO: 2919334 - RNA, 18 nt, Human T-lymphotropic virus 1
acuccaccucgccuucca

SEQ ID NO: 2919335 - RNA, 13 nt, Human T-lymphotropic virus 1
ccccuccuucccc

SEQ ID NO: 2919336 - RNA, 13 nt, Human T-lymphotropic virus 1
cuccuuccuccag

SEQ ID NO: 2919337 - RNA, 20 nt, Human T-lymphotropic virus 1
cacuccccccgacuccagcc

SEQ ID NO: 2919338 - RNA, 12 nt, Human T-lymphotropic virus 1
cuggcaccacca

SEQ ID NO: 2919339 - RNA, 18 nt, Human T-lymphotropic virus 1
uaaacccugcaauccugc

SEQ ID NO: 2919340 - RNA, 16 nt, Human T-lymphotropic virus 1
acaauccaaccagcuc

SEQ ID NO: 2919341 - RNA, 13 nt, Human T-lymphotropic virus 1
gcaguccccaagg

SEQ ID NO: 2919342 - RNA, 13 nt, Human T-lymphotropic virus 1
ggccucuccagcg

SEQ ID NO: 2919343 - RNA, 19 nt, Human T-lymphotropic virus 1
acccugucuuuuccagacc

SEQ ID NO: 2919344 - RNA, 12 nt, Human T-lymphotropic virus 1
accaaaaacaac

SEQ ID NO: 2919345 - RNA, 13 nt, Human T-lymphotropic virus 1
cccagaccagcca

SEQ ID NO: 2919346 - RNA, 16 nt, Human T-lymphotropic virus 1
ccauacuacccauguc

SEQ ID NO: 2919347 - RNA, 18 nt, Human T-lymphotropic virus 1
gcuccugcucuuccugcu

SEQ ID NO: 2919348 - RNA, 17 nt, Human T-lymphotropic virus 1
gccagcuguccuugggc

SEQ ID NO: 2919349 - RNA, 15 nt, Human T-lymphotropic virus 1
ccaccaauuccucca

SEQ ID NO: 2919350 - RNA, 15 nt, Human T-lymphotropic virus 1
gacgucuccccccgg

SEQ ID NO: 2919351 - RNA, 15 nt, Human T-lymphotropic virus 1
uccaccaauuccucc

SEQ ID NO: 2919352 - RNA, 14 nt, Human T-lymphotropic virus 1
caccucgccuucca

SEQ ID NO: 2919353 - RNA, 14 nt, Human T-lymphotropic virus 1
ccgucuccagcccc

SEQ ID NO: 2919354 - RNA, 16 nt, Human T-lymphotropic virus 1
gucuauuugcaccacg

SEQ ID NO: 2919355 - RNA, 23 nt, Human T-lymphotropic virus 1
ccucucccaucaaauccuccuuc

SEQ ID NO: 2919356 - RNA, 15 nt, Human T-lymphotropic virus 1
acaaagauauuuccc

SEQ ID NO: 2919357 - RNA, 21 nt, Human T-lymphotropic virus 1
cagccugcuagggcacccguc

SEQ ID NO: 2919358 - RNA, 17 nt, Human T-lymphotropic virus 1
ucauggaccugccccua

SEQ ID NO: 2919359 - RNA, 14 nt, Human T-lymphotropic virus 1
caaggcagguccuc

SEQ ID NO: 2919360 - RNA, 19 nt, Human T-lymphotropic virus 1
caucauaacaucuccaccc

SEQ ID NO: 2919361 - RNA, 12 nt, Human T-lymphotropic virus 1
ugccccccuacc

SEQ ID NO: 2919362 - RNA, 17 nt, Human T-lymphotropic virus 1
acucccucauccugccc

SEQ ID NO: 2919363 - RNA, 16 nt, Human T-lymphotropic virus 1
aucuccacccaaaccu

SEQ ID NO: 2919364 - RNA, 13 nt, Human T-lymphotropic virus 1
gaccaugcauccu

SEQ ID NO: 2919365 - RNA, 13 nt, Human T-lymphotropic virus 1
ccugccccccuuu

SEQ ID NO: 2919366 - RNA, 23 nt, Human T-lymphotropic virus 1
ugccuuacaacaaugccaaggcg

SEQ ID NO: 2919367 - RNA, 20 nt, Human T-lymphotropic virus 1
uggcccauauccugcagccc

SEQ ID NO: 2919368 - RNA, 16 nt, Human T-lymphotropic virus 1
gugaucauaaacaccg

SEQ ID NO: 2919369 - RNA, 19 nt, Human T-lymphotropic virus 1
acggcccucacacugcaag

SEQ ID NO: 2919370 - RNA, 21 nt, Human T-lymphotropic virus 1
agggggccaaacccaagauca

SEQ ID NO: 2919371 - RNA, 18 nt, Human T-lymphotropic virus 1
aucugcuuuuccuccucu

SEQ ID NO: 2919372 - RNA, 14 nt, Human T-lymphotropic virus 1
cccaacuccugcau

SEQ ID NO: 2919373 - RNA, 19 nt, Human T-lymphotropic virus 1
ggccuccuuccguuccacu

SEQ ID NO: 2919374 - RNA, 16 nt, Human T-lymphotropic virus 1
gagccuaccuagacuc

SEQ ID NO: 2919375 - RNA, 16 nt, Human T-lymphotropic virus 1
ccuaaccaagacccaa

SEQ ID NO: 2919376 - RNA, 18 nt, Human T-lymphotropic virus 1
acgcuuugccugacccug

SEQ ID NO: 2919377 - RNA, 20 nt, Human T-lymphotropic virus 1
aaucauggaccugccccuau

SEQ ID NO: 2919378 - RNA, 20 nt, Human T-lymphotropic virus 1
aauacaggcgccagcugucc

SEQ ID NO: 2919379 - RNA, 12 nt, Human T-lymphotropic virus 1
cauucuccuggc

SEQ ID NO: 2919380 - RNA, 12 nt, Human T-lymphotropic virus 1
uacucccccuuc

SEQ ID NO: 2919381 - RNA, 20 nt, Human T-lymphotropic virus 1
cgcucccuuggagccuaccu

SEQ ID NO: 2919382 - RNA, 15 nt, Human T-lymphotropic virus 1
augucaauuuuacuc

SEQ ID NO: 2919383 - RNA, 14 nt, Human T-lymphotropic virus 1
uccuucucccuucu

SEQ ID NO: 2919384 - RNA, 14 nt, Human T-lymphotropic virus 1
uccagccuccccug

SEQ ID NO: 2919385 - RNA, 23 nt, Human T-lymphotropic virus 1
uucuccuccgcccgcuuccugcg

SEQ ID NO: 2919386 - RNA, 14 nt, Human T-lymphotropic virus 1
gacccuugcccuag

SEQ ID NO: 2919387 - RNA, 14 nt, Human T-lymphotropic virus 1
gaacuccuaccuua

SEQ ID NO: 2919388 - RNA, 14 nt, Human T-lymphotropic virus 1
caggagccaucuca

SEQ ID NO: 2919389 - RNA, 20 nt, Human T-lymphotropic virus 1
agucuccucccccugucaua

SEQ ID NO: 2919390 - RNA, 17 nt, Human T-lymphotropic virus 1
caaaaacaacugggcca

SEQ ID NO: 2919391 - RNA, 13 nt, Human T-lymphotropic virus 1
gcugacagccugg

SEQ ID NO: 2919392 - RNA, 17 nt, Human T-lymphotropic virus 1
cugcagcaaccuccucc

SEQ ID NO: 2919393 - RNA, 20 nt, Human T-lymphotropic virus 1
ccggcuccaugucccucgcc

SEQ ID NO: 2919394 - RNA, 22 nt, Human T-lymphotropic virus 1
cugcgccgugccuucuccucuu

SEQ ID NO: 2919395 - RNA, 22 nt, Human T-lymphotropic virus 1
aucauaggucgugaugccuuac

SEQ ID NO: 2919396 - RNA, 18 nt, Human T-lymphotropic virus 1
acucccuaaccacaucug

SEQ ID NO: 2919397 - RNA, 14 nt, Human T-lymphotropic virus 1
caguuccagcccua

SEQ ID NO: 2919398 - RNA, 16 nt, Human T-lymphotropic virus 1
cuccucuacucuccca

SEQ ID NO: 2919399 - RNA, 14 nt, Human T-lymphotropic virus 1
caauccugcccagc

SEQ ID NO: 2919400 - RNA, 17 nt, Human T-lymphotropic virus 1
cuacacuagcccacuua

SEQ ID NO: 2919401 - RNA, 14 nt, Human T-lymphotropic virus 1
aucuauucccucau

SEQ ID NO: 2919402 - RNA, 16 nt, Human T-lymphotropic virus 1
caauccugcccagcca

SEQ ID NO: 2919403 - RNA, 17 nt, Human T-lymphotropic virus 1
cucccaacgucucuguu

SEQ ID NO: 2919404 - RNA, 15 nt, Human T-lymphotropic virus 1
gcagcaaccuccucc

SEQ ID NO: 2919405 - RNA, 16 nt, Human T-lymphotropic virus 1
cagcuacgacaccucc

SEQ ID NO: 2919406 - RNA, 14 nt, Human T-lymphotropic virus 1
cggauccaccuccc

SEQ ID NO: 2919407 - RNA, 12 nt, Human T-lymphotropic virus 1
acaccucaauau

SEQ ID NO: 2919408 - RNA, 20 nt, Human T-lymphotropic virus 1
gcccagaauaaggcucugac

SEQ ID NO: 2919409 - RNA, 12 nt, Human T-lymphotropic virus 1
ccgucuccagcc

SEQ ID NO: 2919410 - RNA, 16 nt, Human T-lymphotropic virus 1
aacccugccccuccua

SEQ ID NO: 2919411 - RNA, 23 nt, Human T-lymphotropic virus 1
ccccuacaauccaaccagcuccg

SEQ ID NO: 2919412 - RNA, 19 nt, Human T-lymphotropic virus 1
aaccacaacugaggccucc

SEQ ID NO: 2919413 - RNA, 15 nt, Human T-lymphotropic virus 1
gcaccagcucaggcu

SEQ ID NO: 2919414 - RNA, 15 nt, Human T-lymphotropic virus 1
gggcagcaccuccca

SEQ ID NO: 2919415 - RNA, 15 nt, Human T-lymphotropic virus 1
cauccugccccccuu

SEQ ID NO: 2919416 - RNA, 16 nt, Human T-lymphotropic virus 1
ucacucauacaacccc

SEQ ID NO: 2919417 - RNA, 19 nt, Human T-lymphotropic virus 1
gaucacuuuaagcucaccu

SEQ ID NO: 2919418 - RNA, 18 nt, Human T-lymphotropic virus 1
uccugcagcaaccuccuc

SEQ ID NO: 2919419 - RNA, 21 nt, Human T-lymphotropic virus 1
ccuugcccuaggcaccuucca

SEQ ID NO: 2919420 - RNA, 21 nt, Human T-lymphotropic virus 1
ucaaucauuagugcagcugcg

SEQ ID NO: 2919421 - RNA, 21 nt, Human T-lymphotropic virus 1
aaccuccuccguucagccucc

SEQ ID NO: 2919422 - RNA, 13 nt, Human T-lymphotropic virus 1
cccuguccugcag

SEQ ID NO: 2919423 - RNA, 13 nt, Human T-lymphotropic virus 1
cgacgcuccagga

SEQ ID NO: 2919424 - RNA, 23 nt, Human T-lymphotropic virus 1
agacuaguccaaacccugccccu

SEQ ID NO: 2919425 - RNA, 18 nt, Human T-lymphotropic virus 1
ucucagccccuugucucc

SEQ ID NO: 2919426 - RNA, 19 nt, Human T-lymphotropic virus 1
agcacuaauuauacuugca

SEQ ID NO: 2919427 - RNA, 20 nt, Human T-lymphotropic virus 1
uccuccuuguccuuuaacuc

SEQ ID NO: 2919428 - RNA, 19 nt, Human T-lymphotropic virus 1
cagauugacacccagacca

SEQ ID NO: 2919429 - RNA, 16 nt, Human T-lymphotropic virus 1
ccaugucccucgccuc

SEQ ID NO: 2919430 - RNA, 18 nt, Human T-lymphotropic virus 1
aucugaccaccccagugu

SEQ ID NO: 2919431 - RNA, 14 nt, Human T-lymphotropic virus 1
uccucuuucucccg

SEQ ID NO: 2919432 - RNA, 16 nt, Human T-lymphotropic virus 1
gcaccagcucaggcua

SEQ ID NO: 2919433 - RNA, 23 nt, Human T-lymphotropic virus 1
cgcccuacuggccaccuguccag

SEQ ID NO: 2919434 - RNA, 15 nt, Human T-lymphotropic virus 1
acacuagcccacuua

SEQ ID NO: 2919435 - RNA, 16 nt, Human T-lymphotropic virus 1
caacaaugccaaggcg

SEQ ID NO: 2919436 - RNA, 17 nt, Human T-lymphotropic virus 1
accggcuccaugucccu

SEQ ID NO: 2919437 - RNA, 22 nt, Human T-lymphotropic virus 1
cgucacgcccuacuggccaccu

SEQ ID NO: 2919438 - RNA, 23 nt, Human T-lymphotropic virus 1
ccggaggacagcucagcaccagc

SEQ ID NO: 2919439 - RNA, 19 nt, Human T-lymphotropic virus 1
agccccuugucuccacuug

SEQ ID NO: 2919440 - RNA, 14 nt, Human T-lymphotropic virus 1
aagcccuuaugcca

SEQ ID NO: 2919441 - RNA, 19 nt, Human T-lymphotropic virus 1
uccuggcaagccccuccca

SEQ ID NO: 2919442 - RNA, 19 nt, Human T-lymphotropic virus 1
ccuaaacaguuccagcccu

SEQ ID NO: 2919443 - RNA, 15 nt, Human T-lymphotropic virus 1
accugggaccccauc

SEQ ID NO: 2919444 - RNA, 16 nt, Human T-lymphotropic virus 1
ugcgccgugccuucuc

SEQ ID NO: 2919445 - RNA, 16 nt, Human T-lymphotropic virus 1
aaguacuuuacugaca

SEQ ID NO: 2919446 - RNA, 20 nt, Human T-lymphotropic virus 1
caucguuagcgcuuccagcc

SEQ ID NO: 2919447 - RNA, 21 nt, Human T-lymphotropic virus 1
cuacucccuaaccacaucugg

SEQ ID NO: 2919448 - RNA, 16 nt, Human T-lymphotropic virus 1
auugacacccagacca

SEQ ID NO: 2919449 - RNA, 18 nt, Human T-lymphotropic virus 1
uccgcccuggccauggga

SEQ ID NO: 2919450 - RNA, 17 nt, Human T-lymphotropic virus 1
ccaccucccaggcagcc

SEQ ID NO: 2919451 - RNA, 12 nt, Human T-lymphotropic virus 1
acccuccuuccu

SEQ ID NO: 2919452 - RNA, 18 nt, Human T-lymphotropic virus 1
agccauaccaaucuaccu

SEQ ID NO: 2919453 - RNA, 23 nt, Human T-lymphotropic virus 1
cccguccaccaauuccuccacca

SEQ ID NO: 2919454 - RNA, 17 nt, Human T-lymphotropic virus 1
acccugcaauccugccc

SEQ ID NO: 2919455 - RNA, 21 nt, Human T-lymphotropic virus 1
ccuauuguuuuaacaucuugc

SEQ ID NO: 2919456 - RNA, 22 nt, Human T-lymphotropic virus 1
cauaccacucuaaacccugcaa

SEQ ID NO: 2919457 - RNA, 22 nt, Human T-lymphotropic virus 1
ccaaacccugccccuccuaggg

SEQ ID NO: 2919458 - RNA, 14 nt, Human T-lymphotropic virus 1
uccagccugccaac

SEQ ID NO: 2919459 - RNA, 15 nt, Human T-lymphotropic virus 1
ccucccgccuguggu

SEQ ID NO: 2919460 - RNA, 23 nt, Human T-lymphotropic virus 1
acccagucuacguguuuggagac

SEQ ID NO: 2919461 - RNA, 22 nt, Human T-lymphotropic virus 1
augacauucuccuggcaagccc

SEQ ID NO: 2919462 - RNA, 22 nt, Human T-lymphotropic virus 1
gacuaguccaaacccugccccu

SEQ ID NO: 2919463 - RNA, 16 nt, Human T-lymphotropic virus 1
cagcaccucccaaccc

SEQ ID NO: 2919464 - RNA, 22 nt, Human T-lymphotropic virus 1
ccaugcgcaaauacucccccuu

SEQ ID NO: 2919465 - RNA, 14 nt, Human T-lymphotropic virus 1
cauggccucuccag

SEQ ID NO: 2919466 - RNA, 21 nt, Human T-lymphotropic virus 1
cuacacaguuucacccauugc

SEQ ID NO: 2919467 - RNA, 20 nt, Human T-lymphotropic virus 1
cacccuugucgcgcuacucc

SEQ ID NO: 2919468 - RNA, 19 nt, Human T-lymphotropic virus 1
cucagaccuccgggaagcc

SEQ ID NO: 2919469 - RNA, 12 nt, Human T-lymphotropic virus 1
uacgccagcccc

SEQ ID NO: 2919470 - RNA, 21 nt, Human T-lymphotropic virus 1
uccuccgcccgcuuccugcgc

SEQ ID NO: 2919471 - RNA, 21 nt, Human T-lymphotropic virus 1
cugccucccaccgccccuccu

SEQ ID NO: 2919472 - RNA, 20 nt, Human T-lymphotropic virus 1
cgggccacuaacucucuaac

SEQ ID NO: 2919473 - RNA, 20 nt, Human T-lymphotropic virus 1
cucaggaaagagccuccuac

SEQ ID NO: 2919474 - RNA, 12 nt, Human T-lymphotropic virus 1
cucuuccuuccu

SEQ ID NO: 2919475 - RNA, 19 nt, Human T-lymphotropic virus 1
ccaucguuagcgcuuccag

SEQ ID NO: 2919476 - RNA, 23 nt, Human T-lymphotropic virus 1
gcccaccacccuuuuccagccug

SEQ ID NO: 2919477 - RNA, 20 nt, Human T-lymphotropic virus 1
cuugggcuagaacaccuccc

SEQ ID NO: 2919478 - RNA, 17 nt, Human T-lymphotropic virus 1
cccugcaauccugccca

SEQ ID NO: 2919479 - RNA, 14 nt, Human T-lymphotropic virus 1
ugcaauccugccca

SEQ ID NO: 2919480 - RNA, 13 nt, Human T-lymphotropic virus 1
uggccucuccagc

SEQ ID NO: 2919481 - RNA, 16 nt, Human T-lymphotropic virus 1
uagccagugccccugg

SEQ ID NO: 2919482 - RNA, 18 nt, Human T-lymphotropic virus 1
caccucccaacccugucu

SEQ ID NO: 2919483 - RNA, 18 nt, Human T-lymphotropic virus 1
cucuguuccauccccuuc

SEQ ID NO: 2919484 - RNA, 23 nt, Human T-lymphotropic virus 1
ccgccuguaaucuugccaauaca

SEQ ID NO: 2919485 - RNA, 15 nt, Human T-lymphotropic virus 1
uacagccacccugcc

SEQ ID NO: 2919486 - RNA, 12 nt, Human T-lymphotropic virus 1
aaccccucaccu

SEQ ID NO: 2919487 - RNA, 21 nt, Human T-lymphotropic virus 1
cuccccuccuuccccacccag

SEQ ID NO: 2919488 - RNA, 21 nt, Human T-lymphotropic virus 1
uuaguacuacaguccuccucc

SEQ ID NO: 2919489 - RNA, 16 nt, Human T-lymphotropic virus 1
cccuccuuuacccauc

SEQ ID NO: 2919490 - RNA, 13 nt, Human T-lymphotropic virus 1
caugccccccuac

SEQ ID NO: 2919491 - RNA, 19 nt, Human T-lymphotropic virus 1
ccucauuucuacucucaca

SEQ ID NO: 2919492 - RNA, 17 nt, Human T-lymphotropic virus 1
ccaccaauuccuccacc

SEQ ID NO: 2919493 - RNA, 13 nt, Human T-lymphotropic virus 1
aaauauuacuaau

SEQ ID NO: 2919494 - RNA, 17 nt, Human T-lymphotropic virus 1
cucugccaaaccauaca

SEQ ID NO: 2919495 - RNA, 15 nt, Human T-lymphotropic virus 1
aaacaguuccagccc

SEQ ID NO: 2919496 - RNA, 14 nt, Human T-lymphotropic virus 1
ugcuuuuccuccuc

SEQ ID NO: 2919497 - RNA, 13 nt, Human T-lymphotropic virus 1
ccagccgauccca

SEQ ID NO: 2919498 - RNA, 17 nt, Human T-lymphotropic virus 1
uagcgcuuccagccccc

SEQ ID NO: 2919499 - RNA, 16 nt, Human T-lymphotropic virus 1
gucucuacugugccuu

SEQ ID NO: 2919500 - RNA, 16 nt, Human T-lymphotropic virus 1
uugcuuucacuguccc

SEQ ID NO: 2919501 - RNA, 17 nt, Human T-lymphotropic virus 1
uccaguucugcccccuc

SEQ ID NO: 2919502 - RNA, 11 nt, Human T-lymphotropic virus 1
cucgcaucucu

SEQ ID NO: 2919503 - RNA, 22 nt, Human T-lymphotropic virus 1
aucugcuuuuccuccucuuucu

SEQ ID NO: 2919504 - RNA, 15 nt, Human T-lymphotropic virus 1
cuauuauucagccuc

SEQ ID NO: 2919505 - RNA, 15 nt, Human T-lymphotropic virus 1
ucacgcgcccgccgc

SEQ ID NO: 2919506 - RNA, 23 nt, Human T-lymphotropic virus 1
ccccugugaucauaaacaccgcc

SEQ ID NO: 2919507 - RNA, 13 nt, Human T-lymphotropic virus 1
ggccuaccacccc

SEQ ID NO: 2919508 - RNA, 21 nt, Human T-lymphotropic virus 1
cagauacccccauuacucucu

SEQ ID NO: 2919509 - RNA, 21 nt, Human T-lymphotropic virus 1
uaccaccccucauuucuacuc

SEQ ID NO: 2919510 - RNA, 13 nt, Human T-lymphotropic virus 1
uccguucagccuc

SEQ ID NO: 2919511 - RNA, 17 nt, Human T-lymphotropic virus 1
ccaaaucccccuaccua

SEQ ID NO: 2919512 - RNA, 22 nt, Human T-lymphotropic virus 1
cacucuaaccuagaccauaucc

SEQ ID NO: 2919513 - RNA, 19 nt, Human T-lymphotropic virus 1
gaucccguggaggcuccuc

SEQ ID NO: 2919514 - RNA, 18 nt, Human T-lymphotropic virus 1
cgucacgcugacagccug

SEQ ID NO: 2919515 - RNA, 20 nt, Human T-lymphotropic virus 1
ccgucagcuacgacaccucc

SEQ ID NO: 2919516 - RNA, 15 nt, Human T-lymphotropic virus 1
auacucccccuuccg

SEQ ID NO: 2919517 - RNA, 15 nt, Human T-lymphotropic virus 1
aacacuuuucuuaaa

SEQ ID NO: 2919518 - RNA, 17 nt, Human T-lymphotropic virus 1
cuccagccgaucccaga

SEQ ID NO: 2919519 - RNA, 22 nt, Human T-lymphotropic virus 1
cugccaauaauuaaccucuccc

SEQ ID NO: 2919520 - RNA, 22 nt, Human T-lymphotropic virus 1
agcuaccaugccaccuauuccc

SEQ ID NO: 2919521 - RNA, 16 nt, Human T-lymphotropic virus 1
ccacaucgccuccagc

SEQ ID NO: 2919522 - RNA, 16 nt, Human T-lymphotropic virus 1
agacacauucccucag

SEQ ID NO: 2919523 - RNA, 17 nt, Human T-lymphotropic virus 1
caacugccccauuggcu

SEQ ID NO: 2919524 - RNA, 23 nt, Human T-lymphotropic virus 1
cugccucccaccgccccuccucu

SEQ ID NO: 2919525 - RNA, 13 nt, Human T-lymphotropic virus 1
uccuucucccuuc

SEQ ID NO: 2919526 - RNA, 13 nt, Human T-lymphotropic virus 1
uuuuccuccucuu

SEQ ID NO: 2919527 - RNA, 14 nt, Human T-lymphotropic virus 1
acgucuccccccgg

SEQ ID NO: 2919528 - RNA, 15 nt, Human T-lymphotropic virus 1
accccgccaaucacu

SEQ ID NO: 2919529 - RNA, 20 nt, Human T-lymphotropic virus 1
aucauggaccugccccuaua

SEQ ID NO: 2919530 - RNA, 13 nt, Human T-lymphotropic virus 1
gcaaucugcuuuu

SEQ ID NO: 2919531 - RNA, 22 nt, Human T-lymphotropic virus 1
caaccacaucgccuccagccuc

SEQ ID NO: 2919532 - RNA, 13 nt, Human T-lymphotropic virus 1
augaccccaucug

SEQ ID NO: 2919533 - RNA, 18 nt, Human T-lymphotropic virus 1
auaacucccucauccugc

SEQ ID NO: 2919534 - RNA, 14 nt, Human T-lymphotropic virus 1
cauggaacccaccc

SEQ ID NO: 2919535 - RNA, 19 nt, Human T-lymphotropic virus 1
cucucacagaugcccuacu

SEQ ID NO: 2919536 - RNA, 16 nt, Human T-lymphotropic virus 1
auugccuaucuaggca

SEQ ID NO: 2919537 - RNA, 19 nt, Human T-lymphotropic virus 1
cauggaugacauucuccug

SEQ ID NO: 2919538 - RNA, 16 nt, Human T-lymphotropic virus 1
aaccuagaccauaucc

SEQ ID NO: 2919539 - RNA, 21 nt, Human T-lymphotropic virus 1
cucagccccuugucuccacuu

SEQ ID NO: 2919540 - RNA, 12 nt, Human T-lymphotropic virus 1
cgccccuugccu

SEQ ID NO: 2919541 - RNA, 21 nt, Human T-lymphotropic virus 1
accccucauuucuacucucac

SEQ ID NO: 2919542 - RNA, 23 nt, Human T-lymphotropic virus 1
gccuccaggccuugcaacacuug

SEQ ID NO: 2919543 - RNA, 14 nt, Human T-lymphotropic virus 1
caccuggccccucc

SEQ ID NO: 2919544 - RNA, 13 nt, Human T-lymphotropic virus 1
accacccuuuucc

SEQ ID NO: 2919545 - RNA, 20 nt, Human T-lymphotropic virus 1
uacccaucguuagcgcuucc

SEQ ID NO: 2919546 - RNA, 13 nt, Human T-lymphotropic virus 1
acucucccacucu

SEQ ID NO: 2919547 - RNA, 14 nt, Human T-lymphotropic virus 1
uccaaccagcuccg

SEQ ID NO: 2919548 - RNA, 20 nt, Human T-lymphotropic virus 1
ucuuccaguucugcccccuc

SEQ ID NO: 2919549 - RNA, 17 nt, Human T-lymphotropic virus 1
cgccuguggugccuccu

SEQ ID NO: 2919550 - RNA, 16 nt, Human T-lymphotropic virus 1
ugcacuauucuucagu

SEQ ID NO: 2919551 - RNA, 23 nt, Human T-lymphotropic virus 1
uggagccuaccuagacucagccg

SEQ ID NO: 2919552 - RNA, 18 nt, Human T-lymphotropic virus 1
cccuacaauccaaccagc

SEQ ID NO: 2919553 - RNA, 12 nt, Human T-lymphotropic virus 1
ugauuacagccc

SEQ ID NO: 2919554 - RNA, 15 nt, Human T-lymphotropic virus 1
cuccucuuccuuccu

SEQ ID NO: 2919555 - RNA, 20 nt, Human T-lymphotropic virus 1
cagcagaucaggcccuacag

SEQ ID NO: 2919556 - RNA, 17 nt, Human T-lymphotropic virus 1
ugacgacaaccccucac

SEQ ID NO: 2919557 - RNA, 11 nt, Human T-lymphotropic virus 1
acaccuccccu

SEQ ID NO: 2919558 - RNA, 13 nt, Human T-lymphotropic virus 1
uaaccucucccau

SEQ ID NO: 2919559 - RNA, 16 nt, Human T-lymphotropic virus 1
caguggccacuugucu

SEQ ID NO: 2919560 - RNA, 20 nt, Human T-lymphotropic virus 1
cugucauaacucccucaucc

SEQ ID NO: 2919561 - RNA, 17 nt, Human T-lymphotropic virus 1
ucaacccccaacuccug

SEQ ID NO: 2919562 - RNA, 16 nt, Human T-lymphotropic virus 1
cccucaccacuccagg

SEQ ID NO: 2919563 - RNA, 12 nt, Human T-lymphotropic virus 1
aggacagcucag

SEQ ID NO: 2919564 - RNA, 12 nt, Human T-lymphotropic virus 1
cagggcccagaa

SEQ ID NO: 2919565 - RNA, 19 nt, Human T-lymphotropic virus 1
ccuccucuacucucccacu

SEQ ID NO: 2919566 - RNA, 23 nt, Human T-lymphotropic virus 1
gcccuuucagcagaucaggcccu

SEQ ID NO: 2919567 - RNA, 15 nt, Human T-lymphotropic virus 1
ucugcccccucaucc

SEQ ID NO: 2919568 - RNA, 18 nt, Human T-lymphotropic virus 1
caccacccuuuuccagcc

SEQ ID NO: 2919569 - RNA, 15 nt, Human T-lymphotropic virus 1
caccgccccuccucu

SEQ ID NO: 2919570 - RNA, 21 nt, Human T-lymphotropic virus 1
auccucggugauuacagcccc

SEQ ID NO: 2919571 - RNA, 19 nt, Human T-lymphotropic virus 1
gaccaccaacaccaugggu

SEQ ID NO: 2919572 - RNA, 20 nt, Human T-lymphotropic virus 1
aggcccuacagccacccugc

SEQ ID NO: 2919573 - RNA, 15 nt, Human T-lymphotropic virus 1
cagaauaaggcucug

SEQ ID NO: 2919574 - RNA, 13 nt, Human T-lymphotropic virus 1
cauccccuucuuc

SEQ ID NO: 2919575 - RNA, 15 nt, Human T-lymphotropic virus 1
ggacuacucugccaa

SEQ ID NO: 2919576 - RNA, 12 nt, Human T-lymphotropic virus 1
aguacuacccca

SEQ ID NO: 2919577 - RNA, 13 nt, Human T-lymphotropic virus 1
cacauucccucag

SEQ ID NO: 2919578 - RNA, 12 nt, Human T-lymphotropic virus 1
cccgacuccagc

SEQ ID NO: 2919579 - RNA, 17 nt, Human T-lymphotropic virus 1
ccugcagcaaccuccuc

SEQ ID NO: 2919580 - RNA, 13 nt, Human T-lymphotropic virus 1
ccagaccagccac

SEQ ID NO: 2919581 - RNA, 15 nt, Human T-lymphotropic virus 1
guaccucccugaggc

SEQ ID NO: 2919582 - RNA, 22 nt, Human T-lymphotropic virus 1
cacaaauuucaaaccaaggccu

SEQ ID NO: 2919583 - RNA, 14 nt, Human T-lymphotropic virus 1
caagccccucccau

SEQ ID NO: 2919584 - RNA, 13 nt, Human T-lymphotropic virus 1
uacuggccaccug

SEQ ID NO: 2919585 - RNA, 20 nt, Human T-lymphotropic virus 1
acacccucuggggaggcucc

SEQ ID NO: 2919586 - RNA, 15 nt, Human T-lymphotropic virus 1
acaguuuccuccucc

SEQ ID NO: 2919587 - RNA, 16 nt, Human T-lymphotropic virus 1
caccuuuucaggagcc

SEQ ID NO: 2919588 - RNA, 15 nt, Human T-lymphotropic virus 1
cacacuagccagugc

SEQ ID NO: 2919589 - RNA, 20 nt, Human T-lymphotropic virus 1
aggagccgucuccagccccu

SEQ ID NO: 2919590 - RNA, 15 nt, Human T-lymphotropic virus 1
ucgacaaauacaccu

SEQ ID NO: 2919591 - RNA, 14 nt, Human T-lymphotropic virus 1
ugacuuguccagcc

SEQ ID NO: 2919592 - RNA, 18 nt, Human T-lymphotropic virus 1
ccucuggggaggcuccgu

SEQ ID NO: 2919593 - RNA, 22 nt, Human T-lymphotropic virus 1
aagccuagcuacauaaacacag

SEQ ID NO: 2919594 - RNA, 19 nt, Human T-lymphotropic virus 1
uccaugucccucgccucag

SEQ ID NO: 2919595 - RNA, 20 nt, Human T-lymphotropic virus 1
acaggagccgucuccagccc

SEQ ID NO: 2919596 - RNA, 20 nt, Human T-lymphotropic virus 1
gccuaugauuuccgggcccu

SEQ ID NO: 2919597 - RNA, 16 nt, Human T-lymphotropic virus 1
cuggccccuccugccc

SEQ ID NO: 2919598 - RNA, 15 nt, Human T-lymphotropic virus 1
cgacaaccccucacc

SEQ ID NO: 2919599 - RNA, 19 nt, Human T-lymphotropic virus 1
cgcuccugcucuuccugcu

SEQ ID NO: 2919600 - RNA, 14 nt, Human T-lymphotropic virus 1
acugucccacagca

SEQ ID NO: 2919601 - RNA, 15 nt, Human T-lymphotropic virus 1
cccccaacuccugca

SEQ ID NO: 2919602 - RNA, 19 nt, Human T-lymphotropic virus 1
agcacaguuuccuccuccu

SEQ ID NO: 2919603 - RNA, 12 nt, Human T-lymphotropic virus 1
ugugaaagcccu

SEQ ID NO: 2919604 - RNA, 16 nt, Human T-lymphotropic virus 1
ccucgacuccccuccu

SEQ ID NO: 2919605 - RNA, 20 nt, Human T-lymphotropic virus 1
ccccugacuuguccagccug

SEQ ID NO: 2919606 - RNA, 14 nt, Human T-lymphotropic virus 1
acccuuguuccuua

SEQ ID NO: 2919607 - RNA, 15 nt, Human T-lymphotropic virus 1
ugcgccgugccuucu

SEQ ID NO: 2919608 - RNA, 16 nt, Human T-lymphotropic virus 1
uggcaccaccacugug

SEQ ID NO: 2919609 - RNA, 19 nt, Human T-lymphotropic virus 1
caccacuccccccgacucc

SEQ ID NO: 2919610 - RNA, 15 nt, Human T-lymphotropic virus 1
auccaaccagcuccg

SEQ ID NO: 2919611 - RNA, 19 nt, Human T-lymphotropic virus 1
aucaacccccaacuccugc

SEQ ID NO: 2919612 - RNA, 15 nt, Human T-lymphotropic virus 1
ccucauaccacucua

SEQ ID NO: 2919613 - RNA, 14 nt, Human T-lymphotropic virus 1
cuguggugccuccu

SEQ ID NO: 2919614 - RNA, 13 nt, Human T-lymphotropic virus 1
cauucccccuucc

SEQ ID NO: 2919615 - RNA, 20 nt, Human T-lymphotropic virus 1
uccuaccuuacgccagcccc

SEQ ID NO: 2919616 - RNA, 14 nt, Human T-lymphotropic virus 1
gccgcggcuuuccu

SEQ ID NO: 2919617 - RNA, 14 nt, Human T-lymphotropic virus 1
cagaucaggcccua

SEQ ID NO: 2919618 - RNA, 17 nt, Human T-lymphotropic virus 1
ccagaacgccuccaggc

SEQ ID NO: 2919619 - RNA, 14 nt, Human T-lymphotropic virus 1
gcucuuccugcuuu

SEQ ID NO: 2919620 - RNA, 19 nt, Human T-lymphotropic virus 1
uccaggccauugccuaucu

SEQ ID NO: 2919621 - RNA, 19 nt, Human T-lymphotropic virus 1
gccuaccuagacucagccg

SEQ ID NO: 2919622 - RNA, 23 nt, Human T-lymphotropic virus 1
uacaugccccccuaccccacacu

SEQ ID NO: 2919623 - RNA, 17 nt, Human T-lymphotropic virus 1
uccaccucgccuuccaa

SEQ ID NO: 2919624 - RNA, 19 nt, Human T-lymphotropic virus 1
acgcccuacuggccaccug

SEQ ID NO: 2919625 - RNA, 18 nt, Human T-lymphotropic virus 1
ccgucacgcugacagccu

SEQ ID NO: 2919626 - RNA, 18 nt, Human T-lymphotropic virus 1
cugauccccgagaccaaa

SEQ ID NO: 2919627 - RNA, 22 nt, Human T-lymphotropic virus 1
uggcaagccccucccaugcgga

SEQ ID NO: 2919628 - RNA, 16 nt, Human T-lymphotropic virus 1
ccugcagcucucuccu

SEQ ID NO: 2919629 - RNA, 21 nt, Human T-lymphotropic virus 1
agaucaggcccuacagccacc

SEQ ID NO: 2919630 - RNA, 14 nt, Human T-lymphotropic virus 1
ccccggacuccggc

SEQ ID NO: 2919631 - RNA, 14 nt, Human T-lymphotropic virus 1
ccgccccuccucua

SEQ ID NO: 2919632 - RNA, 15 nt, Human T-lymphotropic virus 1
cgccuucucagcccc

SEQ ID NO: 2919633 - RNA, 20 nt, Human T-lymphotropic virus 1
uccuucuccugcagcaaccu

SEQ ID NO: 2919634 - RNA, 23 nt, Human T-lymphotropic virus 1
caugcgcaaauacucccccuucc

SEQ ID NO: 2919635 - RNA, 11 nt, Human T-lymphotropic virus 1
cgcuuuccccc

SEQ ID NO: 2919636 - RNA, 14 nt, Human T-lymphotropic virus 1
gauccaccucccag

SEQ ID NO: 2919637 - RNA, 18 nt, Human T-lymphotropic virus 1
ccagccuccccugccaau

SEQ ID NO: 2919638 - RNA, 23 nt, Human T-lymphotropic virus 1
uccugcagcucucuccugcagac

SEQ ID NO: 2919639 - RNA, 13 nt, Human T-lymphotropic virus 1
cuggcaagccccu

SEQ ID NO: 2919640 - RNA, 13 nt, Human T-lymphotropic virus 1
aacaguuccagcc

SEQ ID NO: 2919641 - RNA, 11 nt, Human T-lymphotropic virus 1
aacuccugcau

SEQ ID NO: 2919642 - RNA, 14 nt, Human T-lymphotropic virus 1
gccccagcugcugu

SEQ ID NO: 2919643 - RNA, 12 nt, Human T-lymphotropic virus 1
ccaacccugucu

SEQ ID NO: 2919644 - RNA, 23 nt, Human T-lymphotropic virus 1
ucucacaguuggagucuccucau

SEQ ID NO: 2919645 - RNA, 14 nt, Human T-lymphotropic virus 1
cagcagaucaggcc

SEQ ID NO: 2919646 - RNA, 17 nt, Human T-lymphotropic virus 1
ugucaagccguccucag

SEQ ID NO: 2919647 - RNA, 22 nt, Human T-lymphotropic virus 1
cucauaccacucuaaacccugc

SEQ ID NO: 2919648 - RNA, 18 nt, Human T-lymphotropic virus 1
ugccaccccggccagcuc

SEQ ID NO: 2919649 - RNA, 22 nt, Human T-lymphotropic virus 1
acuccagccgaucccagagaca

SEQ ID NO: 2919650 - RNA, 22 nt, Human T-lymphotropic virus 1
uaaagacaaaucauaagcucag

SEQ ID NO: 2919651 - RNA, 21 nt, Human T-lymphotropic virus 1
cgcuuccucuucuccucagcc

SEQ ID NO: 2919652 - RNA, 23 nt, Human T-lymphotropic virus 1
aacagaagucugagaaggucagg

SEQ ID NO: 2919653 - RNA, 13 nt, Human T-lymphotropic virus 1
gaucaaaaagcca

SEQ ID NO: 2919654 - RNA, 15 nt, Human T-lymphotropic virus 1
ucauuagugcagcug

SEQ ID NO: 2919655 - RNA, 18 nt, Human T-lymphotropic virus 1
ucuccuggcaagccccuc

SEQ ID NO: 2919656 - RNA, 19 nt, Human T-lymphotropic virus 1
cucccaugcggaccugcaa

SEQ ID NO: 2919657 - RNA, 13 nt, Human T-lymphotropic virus 1
guaugcugcccag

SEQ ID NO: 2919658 - RNA, 13 nt, Human T-lymphotropic virus 1
uacaugccccccu

SEQ ID NO: 2919659 - RNA, 20 nt, Human T-lymphotropic virus 1
gaucucucaucaucuucccc

SEQ ID NO: 2919660 - RNA, 13 nt, Human T-lymphotropic virus 1
agccgccagugga

SEQ ID NO: 2919661 - RNA, 18 nt, Human T-lymphotropic virus 1
accacccuuuuccagccu

SEQ ID NO: 2919662 - RNA, 20 nt, Human T-lymphotropic virus 1
caggcccuacagccacccug

SEQ ID NO: 2919663 - RNA, 21 nt, Human T-lymphotropic virus 1
cuuaagguccuuaccccgcca

SEQ ID NO: 2919664 - RNA, 18 nt, Human T-lymphotropic virus 1
gccuaccuagacucagcc

SEQ ID NO: 2919665 - RNA, 17 nt, Human T-lymphotropic virus 1
ggcuacaugccccccua

SEQ ID NO: 2919666 - RNA, 18 nt, Human T-lymphotropic virus 1
ccagcagguccuccgggc

SEQ ID NO: 2919667 - RNA, 17 nt, Human T-lymphotropic virus 1
uccucucaggcccccuu

SEQ ID NO: 2919668 - RNA, 21 nt, Human T-lymphotropic virus 1
ccuccaaggacuccaccucgc

SEQ ID NO: 2919669 - RNA, 21 nt, Human T-lymphotropic virus 1
caucguuagcgcuuccagccc

SEQ ID NO: 2919670 - RNA, 22 nt, Human T-lymphotropic virus 1
ucucaaguaauacuccccucaa

SEQ ID NO: 2919671 - RNA, 18 nt, Human T-lymphotropic virus 1
cuacaugccccccuaccc

SEQ ID NO: 2919672 - RNA, 13 nt, Human T-lymphotropic virus 1
accugcuggcccu

SEQ ID NO: 2919673 - RNA, 18 nt, Human T-lymphotropic virus 1
ggcucuccacgcuuugcc

SEQ ID NO: 2919674 - RNA, 13 nt, Human T-lymphotropic virus 1
acuggcaccacca

SEQ ID NO: 2919675 - RNA, 22 nt, Human T-lymphotropic virus 1
ccuaccccacacuagccagugc

SEQ ID NO: 2919676 - RNA, 23 nt, Human T-lymphotropic virus 1
cgccuacaucgucacgcccuacu

SEQ ID NO: 2919677 - RNA, 18 nt, Human T-lymphotropic virus 1
cuaccccacacuagccag

SEQ ID NO: 2919678 - RNA, 16 nt, Human T-lymphotropic virus 1
cuagaacaccucccaa

SEQ ID NO: 2919679 - RNA, 20 nt, Human T-lymphotropic virus 1
guccgaaaacaaaacccagc

SEQ ID NO: 2919680 - RNA, 20 nt, Human T-lymphotropic virus 1
ucuuccugcuuucuccgggc

SEQ ID NO: 2919681 - RNA, 15 nt, Human T-lymphotropic virus 1
uaccacaggggcccu

SEQ ID NO: 2919682 - RNA, 13 nt, Human T-lymphotropic virus 1
caagccccuccca

SEQ ID NO: 2919683 - RNA, 22 nt, Human T-lymphotropic virus 1
cccccggaggacagcucagcac

SEQ ID NO: 2919684 - RNA, 13 nt, Human T-lymphotropic virus 1
ggacagcucagca

SEQ ID NO: 2919685 - RNA, 20 nt, Human T-lymphotropic virus 1
ucuaguaaguuacuccagcu

SEQ ID NO: 2919686 - RNA, 19 nt, Human T-lymphotropic virus 1
caguucugcccccucaucc

SEQ ID NO: 2919687 - RNA, 15 nt, Human T-lymphotropic virus 1
ugcaugcccaagacc

SEQ ID NO: 2919688 - RNA, 14 nt, Human T-lymphotropic virus 1
cuccguucagccuc

SEQ ID NO: 2919689 - RNA, 15 nt, Human T-lymphotropic virus 1
ccuugggcagcaccu

SEQ ID NO: 2919690 - RNA, 21 nt, Human T-lymphotropic virus 1
auucaagcuauagucuccucc

SEQ ID NO: 2919691 - RNA, 23 nt, Human T-lymphotropic virus 1
ccaugugauuuuuugccaccccg

SEQ ID NO: 2919692 - RNA, 17 nt, Human T-lymphotropic virus 1
augacauucuccuggca

SEQ ID NO: 2919693 - RNA, 21 nt, Human T-lymphotropic virus 1
gagccuaccuagacucagccg

SEQ ID NO: 2919694 - RNA, 19 nt, Human T-lymphotropic virus 1
caccccucauuucuacucu

SEQ ID NO: 2919695 - RNA, 21 nt, Human T-lymphotropic virus 1
acuccccuccuuccccaccca

SEQ ID NO: 2919696 - RNA, 17 nt, Human T-lymphotropic virus 1
cccugcuugcucaacuc

SEQ ID NO: 2919697 - RNA, 22 nt, Human T-lymphotropic virus 1
cucccuucuagucgacgcucca

SEQ ID NO: 2919698 - RNA, 16 nt, Human T-lymphotropic virus 1
aggcagguccucucag

SEQ ID NO: 2919699 - RNA, 19 nt, Human T-lymphotropic virus 1
cacucaacccucaccacuc

SEQ ID NO: 2919700 - RNA, 17 nt, Human T-lymphotropic virus 1
acuccagcuaccaugcc

SEQ ID NO: 2919701 - RNA, 12 nt, Human T-lymphotropic virus 1
uccagcccccca

SEQ ID NO: 2919702 - RNA, 21 nt, Human T-lymphotropic virus 1
cgccucaggaaagagccuccu

SEQ ID NO: 2919703 - RNA, 22 nt, Human T-lymphotropic virus 1
ccauugccuaucuaggcaagcc

SEQ ID NO: 2919704 - RNA, 14 nt, Human T-lymphotropic virus 1
uuggcuccugugaa

SEQ ID NO: 2919705 - RNA, 23 nt, Human T-lymphotropic virus 1
ccagauugacacccagaccagcc

SEQ ID NO: 2919706 - RNA, 13 nt, Human T-lymphotropic virus 1
ccuuuuccagccu

SEQ ID NO: 2919707 - RNA, 14 nt, Human T-lymphotropic virus 1
gccuccaggccuug

SEQ ID NO: 2919708 - RNA, 16 nt, Human T-lymphotropic virus 1
auuuccgggcccugcc

SEQ ID NO: 2919709 - RNA, 23 nt, Human T-lymphotropic virus 1
acccuuguuccuuaaaaugccca

SEQ ID NO: 2919710 - RNA, 15 nt, Human T-lymphotropic virus 1
cgccauacuacccau

SEQ ID NO: 2919711 - RNA, 14 nt, Human T-lymphotropic virus 1
cgauggcagcuuca

SEQ ID NO: 2919712 - RNA, 23 nt, Human T-lymphotropic virus 1
uagcgcuuccagccccccaccug

SEQ ID NO: 2919713 - RNA, 22 nt, Human T-lymphotropic virus 1
agcgcuaguucugcccagugga

SEQ ID NO: 2919714 - RNA, 14 nt, Human T-lymphotropic virus 1
cuucuccucuuccu

SEQ ID NO: 2919715 - RNA, 16 nt, Human T-lymphotropic virus 1
cccagcaaaccccugg

SEQ ID NO: 2919716 - RNA, 13 nt, Human T-lymphotropic virus 1
cuuccccacccag

SEQ ID NO: 2919717 - RNA, 20 nt, Human T-lymphotropic virus 1
ucgccacuuugauuuuauuc

SEQ ID NO: 2919718 - RNA, 17 nt, Human T-lymphotropic virus 1
uuucgccuucucagccc

SEQ ID NO: 2919719 - RNA, 18 nt, Human T-lymphotropic virus 1
cgccuuaccugaggccgc

SEQ ID NO: 2919720 - RNA, 15 nt, Human T-lymphotropic virus 1
uaaaaugcccauacc

SEQ ID NO: 2919721 - RNA, 14 nt, Human T-lymphotropic virus 1
cugaucccaucucc

SEQ ID NO: 2919722 - RNA, 20 nt, Human T-lymphotropic virus 1
accuccuccguucagccucc

SEQ ID NO: 2919723 - RNA, 21 nt, Human T-lymphotropic virus 1
acccuguucgaaaugcagcug

SEQ ID NO: 2919724 - RNA, 15 nt, Human T-lymphotropic virus 1
aucuuuaucauuacc

SEQ ID NO: 2919725 - RNA, 16 nt, Human T-lymphotropic virus 1
uagcgcuuccagcccc

SEQ ID NO: 2919726 - RNA, 15 nt, Human T-lymphotropic virus 1
ugcucuauccauagc

SEQ ID NO: 2919727 - RNA, 19 nt, Human T-lymphotropic virus 1
uacugacaaacccgaccua

SEQ ID NO: 2919728 - RNA, 14 nt, Human T-lymphotropic virus 1
cccauauccugcag

SEQ ID NO: 2919729 - RNA, 19 nt, Human T-lymphotropic virus 1
cuucccccgggcccccuga

SEQ ID NO: 2919730 - RNA, 16 nt, Human T-lymphotropic virus 1
ccggcgcugcucucau

SEQ ID NO: 2919731 - RNA, 19 nt, Human T-lymphotropic virus 1
ccccacacuagccagugcc

SEQ ID NO: 2919732 - RNA, 12 nt, Human T-lymphotropic virus 1
ccggccagcucg

SEQ ID NO: 2919733 - RNA, 13 nt, Human T-lymphotropic virus 1
ccuggccccuccu

SEQ ID NO: 2919734 - RNA, 19 nt, Human T-lymphotropic virus 1
gcccuacagccacccugcc

SEQ ID NO: 2919735 - RNA, 15 nt, Human T-lymphotropic virus 1
cauggccucuccagc

SEQ ID NO: 2919736 - RNA, 18 nt, Human T-lymphotropic virus 1
gcuuccucuucuccucag

SEQ ID NO: 2919737 - RNA, 13 nt, Human T-lymphotropic virus 1
cagaccuccggga

SEQ ID NO: 2919738 - RNA, 18 nt, Human T-lymphotropic virus 1
cagcuacuugccucagcu

SEQ ID NO: 2919739 - RNA, 14 nt, Human T-lymphotropic virus 1
cugacccucacugg

SEQ ID NO: 2919740 - RNA, 16 nt, Human T-lymphotropic virus 1
cagaacgccuccaggc

SEQ ID NO: 2919741 - RNA, 13 nt, Human T-lymphotropic virus 1
gcuagaacaccuc

SEQ ID NO: 2919742 - RNA, 23 nt, Human T-lymphotropic virus 1
gccauugccuaucuaggcaagcc

SEQ ID NO: 2919743 - RNA, 13 nt, Human T-lymphotropic virus 1
ccacucuaaaccc

SEQ ID NO: 2919744 - RNA, 15 nt, Human T-lymphotropic virus 1
ccugcucuuccugcu

SEQ ID NO: 2919745 - RNA, 21 nt, Human T-lymphotropic virus 1
cucaggcccccuuucaggccc

SEQ ID NO: 2919746 - RNA, 22 nt, Human T-lymphotropic virus 1
ucccgccuguggugccuccuga

SEQ ID NO: 2919747 - RNA, 23 nt, Human T-lymphotropic virus 1
ccucagcaauaaacaaacccauu

SEQ ID NO: 2919748 - RNA, 14 nt, Human T-lymphotropic virus 1
cauucccccuuccg

SEQ ID NO: 2919749 - RNA, 12 nt, Human T-lymphotropic virus 1
cauuccacccuc

SEQ ID NO: 2919750 - RNA, 14 nt, Human T-lymphotropic virus 1
caucgaaacagccc

SEQ ID NO: 2919751 - RNA, 21 nt, Human T-lymphotropic virus 1
cucgacaaauacaccuugcaa

SEQ ID NO: 2919752 - RNA, 15 nt, Human T-lymphotropic virus 1
cuuaugccaguguuu

SEQ ID NO: 2919753 - RNA, 18 nt, Human T-lymphotropic virus 1
ccccuacaauccaaccag

SEQ ID NO: 2919754 - RNA, 15 nt, Human T-lymphotropic virus 1
ugacauucuccuggc

SEQ ID NO: 2919755 - RNA, 18 nt, Human T-lymphotropic virus 1
cuaaccacaucuggcaag

SEQ ID NO: 2919756 - RNA, 23 nt, Human T-lymphotropic virus 1
caaggacuccaccucgccuucca

SEQ ID NO: 2919757 - RNA, 16 nt, Human T-lymphotropic virus 1
ucaaaacuccugacuc

SEQ ID NO: 2919758 - RNA, 20 nt, Human T-lymphotropic virus 1
cccuguccugcagcucucuc

SEQ ID NO: 2919759 - RNA, 12 nt, Human T-lymphotropic virus 1
uccagccccuac

SEQ ID NO: 2919760 - RNA, 17 nt, Human T-lymphotropic virus 1
gucacgcugacagccug

SEQ ID NO: 2919761 - RNA, 19 nt, Human T-lymphotropic virus 1
uaaccaagacccaacaucu

SEQ ID NO: 2919762 - RNA, 14 nt, Human T-lymphotropic virus 1
caguuuccuccucc

SEQ ID NO: 2919763 - RNA, 13 nt, Human T-lymphotropic virus 1
ccuguacacccuc

SEQ ID NO: 2919764 - RNA, 18 nt, Human T-lymphotropic virus 1
ugcccuaggcaccuucca

SEQ ID NO: 2919765 - RNA, 21 nt, Human T-lymphotropic virus 1
auccugcgcucuugccacgcc

SEQ ID NO: 2919766 - RNA, 17 nt, Human T-lymphotropic virus 1
uccaggauaugacccca

SEQ ID NO: 2919767 - RNA, 20 nt, Human T-lymphotropic virus 1
cucgccucaggaaagagccu

SEQ ID NO: 2919768 - RNA, 18 nt, Human T-lymphotropic virus 1
cucauacaguacucuucc

SEQ ID NO: 2919769 - RNA, 14 nt, Human T-lymphotropic virus 1
gcgccagcuguccu

SEQ ID NO: 2919770 - RNA, 18 nt, Human T-lymphotropic virus 1
cuauagucuccucccccu

SEQ ID NO: 2919771 - RNA, 21 nt, Human T-lymphotropic virus 1
acugacaaacccgaccuaccu

SEQ ID NO: 2919772 - RNA, 14 nt, Human T-lymphotropic virus 1
augcagcuggccca

SEQ ID NO: 2919773 - RNA, 17 nt, Human T-lymphotropic virus 1
uccugcagcucucuccu

SEQ ID NO: 2919774 - RNA, 16 nt, Human T-lymphotropic virus 1
cuccagccuccccugc

SEQ ID NO: 2919775 - RNA, 15 nt, Human T-lymphotropic virus 1
ccaugcauccuccgu

SEQ ID NO: 2919776 - RNA, 18 nt, Human T-lymphotropic virus 1
cccagaauaaggcucuga

SEQ ID NO: 2919777 - RNA, 20 nt, Human T-lymphotropic virus 1
cauuuaacuggacccacugc

SEQ ID NO: 2919778 - RNA, 13 nt, Human T-lymphotropic virus 1
cagccaacugccu

SEQ ID NO: 2919779 - RNA, 20 nt, Human T-lymphotropic virus 1
ucacaguuggagucuccuca

SEQ ID NO: 2919780 - RNA, 19 nt, Human T-lymphotropic virus 1
agcgcuuccagccccccac

SEQ ID NO: 2919781 - RNA, 16 nt, Human T-lymphotropic virus 1
cucuucuccucagccc

SEQ ID NO: 2919782 - RNA, 14 nt, Human T-lymphotropic virus 1
ccaauggaaccugg

SEQ ID NO: 2919783 - RNA, 17 nt, Human T-lymphotropic virus 1
ccccuuucaggcccucc

SEQ ID NO: 2919784 - RNA, 14 nt, Human T-lymphotropic virus 1
cauaagcucagacc

SEQ ID NO: 2919785 - RNA, 17 nt, Human T-lymphotropic virus 1
gcuucccuaaucuccca

SEQ ID NO: 2919786 - RNA, 13 nt, Human T-lymphotropic virus 1
cacccuccuuccu

SEQ ID NO: 2919787 - RNA, 17 nt, Human T-lymphotropic virus 1
uggcaagccccucccau

SEQ ID NO: 2919788 - RNA, 18 nt, Human T-lymphotropic virus 1
agcccagauugacaccca

SEQ ID NO: 2919789 - RNA, 18 nt, Human T-lymphotropic virus 1
uacaacaaugccaaggcg

SEQ ID NO: 2919790 - RNA, 17 nt, Human T-lymphotropic virus 1
gcaaauacucccccuuc

SEQ ID NO: 2919791 - RNA, 13 nt, Human T-lymphotropic virus 1
ccaccucgccuuc

SEQ ID NO: 2919792 - RNA, 23 nt, Human T-lymphotropic virus 1
auucccaguuaaaaaagccaaug

SEQ ID NO: 2919793 - RNA, 18 nt, Human T-lymphotropic virus 1
gcucagcaccagcucagg

SEQ ID NO: 2919794 - RNA, 14 nt, Human T-lymphotropic virus 1
ugacauucuccugg

SEQ ID NO: 2919795 - RNA, 21 nt, Human T-lymphotropic virus 1
agguaaguuuagagcucaggu

SEQ ID NO: 2919796 - RNA, 13 nt, Human T-lymphotropic virus 1
ucccucauccugc

SEQ ID NO: 2919797 - RNA, 18 nt, Human T-lymphotropic virus 1
gccuccaauauccugcgc

SEQ ID NO: 2919798 - RNA, 17 nt, Human T-lymphotropic virus 1
caucgccuccagccucc

SEQ ID NO: 2919799 - RNA, 20 nt, Human T-lymphotropic virus 1
cccuacuaaucaccccuguc

SEQ ID NO: 2919800 - RNA, 16 nt, Human T-lymphotropic virus 1
ggccccuccugcccca

SEQ ID NO: 2919801 - RNA, 16 nt, Human T-lymphotropic virus 1
uguaccucccuugcua

SEQ ID NO: 2919802 - RNA, 21 nt, Human T-lymphotropic virus 1
gaggacagcucagcaccagcu

SEQ ID NO: 2919803 - RNA, 12 nt, Human T-lymphotropic virus 1
ucaggcccccuu

SEQ ID NO: 2919804 - RNA, 16 nt, Human T-lymphotropic virus 1
uaacaucuccacccaa

SEQ ID NO: 2919805 - RNA, 12 nt, Human T-lymphotropic virus 1
auuuccucccca

SEQ ID NO: 2919806 - RNA, 21 nt, Human T-lymphotropic virus 1
cagcucagcaccagcucaggc

SEQ ID NO: 2919807 - RNA, 15 nt, Human T-lymphotropic virus 1
aggcaagccuagcua

SEQ ID NO: 2919808 - RNA, 18 nt, Human T-lymphotropic virus 1
ugccucccaccgccccuc

SEQ ID NO: 2919809 - RNA, 23 nt, Human T-lymphotropic virus 1
gguugagucgcguucugccgccu

SEQ ID NO: 2919810 - RNA, 16 nt, Human T-lymphotropic virus 1
gcgcuaguucugccca

SEQ ID NO: 2919811 - RNA, 14 nt, Human T-lymphotropic virus 1
auaugaccccaucu

SEQ ID NO: 2919812 - RNA, 22 nt, Human T-lymphotropic virus 1
uauuuccucuuugcuccaggcc

SEQ ID NO: 2919813 - RNA, 15 nt, Human T-lymphotropic virus 1
ucaagcacaguuucc

SEQ ID NO: 2919814 - RNA, 22 nt, Human T-lymphotropic virus 1
cagggcccagaauaaggcucug

SEQ ID NO: 2919815 - RNA, 21 nt, Human T-lymphotropic virus 1
cugucauaacucccucauccu

SEQ ID NO: 2919816 - RNA, 12 nt, Human T-lymphotropic virus 1
guucugcccagu

SEQ ID NO: 2919817 - RNA, 13 nt, Human T-lymphotropic virus 1
ucgccuccagccu

SEQ ID NO: 2919818 - RNA, 12 nt, Human T-lymphotropic virus 1
cgccuccaggcc

SEQ ID NO: 2919819 - RNA, 14 nt, Human T-lymphotropic virus 1
cuccacgcuuugcc

SEQ ID NO: 2919820 - RNA, 23 nt, Human T-lymphotropic virus 1
accccuguccugcagcucucucc

SEQ ID NO: 2919821 - RNA, 14 nt, Human T-lymphotropic virus 1
ggaaauaacccagu

SEQ ID NO: 2919822 - RNA, 14 nt, Human T-lymphotropic virus 1
acuccaccacaguc

SEQ ID NO: 2919823 - RNA, 18 nt, Human T-lymphotropic virus 1
cggauccaccucccaggc

SEQ ID NO: 2919824 - RNA, 18 nt, Human T-lymphotropic virus 1
aucgucacgcccuacugg

SEQ ID NO: 2919825 - RNA, 18 nt, Human T-lymphotropic virus 1
ccaccucgccuuccaacu

SEQ ID NO: 2919826 - RNA, 18 nt, Human T-lymphotropic virus 1
cugaucccaucuccaggc

SEQ ID NO: 2919827 - RNA, 12 nt, Human T-lymphotropic virus 1
ccuccagccucc

SEQ ID NO: 2919828 - RNA, 20 nt, Human T-lymphotropic virus 1
accuggccccuccugcccca

SEQ ID NO: 2919829 - RNA, 17 nt, Human T-lymphotropic virus 1
ccgccguggccuacucc

SEQ ID NO: 2919830 - RNA, 11 nt, Human T-lymphotropic virus 1
caucuccaccc

SEQ ID NO: 2919831 - RNA, 20 nt, Human T-lymphotropic virus 1
aucaggcccuacagccaccc

SEQ ID NO: 2919832 - RNA, 21 nt, Human T-lymphotropic virus 1
accagcuuuccccccccauca

SEQ ID NO: 2919833 - RNA, 20 nt, Human T-lymphotropic virus 1
uuaccauuuaacuggaccca

SEQ ID NO: 2919834 - RNA, 14 nt, Human T-lymphotropic virus 1
uuacgccagccccu

SEQ ID NO: 2919835 - RNA, 20 nt, Human T-lymphotropic virus 1
gcccaccacccuuuuccagc

SEQ ID NO: 2919836 - RNA, 16 nt, Human T-lymphotropic virus 1
gccgucuccagccccu

SEQ ID NO: 2919837 - RNA, 13 nt, Human T-lymphotropic virus 1
agaacugccgcag

SEQ ID NO: 2919838 - RNA, 18 nt, Human T-lymphotropic virus 1
gcugggcgcuaccugaac

SEQ ID NO: 2919839 - RNA, 21 nt, Human T-lymphotropic virus 1
ucuaguaaguuacuccagcua

SEQ ID NO: 2919840 - RNA, 15 nt, Human T-lymphotropic virus 1
cacggcgcuccugcu

SEQ ID NO: 2919841 - RNA, 23 nt, Human T-lymphotropic virus 1
uaggggcuauuaugcugacccuc

SEQ ID NO: 2919842 - RNA, 17 nt, Human T-lymphotropic virus 1
uucgcuuccucuucucc

SEQ ID NO: 2919843 - RNA, 12 nt, Human T-lymphotropic virus 1
ucuccucagccc

SEQ ID NO: 2919844 - RNA, 20 nt, Human T-lymphotropic virus 1
aaccaacugccacaaaaccc

SEQ ID NO: 2919845 - RNA, 17 nt, Human T-lymphotropic virus 1
gccugacccugcuugcu

SEQ ID NO: 2919846 - RNA, 13 nt, Human T-lymphotropic virus 1
ugcauggccucuc

SEQ ID NO: 2919847 - RNA, 19 nt, Human T-lymphotropic virus 1
ggucgagaccgggccuuug

SEQ ID NO: 2919848 - RNA, 17 nt, Human T-lymphotropic virus 1
ggcccauauccugcagc

SEQ ID NO: 2919849 - RNA, 19 nt, Human T-lymphotropic virus 1
cucagugaaaaacauuucc

SEQ ID NO: 2919850 - RNA, 21 nt, Human T-lymphotropic virus 1
aucaaauccuccuucuccugc

SEQ ID NO: 2919851 - RNA, 23 nt, Human T-lymphotropic virus 1
cugcccuaaagauggccagccau

SEQ ID NO: 2919852 - RNA, 14 nt, Human T-lymphotropic virus 1
cccucgacuccccu

SEQ ID NO: 2919853 - RNA, 16 nt, Human T-lymphotropic virus 1
gacaaagauauuuccc

SEQ ID NO: 2919854 - RNA, 13 nt, Human T-lymphotropic virus 1
gacagcucagcac

SEQ ID NO: 2919855 - RNA, 12 nt, Human T-lymphotropic virus 1
auccuucucaag

SEQ ID NO: 2919856 - RNA, 18 nt, Human T-lymphotropic virus 1
cuucuccugcagcaaccu

SEQ ID NO: 2919857 - RNA, 24 nt, Human T-lymphotropic virus 1
cucccaucaaauccuccuucuccu

SEQ ID NO: 2919858 - RNA, 15 nt, Human T-lymphotropic virus 1
cuagaacaccuccca

SEQ ID NO: 2919859 - RNA, 14 nt, Human T-lymphotropic virus 1
auagucccacccug

SEQ ID NO: 2919860 - RNA, 21 nt, Human T-lymphotropic virus 1
auaccacucuaaacccugcaa

SEQ ID NO: 2919861 - RNA, 18 nt, Human T-lymphotropic virus 1
cccucuauaccauggaaa

SEQ ID NO: 2919862 - RNA, 16 nt, Human T-lymphotropic virus 1
gacccucgaccugcug

SEQ ID NO: 2919863 - RNA, 21 nt, Human T-lymphotropic virus 1
caacugccccauuggcuccug

SEQ ID NO: 2919864 - RNA, 20 nt, Human T-lymphotropic virus 1
cagccucuuauucagacccu

SEQ ID NO: 2919865 - RNA, 17 nt, Human T-lymphotropic virus 1
uguucgaaaugcagcug

SEQ ID NO: 2919866 - RNA, 21 nt, Human T-lymphotropic virus 1
cgucuccccccggaggacagc

SEQ ID NO: 2919867 - RNA, 13 nt, Human T-lymphotropic virus 1
cggacccuugccc

SEQ ID NO: 2919868 - RNA, 16 nt, Human T-lymphotropic virus 1
cagccccuugucucca

SEQ ID NO: 2919869 - RNA, 17 nt, Human T-lymphotropic virus 1
ugcagcuggcccauauc

SEQ ID NO: 2919870 - RNA, 14 nt, Human T-lymphotropic virus 1
cccacuucccaggg

SEQ ID NO: 2919871 - RNA, 16 nt, Human T-lymphotropic virus 1
ccuccuccguucagcc

SEQ ID NO: 2919872 - RNA, 13 nt, Human T-lymphotropic virus 1
gcgcuuccagccc

SEQ ID NO: 2919873 - RNA, 13 nt, Human T-lymphotropic virus 1
cgcaucucuccuu

SEQ ID NO: 2919874 - RNA, 17 nt, Human T-lymphotropic virus 1
guuccuaucuuacucca

SEQ ID NO: 2919875 - RNA, 21 nt, Human T-lymphotropic virus 1
accacaggaggcucuucaaga

SEQ ID NO: 2919876 - RNA, 23 nt, Human T-lymphotropic virus 1
uucacaaauuucaaaccaaggcc

SEQ ID NO: 2919877 - RNA, 21 nt, Human T-lymphotropic virus 1
ccaccgggaaccacccauuuc

SEQ ID NO: 2919878 - RNA, 16 nt, Human T-lymphotropic virus 1
cacgcuuugccugacc

SEQ ID NO: 2919879 - RNA, 22 nt, Human T-lymphotropic virus 1
acuccagcuaccaugccaccua

SEQ ID NO: 2919880 - RNA, 23 nt, Human T-lymphotropic virus 1
caauggcccugccuauauuuccc

SEQ ID NO: 2919881 - RNA, 21 nt, Human T-lymphotropic virus 1
ugcgccgugccuucuccucuu

SEQ ID NO: 2919882 - RNA, 20 nt, Human T-lymphotropic virus 1
cugcccuaaagauggccagc

SEQ ID NO: 2919883 - RNA, 12 nt, Human T-lymphotropic virus 1
acuggccaccug

SEQ ID NO: 2919884 - RNA, 17 nt, Human T-lymphotropic virus 1
uccucuuugcuccaggc

SEQ ID NO: 2919885 - RNA, 19 nt, Human T-lymphotropic virus 1
accacaucgccuccagccu

SEQ ID NO: 2919886 - RNA, 15 nt, Human T-lymphotropic virus 1
ccaucucugggggac

SEQ ID NO: 2919887 - RNA, 16 nt, Human T-lymphotropic virus 1
ucuauaaaauuucccu

SEQ ID NO: 2919888 - RNA, 10 nt, Human T-lymphotropic virus 1
cccccccuug

SEQ ID NO: 2919889 - RNA, 12 nt, Human
cuucucuuaauu

SEQ ID NO: 2919890 - RNA, 16 nt, Human
cuucucuuaauuuaau

SEQ ID NO: 2919891 - RNA, 15 nt, Human
cuucucuuaauuuaa

SEQ ID NO: 2919892 - RNA, 14 nt, Human
cuucucuuaauuua

SEQ ID NO: 2919893 - RNA, 15 nt, Human
cuuggguggagaagc

SEQ ID NO: 2919894 - RNA, 17 nt, Human
cuuggguggagaagcca

SEQ ID NO: 2919895 - RNA, 18 nt, Human
cuuggguggagaagccau

SEQ ID NO: 2919896 - RNA, 23 nt, Human
cuuggguggagaagccauugucu

SEQ ID NO: 2919897 - RNA, 19 nt, Human
cuuggguggagaagccauu

SEQ ID NO: 2919898 - RNA, 20 nt, Human
cuuggguggagaagccauug

SEQ ID NO: 2919899 - RNA, 14 nt, Human
cuuggucacauaca

SEQ ID NO: 2919900 - RNA, 17 nt, Human
cuugguguaguugaacu

SEQ ID NO: 2919901 - RNA, 18 nt, Human
gaagacauguuuuagaca

SEQ ID NO: 2919902 - RNA, 12 nt, Human
gaagacauguuu

SEQ ID NO: 2919903 - RNA, 21 nt, Human
gaacugcauauguuucgcuga

SEQ ID NO: 2919904 - RNA, 15 nt, Human
gaacugcauauguuu

SEQ ID NO: 2919905 - RNA, 19 nt, Human
gaacugauaguuacuguug

SEQ ID NO: 2919906 - RNA, 13 nt, Human
gaacugauaguua

SEQ ID NO: 2919907 - RNA, 15 nt, Human
gaaacaaagcuuagc

SEQ ID NO: 2919908 - RNA, 19 nt, Human
gaaacaaagcuuagcagga

SEQ ID NO: 2919909 - RNA, 22 nt, Human
gaaacaaagcuuagcaggagag

SEQ ID NO: 2919910 - RNA, 13 nt, Human
gaaaugaaagaaa

SEQ ID NO: 2919911 - RNA, 22 nt, Human
gauucuguguguuuucauaaua

SEQ ID NO: 2919912 - RNA, 19 nt, Human
gauucuguguguuuucaua

SEQ ID NO: 2919913 - RNA, 20 nt, Human
gcaaaaaacucgaggacugu

SEQ ID NO: 2919914 - RNA, 22 nt, Human
gauguacauuuccaaauucaca

SEQ ID NO: 2919915 - RNA, 15 nt, Human
gauguacauuuccaa

SEQ ID NO: 2919916 - RNA, 12 nt, Human
gccaagcacagu

SEQ ID NO: 2919917 - RNA, 16 nt, Human
gccaagcacaguggug

SEQ ID NO: 2919918 - RNA, 21 nt, Human
gccaagcacagugguggcagg

SEQ ID NO: 2919919 - RNA, 13 nt, Human
gcauacaaucuga

SEQ ID NO: 2919920 - RNA, 17 nt, Human
gagcccggaugcuucuc

SEQ ID NO: 2919921 - RNA, 17 nt, Human
gacuguauuugugacua

SEQ ID NO: 2919922 - RNA, 19 nt, Human
gacuguauuugugacuaau

SEQ ID NO: 2919923 - RNA, 20 nt, Human
gacuguauuugugacuaauu

SEQ ID NO: 2919924 - RNA, 16 nt, Human
gacuguauuugugacu

SEQ ID NO: 2919925 - RNA, 22 nt, Human
gacuguauuugugacuaauugu

SEQ ID NO: 2919926 - RNA, 23 nt, Human
gacuguauuugugacuaauugua

SEQ ID NO: 2919927 - RNA, 13 nt, Human
gacgcugaauaaa

SEQ ID NO: 2919928 - RNA, 16 nt, Human
gacgcugaauaaaugu

SEQ ID NO: 2919929 - RNA, 17 nt, Human
gacgcugaauaaauguc

SEQ ID NO: 2919930 - RNA, 19 nt, Human
gacacuuuuuugaguggau

SEQ ID NO: 2919931 - RNA, 21 nt, Human
aaaacauccagauacacccaa

SEQ ID NO: 2919932 - RNA, 16 nt, Human
aaaacauccagauaca

SEQ ID NO: 2919933 - RNA, 15 nt, Human
aaacaaagcuuagca

SEQ ID NO: 2919934 - RNA, 17 nt, Human
aaacaaagcuuagcagg

SEQ ID NO: 2919935 - RNA, 22 nt, Human
aaacaaagcuuagcaggagagg

SEQ ID NO: 2919936 - RNA, 23 nt, Human
aaacaaagcuuagcaggagagga

SEQ ID NO: 2919937 - RNA, 15 nt, Human
aaacaauauuguuuc

SEQ ID NO: 2919938 - RNA, 14 nt, Human
aaacaauauuguuu

SEQ ID NO: 2919939 - RNA, 17 nt, Human
aaacaauauuguuucua

SEQ ID NO: 2919940 - RNA, 16 nt, Human
aaacaauauuguuucu

SEQ ID NO: 2919941 - RNA, 23 nt, Human
aaacucgaggacuguauuuguga

SEQ ID NO: 2919942 - RNA, 24 nt, Human
aaacucgaggacuguauuugugac

SEQ ID NO: 2919943 - RNA, 16 nt, Human
aaacucgaggacugua

SEQ ID NO: 2919944 - RNA, 15 nt, Human
aaacucauuuccuau

SEQ ID NO: 2919945 - RNA, 17 nt, Human
aaacucgaggacuguau

SEQ ID NO: 2919946 - RNA, 19 nt, Human
aaacucgaggacuguauuu

SEQ ID NO: 2919947 - RNA, 20 nt, Human
aaacucgaggacuguauuug

SEQ ID NO: 2919948 - RNA, 22 nt, Human
aaacucgaggacuguauuugug

SEQ ID NO: 2919949 - RNA, 13 nt, Human
gguggagaagcca

SEQ ID NO: 2919950 - RNA, 14 nt, Human
gguggagaagccau

SEQ ID NO: 2919951 - RNA, 15 nt, Human
gguggagaagccauu

SEQ ID NO: 2919952 - RNA, 21 nt, Human
gguccuuugggaaaggagaag

SEQ ID NO: 2919953 - RNA, 17 nt, Human
aaauaauaaagaugcuc

SEQ ID NO: 2919954 - RNA, 19 nt, Human
aaauaauaaagaugcucuu

SEQ ID NO: 2919955 - RNA, 14 nt, Human
aaaguuagucuacu

SEQ ID NO: 2919956 - RNA, 23 nt, Human
aaaguuagucuacucuuaagcca

SEQ ID NO: 2919957 - RNA, 12 nt, Human
aaaguugaaauu

SEQ ID NO: 2919958 - RNA, 16 nt, Human
aaaggguuuuaaugua

SEQ ID NO: 2919959 - RNA, 14 nt, Human
aaauacucaugugu

SEQ ID NO: 2919960 - RNA, 15 nt, Human
aaauacucaugugua

SEQ ID NO: 2919961 - RNA, 16 nt, Human
aaauacucauguguau

SEQ ID NO: 2919962 - RNA, 17 nt, Human
aaauacucauguguaug

SEQ ID NO: 2919963 - RNA, 21 nt, Human
aaauacucauguguaugggca

SEQ ID NO: 2919964 - RNA, 11 nt, Human
guaauuuauuu

SEQ ID NO: 2919965 - RNA, 13 nt, Human
guaacugacaacu

SEQ ID NO: 2919966 - RNA, 19 nt, Human
guaacugcauugagaacug

SEQ ID NO: 2919967 - RNA, 18 nt, Human
guaacugcauugagaacu

SEQ ID NO: 2919968 - RNA, 22 nt, Human
guaacugcauugagaacugcau

SEQ ID NO: 2919969 - RNA, 16 nt, Human
guaccagauaaaauua

SEQ ID NO: 2919970 - RNA, 13 nt, Human
ggaagcuacaggu

SEQ ID NO: 2919971 - RNA, 15 nt, Human
ggaagcuacagguua

SEQ ID NO: 2919972 - RNA, 23 nt, Human
ggaagcuacagguuacaacagau

SEQ ID NO: 2919973 - RNA, 21 nt, Human
ggaagcuacagguuacaacag

SEQ ID NO: 2919974 - RNA, 22 nt, Human
ggaagcuacagguuacaacaga

SEQ ID NO: 2919975 - RNA, 18 nt, Human
gcuacucuguuccuucac

SEQ ID NO: 2919976 - RNA, 17 nt, Human
gcuacucuguuccuuca

SEQ ID NO: 2919977 - RNA, 20 nt, Human
gcuaauaucaauagaaggau

SEQ ID NO: 2919978 - RNA, 15 nt, Human
gccuagcugcuacaa

SEQ ID NO: 2919979 - RNA, 16 nt, Human
gccuagcugcuacaaa

SEQ ID NO: 2919980 - RNA, 17 nt, Human
gccuagcugcuacaaag

SEQ ID NO: 2919981 - RNA, 19 nt, Human
gccuagcugcuacaaagaa

SEQ ID NO: 2919982 - RNA, 22 nt, Human
gccuagcugcuacaaagaagac

SEQ ID NO: 2919983 - RNA, 23 nt, Human
gccuagcugcuacaaagaagaca

SEQ ID NO: 2919984 - RNA, 24 nt, Human
gccuagcugcuacaaagaagacau

SEQ ID NO: 2919985 - RNA, 14 nt, Human
gccuagcugcuaca

SEQ ID NO: 2919986 - RNA, 18 nt, Human
cugacacaaaaaguagau

SEQ ID NO: 2919987 - RNA, 14 nt, Human
cuccauacucagga

SEQ ID NO: 2919988 - RNA, 17 nt, Human
cuauguggcuguaucuu

SEQ ID NO: 2919989 - RNA, 19 nt, Human
cuaacucagaaacaucagu

SEQ ID NO: 2919990 - RNA, 14 nt, Human
ccccaugcuguuga

SEQ ID NO: 2919991 - RNA, 19 nt, Human
cccaagcaaaaucauggaa

SEQ ID NO: 2919992 - RNA, 20 nt, Human
ccuaaguuucaguugauuuu

SEQ ID NO: 2919993 - RNA, 22 nt, Human
cacaucuccuccauacucagga

SEQ ID NO: 2919994 - RNA, 16 nt, Human
caaaggguuuuaaugu

SEQ ID NO: 2919995 - RNA, 19 nt, Human
caaaguaucaggacgagaa

SEQ ID NO: 2919996 - RNA, 18 nt, Human
caaaggguuuuaauguag

SEQ ID NO: 2919997 - RNA, 19 nt, Human
caaaggguuuuaauguaga

SEQ ID NO: 2919998 - RNA, 20 nt, Human
caacaaaggguuuuaaugua

SEQ ID NO: 2919999 - RNA, 19 nt, Human
caacaaaggguuuuaaugu

SEQ ID NO: 2920000 - RNA, 14 nt, Human
auuccuucagggug

SEQ ID NO: 2920001 - RNA, 15 nt, Human
auuccuucaggguga

SEQ ID NO: 2920002 - RNA, 22 nt, Human
auuccuucagggugaugccagg

SEQ ID NO: 2920003 - RNA, 16 nt, Human
auuucugugggagaau

SEQ ID NO: 2920004 - RNA, 13 nt, Human
auuucugugggag

SEQ ID NO: 2920005 - RNA, 22 nt, Human
cauccuguguuucuagggaaau

SEQ ID NO: 2920006 - RNA, 21 nt, Human
cauccuguguuucuagggaaa

SEQ ID NO: 2920007 - RNA, 15 nt, Human
cauccuguguuucua

SEQ ID NO: 2920008 - RNA, 22 nt, Human
cagucugaucgugacgcugaau

SEQ ID NO: 2920009 - RNA, 16 nt, Human
auugaaaugacuaaaa

SEQ ID NO: 2920010 - RNA, 23 nt, Human
auucuguguguuuucauaauaaa

SEQ ID NO: 2920011 - RNA, 17 nt, Human
auuugugaacucagcca

SEQ ID NO: 2920012 - RNA, 20 nt, Human
auuugugaacucagccaagc

SEQ ID NO: 2920013 - RNA, 21 nt, Human
auuugugaacucagccaagca

SEQ ID NO: 2920014 - RNA, 17 nt, Human
auuuccaaauucacaag

SEQ ID NO: 2920015 - RNA, 16 nt, Human
auuuaaagacaaagac

SEQ ID NO: 2920016 - RNA, 20 nt, Human
uuucaaaacucauuuccuau

SEQ ID NO: 2920017 - RNA, 19 nt, Human
auggcaccaaagccaccag

SEQ ID NO: 2920018 - RNA, 16 nt, Human
uugguggagauaaaga

SEQ ID NO: 2920019 - RNA, 15 nt, Human
uuuaaugugcugugu

SEQ ID NO: 2920020 - RNA, 22 nt, Human
uuuaaugugcuguguaaaguua

SEQ ID NO: 2920021 - RNA, 20 nt, Human
uuuaaugugcuguguaaagu

SEQ ID NO: 2920022 - RNA, 21 nt, Human
uuuaaugugcuguguaaaguu

SEQ ID NO: 2920023 - RNA, 16 nt, Human
uuuaaugugcugugua

SEQ ID NO: 2920024 - RNA, 17 nt, Human
uuuaaugugcuguguaa

SEQ ID NO: 2920025 - RNA, 18 nt, Human
uuuaaugugcuguguaaa

SEQ ID NO: 2920026 - RNA, 19 nt, Human
uuuaaugugcuguguaaag

SEQ ID NO: 2920027 - RNA, 19 nt, Human
uuucuguucuguggaaagu

SEQ ID NO: 2920028 - RNA, 15 nt, Human
uuucuguucugugga

SEQ ID NO: 2920029 - RNA, 16 nt, Human
uuucuguucuguggaa

SEQ ID NO: 2920030 - RNA, 17 nt, Human
uuucuguucuguggaaa

SEQ ID NO: 2920031 - RNA, 14 nt, Human
augguuauaaaagu

SEQ ID NO: 2920032 - RNA, 16 nt, Human
augguuauaaaaguga

SEQ ID NO: 2920033 - RNA, 20 nt, Human
auguacauuuccaaauucac

SEQ ID NO: 2920034 - RNA, 19 nt, Human
auguagauaaacucagaaa

SEQ ID NO: 2920035 - RNA, 18 nt, Human
auguagauaaacucagaa

SEQ ID NO: 2920036 - RNA, 18 nt, Human
uuugugacuaauuguaua

SEQ ID NO: 2920037 - RNA, 22 nt, Human
uuugugacuaauuguauaacag

SEQ ID NO: 2920038 - RNA, 20 nt, Human
uuugugaacucagccaagca

SEQ ID NO: 2920039 - RNA, 12 nt, Human
uucgcugcaacc

SEQ ID NO: 2920040 - RNA, 12 nt, Human
uucggaaaccuu

SEQ ID NO: 2920041 - RNA, 18 nt, Human
uucggaaaccuuggugua

SEQ ID NO: 2920042 - RNA, 22 nt, Human
uucuuugguggagauaaagauu

SEQ ID NO: 2920043 - RNA, 21 nt, Human
uugaaaggcauucucugaaga

SEQ ID NO: 2920044 - RNA, 20 nt, Human
uugaaaggcauucucugaag

SEQ ID NO: 2920045 - RNA, 19 nt, Human
uugaaaggcauucucugaa

SEQ ID NO: 2920046 - RNA, 12 nt, Human
uugaauaauggu

SEQ ID NO: 2920047 - RNA, 19 nt, Human
uugaauaaugguaccagau

SEQ ID NO: 2920048 - RNA, 22 nt, Human
uugaauaaugguaccagauaaa

SEQ ID NO: 2920049 - RNA, 23 nt, Human
aucuugguaaauuuccccaacag

SEQ ID NO: 2920050 - RNA, 18 nt, Human
uuagaauuccuucagggu

SEQ ID NO: 2920051 - RNA, 15 nt, Human
auaauaugagaauca

SEQ ID NO: 2920052 - RNA, 20 nt, Human
auaauaugcacacagugcuu

SEQ ID NO: 2920053 - RNA, 12 nt, Human
auaauaugcaca

SEQ ID NO: 2920054 - RNA, 12 nt, Human
auaauaugagaa

SEQ ID NO: 2920055 - RNA, 19 nt, Human
uuaguuuuuguaauuuauu

SEQ ID NO: 2920056 - RNA, 13 nt, Human
uuauaaaagugau

SEQ ID NO: 2920057 - RNA, 16 nt, Human
uuaaauuuuaauuuau

SEQ ID NO: 2920058 - RNA, 16 nt, Human
aguuuuuguaauuuau

SEQ ID NO: 2920059 - RNA, 18 nt, Human
aguuuuguuuuaaaauua

SEQ ID NO: 2920060 - RNA, 14 nt, Human
auacucauguguau

SEQ ID NO: 2920061 - RNA, 13 nt, Human
auacucaugugua

SEQ ID NO: 2920062 - RNA, 15 nt, Human
auacucauguguaug

SEQ ID NO: 2920063 - RNA, 12 nt, Human
auagaugggaau

SEQ ID NO: 2920064 - RNA, 13 nt, Human
auagaugggaaug

SEQ ID NO: 2920065 - RNA, 15 nt, Human
auagaugggaaugaa

SEQ ID NO: 2920066 - RNA, 22 nt, Human
auagauguagauaaacucagaa

SEQ ID NO: 2920067 - RNA, 19 nt, Human
auagaugggaaugaagcuu

SEQ ID NO: 2920068 - RNA, 19 nt, Human
auagaaggauguacauuuc

SEQ ID NO: 2920069 - RNA, 18 nt, Human
uuaugugccguguuauug

SEQ ID NO: 2920070 - RNA, 18 nt, Human
auacaaccugcuugggug

SEQ ID NO: 2920071 - RNA, 14 nt, Human
auacaaccugcuug

SEQ ID NO: 2920072 - RNA, 14 nt, Human
auacauggauaaca

SEQ ID NO: 2920073 - RNA, 12 nt, Human
ugugcuguguaa

SEQ ID NO: 2920074 - RNA, 13 nt, Human
ugugcuguguaaa

SEQ ID NO: 2920075 - RNA, 14 nt, Human
ugugcuguguaaag

SEQ ID NO: 2920076 - RNA, 15 nt, Human
ugugcuguguaaagu

SEQ ID NO: 2920077 - RNA, 16 nt, Human
ugugcuguguaaaguu

SEQ ID NO: 2920078 - RNA, 23 nt, Human
ugugcuguguaaaguuagucuac

SEQ ID NO: 2920079 - RNA, 14 nt, Human
agugcccaacuguu

SEQ ID NO: 2920080 - RNA, 14 nt, Human
uguguaaaguuagu

SEQ ID NO: 2920081 - RNA, 17 nt, Human
uguguaaaguuagucua

SEQ ID NO: 2920082 - RNA, 13 nt, Human
aguggaugauguu

SEQ ID NO: 2920083 - RNA, 20 nt, Human
aguggaugauguuucgugaa

SEQ ID NO: 2920084 - RNA, 15 nt, Human
aguggaugauguuuc

SEQ ID NO: 2920085 - RNA, 18 nt, Human
uguuccuucacauccugu

SEQ ID NO: 2920086 - RNA, 17 nt, Human
aggugucauuuccauua

SEQ ID NO: 2920087 - RNA, 15 nt, Human
aggugucauuuccau

SEQ ID NO: 2920088 - RNA, 19 nt, Human
agguucuucccuuuuacau

SEQ ID NO: 2920089 - RNA, 23 nt, Human
agguucuucccuuuuacauacug

SEQ ID NO: 2920090 - RNA, 14 nt, Human
agucuauuagccac

SEQ ID NO: 2920091 - RNA, 20 nt, Human
agucagugcccaacuguuau

SEQ ID NO: 2920092 - RNA, 15 nt, Human
ugggcaaaaaacucg

SEQ ID NO: 2920093 - RNA, 16 nt, Human
ugggcaaaaaacucga

SEQ ID NO: 2920094 - RNA, 14 nt, Human
agggaaaugaaaga

SEQ ID NO: 2920095 - RNA, 17 nt, Human
agggcaucaugcaucuu

SEQ ID NO: 2920096 - RNA, 11 nt, Human
uggagaagcca

SEQ ID NO: 2920097 - RNA, 16 nt, Human
agcuuagcaggagagg

SEQ ID NO: 2920098 - RNA, 22 nt, Human
agcuuagcaggagaggagagcc

SEQ ID NO: 2920099 - RNA, 14 nt, Human
agcuuagcaggaga

SEQ ID NO: 2920100 - RNA, 22 nt, Human
ugcgaaugguuccauucucucu

SEQ ID NO: 2920101 - RNA, 17 nt, Human
ugcauaaagucagugcc

SEQ ID NO: 2920102 - RNA, 15 nt, Human
ucuguuccuucacau

SEQ ID NO: 2920103 - RNA, 13 nt, Human
ucuguuccuucac

SEQ ID NO: 2920104 - RNA, 22 nt, Human
ucuucccuuuuacauacugcug

SEQ ID NO: 2920105 - RNA, 21 nt, Human
ucuucccuuuuacauacugcu

SEQ ID NO: 2920106 - RNA, 19 nt, Human
ucuucccuuuuacauacug

SEQ ID NO: 2920107 - RNA, 15 nt, Human
agacauguuuuagac

SEQ ID NO: 2920108 - RNA, 17 nt, Human
agacauguuuuagacaa

SEQ ID NO: 2920109 - RNA, 19 nt, Human
agacauguuuuagacaaau

SEQ ID NO: 2920110 - RNA, 23 nt, Human
agacauguuuuagacaaauacuc

SEQ ID NO: 2920111 - RNA, 22 nt, Human
agaaauuuaauucauguuucuu

SEQ ID NO: 2920112 - RNA, 21 nt, Human
agaaauuuaauucauguuucu

SEQ ID NO: 2920113 - RNA, 17 nt, Human
agaaauuuaauucaugu

SEQ ID NO: 2920114 - RNA, 22 nt, Human
acuuuuuugaguggaugauguu

SEQ ID NO: 2920115 - RNA, 11 nt, Human
acuuuuuccag

SEQ ID NO: 2920116 - RNA, 14 nt, Human
ucucuccuguacuu

SEQ ID NO: 2920117 - RNA, 21 nt, Human
agcaacaucuagcaaauguua

SEQ ID NO: 2920118 - RNA, 19 nt, Human
agauuugugaacucagcca

SEQ ID NO: 2920119 - RNA, 21 nt, Human
agauuugugaacucagccaag

SEQ ID NO: 2920120 - RNA, 11 nt, Human
agauuugugaa

SEQ ID NO: 2920121 - RNA, 13 nt, Human
agauuugugaacu

SEQ ID NO: 2920122 - RNA, 15 nt, Human
agauuugugaacuca

SEQ ID NO: 2920123 - RNA, 16 nt, Human
agauuugugaacucag

SEQ ID NO: 2920124 - RNA, 13 nt, Human
ugaccugaaguuc

SEQ ID NO: 2920125 - RNA, 14 nt, Human
ugaccugaaguuca

SEQ ID NO: 2920126 - RNA, 18 nt, Human
ugaccugaaguucaccau

SEQ ID NO: 2920127 - RNA, 17 nt, Human
agauaaagauuucuuga

SEQ ID NO: 2920128 - RNA, 14 nt, Human
agauaaagauuucu

SEQ ID NO: 2920129 - RNA, 13 nt, Human
agauaaacucaga

SEQ ID NO: 2920130 - RNA, 21 nt, Human
agauaaaauuauagaugggaa

SEQ ID NO: 2920131 - RNA, 22 nt, Human
agauaaaauuauagaugggaau

SEQ ID NO: 2920132 - RNA, 19 nt, Human
agauaaacucagaaauuua

SEQ ID NO: 2920133 - RNA, 13 nt, Human
ugaagcuugugua

SEQ ID NO: 2920134 - RNA, 14 nt, Human
ugaagcuuguguau

SEQ ID NO: 2920135 - RNA, 15 nt, Human
ugaagcuuguguauc

SEQ ID NO: 2920136 - RNA, 23 nt, Human
ugaagcuuguguauccauuauca

SEQ ID NO: 2920137 - RNA, 20 nt, Human
agcacagugguggcagggcc

SEQ ID NO: 2920138 - RNA, 23 nt, Human
agcacagugguggcagggccuag

SEQ ID NO: 2920139 - RNA, 16 nt, Human
agcacagugguggcag

SEQ ID NO: 2920140 - RNA, 17 nt, Human
agcacagugguggcagg

SEQ ID NO: 2920141 - RNA, 18 nt, Human
agcacagugguggcaggg

SEQ ID NO: 2920142 - RNA, 19 nt, Human
agcacagugguggcagggc

SEQ ID NO: 2920143 - RNA, 15 nt, Human
agcacagugguggca

SEQ ID NO: 2920144 - RNA, 21 nt, Human
ucaccugagcccggaugcuuc

SEQ ID NO: 2920145 - RNA, 23 nt, Human
ucaccugagcccggaugcuucuc

SEQ ID NO: 2920146 - RNA, 22 nt, Human
ucaccugagcccggaugcuucu

SEQ ID NO: 2920147 - RNA, 20 nt, Human
accagagauaauaugagaau

SEQ ID NO: 2920148 - RNA, 19 nt, Human
ucacugacacaaaaaguag

SEQ ID NO: 2920149 - RNA, 12 nt, Human
accccaugcugu

SEQ ID NO: 2920150 - RNA, 16 nt, Human
accccaugcuguugau

SEQ ID NO: 2920151 - RNA, 17 nt, Human
accccaugcuguugauu

SEQ ID NO: 2920152 - RNA, 20 nt, Human
accccaugcuguugauugcu

SEQ ID NO: 2920153 - RNA, 22 nt, Human
accccaugcuguugauugcuaa

SEQ ID NO: 2920154 - RNA, 23 nt, Human
accccaugcuguugauugcuaaa

SEQ ID NO: 2920155 - RNA, 20 nt, Human
accuaaguuucaguugauuu

SEQ ID NO: 2920156 - RNA, 22 nt, Human
accugcuuggguggagaagcca

SEQ ID NO: 2920157 - RNA, 23 nt, Human
accugcuuggguggagaagccau

SEQ ID NO: 2920158 - RNA, 21 nt, Human
accugcuuggguggagaagcc

SEQ ID NO: 2920159 - RNA, 15 nt, Human
accugaaguucacca

SEQ ID NO: 2920160 - RNA, 13 nt, Human
accugaaguucac

SEQ ID NO: 2920161 - RNA, 13 nt, Human
uccacuacugcua

SEQ ID NO: 2920162 - RNA, 18 nt, Human
uccugcuacucuguuccu

SEQ ID NO: 2920163 - RNA, 14 nt, Human
uccugcuacucugu

SEQ ID NO: 2920164 - RNA, 19 nt, Human
uccuguguuucuagggaaa

SEQ ID NO: 2920165 - RNA, 12 nt, Human
uccuguguuucu

SEQ ID NO: 2920166 - RNA, 18 nt, Human
ucgaggcccagcgaccuc

SEQ ID NO: 2920167 - RNA, 20 nt, Human
ucgaggacuguauuugugac

SEQ ID NO: 2920168 - RNA, 19 nt, Human
ucgaggacuguauuuguga

SEQ ID NO: 2920169 - RNA, 14 nt, Human
acugcauacaaucu

SEQ ID NO: 2920170 - RNA, 22 nt, Human
acuggcaguuuuccauugguuu

SEQ ID NO: 2920171 - RNA, 16 nt, Human
acuggcaguuuuccau

SEQ ID NO: 2920172 - RNA, 18 nt, Human
uccuucagggugaugcca

SEQ ID NO: 2920173 - RNA, 23 nt, Human
uccuucagggugaugccagguuc

SEQ ID NO: 2920174 - RNA, 14 nt, Human
uccccaacagugug

SEQ ID NO: 2920175 - RNA, 20 nt, Human
uccccaacagugugaaguua

SEQ ID NO: 2920176 - RNA, 21 nt, Human
uccccaacagugugaaguuag

SEQ ID NO: 2920177 - RNA, 15 nt, Human
uccccaacaguguga

SEQ ID NO: 2920178 - RNA, 16 nt, Human
uccccaacagugugaa

SEQ ID NO: 2920179 - RNA, 18 nt, Human
uccccaacagugugaagu

SEQ ID NO: 2920180 - RNA, 19 nt, Human
uccccaacagugugaaguu

SEQ ID NO: 2920181 - RNA, 23 nt, Human
uccccaacagugugaaguuagaa

SEQ ID NO: 2920182 - RNA, 18 nt, Human
acuauauuaucaugcaaa

SEQ ID NO: 2920183 - RNA, 16 nt, Human
acucauuuccuaugua

SEQ ID NO: 2920184 - RNA, 21 nt, Human
acucugaagggcaucaugcau

SEQ ID NO: 2920185 - RNA, 20 nt, Human
acucugaagggcaucaugca

SEQ ID NO: 2920186 - RNA, 12 nt, Human
acacaucuccuc

SEQ ID NO: 2920187 - RNA, 14 nt, Human
acacaucuccucca

SEQ ID NO: 2920188 - RNA, 21 nt, Human
uaguuacuguugugaccugaa

SEQ ID NO: 2920189 - RNA, 17 nt, Human
uaguuacuguugugacc

SEQ ID NO: 2920190 - RNA, 18 nt, Human
uaguuacuguugugaccu

SEQ ID NO: 2920191 - RNA, 12 nt, Human
uauaacagguua

SEQ ID NO: 2920192 - RNA, 13 nt, Human
uauaacagguuau

SEQ ID NO: 2920193 - RNA, 15 nt, Human
uauaacagguuauuu

SEQ ID NO: 2920194 - RNA, 20 nt, Human
uauaacagguuauuuuaguu

SEQ ID NO: 2920195 - RNA, 21 nt, Human
uauaacagguuauuuuaguuu

SEQ ID NO: 2920196 - RNA, 15 nt, Human
uaugggcaaaaaacu

SEQ ID NO: 2920197 - RNA, 14 nt, Human
uauccauuaucaug

SEQ ID NO: 2920198 - RNA, 19 nt, Human
uauccauuaucauguguaa

SEQ ID NO: 2920199 - RNA, 15 nt, Human
uauccauuaucaugu

SEQ ID NO: 2920200 - RNA, 16 nt, Human
uauccauuaucaugug

SEQ ID NO: 2920201 - RNA, 17 nt, Human
uauccauuaucaugugu

SEQ ID NO: 2920202 - RNA, 18 nt, Human
uauccauuaucaugugua

SEQ ID NO: 2920203 - RNA, 18 nt, Human
uaucacugacacaaaaag

SEQ ID NO: 2920204 - RNA, 12 nt, Human
acagugugaagu

SEQ ID NO: 2920205 - RNA, 13 nt, Human
acagugugaaguu

SEQ ID NO: 2920206 - RNA, 22 nt, Human
acagugugaaguuagaauuccu

SEQ ID NO: 2920207 - RNA, 15 nt, Human
acagugugaaguuag

SEQ ID NO: 2920208 - RNA, 16 nt, Human
acagugugaaguuaga

SEQ ID NO: 2920209 - RNA, 18 nt, Human
acagugugaaguuagaau

SEQ ID NO: 2920210 - RNA, 19 nt, Human
acagugugaaguuagaauu

SEQ ID NO: 2920211 - RNA, 19 nt, Human
acagucugaucgugacgcu

SEQ ID NO: 2920212 - RNA, 20 nt, Human
acagucugaucgugacgcug

SEQ ID NO: 2920213 - RNA, 22 nt, Human
acagucugaucgugacgcugaa

SEQ ID NO: 2920214 - RNA, 12 nt, Human
uauuacaucuuu

SEQ ID NO: 2920215 - RNA, 17 nt, Human
uauuacaucuuucacau

SEQ ID NO: 2920216 - RNA, 23 nt, Human
uauuagccacaaaauugggaaag

SEQ ID NO: 2920217 - RNA, 15 nt, Human
uauuagccacaaaau

SEQ ID NO: 2920218 - RNA, 18 nt, Human
uauuuagggaacugcuug

SEQ ID NO: 2920219 - RNA, 17 nt, Human
uauuuagggaacugcuu

SEQ ID NO: 2920220 - RNA, 22 nt, Human
acaaauguguaucggaugcuuu

SEQ ID NO: 2920221 - RNA, 21 nt, Human
uagacaaauacucauguguau

SEQ ID NO: 2920222 - RNA, 21 nt, Human
aauuuuuuucaucuucucugg

SEQ ID NO: 2920223 - RNA, 22 nt, Human
aauuuuucucuaacucagaaac

SEQ ID NO: 2920224 - RNA, 20 nt, Human
aauuuuucucuaacucagaa

SEQ ID NO: 2920225 - RNA, 18 nt, Human
aauuuaauucauguuucu

SEQ ID NO: 2920226 - RNA, 23 nt, Human
aauuuaauucauguuucuuaaau

SEQ ID NO: 2920227 - RNA, 19 nt, Human
aauuuaauucauguuucuu

SEQ ID NO: 2920228 - RNA, 17 nt, Human
uacugaagguaaaauug

SEQ ID NO: 2920229 - RNA, 20 nt, Human
uacucuuaagccaucuuggu

SEQ ID NO: 2920230 - RNA, 21 nt, Human
uacucuuaagccaucuuggua

SEQ ID NO: 2920231 - RNA, 22 nt, Human
uacucuuaagccaucuugguaa

SEQ ID NO: 2920232 - RNA, 23 nt, Human
uacucuuaagccaucuugguaaa

SEQ ID NO: 2920233 - RNA, 19 nt, Human
uacucuguuccuucacauc

SEQ ID NO: 2920234 - RNA, 14 nt, Human
uacucuguuccuuc

SEQ ID NO: 2920235 - RNA, 14 nt, Human
uacucuuaagccau

SEQ ID NO: 2920236 - RNA, 15 nt, Human
uacucuuaagccauc

SEQ ID NO: 2920237 - RNA, 16 nt, Human
uacucuuaagccaucu

SEQ ID NO: 2920238 - RNA, 17 nt, Human
uacucuuaagccaucuu

SEQ ID NO: 2920239 - RNA, 15 nt, Human
aauucuuacauguuu

SEQ ID NO: 2920240 - RNA, 13 nt, Human
aauucuuacaugu

SEQ ID NO: 2920241 - RNA, 21 nt, Human
aauugaaaggcauucucugaa

SEQ ID NO: 2920242 - RNA, 17 nt, Human
aauugaaaggcauucuc

SEQ ID NO: 2920243 - RNA, 22 nt, Human
aauugaaaggcauucucugaag

SEQ ID NO: 2920244 - RNA, 12 nt, Human
aauguagauuuu

SEQ ID NO: 2920245 - RNA, 12 nt, Human
uacauacugcug

SEQ ID NO: 2920246 - RNA, 13 nt, Human
uacauacugcugu

SEQ ID NO: 2920247 - RNA, 14 nt, Human
uaauucauguuucu

SEQ ID NO: 2920248 - RNA, 22 nt, Human
uaaugugcuguguaaaguuagu

SEQ ID NO: 2920249 - RNA, 20 nt, Human
uaaugugcuguguaaaguua

SEQ ID NO: 2920250 - RNA, 21 nt, Human
uaaugugcuguguaaaguuag

SEQ ID NO: 2920251 - RNA, 12 nt, Human
uaaugugcugug

SEQ ID NO: 2920252 - RNA, 13 nt, Human
uaaugugcugugu

SEQ ID NO: 2920253 - RNA, 14 nt, Human
uaaugugcugugua

SEQ ID NO: 2920254 - RNA, 15 nt, Human
uaaugugcuguguaa

SEQ ID NO: 2920255 - RNA, 16 nt, Human
uaaugugcuguguaaa

SEQ ID NO: 2920256 - RNA, 17 nt, Human
uaaugugcuguguaaag

SEQ ID NO: 2920257 - RNA, 18 nt, Human
uaaugugcuguguaaagu

SEQ ID NO: 2920258 - RNA, 19 nt, Human
uaaugugcuguguaaaguu

SEQ ID NO: 2920259 - RNA, 17 nt, Human
gugaaguuagaauuccu

SEQ ID NO: 2920260 - RNA, 18 nt, Human
gugaaguuagaauuccuu

SEQ ID NO: 2920261 - RNA, 14 nt, Human
gugaaguuagaauu

SEQ ID NO: 2920262 - RNA, 19 nt, Human
gugaaguauacuguauuuu

SEQ ID NO: 2920263 - RNA, 17 nt, Human
gugaaguauacuguauu

SEQ ID NO: 2920264 - RNA, 21 nt, Human
aaccuguugauagcaagugaa

SEQ ID NO: 2920265 - RNA, 21 nt, Human
aaccuugguguaguugaacug

SEQ ID NO: 2920266 - RNA, 22 nt, Human
aaccuugguguaguugaacuga

SEQ ID NO: 2920267 - RNA, 23 nt, Human
gucuacucuuaagccaucuuggu

SEQ ID NO: 2920268 - RNA, 17 nt, Human
gucuacucuuaagccau

SEQ ID NO: 2920269 - RNA, 18 nt, Human
gucuacucuuaagccauc

SEQ ID NO: 2920270 - RNA, 19 nt, Human
gucuacucuuaagccaucu

SEQ ID NO: 2920271 - RNA, 23 nt, Human
aacauuaaaacaauauuguuucu

SEQ ID NO: 2920272 - RNA, 21 nt, Human
aacauuaaaacaauauuguuu

SEQ ID NO: 2920273 - RNA, 23 nt, Human
aacagucugaucgugacgcugaa

SEQ ID NO: 2920274 - RNA, 22 nt, Human
aacagguuauuuuaguuucugu

SEQ ID NO: 2920275 - RNA, 12 nt, Human
aacagucugauc

SEQ ID NO: 2920276 - RNA, 16 nt, Human
aacagguuauuuuagu

SEQ ID NO: 2920277 - RNA, 20 nt, Human
aacagguuauuuuaguuucu

SEQ ID NO: 2920278 - RNA, 21 nt, Human
aacagguuauuuuaguuucug

SEQ ID NO: 2920279 - RNA, 23 nt, Human
gugguggcagggccuagcugcua

SEQ ID NO: 2920280 - RNA, 15 nt, Human
gugguggcagggccu

SEQ ID NO: 2920281 - RNA, 17 nt, Human
gugguggcagggccuag

SEQ ID NO: 2920282 - RNA, 21 nt, Human
gugguggcagggccuagcugc

SEQ ID NO: 2920283 - RNA, 18 nt, Human
guuucuagggaaaugaaa

SEQ ID NO: 2920284 - RNA, 15 nt, Human
guuucuagggaaaug

SEQ ID NO: 2920285 - RNA, 13 nt, Human
guuucucugcugu

SEQ ID NO: 2920286 - RNA, 12 nt, Human
guuucucugcug

SEQ ID NO: 2920287 - RNA, 16 nt, Human
aaggguuuuaauguag

SEQ ID NO: 2920288 - RNA, 21 nt, Human
aagucagugcccaacuguuau

SEQ ID NO: 2920289 - RNA, 20 nt, Human
aagucagugcccaacuguua

SEQ ID NO: 2920290 - RNA, 12 nt, Human
aagugacaggga

SEQ ID NO: 2920291 - RNA, 22 nt, Human
aagugacagggaagcuacaggu

SEQ ID NO: 2920292 - RNA, 23 nt, Human
aagugacagggaagcuacagguu

SEQ ID NO: 2920293 - RNA, 15 nt, Human
aagugacagggaagc

SEQ ID NO: 2920294 - RNA, 16 nt, Human
aagugacagggaagcu

SEQ ID NO: 2920295 - RNA, 19 nt, Human
aagugacagggaagcuaca

SEQ ID NO: 2920296 - RNA, 20 nt, Human
aagugacagggaagcuacag

SEQ ID NO: 2920297 - RNA, 19 nt, Human
aagugaauuuuucucuaac

SEQ ID NO: 2920298 - RNA, 17 nt, Human
aagugaauuuuucucua

SEQ ID NO: 2920299 - RNA, 14 nt, Human
aagugaauuuuucu

SEQ ID NO: 2920300 - RNA, 22 nt, Human
guucuguggaaaguguaaagca

SEQ ID NO: 2920301 - RNA, 20 nt, Human
guucuguggaaaguguaaag

SEQ ID NO: 2920302 - RNA, 21 nt, Human
guucuguggaaaguguaaagc

SEQ ID NO: 2920303 - RNA, 14 nt, Human
guucuguggaaagu

SEQ ID NO: 2920304 - RNA, 16 nt, Human
guucuguggaaagugu

SEQ ID NO: 2920305 - RNA, 17 nt, Human
guucuguggaaagugua

SEQ ID NO: 2920306 - RNA, 19 nt, Human
guucuguggaaaguguaaa

SEQ ID NO: 2920307 - RNA, 11 nt, Human
guucuguggaa

SEQ ID NO: 2920308 - RNA, 12 nt, Human
guucuguggaaa

SEQ ID NO: 2920309 - RNA, 18 nt, Human
guucuauuuggaauuuau

SEQ ID NO: 2920310 - RNA, 14 nt, Human
guucuauuuggaau

SEQ ID NO: 2920311 - RNA, 15 nt, Human
guucuauuuggaauu

SEQ ID NO: 2920312 - RNA, 13 nt, Human
guucuauuuggaa

SEQ ID NO: 2920313 - RNA, 14 nt, Human
uaaagauuucuuga

SEQ ID NO: 2920314 - RNA, 20 nt, Human
uaaagacaaagacaaauucu

SEQ ID NO: 2920315 - RNA, 19 nt, Human
uaaagacaaagacaaauuc

SEQ ID NO: 2920316 - RNA, 22 nt, Human
uaaagacaaagacaaauucugu

SEQ ID NO: 2920317 - RNA, 15 nt, Human
uaaagacaaagacaa

SEQ ID NO: 2920318 - RNA, 11 nt, Human
uaaagacaaag

SEQ ID NO: 2920319 - RNA, 22 nt, Human
uaaacgauuuaauucucuugaa

SEQ ID NO: 2920320 - RNA, 18 nt, Human
uaaacgauuuaauucucu

SEQ ID NO: 2920321 - RNA, 16 nt, Human
aaguuucaguugauuu

SEQ ID NO: 2920322 - RNA, 19 nt, Human
uaaaauuauagaugggaau

SEQ ID NO: 2920323 - RNA, 14 nt, Human
uaaaauuaaagcua

SEQ ID NO: 2920324 - RNA, 15 nt, Human
uaaauuuuaauuuau

SEQ ID NO: 2920325 - RNA, 21 nt, Human
aucauguguaaucaauaaacg

SEQ ID NO: 2920326 - RNA, 13 nt, Human
aucauguguaauc

SEQ ID NO: 2920327 - RNA, 15 nt, Human
aucauguguaaucaa

SEQ ID NO: 2920328 - RNA, 19 nt, Human
aucauguguaaucaauaaa

SEQ ID NO: 2920329 - RNA, 20 nt, Human
aucauguguaaucaauaaac

SEQ ID NO: 2920330 - RNA, 18 nt, Human
augcaucuuacugaaggu

SEQ ID NO: 2920331 - RNA, 16 nt, Human
augcaucuuacugaag

SEQ ID NO: 2920332 - RNA, 14 nt, Human
augcaucuuacuga

SEQ ID NO: 2920333 - RNA, 21 nt, Human
augauguuucgugaaguauac

SEQ ID NO: 2920334 - RNA, 22 nt, Human
auguggcuguaucuuguuuuuc

SEQ ID NO: 2920335 - RNA, 19 nt, Human
auguuuuagacaaauacuc

SEQ ID NO: 2920336 - RNA, 22 nt, Human
auguuuuagacaaauacucaug

SEQ ID NO: 2920337 - RNA, 23 nt, Human
auguuuuagacaaauacucaugu

SEQ ID NO: 2920338 - RNA, 15 nt, Human
auuaaauauaauaug

SEQ ID NO: 2920339 - RNA, 19 nt, Human
agugacagggaagcuacag

SEQ ID NO: 2920340 - RNA, 20 nt, Human
agugacagggaagcuacagg

SEQ ID NO: 2920341 - RNA, 22 nt, Human
agugacagggaagcuacagguu

SEQ ID NO: 2920342 - RNA, 23 nt, Human
agugacagggaagcuacagguua

SEQ ID NO: 2920343 - RNA, 22 nt, Human
agucugaucgugacgcugaaua

SEQ ID NO: 2920344 - RNA, 23 nt, Human
agucugaucgugacgcugaauaa

SEQ ID NO: 2920345 - RNA, 18 nt, Human
agucugaucgugacgcug

SEQ ID NO: 2920346 - RNA, 20 nt, Human
agucugaucgugacgcugaa

SEQ ID NO: 2920347 - RNA, 21 nt, Human
agucugaucgugacgcugaau

SEQ ID NO: 2920348 - RNA, 16 nt, Human
agugacagggaagcua

SEQ ID NO: 2920349 - RNA, 13 nt, Human
agugacagggaag

SEQ ID NO: 2920350 - RNA, 13 nt, Human
aguugaacugaua

SEQ ID NO: 2920351 - RNA, 23 nt, Human
aguugaacugauaguuacuguug

SEQ ID NO: 2920352 - RNA, 16 nt, Human
aguggcugucaucagc

SEQ ID NO: 2920353 - RNA, 17 nt, Human
aguggcugucaucagcc

SEQ ID NO: 2920354 - RNA, 21 nt, Human
auauuaucaugcaaaugcugu

SEQ ID NO: 2920355 - RNA, 19 nt, Human
auauuaucaugcaaaugcu

SEQ ID NO: 2920356 - RNA, 17 nt, Human
agguuauuuuaguuucu

SEQ ID NO: 2920357 - RNA, 19 nt, Human
agguuauuuuaguuucugu

SEQ ID NO: 2920358 - RNA, 20 nt, Human
agguuauuuuaguuucuguu

SEQ ID NO: 2920359 - RNA, 16 nt, Human
agguuacaacagauuu

SEQ ID NO: 2920360 - RNA, 19 nt, Human
agguuacaacagauuugug

SEQ ID NO: 2920361 - RNA, 15 nt, Human
agguuacaacagauu

SEQ ID NO: 2920362 - RNA, 21 nt, Human
agguuacaacagauuugugaa

SEQ ID NO: 2920363 - RNA, 22 nt, Human
agguuacaacagauuugugaac

SEQ ID NO: 2920364 - RNA, 23 nt, Human
agguuacaacagauuugugaacu

SEQ ID NO: 2920365 - RNA, 24 nt, Human
agguuacaacagauuugugaacuc

SEQ ID NO: 2920366 - RNA, 19 nt, Human
agguaaaauugaaaggcau

SEQ ID NO: 2920367 - RNA, 22 nt, Human
agcugcuacaaagaagacaugu

SEQ ID NO: 2920368 - RNA, 20 nt, Human
agcugcuacaaagaagacau

SEQ ID NO: 2920369 - RNA, 21 nt, Human
agcugcuacaaagaagacaug

SEQ ID NO: 2920370 - RNA, 16 nt, Human
agcugcuacaaagaag

SEQ ID NO: 2920371 - RNA, 17 nt, Human
agcugcuacaaagaaga

SEQ ID NO: 2920372 - RNA, 18 nt, Human
agcugcuacaaagaagac

SEQ ID NO: 2920373 - RNA, 19 nt, Human
agcugcuacaaagaagaca

SEQ ID NO: 2920374 - RNA, 11 nt, Human
agcugcuacaa

SEQ ID NO: 2920375 - RNA, 13 nt, Human
agcugcuacaaag

SEQ ID NO: 2920376 - RNA, 14 nt, Human
agcugcuacaaaga

SEQ ID NO: 2920377 - RNA, 15 nt, Human
agcugcuacaaagaa

SEQ ID NO: 2920378 - RNA, 21 nt, Human
agacaaauucuguuucuugag

SEQ ID NO: 2920379 - RNA, 19 nt, Human
agacaaauucuguuucuug

SEQ ID NO: 2920380 - RNA, 18 nt, Human
agacaaauucuguuucuu

SEQ ID NO: 2920381 - RNA, 17 nt, Human
agacaaauucuguuucu

SEQ ID NO: 2920382 - RNA, 20 nt, Human
agcaugaauuuuuuucaucu

SEQ ID NO: 2920383 - RNA, 15 nt, Human
aaugguuauaaaagu

SEQ ID NO: 2920384 - RNA, 16 nt, Human
aaugguuauaaaagug

SEQ ID NO: 2920385 - RNA, 17 nt, Human
aaugguuauaaaaguga

SEQ ID NO: 2920386 - RNA, 19 nt, Human
aaugguuauaaaagugauu

SEQ ID NO: 2920387 - RNA, 14 nt, Human
aaugguuauaaaag

SEQ ID NO: 2920388 - RNA, 21 nt, Human
aaugucuuuuuuuuaaugugc

SEQ ID NO: 2920389 - RNA, 22 nt, Human
aaugucuuuuuuuuaaugugcu

SEQ ID NO: 2920390 - RNA, 21 nt, Human
aauauuagcuuuacuguuugu

SEQ ID NO: 2920391 - RNA, 19 nt, Human
aauauuagcuuuacuguuu

SEQ ID NO: 2920392 - RNA, 18 nt, Human
aauauuagcuuuacuguu

SEQ ID NO: 2920393 - RNA, 15 nt, Human
aauauuagcuuuacu

SEQ ID NO: 2920394 - RNA, 17 nt, Human
aauauaucuaaauugaa

SEQ ID NO: 2920395 - RNA, 18 nt, Human
aauauaucuaaauugaau

SEQ ID NO: 2920396 - RNA, 20 nt, Human
aauauaucuaaauugaauaa

SEQ ID NO: 2920397 - RNA, 21 nt, Human
aauauaucuaaauugaauaau

SEQ ID NO: 2920398 - RNA, 22 nt, Human
aauagaaggauguacauuucca

SEQ ID NO: 2920399 - RNA, 20 nt, Human
aauagaaggauguacauuuc

SEQ ID NO: 2920400 - RNA, 19 nt, Human
aauagaaggauguacauuu

SEQ ID NO: 2920401 - RNA, 12 nt, Human
aauacucaugug

SEQ ID NO: 2920402 - RNA, 13 nt, Human
aauacucaugugu

SEQ ID NO: 2920403 - RNA, 14 nt, Human
aauacucaugugua

SEQ ID NO: 2920404 - RNA, 15 nt, Human
aauacucauguguau

SEQ ID NO: 2920405 - RNA, 16 nt, Human
aauacucauguguaug

SEQ ID NO: 2920406 - RNA, 13 nt, Human
aagcuacagguua

SEQ ID NO: 2920407 - RNA, 14 nt, Human
aagcuacagguuac

SEQ ID NO: 2920408 - RNA, 15 nt, Human
aagcuacagguuaca

SEQ ID NO: 2920409 - RNA, 18 nt, Human
aagcuacagguuacaaca

SEQ ID NO: 2920410 - RNA, 19 nt, Human
aagcuacagguuacaacag

SEQ ID NO: 2920411 - RNA, 20 nt, Human
aagcuacagguuacaacaga

SEQ ID NO: 2920412 - RNA, 21 nt, Human
aagcuacagguuacaacagau

SEQ ID NO: 2920413 - RNA, 22 nt, Human
aagcuacagguuacaacagauu

SEQ ID NO: 2920414 - RNA, 20 nt, Human
aaguguaaagcauuccaaca

SEQ ID NO: 2920415 - RNA, 21 nt, Human
aaguguaaagcauuccaacaa

SEQ ID NO: 2920416 - RNA, 22 nt, Human
aaguguaaagcauuccaacaaa

SEQ ID NO: 2920417 - RNA, 12 nt, Human
aaguguaacugg

SEQ ID NO: 2920418 - RNA, 11 nt, Human
aaguguaacug

SEQ ID NO: 2920419 - RNA, 20 nt, Human
aaauugaaaggcauucucug

SEQ ID NO: 2920420 - RNA, 23 nt, Human
aaauugaaaggcauucucugaag

SEQ ID NO: 2920421 - RNA, 22 nt, Human
aaauugaaaggcauucucugaa

SEQ ID NO: 2920422 - RNA, 13 nt, Human
aaauugaauaaug

SEQ ID NO: 2920423 - RNA, 23 nt, Human
aaauugaauaaugguaccagaua

SEQ ID NO: 2920424 - RNA, 18 nt, Human
aacacauuugauucugug

SEQ ID NO: 2920425 - RNA, 17 nt, Human
aacgauuuaauucucuu

SEQ ID NO: 2920426 - RNA, 18 nt, Human
aacgauuuaauucucuug

SEQ ID NO: 2920427 - RNA, 20 nt, Human
aacgauuuaauucucuugaa

SEQ ID NO: 2920428 - RNA, 21 nt, Human
aacucagaaacaucaguuacu

SEQ ID NO: 2920429 - RNA, 16 nt, Human
aacuuaaauuuuaauu

SEQ ID NO: 2920430 - RNA, 19 nt, Human
aacuuaaauuuuaauuuau

SEQ ID NO: 2920431 - RNA, 22 nt, Human
aacugauaguuacuguugugac

SEQ ID NO: 2920432 - RNA, 15 nt, Human
aacugauaguuacug

SEQ ID NO: 2920433 - RNA, 16 nt, Human
aacugauaguuacugu

SEQ ID NO: 2920434 - RNA, 17 nt, Human
aacugauaguuacuguu

SEQ ID NO: 2920435 - RNA, 19 nt, Human
aacugauaguuacuguugu

SEQ ID NO: 2920436 - RNA, 23 nt, Human
aacugauaguuacuguugugacc

SEQ ID NO: 2920437 - RNA, 17 nt, Human
aaaagugauuguuggca

SEQ ID NO: 2920438 - RNA, 21 nt, Human
aaaaacucgaggacuguauuu

SEQ ID NO: 2920439 - RNA, 17 nt, Human
aaaaacucgaggacugu

SEQ ID NO: 2920440 - RNA, 14 nt, Human
aaaaguugaaauua

SEQ ID NO: 2920441 - RNA, 12 nt, Human
aaaaguugaaau

SEQ ID NO: 2920442 - RNA, 13 nt, Human
aaaaucauggaau

SEQ ID NO: 2920443 - RNA, 22 nt, Human
aaaaucauggaaugguuauaaa

SEQ ID NO: 2920444 - RNA, 17 nt, Human
aaaaucauggaaugguu

SEQ ID NO: 2920445 - RNA, 19 nt, Human
aaaaucauggaaugguuau

SEQ ID NO: 2920446 - RNA, 21 nt, Human
aaagaagacauguuuuagaca

SEQ ID NO: 2920447 - RNA, 15 nt, Human
aaagaagacauguuu

SEQ ID NO: 2920448 - RNA, 18 nt, Human
aaagaagacauguuuuag

SEQ ID NO: 2920449 - RNA, 23 nt, Human
aaagccaaguuuauauacaauua

SEQ ID NO: 2920450 - RNA, 12 nt, Human
acaauugaaaug

SEQ ID NO: 2920451 - RNA, 20 nt, Human
accagauaaaauuauagaug

SEQ ID NO: 2920452 - RNA, 15 nt, Human
acuguuucucugcug

SEQ ID NO: 2920453 - RNA, 14 nt, Human
acuguuucucugcu

SEQ ID NO: 2920454 - RNA, 13 nt, Human
acuguuucucugc

SEQ ID NO: 2920455 - RNA, 20 nt, Human
acugguuguugccaaacagc

SEQ ID NO: 2920456 - RNA, 23 nt, Human
accuugguguaguugaacugaua

SEQ ID NO: 2920457 - RNA, 20 nt, Human
acuaauuguauaacagguua

SEQ ID NO: 2920458 - RNA, 22 nt, Human
acuaauuguauaacagguuauu

SEQ ID NO: 2920459 - RNA, 16 nt, Human
acuaauuguauaacag

SEQ ID NO: 2920460 - RNA, 17 nt, Human
acuaauuguauaacagg

SEQ ID NO: 2920461 - RNA, 18 nt, Human
acuaauuguauaacaggu

SEQ ID NO: 2920462 - RNA, 19 nt, Human
acuaauuguauaacagguu

SEQ ID NO: 2920463 - RNA, 14 nt, Human
acuaauuguauaac

SEQ ID NO: 2920464 - RNA, 15 nt, Human
acuaauuguauaaca

SEQ ID NO: 2920465 - RNA, 14 nt, Human
acucagccaagcac

SEQ ID NO: 2920466 - RNA, 15 nt, Human
acucagccaagcaca

SEQ ID NO: 2920467 - RNA, 16 nt, Human
acucagccaagcacag

SEQ ID NO: 2920468 - RNA, 17 nt, Human
acucagccaagcacagu

SEQ ID NO: 2920469 - RNA, 18 nt, Human
acucagccaagcacagug

SEQ ID NO: 2920470 - RNA, 22 nt, Human
acucagccaagcacaguggugg

SEQ ID NO: 2920471 - RNA, 23 nt, Human
acucagccaagcacagugguggc

SEQ ID NO: 2920472 - RNA, 20 nt, Human
acuauuuaguuuuuguaauu

SEQ ID NO: 2920473 - RNA, 21 nt, Human
acuauuuaguuuuuguaauuu

SEQ ID NO: 2920474 - RNA, 23 nt, Human
acuauuuaguuuuuguaauuuau

SEQ ID NO: 2920475 - RNA, 16 nt, Human
caccccaugcuguuga

SEQ ID NO: 2920476 - RNA, 12 nt, Human
caccccaugcug

SEQ ID NO: 2920477 - RNA, 22 nt, Human
caccccaugcuguugauugcua

SEQ ID NO: 2920478 - RNA, 13 nt, Human
caacaucuagcaa

SEQ ID NO: 2920479 - RNA, 20 nt, Human
caacauuaaaacaauauugu

SEQ ID NO: 2920480 - RNA, 22 nt, Human
caaagcuuagcaggagaggaga

SEQ ID NO: 2920481 - RNA, 17 nt, Human
caaagcuuagcaggaga

SEQ ID NO: 2920482 - RNA, 18 nt, Human
caaagcuuagcaggagag

SEQ ID NO: 2920483 - RNA, 14 nt, Human
caaagcuuagcagg

SEQ ID NO: 2920484 - RNA, 15 nt, Human
caaagcuuagcagga

SEQ ID NO: 2920485 - RNA, 16 nt, Human
caaagcuuagcaggag

SEQ ID NO: 2920486 - RNA, 15 nt, Human
caaaaaacucgagga

SEQ ID NO: 2920487 - RNA, 21 nt, Human
caaaaaacucgaggacuguau

SEQ ID NO: 2920488 - RNA, 20 nt, Human
caaauguguaucggaugcuu

SEQ ID NO: 2920489 - RNA, 17 nt, Human
uugcgaaugguuccauu

SEQ ID NO: 2920490 - RNA, 23 nt, Human
uugguaaauuuccccaacagugu

SEQ ID NO: 2920491 - RNA, 22 nt, Human
uugguaaauuuccccaacagug

SEQ ID NO: 2920492 - RNA, 20 nt, Human
uucuguggaaaguguaaagc

SEQ ID NO: 2920493 - RNA, 18 nt, Human
uucuguggaaaguguaaa

SEQ ID NO: 2920494 - RNA, 19 nt, Human
uucuguggaaaguguaaag

SEQ ID NO: 2920495 - RNA, 13 nt, Human
uucuguggaaagu

SEQ ID NO: 2920496 - RNA, 15 nt, Human
uucuguggaaagugu

SEQ ID NO: 2920497 - RNA, 16 nt, Human
uucuguggaaagugua

SEQ ID NO: 2920498 - RNA, 17 nt, Human
uucuguggaaaguguaa

SEQ ID NO: 2920499 - RNA, 19 nt, Human
uuucacaguguguuuguga

SEQ ID NO: 2920500 - RNA, 13 nt, Human
uuuccacuacugc

SEQ ID NO: 2920501 - RNA, 15 nt, Human
uuuccacuacugcua

SEQ ID NO: 2920502 - RNA, 14 nt, Human
uuuccacuacugcu

SEQ ID NO: 2920503 - RNA, 23 nt, Human
uuugauauccaaagcugaauaca

SEQ ID NO: 2920504 - RNA, 17 nt, Human
uuugauauccaaagcug

SEQ ID NO: 2920505 - RNA, 15 nt, Human
uuucuuaaaugggcu

SEQ ID NO: 2920506 - RNA, 18 nt, Human
uuguuuuaaaauuaaagc

SEQ ID NO: 2920507 - RNA, 20 nt, Human
uuguuuuaaaauuaaagcua

SEQ ID NO: 2920508 - RNA, 15 nt, Human
uuuacauacugcugu

SEQ ID NO: 2920509 - RNA, 16 nt, Human
uuauuuuaguuucugu

SEQ ID NO: 2920510 - RNA, 22 nt, Human
uucaucuuggucacauacaauu

SEQ ID NO: 2920511 - RNA, 15 nt, Human
uuccaaauucacaag

SEQ ID NO: 2920512 - RNA, 15 nt, Human
uuccaacaaaggguu

SEQ ID NO: 2920513 - RNA, 16 nt, Human
uuccaacaaaggguuu

SEQ ID NO: 2920514 - RNA, 21 nt, Human
uuccaacaaaggguuuuaaug

SEQ ID NO: 2920515 - RNA, 23 nt, Human
uuccaaauucacaaguuguguuu

SEQ ID NO: 2920516 - RNA, 14 nt, Human
uuccaacaaagggu

SEQ ID NO: 2920517 - RNA, 15 nt, Human
uuccacuacugcuac

SEQ ID NO: 2920518 - RNA, 14 nt, Human
uuccuauguaacug

SEQ ID NO: 2920519 - RNA, 15 nt, Human
uucccuccugcuacu

SEQ ID NO: 2920520 - RNA, 15 nt, Human
uuacuguuuguuaug

SEQ ID NO: 2920521 - RNA, 14 nt, Human
uuacuguugugacc

SEQ ID NO: 2920522 - RNA, 15 nt, Human
uuacuguugugaccu

SEQ ID NO: 2920523 - RNA, 17 nt, Human
uuagcuuuacuguuugu

SEQ ID NO: 2920524 - RNA, 16 nt, Human
uuagcuuuacuguuug

SEQ ID NO: 2920525 - RNA, 15 nt, Human
uuagcuuuacuguuu

SEQ ID NO: 2920526 - RNA, 19 nt, Human
uuagucuacucuuaagcca

SEQ ID NO: 2920527 - RNA, 20 nt, Human
uuagucuacucuuaagccau

SEQ ID NO: 2920528 - RNA, 21 nt, Human
uuagucuacucuuaagccauc

SEQ ID NO: 2920529 - RNA, 22 nt, Human
uuagucuacucuuaagccaucu

SEQ ID NO: 2920530 - RNA, 16 nt, Human
uuaggcuauucacaac

SEQ ID NO: 2920531 - RNA, 15 nt, Human
uuaggcuauucacaa

SEQ ID NO: 2920532 - RNA, 22 nt, Human
uuaacuuaaauuuuaauuuauu

SEQ ID NO: 2920533 - RNA, 21 nt, Human
uuaaagacaaagacaaauucu

SEQ ID NO: 2920534 - RNA, 17 nt, Human
uuacaauugaaaugacu

SEQ ID NO: 2920535 - RNA, 15 nt, Human
uuacaauugaaauga

SEQ ID NO: 2920536 - RNA, 14 nt, Human
uuacaauugaaaug

SEQ ID NO: 2920537 - RNA, 13 nt, Human
uuacaauugaaau

SEQ ID NO: 2920538 - RNA, 15 nt, Human
uuaauguagauuuuu

SEQ ID NO: 2920539 - RNA, 21 nt, Human
uuaaugugcuguguaaaguua

SEQ ID NO: 2920540 - RNA, 22 nt, Human
uuaaugugcuguguaaaguuag

SEQ ID NO: 2920541 - RNA, 16 nt, Human
uuaaugugcuguguaa

SEQ ID NO: 2920542 - RNA, 17 nt, Human
uuaaugugcuguguaaa

SEQ ID NO: 2920543 - RNA, 18 nt, Human
uuaaugugcuguguaaag

SEQ ID NO: 2920544 - RNA, 19 nt, Human
uuaaugugcuguguaaagu

SEQ ID NO: 2920545 - RNA, 14 nt, Human
uuaaugugcugugu

SEQ ID NO: 2920546 - RNA, 15 nt, Human
uuaaugugcugugua

SEQ ID NO: 2920547 - RNA, 21 nt, Human
uguuucgcugauauauguguu

SEQ ID NO: 2920548 - RNA, 20 nt, Human
uguuucgugaaguauacugu

SEQ ID NO: 2920549 - RNA, 19 nt, Human
uguuucgugaaguauacug

SEQ ID NO: 2920550 - RNA, 15 nt, Human
uguuucgugaaguau

SEQ ID NO: 2920551 - RNA, 21 nt, Human
uuaaaagggauuacccaagca

SEQ ID NO: 2920552 - RNA, 23 nt, Human
uuaaaagggauuacccaagcaaa

SEQ ID NO: 2920553 - RNA, 19 nt, Human
ugcuguugauugcuaaaug

SEQ ID NO: 2920554 - RNA, 20 nt, Human
ugcuguugauugcuaaaugu

SEQ ID NO: 2920555 - RNA, 22 nt, Human
ugcuguugauugcuaaauguaa

SEQ ID NO: 2920556 - RNA, 12 nt, Human
ugcuguugauug

SEQ ID NO: 2920557 - RNA, 15 nt, Human
ugcuguugauugcua

SEQ ID NO: 2920558 - RNA, 16 nt, Human
ugcuguugauugcuaa

SEQ ID NO: 2920559 - RNA, 17 nt, Human
ugcuguugauugcuaaa

SEQ ID NO: 2920560 - RNA, 18 nt, Human
ugcuguugauugcuaaau

SEQ ID NO: 2920561 - RNA, 13 nt, Human
ugcauauguuucg

SEQ ID NO: 2920562 - RNA, 13 nt, Human
ugcuguguaaagu

SEQ ID NO: 2920563 - RNA, 14 nt, Human
ugcuguguaaaguu

SEQ ID NO: 2920564 - RNA, 15 nt, Human
ugcuguguaaaguua

SEQ ID NO: 2920565 - RNA, 17 nt, Human
ugcuguguaaaguuagu

SEQ ID NO: 2920566 - RNA, 12 nt, Human
ugcuguguaaag

SEQ ID NO: 2920567 - RNA, 16 nt, Human
ugcuacucuguuccuu

SEQ ID NO: 2920568 - RNA, 15 nt, Human
ugcuacucuguuccu

SEQ ID NO: 2920569 - RNA, 20 nt, Human
ugaguuuuguuuuaaaauua

SEQ ID NO: 2920570 - RNA, 23 nt, Human
ugauagcaagugaauuuuucucu

SEQ ID NO: 2920571 - RNA, 16 nt, Human
ugauuguuugcucuga

SEQ ID NO: 2920572 - RNA, 14 nt, Human
ugauuguuggcaca

SEQ ID NO: 2920573 - RNA, 22 nt, Human
ugauugcuaaauguaacagucu

SEQ ID NO: 2920574 - RNA, 19 nt, Human
ugauugcuaaauguaacag

SEQ ID NO: 2920575 - RNA, 20 nt, Human
ugauugcuaaauguaacagu

SEQ ID NO: 2920576 - RNA, 13 nt, Human
ugauugcuaaaug

SEQ ID NO: 2920577 - RNA, 14 nt, Human
ugauugcuaaaugu

SEQ ID NO: 2920578 - RNA, 15 nt, Human
ugauugcuaaaugua

SEQ ID NO: 2920579 - RNA, 16 nt, Human
ugauugcuaaauguaa

SEQ ID NO: 2920580 - RNA, 13 nt, Human
ugauucugugugu

SEQ ID NO: 2920581 - RNA, 15 nt, Human
ugauucuguguguuu

SEQ ID NO: 2920582 - RNA, 22 nt, Human
ucuuucaaagguagccaucaug

SEQ ID NO: 2920583 - RNA, 20 nt, Human
ucuuucaaagguagccauca

SEQ ID NO: 2920584 - RNA, 21 nt, Human
ucuuguuuuuccacuacugcu

SEQ ID NO: 2920585 - RNA, 20 nt, Human
ucuuguuuuuccacuacugc

SEQ ID NO: 2920586 - RNA, 13 nt, Human
ucuuguuuuucca

SEQ ID NO: 2920587 - RNA, 18 nt, Human
ugaaauuaaccauagaug

SEQ ID NO: 2920588 - RNA, 22 nt, Human
ugaaauuaaccauagauguaga

SEQ ID NO: 2920589 - RNA, 19 nt, Human
ugaaaggcauucucugaag

SEQ ID NO: 2920590 - RNA, 17 nt, Human
ugaaaggcauucucuga

SEQ ID NO: 2920591 - RNA, 14 nt, Human
ugaaguuagaauuc

SEQ ID NO: 2920592 - RNA, 15 nt, Human
ugaaguuagaauucc

SEQ ID NO: 2920593 - RNA, 16 nt, Human
ugaaguucaccauuaa

SEQ ID NO: 2920594 - RNA, 19 nt, Human
ugaaguuagaauuccuuca

SEQ ID NO: 2920595 - RNA, 21 nt, Human
ugaaguuagaauuccuucagg

SEQ ID NO: 2920596 - RNA, 17 nt, Human
ucucaucugugauuccc

SEQ ID NO: 2920597 - RNA, 13 nt, Human
ucucaucugugau

SEQ ID NO: 2920598 - RNA, 17 nt, Human
ucgugacgcugaauaaa

SEQ ID NO: 2920599 - RNA, 18 nt, Human
ucgugacgcugaauaaau

SEQ ID NO: 2920600 - RNA, 17 nt, Human
ucgugaaguauacugua

SEQ ID NO: 2920601 - RNA, 19 nt, Human
ucgugaaguauacuguauu

SEQ ID NO: 2920602 - RNA, 16 nt, Human
uccuccauacucagga

SEQ ID NO: 2920603 - RNA, 13 nt, Human
uccauuaucaugu

SEQ ID NO: 2920604 - RNA, 14 nt, Human
uccauuaucaugug

SEQ ID NO: 2920605 - RNA, 15 nt, Human
uccauuaucaugugu

SEQ ID NO: 2920606 - RNA, 16 nt, Human
uccauuaucaugugua

SEQ ID NO: 2920607 - RNA, 17 nt, Human
uccauuaucauguguaa

SEQ ID NO: 2920608 - RNA, 14 nt, Human
uccauuauuuauau

SEQ ID NO: 2920609 - RNA, 12 nt, Human
uccauuauuuau

SEQ ID NO: 2920610 - RNA, 11 nt, Human
uccauuauuua

SEQ ID NO: 2920611 - RNA, 20 nt, Human
uccauuaucauguguaauca

SEQ ID NO: 2920612 - RNA, 15 nt, Human
uccauuauuuauauu

SEQ ID NO: 2920613 - RNA, 13 nt, Human
uccauacucagga

SEQ ID NO: 2920614 - RNA, 22 nt, Human
ucauggaaugguuauaaaagug

SEQ ID NO: 2920615 - RNA, 12 nt, Human
ucauggaauggu

SEQ ID NO: 2920616 - RNA, 21 nt, Human
ucauggaaugguuauaaaagu

SEQ ID NO: 2920617 - RNA, 15 nt, Human
uaggcuauucacaac

SEQ ID NO: 2920618 - RNA, 14 nt, Human
uaggcuauucacaa

SEQ ID NO: 2920619 - RNA, 15 nt, Human
uaugcauaaagucag

SEQ ID NO: 2920620 - RNA, 14 nt, Human
uaugcauaaaguca

SEQ ID NO: 2920621 - RNA, 15 nt, Human
uaugcaauauaucua

SEQ ID NO: 2920622 - RNA, 16 nt, Human
uaucuaaauugaauaa

SEQ ID NO: 2920623 - RNA, 17 nt, Human
uaucuaaauugaauaau

SEQ ID NO: 2920624 - RNA, 20 nt, Human
uaucuaaauugaauaauggu

SEQ ID NO: 2920625 - RNA, 21 nt, Human
uaucuaaauugaauaauggua

SEQ ID NO: 2920626 - RNA, 13 nt, Human
uaucuaaauugaa

SEQ ID NO: 2920627 - RNA, 14 nt, Human
uaucuaaauugaau

SEQ ID NO: 2920628 - RNA, 18 nt, Human
uauauguguuuuucacau

SEQ ID NO: 2920629 - RNA, 17 nt, Human
uauguguuuuucacauu

SEQ ID NO: 2920630 - RNA, 16 nt, Human
uauguguuuuucacau

SEQ ID NO: 2920631 - RNA, 15 nt, Human
uauguguuuuucaca

SEQ ID NO: 2920632 - RNA, 22 nt, Human
uauuaucaugcaaaugcuguau

SEQ ID NO: 2920633 - RNA, 18 nt, Human
uauuaucaugcaaaugcu

SEQ ID NO: 2920634 - RNA, 16 nt, Human
uauuaucaugcaaaug

SEQ ID NO: 2920635 - RNA, 18 nt, Human
uauuuaaagacaaagaca

SEQ ID NO: 2920636 - RNA, 17 nt, Human
uauuuaaagacaaagac

SEQ ID NO: 2920637 - RNA, 13 nt, Human
uauuuaaagacaa

SEQ ID NO: 2920638 - RNA, 12 nt, Human
uauuuaaagaca

SEQ ID NO: 2920639 - RNA, 22 nt, Human
ucacaagugaaaaacauccaga

SEQ ID NO: 2920640 - RNA, 16 nt, Human
ucacaagugaaaaaca

SEQ ID NO: 2920641 - RNA, 18 nt, Human
guggcagggccuagcugc

SEQ ID NO: 2920642 - RNA, 22 nt, Human
guggcagggccuagcugcuaca

SEQ ID NO: 2920643 - RNA, 23 nt, Human
guggcagggccuagcugcuacaa

SEQ ID NO: 2920644 - RNA, 15 nt, Human
guggaugauguuucg

SEQ ID NO: 2920645 - RNA, 20 nt, Human
guggagaagccauugucuuc

SEQ ID NO: 2920646 - RNA, 18 nt, Human
guggagaagccauugucu

SEQ ID NO: 2920647 - RNA, 19 nt, Human
guggagaagccauugucuu

SEQ ID NO: 2920648 - RNA, 12 nt, Human
guggagaagcca

SEQ ID NO: 2920649 - RNA, 13 nt, Human
guggagaagccau

SEQ ID NO: 2920650 - RNA, 14 nt, Human
guggagaagccauu

SEQ ID NO: 2920651 - RNA, 15 nt, Human
guggagaagccauug

SEQ ID NO: 2920652 - RNA, 12 nt, Human
gugcuguguaaa

SEQ ID NO: 2920653 - RNA, 13 nt, Human
gugcuguguaaag

SEQ ID NO: 2920654 - RNA, 14 nt, Human
gugcuguguaaagu

SEQ ID NO: 2920655 - RNA, 15 nt, Human
gugcuguguaaaguu

SEQ ID NO: 2920656 - RNA, 16 nt, Human
gugcuguguaaaguua

SEQ ID NO: 2920657 - RNA, 18 nt, Human
gugcuguguaaaguuagu

SEQ ID NO: 2920658 - RNA, 22 nt, Human
gugcuguguaaaguuagucuac

SEQ ID NO: 2920659 - RNA, 23 nt, Human
guggaaaguguaaagcauuccaa

SEQ ID NO: 2920660 - RNA, 20 nt, Human
guggaaaguguaaagcauuc

SEQ ID NO: 2920661 - RNA, 21 nt, Human
guggaaaguguaaagcauucc

SEQ ID NO: 2920662 - RNA, 13 nt, Human
guggaaaguguaa

SEQ ID NO: 2920663 - RNA, 15 nt, Human
guggaaaguguaaag

SEQ ID NO: 2920664 - RNA, 16 nt, Human
guggaaaguguaaagc

SEQ ID NO: 2920665 - RNA, 18 nt, Human
guggaaaguguaaagcau

SEQ ID NO: 2920666 - RNA, 22 nt, Human
gugcuuuccguggcacugcaua

SEQ ID NO: 2920667 - RNA, 18 nt, Human
gugaccuccacagcuacc

SEQ ID NO: 2920668 - RNA, 14 nt, Human
gugaccugaaguuc

SEQ ID NO: 2920669 - RNA, 19 nt, Human
gugaccugaaguucaccau

SEQ ID NO: 2920670 - RNA, 16 nt, Human
gugaauuuuucucuaa

SEQ ID NO: 2920671 - RNA, 21 nt, Human
gugaaauaguucaaagccaag

SEQ ID NO: 2920672 - RNA, 17 nt, Human
gugaaauaguucaaagc

SEQ ID NO: 2920673 - RNA, 15 nt, Human
gugaauuuuucucua

SEQ ID NO: 2920674 - RNA, 14 nt, Human
gugaauuuuucucu

SEQ ID NO: 2920675 - RNA, 19 nt, Human
gucugaucgugacgcugaa

SEQ ID NO: 2920676 - RNA, 20 nt, Human
gucugaucgugacgcugaau

SEQ ID NO: 2920677 - RNA, 21 nt, Human
gucugaucgugacgcugaaua

SEQ ID NO: 2920678 - RNA, 20 nt, Human
guccacugucacuguuucuc

SEQ ID NO: 2920679 - RNA, 11 nt, Human
guauuugugac

SEQ ID NO: 2920680 - RNA, 18 nt, Human
guauuugugacuaauugu

SEQ ID NO: 2920681 - RNA, 20 nt, Human
guauuugugacuaauuguau

SEQ ID NO: 2920682 - RNA, 21 nt, Human
guauuugugacuaauuguaua

SEQ ID NO: 2920683 - RNA, 12 nt, Human
gggcugugaucg

SEQ ID NO: 2920684 - RNA, 12 nt, Human
ggguggagaagc

SEQ ID NO: 2920685 - RNA, 13 nt, Human
ggguggagaagcc

SEQ ID NO: 2920686 - RNA, 14 nt, Human
ggguggagaagcca

SEQ ID NO: 2920687 - RNA, 15 nt, Human
ggguggagaagccau

SEQ ID NO: 2920688 - RNA, 16 nt, Human
ggguggagaagccauu

SEQ ID NO: 2920689 - RNA, 14 nt, Human
guaaaguuagucua

SEQ ID NO: 2920690 - RNA, 18 nt, Human
guaaaguuagucuacucu

SEQ ID NO: 2920691 - RNA, 14 nt, Human
gcuaaauguaacag

SEQ ID NO: 2920692 - RNA, 17 nt, Human
gcuaaauguaacagucu

SEQ ID NO: 2920693 - RNA, 14 nt, Human
gcccggaugcuucu

SEQ ID NO: 2920694 - RNA, 11 nt, Human
gcuuagcagga

SEQ ID NO: 2920695 - RNA, 16 nt, Human
gcuuagcaggagagga

SEQ ID NO: 2920696 - RNA, 18 nt, Human
gcuuagcaggagaggaga

SEQ ID NO: 2920697 - RNA, 21 nt, Human
gcuuagcaggagaggagagcc

SEQ ID NO: 2920698 - RNA, 22 nt, Human
gcuuagcaggagaggagagcca

SEQ ID NO: 2920699 - RNA, 23 nt, Human
gcuuagcaggagaggagagccag

SEQ ID NO: 2920700 - RNA, 15 nt, Human
gcuguugauugcuaa

SEQ ID NO: 2920701 - RNA, 16 nt, Human
gcuguugauugcuaaa

SEQ ID NO: 2920702 - RNA, 19 nt, Human
gcuguugauugcuaaaugu

SEQ ID NO: 2920703 - RNA, 20 nt, Human
gcuguugauugcuaaaugua

SEQ ID NO: 2920704 - RNA, 16 nt, Human
gcuuuacuguuuguua

SEQ ID NO: 2920705 - RNA, 20 nt, Human
ggaaauaauaaagaugcucu

SEQ ID NO: 2920706 - RNA, 18 nt, Human
ggaaaguguaaagcauuc

SEQ ID NO: 2920707 - RNA, 19 nt, Human
ggaaaguguaaagcauucc

SEQ ID NO: 2920708 - RNA, 17 nt, Human
ggagaagccauugucuu

SEQ ID NO: 2920709 - RNA, 12 nt, Human
ggagaggagagc

SEQ ID NO: 2920710 - RNA, 13 nt, Human
ggagaggagagcc

SEQ ID NO: 2920711 - RNA, 14 nt, Human
ggagaggagagcca

SEQ ID NO: 2920712 - RNA, 15 nt, Human
ggagaggagagccag

SEQ ID NO: 2920713 - RNA, 16 nt, Human
ggagaggagagccaga

SEQ ID NO: 2920714 - RNA, 20 nt, Human
ggagaggagagccagagaag

SEQ ID NO: 2920715 - RNA, 11 nt, Human
ggagaagccau

SEQ ID NO: 2920716 - RNA, 12 nt, Human
ggagaagccauu

SEQ ID NO: 2920717 - RNA, 16 nt, Human
ggagaagccauugucu

SEQ ID NO: 2920718 - RNA, 13 nt, Human
ggcuauucacaac

SEQ ID NO: 2920719 - RNA, 21 nt, Human
ggccuagcugcuacaaagaag

SEQ ID NO: 2920720 - RNA, 16 nt, Human
ggccuagcugcuacaa

SEQ ID NO: 2920721 - RNA, 19 nt, Human
ggccuagcugcuacaaaga

SEQ ID NO: 2920722 - RNA, 20 nt, Human
ggccuagcugcuacaaagaa

SEQ ID NO: 2920723 - RNA, 15 nt, Human
ggauuacccaagcaa

SEQ ID NO: 2920724 - RNA, 13 nt, Human
gauugcuaaaugu

SEQ ID NO: 2920725 - RNA, 14 nt, Human
gauugcuaaaugua

SEQ ID NO: 2920726 - RNA, 19 nt, Human
gauuuuacaauugaaauga

SEQ ID NO: 2920727 - RNA, 18 nt, Human
gauuuuacaauugaaaug

SEQ ID NO: 2920728 - RNA, 18 nt, Human
gauggguuugacaagguu

SEQ ID NO: 2920729 - RNA, 22 nt, Human
gaugccagguucuauuuggaau

SEQ ID NO: 2920730 - RNA, 14 nt, Human
gaugccagguucua

SEQ ID NO: 2920731 - RNA, 17 nt, Human
gcaccccaugcuguuga

SEQ ID NO: 2920732 - RNA, 15 nt, Human
gcaccccaugcuguu

SEQ ID NO: 2920733 - RNA, 20 nt, Human
gauagcaagugaauuuuucu

SEQ ID NO: 2920734 - RNA, 18 nt, Human
gauaaaucagugguuauu

SEQ ID NO: 2920735 - RNA, 18 nt, Human
gagaaccuaaguuucagu

SEQ ID NO: 2920736 - RNA, 23 nt, Human
gagaacugcauauguuucgcuga

SEQ ID NO: 2920737 - RNA, 19 nt, Human
gagaacugcauauguuucg

SEQ ID NO: 2920738 - RNA, 18 nt, Human
gagaacugcauauguuuc

SEQ ID NO: 2920739 - RNA, 14 nt, Human
gacagggaagcuac

SEQ ID NO: 2920740 - RNA, 17 nt, Human
gacagggaagcuacagg

SEQ ID NO: 2920741 - RNA, 16 nt, Human
gacacaaaaaguagau

SEQ ID NO: 2920742 - RNA, 20 nt, Human
gacaaauucuguuucuugag

SEQ ID NO: 2920743 - RNA, 17 nt, Human
gacaaauucuguuucuu

SEQ ID NO: 2920744 - RNA, 16 nt, Human
gacaaauucuguuucu

SEQ ID NO: 2920745 - RNA, 22 nt, Human
gacaaauguguaucggaugcuu

SEQ ID NO: 2920746 - RNA, 12 nt, Human
gacaaauucugu

SEQ ID NO: 2920747 - RNA, 15 nt, Human
gacaaauucuguuuc

SEQ ID NO: 2920748 - RNA, 14 nt, Human
gacaaauucuguuu

SEQ ID NO: 2920749 - RNA, 12 nt, Human
gacaacauuaaa

SEQ ID NO: 2920750 - RNA, 17 nt, Human
gaaaggcauucucugaa

SEQ ID NO: 2920751 - RNA, 18 nt, Human
gaauucuuacauguuuuc

SEQ ID NO: 2920752 - RNA, 22 nt, Human
gaauucuuacauguuuucuuug

SEQ ID NO: 2920753 - RNA, 19 nt, Human
gaauucuuacauguuuucu

SEQ ID NO: 2920754 - RNA, 21 nt, Human
cuguggaaaguguaaagcauu

SEQ ID NO: 2920755 - RNA, 18 nt, Human
cuguggaaaguguaaagc

SEQ ID NO: 2920756 - RNA, 20 nt, Human
cuguggaaaguguaaagcau

SEQ ID NO: 2920757 - RNA, 13 nt, Human
cuguggaaagugu

SEQ ID NO: 2920758 - RNA, 14 nt, Human
cuguggaaagugua

SEQ ID NO: 2920759 - RNA, 15 nt, Human
cuguggaaaguguaa

SEQ ID NO: 2920760 - RNA, 16 nt, Human
cuguggaaaguguaaa

SEQ ID NO: 2920761 - RNA, 17 nt, Human
cuguggaaaguguaaag

SEQ ID NO: 2920762 - RNA, 15 nt, Human
cuguuccuucacauc

SEQ ID NO: 2920763 - RNA, 21 nt, Human
cuguuccuucacauccugugu

SEQ ID NO: 2920764 - RNA, 18 nt, Human
cuguuccuucacauccug

SEQ ID NO: 2920765 - RNA, 18 nt, Human
cuguaucuuguuuuucca

SEQ ID NO: 2920766 - RNA, 15 nt, Human
cuggcaguuuuccau

SEQ ID NO: 2920767 - RNA, 18 nt, Human
cuuaucacugacacaaaa

SEQ ID NO: 2920768 - RNA, 11 nt, Human
cuguucugugg

SEQ ID NO: 2920769 - RNA, 21 nt, Human
cuucacauccuguguuucuag

SEQ ID NO: 2920770 - RNA, 15 nt, Human
cuuguguauccauua

SEQ ID NO: 2920771 - RNA, 16 nt, Human
cuuguguauccauuau

SEQ ID NO: 2920772 - RNA, 22 nt, Human
cuuguguauccauuaucaugug

SEQ ID NO: 2920773 - RNA, 23 nt, Human
cuuguguauccauuaucaugugu

SEQ ID NO: 2920774 - RNA, 14 nt, Human
cuuguguauccauu

SEQ ID NO: 2920775 - RNA, 22 nt, Human
cuuuuguucagggcugugaucg

SEQ ID NO: 2920776 - RNA, 22 nt, Human
gaaaaagcaguaacugacaacu

SEQ ID NO: 2920777 - RNA, 16 nt, Human
gaaaggcauucucuga

SEQ ID NO: 2920778 - RNA, 17 nt, Human
ccugaaguucaccauua

SEQ ID NO: 2920779 - RNA, 12 nt, Human
ccuguacuuuuu

SEQ ID NO: 2920780 - RNA, 13 nt, Human
ccugcuacucugu

SEQ ID NO: 2920781 - RNA, 16 nt, Human
ccugcuacucuguucc

SEQ ID NO: 2920782 - RNA, 21 nt, Human
cgaggacuguauuugugacua

SEQ ID NO: 2920783 - RNA, 19 nt, Human
cgaggacuguauuugugac

SEQ ID NO: 2920784 - RNA, 20 nt, Human
cgaggacuguauuugugacu

SEQ ID NO: 2920785 - RNA, 18 nt, Human
cgaggacuguauuuguga

SEQ ID NO: 2920786 - RNA, 18 nt, Human
ccuugguguaguugaacu

SEQ ID NO: 2920787 - RNA, 23 nt, Human
ccugucccuucucuuaauuuaau

SEQ ID NO: 2920788 - RNA, 20 nt, Human
cuacagguuacaacagauuu

SEQ ID NO: 2920789 - RNA, 11 nt, Human
cuacagguuac

SEQ ID NO: 2920790 - RNA, 14 nt, Human
cuacagguuacaac

SEQ ID NO: 2920791 - RNA, 17 nt, Human
cuacagguuacaacaga

SEQ ID NO: 2920792 - RNA, 18 nt, Human
cuacagguuacaacagau

SEQ ID NO: 2920793 - RNA, 14 nt, Human
cuaaauugaauaau

SEQ ID NO: 2920794 - RNA, 12 nt, Human
cuaaauugaaua

SEQ ID NO: 2920795 - RNA, 13 nt, Human
cuaaauugaauaa

SEQ ID NO: 2920796 - RNA, 14 nt, Human
cuagcugcuacaaa

SEQ ID NO: 2920797 - RNA, 15 nt, Human
cuagcugcuacaaag

SEQ ID NO: 2920798 - RNA, 16 nt, Human
cuagcugcuacaaaga

SEQ ID NO: 2920799 - RNA, 18 nt, Human
cuagcugcuacaaagaag

SEQ ID NO: 2920800 - RNA, 21 nt, Human
cuagcugcuacaaagaagaca

SEQ ID NO: 2920801 - RNA, 23 nt, Human
cuagcugcuacaaagaagacaug

SEQ ID NO: 2920802 - RNA, 21 nt, Human
cucacaccgcgucuggugaca

SEQ ID NO: 2920803 - RNA, 21 nt, Human
cuauguaacugcauugagaac

SEQ ID NO: 2920804 - RNA, 18 nt, Human
cuauggggaugguccacu

SEQ ID NO: 2920805 - RNA, 15 nt, Human
cuauggggauggucc

SEQ ID NO: 2920806 - RNA, 15 nt, Human
cuauguaacugcauu

SEQ ID NO: 2920807 - RNA, 20 nt, Human
cuaugcaauauaucuaaauu

SEQ ID NO: 2920808 - RNA, 22 nt, Human
cuaugcaauauaucuaaauuga

SEQ ID NO: 2920809 - RNA, 16 nt, Human
cucagccaagcacagu

SEQ ID NO: 2920810 - RNA, 13 nt, Human
cucagccaagcac

SEQ ID NO: 2920811 - RNA, 14 nt, Human
cucagccaagcaca

SEQ ID NO: 2920812 - RNA, 15 nt, Human
cucagccaagcacag

SEQ ID NO: 2920813 - RNA, 16 nt, Human
cucaggacuccucucc

SEQ ID NO: 2920814 - RNA, 15 nt, Human
cucaggacuccucuc

SEQ ID NO: 2920815 - RNA, 22 nt, Human
cccaugcuguugauugcuaaau

SEQ ID NO: 2920816 - RNA, 14 nt, Human
cccaugcuguugau

SEQ ID NO: 2920817 - RNA, 19 nt, Human
cccaugcuguugauugcua

SEQ ID NO: 2920818 - RNA, 21 nt, Human
cccaugcuguugauugcuaaa

SEQ ID NO: 2920819 - RNA, 19 nt, Human
cccaacagugugaaguuag

SEQ ID NO: 2920820 - RNA, 12 nt, Human
cccaacagugug

SEQ ID NO: 2920821 - RNA, 13 nt, Human
cccaacaguguga

SEQ ID NO: 2920822 - RNA, 14 nt, Human
cccaacagugugaa

SEQ ID NO: 2920823 - RNA, 15 nt, Human
cccaacagugugaag

SEQ ID NO: 2920824 - RNA, 16 nt, Human
cccaacagugugaagu

SEQ ID NO: 2920825 - RNA, 14 nt, Human
ccauuaucaugugu

SEQ ID NO: 2920826 - RNA, 15 nt, Human
ccauuaucaugugua

SEQ ID NO: 2920827 - RNA, 16 nt, Human
ccauuaucauguguaa

SEQ ID NO: 2920828 - RNA, 13 nt, Human
ccauuaucaugug

SEQ ID NO: 2920829 - RNA, 14 nt, Human
ccauucucucuccu

SEQ ID NO: 2920830 - RNA, 22 nt, Human
ccacugucacuguuucucugcu

SEQ ID NO: 2920831 - RNA, 19 nt, Human
ccacugucacuguuucucu

SEQ ID NO: 2920832 - RNA, 24 nt, Human
ccacugucacuguuucucugcugu

SEQ ID NO: 2920833 - RNA, 23 nt, Human
ccacugucacuguuucucugcug

SEQ ID NO: 2920834 - RNA, 19 nt, Human
aaaaaacucgaggacugua

SEQ ID NO: 2920835 - RNA, 18 nt, Human
ggcacauccuaugcaaua

SEQ ID NO: 2920836 - RNA, 21 nt, Human
ggcacauccuaugcaauauau

SEQ ID NO: 2920837 - RNA, 16 nt, Human
ggcaccaaagccacca

SEQ ID NO: 2920838 - RNA, 19 nt, Human
ggcagggccuagcugcuac

SEQ ID NO: 2920839 - RNA, 23 nt, Human
ggcaucaugcaucuuacugaagg

SEQ ID NO: 2920840 - RNA, 15 nt, Human
aaacgauuuaauucu

SEQ ID NO: 2920841 - RNA, 16 nt, Human
aaacgauuuaauucuc

SEQ ID NO: 2920842 - RNA, 17 nt, Human
aaacgauuuaauucucu

SEQ ID NO: 2920843 - RNA, 18 nt, Human
aaacgauuuaauucucuu

SEQ ID NO: 2920844 - RNA, 19 nt, Human
aaacgauuuaauucucuug

SEQ ID NO: 2920845 - RNA, 14 nt, Human
aaaccuugguguag

SEQ ID NO: 2920846 - RNA, 22 nt, Human
aaaccuugguguaguugaacug

SEQ ID NO: 2920847 - RNA, 21 nt, Human
aaacgauuuaauucucuugaa

SEQ ID NO: 2920848 - RNA, 18 nt, Human
gguaaauuuccccaacag

SEQ ID NO: 2920849 - RNA, 13 nt, Human
gguaaauuucugu

SEQ ID NO: 2920850 - RNA, 20 nt, Human
gguaaauuuccccaacagug

SEQ ID NO: 2920851 - RNA, 22 nt, Human
gguaaauuuccccaacagugug

SEQ ID NO: 2920852 - RNA, 20 nt, Human
guaaauuuccccaacagugu

SEQ ID NO: 2920853 - RNA, 21 nt, Human
guaaauuuccccaacagugug

SEQ ID NO: 2920854 - RNA, 23 nt, Human
guaaauuuccccaacagugugaa

SEQ ID NO: 2920855 - RNA, 16 nt, Human
guaaaauugaaaggca

SEQ ID NO: 2920856 - RNA, 13 nt, Human
guaaucaauaaac

SEQ ID NO: 2920857 - RNA, 17 nt, Human
guaaucaauaaacgauu

SEQ ID NO: 2920858 - RNA, 18 nt, Human
guaaucaauaaacgauuu

SEQ ID NO: 2920859 - RNA, 20 nt, Human
guaaucaauaaacgauuuaa

SEQ ID NO: 2920860 - RNA, 17 nt, Human
aaagcaguaacugacaa

SEQ ID NO: 2920861 - RNA, 11 nt, Human
gguggagaagc

SEQ ID NO: 2920862 - RNA, 12 nt, Human
gguggagaagcc

SEQ ID NO: 2920863 - RNA, 19 nt, Human
aaagggauuacccaagcaa

SEQ ID NO: 2920864 - RNA, 15 nt, Human
aaagcuuagcaggag

SEQ ID NO: 2920865 - RNA, 16 nt, Human
gguucuauuuggaauu

SEQ ID NO: 2920866 - RNA, 13 nt, Human
gguucuauuugga

SEQ ID NO: 2920867 - RNA, 14 nt, Human
aaaguagauuaaga

SEQ ID NO: 2920868 - RNA, 12 nt, Human
gguuuuaaugua

SEQ ID NO: 2920869 - RNA, 23 nt, Human
gccuccucucucaguuuuuauau

SEQ ID NO: 2920870 - RNA, 21 nt, Human
gccauugucuucggaaaccuu

SEQ ID NO: 2920871 - RNA, 21 nt, Human
ggaaaggaguagaaaaagcag

SEQ ID NO: 2920872 - RNA, 18 nt, Human
ggaaugaagcuuguguau

SEQ ID NO: 2920873 - RNA, 12 nt, Human
ggaaugaagcuu

SEQ ID NO: 2920874 - RNA, 15 nt, Human
ggaaugaagcuugug

SEQ ID NO: 2920875 - RNA, 16 nt, Human
ggaaugaagcuugugu

SEQ ID NO: 2920876 - RNA, 20 nt, Human
gcaaaaucauggaaugguua

SEQ ID NO: 2920877 - RNA, 13 nt, Human
gcaaaaucaugga

SEQ ID NO: 2920878 - RNA, 18 nt, Human
gcaacaucuagcaaaugu

SEQ ID NO: 2920879 - RNA, 15 nt, Human
gauuuaauucucuug

SEQ ID NO: 2920880 - RNA, 12 nt, Human
gauuuaauucuc

SEQ ID NO: 2920881 - RNA, 13 nt, Human
gauuuaauucucu

SEQ ID NO: 2920882 - RNA, 13 nt, Human
gaggacuguauuu

SEQ ID NO: 2920883 - RNA, 18 nt, Human
gaggacuguauuugugac

SEQ ID NO: 2920884 - RNA, 13 nt, Human
gaggagagccaga

SEQ ID NO: 2920885 - RNA, 23 nt, Human
gaggagagccagagaagugacag

SEQ ID NO: 2920886 - RNA, 17 nt, Human
gaggagagccagagaag

SEQ ID NO: 2920887 - RNA, 22 nt, Human
gaggagagccagagaagugaca

SEQ ID NO: 2920888 - RNA, 16 nt, Human
gagaggagagccagag

SEQ ID NO: 2920889 - RNA, 19 nt, Human
gagaggagagccagagaag

SEQ ID NO: 2920890 - RNA, 13 nt, Human
gagaggagagcca

SEQ ID NO: 2920891 - RNA, 15 nt, Human
gagaggagagccaga

SEQ ID NO: 2920892 - RNA, 23 nt, Human
gagaauauuagcuuuacuguuug

SEQ ID NO: 2920893 - RNA, 17 nt, Human
gacaaauacucaugugu

SEQ ID NO: 2920894 - RNA, 18 nt, Human
gacaaauacucaugugua

SEQ ID NO: 2920895 - RNA, 19 nt, Human
gacaaauacucauguguau

SEQ ID NO: 2920896 - RNA, 20 nt, Human
gacaaauacucauguguaug

SEQ ID NO: 2920897 - RNA, 21 nt, Human
gacaaagacaaauucuguuuc

SEQ ID NO: 2920898 - RNA, 14 nt, Human
gacaaagacaaauu

SEQ ID NO: 2920899 - RNA, 22 nt, Human
gaauuuuuuucaucuucucugg

SEQ ID NO: 2920900 - RNA, 20 nt, Human
gaauuuuuuucaucuucucu

SEQ ID NO: 2920901 - RNA, 16 nt, Human
gaauuuuuuucaucuu

SEQ ID NO: 2920902 - RNA, 23 nt, Human
gacauguuuuagacaaauacuca

SEQ ID NO: 2920903 - RNA, 20 nt, Human
cuguugugaccugaaguuca

SEQ ID NO: 2920904 - RNA, 19 nt, Human
cuguugugaccugaaguuc

SEQ ID NO: 2920905 - RNA, 22 nt, Human
cugcuacucuguuccuucacau

SEQ ID NO: 2920906 - RNA, 18 nt, Human
cugcuacucuguuccuuc

SEQ ID NO: 2920907 - RNA, 17 nt, Human
cugcuacucuguuccuu

SEQ ID NO: 2920908 - RNA, 21 nt, Human
cuuacauguuuucuuugcuuu

SEQ ID NO: 2920909 - RNA, 14 nt, Human
cuuacauguuuucu

SEQ ID NO: 2920910 - RNA, 23 nt, Human
cuucuauggacugguuguugcca

SEQ ID NO: 2920911 - RNA, 17 nt, Human
cuuuuuuuuaaugugcu

SEQ ID NO: 2920912 - RNA, 18 nt, Human
cuuuuuuuuaaugugcug

SEQ ID NO: 2920913 - RNA, 15 nt, Human
cacagcuaccucuuc

SEQ ID NO: 2920914 - RNA, 17 nt, Human
cacauuugauucugugu

SEQ ID NO: 2920915 - RNA, 19 nt, Human
cacauccuaugcaauauau

SEQ ID NO: 2920916 - RNA, 17 nt, Human
cacauccuguguuucua

SEQ ID NO: 2920917 - RNA, 19 nt, Human
caauaaacgauuuaauucu

SEQ ID NO: 2920918 - RNA, 21 nt, Human
caauaaacgauuuaauucucu

SEQ ID NO: 2920919 - RNA, 12 nt, Human
caauaaacgauu

SEQ ID NO: 2920920 - RNA, 16 nt, Human
caauaaacgauuuaau

SEQ ID NO: 2920921 - RNA, 17 nt, Human
caauaaacgauuuaauu

SEQ ID NO: 2920922 - RNA, 18 nt, Human
caauaaacgauuuaauuc

SEQ ID NO: 2920923 - RNA, 22 nt, Human
cagaaauuuaauucauguuucu

SEQ ID NO: 2920924 - RNA, 23 nt, Human
cagaaauuuaauucauguuucuu

SEQ ID NO: 2920925 - RNA, 18 nt, Human
cacuguuucucugcuguu

SEQ ID NO: 2920926 - RNA, 14 nt, Human
cacuguuucucugc

SEQ ID NO: 2920927 - RNA, 12 nt, Human
cacuguuucucu

SEQ ID NO: 2920928 - RNA, 20 nt, Human
auuuuuaccuuuuuccuucc

SEQ ID NO: 2920929 - RNA, 15 nt, Human
auucucucuccugua

SEQ ID NO: 2920930 - RNA, 22 nt, Human
auugagaacugcauauguuucg

SEQ ID NO: 2920931 - RNA, 18 nt, Human
auugagaacugcauaugu

SEQ ID NO: 2920932 - RNA, 14 nt, Human
auugagaacugcau

SEQ ID NO: 2920933 - RNA, 14 nt, Human
auuuauacuauuua

SEQ ID NO: 2920934 - RNA, 18 nt, Human
auuuaaucuuuuuuaugu

SEQ ID NO: 2920935 - RNA, 15 nt, Human
caucugugauucccu

SEQ ID NO: 2920936 - RNA, 12 nt, Human
cagugguggcag

SEQ ID NO: 2920937 - RNA, 14 nt, Human
cagugguggcaggg

SEQ ID NO: 2920938 - RNA, 16 nt, Human
cagugguggcagggcc

SEQ ID NO: 2920939 - RNA, 19 nt, Human
cagugguggcagggccuag

SEQ ID NO: 2920940 - RNA, 22 nt, Human
cauauguuucgcugauauaugu

SEQ ID NO: 2920941 - RNA, 18 nt, Human
cccuauggggauggucca

SEQ ID NO: 2920942 - RNA, 16 nt, Human
cccuauggggaugguc

SEQ ID NO: 2920943 - RNA, 17 nt, Human
ccgcaguuccugucccu

SEQ ID NO: 2920944 - RNA, 19 nt, Human
ccugugaaauaguucaaag

SEQ ID NO: 2920945 - RNA, 19 nt, Human
cgcugcaaccuguugauag

SEQ ID NO: 2920946 - RNA, 13 nt, Human
cgcugauauaugu

SEQ ID NO: 2920947 - RNA, 12 nt, Human
cucaucugugau

SEQ ID NO: 2920948 - RNA, 12 nt, Human
cucauguguaug

SEQ ID NO: 2920949 - RNA, 9 nt, Human
cucaugugu

SEQ ID NO: 2920950 - RNA, 13 nt, Human
cugacaacuugaa

SEQ ID NO: 2920951 - RNA, 15 nt, Human
auuccaacaaagggu

SEQ ID NO: 2920952 - RNA, 23 nt, Human
auuccaacaaaggguuuuaaugu

SEQ ID NO: 2920953 - RNA, 18 nt, Human
auuccaacaaaggguuuu

SEQ ID NO: 2920954 - RNA, 19 nt, Human
auuccaacaaaggguuuua

SEQ ID NO: 2920955 - RNA, 14 nt, Human
auucccuccugcua

SEQ ID NO: 2920956 - RNA, 21 nt, Human
auucccuccugcuacucuguu

SEQ ID NO: 2920957 - RNA, 13 nt, Human
uuuuuguaauuua

SEQ ID NO: 2920958 - RNA, 22 nt, Human
auuacaucuuucacauuggcua

SEQ ID NO: 2920959 - RNA, 18 nt, Human
auuacaucuuucacauug

SEQ ID NO: 2920960 - RNA, 16 nt, Human
auuacaucuuucacau

SEQ ID NO: 2920961 - RNA, 15 nt, Human
auuacaucuuucaca

SEQ ID NO: 2920962 - RNA, 13 nt, Human
auuacccaagcaa

SEQ ID NO: 2920963 - RNA, 15 nt, Human
auuacccaagcaaaa

SEQ ID NO: 2920964 - RNA, 17 nt, Human
uuuugcaccccaugcug

SEQ ID NO: 2920965 - RNA, 18 nt, Human
uuuugcaccccaugcugu

SEQ ID NO: 2920966 - RNA, 19 nt, Human
uuuugcaccccaugcuguu

SEQ ID NO: 2920967 - RNA, 21 nt, Human
uuuugcaccccaugcuguuga

SEQ ID NO: 2920968 - RNA, 18 nt, Human
uuuugaguggaugauguu

SEQ ID NO: 2920969 - RNA, 21 nt, Human
augugccguguuauuguauua

SEQ ID NO: 2920970 - RNA, 12 nt, Human
uuuucauaauaa

SEQ ID NO: 2920971 - RNA, 17 nt, Human
uuuucucuaacucagaa

SEQ ID NO: 2920972 - RNA, 21 nt, Human
uuuucaucuucucuggcgaca

SEQ ID NO: 2920973 - RNA, 11 nt, Human
auuugugacua

SEQ ID NO: 2920974 - RNA, 16 nt, Human
auuugugacuaauugu

SEQ ID NO: 2920975 - RNA, 18 nt, Human
auuugugacuaauuguau

SEQ ID NO: 2920976 - RNA, 19 nt, Human
auuugugacuaauuguaua

SEQ ID NO: 2920977 - RNA, 20 nt, Human
auuugugacuaauuguauaa

SEQ ID NO: 2920978 - RNA, 22 nt, Human
auuugugacuaauuguauaaca

SEQ ID NO: 2920979 - RNA, 23 nt, Human
auuguauuaggugucauuuccau

SEQ ID NO: 2920980 - RNA, 17 nt, Human
auucuuacauguuuucu

SEQ ID NO: 2920981 - RNA, 15 nt, Human
auucuuacauguuuu

SEQ ID NO: 2920982 - RNA, 12 nt, Human
auucuguuucuu

SEQ ID NO: 2920983 - RNA, 22 nt, Human
auucuguguguuuucauaauaa

SEQ ID NO: 2920984 - RNA, 21 nt, Human
auucuguguguuuucauaaua

SEQ ID NO: 2920985 - RNA, 17 nt, Human
auucuguguguuuucau

SEQ ID NO: 2920986 - RNA, 18 nt, Human
auugaaaggcauucucug

SEQ ID NO: 2920987 - RNA, 15 nt, Human
auuuccccaacagug

SEQ ID NO: 2920988 - RNA, 16 nt, Human
auuuccccaacagugu

SEQ ID NO: 2920989 - RNA, 17 nt, Human
auuuccccaacagugug

SEQ ID NO: 2920990 - RNA, 18 nt, Human
auuuccccaacaguguga

SEQ ID NO: 2920991 - RNA, 19 nt, Human
auuuccccaacagugugaa

SEQ ID NO: 2920992 - RNA, 14 nt, Human
auuucaaaacucau

SEQ ID NO: 2920993 - RNA, 19 nt, Human
auuuaguuuuuguaauuua

SEQ ID NO: 2920994 - RNA, 20 nt, Human
auuuaguuuuuguaauuuau

SEQ ID NO: 2920995 - RNA, 22 nt, Human
augaauuuuuuucaucuucucu

SEQ ID NO: 2920996 - RNA, 23 nt, Human
augaauuuuuuucaucuucucug

SEQ ID NO: 2920997 - RNA, 17 nt, Human
uuguauaacagguuauu

SEQ ID NO: 2920998 - RNA, 15 nt, Human
uuguauaacagguua

SEQ ID NO: 2920999 - RNA, 16 nt, Human
uuguauaacagguuau

SEQ ID NO: 2921000 - RNA, 13 nt, Human
uuguauaacaggu

SEQ ID NO: 2921001 - RNA, 14 nt, Human
uuguauaacagguu

SEQ ID NO: 2921002 - RNA, 22 nt, Human
uugugaacucagccaagcacag

SEQ ID NO: 2921003 - RNA, 23 nt, Human
uugugaacucagccaagcacagu

SEQ ID NO: 2921004 - RNA, 19 nt, Human
uugugaacucagccaagca

SEQ ID NO: 2921005 - RNA, 19 nt, Human
augcuguauucuucuuugg

SEQ ID NO: 2921006 - RNA, 16 nt, Human
uuuaccugugaaauag

SEQ ID NO: 2921007 - RNA, 15 nt, Human
uuuaccugugaaaua

SEQ ID NO: 2921008 - RNA, 18 nt, Human
uuucuagggaaaugaaag

SEQ ID NO: 2921009 - RNA, 15 nt, Human
uuucuagggaaauga

SEQ ID NO: 2921010 - RNA, 14 nt, Human
uuucuagggaaaug

SEQ ID NO: 2921011 - RNA, 15 nt, Human
uuuccuucucaucug

SEQ ID NO: 2921012 - RNA, 18 nt, Human
uuuccuucucaucuguga

SEQ ID NO: 2921013 - RNA, 23 nt, Human
auauauguguuuuucacauuugc

SEQ ID NO: 2921014 - RNA, 21 nt, Human
auauauguguuuuucacauuu

SEQ ID NO: 2921015 - RNA, 15 nt, Human
auauauguguuuuuc

SEQ ID NO: 2921016 - RNA, 13 nt, Human
auauauguguuuu

SEQ ID NO: 2921017 - RNA, 21 nt, Human
uuaucauguguaaucaauaaa

SEQ ID NO: 2921018 - RNA, 15 nt, Human
uuaucauguguaauc

SEQ ID NO: 2921019 - RNA, 18 nt, Human
uuaucauguguaaucaau

SEQ ID NO: 2921020 - RNA, 16 nt, Human
uucagggugaugccag

SEQ ID NO: 2921021 - RNA, 15 nt, Human
uucagggugaugcca

SEQ ID NO: 2921022 - RNA, 19 nt, Human
auauguguuuuucacauuu

SEQ ID NO: 2921023 - RNA, 17 nt, Human
auauguguuuuucacau

SEQ ID NO: 2921024 - RNA, 22 nt, Human
auauguguuuuucacauuugcg

SEQ ID NO: 2921025 - RNA, 12 nt, Human
auauuguuucua

SEQ ID NO: 2921026 - RNA, 18 nt, Human
aucaguuacucugaaggg

SEQ ID NO: 2921027 - RNA, 14 nt, Human
uucuuacauguuuu

SEQ ID NO: 2921028 - RNA, 13 nt, Human
uucuuacauguuu

SEQ ID NO: 2921029 - RNA, 21 nt, Human
uucuuaaaugggcuacuuugu

SEQ ID NO: 2921030 - RNA, 11 nt, Human
uucuguuucuu

SEQ ID NO: 2921031 - RNA, 12 nt, Human
uugaguuuuguu

SEQ ID NO: 2921032 - RNA, 21 nt, Human
uugaguuuuguuuuaaaauua

SEQ ID NO: 2921033 - RNA, 21 nt, Human
uugagaacugcauauguuucg

SEQ ID NO: 2921034 - RNA, 19 nt, Human
uugagaacugcauauguuu

SEQ ID NO: 2921035 - RNA, 17 nt, Human
aucgugacgcugaauaa

SEQ ID NO: 2921036 - RNA, 18 nt, Human
aucgugacgcugaauaaa

SEQ ID NO: 2921037 - RNA, 20 nt, Human
aucgugacgcugaauaaaug

SEQ ID NO: 2921038 - RNA, 21 nt, Human
aucgugacgcugaauaaaugu

SEQ ID NO: 2921039 - RNA, 22 nt, Human
aucgugacgcugaauaaauguc

SEQ ID NO: 2921040 - RNA, 15 nt, Human
aucuaaauugaauaa

SEQ ID NO: 2921041 - RNA, 16 nt, Human
aucuaaauugaauaau

SEQ ID NO: 2921042 - RNA, 21 nt, Human
aucuaaauugaauaaugguac

SEQ ID NO: 2921043 - RNA, 18 nt, Human
auccuguguuucuaggga

SEQ ID NO: 2921044 - RNA, 14 nt, Human
auccuguguuucua

SEQ ID NO: 2921045 - RNA, 16 nt, Human
uggcuauuuaaagaca

SEQ ID NO: 2921046 - RNA, 16 nt, Human
ugggaaaggaguagaa

SEQ ID NO: 2921047 - RNA, 17 nt, Human
ugggaaaggaguagaaa

SEQ ID NO: 2921048 - RNA, 14 nt, Human
ugcugucuaugugg

SEQ ID NO: 2921049 - RNA, 18 nt, Human
aggacuguauuugugacu

SEQ ID NO: 2921050 - RNA, 22 nt, Human
aggacuguauuugugacuaauu

SEQ ID NO: 2921051 - RNA, 19 nt, Human
aggagcaggagccugagcc

SEQ ID NO: 2921052 - RNA, 17 nt, Human
ugcuuggguggagaagc

SEQ ID NO: 2921053 - RNA, 18 nt, Human
ugcuuggguggagaagcc

SEQ ID NO: 2921054 - RNA, 15 nt, Human
ugcuuggguggagaa

SEQ ID NO: 2921055 - RNA, 16 nt, Human
ugcuuggguggagaag

SEQ ID NO: 2921056 - RNA, 17 nt, Human
uggaauuuauauacaac

SEQ ID NO: 2921057 - RNA, 21 nt, Human
agccagagaagugacagggaa

SEQ ID NO: 2921058 - RNA, 11 nt, Human
agccagagaag

SEQ ID NO: 2921059 - RNA, 14 nt, Human
agccagagaaguga

SEQ ID NO: 2921060 - RNA, 15 nt, Human
agccagagaagugac

SEQ ID NO: 2921061 - RNA, 16 nt, Human
agccagagaagugaca

SEQ ID NO: 2921062 - RNA, 17 nt, Human
agccagagaagugacag

SEQ ID NO: 2921063 - RNA, 18 nt, Human
agccagagaagugacagg

SEQ ID NO: 2921064 - RNA, 19 nt, Human
agccagagaagugacaggg

SEQ ID NO: 2921065 - RNA, 15 nt, Human
agccaucuugguaaa

SEQ ID NO: 2921066 - RNA, 17 nt, Human
agccaucuugguaaauu

SEQ ID NO: 2921067 - RNA, 19 nt, Human
agccaucuugguaaauuuc

SEQ ID NO: 2921068 - RNA, 13 nt, Human
agccaucauggau

SEQ ID NO: 2921069 - RNA, 17 nt, Human
ugauucccuccugcuac

SEQ ID NO: 2921070 - RNA, 18 nt, Human
ugauucccuccugcuacu

SEQ ID NO: 2921071 - RNA, 14 nt, Human
agcccggaugcuuc

SEQ ID NO: 2921072 - RNA, 20 nt, Human
ugcaauauaucuaaauugaa

SEQ ID NO: 2921073 - RNA, 18 nt, Human
ugcaauauaucuaaauug

SEQ ID NO: 2921074 - RNA, 19 nt, Human
ugcaauauaucuaaauuga

SEQ ID NO: 2921075 - RNA, 12 nt, Human
agcuacagguua

SEQ ID NO: 2921076 - RNA, 13 nt, Human
agcuacagguuac

SEQ ID NO: 2921077 - RNA, 14 nt, Human
agcuacagguuaca

SEQ ID NO: 2921078 - RNA, 18 nt, Human
agcuacagguuacaacag

SEQ ID NO: 2921079 - RNA, 19 nt, Human
agcuacagguuacaacaga

SEQ ID NO: 2921080 - RNA, 20 nt, Human
agcuacagguuacaacagau

SEQ ID NO: 2921081 - RNA, 22 nt, Human
agcuacagguuacaacagauuu

SEQ ID NO: 2921082 - RNA, 21 nt, Human
agcuacagguuacaacagauu

SEQ ID NO: 2921083 - RNA, 20 nt, Human
uguuuuagacaaauacucau

SEQ ID NO: 2921084 - RNA, 19 nt, Human
uguuuuagacaaauacuca

SEQ ID NO: 2921085 - RNA, 21 nt, Human
uguuuuagacaaauacucaug

SEQ ID NO: 2921086 - RNA, 22 nt, Human
uguuuuagacaaauacucaugu

SEQ ID NO: 2921087 - RNA, 23 nt, Human
uguuuuagacaaauacucaugug

SEQ ID NO: 2921088 - RNA, 24 nt, Human
uguuuuagacaaauacucaugugu

SEQ ID NO: 2921089 - RNA, 23 nt, Human
aguugauuuuacaauugaaauga

SEQ ID NO: 2921090 - RNA, 21 nt, Human
aguugauuuuacaauugaaau

SEQ ID NO: 2921091 - RNA, 18 nt, Human
uguuauggcuuaaugaca

SEQ ID NO: 2921092 - RNA, 15 nt, Human
aguggguuucacaag

SEQ ID NO: 2921093 - RNA, 21 nt, Human
aguggguuucacaagugaaaa

SEQ ID NO: 2921094 - RNA, 17 nt, Human
aguuagucuacucuuaa

SEQ ID NO: 2921095 - RNA, 22 nt, Human
aguuagucuacucuuaagccau

SEQ ID NO: 2921096 - RNA, 23 nt, Human
aguuagucuacucuuaagccauc

SEQ ID NO: 2921097 - RNA, 18 nt, Human
aguuaggcuauucacaac

SEQ ID NO: 2921098 - RNA, 20 nt, Human
aguuccugucccuucucuua

SEQ ID NO: 2921099 - RNA, 23 nt, Human
aguuccugucccuucucuuaauu

SEQ ID NO: 2921100 - RNA, 21 nt, Human
aguuccugucccuucucuuaa

SEQ ID NO: 2921101 - RNA, 11 nt, Human
uuaucaugcaa

SEQ ID NO: 2921102 - RNA, 16 nt, Human
uuaucaugcaaaugcu

SEQ ID NO: 2921103 - RNA, 12 nt, Human
uuaucaugugua

SEQ ID NO: 2921104 - RNA, 13 nt, Human
uuaucauguguaa

SEQ ID NO: 2921105 - RNA, 14 nt, Human
uuaucauguguaau

SEQ ID NO: 2921106 - RNA, 18 nt, Human
uuaucacugacacaaaaa

SEQ ID NO: 2921107 - RNA, 12 nt, Human
auacucaugugu

SEQ ID NO: 2921108 - RNA, 11 nt, Human
auacucaugug

SEQ ID NO: 2921109 - RNA, 23 nt, Human
auacuauuuaguuuuuguaauuu

SEQ ID NO: 2921110 - RNA, 20 nt, Human
auacuauuuaguuuuuguaa

SEQ ID NO: 2921111 - RNA, 21 nt, Human
uuauagaugggaaugaagcuu

SEQ ID NO: 2921112 - RNA, 22 nt, Human
uuagcaggagaggagagccaga

SEQ ID NO: 2921113 - RNA, 23 nt, Human
uuagcaggagaggagagccagag

SEQ ID NO: 2921114 - RNA, 15 nt, Human
auaaacgauuuaauu

SEQ ID NO: 2921115 - RNA, 18 nt, Human
auaaacgauuuaauucuc

SEQ ID NO: 2921116 - RNA, 19 nt, Human
auaaacgauuuaauucucu

SEQ ID NO: 2921117 - RNA, 20 nt, Human
auaaacgauuuaauucucuu

SEQ ID NO: 2921118 - RNA, 22 nt, Human
aguuuuccuucucaucugugau

SEQ ID NO: 2921119 - RNA, 18 nt, Human
aguuuuccuucucaucug

SEQ ID NO: 2921120 - RNA, 14 nt, Human
aguuuuccuucuca

SEQ ID NO: 2921121 - RNA, 12 nt, Human
aguuuuccuucu

SEQ ID NO: 2921122 - RNA, 23 nt, Human
aguuuuccuucucaucugugauu

SEQ ID NO: 2921123 - RNA, 15 nt, Human
uuacaucuuucacau

SEQ ID NO: 2921124 - RNA, 20 nt, Human
uuacccaagcaaaaucaugg

SEQ ID NO: 2921125 - RNA, 12 nt, Human
uuacccaagcaa

SEQ ID NO: 2921126 - RNA, 13 nt, Human
uuacccaagcaaa

SEQ ID NO: 2921127 - RNA, 12 nt, Human
auaaaugucuuu

SEQ ID NO: 2921128 - RNA, 20 nt, Human
auaaaugucuuuuuuuuaau

SEQ ID NO: 2921129 - RNA, 22 nt, Human
auaaaugucuuuuuuuuaaugu

SEQ ID NO: 2921130 - RNA, 23 nt, Human
auaaaugucuuuuuuuuaaugug

SEQ ID NO: 2921131 - RNA, 20 nt, Human
uuagcaggagaggagagcca

SEQ ID NO: 2921132 - RNA, 21 nt, Human
uguauuaggugucauuuccau

SEQ ID NO: 2921133 - RNA, 13 nt, Human
uguauccauuauc

SEQ ID NO: 2921134 - RNA, 14 nt, Human
uguauccauuauca

SEQ ID NO: 2921135 - RNA, 17 nt, Human
uguauccauuaucaugu

SEQ ID NO: 2921136 - RNA, 18 nt, Human
uguauccauuaucaugug

SEQ ID NO: 2921137 - RNA, 19 nt, Human
uguauccauuaucaugugu

SEQ ID NO: 2921138 - RNA, 20 nt, Human
uguauccauuaucaugugua

SEQ ID NO: 2921139 - RNA, 22 nt, Human
uguauccauuaucauguguaau

SEQ ID NO: 2921140 - RNA, 14 nt, Human
ugugaacucagcca

SEQ ID NO: 2921141 - RNA, 15 nt, Human
ugugaacucagccaa

SEQ ID NO: 2921142 - RNA, 16 nt, Human
ugugaacucagccaag

SEQ ID NO: 2921143 - RNA, 18 nt, Human
ugugaacucagccaagca

SEQ ID NO: 2921144 - RNA, 19 nt, Human
ugugaacucagccaagcac

SEQ ID NO: 2921145 - RNA, 20 nt, Human
ugugaacucagccaagcaca

SEQ ID NO: 2921146 - RNA, 16 nt, Human
ugucuucggaaaccuu

SEQ ID NO: 2921147 - RNA, 19 nt, Human
ugucuucggaaaccuuggu

SEQ ID NO: 2921148 - RNA, 20 nt, Human
ugucuucggaaaccuuggug

SEQ ID NO: 2921149 - RNA, 21 nt, Human
ugucuucggaaaccuuggugu

SEQ ID NO: 2921150 - RNA, 21 nt, Human
ugugaacucagccaagcacag

SEQ ID NO: 2921151 - RNA, 21 nt, Human
uggguggagaagccauugucu

SEQ ID NO: 2921152 - RNA, 22 nt, Human
uggguggagaagccauugucuu

SEQ ID NO: 2921153 - RNA, 23 nt, Human
uggguggagaagccauugucuuc

SEQ ID NO: 2921154 - RNA, 14 nt, Human
uggguggagaagcc

SEQ ID NO: 2921155 - RNA, 15 nt, Human
uggguggagaagcca

SEQ ID NO: 2921156 - RNA, 16 nt, Human
uggguggagaagccau

SEQ ID NO: 2921157 - RNA, 17 nt, Human
uggguggagaagccauu

SEQ ID NO: 2921158 - RNA, 19 nt, Human
agggugaugccagguucua

SEQ ID NO: 2921159 - RNA, 15 nt, Human
agggugaugccaggu

SEQ ID NO: 2921160 - RNA, 14 nt, Human
agggugaugccagg

SEQ ID NO: 2921161 - RNA, 22 nt, Human
ugguuauuuagggaacugcuug

SEQ ID NO: 2921162 - RNA, 12 nt, Human
uguaaagcauuc

SEQ ID NO: 2921163 - RNA, 17 nt, Human
uguaaagcauuccaaca

SEQ ID NO: 2921164 - RNA, 18 nt, Human
uguaaagcauuccaacaa

SEQ ID NO: 2921165 - RNA, 18 nt, Human
uguacauuuccaaauuca

SEQ ID NO: 2921166 - RNA, 22 nt, Human
uguacauuuccaaauucacaag

SEQ ID NO: 2921167 - RNA, 21 nt, Human
uguacauuuccaaauucacaa

SEQ ID NO: 2921168 - RNA, 13 nt, Human
ugaacucagccaa

SEQ ID NO: 2921169 - RNA, 14 nt, Human
ugaacucagccaag

SEQ ID NO: 2921170 - RNA, 15 nt, Human
ugaacucagccaagc

SEQ ID NO: 2921171 - RNA, 16 nt, Human
ugaacucagccaagca

SEQ ID NO: 2921172 - RNA, 17 nt, Human
ugaacucagccaagcac

SEQ ID NO: 2921173 - RNA, 18 nt, Human
ugaacucagccaagcaca

SEQ ID NO: 2921174 - RNA, 19 nt, Human
ugaacucagccaagcacag

SEQ ID NO: 2921175 - RNA, 20 nt, Human
ugaacucagccaagcacagu

SEQ ID NO: 2921176 - RNA, 21 nt, Human
ugaacucagccaagcacagug

SEQ ID NO: 2921177 - RNA, 22 nt, Human
ugaacucagccaagcacagugg

SEQ ID NO: 2921178 - RNA, 23 nt, Human
ugaacucagccaagcacaguggu

SEQ ID NO: 2921179 - RNA, 18 nt, Human
ugaauaaugguaccagau

SEQ ID NO: 2921180 - RNA, 20 nt, Human
ugaauaaugguaccagauaa

SEQ ID NO: 2921181 - RNA, 15 nt, Human
ugaaguauacuguau

SEQ ID NO: 2921182 - RNA, 22 nt, Human
ucuuuuuuuuaaugugcugugu

SEQ ID NO: 2921183 - RNA, 19 nt, Human
ucuuuuuuuuaaugugcug

SEQ ID NO: 2921184 - RNA, 20 nt, Human
ucuuuuuuuuaaugugcugu

SEQ ID NO: 2921185 - RNA, 20 nt, Human
ugagaaucagaucauuucaa

SEQ ID NO: 2921186 - RNA, 14 nt, Human
agcaagugaauuuu

SEQ ID NO: 2921187 - RNA, 22 nt, Human
agauuugugaacucagccaagc

SEQ ID NO: 2921188 - RNA, 21 nt, Human
ucugaucgugacgcugaauaa

SEQ ID NO: 2921189 - RNA, 22 nt, Human
ucugaucgugacgcugaauaaa

SEQ ID NO: 2921190 - RNA, 20 nt, Human
ucugaucgugacgcugaaua

SEQ ID NO: 2921191 - RNA, 23 nt, Human
agaauucuuacauguuuucuuug

SEQ ID NO: 2921192 - RNA, 20 nt, Human
agaauucuuacauguuuucu

SEQ ID NO: 2921193 - RNA, 19 nt, Human
agaauucuuacauguuuuc

SEQ ID NO: 2921194 - RNA, 17 nt, Human
agaauucuuacauguuu

SEQ ID NO: 2921195 - RNA, 16 nt, Human
agaauucuuacauguu

SEQ ID NO: 2921196 - RNA, 15 nt, Human
agaaguuaagcaaca

SEQ ID NO: 2921197 - RNA, 19 nt, Human
agaaguuaagcaacaucua

SEQ ID NO: 2921198 - RNA, 19 nt, Human
agaauauuagcuuuacugu

SEQ ID NO: 2921199 - RNA, 21 nt, Human
agaauauuagcuuuacuguuu

SEQ ID NO: 2921200 - RNA, 20 nt, Human
agaauauuagcuuuacuguu

SEQ ID NO: 2921201 - RNA, 17 nt, Human
agaaucagaucauuuca

SEQ ID NO: 2921202 - RNA, 23 nt, Human
agaauauuagcuuuacuguuugu

SEQ ID NO: 2921203 - RNA, 17 nt, Human
acuuaaauuuuaauuua

SEQ ID NO: 2921204 - RNA, 16 nt, Human
ucuauuuggaauuuau

SEQ ID NO: 2921205 - RNA, 12 nt, Human
ucuauuuggaau

SEQ ID NO: 2921206 - RNA, 13 nt, Human
ucuauuuggaauu

SEQ ID NO: 2921207 - RNA, 18 nt, Human
ucuccuccauacucagga

SEQ ID NO: 2921208 - RNA, 17 nt, Human
ucuccuccauacucagg

SEQ ID NO: 2921209 - RNA, 20 nt, Human
acuacugcuaccacaacuau

SEQ ID NO: 2921210 - RNA, 13 nt, Human
uccagacacuuuu

SEQ ID NO: 2921211 - RNA, 15 nt, Human
accuuuuuccuuccu

SEQ ID NO: 2921212 - RNA, 14 nt, Human
accuuuuuccuucc

SEQ ID NO: 2921213 - RNA, 22 nt, Human
uccacugucacuguuucucugc

SEQ ID NO: 2921214 - RNA, 19 nt, Human
uccacugucacuguuucuc

SEQ ID NO: 2921215 - RNA, 15 nt, Human
acugauaguuacugu

SEQ ID NO: 2921216 - RNA, 17 nt, Human
acugauaguuacuguug

SEQ ID NO: 2921217 - RNA, 23 nt, Human
acugauaguuacuguugugaccu

SEQ ID NO: 2921218 - RNA, 18 nt, Human
acugauaguuacuguugu

SEQ ID NO: 2921219 - RNA, 20 nt, Human
acugauaguuacuguuguga

SEQ ID NO: 2921220 - RNA, 14 nt, Human
acucuuaagccauc

SEQ ID NO: 2921221 - RNA, 22 nt, Human
acucuuaagccaucuugguaaa

SEQ ID NO: 2921222 - RNA, 13 nt, Human
acucuuaagccau

SEQ ID NO: 2921223 - RNA, 16 nt, Human
ucagggugaugccagg

SEQ ID NO: 2921224 - RNA, 16 nt, Human
ucauguuucuuaaaug

SEQ ID NO: 2921225 - RNA, 15 nt, Human
ucauguuucuuaaau

SEQ ID NO: 2921226 - RNA, 11 nt, Human
ucauguuucuu

SEQ ID NO: 2921227 - RNA, 19 nt, Human
ucauguguaugggcaaaaa

SEQ ID NO: 2921228 - RNA, 18 nt, Human
ucauguguaaucaauaaa

SEQ ID NO: 2921229 - RNA, 19 nt, Human
ucauguguaaucaauaaac

SEQ ID NO: 2921230 - RNA, 21 nt, Human
ucauguguaaucaauaaacga

SEQ ID NO: 2921231 - RNA, 22 nt, Human
ucauguguaaucaauaaacgau

SEQ ID NO: 2921232 - RNA, 23 nt, Human
ucauguguaaucaauaaacgauu

SEQ ID NO: 2921233 - RNA, 20 nt, Human
ucaugcaaaugcuguauucu

SEQ ID NO: 2921234 - RNA, 16 nt, Human
ucagugcccaacuguu

SEQ ID NO: 2921235 - RNA, 18 nt, Human
ucacauacaauuauuuuu

SEQ ID NO: 2921236 - RNA, 14 nt, Human
accaaagccaccag

SEQ ID NO: 2921237 - RNA, 17 nt, Human
ucacuguuucucugcug

SEQ ID NO: 2921238 - RNA, 14 nt, Human
ucacuguuucucug

SEQ ID NO: 2921239 - RNA, 23 nt, Human
uaagcaacaucuagcaaauguua

SEQ ID NO: 2921240 - RNA, 13 nt, Human
uacagguuacaac

SEQ ID NO: 2921241 - RNA, 15 nt, Human
uacagguuacaacag

SEQ ID NO: 2921242 - RNA, 17 nt, Human
uacagguuacaacagau

SEQ ID NO: 2921243 - RNA, 18 nt, Human
uacagguuacaacagauu

SEQ ID NO: 2921244 - RNA, 21 nt, Human
uacagguuacaacagauuugu

SEQ ID NO: 2921245 - RNA, 23 nt, Human
uacagguuacaacagauuuguga

SEQ ID NO: 2921246 - RNA, 17 nt, Human
aauguaacagucugauc

SEQ ID NO: 2921247 - RNA, 17 nt, Human
aauuauuuuuacaguuc

SEQ ID NO: 2921248 - RNA, 12 nt, Human
uacucugaaggg

SEQ ID NO: 2921249 - RNA, 19 nt, Human
uacucugaagggcaucaug

SEQ ID NO: 2921250 - RNA, 22 nt, Human
uacucugaagggcaucaugcau

SEQ ID NO: 2921251 - RNA, 17 nt, Human
acaggaagucuucaggg

SEQ ID NO: 2921252 - RNA, 16 nt, Human
uauuagcuuuacuguu

SEQ ID NO: 2921253 - RNA, 14 nt, Human
uauuagcuuuacug

SEQ ID NO: 2921254 - RNA, 23 nt, Human
acagggaagcuacagguuacaac

SEQ ID NO: 2921255 - RNA, 18 nt, Human
acagggaagcuacagguu

SEQ ID NO: 2921256 - RNA, 19 nt, Human
acagggaagcuacagguua

SEQ ID NO: 2921257 - RNA, 13 nt, Human
acagggaagcuac

SEQ ID NO: 2921258 - RNA, 14 nt, Human
acagggaagcuaca

SEQ ID NO: 2921259 - RNA, 15 nt, Human
acagggaagcuacag

SEQ ID NO: 2921260 - RNA, 16 nt, Human
acagggaagcuacagg

SEQ ID NO: 2921261 - RNA, 20 nt, Human
uauauuaucaugcaaaugcu

SEQ ID NO: 2921262 - RNA, 14 nt, Human
uauauuaucaugca

SEQ ID NO: 2921263 - RNA, 13 nt, Human
uauaaaagugauu

SEQ ID NO: 2921264 - RNA, 22 nt, Human
uauaaaagugauuguuggcaca

SEQ ID NO: 2921265 - RNA, 20 nt, Human
uagccacaaaauugggaaag

SEQ ID NO: 2921266 - RNA, 13 nt, Human
acaacagauuugu

SEQ ID NO: 2921267 - RNA, 14 nt, Human
acaacagauuugug

SEQ ID NO: 2921268 - RNA, 13 nt, Human
uagaugggaauga

SEQ ID NO: 2921269 - RNA, 17 nt, Human
acaaaggguuuuaaugu

SEQ ID NO: 2921270 - RNA, 18 nt, Human
acaaaggguuuuaaugua

SEQ ID NO: 2921271 - RNA, 15 nt, Human
acaaaggguuuuaau

SEQ ID NO: 2921272 - RNA, 14 nt, Human
aacugcauugagaa

SEQ ID NO: 2921273 - RNA, 20 nt, Human
aacugcauugagaacugcau

SEQ ID NO: 2921274 - RNA, 22 nt, Human
gugacagggaagcuacagguua

SEQ ID NO: 2921275 - RNA, 17 nt, Human
gugacagggaagcuaca

SEQ ID NO: 2921276 - RNA, 18 nt, Human
gugacagggaagcuacag

SEQ ID NO: 2921277 - RNA, 19 nt, Human
gugacagggaagcuacagg

SEQ ID NO: 2921278 - RNA, 20 nt, Human
gugacagggaagcuacaggu

SEQ ID NO: 2921279 - RNA, 13 nt, Human
gugacagggaagc

SEQ ID NO: 2921280 - RNA, 16 nt, Human
gugacagggaagcuac

SEQ ID NO: 2921281 - RNA, 15 nt, Human
guccucuuucaaagg

SEQ ID NO: 2921282 - RNA, 19 nt, Human
gucccuucucuuaauuuaa

SEQ ID NO: 2921283 - RNA, 14 nt, Human
gucacauacaauua

SEQ ID NO: 2921284 - RNA, 15 nt, Human
gucacuguuucucug

SEQ ID NO: 2921285 - RNA, 13 nt, Human
gucacuguuucuc

SEQ ID NO: 2921286 - RNA, 16 nt, Human
gucacuguuucucugc

SEQ ID NO: 2921287 - RNA, 17 nt, Human
aaaucauggaaugguua

SEQ ID NO: 2921288 - RNA, 21 nt, Human
aaauucgcugcaaccuguuga

SEQ ID NO: 2921289 - RNA, 19 nt, Human
aaauucacaaguuguguuu

SEQ ID NO: 2921290 - RNA, 18 nt, Human
aaauucacaaguuguguu

SEQ ID NO: 2921291 - RNA, 22 nt, Human
guugauagcaagugaauuuuuc

SEQ ID NO: 2921292 - RNA, 23 nt, Human
guugauagcaagugaauuuuucu

SEQ ID NO: 2921293 - RNA, 22 nt, Human
aagcuucgaggcccagcgaccu

SEQ ID NO: 2921294 - RNA, 13 nt, Human
aagcuuagcagga

SEQ ID NO: 2921295 - RNA, 15 nt, Human
aagcuuagcaggaga

SEQ ID NO: 2921296 - RNA, 16 nt, Human
aagcuuagcaggagag

SEQ ID NO: 2921297 - RNA, 20 nt, Human
aagcuuagcaggagaggaga

SEQ ID NO: 2921298 - RNA, 22 nt, Human
aagcuuagcaggagaggagagc

SEQ ID NO: 2921299 - RNA, 13 nt, Human
aagccauugucuu

SEQ ID NO: 2921300 - RNA, 14 nt, Human
aagccauugucuuc

SEQ ID NO: 2921301 - RNA, 12 nt, Human
aagccauugucu

SEQ ID NO: 2921302 - RNA, 19 nt, Human
guuauuuuaguuucuguuc

SEQ ID NO: 2921303 - RNA, 13 nt, Human
guuauuuuaguuu

SEQ ID NO: 2921304 - RNA, 15 nt, Human
guuauuuuaguuucu

SEQ ID NO: 2921305 - RNA, 20 nt, Human
guuagaauuccuucagggug

SEQ ID NO: 2921306 - RNA, 12 nt, Human
guuagaauuccu

SEQ ID NO: 2921307 - RNA, 14 nt, Human
guuacuguugugac

SEQ ID NO: 2921308 - RNA, 13 nt, Human
guuagaauuccuu

SEQ ID NO: 2921309 - RNA, 12 nt, Human
guguaaagcauu

SEQ ID NO: 2921310 - RNA, 21 nt, Human
guguaaagcauuccaacaaag

SEQ ID NO: 2921311 - RNA, 13 nt, Human
guguaaaguuagu

SEQ ID NO: 2921312 - RNA, 16 nt, Human
guguaaaguuagucua

SEQ ID NO: 2921313 - RNA, 19 nt, Human
guguaaaguuagucuacuc

SEQ ID NO: 2921314 - RNA, 18 nt, Human
guguaacuggcaguuuuc

SEQ ID NO: 2921315 - RNA, 17 nt, Human
aagcaaaaucauggaau

SEQ ID NO: 2921316 - RNA, 15 nt, Human
guguuucuagggaaa

SEQ ID NO: 2921317 - RNA, 11 nt, Human
gugugaaguua

SEQ ID NO: 2921318 - RNA, 12 nt, Human
gugugaaguuag

SEQ ID NO: 2921319 - RNA, 13 nt, Human
gugugaaguuaga

SEQ ID NO: 2921320 - RNA, 17 nt, Human
gugugaaguuagaauuc

SEQ ID NO: 2921321 - RNA, 21 nt, Human
gugugaaguuagaauuccuuc

SEQ ID NO: 2921322 - RNA, 24 nt, Human
aagcacagugguggcagggccuag

SEQ ID NO: 2921323 - RNA, 20 nt, Human
aagcacagugguggcagggc

SEQ ID NO: 2921324 - RNA, 23 nt, Human
aagcacagugguggcagggccua

SEQ ID NO: 2921325 - RNA, 12 nt, Human
aagcacaguggu

SEQ ID NO: 2921326 - RNA, 13 nt, Human
aagcacaguggug

SEQ ID NO: 2921327 - RNA, 14 nt, Human
aagcacaguggugg

SEQ ID NO: 2921328 - RNA, 18 nt, Human
aagcacagugguggcagg

SEQ ID NO: 2921329 - RNA, 19 nt, Human
aagcacagugguggcaggg

SEQ ID NO: 2921330 - RNA, 15 nt, Human
aagugauuguuggca

SEQ ID NO: 2921331 - RNA, 11 nt, Human
aaguuagucua

SEQ ID NO: 2921332 - RNA, 23 nt, Human
aaguuagucuacucuuaagccau

SEQ ID NO: 2921333 - RNA, 17 nt, Human
aaguuagaauuccuuca

SEQ ID NO: 2921334 - RNA, 21 nt, Human
aaguuagaauuccuucagggu

SEQ ID NO: 2921335 - RNA, 22 nt, Human
aaguuagaauuccuucagggug

SEQ ID NO: 2921336 - RNA, 15 nt, Human
aaguuagaauuccuu

SEQ ID NO: 2921337 - RNA, 14 nt, Human
aaguuagaauuccu

SEQ ID NO: 2921338 - RNA, 15 nt, Human
aaguucaccauuaaa

SEQ ID NO: 2921339 - RNA, 13 nt, Human
uaaaauugaaagg

SEQ ID NO: 2921340 - RNA, 14 nt, Human
guuuuaaaauuaaa

SEQ ID NO: 2921341 - RNA, 12 nt, Human
guuuuaaaauua

SEQ ID NO: 2921342 - RNA, 15 nt, Human
aaaacaauauuguuu

SEQ ID NO: 2921343 - RNA, 18 nt, Human
aaaacaauauuguuucua

SEQ ID NO: 2921344 - RNA, 17 nt, Human
aaaacaauauuguuucu

SEQ ID NO: 2921345 - RNA, 12 nt, Human
aaaacaaagaag

SEQ ID NO: 2921346 - RNA, 12 nt, Human
agccauugucuu

SEQ ID NO: 2921347 - RNA, 17 nt, Human
agccauugucuucggaa

SEQ ID NO: 2921348 - RNA, 21 nt, Human
agaggagagccagagaaguga

SEQ ID NO: 2921349 - RNA, 23 nt, Human
agaggagagccagagaagugaca

SEQ ID NO: 2921350 - RNA, 13 nt, Human
agaggagagccag

SEQ ID NO: 2921351 - RNA, 12 nt, Human
agaggagagcca

SEQ ID NO: 2921352 - RNA, 14 nt, Human
agaggagagccaga

SEQ ID NO: 2921353 - RNA, 15 nt, Human
agaggagagccagag

SEQ ID NO: 2921354 - RNA, 16 nt, Human
agaggagagccagaga

SEQ ID NO: 2921355 - RNA, 17 nt, Human
agaggagagccagagaa

SEQ ID NO: 2921356 - RNA, 18 nt, Human
agaugggaaugaagcuug

SEQ ID NO: 2921357 - RNA, 23 nt, Human
agaugggaaugaagcuuguguau

SEQ ID NO: 2921358 - RNA, 14 nt, Human
agaugggaaugaag

SEQ ID NO: 2921359 - RNA, 15 nt, Human
agaugggaaugaagc

SEQ ID NO: 2921360 - RNA, 16 nt, Human
agaugggaaugaagcu

SEQ ID NO: 2921361 - RNA, 17 nt, Human
agaugggaaugaagcuu

SEQ ID NO: 2921362 - RNA, 14 nt, Human
agguuacaacagau

SEQ ID NO: 2921363 - RNA, 20 nt, Human
aggaacgguaaauuucugug

SEQ ID NO: 2921364 - RNA, 13 nt, Human
aggagaggagagc

SEQ ID NO: 2921365 - RNA, 14 nt, Human
aggagaggagagcc

SEQ ID NO: 2921366 - RNA, 15 nt, Human
aggagaggagagcca

SEQ ID NO: 2921367 - RNA, 16 nt, Human
aggagaggagagccag

SEQ ID NO: 2921368 - RNA, 17 nt, Human
aggagaggagagccaga

SEQ ID NO: 2921369 - RNA, 19 nt, Human
aggagaggagagccagaga

SEQ ID NO: 2921370 - RNA, 16 nt, Human
aggaacgguaaauuuc

SEQ ID NO: 2921371 - RNA, 22 nt, Human
augcaauauaucuaaauugaau

SEQ ID NO: 2921372 - RNA, 20 nt, Human
augcaauauaucuaaauuga

SEQ ID NO: 2921373 - RNA, 21 nt, Human
augcaauauaucuaaauugaa

SEQ ID NO: 2921374 - RNA, 15 nt, Human
augcaauauaucuaa

SEQ ID NO: 2921375 - RNA, 19 nt, Human
augcaauauaucuaaauug

SEQ ID NO: 2921376 - RNA, 13 nt, Human
augggaaugaagc

SEQ ID NO: 2921377 - RNA, 14 nt, Human
augggaaugaagcu

SEQ ID NO: 2921378 - RNA, 15 nt, Human
augggaaugaagcuu

SEQ ID NO: 2921379 - RNA, 16 nt, Human
augggaaugaagcuug

SEQ ID NO: 2921380 - RNA, 21 nt, Human
augggaaugaagcuuguguau

SEQ ID NO: 2921381 - RNA, 22 nt, Human
auguguaaucaauaaacgauuu

SEQ ID NO: 2921382 - RNA, 17 nt, Human
auguguauuuuauuaca

SEQ ID NO: 2921383 - RNA, 20 nt, Human
auguguaugggcaaaaaacu

SEQ ID NO: 2921384 - RNA, 16 nt, Human
auguguaaucaauaaa

SEQ ID NO: 2921385 - RNA, 17 nt, Human
auguguaaucaauaaac

SEQ ID NO: 2921386 - RNA, 20 nt, Human
auguguaaucaauaaacgau

SEQ ID NO: 2921387 - RNA, 21 nt, Human
auguguaaucaauaaacgauu

SEQ ID NO: 2921388 - RNA, 19 nt, Human
augaagcuuguguauccau

SEQ ID NO: 2921389 - RNA, 18 nt, Human
augaagcuuguguaucca

SEQ ID NO: 2921390 - RNA, 15 nt, Human
augaagcuuguguau

SEQ ID NO: 2921391 - RNA, 14 nt, Human
aucuucucuggcga

SEQ ID NO: 2921392 - RNA, 23 nt, Human
agugaauuuuucucuaacucaga

SEQ ID NO: 2921393 - RNA, 12 nt, Human
agugugaaguua

SEQ ID NO: 2921394 - RNA, 13 nt, Human
agugugaaguuag

SEQ ID NO: 2921395 - RNA, 14 nt, Human
agugugaaguuaga

SEQ ID NO: 2921396 - RNA, 15 nt, Human
agugugaaguuagaa

SEQ ID NO: 2921397 - RNA, 18 nt, Human
agugugaaguuagaauuc

SEQ ID NO: 2921398 - RNA, 20 nt, Human
agugugaaguuagaauuccu

SEQ ID NO: 2921399 - RNA, 21 nt, Human
agugugaaguuagaauuccuu

SEQ ID NO: 2921400 - RNA, 22 nt, Human
agugugaaguuagaauuccuuc

SEQ ID NO: 2921401 - RNA, 21 nt, Human
auauuagcuuuacuguuuguu

SEQ ID NO: 2921402 - RNA, 20 nt, Human
auauuagcuuuacuguuugu

SEQ ID NO: 2921403 - RNA, 14 nt, Human
auaacagguuauuu

SEQ ID NO: 2921404 - RNA, 18 nt, Human
auaacagguuauuuuagu

SEQ ID NO: 2921405 - RNA, 22 nt, Human
auaacagguuauuuuaguuucu

SEQ ID NO: 2921406 - RNA, 23 nt, Human
auaacagguuauuuuaguuucug

SEQ ID NO: 2921407 - RNA, 13 nt, Human
auaacagguuauu

SEQ ID NO: 2921408 - RNA, 14 nt, Human
acgauuuaauucuc

SEQ ID NO: 2921409 - RNA, 15 nt, Human
acgauuuaauucucu

SEQ ID NO: 2921410 - RNA, 17 nt, Human
acgauuuaauucucuug

SEQ ID NO: 2921411 - RNA, 19 nt, Human
acgauuuaauucucuugaa

SEQ ID NO: 2921412 - RNA, 22 nt, Human
acucuguuccuucacauccugu

SEQ ID NO: 2921413 - RNA, 20 nt, Human
acucuguuccuucacauccu

SEQ ID NO: 2921414 - RNA, 14 nt, Human
acucuguuccuuca

SEQ ID NO: 2921415 - RNA, 17 nt, Human
acucuguuccuucacau

SEQ ID NO: 2921416 - RNA, 15 nt, Human
acugcauugagaacu

SEQ ID NO: 2921417 - RNA, 17 nt, Human
acugaagguaaaauuga

SEQ ID NO: 2921418 - RNA, 16 nt, Human
acuguugugaccugaa

SEQ ID NO: 2921419 - RNA, 19 nt, Human
acuguugugaccugaaguu

SEQ ID NO: 2921420 - RNA, 12 nt, Human
acuguuuguuau

SEQ ID NO: 2921421 - RNA, 23 nt, Human
acagguuauuuuaguuucuguuc

SEQ ID NO: 2921422 - RNA, 21 nt, Human
acagguuauuuuaguuucugu

SEQ ID NO: 2921423 - RNA, 22 nt, Human
acagguuauuuuaguuucuguu

SEQ ID NO: 2921424 - RNA, 14 nt, Human
acagguuauuuuag

SEQ ID NO: 2921425 - RNA, 23 nt, Human
acagguuacaacagauuugugaa

SEQ ID NO: 2921426 - RNA, 19 nt, Human
acagguuacaacagauuug

SEQ ID NO: 2921427 - RNA, 20 nt, Human
acagguuacaacagauuugu

SEQ ID NO: 2921428 - RNA, 21 nt, Human
acagguuacaacagauuugug

SEQ ID NO: 2921429 - RNA, 22 nt, Human
acagguuacaacagauuuguga

SEQ ID NO: 2921430 - RNA, 16 nt, Human
acauccuguguuucua

SEQ ID NO: 2921431 - RNA, 14 nt, Human
acauccuguguuuc

SEQ ID NO: 2921432 - RNA, 23 nt, Human
acauccuguguuucuagggaaau

SEQ ID NO: 2921433 - RNA, 22 nt, Human
acauuaaaacaauauuguuucu

SEQ ID NO: 2921434 - RNA, 15 nt, Human
acauuaaaacaauau

SEQ ID NO: 2921435 - RNA, 18 nt, Human
acagguuacaacagauuu

SEQ ID NO: 2921436 - RNA, 18 nt, Human
acaagugaaaaacaucca

SEQ ID NO: 2921437 - RNA, 22 nt, Human
acaagguucuucccuuuuacau

SEQ ID NO: 2921438 - RNA, 22 nt, Human
acaaagaagacauguuuuagac

SEQ ID NO: 2921439 - RNA, 18 nt, Human
acaaagacaaauucuguu

SEQ ID NO: 2921440 - RNA, 15 nt, Human
acaaagaagacaugu

SEQ ID NO: 2921441 - RNA, 16 nt, Human
acaaagaagacauguu

SEQ ID NO: 2921442 - RNA, 19 nt, Human
acaaagaagacauguuuua

SEQ ID NO: 2921443 - RNA, 21 nt, Human
acaaagaagacauguuuuaga

SEQ ID NO: 2921444 - RNA, 13 nt, Human
acaaagaagacau

SEQ ID NO: 2921445 - RNA, 18 nt, Human
acaaagaagacaacauua

SEQ ID NO: 2921446 - RNA, 22 nt, Human
acaaagacaaauucuguuucuu

SEQ ID NO: 2921447 - RNA, 19 nt, Human
acaaagacaaauucuguuu

SEQ ID NO: 2921448 - RNA, 21 nt, Human
aacaucaguuacucugaaggg

SEQ ID NO: 2921449 - RNA, 19 nt, Human
aacaucaguuacucugaag

SEQ ID NO: 2921450 - RNA, 18 nt, Human
aacaucaguuacucugaa

SEQ ID NO: 2921451 - RNA, 20 nt, Human
aaauugggaaaggaguagaa

SEQ ID NO: 2921452 - RNA, 15 nt, Human
aaauugggaaaggag

SEQ ID NO: 2921453 - RNA, 17 nt, Human
aacaaagcuuagcagga

SEQ ID NO: 2921454 - RNA, 19 nt, Human
aacaaagcuuagcaggaga

SEQ ID NO: 2921455 - RNA, 14 nt, Human
aacaaagcuuagca

SEQ ID NO: 2921456 - RNA, 16 nt, Human
aacaaagcuuagcagg

SEQ ID NO: 2921457 - RNA, 17 nt, Human
aacaaagaagacaacau

SEQ ID NO: 2921458 - RNA, 20 nt, Human
aacacauuugauucugugug

SEQ ID NO: 2921459 - RNA, 18 nt, Human
aacucagccaagcacagu

SEQ ID NO: 2921460 - RNA, 20 nt, Human
aacucagccaagcacagugg

SEQ ID NO: 2921461 - RNA, 14 nt, Human
aacucagccaagca

SEQ ID NO: 2921462 - RNA, 15 nt, Human
aacucagccaagcac

SEQ ID NO: 2921463 - RNA, 16 nt, Human
aacucagccaagcaca

SEQ ID NO: 2921464 - RNA, 17 nt, Human
aacucagccaagcacag

SEQ ID NO: 2921465 - RNA, 12 nt, Human
aacucagccaag

SEQ ID NO: 2921466 - RNA, 21 nt, Human
aacucagccaagcacaguggu

SEQ ID NO: 2921467 - RNA, 15 nt, Human
aaugguaccagauaa

SEQ ID NO: 2921468 - RNA, 16 nt, Human
aaugguaccagauaaa

SEQ ID NO: 2921469 - RNA, 21 nt, Human
aagguucuucccuuuuacaua

SEQ ID NO: 2921470 - RNA, 11 nt, Human
aaguguaaagc

SEQ ID NO: 2921471 - RNA, 13 nt, Human
aaguguaaagcau

SEQ ID NO: 2921472 - RNA, 14 nt, Human
aaguguaaagcauu

SEQ ID NO: 2921473 - RNA, 16 nt, Human
aaguguaaagcauucc

SEQ ID NO: 2921474 - RNA, 17 nt, Human
aaguguaaagcauucca

SEQ ID NO: 2921475 - RNA, 18 nt, Human
aaguguaaagcauuccaa

SEQ ID NO: 2921476 - RNA, 13 nt, Human
aauaaugguacca

SEQ ID NO: 2921477 - RNA, 17 nt, Human
aauaaugguaccagaua

SEQ ID NO: 2921478 - RNA, 20 nt, Human
aauaaugguaccagauaaaa

SEQ ID NO: 2921479 - RNA, 21 nt, Human
aauaaugguaccagauaaaau

SEQ ID NO: 2921480 - RNA, 23 nt, Human
aauaaugguaccagauaaaauua

SEQ ID NO: 2921481 - RNA, 16 nt, Human
aagccaucuugguaaa

SEQ ID NO: 2921482 - RNA, 15 nt, Human
aagccaucuugguaa

SEQ ID NO: 2921483 - RNA, 14 nt, Human
aagccaucuuggua

SEQ ID NO: 2921484 - RNA, 13 nt, Human
aagauuucuugag

SEQ ID NO: 2921485 - RNA, 15 nt, Human
cacagugguggcagg

SEQ ID NO: 2921486 - RNA, 23 nt, Human
cacagugguggcagggccuagcu

SEQ ID NO: 2921487 - RNA, 17 nt, Human
cacagugguggcagggc

SEQ ID NO: 2921488 - RNA, 19 nt, Human
cacagugguggcagggccu

SEQ ID NO: 2921489 - RNA, 23 nt, Human
caaaauugggaaaggaguagaaa

SEQ ID NO: 2921490 - RNA, 17 nt, Human
caaauacucauguguau

SEQ ID NO: 2921491 - RNA, 18 nt, Human
caaauacucauguguaug

SEQ ID NO: 2921492 - RNA, 14 nt, Human
caaauacucaugug

SEQ ID NO: 2921493 - RNA, 15 nt, Human
caaauacucaugugu

SEQ ID NO: 2921494 - RNA, 16 nt, Human
caaauacucaugugua

SEQ ID NO: 2921495 - RNA, 19 nt, Human
caauauaucuaaauugaau

SEQ ID NO: 2921496 - RNA, 22 nt, Human
caauauaucuaaauugaauaau

SEQ ID NO: 2921497 - RNA, 20 nt, Human
caauauaucuaaauugaaua

SEQ ID NO: 2921498 - RNA, 21 nt, Human
caauauaucuaaauugaauaa

SEQ ID NO: 2921499 - RNA, 22 nt, Human
uucuucccuuuuacauacugcu

SEQ ID NO: 2921500 - RNA, 21 nt, Human
uucuucccuuuuacauacugc

SEQ ID NO: 2921501 - RNA, 20 nt, Human
uucuucccuuuuacauacug

SEQ ID NO: 2921502 - RNA, 15 nt, Human
uucugcuuucaucuu

SEQ ID NO: 2921503 - RNA, 20 nt, Human
uucuguguguuuucauaaua

SEQ ID NO: 2921504 - RNA, 23 nt, Human
uugauuuuacaauugaaaugacu

SEQ ID NO: 2921505 - RNA, 13 nt, Human
uugauuuuacaau

SEQ ID NO: 2921506 - RNA, 12 nt, Human
uugauugcuaaa

SEQ ID NO: 2921507 - RNA, 13 nt, Human
uugauugcuaaau

SEQ ID NO: 2921508 - RNA, 15 nt, Human
uugauugcuaaaugu

SEQ ID NO: 2921509 - RNA, 20 nt, Human
uugauugcuaaauguaacag

SEQ ID NO: 2921510 - RNA, 23 nt, Human
uugauugcuaaauguaacagucu

SEQ ID NO: 2921511 - RNA, 20 nt, Human
uugaacugauaguuacuguu

SEQ ID NO: 2921512 - RNA, 21 nt, Human
uugaacugauaguuacuguug

SEQ ID NO: 2921513 - RNA, 22 nt, Human
uugaacugauaguuacuguugu

SEQ ID NO: 2921514 - RNA, 15 nt, Human
uugaacugauaguua

SEQ ID NO: 2921515 - RNA, 19 nt, Human
uugaacugauaguuacugu

SEQ ID NO: 2921516 - RNA, 21 nt, Human
uucgugaaguauacuguauuu

SEQ ID NO: 2921517 - RNA, 18 nt, Human
uucgugaaguauacugua

SEQ ID NO: 2921518 - RNA, 17 nt, Human
uucgugaaguauacugu

SEQ ID NO: 2921519 - RNA, 23 nt, Human
uuccaacaaaggguuuuaaugua

SEQ ID NO: 2921520 - RNA, 22 nt, Human
uuccaacaaaggguuuuaaugu

SEQ ID NO: 2921521 - RNA, 19 nt, Human
uuauaucaguccucuuuca

SEQ ID NO: 2921522 - RNA, 18 nt, Human
uuauuacaucuuucacau

SEQ ID NO: 2921523 - RNA, 12 nt, Human
uuauuacaucuu

SEQ ID NO: 2921524 - RNA, 19 nt, Human
uuguuauggcuuaaugaca

SEQ ID NO: 2921525 - RNA, 14 nt, Human
uuguuauggcuuaa

SEQ ID NO: 2921526 - RNA, 23 nt, Human
uuuccaaauucacaaguuguguu

SEQ ID NO: 2921527 - RNA, 22 nt, Human
uuuaguuucuguucuguggaaa

SEQ ID NO: 2921528 - RNA, 23 nt, Human
uuuagacaaauacucauguguau

SEQ ID NO: 2921529 - RNA, 16 nt, Human
uuuagacaaauacuca

SEQ ID NO: 2921530 - RNA, 18 nt, Human
uuuagacaaauacucaug

SEQ ID NO: 2921531 - RNA, 19 nt, Human
uuuagacaaauacucaugu

SEQ ID NO: 2921532 - RNA, 20 nt, Human
uuuagacaaauacucaugug

SEQ ID NO: 2921533 - RNA, 21 nt, Human
uuuagacaaauacucaugugu

SEQ ID NO: 2921534 - RNA, 22 nt, Human
uuuagacaaauacucaugugua

SEQ ID NO: 2921535 - RNA, 22 nt, Human
uuuaaguguaacuggcaguuuu

SEQ ID NO: 2921536 - RNA, 14 nt, Human
uuuaaguguaacug

SEQ ID NO: 2921537 - RNA, 13 nt, Human
uuuuuuuuaaugu

SEQ ID NO: 2921538 - RNA, 12 nt, Human
uuuuuucaucuu

SEQ ID NO: 2921539 - RNA, 16 nt, Human
uuuuuuaaugugcugu

SEQ ID NO: 2921540 - RNA, 15 nt, Human
uuuuuuaaugugcug

SEQ ID NO: 2921541 - RNA, 13 nt, Human
uuuuuuuaaugug

SEQ ID NO: 2921542 - RNA, 17 nt, Human
uuuuuaaugugcugugu

SEQ ID NO: 2921543 - RNA, 12 nt, Human
uuuuuaaugugc

SEQ ID NO: 2921544 - RNA, 19 nt, Human
uuuuuaaugugcuguguaa

SEQ ID NO: 2921545 - RNA, 17 nt, Human
uuugcaccccaugcugu

SEQ ID NO: 2921546 - RNA, 18 nt, Human
uuugcaccccaugcuguu

SEQ ID NO: 2921547 - RNA, 20 nt, Human
uuugcaccccaugcuguuga

SEQ ID NO: 2921548 - RNA, 21 nt, Human
uuugaguggaugauguuucgu

SEQ ID NO: 2921549 - RNA, 20 nt, Human
uuugaguggaugauguuucg

SEQ ID NO: 2921550 - RNA, 16 nt, Human
uuugaguggaugaugu

SEQ ID NO: 2921551 - RNA, 16 nt, Human
uuuccguggcacugca

SEQ ID NO: 2921552 - RNA, 15 nt, Human
uuuccaaauucacaa

SEQ ID NO: 2921553 - RNA, 16 nt, Human
uuuuacaauugaaaug

SEQ ID NO: 2921554 - RNA, 14 nt, Human
uuuuacaauugaaa

SEQ ID NO: 2921555 - RNA, 14 nt, Human
ugcaaccuguugau

SEQ ID NO: 2921556 - RNA, 19 nt, Human
ugauuuuacaauugaaaug

SEQ ID NO: 2921557 - RNA, 19 nt, Human
ugccagguucuauuuggaa

SEQ ID NO: 2921558 - RNA, 20 nt, Human
ugccagguucuauuuggaau

SEQ ID NO: 2921559 - RNA, 12 nt, Human
ugauaguuacug

SEQ ID NO: 2921560 - RNA, 13 nt, Human
ugauaguuacugu

SEQ ID NO: 2921561 - RNA, 14 nt, Human
ugauaguuacuguu

SEQ ID NO: 2921562 - RNA, 16 nt, Human
ugauaguuacuguugu

SEQ ID NO: 2921563 - RNA, 17 nt, Human
ugauaguuacuguugug

SEQ ID NO: 2921564 - RNA, 21 nt, Human
ugauaguuacuguugugaccu

SEQ ID NO: 2921565 - RNA, 19 nt, Human
ugaugccagguucuauuug

SEQ ID NO: 2921566 - RNA, 13 nt, Human
ugauauauguguu

SEQ ID NO: 2921567 - RNA, 21 nt, Human
ugauauauguguuuuucacau

SEQ ID NO: 2921568 - RNA, 20 nt, Human
ugauaguuacuguugugacc

SEQ ID NO: 2921569 - RNA, 17 nt, Human
ugagcccggaugcuucu

SEQ ID NO: 2921570 - RNA, 22 nt, Human
ugacgcugaauaaaugucuuuu

SEQ ID NO: 2921571 - RNA, 15 nt, Human
ugacgcugaauaaau

SEQ ID NO: 2921572 - RNA, 17 nt, Human
ugacgcugaauaaaugu

SEQ ID NO: 2921573 - RNA, 18 nt, Human
ugacgcugaauaaauguc

SEQ ID NO: 2921574 - RNA, 20 nt, Human
ugacgcugaauaaaugucuu

SEQ ID NO: 2921575 - RNA, 14 nt, Human
ugacgcugaauaaa

SEQ ID NO: 2921576 - RNA, 21 nt, Human
ugggaaugaagcuuguguauc

SEQ ID NO: 2921577 - RNA, 15 nt, Human
ugggaaugaagcuug

SEQ ID NO: 2921578 - RNA, 18 nt, Human
ugggaaugaagcuugugu

SEQ ID NO: 2921579 - RNA, 19 nt, Human
ugggaaugaagcuugugua

SEQ ID NO: 2921580 - RNA, 20 nt, Human
ugggaaugaagcuuguguau

SEQ ID NO: 2921581 - RNA, 12 nt, Human
ugggaaugaagc

SEQ ID NO: 2921582 - RNA, 13 nt, Human
ugggaaugaagcu

SEQ ID NO: 2921583 - RNA, 14 nt, Human
ugggaaugaagcuu

SEQ ID NO: 2921584 - RNA, 20 nt, Human
uggagauaaagauuucuuga

SEQ ID NO: 2921585 - RNA, 14 nt, Human
uggaugauguuucg

SEQ ID NO: 2921586 - RNA, 17 nt, Human
uggaugauguuucguga

SEQ ID NO: 2921587 - RNA, 21 nt, Human
ugcuuuccguggcacugcaua

SEQ ID NO: 2921588 - RNA, 20 nt, Human
ugcuuuccguggcacugcau

SEQ ID NO: 2921589 - RNA, 17 nt, Human
ugcuuuccguggcacug

SEQ ID NO: 2921590 - RNA, 17 nt, Human
ugcuucuccaugagaca

SEQ ID NO: 2921591 - RNA, 18 nt, Human
ugucacuguuucucugcu

SEQ ID NO: 2921592 - RNA, 17 nt, Human
ugucacuguuucucugc

SEQ ID NO: 2921593 - RNA, 13 nt, Human
ugucacuguuucu

SEQ ID NO: 2921594 - RNA, 14 nt, Human
uguaugggcaaaaa

SEQ ID NO: 2921595 - RNA, 15 nt, Human
uguaugggcaaaaaa

SEQ ID NO: 2921596 - RNA, 14 nt, Human
uguauaacagguua

SEQ ID NO: 2921597 - RNA, 15 nt, Human
uguauaacagguuau

SEQ ID NO: 2921598 - RNA, 17 nt, Human
uguauaacagguuauuu

SEQ ID NO: 2921599 - RNA, 21 nt, Human
uguauaacagguuauuuuagu

SEQ ID NO: 2921600 - RNA, 23 nt, Human
uguccccuauggggaugguccac

SEQ ID NO: 2921601 - RNA, 19 nt, Human
ugguguaguugaacugaua

SEQ ID NO: 2921602 - RNA, 14 nt, Human
uguaacagucugau

SEQ ID NO: 2921603 - RNA, 16 nt, Human
uguaacagucugaucg

SEQ ID NO: 2921604 - RNA, 23 nt, Human
ucuuaagccaucuugguaaauuu

SEQ ID NO: 2921605 - RNA, 20 nt, Human
ucuuaagccaucuugguaaa

SEQ ID NO: 2921606 - RNA, 22 nt, Human
ucuuaagccaucuugguaaauu

SEQ ID NO: 2921607 - RNA, 12 nt, Human
ucuuaagccauc

SEQ ID NO: 2921608 - RNA, 13 nt, Human
ucuuaagccaucu

SEQ ID NO: 2921609 - RNA, 16 nt, Human
ucuuaagccaucuugg

SEQ ID NO: 2921610 - RNA, 17 nt, Human
ucuuaagccaucuuggu

SEQ ID NO: 2921611 - RNA, 19 nt, Human
ucuuaagccaucuugguaa

SEQ ID NO: 2921612 - RNA, 18 nt, Human
ucucuuaauuuaaucuuu

SEQ ID NO: 2921613 - RNA, 23 nt, Human
ucugaggccuccucucucaguuu

SEQ ID NO: 2921614 - RNA, 21 nt, Human
ucucuaacucagaaacaucag

SEQ ID NO: 2921615 - RNA, 20 nt, Human
ucucuaacucagaaacauca

SEQ ID NO: 2921616 - RNA, 18 nt, Human
ucucuaacucagaaacau

SEQ ID NO: 2921617 - RNA, 22 nt, Human
ucucuaacucagaaacaucagu

SEQ ID NO: 2921618 - RNA, 22 nt, Human
ucucugaagaguggguuucaca

SEQ ID NO: 2921619 - RNA, 23 nt, Human
ucucugaagaguggguuucacaa

SEQ ID NO: 2921620 - RNA, 22 nt, Human
ucucucuccuguacuuuuucca

SEQ ID NO: 2921621 - RNA, 22 nt, Human
ucucuggcgacaguuuuccuuc

SEQ ID NO: 2921622 - RNA, 17 nt, Human
ucucuggcgacaguuuu

SEQ ID NO: 2921623 - RNA, 16 nt, Human
ucucuggcgacaguuu

SEQ ID NO: 2921624 - RNA, 14 nt, Human
ucccuccugcuacu

SEQ ID NO: 2921625 - RNA, 22 nt, Human
ucgugacgcugaauaaaugucu

SEQ ID NO: 2921626 - RNA, 21 nt, Human
ucgugacgcugaauaaauguc

SEQ ID NO: 2921627 - RNA, 20 nt, Human
ucgugacgcugaauaaaugu

SEQ ID NO: 2921628 - RNA, 21 nt, Human
uccugucccuucucuuaauuu

SEQ ID NO: 2921629 - RNA, 20 nt, Human
uccuucacauccuguguuuc

SEQ ID NO: 2921630 - RNA, 14 nt, Human
uccuucacauccug

SEQ ID NO: 2921631 - RNA, 17 nt, Human
ucaauaaacgauuuaau

SEQ ID NO: 2921632 - RNA, 18 nt, Human
ucaauaaacgauuuaauu

SEQ ID NO: 2921633 - RNA, 22 nt, Human
ucaauaaacgauuuaauucucu

SEQ ID NO: 2921634 - RNA, 23 nt, Human
ucaauaaacgauuuaauucucuu

SEQ ID NO: 2921635 - RNA, 15 nt, Human
ucaauaaacgauuua

SEQ ID NO: 2921636 - RNA, 13 nt, Human
ucaauaaacgauu

SEQ ID NO: 2921637 - RNA, 21 nt, Human
uauuuuauuacaucuuucaca

SEQ ID NO: 2921638 - RNA, 11 nt, Human
uauuguuucua

SEQ ID NO: 2921639 - RNA, 24 nt, Human
uauguaacugcauugagaacugca

SEQ ID NO: 2921640 - RNA, 14 nt, Human
uauguaacugcauu

SEQ ID NO: 2921641 - RNA, 22 nt, Human
ucauuuccuauguaacugcauu

SEQ ID NO: 2921642 - RNA, 22 nt, Human
ucauucaaaaguugaaauuaac

SEQ ID NO: 2921643 - RNA, 18 nt, Human
ucauucaaaaguugaaau

SEQ ID NO: 2921644 - RNA, 16 nt, Human
ucauucaaaaguugaa

SEQ ID NO: 2921645 - RNA, 13 nt, Human
ucaucuucucugg

SEQ ID NO: 2921646 - RNA, 23 nt, Human
ucagaaauuuaauucauguuucu

SEQ ID NO: 2921647 - RNA, 21 nt, Human
ucagaaauuuaauucauguuu

SEQ ID NO: 2921648 - RNA, 14 nt, Human
ucagaaauuuaauu

SEQ ID NO: 2921649 - RNA, 22 nt, Human
ucagaaacaucaguuacucuga

SEQ ID NO: 2921650 - RNA, 18 nt, Human
ucagaaacaucaguuacu

SEQ ID NO: 2921651 - RNA, 15 nt, Human
gcugcuacaaagaag

SEQ ID NO: 2921652 - RNA, 20 nt, Human
gcugcuacaaagaagacaug

SEQ ID NO: 2921653 - RNA, 21 nt, Human
gcugcuacaaagaagacaugu

SEQ ID NO: 2921654 - RNA, 16 nt, Human
gcugcuacaaagaaga

SEQ ID NO: 2921655 - RNA, 17 nt, Human
gcugcuacaaagaagac

SEQ ID NO: 2921656 - RNA, 18 nt, Human
gcugcuacaaagaagaca

SEQ ID NO: 2921657 - RNA, 19 nt, Human
gcugcuacaaagaagacau

SEQ ID NO: 2921658 - RNA, 23 nt, Human
gcugcuacaaagaagacauguuu

SEQ ID NO: 2921659 - RNA, 20 nt, Human
gcugauauauguguuuuuca

SEQ ID NO: 2921660 - RNA, 18 nt, Human
gcugauauauguguuuuu

SEQ ID NO: 2921661 - RNA, 17 nt, Human
gcugauauauguguuuu

SEQ ID NO: 2921662 - RNA, 11 nt, Human
gcuuguguauc

SEQ ID NO: 2921663 - RNA, 18 nt, Human
gcuuguguauccauuauc

SEQ ID NO: 2921664 - RNA, 19 nt, Human
gcuuguguauccauuauca

SEQ ID NO: 2921665 - RNA, 20 nt, Human
gcuuguguauccauuaucau

SEQ ID NO: 2921666 - RNA, 22 nt, Human
gcuuguguauccauuaucaugu

SEQ ID NO: 2921667 - RNA, 23 nt, Human
gcaggagaggagagccagagaag

SEQ ID NO: 2921668 - RNA, 13 nt, Human
gcaggagaggaga

SEQ ID NO: 2921669 - RNA, 16 nt, Human
gcaggagaggagagcc

SEQ ID NO: 2921670 - RNA, 17 nt, Human
gcaggagaggagagcca

SEQ ID NO: 2921671 - RNA, 18 nt, Human
gcaggagaggagagccag

SEQ ID NO: 2921672 - RNA, 19 nt, Human
gcaggagaggagagccaga

SEQ ID NO: 2921673 - RNA, 20 nt, Human
gcaggagaggagagccagag

SEQ ID NO: 2921674 - RNA, 22 nt, Human
gcaggagaggagagccagagaa

SEQ ID NO: 2921675 - RNA, 19 nt, Human
gcauuaaauauaauaugca

SEQ ID NO: 2921676 - RNA, 21 nt, Human
gcauugagaacugcauauguu

SEQ ID NO: 2921677 - RNA, 12 nt, Human
gcauugagaacu

SEQ ID NO: 2921678 - RNA, 22 nt, Human
gcauugagaacugcauauguuu

SEQ ID NO: 2921679 - RNA, 17 nt, Human
gccaaguuuauauacaa

SEQ ID NO: 2921680 - RNA, 15 nt, Human
gccaaguuuauauac

SEQ ID NO: 2921681 - RNA, 20 nt, Human
gccaaguuuauauacaauua

SEQ ID NO: 2921682 - RNA, 20 nt, Human
gccagguucuauuuggaauu

SEQ ID NO: 2921683 - RNA, 23 nt, Human
gccagguucuauuuggaauuuau

SEQ ID NO: 2921684 - RNA, 18 nt, Human
gccagguucuauuuggaa

SEQ ID NO: 2921685 - RNA, 19 nt, Human
gccagguucuauuuggaau

SEQ ID NO: 2921686 - RNA, 13 nt, Human
gaguuuuguuuua

SEQ ID NO: 2921687 - RNA, 19 nt, Human
gaguuuuguuuuaaaauua

SEQ ID NO: 2921688 - RNA, 19 nt, Human
gauacacccaaaguaucag

SEQ ID NO: 2921689 - RNA, 20 nt, Human
gauauauguguuuuucacau

SEQ ID NO: 2921690 - RNA, 22 nt, Human
gauauauguguuuuucacauuu

SEQ ID NO: 2921691 - RNA, 18 nt, Human
gaguuaggcuauucacaa

SEQ ID NO: 2921692 - RNA, 17 nt, Human
gaguuaggcuauucaca

SEQ ID NO: 2921693 - RNA, 22 nt, Human
gauuaagagauggguuugacaa

SEQ ID NO: 2921694 - RNA, 21 nt, Human
gauucccuccugcuacucugu

SEQ ID NO: 2921695 - RNA, 22 nt, Human
gaugggaaugaagcuuguguau

SEQ ID NO: 2921696 - RNA, 16 nt, Human
gaugggaaugaagcuu

SEQ ID NO: 2921697 - RNA, 18 nt, Human
gaugggaaugaagcuugu

SEQ ID NO: 2921698 - RNA, 13 nt, Human
gaugggaaugaag

SEQ ID NO: 2921699 - RNA, 14 nt, Human
gaugggaaugaagc

SEQ ID NO: 2921700 - RNA, 22 nt, Human
gagccagagaagugacagggaa

SEQ ID NO: 2921701 - RNA, 19 nt, Human
gagccagagaagugacagg

SEQ ID NO: 2921702 - RNA, 20 nt, Human
gagccagagaagugacaggg

SEQ ID NO: 2921703 - RNA, 12 nt, Human
gagccagagaag

SEQ ID NO: 2921704 - RNA, 13 nt, Human
gagccagagaagu

SEQ ID NO: 2921705 - RNA, 14 nt, Human
gagccagagaagug

SEQ ID NO: 2921706 - RNA, 15 nt, Human
gagccagagaaguga

SEQ ID NO: 2921707 - RNA, 16 nt, Human
gagccagagaagugac

SEQ ID NO: 2921708 - RNA, 17 nt, Human
gagccagagaagugaca

SEQ ID NO: 2921709 - RNA, 18 nt, Human
gagccagagaagugacag

SEQ ID NO: 2921710 - RNA, 23 nt, Human
cucugaagggcaucaugcaucuu

SEQ ID NO: 2921711 - RNA, 22 nt, Human
cucugaagggcaucaugcaucu

SEQ ID NO: 2921712 - RNA, 19 nt, Human
cucugaagggcaucaugca

SEQ ID NO: 2921713 - RNA, 17 nt, Human
cucugaagggcaucaug

SEQ ID NO: 2921714 - RNA, 22 nt, Human
cucuuaagccaucuugguaaau

SEQ ID NO: 2921715 - RNA, 12 nt, Human
cucuuaagccau

SEQ ID NO: 2921716 - RNA, 13 nt, Human
cucuuaagccauc

SEQ ID NO: 2921717 - RNA, 14 nt, Human
cucuuaagccaucu

SEQ ID NO: 2921718 - RNA, 20 nt, Human
cucuuaagccaucuugguaa

SEQ ID NO: 2921719 - RNA, 21 nt, Human
cucuuaagccaucuugguaaa

SEQ ID NO: 2921720 - RNA, 16 nt, Human
cucuggcgacaguuuu

SEQ ID NO: 2921721 - RNA, 14 nt, Human
cugaaguucaccau

SEQ ID NO: 2921722 - RNA, 22 nt, Human
cugauauauguguuuuucacau

SEQ ID NO: 2921723 - RNA, 21 nt, Human
cugauauauguguuuuucaca

SEQ ID NO: 2921724 - RNA, 15 nt, Human
cugauauauguguuu

SEQ ID NO: 2921725 - RNA, 17 nt, Human
cuauuuaguuuuuguaa

SEQ ID NO: 2921726 - RNA, 20 nt, Human
cuauuuaguuuuuguaauuu

SEQ ID NO: 2921727 - RNA, 22 nt, Human
cuauuuaguuuuuguaauuuau

SEQ ID NO: 2921728 - RNA, 23 nt, Human
cuauuuaguuuuuguaauuuauu

SEQ ID NO: 2921729 - RNA, 19 nt, Human
cucacaccgcgucugguga

SEQ ID NO: 2921730 - RNA, 16 nt, Human
cuauuagccacaaaau

SEQ ID NO: 2921731 - RNA, 11 nt, Human
cuauucacaac

SEQ ID NO: 2921732 - RNA, 18 nt, Human
cucagccaagcacagugg

SEQ ID NO: 2921733 - RNA, 20 nt, Human
cucagccaagcacaguggug

SEQ ID NO: 2921734 - RNA, 23 nt, Human
cucagccaagcacagugguggca

SEQ ID NO: 2921735 - RNA, 17 nt, Human
cucagccaagcacagug

SEQ ID NO: 2921736 - RNA, 18 nt, Human
cuccugcuacucuguucc

SEQ ID NO: 2921737 - RNA, 16 nt, Human
cucgaggacuguauuu

SEQ ID NO: 2921738 - RNA, 17 nt, Human
cucgaggacuguauuug

SEQ ID NO: 2921739 - RNA, 20 nt, Human
cucgaggacuguauuuguga

SEQ ID NO: 2921740 - RNA, 22 nt, Human
cucgaggacuguauuugugacu

SEQ ID NO: 2921741 - RNA, 23 nt, Human
cucgaggacuguauuugugacua

SEQ ID NO: 2921742 - RNA, 15 nt, Human
cuccgcaguuccugu

SEQ ID NO: 2921743 - RNA, 18 nt, Human
cuuguuuuuccacuacug

SEQ ID NO: 2921744 - RNA, 12 nt, Human
cuuuacuguuug

SEQ ID NO: 2921745 - RNA, 15 nt, Human
cuuuacuguuuguua

SEQ ID NO: 2921746 - RNA, 14 nt, Human
cuuuacuguuuguu

SEQ ID NO: 2921747 - RNA, 22 nt, Human
cuuugggaaaggagaaguuaag

SEQ ID NO: 2921748 - RNA, 15 nt, Human
cuuugggaaaggaga

SEQ ID NO: 2921749 - RNA, 17 nt, Human
cuuuguccuuuuuguua

SEQ ID NO: 2921750 - RNA, 17 nt, Human
cuuuuacauacugcugu

SEQ ID NO: 2921751 - RNA, 14 nt, Human
cuuuuacauacugc

SEQ ID NO: 2921752 - RNA, 13 nt, Human
cuuuuacauacug

SEQ ID NO: 2921753 - RNA, 19 nt, Human
gaaucagaucauuucaaaa

SEQ ID NO: 2921754 - RNA, 11 nt, Human
gaauaaauguc

SEQ ID NO: 2921755 - RNA, 14 nt, Human
gaauaaaugucuuu

SEQ ID NO: 2921756 - RNA, 20 nt, Human
gaauaaugguaccagauaaa

SEQ ID NO: 2921757 - RNA, 21 nt, Human
gaauaaugguaccagauaaaa

SEQ ID NO: 2921758 - RNA, 13 nt, Human
gaagguaaaauug

SEQ ID NO: 2921759 - RNA, 13 nt, Human
gaagccauugucu

SEQ ID NO: 2921760 - RNA, 14 nt, Human
gaagccauugucuu

SEQ ID NO: 2921761 - RNA, 16 nt, Human
gaagccauugucuucg

SEQ ID NO: 2921762 - RNA, 12 nt, Human
gaagccauuguc

SEQ ID NO: 2921763 - RNA, 22 nt, Human
gaagcuuguguauccauuauca

SEQ ID NO: 2921764 - RNA, 23 nt, Human
gaagcuuguguauccauuaucau

SEQ ID NO: 2921765 - RNA, 18 nt, Human
gaaauaguucaaagccaa

SEQ ID NO: 2921766 - RNA, 20 nt, Human
gaaacaucaguuacucugaa

SEQ ID NO: 2921767 - RNA, 19 nt, Human
gaaacaucaguuacucuga

SEQ ID NO: 2921768 - RNA, 23 nt, Human
gaaacaucaguuacucugaaggg

SEQ ID NO: 2921769 - RNA, 23 nt, Human
gaaauuuaauucauguuucuuaa

SEQ ID NO: 2921770 - RNA, 21 nt, Human
gaaauuuaauucauguuucuu

SEQ ID NO: 2921771 - RNA, 20 nt, Human
gaaauuuaauucauguuucu

SEQ ID NO: 2921772 - RNA, 16 nt, Human
gaaauuuaauucaugu

SEQ ID NO: 2921773 - RNA, 15 nt, Human
gaacgguaaauuucu

SEQ ID NO: 2921774 - RNA, 17 nt, Human
gaacgguaaauuucugu

SEQ ID NO: 2921775 - RNA, 21 nt, Human
cuguauuuuuaccuuuuuccu

SEQ ID NO: 2921776 - RNA, 12 nt, Human
cugugaaauagu

SEQ ID NO: 2921777 - RNA, 23 nt, Human
cuguggaaaguguaaagcauucc

SEQ ID NO: 2921778 - RNA, 15 nt, Human
cuguguaaaguuagu

SEQ ID NO: 2921779 - RNA, 18 nt, Human
cuguguaaaguuagucua

SEQ ID NO: 2921780 - RNA, 11 nt, Human
cuguguaaagu

SEQ ID NO: 2921781 - RNA, 12 nt, Human
cuguguaaaguu

SEQ ID NO: 2921782 - RNA, 13 nt, Human
cuguguaaaguua

SEQ ID NO: 2921783 - RNA, 14 nt, Human
cuguguaaaguuag

SEQ ID NO: 2921784 - RNA, 19 nt, Human
cuguguguuuucauaauaa

SEQ ID NO: 2921785 - RNA, 18 nt, Human
cuguguguuuucauaaua

SEQ ID NO: 2921786 - RNA, 16 nt, Human
cuguguguuuucauaa

SEQ ID NO: 2921787 - RNA, 12 nt, Human
cuuacugaaggu

SEQ ID NO: 2921788 - RNA, 17 nt, Human
cuuaaauuuuaauuuau

SEQ ID NO: 2921789 - RNA, 18 nt, Human
cuuaaauuuuaauuuauu

SEQ ID NO: 2921790 - RNA, 14 nt, Human
cuguugauugcuaa

SEQ ID NO: 2921791 - RNA, 15 nt, Human
cuguugauugcuaaa

SEQ ID NO: 2921792 - RNA, 17 nt, Human
cuguugauugcuaaaug

SEQ ID NO: 2921793 - RNA, 18 nt, Human
cuguugauugcuaaaugu

SEQ ID NO: 2921794 - RNA, 19 nt, Human
cuguugauugcuaaaugua

SEQ ID NO: 2921795 - RNA, 20 nt, Human
cuguugauugcuaaauguaa

SEQ ID NO: 2921796 - RNA, 22 nt, Human
cuguugauugcuaaauguaaca

SEQ ID NO: 2921797 - RNA, 23 nt, Human
cuguugauugcuaaauguaacag

SEQ ID NO: 2921798 - RNA, 23 nt, Human
cuguucuguggaaaguguaaagc

SEQ ID NO: 2921799 - RNA, 15 nt, Human
cuguucuguggaaag

SEQ ID NO: 2921800 - RNA, 20 nt, Human
cuguucuguggaaaguguaa

SEQ ID NO: 2921801 - RNA, 21 nt, Human
cuguucuguggaaaguguaaa

SEQ ID NO: 2921802 - RNA, 22 nt, Human
cuguucuguggaaaguguaaag

SEQ ID NO: 2921803 - RNA, 14 nt, Human
cuguucuguggaaa

SEQ ID NO: 2921804 - RNA, 12 nt, Human
cuguuuguuaug

SEQ ID NO: 2921805 - RNA, 20 nt, Human
cuucacauccuguguuucua

SEQ ID NO: 2921806 - RNA, 12 nt, Human
cuucucaucugu

SEQ ID NO: 2921807 - RNA, 19 nt, Human
cuucggaaaccuuggugua

SEQ ID NO: 2921808 - RNA, 15 nt, Human
ccuccugcuacucug

SEQ ID NO: 2921809 - RNA, 22 nt, Human
ccuaugcaauauaucuaaauug

SEQ ID NO: 2921810 - RNA, 14 nt, Human
ccuaugcaauauau

SEQ ID NO: 2921811 - RNA, 17 nt, Human
ccgcgucuggugacaac

SEQ ID NO: 2921812 - RNA, 18 nt, Human
ccuuuuacauacugcugu

SEQ ID NO: 2921813 - RNA, 17 nt, Human
ccuuuuacauacugcug

SEQ ID NO: 2921814 - RNA, 13 nt, Human
ccuguguuucuag

SEQ ID NO: 2921815 - RNA, 20 nt, Human
ccuucacauccuguguuucu

SEQ ID NO: 2921816 - RNA, 15 nt, Human
ccagguucuauuugg

SEQ ID NO: 2921817 - RNA, 16 nt, Human
ccagguucuauuugga

SEQ ID NO: 2921818 - RNA, 22 nt, Human
ccagguucuauuuggaauuuau

SEQ ID NO: 2921819 - RNA, 20 nt, Human
caucuccuccauacucagga

SEQ ID NO: 2921820 - RNA, 12 nt, Human
caucuuucacau

SEQ ID NO: 2921821 - RNA, 13 nt, Human
caucuuucacauu

SEQ ID NO: 2921822 - RNA, 19 nt, Human
caugagacacaucuccucc

SEQ ID NO: 2921823 - RNA, 14 nt, Human
caugagacacaucu

SEQ ID NO: 2921824 - RNA, 16 nt, Human
caucaugcaucuuacu

SEQ ID NO: 2921825 - RNA, 22 nt, Human
caucaguuacucugaagggcau

SEQ ID NO: 2921826 - RNA, 22 nt, Human
cauggaaugguuauaaaaguga

SEQ ID NO: 2921827 - RNA, 22 nt, Human
cauuaaaacaauauuguuucua

SEQ ID NO: 2921828 - RNA, 21 nt, Human
cauuaaaacaauauuguuucu

SEQ ID NO: 2921829 - RNA, 12 nt, Human
cauuaaaacaau

SEQ ID NO: 2921830 - RNA, 10 nt, Human
cauguuucuu

SEQ ID NO: 2921831 - RNA, 18 nt, Human
cauguguaugggcaaaaa

SEQ ID NO: 2921832 - RNA, 17 nt, Human
cauguguaaucaauaaa

SEQ ID NO: 2921833 - RNA, 18 nt, Human
cauguguaaucaauaaac

SEQ ID NO: 2921834 - RNA, 22 nt, Human
cauguguaaucaauaaacgauu

SEQ ID NO: 2921835 - RNA, 23 nt, Human
cauguguaaucaauaaacgauuu

SEQ ID NO: 2921836 - RNA, 15 nt, Human
cauuugauucugugu

SEQ ID NO: 2921837 - RNA, 20 nt, Human
cauucugcuuucaucuuggu

SEQ ID NO: 2921838 - RNA, 18 nt, Human
cauucaaaaguugaaauu

SEQ ID NO: 2921839 - RNA, 17 nt, Human
cauucaaaaguugaaau

SEQ ID NO: 2921840 - RNA, 16 nt, Human
cauucaaaaguugaaa

SEQ ID NO: 2921841 - RNA, 12 nt, Human
cauuccaacaaa

SEQ ID NO: 2921842 - RNA, 14 nt, Human
cauuccaacaaagg

SEQ ID NO: 2921843 - RNA, 18 nt, Human
cauuccaacaaaggguuu

SEQ ID NO: 2921844 - RNA, 11 nt, Human
cagguuacaac

SEQ ID NO: 2921845 - RNA, 12 nt, Human
cagguuacaaca

SEQ ID NO: 2921846 - RNA, 13 nt, Human
cagguuacaacag

SEQ ID NO: 2921847 - RNA, 14 nt, Human
cagguuacaacaga

SEQ ID NO: 2921848 - RNA, 15 nt, Human
cagguuacaacagau

SEQ ID NO: 2921849 - RNA, 16 nt, Human
cagguuacaacagauu

SEQ ID NO: 2921850 - RNA, 17 nt, Human
cagguuacaacagauuu

SEQ ID NO: 2921851 - RNA, 19 nt, Human
cagguuacaacagauuugu

SEQ ID NO: 2921852 - RNA, 21 nt, Human
cagguuacaacagauuuguga

SEQ ID NO: 2921853 - RNA, 16 nt, Human
cagguucuauuuggaa

SEQ ID NO: 2921854 - RNA, 17 nt, Human
cagguucuauuuggaau

SEQ ID NO: 2921855 - RNA, 19 nt, Human
cagguucuauuuggaauuu

SEQ ID NO: 2921856 - RNA, 21 nt, Human
cagguucuauuuggaauuuau

SEQ ID NO: 2921857 - RNA, 22 nt, Human
cagguuacaacagauuugugaa

SEQ ID NO: 2921858 - RNA, 23 nt, Human
cagguuacaacagauuugugaac

SEQ ID NO: 2921859 - RNA, 14 nt, Human
cagguuauuuuagu

SEQ ID NO: 2921860 - RNA, 16 nt, Human
cagguuauuuuaguuu

SEQ ID NO: 2921861 - RNA, 21 nt, Human
cagguuauuuuaguuucuguu

SEQ ID NO: 2921862 - RNA, 15 nt, Human
cagguucuauuugga

SEQ ID NO: 2921863 - RNA, 24 nt, Human
cagucauggcaccaaagccaccag

SEQ ID NO: 2921864 - RNA, 13 nt, Human
caguccucuuuca

SEQ ID NO: 2921865 - RNA, 14 nt, Human
caggagaggagagc

SEQ ID NO: 2921866 - RNA, 15 nt, Human
caggagaggagagcc

SEQ ID NO: 2921867 - RNA, 16 nt, Human
caggagaggagagcca

SEQ ID NO: 2921868 - RNA, 17 nt, Human
caggagaggagagccag

SEQ ID NO: 2921869 - RNA, 22 nt, Human
caggagaggagagccagagaag

SEQ ID NO: 2921870 - RNA, 18 nt, Human
caggagaggagagccaga

SEQ ID NO: 2921871 - RNA, 19 nt, Human
caggagaggagagccagag

SEQ ID NO: 2921872 - RNA, 20 nt, Human
caggagaggagagccagaga

SEQ ID NO: 2921873 - RNA, 21 nt, Human
caggagaggagagccagagaa

SEQ ID NO: 2921874 - RNA, 14 nt, Human
cagggaagcuacag

SEQ ID NO: 2921875 - RNA, 15 nt, Human
cagggaagcuacagg

SEQ ID NO: 2921876 - RNA, 17 nt, Human
cagggaagcuacagguu

SEQ ID NO: 2921877 - RNA, 22 nt, Human
cagggaagcuacagguuacaac

SEQ ID NO: 2921878 - RNA, 24 nt, Human
cagggaagcuacagguuacaacag

SEQ ID NO: 2921879 - RNA, 18 nt, Human
cagggaagcuacagguua

SEQ ID NO: 2921880 - RNA, 19 nt, Human
cagggaagcuacagguuac

SEQ ID NO: 2921881 - RNA, 20 nt, Human
cagggaagcuacagguuaca

SEQ ID NO: 2921882 - RNA, 21 nt, Human
cagggaagcuacagguuacaa

SEQ ID NO: 2921883 - RNA, 23 nt, Human
cagggccuagcugcuacaaagaa

SEQ ID NO: 2921884 - RNA, 21 nt, Human
cagggccuagcugcuacaaag

SEQ ID NO: 2921885 - RNA, 22 nt, Human
cagggccuagcugcuacaaaga

SEQ ID NO: 2921886 - RNA, 19 nt, Human
cagggccuagcugcuacaa

SEQ ID NO: 2921887 - RNA, 20 nt, Human
cagggccuagcugcuacaaa

SEQ ID NO: 2921888 - RNA, 19 nt, Human
cagccaagcacaguggugg

SEQ ID NO: 2921889 - RNA, 23 nt, Human
cagccaagcacagugguggcagg

SEQ ID NO: 2921890 - RNA, 13 nt, Human
cagccaagcacag

SEQ ID NO: 2921891 - RNA, 14 nt, Human
cagccaagcacagu

SEQ ID NO: 2921892 - RNA, 16 nt, Human
cagccaagcacagugg

SEQ ID NO: 2921893 - RNA, 17 nt, Human
cagccaagcacaguggu

SEQ ID NO: 2921894 - RNA, 12 nt, Human
cagccacacugu

SEQ ID NO: 2921895 - RNA, 11 nt, Human
cagccaagcac

SEQ ID NO: 2921896 - RNA, 24 nt, Human
cagauuugugaacucagccaagca

SEQ ID NO: 2921897 - RNA, 12 nt, Human
cagauuugugaa

SEQ ID NO: 2921898 - RNA, 14 nt, Human
cagauuugugaacu

SEQ ID NO: 2921899 - RNA, 15 nt, Human
cagauuugugaacuc

SEQ ID NO: 2921900 - RNA, 16 nt, Human
cagauuugugaacuca

SEQ ID NO: 2921901 - RNA, 17 nt, Human
cagauuugugaacucag

SEQ ID NO: 2921902 - RNA, 23 nt, Human
cagauuugugaacucagccaagc

SEQ ID NO: 2921903 - RNA, 16 nt, Human
caggaagucuucaggg

SEQ ID NO: 2921904 - RNA, 22 nt, Human
cagagacaggaagucuucaggg

SEQ ID NO: 2921905 - RNA, 13 nt, Human
cagagaagugaca

SEQ ID NO: 2921906 - RNA, 14 nt, Human
cagagaagugacag

SEQ ID NO: 2921907 - RNA, 15 nt, Human
cagagaagugacagg

SEQ ID NO: 2921908 - RNA, 16 nt, Human
cagagaagugacaggg

SEQ ID NO: 2921909 - RNA, 17 nt, Human
cagagaagugacaggga

SEQ ID NO: 2921910 - RNA, 18 nt, Human
cagagaagugacagggaa

SEQ ID NO: 2921911 - RNA, 19 nt, Human
cagagaagugacagggaag

SEQ ID NO: 2921912 - RNA, 20 nt, Human
cagagaagugacagggaagc

SEQ ID NO: 2921913 - RNA, 21 nt, Human
cagagaagugacagggaagcu

SEQ ID NO: 2921914 - RNA, 22 nt, Human
cagagaagugacagggaagcua

SEQ ID NO: 2921915 - RNA, 23 nt, Human
cagagaagugacagggaagcuac

SEQ ID NO: 2921916 - RNA, 24 nt, Human
cagagaagugacagggaagcuaca

SEQ ID NO: 2921917 - RNA, 16 nt, Human
cagauaaaauuauaga

SEQ ID NO: 2921918 - RNA, 21 nt, Human
cagauaaaauuauagauggga

SEQ ID NO: 2921919 - RNA, 21 nt, Human
cacuuuuuugaguggaugaug

SEQ ID NO: 2921920 - RNA, 22 nt, Human
cagaaacaucaguuacucugaa

SEQ ID NO: 2921921 - RNA, 19 nt, Human
cagaaacaucaguuacucu

SEQ ID NO: 2921922 - RNA, 17 nt, Human
cagaaacaucaguuacu

SEQ ID NO: 2921923 - RNA, 23 nt, Human
cagaaacaucaguuacucugaag

SEQ ID NO: 2921924 - RNA, 21 nt, Human
cagacacuuuuuugaguggau

SEQ ID NO: 2921925 - RNA, 23 nt, Human
caccugagcccggaugcuucucc

SEQ ID NO: 2921926 - RNA, 21 nt, Human
caccugagcccggaugcuucu

SEQ ID NO: 2921927 - RNA, 22 nt, Human
cacugucacuguuucucugcug

SEQ ID NO: 2921928 - RNA, 19 nt, Human
cacugucacuguuucucug

SEQ ID NO: 2921929 - RNA, 18 nt, Human
cacugucacuguuucucu

SEQ ID NO: 2921930 - RNA, 16 nt, Human
cacugucacuguuucu

SEQ ID NO: 2921931 - RNA, 16 nt, Human
cacugugggacucuuc

SEQ ID NO: 2921932 - RNA, 16 nt, Human
agaguggguuucacaa

SEQ ID NO: 2921933 - RNA, 17 nt, Human
agcaaauguuaugcaua

SEQ ID NO: 2921934 - RNA, 22 nt, Human
agaagagaauauuagcuuuacu

SEQ ID NO: 2921935 - RNA, 22 nt, Human
agagaauauuagcuuuacuguu

SEQ ID NO: 2921936 - RNA, 14 nt, Human
agagaagugacagg

SEQ ID NO: 2921937 - RNA, 15 nt, Human
agagaagugacaggg

SEQ ID NO: 2921938 - RNA, 17 nt, Human
agagaagugacagggaa

SEQ ID NO: 2921939 - RNA, 18 nt, Human
agagaagugacagggaag

SEQ ID NO: 2921940 - RNA, 20 nt, Human
agagaagugacagggaagcu

SEQ ID NO: 2921941 - RNA, 14 nt, Human
aggagagccagaga

SEQ ID NO: 2921942 - RNA, 15 nt, Human
aggagagccagagaa

SEQ ID NO: 2921943 - RNA, 21 nt, Human
aggagagccagagaagugaca

SEQ ID NO: 2921944 - RNA, 23 nt, Human
aggagagccagagaagugacagg

SEQ ID NO: 2921945 - RNA, 12 nt, Human
aggagagccaga

SEQ ID NO: 2921946 - RNA, 13 nt, Human
aggcauucucuga

SEQ ID NO: 2921947 - RNA, 13 nt, Human
augaagcuugugu

SEQ ID NO: 2921948 - RNA, 14 nt, Human
augaaagaaaggcc

SEQ ID NO: 2921949 - RNA, 22 nt, Human
auagcaagugaauuuuucucua

SEQ ID NO: 2921950 - RNA, 19 nt, Human
auagcaagugaauuuuucu

SEQ ID NO: 2921951 - RNA, 13 nt, Human
auagcaagugaau

SEQ ID NO: 2921952 - RNA, 20 nt, Human
auccagauacacccaaagua

SEQ ID NO: 2921953 - RNA, 19 nt, Human
aucaugcaaaugcuguauu

SEQ ID NO: 2921954 - RNA, 22 nt, Human
aucaugcaucuuacugaaggua

SEQ ID NO: 2921955 - RNA, 19 nt, Human
aucauggaaugguuauaaa

SEQ ID NO: 2921956 - RNA, 20 nt, Human
aucauggaaugguuauaaaa

SEQ ID NO: 2921957 - RNA, 14 nt, Human
aguaacugacaacu

SEQ ID NO: 2921958 - RNA, 19 nt, Human
auacaccagagauaauaug

SEQ ID NO: 2921959 - RNA, 23 nt, Human
aguuucuguucuguggaaagugu

SEQ ID NO: 2921960 - RNA, 18 nt, Human
aguuucuguucuguggaa

SEQ ID NO: 2921961 - RNA, 19 nt, Human
aguuucuguucuguggaaa

SEQ ID NO: 2921962 - RNA, 21 nt, Human
aguuucuguucuguggaaagu

SEQ ID NO: 2921963 - RNA, 22 nt, Human
aguuucuguucuguggaaagug

SEQ ID NO: 2921964 - RNA, 13 nt, Human
aguuucuguucug

SEQ ID NO: 2921965 - RNA, 15 nt, Human
aguuucuguucugug

SEQ ID NO: 2921966 - RNA, 16 nt, Human
aguuucuguucugugg

SEQ ID NO: 2921967 - RNA, 17 nt, Human
aguuucuguucugugga

SEQ ID NO: 2921968 - RNA, 23 nt, Human
acugacacaaaaaguagauuaag

SEQ ID NO: 2921969 - RNA, 12 nt, Human
acuguuucucug

SEQ ID NO: 2921970 - RNA, 22 nt, Human
acauacaauuauuuuuacaguu

SEQ ID NO: 2921971 - RNA, 20 nt, Human
acauguuuuagacaaauacu

SEQ ID NO: 2921972 - RNA, 17 nt, Human
acauguuuuagacaaau

SEQ ID NO: 2921973 - RNA, 23 nt, Human
acauguuuuagacaaauacucau

SEQ ID NO: 2921974 - RNA, 21 nt, Human
acauguuuuagacaaauacuc

SEQ ID NO: 2921975 - RNA, 22 nt, Human
acauguuuuagacaaauacuca

SEQ ID NO: 2921976 - RNA, 17 nt, Human
acaaccacucauucaaa

SEQ ID NO: 2921977 - RNA, 16 nt, Human
acaacauuaaaacaau

SEQ ID NO: 2921978 - RNA, 13 nt, Human
acaagguucuucc

SEQ ID NO: 2921979 - RNA, 14 nt, Human
aauuuccccaacag

SEQ ID NO: 2921980 - RNA, 15 nt, Human
aauuuccccaacagu

SEQ ID NO: 2921981 - RNA, 17 nt, Human
aauuuccccaacagugu

SEQ ID NO: 2921982 - RNA, 18 nt, Human
aauuuccccaacagugug

SEQ ID NO: 2921983 - RNA, 19 nt, Human
aauuuccccaacaguguga

SEQ ID NO: 2921984 - RNA, 20 nt, Human
aauuuccccaacagugugaa

SEQ ID NO: 2921985 - RNA, 21 nt, Human
aauuuccccaacagugugaag

SEQ ID NO: 2921986 - RNA, 22 nt, Human
aauuuccccaacagugugaagu

SEQ ID NO: 2921987 - RNA, 13 nt, Human
aauuguauaacag

SEQ ID NO: 2921988 - RNA, 14 nt, Human
aauuguauaacagg

SEQ ID NO: 2921989 - RNA, 15 nt, Human
aauuguauaacaggu

SEQ ID NO: 2921990 - RNA, 16 nt, Human
aauuguauaacagguu

SEQ ID NO: 2921991 - RNA, 17 nt, Human
aauuguauaacagguua

SEQ ID NO: 2921992 - RNA, 18 nt, Human
aauuguauaacagguuau

SEQ ID NO: 2921993 - RNA, 19 nt, Human
aauuguauaacagguuauu

SEQ ID NO: 2921994 - RNA, 18 nt, Human
aauucgcugcaaccuguu

SEQ ID NO: 2921995 - RNA, 23 nt, Human
aauuccuucagggugaugccagg

SEQ ID NO: 2921996 - RNA, 16 nt, Human
aauuccuucaggguga

SEQ ID NO: 2921997 - RNA, 15 nt, Human
aauuauagaugggaa

SEQ ID NO: 2921998 - RNA, 19 nt, Human
aauuauagaugggaaugaa

SEQ ID NO: 2921999 - RNA, 22 nt, Human
aauuauaucaguccucuuucaa

SEQ ID NO: 2922000 - RNA, 13 nt, Human
aauucuguuucuu

SEQ ID NO: 2922001 - RNA, 12 nt, Human
aauucuguuucu

SEQ ID NO: 2922002 - RNA, 16 nt, Human
aauucuguuucuugag

SEQ ID NO: 2922003 - RNA, 21 nt, Human
aagacaacauuaaaacaauau

SEQ ID NO: 2922004 - RNA, 15 nt, Human
aagacaacauuaaaa

SEQ ID NO: 2922005 - RNA, 13 nt, Human
aagaagacauguu

SEQ ID NO: 2922006 - RNA, 12 nt, Human
aagacaacauua

SEQ ID NO: 2922007 - RNA, 14 nt, Human
aagaagacauguuu

SEQ ID NO: 2922008 - RNA, 15 nt, Human
aagaagacauguuuu

SEQ ID NO: 2922009 - RNA, 17 nt, Human
aagaagacauguuuuag

SEQ ID NO: 2922010 - RNA, 17 nt, Human
aaguugaaauuaaccau

SEQ ID NO: 2922011 - RNA, 13 nt, Human
aaucaauaaacga

SEQ ID NO: 2922012 - RNA, 16 nt, Human
aaucaauaaacgauuu

SEQ ID NO: 2922013 - RNA, 17 nt, Human
aaucugaggccuccucu

SEQ ID NO: 2922014 - RNA, 12 nt, Human
aaugaagcuugu

SEQ ID NO: 2922015 - RNA, 14 nt, Human
aaugaagcuugugu

SEQ ID NO: 2922016 - RNA, 15 nt, Human
aaugaagcuugugua

SEQ ID NO: 2922017 - RNA, 16 nt, Human
aaugaagcuuguguau

SEQ ID NO: 2922018 - RNA, 22 nt, Human
aaugaagcuuguguauccauua

SEQ ID NO: 2922019 - RNA, 17 nt, Human
aaugaagcuuguguauc

SEQ ID NO: 2922020 - RNA, 19 nt, Human
aaugaagcuuguguaucca

SEQ ID NO: 2922021 - RNA, 13 nt, Human
aaauucuguuucu

SEQ ID NO: 2922022 - RNA, 15 nt, Human
aaauucuguuucuug

SEQ ID NO: 2922023 - RNA, 14 nt, Human
aaauucuguuucuu

SEQ ID NO: 2922024 - RNA, 18 nt, Human
aaagcauuccaacaaagg

SEQ ID NO: 2922025 - RNA, 21 nt, Human
gggcaaaaaacucgaggacug

SEQ ID NO: 2922026 - RNA, 18 nt, Human
aaagcuaaaguaucugua

SEQ ID NO: 2922027 - RNA, 13 nt, Human
ggugaugccaggu

SEQ ID NO: 2922028 - RNA, 22 nt, Human
aaacucauuuccuauguaacug

SEQ ID NO: 2922029 - RNA, 16 nt, Human
ggcccagcgaccucgg

SEQ ID NO: 2922030 - RNA, 12 nt, Human
ggcauucucuga

SEQ ID NO: 2922031 - RNA, 13 nt, Human
ggagagccagaga

SEQ ID NO: 2922032 - RNA, 14 nt, Human
ggagagccagagaa

SEQ ID NO: 2922033 - RNA, 15 nt, Human
ggagagccagagaag

SEQ ID NO: 2922034 - RNA, 16 nt, Human
ggagagccagagaagu

SEQ ID NO: 2922035 - RNA, 21 nt, Human
ggagagccagagaagugacag

SEQ ID NO: 2922036 - RNA, 13 nt, Human
gcuuggguggaga

SEQ ID NO: 2922037 - RNA, 14 nt, Human
gcuuggguggagaa

SEQ ID NO: 2922038 - RNA, 20 nt, Human
gcuuggguggagaagccauu

SEQ ID NO: 2922039 - RNA, 21 nt, Human
gcuuggguggagaagccauug

SEQ ID NO: 2922040 - RNA, 16 nt, Human
gcuuggguggagaagc

SEQ ID NO: 2922041 - RNA, 17 nt, Human
gcuuggguggagaagcc

SEQ ID NO: 2922042 - RNA, 18 nt, Human
gcuuggguggagaagcca

SEQ ID NO: 2922043 - RNA, 19 nt, Human
gcuuggguggagaagccau

SEQ ID NO: 2922044 - RNA, 19 nt, Human
gcuucgaggcccagcgacc

SEQ ID NO: 2922045 - RNA, 21 nt, Human
gcuucgaggcccagcgaccuc

SEQ ID NO: 2922046 - RNA, 18 nt, Human
gcuguaucuuguuuuucc

SEQ ID NO: 2922047 - RNA, 16 nt, Human
gcuguaucuuguuuuu

SEQ ID NO: 2922048 - RNA, 14 nt, Human
gcuguaucuuguuu

SEQ ID NO: 2922049 - RNA, 18 nt, Human
gaguggaugauguuucgu

SEQ ID NO: 2922050 - RNA, 17 nt, Human
gcaauauaucuaaauug

SEQ ID NO: 2922051 - RNA, 23 nt, Human
gcaauauaucuaaauugaauaau

SEQ ID NO: 2922052 - RNA, 16 nt, Human
gcacagugguggcagg

SEQ ID NO: 2922053 - RNA, 22 nt, Human
gcacagugguggcagggccuag

SEQ ID NO: 2922054 - RNA, 17 nt, Human
gcacagugguggcaggg

SEQ ID NO: 2922055 - RNA, 18 nt, Human
gcacagugguggcagggc

SEQ ID NO: 2922056 - RNA, 17 nt, Human
gcacauccuaugcaaua

SEQ ID NO: 2922057 - RNA, 20 nt, Human
gcacauccuaugcaauauau

SEQ ID NO: 2922058 - RNA, 20 nt, Human
gaaguucaccauuaaaaggg

SEQ ID NO: 2922059 - RNA, 22 nt, Human
gaaguucaccauuaaaagggau

SEQ ID NO: 2922060 - RNA, 15 nt, Human
gaaguucaccauuaa

SEQ ID NO: 2922061 - RNA, 19 nt, Human
gaaguucaccauuaaaagg

SEQ ID NO: 2922062 - RNA, 13 nt, Human
gaaguuagaauuc

SEQ ID NO: 2922063 - RNA, 14 nt, Human
gaaguuagaauucc

SEQ ID NO: 2922064 - RNA, 20 nt, Human
gaaguuagaauuccuucagg

SEQ ID NO: 2922065 - RNA, 21 nt, Human
gaaguuagaauuccuucaggg

SEQ ID NO: 2922066 - RNA, 21 nt, Human
gaauauuagcuuuacuguuug

SEQ ID NO: 2922067 - RNA, 12 nt, Human
gaauauuagcuu

SEQ ID NO: 2922068 - RNA, 22 nt, Human
gaccugaaguucaccauuaaaa

SEQ ID NO: 2922069 - RNA, 13 nt, Human
gaccugaaguuca

SEQ ID NO: 2922070 - RNA, 15 nt, Human
gacuguauuugugac

SEQ ID NO: 2922071 - RNA, 14 nt, Human
gacuguauuuguga

SEQ ID NO: 2922072 - RNA, 17 nt, Human
cuuugguggagauaaag

SEQ ID NO: 2922073 - RNA, 21 nt, Human
cuuagcaggagaggagagcca

SEQ ID NO: 2922074 - RNA, 22 nt, Human
cuuagcaggagaggagagccag

SEQ ID NO: 2922075 - RNA, 13 nt, Human
cuuagcaggagag

SEQ ID NO: 2922076 - RNA, 14 nt, Human
cuuagcaggagagg

SEQ ID NO: 2922077 - RNA, 15 nt, Human
cugcaaccuguugau

SEQ ID NO: 2922078 - RNA, 14 nt, Human
ccagagaagugaca

SEQ ID NO: 2922079 - RNA, 15 nt, Human
ccagagaagugacag

SEQ ID NO: 2922080 - RNA, 16 nt, Human
ccagagaagugacagg

SEQ ID NO: 2922081 - RNA, 22 nt, Human
ccagagaagugacagggaagcu

SEQ ID NO: 2922082 - RNA, 17 nt, Human
ccagagaagugacaggg

SEQ ID NO: 2922083 - RNA, 18 nt, Human
ccagagaagugacaggga

SEQ ID NO: 2922084 - RNA, 19 nt, Human
ccagagaagugacagggaa

SEQ ID NO: 2922085 - RNA, 20 nt, Human
ccagagaagugacagggaag

SEQ ID NO: 2922086 - RNA, 22 nt, Human
ccagauaaaauuauagauggga

SEQ ID NO: 2922087 - RNA, 19 nt, Human
ccagauaaaauuauagaug

SEQ ID NO: 2922088 - RNA, 21 nt, Human
ccagauacacccaaaguauca

SEQ ID NO: 2922089 - RNA, 12 nt, Human
cccaacuguuau

SEQ ID NO: 2922090 - RNA, 10 nt, Human
ccauugucuu

SEQ ID NO: 2922091 - RNA, 18 nt, Human
ccuagcugcuacaaagaa

SEQ ID NO: 2922092 - RNA, 14 nt, Human
ccuagcugcuacaa

SEQ ID NO: 2922093 - RNA, 15 nt, Human
ccuagcugcuacaaa

SEQ ID NO: 2922094 - RNA, 17 nt, Human
ccuagcugcuacaaaga

SEQ ID NO: 2922095 - RNA, 17 nt, Human
cuccuguacuuuuucca

SEQ ID NO: 2922096 - RNA, 14 nt, Human
ccuucucuuaauuu

SEQ ID NO: 2922097 - RNA, 13 nt, Human
cuaaguuucaguu

SEQ ID NO: 2922098 - RNA, 19 nt, Human
cuaaguuucaguugauuuu

SEQ ID NO: 2922099 - RNA, 13 nt, Human
cgcugaauaaaug

SEQ ID NO: 2922100 - RNA, 14 nt, Human
cgcugaauaaaugu

SEQ ID NO: 2922101 - RNA, 15 nt, Human
cgcugaauaaauguc

SEQ ID NO: 2922102 - RNA, 12 nt, Human
auucauguuucu

SEQ ID NO: 2922103 - RNA, 15 nt, Human
auucauguuucuuaa

SEQ ID NO: 2922104 - RNA, 13 nt, Human
auucauguuucuu

SEQ ID NO: 2922105 - RNA, 17 nt, Human
auuuaauucauguuucu

SEQ ID NO: 2922106 - RNA, 15 nt, Human
auuuaauucauguuu

SEQ ID NO: 2922107 - RNA, 13 nt, Human
auuuaauucucuu

SEQ ID NO: 2922108 - RNA, 16 nt, Human
auuuaauucucuugaa

SEQ ID NO: 2922109 - RNA, 19 nt, Human
auuuauauacaaccugcuu

SEQ ID NO: 2922110 - RNA, 15 nt, Human
auuuaauucucuuga

SEQ ID NO: 2922111 - RNA, 23 nt, Human
auuucacaguguguuugugauug

SEQ ID NO: 2922112 - RNA, 14 nt, Human
auuuuaguuucugu

SEQ ID NO: 2922113 - RNA, 15 nt, Human
auuuuaguuucuguu

SEQ ID NO: 2922114 - RNA, 16 nt, Human
auuuuaguuucuguuc

SEQ ID NO: 2922115 - RNA, 18 nt, Human
auuuuaguuucuguucug

SEQ ID NO: 2922116 - RNA, 19 nt, Human
auuuuaguuucuguucugu

SEQ ID NO: 2922117 - RNA, 21 nt, Human
auuuuaguuucuguucugugg

SEQ ID NO: 2922118 - RNA, 23 nt, Human
auuuuaguuucuguucuguggaa

SEQ ID NO: 2922119 - RNA, 21 nt, Human
cacuacugcuaccacaacuau

SEQ ID NO: 2922120 - RNA, 16 nt, Human
caagcacagugguggc

SEQ ID NO: 2922121 - RNA, 19 nt, Human
caagcacagugguggcagg

SEQ ID NO: 2922122 - RNA, 20 nt, Human
caagcacagugguggcaggg

SEQ ID NO: 2922123 - RNA, 21 nt, Human
caagcacagugguggcagggc

SEQ ID NO: 2922124 - RNA, 13 nt, Human
caagcacaguggu

SEQ ID NO: 2922125 - RNA, 15 nt, Human
caagcacaguggugg

SEQ ID NO: 2922126 - RNA, 14 nt, Human
caagcaaaaucaug

SEQ ID NO: 2922127 - RNA, 22 nt, Human
caagcaaaaucauggaaugguu

SEQ ID NO: 2922128 - RNA, 23 nt, Human
caagcaaaaucauggaaugguua

SEQ ID NO: 2922129 - RNA, 19 nt, Human
caacuauauuaucaugcaa

SEQ ID NO: 2922130 - RNA, 18 nt, Human
caacuauauuaucaugca

SEQ ID NO: 2922131 - RNA, 14 nt, Human
caauauuguuucua

SEQ ID NO: 2922132 - RNA, 20 nt, Human
cagacugacaaauguguauc

SEQ ID NO: 2922133 - RNA, 16 nt, Human
caguuacucugaaggg

SEQ ID NO: 2922134 - RNA, 15 nt, Human
caguuacucugaagg

SEQ ID NO: 2922135 - RNA, 13 nt, Human
caguuacucugaa

SEQ ID NO: 2922136 - RNA, 13 nt, Human
caguuuuccauug

SEQ ID NO: 2922137 - RNA, 21 nt, Human
caugaauuuuuuucaucuucu

SEQ ID NO: 2922138 - RNA, 22 nt, Human
caugcaaaugcuguauucuucu

SEQ ID NO: 2922139 - RNA, 16 nt, Human
caugcaaaugcuguau

SEQ ID NO: 2922140 - RNA, 14 nt, Human
caugcaaaugcugu

SEQ ID NO: 2922141 - RNA, 16 nt, Human
cauucucucuccugua

SEQ ID NO: 2922142 - RNA, 13 nt, Human
cauucucugaaga

SEQ ID NO: 2922143 - RNA, 12 nt, Human
cauucucugaag

SEQ ID NO: 2922144 - RNA, 22 nt, Human
cauuaucauguguaaucaauaa

SEQ ID NO: 2922145 - RNA, 16 nt, Human
cauuaucauguguaau

SEQ ID NO: 2922146 - RNA, 18 nt, Human
cauuaucauguguaauca

SEQ ID NO: 2922147 - RNA, 12 nt, Human
cauuaucaugug

SEQ ID NO: 2922148 - RNA, 13 nt, Human
cauuaucaugugu

SEQ ID NO: 2922149 - RNA, 14 nt, Human
cauuaucaugugua

SEQ ID NO: 2922150 - RNA, 15 nt, Human
cauuaucauguguaa

SEQ ID NO: 2922151 - RNA, 20 nt, Human
auuuccuauguaacugcauu

SEQ ID NO: 2922152 - RNA, 17 nt, Human
auuuccauuauuuauau

SEQ ID NO: 2922153 - RNA, 15 nt, Human
auuuccauuauuuau

SEQ ID NO: 2922154 - RNA, 21 nt, Human
auuucuugaguuuuguuuuaa

SEQ ID NO: 2922155 - RNA, 22 nt, Human
auugaauaaugguaccagauaa

SEQ ID NO: 2922156 - RNA, 14 nt, Human
auugaauaauggua

SEQ ID NO: 2922157 - RNA, 23 nt, Human
auugcauuaaauauaauaugcac

SEQ ID NO: 2922158 - RNA, 19 nt, Human
auuggcuauuuaaagacaa

SEQ ID NO: 2922159 - RNA, 21 nt, Human
auuaaaacaauauuguuucua

SEQ ID NO: 2922160 - RNA, 20 nt, Human
auuaaaacaauauuguuucu

SEQ ID NO: 2922161 - RNA, 18 nt, Human
auuaaaacaauauuguuu

SEQ ID NO: 2922162 - RNA, 14 nt, Human
auuaaaacaauauu

SEQ ID NO: 2922163 - RNA, 15 nt, Human
uuuuccacuacugcu

SEQ ID NO: 2922164 - RNA, 13 nt, Human
uuuuccacuacug

SEQ ID NO: 2922165 - RNA, 23 nt, Human
uuuuagacaaauacucaugugua

SEQ ID NO: 2922166 - RNA, 21 nt, Human
uuuuagacaaauacucaugug

SEQ ID NO: 2922167 - RNA, 22 nt, Human
uuuuagacaaauacucaugugu

SEQ ID NO: 2922168 - RNA, 18 nt, Human
auguuaugcauaaaguca

SEQ ID NO: 2922169 - RNA, 17 nt, Human
auguuaugcauaaaguc

SEQ ID NO: 2922170 - RNA, 18 nt, Human
uuuuagacaaauacucau

SEQ ID NO: 2922171 - RNA, 20 nt, Human
uuuuagacaaauacucaugu

SEQ ID NO: 2922172 - RNA, 20 nt, Human
augugcuguguaaaguuagu

SEQ ID NO: 2922173 - RNA, 11 nt, Human
augugcugugu

SEQ ID NO: 2922174 - RNA, 13 nt, Human
augugcuguguaa

SEQ ID NO: 2922175 - RNA, 14 nt, Human
augugcuguguaaa

SEQ ID NO: 2922176 - RNA, 15 nt, Human
augugcuguguaaag

SEQ ID NO: 2922177 - RNA, 16 nt, Human
augugcuguguaaagu

SEQ ID NO: 2922178 - RNA, 17 nt, Human
augugcuguguaaaguu

SEQ ID NO: 2922179 - RNA, 18 nt, Human
augugcuguguaaaguua

SEQ ID NO: 2922180 - RNA, 19 nt, Human
augugcuguguaaaguuag

SEQ ID NO: 2922181 - RNA, 15 nt, Human
uuuguuuuaaaauua

SEQ ID NO: 2922182 - RNA, 15 nt, Human
uuugauucugugugu

SEQ ID NO: 2922183 - RNA, 19 nt, Human
uuuuugcaccccaugcugu

SEQ ID NO: 2922184 - RNA, 20 nt, Human
uuuuugcaccccaugcuguu

SEQ ID NO: 2922185 - RNA, 22 nt, Human
uuuuugcaccccaugcuguuga

SEQ ID NO: 2922186 - RNA, 23 nt, Human
uuuuugcaccccaugcuguugau

SEQ ID NO: 2922187 - RNA, 21 nt, Human
uuuuuaaugugcuguguaaag

SEQ ID NO: 2922188 - RNA, 20 nt, Human
uuuuuaaugugcuguguaaa

SEQ ID NO: 2922189 - RNA, 16 nt, Human
uuuuguuuuaaaauua

SEQ ID NO: 2922190 - RNA, 23 nt, Human
uuguguauccauuaucaugugua

SEQ ID NO: 2922191 - RNA, 21 nt, Human
uuguguauccauuaucaugug

SEQ ID NO: 2922192 - RNA, 22 nt, Human
uuguguauccauuaucaugugu

SEQ ID NO: 2922193 - RNA, 20 nt, Human
uuguguauccauuaucaugu

SEQ ID NO: 2922194 - RNA, 16 nt, Human
uugugaccugaaguuc

SEQ ID NO: 2922195 - RNA, 13 nt, Human
uuuccauuauuua

SEQ ID NO: 2922196 - RNA, 21 nt, Human
uuuccauuauuuauauuaguu

SEQ ID NO: 2922197 - RNA, 21 nt, Human
uuuccauugguuuaccuguga

SEQ ID NO: 2922198 - RNA, 16 nt, Human
auggaaugguuauaaa

SEQ ID NO: 2922199 - RNA, 18 nt, Human
auggaaugguuauaaaag

SEQ ID NO: 2922200 - RNA, 20 nt, Human
auggaaugguuauaaaagug

SEQ ID NO: 2922201 - RNA, 19 nt, Human
auggaaugguuauaaaagu

SEQ ID NO: 2922202 - RNA, 23 nt, Human
augcuguugauugcuaaauguaa

SEQ ID NO: 2922203 - RNA, 21 nt, Human
augcuguugauugcuaaaugu

SEQ ID NO: 2922204 - RNA, 22 nt, Human
augcuguugauugcuaaaugua

SEQ ID NO: 2922205 - RNA, 16 nt, Human
augcuguugauugcua

SEQ ID NO: 2922206 - RNA, 17 nt, Human
augcuguugauugcuaa

SEQ ID NO: 2922207 - RNA, 18 nt, Human
augcuguugauugcuaaa

SEQ ID NO: 2922208 - RNA, 19 nt, Human
augcuguugauugcuaaau

SEQ ID NO: 2922209 - RNA, 11 nt, Human
augcuguugau

SEQ ID NO: 2922210 - RNA, 12 nt, Human
augcuguugauu

SEQ ID NO: 2922211 - RNA, 15 nt, Human
augcuguugauugcu

SEQ ID NO: 2922212 - RNA, 18 nt, Human
augccagguucuauuugg

SEQ ID NO: 2922213 - RNA, 19 nt, Human
augccagguucuauuugga

SEQ ID NO: 2922214 - RNA, 20 nt, Human
augccagguucuauuuggaa

SEQ ID NO: 2922215 - RNA, 21 nt, Human
augccagguucuauuuggaau

SEQ ID NO: 2922216 - RNA, 14 nt, Human
uuuacuguuuguua

SEQ ID NO: 2922217 - RNA, 19 nt, Human
uugcaccccaugcuguuga

SEQ ID NO: 2922218 - RNA, 19 nt, Human
uugaguggaugauguuucg

SEQ ID NO: 2922219 - RNA, 17 nt, Human
uugaguggaugauguuu

SEQ ID NO: 2922220 - RNA, 18 nt, Human
aucuagcaaauguuaugc

SEQ ID NO: 2922221 - RNA, 14 nt, Human
aucuagcaaauguu

SEQ ID NO: 2922222 - RNA, 23 nt, Human
aucuuguuuuuccacuacugcua

SEQ ID NO: 2922223 - RNA, 15 nt, Human
aucuuguuuuuccac

SEQ ID NO: 2922224 - RNA, 12 nt, Human
aucuugguaaau

SEQ ID NO: 2922225 - RNA, 14 nt, Human
uuggguggagaagc

SEQ ID NO: 2922226 - RNA, 15 nt, Human
uuggguggagaagcc

SEQ ID NO: 2922227 - RNA, 16 nt, Human
uuggguggagaagcca

SEQ ID NO: 2922228 - RNA, 17 nt, Human
uuggguggagaagccau

SEQ ID NO: 2922229 - RNA, 18 nt, Human
uuggguggagaagccauu

SEQ ID NO: 2922230 - RNA, 19 nt, Human
uuggguggagaagccauug

SEQ ID NO: 2922231 - RNA, 13 nt, Human
auaucuaaauuga

SEQ ID NO: 2922232 - RNA, 14 nt, Human
auaucuaaauugaa

SEQ ID NO: 2922233 - RNA, 22 nt, Human
auaucuaaauugaauaauggua

SEQ ID NO: 2922234 - RNA, 17 nt, Human
auaucuaaauugaauaa

SEQ ID NO: 2922235 - RNA, 18 nt, Human
auaucuaaauugaauaau

SEQ ID NO: 2922236 - RNA, 19 nt, Human
auaugcacacagugcuuuc

SEQ ID NO: 2922237 - RNA, 18 nt, Human
uucacauccuguguuucu

SEQ ID NO: 2922238 - RNA, 17 nt, Human
uuauuuagggaacugcu

SEQ ID NO: 2922239 - RNA, 21 nt, Human
uuauuuagggaacugcuugac

SEQ ID NO: 2922240 - RNA, 18 nt, Human
uuauuuagggaacugcuu

SEQ ID NO: 2922241 - RNA, 21 nt, Human
aucaguccucuuucaaaggua

SEQ ID NO: 2922242 - RNA, 19 nt, Human
aucagugguuauuuaggga

SEQ ID NO: 2922243 - RNA, 22 nt, Human
aucagaucauuucaaaacucau

SEQ ID NO: 2922244 - RNA, 18 nt, Human
aucagaucauuucaaaac

SEQ ID NO: 2922245 - RNA, 15 nt, Human
uucuagggaaaugaa

SEQ ID NO: 2922246 - RNA, 18 nt, Human
auccauuaucauguguaa

SEQ ID NO: 2922247 - RNA, 16 nt, Human
auccauuaucaugugu

SEQ ID NO: 2922248 - RNA, 17 nt, Human
auccauuaucaugugua

SEQ ID NO: 2922249 - RNA, 14 nt, Human
auccauuaucaugu

SEQ ID NO: 2922250 - RNA, 15 nt, Human
auccauuaucaugug

SEQ ID NO: 2922251 - RNA, 15 nt, Human
uucucuuaauuuaau

SEQ ID NO: 2922252 - RNA, 13 nt, Human
uucauguuucuua

SEQ ID NO: 2922253 - RNA, 12 nt, Human
uucauguuucuu

SEQ ID NO: 2922254 - RNA, 14 nt, Human
uuccuucaggguga

SEQ ID NO: 2922255 - RNA, 15 nt, Human
uuccuucagggugau

SEQ ID NO: 2922256 - RNA, 22 nt, Human
uuccuucagggugaugccaggu

SEQ ID NO: 2922257 - RNA, 13 nt, Human
aguguaaagcauu

SEQ ID NO: 2922258 - RNA, 14 nt, Human
aguguaaagcauuc

SEQ ID NO: 2922259 - RNA, 16 nt, Human
aguguaaagcauucca

SEQ ID NO: 2922260 - RNA, 17 nt, Human
aguguaaagcauuccaa

SEQ ID NO: 2922261 - RNA, 18 nt, Human
aguguaaagcauuccaac

SEQ ID NO: 2922262 - RNA, 20 nt, Human
aguguaaagcauuccaacaa

SEQ ID NO: 2922263 - RNA, 22 nt, Human
aguguaaagcauuccaacaaag

SEQ ID NO: 2922264 - RNA, 16 nt, Human
agugguggcagggccu

SEQ ID NO: 2922265 - RNA, 18 nt, Human
agugguggcagggccuag

SEQ ID NO: 2922266 - RNA, 11 nt, Human
agugguggcag

SEQ ID NO: 2922267 - RNA, 13 nt, Human
agugguggcaggg

SEQ ID NO: 2922268 - RNA, 14 nt, Human
agugguggcagggc

SEQ ID NO: 2922269 - RNA, 15 nt, Human
agugguggcagggcc

SEQ ID NO: 2922270 - RNA, 16 nt, Human
uguugauugcuaaaug

SEQ ID NO: 2922271 - RNA, 17 nt, Human
uguugauugcuaaaugu

SEQ ID NO: 2922272 - RNA, 15 nt, Human
uguugauugcuaaau

SEQ ID NO: 2922273 - RNA, 18 nt, Human
uguugauugcuaaaugua

SEQ ID NO: 2922274 - RNA, 19 nt, Human
uguugauugcuaaauguaa

SEQ ID NO: 2922275 - RNA, 13 nt, Human
uguucuguggaaa

SEQ ID NO: 2922276 - RNA, 17 nt, Human
uguucuguggaaagugu

SEQ ID NO: 2922277 - RNA, 18 nt, Human
uguucuguggaaagugua

SEQ ID NO: 2922278 - RNA, 19 nt, Human
uguucuguggaaaguguaa

SEQ ID NO: 2922279 - RNA, 20 nt, Human
uguucuguggaaaguguaaa

SEQ ID NO: 2922280 - RNA, 21 nt, Human
uguucuguggaaaguguaaag

SEQ ID NO: 2922281 - RNA, 22 nt, Human
uguucuguggaaaguguaaagc

SEQ ID NO: 2922282 - RNA, 18 nt, Human
uguuauagguuguuggau

SEQ ID NO: 2922283 - RNA, 21 nt, Human
ugugaaauaguucaaagccaa

SEQ ID NO: 2922284 - RNA, 15 nt, Human
ugugacuaauuguau

SEQ ID NO: 2922285 - RNA, 17 nt, Human
ugugacuaauuguauaa

SEQ ID NO: 2922286 - RNA, 18 nt, Human
ugugacuaauuguauaac

SEQ ID NO: 2922287 - RNA, 19 nt, Human
ugugacuaauuguauaaca

SEQ ID NO: 2922288 - RNA, 22 nt, Human
ugugacuaauuguauaacaggu

SEQ ID NO: 2922289 - RNA, 23 nt, Human
ugugacuaauuguauaacagguu

SEQ ID NO: 2922290 - RNA, 14 nt, Human
ugugaccugaaguu

SEQ ID NO: 2922291 - RNA, 15 nt, Human
ugugaccugaaguuc

SEQ ID NO: 2922292 - RNA, 16 nt, Human
ugugaccugaaguuca

SEQ ID NO: 2922293 - RNA, 14 nt, Human
uuaauucucuugaa

SEQ ID NO: 2922294 - RNA, 15 nt, Human
uuaauucauguuucu

SEQ ID NO: 2922295 - RNA, 14 nt, Human
uuaauucauguuuc

SEQ ID NO: 2922296 - RNA, 14 nt, Human
auaaaauuauagau

SEQ ID NO: 2922297 - RNA, 13 nt, Human
auaaaauuauaga

SEQ ID NO: 2922298 - RNA, 23 nt, Human
auaaaauuauagaugggaaugaa

SEQ ID NO: 2922299 - RNA, 20 nt, Human
auaaaauuauagaugggaau

SEQ ID NO: 2922300 - RNA, 21 nt, Human
auaaaauuauagaugggaaug

SEQ ID NO: 2922301 - RNA, 21 nt, Human
auaaaagugauuguuggcaca

SEQ ID NO: 2922302 - RNA, 14 nt, Human
auaaaagugauugu

SEQ ID NO: 2922303 - RNA, 18 nt, Human
auaaaagugauuguuggc

SEQ ID NO: 2922304 - RNA, 23 nt, Human
uuagacaaauacucauguguaug

SEQ ID NO: 2922305 - RNA, 15 nt, Human
uuagacaaauacuca

SEQ ID NO: 2922306 - RNA, 18 nt, Human
uuagacaaauacucaugu

SEQ ID NO: 2922307 - RNA, 19 nt, Human
uuagacaaauacucaugug

SEQ ID NO: 2922308 - RNA, 20 nt, Human
uuagacaaauacucaugugu

SEQ ID NO: 2922309 - RNA, 21 nt, Human
uuagacaaauacucaugugua

SEQ ID NO: 2922310 - RNA, 22 nt, Human
uuagacaaauacucauguguau

SEQ ID NO: 2922311 - RNA, 14 nt, Human
uuacauacugcugu

SEQ ID NO: 2922312 - RNA, 13 nt, Human
uuaccugugaaau

SEQ ID NO: 2922313 - RNA, 15 nt, Human
uuaaauuuuaauuua

SEQ ID NO: 2922314 - RNA, 15 nt, Human
uguuuucauaauaaa

SEQ ID NO: 2922315 - RNA, 14 nt, Human
ugguaccagauaaa

SEQ ID NO: 2922316 - RNA, 15 nt, Human
ugguaccagauaaaa

SEQ ID NO: 2922317 - RNA, 18 nt, Human
ugguaccagauaaaauua

SEQ ID NO: 2922318 - RNA, 23 nt, Human
ugguaaauuuccccaacagugug

SEQ ID NO: 2922319 - RNA, 20 nt, Human
ugguaaauuuccccaacagu

SEQ ID NO: 2922320 - RNA, 22 nt, Human
ugguaaauuuccccaacagugu

SEQ ID NO: 2922321 - RNA, 16 nt, Human
ugguaaauuuccccaa

SEQ ID NO: 2922322 - RNA, 19 nt, Human
ugguaaauuuccccaacag

SEQ ID NO: 2922323 - RNA, 22 nt, Human
ugggagaauucuuacauguuuu

SEQ ID NO: 2922324 - RNA, 21 nt, Human
ugggagaauucuuacauguuu

SEQ ID NO: 2922325 - RNA, 21 nt, Human
agggaagcuacagguuacaac

SEQ ID NO: 2922326 - RNA, 13 nt, Human
agggaagcuacag

SEQ ID NO: 2922327 - RNA, 16 nt, Human
agggaagcuacagguu

SEQ ID NO: 2922328 - RNA, 19 nt, Human
agggaagcuacagguuaca

SEQ ID NO: 2922329 - RNA, 15 nt, Human
agguucuauuuggaa

SEQ ID NO: 2922330 - RNA, 17 nt, Human
agguucuauuuggaauu

SEQ ID NO: 2922331 - RNA, 20 nt, Human
ugguuauaaaagugauuguu

SEQ ID NO: 2922332 - RNA, 16 nt, Human
ugguuauaaaagugau

SEQ ID NO: 2922333 - RNA, 15 nt, Human
ugguuauaaaaguga

SEQ ID NO: 2922334 - RNA, 12 nt, Human
uguaaaguuagu

SEQ ID NO: 2922335 - RNA, 14 nt, Human
uguaaaguuagucu

SEQ ID NO: 2922336 - RNA, 17 nt, Human
uguaaaguuagucuacu

SEQ ID NO: 2922337 - RNA, 20 nt, Human
agcuuguguauccauuauca

SEQ ID NO: 2922338 - RNA, 12 nt, Human
agcuuguguauc

SEQ ID NO: 2922339 - RNA, 21 nt, Human
aggaaacaaagcuuagcagga

SEQ ID NO: 2922340 - RNA, 23 nt, Human
uggcacauccuaugcaauauauc

SEQ ID NO: 2922341 - RNA, 18 nt, Human
uggcacauccuaugcaau

SEQ ID NO: 2922342 - RNA, 19 nt, Human
uggcacauccuaugcaaua

SEQ ID NO: 2922343 - RNA, 15 nt, Human
uggcacauccuaugc

SEQ ID NO: 2922344 - RNA, 21 nt, Human
uggaaaguguaaagcauucca

SEQ ID NO: 2922345 - RNA, 17 nt, Human
uggaaaguguaaagcau

SEQ ID NO: 2922346 - RNA, 18 nt, Human
uggaaaguguaaagcauu

SEQ ID NO: 2922347 - RNA, 13 nt, Human
uggaaaguguaaa

SEQ ID NO: 2922348 - RNA, 14 nt, Human
uggaaaguguaaag

SEQ ID NO: 2922349 - RNA, 15 nt, Human
uggaaaguguaaagc

SEQ ID NO: 2922350 - RNA, 16 nt, Human
uggaaaguguaaagca

SEQ ID NO: 2922351 - RNA, 17 nt, Human
aggacuguauuugugac

SEQ ID NO: 2922352 - RNA, 15 nt, Human
aggacuguauuugug

SEQ ID NO: 2922353 - RNA, 16 nt, Human
aggacuguauuuguga

SEQ ID NO: 2922354 - RNA, 16 nt, Human
ugcaccccaugcuguu

SEQ ID NO: 2922355 - RNA, 14 nt, Human
ugcaccccaugcug

SEQ ID NO: 2922356 - RNA, 15 nt, Human
ugcaaaugcuguauu

SEQ ID NO: 2922357 - RNA, 21 nt, Human
ugcaauauaucuaaauugaau

SEQ ID NO: 2922358 - RNA, 22 nt, Human
ugcaauauaucuaaauugaaua

SEQ ID NO: 2922359 - RNA, 23 nt, Human
ugcaauauaucuaaauugaauaa

SEQ ID NO: 2922360 - RNA, 22 nt, Human
ugcaucuuacugaagguaaaau

SEQ ID NO: 2922361 - RNA, 18 nt, Human
ugcaucuuacugaaggua

SEQ ID NO: 2922362 - RNA, 17 nt, Human
ugcaucuuacugaaggu

SEQ ID NO: 2922363 - RNA, 14 nt, Human
ugcaucuuacugaa

SEQ ID NO: 2922364 - RNA, 23 nt, Human
agccuugggaacaugcgugugac

SEQ ID NO: 2922365 - RNA, 18 nt, Human
ugaguggaugauguuucg

SEQ ID NO: 2922366 - RNA, 17 nt, Human
agcaguaacugacaacu

SEQ ID NO: 2922367 - RNA, 23 nt, Human
agcaggagaggagagccagagaa

SEQ ID NO: 2922368 - RNA, 19 nt, Human
agcaggagaggagagccag

SEQ ID NO: 2922369 - RNA, 20 nt, Human
agcaggagaggagagccaga

SEQ ID NO: 2922370 - RNA, 21 nt, Human
agcaggagaggagagccagag

SEQ ID NO: 2922371 - RNA, 22 nt, Human
agcaggagaggagagccagaga

SEQ ID NO: 2922372 - RNA, 14 nt, Human
agcaggagaggaga

SEQ ID NO: 2922373 - RNA, 16 nt, Human
agcaggagaggagagc

SEQ ID NO: 2922374 - RNA, 17 nt, Human
agcaggagaggagagcc

SEQ ID NO: 2922375 - RNA, 21 nt, Human
agccacacugugggacucuuc

SEQ ID NO: 2922376 - RNA, 13 nt, Human
agcauuccaacaa

SEQ ID NO: 2922377 - RNA, 14 nt, Human
agcauuccaacaaa

SEQ ID NO: 2922378 - RNA, 15 nt, Human
agcauuccaacaaag

SEQ ID NO: 2922379 - RNA, 17 nt, Human
agcauuccaacaaaggg

SEQ ID NO: 2922380 - RNA, 19 nt, Human
agcauuccaacaaaggguu

SEQ ID NO: 2922381 - RNA, 10 nt, Human
agagccagag

SEQ ID NO: 2922382 - RNA, 13 nt, Human
agagccagagaag

SEQ ID NO: 2922383 - RNA, 15 nt, Human
agagccagagaagug

SEQ ID NO: 2922384 - RNA, 16 nt, Human
agagccagagaaguga

SEQ ID NO: 2922385 - RNA, 17 nt, Human
agagccagagaagugac

SEQ ID NO: 2922386 - RNA, 19 nt, Human
ugaaauaguucaaagccaa

SEQ ID NO: 2922387 - RNA, 23 nt, Human
ugacagggaagcuacagguuaca

SEQ ID NO: 2922388 - RNA, 12 nt, Human
ugacagggaagc

SEQ ID NO: 2922389 - RNA, 13 nt, Human
ugacagggaagcu

SEQ ID NO: 2922390 - RNA, 14 nt, Human
ugacagggaagcua

SEQ ID NO: 2922391 - RNA, 16 nt, Human
ugacagggaagcuaca

SEQ ID NO: 2922392 - RNA, 17 nt, Human
ugacagggaagcuacag

SEQ ID NO: 2922393 - RNA, 19 nt, Human
ugacagggaagcuacaggu

SEQ ID NO: 2922394 - RNA, 20 nt, Human
ugacagggaagcuacagguu

SEQ ID NO: 2922395 - RNA, 21 nt, Human
ugacagggaagcuacagguua

SEQ ID NO: 2922396 - RNA, 18 nt, Human
agauaaagauuucuugag

SEQ ID NO: 2922397 - RNA, 23 nt, Human
ugaauuuuuuucaucuucucugg

SEQ ID NO: 2922398 - RNA, 21 nt, Human
ugaauuuuuuucaucuucucu

SEQ ID NO: 2922399 - RNA, 22 nt, Human
ugaauuuuucucuaacucagaa

SEQ ID NO: 2922400 - RNA, 21 nt, Human
ucuugaguuuuguuuuaaaau

SEQ ID NO: 2922401 - RNA, 12 nt, Human
agaauuccuuca

SEQ ID NO: 2922402 - RNA, 18 nt, Human
agaauuccuucaggguga

SEQ ID NO: 2922403 - RNA, 20 nt, Human
agaauuccuucagggugaug

SEQ ID NO: 2922404 - RNA, 14 nt, Human
ucuguggaaagugu

SEQ ID NO: 2922405 - RNA, 15 nt, Human
ucuguggaaagugua

SEQ ID NO: 2922406 - RNA, 16 nt, Human
ucuguggaaaguguaa

SEQ ID NO: 2922407 - RNA, 20 nt, Human
ucuguggaaaguguaaagca

SEQ ID NO: 2922408 - RNA, 22 nt, Human
ucuguggaaaguguaaagcauu

SEQ ID NO: 2922409 - RNA, 23 nt, Human
ucuguucuguggaaaguguaaag

SEQ ID NO: 2922410 - RNA, 15 nt, Human
ucuguucuguggaaa

SEQ ID NO: 2922411 - RNA, 16 nt, Human
ucuguucuguggaaag

SEQ ID NO: 2922412 - RNA, 19 nt, Human
ucuguucuguggaaagugu

SEQ ID NO: 2922413 - RNA, 22 nt, Human
ucuguucuguggaaaguguaaa

SEQ ID NO: 2922414 - RNA, 12 nt, Human
ucuguucugugg

SEQ ID NO: 2922415 - RNA, 14 nt, Human
ucuguucuguggaa

SEQ ID NO: 2922416 - RNA, 23 nt, Human
ucuuaauuuaaucuuuuuuaugu

SEQ ID NO: 2922417 - RNA, 13 nt, Human
ucuuacugaaggu

SEQ ID NO: 2922418 - RNA, 23 nt, Human
ucuuacugaagguaaaauugaaa

SEQ ID NO: 2922419 - RNA, 15 nt, Human
ucuuacauguuuucu

SEQ ID NO: 2922420 - RNA, 14 nt, Human
ucuuacauguuuuc

SEQ ID NO: 2922421 - RNA, 15 nt, Human
acuuuaaaauaaaau

SEQ ID NO: 2922422 - RNA, 22 nt, Human
ucugaagaguggguuucacaag

SEQ ID NO: 2922423 - RNA, 21 nt, Human
acugucacuguuucucugcug

SEQ ID NO: 2922424 - RNA, 20 nt, Human
acugucacuguuucucugcu

SEQ ID NO: 2922425 - RNA, 16 nt, Human
acugucacuguuucuc

SEQ ID NO: 2922426 - RNA, 15 nt, Human
acugucacuguuucu

SEQ ID NO: 2922427 - RNA, 15 nt, Human
accgcgucuggugac

SEQ ID NO: 2922428 - RNA, 19 nt, Human
ucccuuuuacauacugcug

SEQ ID NO: 2922429 - RNA, 17 nt, Human
ucccuuuuacauacugc

SEQ ID NO: 2922430 - RNA, 13 nt, Human
ucccuuuuacaua

SEQ ID NO: 2922431 - RNA, 20 nt, Human
ucccuuuuacauacugcugu

SEQ ID NO: 2922432 - RNA, 15 nt, Human
acucagaaacaucag

SEQ ID NO: 2922433 - RNA, 14 nt, Human
acucagaaacauca

SEQ ID NO: 2922434 - RNA, 13 nt, Human
acucauguguaug

SEQ ID NO: 2922435 - RNA, 21 nt, Human
acucauguguaugggcaaaaa

SEQ ID NO: 2922436 - RNA, 10 nt, Human
acucaugugu

SEQ ID NO: 2922437 - RNA, 11 nt, Human
acucaugugua

SEQ ID NO: 2922438 - RNA, 12 nt, Human
acucauguguau

SEQ ID NO: 2922439 - RNA, 21 nt, Human
acucauucaaaaguugaaauu

SEQ ID NO: 2922440 - RNA, 13 nt, Human
acucauucaaaag

SEQ ID NO: 2922441 - RNA, 19 nt, Human
uccccuauggggauggucc

SEQ ID NO: 2922442 - RNA, 20 nt, Human
ucagccaagcacaguggugg

SEQ ID NO: 2922443 - RNA, 12 nt, Human
ucagccaagcac

SEQ ID NO: 2922444 - RNA, 14 nt, Human
ucagccaagcacag

SEQ ID NO: 2922445 - RNA, 15 nt, Human
ucagccaagcacagu

SEQ ID NO: 2922446 - RNA, 13 nt, Human
ucacaguguguuu

SEQ ID NO: 2922447 - RNA, 17 nt, Human
ucacauccuguguuucu

SEQ ID NO: 2922448 - RNA, 19 nt, Human
ucacauccuguguuucuag

SEQ ID NO: 2922449 - RNA, 18 nt, Human
ucacauccuguguuucua

SEQ ID NO: 2922450 - RNA, 21 nt, Human
acaucuccuccauacucagga

SEQ ID NO: 2922451 - RNA, 12 nt, Human
acauacugcugu

SEQ ID NO: 2922452 - RNA, 22 nt, Human
acaguuuuccuucucaucugug

SEQ ID NO: 2922453 - RNA, 14 nt, Human
acaguuuuccuucu

SEQ ID NO: 2922454 - RNA, 12 nt, Human
acauucugcuuu

SEQ ID NO: 2922455 - RNA, 18 nt, Human
acauucugcuuucaucuu

SEQ ID NO: 2922456 - RNA, 14 nt, Human
ucaaaaguugaaau

SEQ ID NO: 2922457 - RNA, 16 nt, Human
ucaaaaguugaaauua

SEQ ID NO: 2922458 - RNA, 15 nt, Human
ucaaaaguugaaauu

SEQ ID NO: 2922459 - RNA, 21 nt, Human
uauuugugacuaauuguauaa

SEQ ID NO: 2922460 - RNA, 19 nt, Human
uauuugugacuaauuguau

SEQ ID NO: 2922461 - RNA, 20 nt, Human
uauuugugacuaauuguaua

SEQ ID NO: 2922462 - RNA, 12 nt, Human
uauuugugacua

SEQ ID NO: 2922463 - RNA, 14 nt, Human
uauuugugacuaau

SEQ ID NO: 2922464 - RNA, 17 nt, Human
uauuugugacuaauugu

SEQ ID NO: 2922465 - RNA, 22 nt, Human
uauuugugacuaauuguauaac

SEQ ID NO: 2922466 - RNA, 18 nt, Human
ucaaagccaaguuuauau

SEQ ID NO: 2922467 - RNA, 22 nt, Human
uaucuuguuuuuccacuacugc

SEQ ID NO: 2922468 - RNA, 18 nt, Human
uaucuuguuuuuccacua

SEQ ID NO: 2922469 - RNA, 14 nt, Human
uaucuuguuuuucc

SEQ ID NO: 2922470 - RNA, 22 nt, Human
uauauuaucaugcaaaugcugu

SEQ ID NO: 2922471 - RNA, 17 nt, Human
uaguuuuuguaauuuau

SEQ ID NO: 2922472 - RNA, 22 nt, Human
acacuagcuaauaucaauagaa

SEQ ID NO: 2922473 - RNA, 14 nt, Human
uagucuauuagcca

SEQ ID NO: 2922474 - RNA, 22 nt, Human
uagucuacucuuaagccaucuu

SEQ ID NO: 2922475 - RNA, 20 nt, Human
uagucuacucuuaagccauc

SEQ ID NO: 2922476 - RNA, 21 nt, Human
uagucuacucuuaagccaucu

SEQ ID NO: 2922477 - RNA, 19 nt, Human
aauguguaucggaugcuuu

SEQ ID NO: 2922478 - RNA, 23 nt, Human
aauugaauaaugguaccagauaa

SEQ ID NO: 2922479 - RNA, 14 nt, Human
aauugaauaauggu

SEQ ID NO: 2922480 - RNA, 21 nt, Human
aauugaauaaugguaccagau

SEQ ID NO: 2922481 - RNA, 22 nt, Human
aauugaauaaugguaccagaua

SEQ ID NO: 2922482 - RNA, 20 nt, Human
aauuuauauacaaccugcuu

SEQ ID NO: 2922483 - RNA, 20 nt, Human
uacuuuguccuuuuuguuau

SEQ ID NO: 2922484 - RNA, 16 nt, Human
acaaagcuuagcagga

SEQ ID NO: 2922485 - RNA, 19 nt, Human
acaaagcuuagcaggagag

SEQ ID NO: 2922486 - RNA, 21 nt, Human
acaaagcuuagcaggagagga

SEQ ID NO: 2922487 - RNA, 18 nt, Human
uagcaagugaauuuuucu

SEQ ID NO: 2922488 - RNA, 22 nt, Human
uagcaagugaauuuuucucuaa

SEQ ID NO: 2922489 - RNA, 18 nt, Human
acaacagauuugugaacu

SEQ ID NO: 2922490 - RNA, 16 nt, Human
acaaauucuguuucuu

SEQ ID NO: 2922491 - RNA, 15 nt, Human
acaaauucuguuucu

SEQ ID NO: 2922492 - RNA, 12 nt, Human
acaaauucuguu

SEQ ID NO: 2922493 - RNA, 15 nt, Human
acaacagauuuguga

SEQ ID NO: 2922494 - RNA, 16 nt, Human
acaacagauuugugaa

SEQ ID NO: 2922495 - RNA, 17 nt, Human
acaacagauuugugaac

SEQ ID NO: 2922496 - RNA, 15 nt, Human
acaaguuguguuuga

SEQ ID NO: 2922497 - RNA, 14 nt, Human
acaaguuguguuug

SEQ ID NO: 2922498 - RNA, 18 nt, Human
aauaugcacacagugcuu

SEQ ID NO: 2922499 - RNA, 13 nt, Human
aauauuguuucua

SEQ ID NO: 2922500 - RNA, 16 nt, Human
aauaugagaaucagau

SEQ ID NO: 2922501 - RNA, 13 nt, Human
aauaaaugucuuu

SEQ ID NO: 2922502 - RNA, 23 nt, Human
aauaaaugucuuuuuuuuaaugu

SEQ ID NO: 2922503 - RNA, 20 nt, Human
uacaccagagauaauaugag

SEQ ID NO: 2922504 - RNA, 19 nt, Human
uacaccagagauaauauga

SEQ ID NO: 2922505 - RNA, 15 nt, Human
uaauucauguuucuu

SEQ ID NO: 2922506 - RNA, 15 nt, Human
aaucagaucauuuca

SEQ ID NO: 2922507 - RNA, 14 nt, Human
aaucagaucauuuc

SEQ ID NO: 2922508 - RNA, 18 nt, Human
aaucauggaaugguuaua

SEQ ID NO: 2922509 - RNA, 21 nt, Human
aaucauggaaugguuauaaaa

SEQ ID NO: 2922510 - RNA, 16 nt, Human
uaaucaauaaacgauu

SEQ ID NO: 2922511 - RNA, 22 nt, Human
uaaucaauaaacgauuuaauuc

SEQ ID NO: 2922512 - RNA, 18 nt, Human
aagacaaauucuguuucu

SEQ ID NO: 2922513 - RNA, 16 nt, Human
aagacaaauucuguuu

SEQ ID NO: 2922514 - RNA, 15 nt, Human
aagaugcucuuuuaa

SEQ ID NO: 2922515 - RNA, 23 nt, Human
guuagucuacucuuaagccaucu

SEQ ID NO: 2922516 - RNA, 11 nt, Human
guguuucuagg

SEQ ID NO: 2922517 - RNA, 16 nt, Human
guuagucuacucuuaa

SEQ ID NO: 2922518 - RNA, 21 nt, Human
guuagucuacucuuaagccau

SEQ ID NO: 2922519 - RNA, 22 nt, Human
guuagucuacucuuaagccauc

SEQ ID NO: 2922520 - RNA, 22 nt, Human
guuacaacagauuugugaacuc

SEQ ID NO: 2922521 - RNA, 23 nt, Human
guuacaacagauuugugaacuca

SEQ ID NO: 2922522 - RNA, 13 nt, Human
guuacaacagauu

SEQ ID NO: 2922523 - RNA, 14 nt, Human
guuacaacagauuu

SEQ ID NO: 2922524 - RNA, 18 nt, Human
guuacaacagauuuguga

SEQ ID NO: 2922525 - RNA, 19 nt, Human
guuacaacagauuugugaa

SEQ ID NO: 2922526 - RNA, 20 nt, Human
guuacaacagauuugugaac

SEQ ID NO: 2922527 - RNA, 21 nt, Human
guuacaacagauuugugaacu

SEQ ID NO: 2922528 - RNA, 12 nt, Human
aagcuuguguau

SEQ ID NO: 2922529 - RNA, 13 nt, Human
aagcuuguguauc

SEQ ID NO: 2922530 - RNA, 16 nt, Human
aagcuuguguauccau

SEQ ID NO: 2922531 - RNA, 21 nt, Human
aagcuuguguauccauuauca

SEQ ID NO: 2922532 - RNA, 22 nt, Human
aagcuuguguauccauuaucau

SEQ ID NO: 2922533 - RNA, 23 nt, Human
aagcuuguguauccauuaucaug

SEQ ID NO: 2922534 - RNA, 23 nt, Human
aagcugaauacauucugcuuuca

SEQ ID NO: 2922535 - RNA, 13 nt, Human
aagcugaauacau

SEQ ID NO: 2922536 - RNA, 14 nt, Human
guuucuguucugug

SEQ ID NO: 2922537 - RNA, 15 nt, Human
guuucuguucugugg

SEQ ID NO: 2922538 - RNA, 20 nt, Human
guuucuguucuguggaaagu

SEQ ID NO: 2922539 - RNA, 17 nt, Human
guuucuguucuguggaa

SEQ ID NO: 2922540 - RNA, 18 nt, Human
guuucuguucuguggaaa

SEQ ID NO: 2922541 - RNA, 22 nt, Human
guuucuguucuguggaaagugu

SEQ ID NO: 2922542 - RNA, 22 nt, Human
guuuuagacaaauacucaugug

SEQ ID NO: 2922543 - RNA, 23 nt, Human
guuuuagacaaauacucaugugu

SEQ ID NO: 2922544 - RNA, 18 nt, Human
guuuuagacaaauacuca

SEQ ID NO: 2922545 - RNA, 17 nt, Human
guuuuagacaaauacuc

SEQ ID NO: 2922546 - RNA, 16 nt, Human
aagguaaaauugaaag

SEQ ID NO: 2922547 - RNA, 12 nt, Human
aagguaaaauug

SEQ ID NO: 2922548 - RNA, 16 nt, Human
aaggauguacauuucc

SEQ ID NO: 2922549 - RNA, 15 nt, Human
aaggauguacauuuc

SEQ ID NO: 2922550 - RNA, 22 nt, Human
aaccugcuuggguggagaagcc

SEQ ID NO: 2922551 - RNA, 23 nt, Human
aaccugcuuggguggagaagcca

SEQ ID NO: 2922552 - RNA, 16 nt, Human
aacaauauuguuucua

SEQ ID NO: 2922553 - RNA, 22 nt, Human
aacagugugaaguuagaauucc

SEQ ID NO: 2922554 - RNA, 13 nt, Human
aacagugugaagu

SEQ ID NO: 2922555 - RNA, 14 nt, Human
aacagugugaaguu

SEQ ID NO: 2922556 - RNA, 15 nt, Human
aacagugugaaguua

SEQ ID NO: 2922557 - RNA, 16 nt, Human
aacagugugaaguuag

SEQ ID NO: 2922558 - RNA, 17 nt, Human
aacagugugaaguuaga

SEQ ID NO: 2922559 - RNA, 18 nt, Human
aacagugugaaguuagaa

SEQ ID NO: 2922560 - RNA, 20 nt, Human
aacagugugaaguuagaauu

SEQ ID NO: 2922561 - RNA, 22 nt, Human
aaaugacuaaaaaacaaagaag

SEQ ID NO: 2922562 - RNA, 19 nt, Human
aaaugacuaaaaaacaaag

SEQ ID NO: 2922563 - RNA, 18 nt, Human
guaggaacgguaaauuuc

SEQ ID NO: 2922564 - RNA, 21 nt, Human
guaggaacgguaaauuucugu

SEQ ID NO: 2922565 - RNA, 12 nt, Human
aaaugaaagaaa

SEQ ID NO: 2922566 - RNA, 14 nt, Human
guaugggcaaaaaa

SEQ ID NO: 2922567 - RNA, 20 nt, Human
guauaacagguuauuuuagu

SEQ ID NO: 2922568 - RNA, 22 nt, Human
guauaacagguuauuuuaguuu

SEQ ID NO: 2922569 - RNA, 13 nt, Human
guauaacagguua

SEQ ID NO: 2922570 - RNA, 15 nt, Human
guauaacagguuauu

SEQ ID NO: 2922571 - RNA, 17 nt, Human
aaauuauagaugggaau

SEQ ID NO: 2922572 - RNA, 20 nt, Human
aaauuauagaugggaaugaa

SEQ ID NO: 2922573 - RNA, 22 nt, Human
aaauuuccccaacagugugaag

SEQ ID NO: 2922574 - RNA, 23 nt, Human
aaauuuccccaacagugugaagu

SEQ ID NO: 2922575 - RNA, 16 nt, Human
aaauuuccccaacagu

SEQ ID NO: 2922576 - RNA, 17 nt, Human
aaauuuccccaacagug

SEQ ID NO: 2922577 - RNA, 18 nt, Human
aaauuuccccaacagugu

SEQ ID NO: 2922578 - RNA, 19 nt, Human
aaauuuccccaacagugug

SEQ ID NO: 2922579 - RNA, 20 nt, Human
aaauuuccccaacaguguga

SEQ ID NO: 2922580 - RNA, 18 nt, Human
aaauuuaauucauguuuc

SEQ ID NO: 2922581 - RNA, 17 nt, Human
aaauuuaauucauguuu

SEQ ID NO: 2922582 - RNA, 14 nt, Human
caccauuaaaaggg

SEQ ID NO: 2922583 - RNA, 22 nt, Human
caccauuaaaagggauuaccca

SEQ ID NO: 2922584 - RNA, 23 nt, Human
caauuauaucaguccucuuucaa

SEQ ID NO: 2922585 - RNA, 13 nt, Human
caauuauuuuuac

SEQ ID NO: 2922586 - RNA, 16 nt, Human
cacaagugaaaaacau

SEQ ID NO: 2922587 - RNA, 12 nt, Human
cacaagugaaaa

SEQ ID NO: 2922588 - RNA, 12 nt, Human
caacagugugaa

SEQ ID NO: 2922589 - RNA, 13 nt, Human
caacagugugaag

SEQ ID NO: 2922590 - RNA, 14 nt, Human
caacagugugaagu

SEQ ID NO: 2922591 - RNA, 16 nt, Human
caacagugugaaguua

SEQ ID NO: 2922592 - RNA, 17 nt, Human
caacagugugaaguuag

SEQ ID NO: 2922593 - RNA, 18 nt, Human
caacagugugaaguuaga

SEQ ID NO: 2922594 - RNA, 19 nt, Human
caacagugugaaguuagaa

SEQ ID NO: 2922595 - RNA, 21 nt, Human
caacagugugaaguuagaauu

SEQ ID NO: 2922596 - RNA, 22 nt, Human
caacagugugaaguuagaauuc

SEQ ID NO: 2922597 - RNA, 23 nt, Human
caacagugugaaguuagaauucc

SEQ ID NO: 2922598 - RNA, 19 nt, Human
caagugaauuuuucucuaa

SEQ ID NO: 2922599 - RNA, 15 nt, Human
caaauucuguuucuu

SEQ ID NO: 2922600 - RNA, 14 nt, Human
caaauucuguuucu

SEQ ID NO: 2922601 - RNA, 21 nt, Human
caaagacaaauucuguuucuu

SEQ ID NO: 2922602 - RNA, 20 nt, Human
caaagacaaauucuguuucu

SEQ ID NO: 2922603 - RNA, 16 nt, Human
uuuuccauugguuuac

SEQ ID NO: 2922604 - RNA, 16 nt, Human
uuuuacauacugcugu

SEQ ID NO: 2922605 - RNA, 15 nt, Human
uuuuacauacugcug

SEQ ID NO: 2922606 - RNA, 21 nt, Human
uuuuaauuuauuuauacuauu

SEQ ID NO: 2922607 - RNA, 15 nt, Human
uuuauuuauacuauu

SEQ ID NO: 2922608 - RNA, 16 nt, Human
uuuacaauugaaauga

SEQ ID NO: 2922609 - RNA, 15 nt, Human
uuuacaauugaaaug

SEQ ID NO: 2922610 - RNA, 23 nt, Human
uucucugaagaguggguuucaca

SEQ ID NO: 2922611 - RNA, 23 nt, Human
uucuccaugagacacaucuccuc

SEQ ID NO: 2922612 - RNA, 12 nt, Human
uucuauuuggaa

SEQ ID NO: 2922613 - RNA, 16 nt, Human
uuccuucucaucugug

SEQ ID NO: 2922614 - RNA, 14 nt, Human
uuccuucucaucug

SEQ ID NO: 2922615 - RNA, 16 nt, Human
uucaguugauuuuaca

SEQ ID NO: 2922616 - RNA, 23 nt, Human
uuccccaacagugugaaguuaga

SEQ ID NO: 2922617 - RNA, 19 nt, Human
uuccccaacagugugaagu

SEQ ID NO: 2922618 - RNA, 20 nt, Human
uuccccaacagugugaaguu

SEQ ID NO: 2922619 - RNA, 13 nt, Human
uuccccaacagug

SEQ ID NO: 2922620 - RNA, 15 nt, Human
uuccccaacagugug

SEQ ID NO: 2922621 - RNA, 16 nt, Human
uuccccaacaguguga

SEQ ID NO: 2922622 - RNA, 23 nt, Human
uucaaagccaaguuuauauacaa

SEQ ID NO: 2922623 - RNA, 13 nt, Human
uucuguucugugg

SEQ ID NO: 2922624 - RNA, 16 nt, Human
uucuguucuguggaaa

SEQ ID NO: 2922625 - RNA, 20 nt, Human
uucuguucuguggaaagugu

SEQ ID NO: 2922626 - RNA, 21 nt, Human
uucuguucuguggaaagugua

SEQ ID NO: 2922627 - RNA, 22 nt, Human
uucugugggagaauucuuacau

SEQ ID NO: 2922628 - RNA, 22 nt, Human
uucuguggaaaguguaaagcau

SEQ ID NO: 2922629 - RNA, 23 nt, Human
uucuguggaaaguguaaagcauu

SEQ ID NO: 2922630 - RNA, 21 nt, Human
uucuguggaaaguguaaagca

SEQ ID NO: 2922631 - RNA, 15 nt, Human
uugcuaaauguaaca

SEQ ID NO: 2922632 - RNA, 12 nt, Human
uugcuaaaugua

SEQ ID NO: 2922633 - RNA, 16 nt, Human
uugguaaauuucccca

SEQ ID NO: 2922634 - RNA, 21 nt, Human
uugguaaauuuccccaacagu

SEQ ID NO: 2922635 - RNA, 18 nt, Human
ugucuuuuuuuuaaugug

SEQ ID NO: 2922636 - RNA, 21 nt, Human
ugucuuuuuuuuaaugugcug

SEQ ID NO: 2922637 - RNA, 21 nt, Human
uguggaaaguguaaagcauuc

SEQ ID NO: 2922638 - RNA, 19 nt, Human
uguggaaaguguaaagcau

SEQ ID NO: 2922639 - RNA, 20 nt, Human
uguggaaaguguaaagcauu

SEQ ID NO: 2922640 - RNA, 14 nt, Human
uguggaaaguguaa

SEQ ID NO: 2922641 - RNA, 15 nt, Human
uguggaaaguguaaa

SEQ ID NO: 2922642 - RNA, 16 nt, Human
uguggaaaguguaaag

SEQ ID NO: 2922643 - RNA, 17 nt, Human
uguggaaaguguaaagc

SEQ ID NO: 2922644 - RNA, 12 nt, Human
uguggaaagugu

SEQ ID NO: 2922645 - RNA, 19 nt, Human
ugguagggggaaaaugugu

SEQ ID NO: 2922646 - RNA, 23 nt, Human
uguaacugcauugagaacugcau

SEQ ID NO: 2922647 - RNA, 21 nt, Human
uguaacuggcaguuuuccauu

SEQ ID NO: 2922648 - RNA, 22 nt, Human
uguauuugugacuaauuguaua

SEQ ID NO: 2922649 - RNA, 18 nt, Human
uguauuugugacuaauug

SEQ ID NO: 2922650 - RNA, 20 nt, Human
uguauuugugacuaauugua

SEQ ID NO: 2922651 - RNA, 12 nt, Human
uguauuugugac

SEQ ID NO: 2922652 - RNA, 13 nt, Human
uguauuugugacu

SEQ ID NO: 2922653 - RNA, 14 nt, Human
uguauuugugacua

SEQ ID NO: 2922654 - RNA, 15 nt, Human
uguauuugugacuaa

SEQ ID NO: 2922655 - RNA, 16 nt, Human
uguauuugugacuaau

SEQ ID NO: 2922656 - RNA, 15 nt, Human
uguaucggaugcuuu

SEQ ID NO: 2922657 - RNA, 20 nt, Human
uguuggauaaaucagugguu

SEQ ID NO: 2922658 - RNA, 19 nt, Human
uguuggauaaaucaguggu

SEQ ID NO: 2922659 - RNA, 17 nt, Human
uguguuuucauaauaaa

SEQ ID NO: 2922660 - RNA, 16 nt, Human
uguguauccauuauca

SEQ ID NO: 2922661 - RNA, 18 nt, Human
uguguauccauuaucaug

SEQ ID NO: 2922662 - RNA, 19 nt, Human
uguguauccauuaucaugu

SEQ ID NO: 2922663 - RNA, 18 nt, Human
uuacauguuuucuuugcu

SEQ ID NO: 2922664 - RNA, 12 nt, Human
uuacauguuuuc

SEQ ID NO: 2922665 - RNA, 22 nt, Human
uuacauguuuucuuugcuuuaa

SEQ ID NO: 2922666 - RNA, 13 nt, Human
uuaauucauguuu

SEQ ID NO: 2922667 - RNA, 13 nt, Human
uguuuuucacauu

SEQ ID NO: 2922668 - RNA, 20 nt, Human
uuaaaacaauauuguuucua

SEQ ID NO: 2922669 - RNA, 15 nt, Human
uguuucuagggaaau

SEQ ID NO: 2922670 - RNA, 15 nt, Human
uguuucucugcuguu

SEQ ID NO: 2922671 - RNA, 14 nt, Human
uguuucucugcugu

SEQ ID NO: 2922672 - RNA, 13 nt, Human
uguuucucugcug

SEQ ID NO: 2922673 - RNA, 15 nt, Human
uuaaauauaauaugc

SEQ ID NO: 2922674 - RNA, 23 nt, Human
uuaaaugggcuacuuuguccuuu

SEQ ID NO: 2922675 - RNA, 19 nt, Human
uuaaagcuaaaguaucugu

SEQ ID NO: 2922676 - RNA, 17 nt, Human
uggcuguaucuuguuuu

SEQ ID NO: 2922677 - RNA, 22 nt, Human
uggguuucacaagugaaaaaca

SEQ ID NO: 2922678 - RNA, 19 nt, Human
uggcacugcauacaaucug

SEQ ID NO: 2922679 - RNA, 12 nt, Human
uggaugauguuu

SEQ ID NO: 2922680 - RNA, 19 nt, Human
ugcuuucaucuuggucaca

SEQ ID NO: 2922681 - RNA, 21 nt, Human
uggaaugguuauaaaagugau

SEQ ID NO: 2922682 - RNA, 18 nt, Human
uggaaugguuauaaaagu

SEQ ID NO: 2922683 - RNA, 22 nt, Human
ucuuguuuuuccacuacugcua

SEQ ID NO: 2922684 - RNA, 18 nt, Human
ucuggcgacaguuuuccu

SEQ ID NO: 2922685 - RNA, 22 nt, Human
ucuggcgacaguuuuccuucuc

SEQ ID NO: 2922686 - RNA, 10 nt, Human
ucuuucacau

SEQ ID NO: 2922687 - RNA, 13 nt, Human
ucuuuuuuaugug

SEQ ID NO: 2922688 - RNA, 18 nt, Human
ugaacugauaguuacugu

SEQ ID NO: 2922689 - RNA, 19 nt, Human
ugaacugauaguuacuguu

SEQ ID NO: 2922690 - RNA, 21 nt, Human
ugaacugauaguuacuguugu

SEQ ID NO: 2922691 - RNA, 23 nt, Human
ugaacugauaguuacuguuguga

SEQ ID NO: 2922692 - RNA, 13 nt, Human
ucuagggaaauga

SEQ ID NO: 2922693 - RNA, 17 nt, Human
ucuagggaaaugaaaga

SEQ ID NO: 2922694 - RNA, 13 nt, Human
ucuaaauugaaua

SEQ ID NO: 2922695 - RNA, 17 nt, Human
ucuaaauugaauaaugg

SEQ ID NO: 2922696 - RNA, 14 nt, Human
ucuaaauugaauaa

SEQ ID NO: 2922697 - RNA, 15 nt, Human
ucuaaauugaauaau

SEQ ID NO: 2922698 - RNA, 15 nt, Human
ucuaacucagaaaca

SEQ ID NO: 2922699 - RNA, 21 nt, Human
ucggaaaccuugguguaguug

SEQ ID NO: 2922700 - RNA, 14 nt, Human
uccuuuuuguuauu

SEQ ID NO: 2922701 - RNA, 13 nt, Human
uccuuuuuguuau

SEQ ID NO: 2922702 - RNA, 17 nt, Human
ucaguuacucugaaggg

SEQ ID NO: 2922703 - RNA, 16 nt, Human
ucaguuacucugaagg

SEQ ID NO: 2922704 - RNA, 20 nt, Human
ucagugguuauuuagggaac

SEQ ID NO: 2922705 - RNA, 20 nt, Human
ucacaaguuguguuugauau

SEQ ID NO: 2922706 - RNA, 18 nt, Human
ucaaaacucauuuccuau

SEQ ID NO: 2922707 - RNA, 20 nt, Human
uauuuuaguuucuguucugu

SEQ ID NO: 2922708 - RNA, 21 nt, Human
uauuuuaguuucuguucugug

SEQ ID NO: 2922709 - RNA, 14 nt, Human
uauuuuaguuucug

SEQ ID NO: 2922710 - RNA, 16 nt, Human
uauuuuaguuucuguu

SEQ ID NO: 2922711 - RNA, 18 nt, Human
uauuuuaguuucuguucu

SEQ ID NO: 2922712 - RNA, 20 nt, Human
uauuuggaauuuauauacaa

SEQ ID NO: 2922713 - RNA, 21 nt, Human
uauuuggaauuuauauacaac

SEQ ID NO: 2922714 - RNA, 11 nt, Human
uauuuggaauu

SEQ ID NO: 2922715 - RNA, 14 nt, Human
uauuuggaauuuau

SEQ ID NO: 2922716 - RNA, 11 nt, Human
uaaaucagugg

SEQ ID NO: 2922717 - RNA, 12 nt, Human
uaaagcauucca

SEQ ID NO: 2922718 - RNA, 13 nt, Human
uaaagcauuccaa

SEQ ID NO: 2922719 - RNA, 15 nt, Human
uaaagcauuccaaca

SEQ ID NO: 2922720 - RNA, 16 nt, Human
uaaagcauuccaacaa

SEQ ID NO: 2922721 - RNA, 17 nt, Human
guuuuguuuuaaaauua

SEQ ID NO: 2922722 - RNA, 22 nt, Human
guuuucauaauaaaacuuuaaa

SEQ ID NO: 2922723 - RNA, 14 nt, Human
guuuucauaauaaa

SEQ ID NO: 2922724 - RNA, 19 nt, Human
uaaaaaacaaagaagacaa

SEQ ID NO: 2922725 - RNA, 14 nt, Human
uaaaaaacaaagaa

SEQ ID NO: 2922726 - RNA, 20 nt, Human
guuucgugaaguauacugua

SEQ ID NO: 2922727 - RNA, 17 nt, Human
uaagccaucuugguaaa

SEQ ID NO: 2922728 - RNA, 22 nt, Human
uaacucagaaacaucaguuacu

SEQ ID NO: 2922729 - RNA, 23 nt, Human
uaacuggcaguuuuccauugguu

SEQ ID NO: 2922730 - RNA, 24 nt, Human
uaacuggcaguuuuccauugguuu

SEQ ID NO: 2922731 - RNA, 17 nt, Human
uaacugcauugagaacu

SEQ ID NO: 2922732 - RNA, 12 nt, Human
uaauucucuuga

SEQ ID NO: 2922733 - RNA, 13 nt, Human
uaauucucuugaa

SEQ ID NO: 2922734 - RNA, 16 nt, Human
uaauuguauaacaggu

SEQ ID NO: 2922735 - RNA, 17 nt, Human
uaauuguauaacagguu

SEQ ID NO: 2922736 - RNA, 18 nt, Human
uaauuguauaacagguua

SEQ ID NO: 2922737 - RNA, 14 nt, Human
uaauaaagaugcuc

SEQ ID NO: 2922738 - RNA, 16 nt, Human
uaauaaagaugcucuu

SEQ ID NO: 2922739 - RNA, 17 nt, Human
uaauaaagaugcucuuu

SEQ ID NO: 2922740 - RNA, 14 nt, Human
uacaucuuucacau

SEQ ID NO: 2922741 - RNA, 12 nt, Human
uacccaagcaaa

SEQ ID NO: 2922742 - RNA, 22 nt, Human
uacuguauuuuuaccuuuuucc

SEQ ID NO: 2922743 - RNA, 14 nt, Human
uacuguugugaccu

SEQ ID NO: 2922744 - RNA, 18 nt, Human
uagauuaagagauggguu

SEQ ID NO: 2922745 - RNA, 15 nt, Human
uagaugggaaugaag

SEQ ID NO: 2922746 - RNA, 17 nt, Human
uagaugggaaugaagcu

SEQ ID NO: 2922747 - RNA, 18 nt, Human
uagaugggaaugaagcuu

SEQ ID NO: 2922748 - RNA, 19 nt, Human
uagaugggaaugaagcuug

SEQ ID NO: 2922749 - RNA, 22 nt, Human
uagaugggaaugaagcuugugu

SEQ ID NO: 2922750 - RNA, 15 nt, Human
uagauaaacucagaa

SEQ ID NO: 2922751 - RNA, 23 nt, Human
uagaugggaaugaagcuugugua

SEQ ID NO: 2922752 - RNA, 20 nt, Human
uagauguagauaaacucaga

SEQ ID NO: 2922753 - RNA, 23 nt, Human
uagauguagauaaacucagaaau

SEQ ID NO: 2922754 - RNA, 12 nt, Human
uagauaaacuca

SEQ ID NO: 2922755 - RNA, 15 nt, Human
uagcugcuacaaaga

SEQ ID NO: 2922756 - RNA, 16 nt, Human
uagcugcuacaaagaa

SEQ ID NO: 2922757 - RNA, 19 nt, Human
uagcugcuacaaagaagac

SEQ ID NO: 2922758 - RNA, 20 nt, Human
uagcugcuacaaagaagaca

SEQ ID NO: 2922759 - RNA, 23 nt, Human
uagcugcuacaaagaagacaugu

SEQ ID NO: 2922760 - RNA, 21 nt, Human
uagcugcuacaaagaagacau

SEQ ID NO: 2922761 - RNA, 12 nt, Human
uagcugcuacaa

SEQ ID NO: 2922762 - RNA, 13 nt, Human
uagcugcuacaaa

SEQ ID NO: 2922763 - RNA, 20 nt, Human
uaggaacgguaaauuucugu

SEQ ID NO: 2922764 - RNA, 18 nt, Human
uaguuucuguucugugga

SEQ ID NO: 2922765 - RNA, 14 nt, Human
uaguuucuguucug

SEQ ID NO: 2922766 - RNA, 15 nt, Human
uaguuucuguucugu

SEQ ID NO: 2922767 - RNA, 16 nt, Human
uaguuucuguucugug

SEQ ID NO: 2922768 - RNA, 17 nt, Human
uaguuucuguucugugg

SEQ ID NO: 2922769 - RNA, 19 nt, Human
uauauacaaccugcuuggg

SEQ ID NO: 2922770 - RNA, 20 nt, Human
uauauacaaccugcuugggu

SEQ ID NO: 2922771 - RNA, 17 nt, Human
uaucauguguaaucaau

SEQ ID NO: 2922772 - RNA, 11 nt, Human
uaucaugugua

SEQ ID NO: 2922773 - RNA, 13 nt, Human
uaucauguguaau

SEQ ID NO: 2922774 - RNA, 14 nt, Human
uaucauguguaauc

SEQ ID NO: 2922775 - RNA, 16 nt, Human
gggugaugccagguuc

SEQ ID NO: 2922776 - RNA, 16 nt, Human
gguagccaucauggau

SEQ ID NO: 2922777 - RNA, 13 nt, Human
gguucuucccuuu

SEQ ID NO: 2922778 - RNA, 20 nt, Human
gguuauuuagggaacugcuu

SEQ ID NO: 2922779 - RNA, 17 nt, Human
gguuauuuuaguuucug

SEQ ID NO: 2922780 - RNA, 19 nt, Human
gguuauuuuaguuucuguu

SEQ ID NO: 2922781 - RNA, 23 nt, Human
gguuauuuuaguuucuguucugu

SEQ ID NO: 2922782 - RNA, 19 nt, Human
gguuacaacagauuuguga

SEQ ID NO: 2922783 - RNA, 21 nt, Human
gguuacaacagauuugugaac

SEQ ID NO: 2922784 - RNA, 14 nt, Human
gguuacaacagauu

SEQ ID NO: 2922785 - RNA, 13 nt, Human
gguuacaacagau

SEQ ID NO: 2922786 - RNA, 14 nt, Human
gguuauaaaaguga

SEQ ID NO: 2922787 - RNA, 13 nt, Human
gggcaucaugcau

SEQ ID NO: 2922788 - RNA, 14 nt, Human
gggaaugaagcuug

SEQ ID NO: 2922789 - RNA, 24 nt, Human
gggaaugaagcuuguguauccauu

SEQ ID NO: 2922790 - RNA, 12 nt, Human
gggaaggucacc

SEQ ID NO: 2922791 - RNA, 20 nt, Human
ggaacgguaaauuucugugg

SEQ ID NO: 2922792 - RNA, 17 nt, Human
ggaaaguguaaagcauu

SEQ ID NO: 2922793 - RNA, 13 nt, Human
ggaaaguguaaag

SEQ ID NO: 2922794 - RNA, 14 nt, Human
ggaaaguguaaagc

SEQ ID NO: 2922795 - RNA, 15 nt, Human
ggaaaguguaaagca

SEQ ID NO: 2922796 - RNA, 16 nt, Human
ggaaaguguaaagcau

SEQ ID NO: 2922797 - RNA, 12 nt, Human
gcuguguaaagu

SEQ ID NO: 2922798 - RNA, 11 nt, Human
gcuguguaaag

SEQ ID NO: 2922799 - RNA, 13 nt, Human
gcuguguaaaguu

SEQ ID NO: 2922800 - RNA, 14 nt, Human
gcuguguaaaguua

SEQ ID NO: 2922801 - RNA, 15 nt, Human
gcuguguaaaguuag

SEQ ID NO: 2922802 - RNA, 16 nt, Human
gcuguguaaaguuagu

SEQ ID NO: 2922803 - RNA, 19 nt, Human
gcuguguaaaguuagucua

SEQ ID NO: 2922804 - RNA, 17 nt, Human
gcuguguaaaguuaguc

SEQ ID NO: 2922805 - RNA, 18 nt, Human
gcuguguaaaguuagucu

SEQ ID NO: 2922806 - RNA, 15 nt, Human
ggacuguauuuguga

SEQ ID NO: 2922807 - RNA, 11 nt, Human
gccagagaagu

SEQ ID NO: 2922808 - RNA, 13 nt, Human
gccagagaaguga

SEQ ID NO: 2922809 - RNA, 10 nt, Human
gccagagaag

SEQ ID NO: 2922810 - RNA, 18 nt, Human
gccagagaagugacaggg

SEQ ID NO: 2922811 - RNA, 19 nt, Human
gccagagaagugacaggga

SEQ ID NO: 2922812 - RNA, 14 nt, Human
gccagagaagugac

SEQ ID NO: 2922813 - RNA, 15 nt, Human
gccagagaagugaca

SEQ ID NO: 2922814 - RNA, 16 nt, Human
gccagagaagugacag

SEQ ID NO: 2922815 - RNA, 17 nt, Human
gccagagaagugacagg

SEQ ID NO: 2922816 - RNA, 23 nt, Human
gccauugucuucggaaaccuugg

SEQ ID NO: 2922817 - RNA, 22 nt, Human
gccauugucuucggaaaccuug

SEQ ID NO: 2922818 - RNA, 17 nt, Human
gcauuccaacaaagggu

SEQ ID NO: 2922819 - RNA, 18 nt, Human
gcauuccaacaaaggguu

SEQ ID NO: 2922820 - RNA, 15 nt, Human
gccaaacagccacac

SEQ ID NO: 2922821 - RNA, 21 nt, Human
gcauauguuucgcugauauau

SEQ ID NO: 2922822 - RNA, 14 nt, Human
gcaggagccugagc

SEQ ID NO: 2922823 - RNA, 16 nt, Human
gauugcuaaauguaac

SEQ ID NO: 2922824 - RNA, 20 nt, Human
gauugcuaaauguaacaguc

SEQ ID NO: 2922825 - RNA, 17 nt, Human
gauuguuugcucugaga

SEQ ID NO: 2922826 - RNA, 20 nt, Human
gauaguuacuguugugaccu

SEQ ID NO: 2922827 - RNA, 12 nt, Human
gauaguuacugu

SEQ ID NO: 2922828 - RNA, 14 nt, Human
gauaguuacuguug

SEQ ID NO: 2922829 - RNA, 17 nt, Human
gauaguuacuguuguga

SEQ ID NO: 2922830 - RNA, 17 nt, Human
gauaauaugagaaucag

SEQ ID NO: 2922831 - RNA, 22 nt, Human
gauaaaauuauagaugggaaug

SEQ ID NO: 2922832 - RNA, 19 nt, Human
gauaaaauuauagauggga

SEQ ID NO: 2922833 - RNA, 14 nt, Human
gaacucagccaagc

SEQ ID NO: 2922834 - RNA, 15 nt, Human
gaacucagccaagca

SEQ ID NO: 2922835 - RNA, 16 nt, Human
gaacucagccaagcac

SEQ ID NO: 2922836 - RNA, 17 nt, Human
gaacucagccaagcaca

SEQ ID NO: 2922837 - RNA, 18 nt, Human
gaacucagccaagcacag

SEQ ID NO: 2922838 - RNA, 19 nt, Human
gaacucagccaagcacagu

SEQ ID NO: 2922839 - RNA, 20 nt, Human
gaacucagccaagcacagug

SEQ ID NO: 2922840 - RNA, 24 nt, Human
gaacucagccaagcacaguggugg

SEQ ID NO: 2922841 - RNA, 20 nt, Human
gaaugaagcuuguguaucca

SEQ ID NO: 2922842 - RNA, 16 nt, Human
gaaugaagcuugugua

SEQ ID NO: 2922843 - RNA, 18 nt, Human
gaaugaagcuuguguauc

SEQ ID NO: 2922844 - RNA, 16 nt, Human
gaaugguuauaaaagu

SEQ ID NO: 2922845 - RNA, 17 nt, Human
gaaugguuauaaaagug

SEQ ID NO: 2922846 - RNA, 13 nt, Human
gaaugguuauaaa

SEQ ID NO: 2922847 - RNA, 16 nt, Human
gaauuccuucagggug

SEQ ID NO: 2922848 - RNA, 17 nt, Human
gaauuccuucaggguga

SEQ ID NO: 2922849 - RNA, 22 nt, Human
gaauuuauauacaaccugcuug

SEQ ID NO: 2922850 - RNA, 22 nt, Human
gacaguuuuccuucucaucugu

SEQ ID NO: 2922851 - RNA, 16 nt, Human
cuuaaauuuuaauuua

SEQ ID NO: 2922852 - RNA, 22 nt, Human
cuuaacuuaaauuuuaauuuau

SEQ ID NO: 2922853 - RNA, 23 nt, Human
cuuaagccaucuugguaaauuuc

SEQ ID NO: 2922854 - RNA, 20 nt, Human
cuuaagccaucuugguaaau

SEQ ID NO: 2922855 - RNA, 22 nt, Human
cuuaagccaucuugguaaauuu

SEQ ID NO: 2922856 - RNA, 15 nt, Human
cuuaagccaucuugg

SEQ ID NO: 2922857 - RNA, 16 nt, Human
cuuaagccaucuuggu

SEQ ID NO: 2922858 - RNA, 17 nt, Human
cuuaagccaucuuggua

SEQ ID NO: 2922859 - RNA, 19 nt, Human
cuuaagccaucuugguaaa

SEQ ID NO: 2922860 - RNA, 14 nt, Human
cuguuucucugcug

SEQ ID NO: 2922861 - RNA, 13 nt, Human
cuguuucucugcu

SEQ ID NO: 2922862 - RNA, 14 nt, Human
cuucccuuuuacau

SEQ ID NO: 2922863 - RNA, 15 nt, Human
cuucccucacaccgc

SEQ ID NO: 2922864 - RNA, 18 nt, Human
cuucagggugaugccagg

SEQ ID NO: 2922865 - RNA, 15 nt, Human
cucauucaaaaguug

SEQ ID NO: 2922866 - RNA, 19 nt, Human
cucauucaaaaguugaaau

SEQ ID NO: 2922867 - RNA, 15 nt, Human
cuccacagcuaccuc

SEQ ID NO: 2922868 - RNA, 12 nt, Human
cucucaguuuuu

SEQ ID NO: 2922869 - RNA, 18 nt, Human
cucuccuguacuuuuucc

SEQ ID NO: 2922870 - RNA, 22 nt, Human
cucuguuccuucacauccugug

SEQ ID NO: 2922871 - RNA, 16 nt, Human
cucuguuccuucacau

SEQ ID NO: 2922872 - RNA, 12 nt, Human
cugaauaaaugu

SEQ ID NO: 2922873 - RNA, 13 nt, Human
cugaauaaauguc

SEQ ID NO: 2922874 - RNA, 15 nt, Human
cugaauaaaugucuu

SEQ ID NO: 2922875 - RNA, 18 nt, Human
cugaauacauucugcuuu

SEQ ID NO: 2922876 - RNA, 16 nt, Human
cugaauacauucugcu

SEQ ID NO: 2922877 - RNA, 19 nt, Human
cugaagguaaaauugaaag

SEQ ID NO: 2922878 - RNA, 22 nt, Human
cugaucgugacgcugaauaaau

SEQ ID NO: 2922879 - RNA, 14 nt, Human
cugaucgugacgcu

SEQ ID NO: 2922880 - RNA, 21 nt, Human
cugaucgugacgcugaauaaa

SEQ ID NO: 2922881 - RNA, 21 nt, Human
cugauaguuacuguugugacc

SEQ ID NO: 2922882 - RNA, 22 nt, Human
cugauaguuacuguugugaccu

SEQ ID NO: 2922883 - RNA, 16 nt, Human
cugauaguuacuguug

SEQ ID NO: 2922884 - RNA, 17 nt, Human
cugauaguuacuguugu

SEQ ID NO: 2922885 - RNA, 18 nt, Human
cugauaguuacuguugug

SEQ ID NO: 2922886 - RNA, 19 nt, Human
cugauaguuacuguuguga

SEQ ID NO: 2922887 - RNA, 15 nt, Human
cugauaguuacuguu

SEQ ID NO: 2922888 - RNA, 17 nt, Human
ccuauggggauggucca

SEQ ID NO: 2922889 - RNA, 20 nt, Human
cccuguccccucccccuucc

SEQ ID NO: 2922890 - RNA, 12 nt, Human
ccuucaggguga

SEQ ID NO: 2922891 - RNA, 18 nt, Human
ccuucagggugaugccag

SEQ ID NO: 2922892 - RNA, 19 nt, Human
ccuucagggugaugccagg

SEQ ID NO: 2922893 - RNA, 20 nt, Human
ccuucagggugaugccaggu

SEQ ID NO: 2922894 - RNA, 21 nt, Human
ccugcuuggguggagaagcca

SEQ ID NO: 2922895 - RNA, 22 nt, Human
ccugcuuggguggagaagccau

SEQ ID NO: 2922896 - RNA, 23 nt, Human
ccugcuuggguggagaagccauu

SEQ ID NO: 2922897 - RNA, 20 nt, Human
ccugcuuggguggagaagcc

SEQ ID NO: 2922898 - RNA, 17 nt, Human
cgugaaguauacuguau

SEQ ID NO: 2922899 - RNA, 14 nt, Human
cgauuuaauucucu

SEQ ID NO: 2922900 - RNA, 15 nt, Human
cgauuuaauucucuu

SEQ ID NO: 2922901 - RNA, 18 nt, Human
cgauuuaauucucuugaa

SEQ ID NO: 2922902 - RNA, 17 nt, Human
cggaaaccuugguguag

SEQ ID NO: 2922903 - RNA, 16 nt, Human
ccaaacagccacacug

SEQ ID NO: 2922904 - RNA, 21 nt, Human
cauuugcgaaugguuccauuc

SEQ ID NO: 2922905 - RNA, 13 nt, Human
cauugucuucgga

SEQ ID NO: 2922906 - RNA, 23 nt, Human
cauugucuucggaaaccuuggug

SEQ ID NO: 2922907 - RNA, 19 nt, Human
cauuuccuauguaacugca

SEQ ID NO: 2922908 - RNA, 17 nt, Human
cauuuccuauguaacug

SEQ ID NO: 2922909 - RNA, 14 nt, Human
ccaaguuuauauac

SEQ ID NO: 2922910 - RNA, 24 nt, Human
ccaagggaguuaggcuauucacaa

SEQ ID NO: 2922911 - RNA, 16 nt, Human
ccaagcacaguggugg

SEQ ID NO: 2922912 - RNA, 19 nt, Human
ccaagcacagugguggcag

SEQ ID NO: 2922913 - RNA, 20 nt, Human
ccaagcacagugguggcagg

SEQ ID NO: 2922914 - RNA, 21 nt, Human
ccaagcacagugguggcaggg

SEQ ID NO: 2922915 - RNA, 22 nt, Human
ccaagcacagugguggcagggc

SEQ ID NO: 2922916 - RNA, 23 nt, Human
ccaagcacagugguggcagggcc

SEQ ID NO: 2922917 - RNA, 17 nt, Human
ccaagcaaaaucaugga

SEQ ID NO: 2922918 - RNA, 22 nt, Human
ccaacaaaggguuuuaauguag

SEQ ID NO: 2922919 - RNA, 21 nt, Human
ccaacaaaggguuuuaaugua

SEQ ID NO: 2922920 - RNA, 13 nt, Human
ccaaagccaccag

SEQ ID NO: 2922921 - RNA, 22 nt, Human
ccaaagccaccagacugacaaa

SEQ ID NO: 2922922 - RNA, 24 nt, Human
ccaugcuguugauugcuaaaugua

SEQ ID NO: 2922923 - RNA, 21 nt, Human
ccaugcuguugauugcuaaau

SEQ ID NO: 2922924 - RNA, 22 nt, Human
ccaugcuguugauugcuaaaug

SEQ ID NO: 2922925 - RNA, 20 nt, Human
ccaugcuguugauugcuaaa

SEQ ID NO: 2922926 - RNA, 12 nt, Human
ccccaacagugu

SEQ ID NO: 2922927 - RNA, 18 nt, Human
ggcgacaguuuuccuucu

SEQ ID NO: 2922928 - RNA, 21 nt, Human
ggaucugguagggggaaaaug

SEQ ID NO: 2922929 - RNA, 16 nt, Human
ggauguacauuuccaa

SEQ ID NO: 2922930 - RNA, 17 nt, Human
gguaccagauaaaauua

SEQ ID NO: 2922931 - RNA, 13 nt, Human
ggguuuuaaugua

SEQ ID NO: 2922932 - RNA, 17 nt, Human
aaagacaaauucuguuu

SEQ ID NO: 2922933 - RNA, 16 nt, Human
aaagacaaauucuguu

SEQ ID NO: 2922934 - RNA, 22 nt, Human
aaagacaaauucuguuucuuga

SEQ ID NO: 2922935 - RNA, 19 nt, Human
aaagacaaauucuguuucu

SEQ ID NO: 2922936 - RNA, 14 nt, Human
aaagauuucuugag

SEQ ID NO: 2922937 - RNA, 11 nt, Human
aaaguguaaag

SEQ ID NO: 2922938 - RNA, 12 nt, Human
aaaguguaaagc

SEQ ID NO: 2922939 - RNA, 13 nt, Human
aaaguguaaagca

SEQ ID NO: 2922940 - RNA, 15 nt, Human
aaaguguaaagcauu

SEQ ID NO: 2922941 - RNA, 16 nt, Human
aaaguguaaagcauuc

SEQ ID NO: 2922942 - RNA, 17 nt, Human
aaaguguaaagcauucc

SEQ ID NO: 2922943 - RNA, 18 nt, Human
aaaguguaaagcauucca

SEQ ID NO: 2922944 - RNA, 22 nt, Human
aaaguguaaagcauuccaacaa

SEQ ID NO: 2922945 - RNA, 16 nt, Human
guaaagcauuccaaca

SEQ ID NO: 2922946 - RNA, 23 nt, Human
aaacaucaguuacucugaagggc

SEQ ID NO: 2922947 - RNA, 22 nt, Human
aaacaucaguuacucugaaggg

SEQ ID NO: 2922948 - RNA, 20 nt, Human
aaacaucaguuacucugaag

SEQ ID NO: 2922949 - RNA, 19 nt, Human
aaacaucaguuacucugaa

SEQ ID NO: 2922950 - RNA, 16 nt, Human
aaacaucaguuacucu

SEQ ID NO: 2922951 - RNA, 23 nt, Human
gggccuagcugcuacaaagaaga

SEQ ID NO: 2922952 - RNA, 18 nt, Human
aaaagggauuacccaagc

SEQ ID NO: 2922953 - RNA, 15 nt, Human
gggauuacccaagca

SEQ ID NO: 2922954 - RNA, 16 nt, Human
gggauuacccaagcaa

SEQ ID NO: 2922955 - RNA, 22 nt, Human
aaaacucgaggacuguauuugu

SEQ ID NO: 2922956 - RNA, 16 nt, Human
gggaagcuacagguua

SEQ ID NO: 2922957 - RNA, 14 nt, Human
gcuacaaagaagac

SEQ ID NO: 2922958 - RNA, 15 nt, Human
gcuacaaagaagaca

SEQ ID NO: 2922959 - RNA, 16 nt, Human
gcuacaaagaagacau

SEQ ID NO: 2922960 - RNA, 17 nt, Human
gcuacaaagaagacaug

SEQ ID NO: 2922961 - RNA, 18 nt, Human
gcuacaaagaagacaugu

SEQ ID NO: 2922962 - RNA, 19 nt, Human
gcuacaaagaagacauguu

SEQ ID NO: 2922963 - RNA, 20 nt, Human
gcuacaaagaagacauguuu

SEQ ID NO: 2922964 - RNA, 22 nt, Human
gcuacaaagaagacauguuuua

SEQ ID NO: 2922965 - RNA, 20 nt, Human
gcgagaaccuaaguuucagu

SEQ ID NO: 2922966 - RNA, 15 nt, Human
ggaaaugaaagaaag

SEQ ID NO: 2922967 - RNA, 15 nt, Human
ggaaaccuuggugua

SEQ ID NO: 2922968 - RNA, 22 nt, Human
ggaaacaaagcuuagcaggaga

SEQ ID NO: 2922969 - RNA, 23 nt, Human
ggaaacaaagcuuagcaggagag

SEQ ID NO: 2922970 - RNA, 14 nt, Human
ggaaacaaagcuua

SEQ ID NO: 2922971 - RNA, 13 nt, Human
gcuguauucuucu

SEQ ID NO: 2922972 - RNA, 18 nt, Human
gcuuaaugacacuagcua

SEQ ID NO: 2922973 - RNA, 12 nt, Human
gcugaauaaaug

SEQ ID NO: 2922974 - RNA, 18 nt, Human
gcugaauaaaugucuuuu

SEQ ID NO: 2922975 - RNA, 13 nt, Human
gcugaauaaaugu

SEQ ID NO: 2922976 - RNA, 14 nt, Human
gcugaauaaauguc

SEQ ID NO: 2922977 - RNA, 16 nt, Human
gcugaauaaaugucuu

SEQ ID NO: 2922978 - RNA, 17 nt, Human
gcugaauaaaugucuuu

SEQ ID NO: 2922979 - RNA, 14 nt, Human
gauuacccaagcaa

SEQ ID NO: 2922980 - RNA, 21 nt, Human
gauuacccaagcaaaaucaug

SEQ ID NO: 2922981 - RNA, 20 nt, Human
gcaagugaauuuuucucuaa

SEQ ID NO: 2922982 - RNA, 20 nt, Human
gagaaucagaucauuucaaa

SEQ ID NO: 2922983 - RNA, 24 nt, Human
gagaagugacagggaagcuacagg

SEQ ID NO: 2922984 - RNA, 21 nt, Human
gagaagugacagggaagcuac

SEQ ID NO: 2922985 - RNA, 23 nt, Human
gagaagugacagggaagcuacag

SEQ ID NO: 2922986 - RNA, 15 nt, Human
gagaagugacaggga

SEQ ID NO: 2922987 - RNA, 16 nt, Human
gagaagugacagggaa

SEQ ID NO: 2922988 - RNA, 17 nt, Human
gagaagugacagggaag

SEQ ID NO: 2922989 - RNA, 19 nt, Human
gagaagugacagggaagcu

SEQ ID NO: 2922990 - RNA, 14 nt, Human
gaauuuuucucuaa

SEQ ID NO: 2922991 - RNA, 14 nt, Human
gaagcuacagguua

SEQ ID NO: 2922992 - RNA, 15 nt, Human
gaagcuacagguuac

SEQ ID NO: 2922993 - RNA, 19 nt, Human
gaagcuacagguuacaaca

SEQ ID NO: 2922994 - RNA, 21 nt, Human
gaagcuacagguuacaacaga

SEQ ID NO: 2922995 - RNA, 22 nt, Human
gaagcuacagguuacaacagau

SEQ ID NO: 2922996 - RNA, 23 nt, Human
gaagcuacagguuacaacagauu

SEQ ID NO: 2922997 - RNA, 22 nt, Human
gaagugacagggaagcuacagg

SEQ ID NO: 2922998 - RNA, 20 nt, Human
gaagugacagggaagcuaca

SEQ ID NO: 2922999 - RNA, 21 nt, Human
gaagugacagggaagcuacag

SEQ ID NO: 2923000 - RNA, 13 nt, Human
gaagugacaggga

SEQ ID NO: 2923001 - RNA, 14 nt, Human
gaagugacagggaa

SEQ ID NO: 2923002 - RNA, 15 nt, Human
gaagugacagggaag

SEQ ID NO: 2923003 - RNA, 18 nt, Human
gaagugacagggaagcua

SEQ ID NO: 2923004 - RNA, 12 nt, Human
gaagugacaggg

SEQ ID NO: 2923005 - RNA, 18 nt, Human
gaagggcaucaugcaucu

SEQ ID NO: 2923006 - RNA, 20 nt, Human
cugucacuguuucucugcug

SEQ ID NO: 2923007 - RNA, 19 nt, Human
cugucacuguuucucugcu

SEQ ID NO: 2923008 - RNA, 14 nt, Human
cugucacuguuucu

SEQ ID NO: 2923009 - RNA, 20 nt, Human
cugcuacaaagaagacaugu

SEQ ID NO: 2923010 - RNA, 22 nt, Human
cugcuacaaagaagacauguuu

SEQ ID NO: 2923011 - RNA, 15 nt, Human
cugcuacaaagaaga

SEQ ID NO: 2923012 - RNA, 17 nt, Human
cugcuacaaagaagaca

SEQ ID NO: 2923013 - RNA, 18 nt, Human
cugcuacaaagaagacau

SEQ ID NO: 2923014 - RNA, 19 nt, Human
cugcuacaaagaagacaug

SEQ ID NO: 2923015 - RNA, 12 nt, Human
cugcuacaaaga

SEQ ID NO: 2923016 - RNA, 17 nt, Human
cugcauugagaacugca

SEQ ID NO: 2923017 - RNA, 19 nt, Human
cagaucauuucaaaacuca

SEQ ID NO: 2923018 - RNA, 18 nt, Human
cagggugaugccagguuc

SEQ ID NO: 2923019 - RNA, 15 nt, Human
cagggugaugccagg

SEQ ID NO: 2923020 - RNA, 16 nt, Human
cagggugaugccaggu

SEQ ID NO: 2923021 - RNA, 23 nt, Human
ccaccagacugacaaauguguau

SEQ ID NO: 2923022 - RNA, 17 nt, Human
cauuuccaaauucacaa

SEQ ID NO: 2923023 - RNA, 13 nt, Human
caucuuacugaag

SEQ ID NO: 2923024 - RNA, 15 nt, Human
caucuuacugaaggu

SEQ ID NO: 2923025 - RNA, 14 nt, Human
caucuuacugaagg

SEQ ID NO: 2923026 - RNA, 19 nt, Human
cacugacacaaaaaguaga

SEQ ID NO: 2923027 - RNA, 18 nt, Human
auuguuggcacauccuau

SEQ ID NO: 2923028 - RNA, 17 nt, Human
auuagccacaaaauugg

SEQ ID NO: 2923029 - RNA, 20 nt, Human
auuagcuuuacuguuuguua

SEQ ID NO: 2923030 - RNA, 15 nt, Human
auuagcuuuacuguu

SEQ ID NO: 2923031 - RNA, 23 nt, Human
auuugauucuguguguuuucaua

SEQ ID NO: 2923032 - RNA, 15 nt, Human
auuugcgaaugguuc

SEQ ID NO: 2923033 - RNA, 13 nt, Human
caaacagccacac

SEQ ID NO: 2923034 - RNA, 15 nt, Human
caaaugcuguauucu

SEQ ID NO: 2923035 - RNA, 20 nt, Human
cgugacgcugaauaaauguc

SEQ ID NO: 2923036 - RNA, 14 nt, Human
cgugacgcugaaua

SEQ ID NO: 2923037 - RNA, 16 nt, Human
cgugacgcugaauaaa

SEQ ID NO: 2923038 - RNA, 19 nt, Human
cgugacgcugaauaaaugu

SEQ ID NO: 2923039 - RNA, 19 nt, Human
cuacaaagaagacauguuu

SEQ ID NO: 2923040 - RNA, 20 nt, Human
cuacaaagaagacauguuuu

SEQ ID NO: 2923041 - RNA, 14 nt, Human
cuacaaagaagaca

SEQ ID NO: 2923042 - RNA, 15 nt, Human
cuacaaagaagacau

SEQ ID NO: 2923043 - RNA, 16 nt, Human
cuacaaagaagacaug

SEQ ID NO: 2923044 - RNA, 18 nt, Human
cuacaaagaagacauguu

SEQ ID NO: 2923045 - RNA, 22 nt, Human
cuaauuguauaacagguuauuu

SEQ ID NO: 2923046 - RNA, 19 nt, Human
cuaauuguauaacagguua

SEQ ID NO: 2923047 - RNA, 20 nt, Human
cuaauuguauaacagguuau

SEQ ID NO: 2923048 - RNA, 13 nt, Human
cuaauuguauaac

SEQ ID NO: 2923049 - RNA, 15 nt, Human
cuaauuguauaacag

SEQ ID NO: 2923050 - RNA, 16 nt, Human
cuaauuguauaacagg

SEQ ID NO: 2923051 - RNA, 17 nt, Human
cuaauuguauaacaggu

SEQ ID NO: 2923052 - RNA, 18 nt, Human
cuaauuguauaacagguu

SEQ ID NO: 2923053 - RNA, 12 nt, Human
cgaccucggugg

SEQ ID NO: 2923054 - RNA, 13 nt, Human
ccuuuuuccuucc

SEQ ID NO: 2923055 - RNA, 21 nt, Human
cucugaagaguggguuucaca

SEQ ID NO: 2923056 - RNA, 13 nt, Human
cucugaagagugg

SEQ ID NO: 2923057 - RNA, 23 nt, Human
cucugaagaguggguuucacaag

SEQ ID NO: 2923058 - RNA, 22 nt, Human
cucugaagaguggguuucacaa

SEQ ID NO: 2923059 - RNA, 15 nt, Human
cugaagguaaaauug

SEQ ID NO: 2923060 - RNA, 17 nt, Human
cugaagguaaaauugaa

SEQ ID NO: 2923061 - RNA, 21 nt, Human
augaauuuuuuucaucuucuc

SEQ ID NO: 2923062 - RNA, 13 nt, Human
auccuaugcaaua

SEQ ID NO: 2923063 - RNA, 15 nt, Human
aucuuacugaaggua

SEQ ID NO: 2923064 - RNA, 14 nt, Human
aucuuacugaaggu

SEQ ID NO: 2923065 - RNA, 20 nt, Human
aucugguagggggaaaaugu

SEQ ID NO: 2923066 - RNA, 16 nt, Human
uuuauuacaucuuuca

SEQ ID NO: 2923067 - RNA, 18 nt, Human
uuuccccaacagugugaa

SEQ ID NO: 2923068 - RNA, 19 nt, Human
uuuccccaacagugugaag

SEQ ID NO: 2923069 - RNA, 14 nt, Human
uuuccccaacagug

SEQ ID NO: 2923070 - RNA, 15 nt, Human
uuuccccaacagugu

SEQ ID NO: 2923071 - RNA, 15 nt, Human
augcauaaagucagu

SEQ ID NO: 2923072 - RNA, 13 nt, Human
uuuaauucucuug

SEQ ID NO: 2923073 - RNA, 11 nt, Human
uuuaauucucu

SEQ ID NO: 2923074 - RNA, 23 nt, Human
uuuaauucauguuucuuaaaugg

SEQ ID NO: 2923075 - RNA, 16 nt, Human
uuuaauucauguuucu

SEQ ID NO: 2923076 - RNA, 14 nt, Human
uuuaauucauguuu

SEQ ID NO: 2923077 - RNA, 14 nt, Human
uugugacuaauugu

SEQ ID NO: 2923078 - RNA, 16 nt, Human
uugugacuaauuguau

SEQ ID NO: 2923079 - RNA, 20 nt, Human
uugugacuaauuguauaaca

SEQ ID NO: 2923080 - RNA, 22 nt, Human
uugugacuaauuguauaacagg

SEQ ID NO: 2923081 - RNA, 23 nt, Human
uugugacuaauuguauaacaggu

SEQ ID NO: 2923082 - RNA, 20 nt, Human
uugugaccugaaguucacca

SEQ ID NO: 2923083 - RNA, 19 nt, Human
aucaauaaacgauuuaauu

SEQ ID NO: 2923084 - RNA, 14 nt, Human
aucaauaaacgauu

SEQ ID NO: 2923085 - RNA, 15 nt, Human
aucaauaaacgauuu

SEQ ID NO: 2923086 - RNA, 21 nt, Human
uucccuuuuacauacugcugu

SEQ ID NO: 2923087 - RNA, 19 nt, Human
uucccuuuuacauacugcu

SEQ ID NO: 2923088 - RNA, 18 nt, Human
uucccuuuuacauacugc

SEQ ID NO: 2923089 - RNA, 17 nt, Human
uucccuuuuacauacug

SEQ ID NO: 2923090 - RNA, 17 nt, Human
uuccuucacauccugug

SEQ ID NO: 2923091 - RNA, 17 nt, Human
uuaguuuuuguaauuua

SEQ ID NO: 2923092 - RNA, 18 nt, Human
uuaguuuuuguaauuuau

SEQ ID NO: 2923093 - RNA, 17 nt, Human
uucaaaaguugaaauua

SEQ ID NO: 2923094 - RNA, 16 nt, Human
uucaaaaguugaaauu

SEQ ID NO: 2923095 - RNA, 19 nt, Human
uucacauccuguguuucua

SEQ ID NO: 2923096 - RNA, 21 nt, Human
uucacauccuguguuucuagg

SEQ ID NO: 2923097 - RNA, 15 nt, Human
auaguucaaagccaa

SEQ ID NO: 2923098 - RNA, 16 nt, Human
auaguuacuguuguga

SEQ ID NO: 2923099 - RNA, 12 nt, Human
auaguuacuguu

SEQ ID NO: 2923100 - RNA, 18 nt, Human
auauaucuaaauugaaua

SEQ ID NO: 2923101 - RNA, 19 nt, Human
auauaucuaaauugaauaa

SEQ ID NO: 2923102 - RNA, 18 nt, Human
auuuggaauuuauauaca

SEQ ID NO: 2923103 - RNA, 16 nt, Human
auuuagggaacugcuu

SEQ ID NO: 2923104 - RNA, 18 nt, Human
auuuagggaacugcuuga

SEQ ID NO: 2923105 - RNA, 20 nt, Human
auuuuauuacaucuuucaca

SEQ ID NO: 2923106 - RNA, 21 nt, Human
auuuuacaauugaaaugacua

SEQ ID NO: 2923107 - RNA, 17 nt, Human
auuuuacaauugaaaug

SEQ ID NO: 2923108 - RNA, 13 nt, Human
auuuuacaauuga

SEQ ID NO: 2923109 - RNA, 12 nt, Human
auuuuaauuuau

SEQ ID NO: 2923110 - RNA, 13 nt, Human
auuguauaacagg

SEQ ID NO: 2923111 - RNA, 14 nt, Human
auuguauaacaggu

SEQ ID NO: 2923112 - RNA, 15 nt, Human
auuguauaacagguu

SEQ ID NO: 2923113 - RNA, 16 nt, Human
auuguauaacagguua

SEQ ID NO: 2923114 - RNA, 17 nt, Human
auuguauaacagguuau

SEQ ID NO: 2923115 - RNA, 18 nt, Human
auuguauaacagguuauu

SEQ ID NO: 2923116 - RNA, 13 nt, Human
auugcuaaaugua

SEQ ID NO: 2923117 - RNA, 14 nt, Human
auugcuaaauguaa

SEQ ID NO: 2923118 - RNA, 16 nt, Human
auugcuaaauguaaca

SEQ ID NO: 2923119 - RNA, 17 nt, Human
auugcuaaauguaacag

SEQ ID NO: 2923120 - RNA, 18 nt, Human
auugcuaaauguaacagu

SEQ ID NO: 2923121 - RNA, 23 nt, Human
auugucuucggaaaccuuggugu

SEQ ID NO: 2923122 - RNA, 18 nt, Human
auugucuucggaaaccuu

SEQ ID NO: 2923123 - RNA, 20 nt, Human
auugucuucggaaaccuugg

SEQ ID NO: 2923124 - RNA, 16 nt, Human
auucaaaaguugaaau

SEQ ID NO: 2923125 - RNA, 21 nt, Human
auuauagaugggaaugaagcu

SEQ ID NO: 2923126 - RNA, 21 nt, Human
auuaucauguguaaucaauaa

SEQ ID NO: 2923127 - RNA, 22 nt, Human
auuaucauguguaaucaauaaa

SEQ ID NO: 2923128 - RNA, 15 nt, Human
auuaucaugcaaaug

SEQ ID NO: 2923129 - RNA, 17 nt, Human
auuaucaugcaaaugcu

SEQ ID NO: 2923130 - RNA, 12 nt, Human
auuaucaugugu

SEQ ID NO: 2923131 - RNA, 13 nt, Human
auuaucaugugua

SEQ ID NO: 2923132 - RNA, 14 nt, Human
auuaucauguguaa

SEQ ID NO: 2923133 - RNA, 16 nt, Human
auuaucauguguaauc

SEQ ID NO: 2923134 - RNA, 17 nt, Human
auuaucauguguaauca

SEQ ID NO: 2923135 - RNA, 19 nt, Human
auuaucauguguaaucaau

SEQ ID NO: 2923136 - RNA, 22 nt, Human
uuuuaguuucuguucuguggaa

SEQ ID NO: 2923137 - RNA, 20 nt, Human
uuuuaguuucuguucugugg

SEQ ID NO: 2923138 - RNA, 21 nt, Human
uuuuaguuucuguucugugga

SEQ ID NO: 2923139 - RNA, 18 nt, Human
uuuuaguuucuguucugu

SEQ ID NO: 2923140 - RNA, 19 nt, Human
uuuuaguuucuguucugug

SEQ ID NO: 2923141 - RNA, 15 nt, Human
auuaaccauagaugu

SEQ ID NO: 2923142 - RNA, 18 nt, Human
auuaaagcuaaaguaucu

SEQ ID NO: 2923143 - RNA, 17 nt, Human
auuaaagcuaaaguauc

SEQ ID NO: 2923144 - RNA, 18 nt, Human
auguuuucuuugcuuuaa

SEQ ID NO: 2923145 - RNA, 22 nt, Human
auuaaaagggauuacccaagca

SEQ ID NO: 2923146 - RNA, 20 nt, Human
uuacugaagguaaaauugaa

SEQ ID NO: 2923147 - RNA, 19 nt, Human
uuacugaagguaaaauuga

SEQ ID NO: 2923148 - RNA, 18 nt, Human
uuacugaagguaaaauug

SEQ ID NO: 2923149 - RNA, 13 nt, Human
uuacucugaaggg

SEQ ID NO: 2923150 - RNA, 22 nt, Human
uuacucugaagggcaucaugca

SEQ ID NO: 2923151 - RNA, 20 nt, Human
uuaguuucuguucuguggaa

SEQ ID NO: 2923152 - RNA, 21 nt, Human
uuaguuucuguucuguggaaa

SEQ ID NO: 2923153 - RNA, 15 nt, Human
uuaguuucuguucug

SEQ ID NO: 2923154 - RNA, 19 nt, Human
uuaguuucuguucugugga

SEQ ID NO: 2923155 - RNA, 13 nt, Human
uuagccacaaaau

SEQ ID NO: 2923156 - RNA, 14 nt, Human
aguucaccauuaaa

SEQ ID NO: 2923157 - RNA, 21 nt, Human
aguuagaauuccuucagggug

SEQ ID NO: 2923158 - RNA, 14 nt, Human
aguuagaauuccuu

SEQ ID NO: 2923159 - RNA, 15 nt, Human
aguuagaauuccuuc

SEQ ID NO: 2923160 - RNA, 19 nt, Human
aguuagaauuccuucaggg

SEQ ID NO: 2923161 - RNA, 16 nt, Human
aguuacucugaagggc

SEQ ID NO: 2923162 - RNA, 13 nt, Human
aguuacuguugug

SEQ ID NO: 2923163 - RNA, 17 nt, Human
aguuacuguugugaccu

SEQ ID NO: 2923164 - RNA, 15 nt, Human
aguuacucugaaggg

SEQ ID NO: 2923165 - RNA, 17 nt, Human
agugcccaacuguuaua

SEQ ID NO: 2923166 - RNA, 15 nt, Human
agugcccaacuguua

SEQ ID NO: 2923167 - RNA, 15 nt, Human
agugauuguuggcac

SEQ ID NO: 2923168 - RNA, 20 nt, Human
agggccuagcugcuacaaag

SEQ ID NO: 2923169 - RNA, 21 nt, Human
agggccuagcugcuacaaaga

SEQ ID NO: 2923170 - RNA, 15 nt, Human
agggccuagcugcua

SEQ ID NO: 2923171 - RNA, 16 nt, Human
agggccuagcugcuac

SEQ ID NO: 2923172 - RNA, 18 nt, Human
agggccuagcugcuacaa

SEQ ID NO: 2923173 - RNA, 19 nt, Human
agggccuagcugcuacaaa

SEQ ID NO: 2923174 - RNA, 21 nt, Human
agucuacucuuaagccaucuu

SEQ ID NO: 2923175 - RNA, 19 nt, Human
agucuacucuuaagccauc

SEQ ID NO: 2923176 - RNA, 20 nt, Human
agucuacucuuaagccaucu

SEQ ID NO: 2923177 - RNA, 13 nt, Human
agucuacucuuaa

SEQ ID NO: 2923178 - RNA, 18 nt, Human
agucuacucuuaagccau

SEQ ID NO: 2923179 - RNA, 17 nt, Human
uguccuuuuuguuauua

SEQ ID NO: 2923180 - RNA, 16 nt, Human
uguccuuuuuguuauu

SEQ ID NO: 2923181 - RNA, 15 nt, Human
uguacuuuuuccaga

SEQ ID NO: 2923182 - RNA, 15 nt, Human
agcuuuacuguuugu

SEQ ID NO: 2923183 - RNA, 12 nt, Human
ugcuacaaagaa

SEQ ID NO: 2923184 - RNA, 16 nt, Human
ugcuacaaagaagaca

SEQ ID NO: 2923185 - RNA, 17 nt, Human
ugcuacaaagaagacau

SEQ ID NO: 2923186 - RNA, 18 nt, Human
ugcuacaaagaagacaug

SEQ ID NO: 2923187 - RNA, 20 nt, Human
ugcuacaaagaagacauguu

SEQ ID NO: 2923188 - RNA, 21 nt, Human
ugcuacaaagaagacauguuu

SEQ ID NO: 2923189 - RNA, 23 nt, Human
ugcuacaaagaagacauguuuua

SEQ ID NO: 2923190 - RNA, 20 nt, Human
ugcuuggguggagaagccau

SEQ ID NO: 2923191 - RNA, 21 nt, Human
ugcuuggguggagaagccauu

SEQ ID NO: 2923192 - RNA, 19 nt, Human
ugcuuggguggagaagcca

SEQ ID NO: 2923193 - RNA, 22 nt, Human
ugcuuggguggagaagccauug

SEQ ID NO: 2923194 - RNA, 14 nt, Human
uggagaagccauug

SEQ ID NO: 2923195 - RNA, 17 nt, Human
uggagaagccauugucu

SEQ ID NO: 2923196 - RNA, 18 nt, Human
uggagaagccauugucuu

SEQ ID NO: 2923197 - RNA, 19 nt, Human
uggagaagccauugucuuc

SEQ ID NO: 2923198 - RNA, 12 nt, Human
uggagaagccau

SEQ ID NO: 2923199 - RNA, 13 nt, Human
uggagaagccauu

SEQ ID NO: 2923200 - RNA, 17 nt, Human
ugcauugagaacugcau

SEQ ID NO: 2923201 - RNA, 15 nt, Human
ugcauugagaacugc

SEQ ID NO: 2923202 - RNA, 14 nt, Human
ugcccaacuguuau

SEQ ID NO: 2923203 - RNA, 14 nt, Human
ugcacacagugcuu

SEQ ID NO: 2923204 - RNA, 19 nt, Human
ugaucgugacgcugaauaa

SEQ ID NO: 2923205 - RNA, 20 nt, Human
ugaucgugacgcugaauaaa

SEQ ID NO: 2923206 - RNA, 21 nt, Human
ugaucgugacgcugaauaaau

SEQ ID NO: 2923207 - RNA, 23 nt, Human
ugaucgugacgcugaauaaaugu

SEQ ID NO: 2923208 - RNA, 15 nt, Human
ugaucgugacgcuga

SEQ ID NO: 2923209 - RNA, 16 nt, Human
ugaucgugacgcugaa

SEQ ID NO: 2923210 - RNA, 18 nt, Human
agagccagagaagugaca

SEQ ID NO: 2923211 - RNA, 20 nt, Human
agagccagagaagugacagg

SEQ ID NO: 2923212 - RNA, 21 nt, Human
agagccagagaagugacaggg

SEQ ID NO: 2923213 - RNA, 13 nt, Human
ucuucuuaacuua

SEQ ID NO: 2923214 - RNA, 21 nt, Human
ucuucucuggcgacaguuuuc

SEQ ID NO: 2923215 - RNA, 22 nt, Human
ucuugguaaauuuccccaacag

SEQ ID NO: 2923216 - RNA, 13 nt, Human
agaugcucuuuua

SEQ ID NO: 2923217 - RNA, 19 nt, Human
agauuucuugaguuuuguu

SEQ ID NO: 2923218 - RNA, 17 nt, Human
ugagaaucagaucauuu

SEQ ID NO: 2923219 - RNA, 17 nt, Human
ugagaacugcauauguu

SEQ ID NO: 2923220 - RNA, 20 nt, Human
ugagaacugcauauguuucg

SEQ ID NO: 2923221 - RNA, 15 nt, Human
agauaauaugagaau

SEQ ID NO: 2923222 - RNA, 17 nt, Human
agauaauaugagaauca

SEQ ID NO: 2923223 - RNA, 13 nt, Human
ugaauuuuucucu

SEQ ID NO: 2923224 - RNA, 15 nt, Human
ugaauuuuucucuaa

SEQ ID NO: 2923225 - RNA, 21 nt, Human
ugaagguaaaauugaaaggca

SEQ ID NO: 2923226 - RNA, 12 nt, Human
ugaauaaauguc

SEQ ID NO: 2923227 - RNA, 14 nt, Human
ugaauaaaugucuu

SEQ ID NO: 2923228 - RNA, 17 nt, Human
agaaggauguacauuuc

SEQ ID NO: 2923229 - RNA, 17 nt, Human
agaagugacagggaagc

SEQ ID NO: 2923230 - RNA, 18 nt, Human
agaagugacagggaagcu

SEQ ID NO: 2923231 - RNA, 19 nt, Human
agaagugacagggaagcua

SEQ ID NO: 2923232 - RNA, 22 nt, Human
agaagugacagggaagcuacag

SEQ ID NO: 2923233 - RNA, 23 nt, Human
agaagugacagggaagcuacagg

SEQ ID NO: 2923234 - RNA, 16 nt, Human
agaaggauguacauuu

SEQ ID NO: 2923235 - RNA, 21 nt, Human
agaacugcauauguuucgcug

SEQ ID NO: 2923236 - RNA, 20 nt, Human
agaacugcauauguuucgcu

SEQ ID NO: 2923237 - RNA, 19 nt, Human
agaacugcauauguuucgc

SEQ ID NO: 2923238 - RNA, 15 nt, Human
agaacugcauauguu

SEQ ID NO: 2923239 - RNA, 20 nt, Human
agaagccauugucuucggaa

SEQ ID NO: 2923240 - RNA, 14 nt, Human
agaagccauugucu

SEQ ID NO: 2923241 - RNA, 15 nt, Human
agaagccauugucuu

SEQ ID NO: 2923242 - RNA, 10 nt, Human
agaagccauu

SEQ ID NO: 2923243 - RNA, 11 nt, Human
agaagccauug

SEQ ID NO: 2923244 - RNA, 12 nt, Human
agaagccauugu

SEQ ID NO: 2923245 - RNA, 23 nt, Human
agaaacaucaguuacucugaagg

SEQ ID NO: 2923246 - RNA, 21 nt, Human
agaaacaucaguuacucugaa

SEQ ID NO: 2923247 - RNA, 16 nt, Human
agaaacaucaguuacu

SEQ ID NO: 2923248 - RNA, 14 nt, Human
agaaacaucaguua

SEQ ID NO: 2923249 - RNA, 15 nt, Human
ucuagcaaauguuau

SEQ ID NO: 2923250 - RNA, 16 nt, Human
ucuagcaaauguuaug

SEQ ID NO: 2923251 - RNA, 19 nt, Human
ucgcugauauauguguuuu

SEQ ID NO: 2923252 - RNA, 22 nt, Human
ucgcugauauauguguuuuuca

SEQ ID NO: 2923253 - RNA, 13 nt, Human
acuguauuuguga

SEQ ID NO: 2923254 - RNA, 14 nt, Human
acuguauuugugac

SEQ ID NO: 2923255 - RNA, 15 nt, Human
acuguauuugugacu

SEQ ID NO: 2923256 - RNA, 16 nt, Human
acuguauuugugacua

SEQ ID NO: 2923257 - RNA, 17 nt, Human
acuguauuugugacuaa

SEQ ID NO: 2923258 - RNA, 20 nt, Human
acuguauuugugacuaauug

SEQ ID NO: 2923259 - RNA, 20 nt, Human
acuguauuuuuaccuuuuuc

SEQ ID NO: 2923260 - RNA, 22 nt, Human
acuguauuugugacuaauugua

SEQ ID NO: 2923261 - RNA, 23 nt, Human
acuguauuugugacuaauuguau

SEQ ID NO: 2923262 - RNA, 18 nt, Human
ucacuguuucucugcugu

SEQ ID NO: 2923263 - RNA, 20 nt, Human
ucacuguuucucugcuguug

SEQ ID NO: 2923264 - RNA, 20 nt, Human
ucagagacaggaagucuuca

SEQ ID NO: 2923265 - RNA, 23 nt, Human
ucagagacaggaagucuucaggg

SEQ ID NO: 2923266 - RNA, 19 nt, Human
ucaaagguagccaucaugg

SEQ ID NO: 2923267 - RNA, 15 nt, Human
acaucuuucacauug

SEQ ID NO: 2923268 - RNA, 13 nt, Human
acaucuuucacau

SEQ ID NO: 2923269 - RNA, 12 nt, Human
acaucuuucaca

SEQ ID NO: 2923270 - RNA, 22 nt, Human
uccauugguuuaccugugaaau

SEQ ID NO: 2923271 - RNA, 18 nt, Human
acgcugaauaaaugucuu

SEQ ID NO: 2923272 - RNA, 19 nt, Human
acgcugaauaaaugucuuu

SEQ ID NO: 2923273 - RNA, 12 nt, Human
acgcugaauaaa

SEQ ID NO: 2923274 - RNA, 13 nt, Human
acgcugaauaaau

SEQ ID NO: 2923275 - RNA, 15 nt, Human
acgcugaauaaaugu

SEQ ID NO: 2923276 - RNA, 16 nt, Human
acgcugaauaaauguc

SEQ ID NO: 2923277 - RNA, 18 nt, Human
uccaacaaaggguuuuaa

SEQ ID NO: 2923278 - RNA, 22 nt, Human
uccaacaaaggguuuuaaugua

SEQ ID NO: 2923279 - RNA, 13 nt, Human
uccaaauucacaa

SEQ ID NO: 2923280 - RNA, 20 nt, Human
accugcuuggguggagaagc

SEQ ID NO: 2923281 - RNA, 18 nt, Human
accugcuuggguggagaa

SEQ ID NO: 2923282 - RNA, 23 nt, Human
accugagcccggaugcuucucca

SEQ ID NO: 2923283 - RNA, 21 nt, Human
accugagcccggaugcuucuc

SEQ ID NO: 2923284 - RNA, 20 nt, Human
uccucuccgcaguuccuguc

SEQ ID NO: 2923285 - RNA, 19 nt, Human
acucuucuuaacuuaaauu

SEQ ID NO: 2923286 - RNA, 20 nt, Human
acucuucuuaacuuaaauuu

SEQ ID NO: 2923287 - RNA, 21 nt, Human
acucgaggacuguauuuguga

SEQ ID NO: 2923288 - RNA, 19 nt, Human
acucgaggacuguauuugu

SEQ ID NO: 2923289 - RNA, 21 nt, Human
acucagaaauuuaauucaugu

SEQ ID NO: 2923290 - RNA, 19 nt, Human
uagcuuuacuguuuguuau

SEQ ID NO: 2923291 - RNA, 15 nt, Human
acaauauuguuucua

SEQ ID NO: 2923292 - RNA, 14 nt, Human
acaauauuguuucu

SEQ ID NO: 2923293 - RNA, 16 nt, Human
uagggaaaugaaagaa

SEQ ID NO: 2923294 - RNA, 13 nt, Human
uagggaaaugaaa

SEQ ID NO: 2923295 - RNA, 21 nt, Human
uaggaaacaaagcuuagcagg

SEQ ID NO: 2923296 - RNA, 18 nt, Human
acaaauacucauguguau

SEQ ID NO: 2923297 - RNA, 14 nt, Human
acaaauacucaugu

SEQ ID NO: 2923298 - RNA, 15 nt, Human
acaaauacucaugug

SEQ ID NO: 2923299 - RNA, 16 nt, Human
acaaauacucaugugu

SEQ ID NO: 2923300 - RNA, 17 nt, Human
acaaauacucaugugua

SEQ ID NO: 2923301 - RNA, 13 nt, Human
acaaauacucaug

SEQ ID NO: 2923302 - RNA, 13 nt, Human
aauuuuaauuuau

SEQ ID NO: 2923303 - RNA, 15 nt, Human
aauuuuaauuuauuu

SEQ ID NO: 2923304 - RNA, 21 nt, Human
uagaaggauguacauuuccaa

SEQ ID NO: 2923305 - RNA, 17 nt, Human
uagaaggauguacauuu

SEQ ID NO: 2923306 - RNA, 14 nt, Human
uagacaaauacuca

SEQ ID NO: 2923307 - RNA, 15 nt, Human
uagacaaauacucau

SEQ ID NO: 2923308 - RNA, 16 nt, Human
uagacaaauacucaug

SEQ ID NO: 2923309 - RNA, 17 nt, Human
uagacaaauacucaugu

SEQ ID NO: 2923310 - RNA, 18 nt, Human
uagacaaauacucaugug

SEQ ID NO: 2923311 - RNA, 19 nt, Human
uagacaaauacucaugugu

SEQ ID NO: 2923312 - RNA, 20 nt, Human
uagacaaauacucaugugua

SEQ ID NO: 2923313 - RNA, 13 nt, Human
uagaaaaagcagu

SEQ ID NO: 2923314 - RNA, 14 nt, Human
aauucauguuucuu

SEQ ID NO: 2923315 - RNA, 21 nt, Human
acagauuugugaacucagcca

SEQ ID NO: 2923316 - RNA, 22 nt, Human
acagauuugugaacucagccaa

SEQ ID NO: 2923317 - RNA, 13 nt, Human
acagauuugugaa

SEQ ID NO: 2923318 - RNA, 14 nt, Human
acagauuugugaac

SEQ ID NO: 2923319 - RNA, 15 nt, Human
acagauuugugaacu

SEQ ID NO: 2923320 - RNA, 12 nt, Human
acagauuuguga

SEQ ID NO: 2923321 - RNA, 13 nt, Human
uauaucuaaauug

SEQ ID NO: 2923322 - RNA, 17 nt, Human
uauaucuaaauugaaua

SEQ ID NO: 2923323 - RNA, 18 nt, Human
uauaucuaaauugaauaa

SEQ ID NO: 2923324 - RNA, 16 nt, Human
uauagaugggaaugaa

SEQ ID NO: 2923325 - RNA, 17 nt, Human
uauagaugggaaugaag

SEQ ID NO: 2923326 - RNA, 19 nt, Human
uauagaugggaaugaagcu

SEQ ID NO: 2923327 - RNA, 13 nt, Human
uaccugugaaaua

SEQ ID NO: 2923328 - RNA, 15 nt, Human
uaccagauaaaauua

SEQ ID NO: 2923329 - RNA, 21 nt, Human
uacauuuccaaauucacaagu

SEQ ID NO: 2923330 - RNA, 20 nt, Human
aaugugcuguguaaaguuag

SEQ ID NO: 2923331 - RNA, 21 nt, Human
aaugugcuguguaaaguuagu

SEQ ID NO: 2923332 - RNA, 12 nt, Human
aaugugcugugu

SEQ ID NO: 2923333 - RNA, 13 nt, Human
aaugugcugugua

SEQ ID NO: 2923334 - RNA, 14 nt, Human
aaugugcuguguaa

SEQ ID NO: 2923335 - RNA, 15 nt, Human
aaugugcuguguaaa

SEQ ID NO: 2923336 - RNA, 16 nt, Human
aaugugcuguguaaag

SEQ ID NO: 2923337 - RNA, 17 nt, Human
aaugugcuguguaaagu

SEQ ID NO: 2923338 - RNA, 18 nt, Human
aaugugcuguguaaaguu

SEQ ID NO: 2923339 - RNA, 19 nt, Human
aaugugcuguguaaaguua

SEQ ID NO: 2923340 - RNA, 17 nt, Human
aaugacuaaaaaacaaa

SEQ ID NO: 2923341 - RNA, 20 nt, Human
aaugacuaaaaaacaaagaa

SEQ ID NO: 2923342 - RNA, 19 nt, Human
uacaauuauaucaguccuc

SEQ ID NO: 2923343 - RNA, 15 nt, Human
uacaauuauaucagu

SEQ ID NO: 2923344 - RNA, 13 nt, Human
uacaauugaaaug

SEQ ID NO: 2923345 - RNA, 14 nt, Human
uacaauugaaauga

SEQ ID NO: 2923346 - RNA, 22 nt, Human
uacaauuauuuuuacaguucuc

SEQ ID NO: 2923347 - RNA, 18 nt, Human
uacaauuauuuuuacagu

SEQ ID NO: 2923348 - RNA, 17 nt, Human
uaaguuucaguugauuu

SEQ ID NO: 2923349 - RNA, 16 nt, Human
uaacagguuauuuuag

SEQ ID NO: 2923350 - RNA, 21 nt, Human
uaacagguuauuuuaguuucu

SEQ ID NO: 2923351 - RNA, 22 nt, Human
uaacagguuauuuuaguuucug

SEQ ID NO: 2923352 - RNA, 23 nt, Human
uaacagguuauuuuaguuucugu

SEQ ID NO: 2923353 - RNA, 22 nt, Human
aauaguucaaagccaaguuuau

SEQ ID NO: 2923354 - RNA, 15 nt, Human
aauacauucugcuuu

SEQ ID NO: 2923355 - RNA, 13 nt, Human
aagcaguaacuga

SEQ ID NO: 2923356 - RNA, 17 nt, Human
aagcauuccaacaaagg

SEQ ID NO: 2923357 - RNA, 13 nt, Human
aagcauuccaaca

SEQ ID NO: 2923358 - RNA, 14 nt, Human
aagcauuccaacaa

SEQ ID NO: 2923359 - RNA, 23 nt, Human
guuacuguugugaccugaaguuc

SEQ ID NO: 2923360 - RNA, 16 nt, Human
guuacuguugugaccu

SEQ ID NO: 2923361 - RNA, 18 nt, Human
guuuuuccacuacugcua

SEQ ID NO: 2923362 - RNA, 17 nt, Human
guuuuuccacuacugcu

SEQ ID NO: 2923363 - RNA, 16 nt, Human
guuuuuccacuacugc

SEQ ID NO: 2923364 - RNA, 15 nt, Human
guuuuuccacuacug

SEQ ID NO: 2923365 - RNA, 12 nt, Human
aagucuucaggg

SEQ ID NO: 2923366 - RNA, 13 nt, Human
aaggaguagaaaa

SEQ ID NO: 2923367 - RNA, 12 nt, Human
aaggcauucucu

SEQ ID NO: 2923368 - RNA, 17 nt, Human
aaggcauucucugaaga

SEQ ID NO: 2923369 - RNA, 14 nt, Human
aaggcauucucuga

SEQ ID NO: 2923370 - RNA, 15 nt, Human
guuucucugcuguug

SEQ ID NO: 2923371 - RNA, 17 nt, Human
guaucaggacgagaaug

SEQ ID NO: 2923372 - RNA, 21 nt, Human
guauccauuaucauguguaau

SEQ ID NO: 2923373 - RNA, 18 nt, Human
guauccauuaucaugugu

SEQ ID NO: 2923374 - RNA, 19 nt, Human
guauccauuaucaugugua

SEQ ID NO: 2923375 - RNA, 16 nt, Human
guauccauuaucaugu

SEQ ID NO: 2923376 - RNA, 17 nt, Human
guauccauuaucaugug

SEQ ID NO: 2923377 - RNA, 13 nt, Human
aaauguaacaguc

SEQ ID NO: 2923378 - RNA, 16 nt, Human
aaauguaacagucuga

SEQ ID NO: 2923379 - RNA, 17 nt, Human
aaauguaacagucugau

SEQ ID NO: 2923380 - RNA, 18 nt, Human
guaaauuuccccaacagu

SEQ ID NO: 2923381 - RNA, 19 nt, Human
guaaauuuccccaacagug

SEQ ID NO: 2923382 - RNA, 18 nt, Human
guaacagucugaucguga

SEQ ID NO: 2923383 - RNA, 20 nt, Human
aaauguguaucggaugcuuu

SEQ ID NO: 2923384 - RNA, 13 nt, Human
aaauguguauuuu

SEQ ID NO: 2923385 - RNA, 22 nt, Human
aaaugucuuuuuuuuaaugugc

SEQ ID NO: 2923386 - RNA, 20 nt, Human
aaaugucuuuuuuuuaaugu

SEQ ID NO: 2923387 - RNA, 14 nt, Human
aaauuuuaauuuau

SEQ ID NO: 2923388 - RNA, 15 nt, Human
gugaacucagccaag

SEQ ID NO: 2923389 - RNA, 16 nt, Human
gugaacucagccaagc

SEQ ID NO: 2923390 - RNA, 17 nt, Human
gugaacucagccaagca

SEQ ID NO: 2923391 - RNA, 18 nt, Human
gugaacucagccaagcac

SEQ ID NO: 2923392 - RNA, 19 nt, Human
gugaacucagccaagcaca

SEQ ID NO: 2923393 - RNA, 21 nt, Human
gugaacucagccaagcacagu

SEQ ID NO: 2923394 - RNA, 22 nt, Human
gugaacucagccaagcacagug

SEQ ID NO: 2923395 - RNA, 23 nt, Human
gugaacucagccaagcacagugg

SEQ ID NO: 2923396 - RNA, 17 nt, Human
aacuggcaguuuuccau

SEQ ID NO: 2923397 - RNA, 15 nt, Human
gugaugccagguucu

SEQ ID NO: 2923398 - RNA, 18 nt, Human
gugaugccagguucuauu

SEQ ID NO: 2923399 - RNA, 23 nt, Human
gugaugccagguucuauuuggaa

SEQ ID NO: 2923400 - RNA, 15 nt, Human
gucuucggaaaccuu

SEQ ID NO: 2923401 - RNA, 17 nt, Human
gucuucggaaaccuugg

SEQ ID NO: 2923402 - RNA, 14 nt, Human
gugaacucagccaa

SEQ ID NO: 2923403 - RNA, 14 nt, Human
aacucgaggacugu

SEQ ID NO: 2923404 - RNA, 19 nt, Human
aacucgaggacuguauuug

SEQ ID NO: 2923405 - RNA, 20 nt, Human
aacucgaggacuguauuugu

SEQ ID NO: 2923406 - RNA, 22 nt, Human
aacucgaggacuguauuuguga

SEQ ID NO: 2923407 - RNA, 22 nt, Human
aacucauuuccuauguaacugc

SEQ ID NO: 2923408 - RNA, 20 nt, Human
aaccuugguguaguugaacu

SEQ ID NO: 2923409 - RNA, 18 nt, Human
aaccuugguguaguugaa

SEQ ID NO: 2923410 - RNA, 16 nt, Human
acauacaauuauuuuu

SEQ ID NO: 2923411 - RNA, 20 nt, Human
acaucaguuacucugaaggg

SEQ ID NO: 2923412 - RNA, 18 nt, Human
acaucaguuacucugaag

SEQ ID NO: 2923413 - RNA, 15 nt, Human
acaucaguuacucug

SEQ ID NO: 2923414 - RNA, 16 nt, Human
acagguuacaacagau

SEQ ID NO: 2923415 - RNA, 17 nt, Human
acagguuacaacagauu

SEQ ID NO: 2923416 - RNA, 12 nt, Human
acagguuacaac

SEQ ID NO: 2923417 - RNA, 13 nt, Human
acagguuacaaca

SEQ ID NO: 2923418 - RNA, 14 nt, Human
acagguuacaacag

SEQ ID NO: 2923419 - RNA, 15 nt, Human
acagguuacaacaga

SEQ ID NO: 2923420 - RNA, 23 nt, Human
acagugguggcagggccuagcug

SEQ ID NO: 2923421 - RNA, 13 nt, Human
acagugguggcag

SEQ ID NO: 2923422 - RNA, 15 nt, Human
acagugguggcaggg

SEQ ID NO: 2923423 - RNA, 16 nt, Human
acagugguggcagggc

SEQ ID NO: 2923424 - RNA, 17 nt, Human
acagugguggcagggcc

SEQ ID NO: 2923425 - RNA, 17 nt, Human
aauuuauuuauacuauu

SEQ ID NO: 2923426 - RNA, 20 nt, Human
aauuuauuuauacuauuuag

SEQ ID NO: 2923427 - RNA, 22 nt, Human
acaaccugcuuggguggagaag

SEQ ID NO: 2923428 - RNA, 23 nt, Human
acaaccugcuuggguggagaagc

SEQ ID NO: 2923429 - RNA, 21 nt, Human
acaauuauuuuuacaguucuc

SEQ ID NO: 2923430 - RNA, 18 nt, Human
acaauuauuuuuacaguu

SEQ ID NO: 2923431 - RNA, 18 nt, Human
acaauuauaucaguccuc

SEQ ID NO: 2923432 - RNA, 18 nt, Human
aaaggcauucucugaaga

SEQ ID NO: 2923433 - RNA, 16 nt, Human
aaaggcauucucugaa

SEQ ID NO: 2923434 - RNA, 14 nt, Human
aaagaagacauguu

SEQ ID NO: 2923435 - RNA, 12 nt, Human
aaagaagacaug

SEQ ID NO: 2923436 - RNA, 19 nt, Human
aaagaagacaacauuaaaa

SEQ ID NO: 2923437 - RNA, 18 nt, Human
aaaauuauagaugggaau

SEQ ID NO: 2923438 - RNA, 22 nt, Human
aaaauuauagaugggaaugaag

SEQ ID NO: 2923439 - RNA, 11 nt, Human
aaaauuaaagc

SEQ ID NO: 2923440 - RNA, 18 nt, Human
aacaaaggguuuuaaugu

SEQ ID NO: 2923441 - RNA, 20 nt, Human
aaauuaaccauagauguaga

SEQ ID NO: 2923442 - RNA, 23 nt, Human
aacagauuugugaacucagccaa

SEQ ID NO: 2923443 - RNA, 21 nt, Human
aacagauuugugaacucagcc

SEQ ID NO: 2923444 - RNA, 22 nt, Human
aacagauuugugaacucagcca

SEQ ID NO: 2923445 - RNA, 13 nt, Human
aacagauuuguga

SEQ ID NO: 2923446 - RNA, 14 nt, Human
aacagauuugugaa

SEQ ID NO: 2923447 - RNA, 15 nt, Human
aacagauuugugaac

SEQ ID NO: 2923448 - RNA, 16 nt, Human
aacagauuugugaacu

SEQ ID NO: 2923449 - RNA, 18 nt, Human
aacagauuugugaacuca

SEQ ID NO: 2923450 - RNA, 17 nt, Human
aacaucuagcaaauguu

SEQ ID NO: 2923451 - RNA, 17 nt, Human
aacgguaaauuucugug

SEQ ID NO: 2923452 - RNA, 12 nt, Human
aauaaacgauuu

SEQ ID NO: 2923453 - RNA, 15 nt, Human
aauaaacgauuuaau

SEQ ID NO: 2923454 - RNA, 21 nt, Human
aauaaacgauuuaauucucuu

SEQ ID NO: 2923455 - RNA, 19 nt, Human
aauaauaaagaugcucuuu

SEQ ID NO: 2923456 - RNA, 18 nt, Human
aauaauaaagaugcucuu

SEQ ID NO: 2923457 - RNA, 18 nt, Human
aaguauacuguauuuuua

SEQ ID NO: 2923458 - RNA, 12 nt, Human
aaguauacugua

SEQ ID NO: 2923459 - RNA, 20 nt, Human
aagagaauauuagcuuuacu

SEQ ID NO: 2923460 - RNA, 13 nt, Human
aagacauguuuua

SEQ ID NO: 2923461 - RNA, 14 nt, Human
aagacauguuuuag

SEQ ID NO: 2923462 - RNA, 17 nt, Human
aagacauguuuuagaca

SEQ ID NO: 2923463 - RNA, 18 nt, Human
aagggauuacccaagcaa

SEQ ID NO: 2923464 - RNA, 17 nt, Human
aagggauuacccaagca

SEQ ID NO: 2923465 - RNA, 19 nt, Human
aagggauuacccaagcaaa

SEQ ID NO: 2923466 - RNA, 18 nt, Human
agccaagcacaguggugg

SEQ ID NO: 2923467 - RNA, 21 nt, Human
agccaagcacagugguggcag

SEQ ID NO: 2923468 - RNA, 13 nt, Human
agccaagcacagu

SEQ ID NO: 2923469 - RNA, 14 nt, Human
agccaagcacagug

SEQ ID NO: 2923470 - RNA, 16 nt, Human
agccaagcacaguggu

SEQ ID NO: 2923471 - RNA, 17 nt, Human
agccaagcacaguggug

SEQ ID NO: 2923472 - RNA, 20 nt, Human
agcaaaaucauggaaugguu

SEQ ID NO: 2923473 - RNA, 23 nt, Human
agcaaaaucauggaaugguuaua

SEQ ID NO: 2923474 - RNA, 19 nt, Human
agauguagauaaacucaga

SEQ ID NO: 2923475 - RNA, 17 nt, Human
agaagacauguuuuaga

SEQ ID NO: 2923476 - RNA, 19 nt, Human
agaagacauguuuuagaca

SEQ ID NO: 2923477 - RNA, 13 nt, Human
agaagacauguuu

SEQ ID NO: 2923478 - RNA, 14 nt, Human
agaagacauguuuu

SEQ ID NO: 2923479 - RNA, 15 nt, Human
agaagacauguuuua

SEQ ID NO: 2923480 - RNA, 16 nt, Human
agaagacauguuuuag

SEQ ID NO: 2923481 - RNA, 12 nt, Human
agaagugacagg

SEQ ID NO: 2923482 - RNA, 13 nt, Human
agaagugacaggg

SEQ ID NO: 2923483 - RNA, 14 nt, Human
agaagugacaggga

SEQ ID NO: 2923484 - RNA, 16 nt, Human
agaagugacagggaag

SEQ ID NO: 2923485 - RNA, 18 nt, Human
agacaaauacucaugugu

SEQ ID NO: 2923486 - RNA, 20 nt, Human
agacaaauacucauguguau

SEQ ID NO: 2923487 - RNA, 13 nt, Human
agacaaauacuca

SEQ ID NO: 2923488 - RNA, 14 nt, Human
agacaaauacucau

SEQ ID NO: 2923489 - RNA, 17 nt, Human
agacaaauacucaugug

SEQ ID NO: 2923490 - RNA, 16 nt, Human
aggguuuuaauguaga

SEQ ID NO: 2923491 - RNA, 17 nt, Human
aggguuuuaauguagau

SEQ ID NO: 2923492 - RNA, 19 nt, Human
agggauuacccaagcaaaa

SEQ ID NO: 2923493 - RNA, 17 nt, Human
agggauuacccaagcaa

SEQ ID NO: 2923494 - RNA, 18 nt, Human
agggauuacccaagcaaa

SEQ ID NO: 2923495 - RNA, 18 nt, Human
agcugaauacauucugcu

SEQ ID NO: 2923496 - RNA, 15 nt, Human
agcugaauacauucu

SEQ ID NO: 2923497 - RNA, 21 nt, Human
augcacacagugcuuuccgug

SEQ ID NO: 2923498 - RNA, 15 nt, Human
augguaccagauaaa

SEQ ID NO: 2923499 - RNA, 23 nt, Human
auguaacugcauugagaacugca

SEQ ID NO: 2923500 - RNA, 20 nt, Human
auguaacugcauugagaacu

SEQ ID NO: 2923501 - RNA, 13 nt, Human
auguaacagucug

SEQ ID NO: 2923502 - RNA, 16 nt, Human
auguaacagucugauc

SEQ ID NO: 2923503 - RNA, 19 nt, Human
augucuuuuuuuuaaugug

SEQ ID NO: 2923504 - RNA, 22 nt, Human
augucuuuuuuuuaaugugcug

SEQ ID NO: 2923505 - RNA, 18 nt, Human
augucuuuuuuuuaaugu

SEQ ID NO: 2923506 - RNA, 17 nt, Human
augucuuuuuuuuaaug

SEQ ID NO: 2923507 - RNA, 18 nt, Human
auguguaucggaugcuuu

SEQ ID NO: 2923508 - RNA, 23 nt, Human
auguuucgugaaguauacuguau

SEQ ID NO: 2923509 - RNA, 20 nt, Human
auguuucgugaaguauacug

SEQ ID NO: 2923510 - RNA, 22 nt, Human
auguuucgcugauauauguguu

SEQ ID NO: 2923511 - RNA, 18 nt, Human
auguuucuuaaaugggcu

SEQ ID NO: 2923512 - RNA, 20 nt, Human
agugaauuuuucucuaacuc

SEQ ID NO: 2923513 - RNA, 17 nt, Human
agugaauuuuucucuaa

SEQ ID NO: 2923514 - RNA, 16 nt, Human
agugaauuuuucucua

SEQ ID NO: 2923515 - RNA, 15 nt, Human
agugaauuuuucucu

SEQ ID NO: 2923516 - RNA, 23 nt, Human
auauaauaugcacacagugcuuu

SEQ ID NO: 2923517 - RNA, 14 nt, Human
auauacaauuauau

SEQ ID NO: 2923518 - RNA, 21 nt, Human
auauacaaccugcuugggugg

SEQ ID NO: 2923519 - RNA, 14 nt, Human
auaaagaugcucuu

SEQ ID NO: 2923520 - RNA, 15 nt, Human
auaaagaugcucuuu

SEQ ID NO: 2923521 - RNA, 20 nt, Human
auaaagauuucuugaguuuu

SEQ ID NO: 2923522 - RNA, 15 nt, Human
auaaugguaccagau

SEQ ID NO: 2923523 - RNA, 17 nt, Human
auaaugguaccagauaa

SEQ ID NO: 2923524 - RNA, 18 nt, Human
auaaugguaccagauaaa

SEQ ID NO: 2923525 - RNA, 19 nt, Human
auaaugguaccagauaaaa

SEQ ID NO: 2923526 - RNA, 13 nt, Human
cacaguguguuug

SEQ ID NO: 2923527 - RNA, 16 nt, Human
cacaguguguuuguga

SEQ ID NO: 2923528 - RNA, 22 nt, Human
cacagugcuuuccguggcacug

SEQ ID NO: 2923529 - RNA, 23 nt, Human
caaaaucauggaaugguuauaaa

SEQ ID NO: 2923530 - RNA, 21 nt, Human
caaaacucauuuccuauguaa

SEQ ID NO: 2923531 - RNA, 20 nt, Human
caacagauuugugaacucag

SEQ ID NO: 2923532 - RNA, 23 nt, Human
caacagauuugugaacucagcca

SEQ ID NO: 2923533 - RNA, 15 nt, Human
caacagauuugugaa

SEQ ID NO: 2923534 - RNA, 16 nt, Human
caacagauuugugaac

SEQ ID NO: 2923535 - RNA, 17 nt, Human
caacagauuugugaacu

SEQ ID NO: 2923536 - RNA, 19 nt, Human
caacagauuugugaacuca

SEQ ID NO: 2923537 - RNA, 14 nt, Human
caacagauuuguga

SEQ ID NO: 2923538 - RNA, 20 nt, Human
caaagaagacauguuuuaga

SEQ ID NO: 2923539 - RNA, 14 nt, Human
caaagaagacaugu

SEQ ID NO: 2923540 - RNA, 16 nt, Human
caaagaagacauguuu

SEQ ID NO: 2923541 - RNA, 14 nt, Human
caaagaagacaaca

SEQ ID NO: 2923542 - RNA, 13 nt, Human
caaagaagacaug

SEQ ID NO: 2923543 - RNA, 21 nt, Human
caaauguuaugcauaaaguca

SEQ ID NO: 2923544 - RNA, 13 nt, Human
caaauguuaugca

SEQ ID NO: 2923545 - RNA, 23 nt, Human
caauagaaggauguacauuucca

SEQ ID NO: 2923546 - RNA, 14 nt, Human
cacaaguuguguuu

SEQ ID NO: 2923547 - RNA, 16 nt, Human
cacaaaauugggaaag

SEQ ID NO: 2923548 - RNA, 14 nt, Human
uguguaugggcaaa

SEQ ID NO: 2923549 - RNA, 22 nt, Human
uguguauccauuaucaugugua

SEQ ID NO: 2923550 - RNA, 23 nt, Human
uguguauccauuaucauguguaa

SEQ ID NO: 2923551 - RNA, 24 nt, Human
uguguauccauuaucauguguaau

SEQ ID NO: 2923552 - RNA, 18 nt, Human
uguuggcacauccuaugc

SEQ ID NO: 2923553 - RNA, 19 nt, Human
uguuggcacauccuaugca

SEQ ID NO: 2923554 - RNA, 12 nt, Human
uguugauugcua

SEQ ID NO: 2923555 - RNA, 13 nt, Human
uguugauugcuaa

SEQ ID NO: 2923556 - RNA, 14 nt, Human
uguugauugcuaaa

SEQ ID NO: 2923557 - RNA, 16 nt, Human
uuaagccaucuuggua

SEQ ID NO: 2923558 - RNA, 18 nt, Human
uuaagccaucuugguaaa

SEQ ID NO: 2923559 - RNA, 21 nt, Human
uuacaacagauuugugaacuc

SEQ ID NO: 2923560 - RNA, 18 nt, Human
uuacaacagauuugugaa

SEQ ID NO: 2923561 - RNA, 19 nt, Human
uuacaacagauuugugaac

SEQ ID NO: 2923562 - RNA, 13 nt, Human
uuacaacagauuu

SEQ ID NO: 2923563 - RNA, 15 nt, Human
uuacaacagauuugu

SEQ ID NO: 2923564 - RNA, 16 nt, Human
uuacaacagauuugug

SEQ ID NO: 2923565 - RNA, 17 nt, Human
uuacaacagauuuguga

SEQ ID NO: 2923566 - RNA, 12 nt, Human
uguuuguuaugg

SEQ ID NO: 2923567 - RNA, 13 nt, Human
uguaaucaauaaa

SEQ ID NO: 2923568 - RNA, 14 nt, Human
uguaaucaauaaac

SEQ ID NO: 2923569 - RNA, 15 nt, Human
uguaaucaauaaacg

SEQ ID NO: 2923570 - RNA, 16 nt, Human
uguaaucaauaaacga

SEQ ID NO: 2923571 - RNA, 18 nt, Human
uguaaucaauaaacgauu

SEQ ID NO: 2923572 - RNA, 14 nt, Human
uguaguugaacuga

SEQ ID NO: 2923573 - RNA, 20 nt, Human
uguaguugaacugauaguua

SEQ ID NO: 2923574 - RNA, 20 nt, Human
ugugaaguuagaauuccuuc

SEQ ID NO: 2923575 - RNA, 13 nt, Human
ugugaaguuagaa

SEQ ID NO: 2923576 - RNA, 14 nt, Human
ugugaaguuagaau

SEQ ID NO: 2923577 - RNA, 15 nt, Human
ugugaaguuagaauu

SEQ ID NO: 2923578 - RNA, 15 nt, Human
uguguaaucaauaaa

SEQ ID NO: 2923579 - RNA, 19 nt, Human
uguguaaucaauaaacgau

SEQ ID NO: 2923580 - RNA, 20 nt, Human
uguguaaucaauaaacgauu

SEQ ID NO: 2923581 - RNA, 21 nt, Human
uguguauccauuaucaugugu

SEQ ID NO: 2923582 - RNA, 17 nt, Human
uggaaugguuauaaaag

SEQ ID NO: 2923583 - RNA, 14 nt, Human
uggcagggccuagc

SEQ ID NO: 2923584 - RNA, 15 nt, Human
uggcagggccuagcu

SEQ ID NO: 2923585 - RNA, 19 nt, Human
uggcagggccuagcugcua

SEQ ID NO: 2923586 - RNA, 16 nt, Human
ugggcuacuuuguccu

SEQ ID NO: 2923587 - RNA, 19 nt, Human
ugcuaaauguaacagucug

SEQ ID NO: 2923588 - RNA, 20 nt, Human
ugcuaaauguaacagucuga

SEQ ID NO: 2923589 - RNA, 15 nt, Human
ugcuaaauguaacag

SEQ ID NO: 2923590 - RNA, 16 nt, Human
ugcuaaauguaacagu

SEQ ID NO: 2923591 - RNA, 17 nt, Human
ugcuaaauguaacaguc

SEQ ID NO: 2923592 - RNA, 18 nt, Human
ugcuaaauguaacagucu

SEQ ID NO: 2923593 - RNA, 11 nt, Human
ugcuaaaugua

SEQ ID NO: 2923594 - RNA, 14 nt, Human
ugcuaaauguaaca

SEQ ID NO: 2923595 - RNA, 18 nt, Human
uccugucccuucucuuaa

SEQ ID NO: 2923596 - RNA, 21 nt, Human
uccuuaucacugacacaaaaa

SEQ ID NO: 2923597 - RNA, 13 nt, Human
uccuuugggaaag

SEQ ID NO: 2923598 - RNA, 18 nt, Human
ucuacucuuaagccaucu

SEQ ID NO: 2923599 - RNA, 16 nt, Human
ucuacucuuaagccau

SEQ ID NO: 2923600 - RNA, 17 nt, Human
ucuacucuuaagccauc

SEQ ID NO: 2923601 - RNA, 14 nt, Human
uccacagcuaccuc

SEQ ID NO: 2923602 - RNA, 21 nt, Human
ucagaucauuucaaaacucau

SEQ ID NO: 2923603 - RNA, 14 nt, Human
ucaggacuccucuc

SEQ ID NO: 2923604 - RNA, 19 nt, Human
ucaggacgagaaugagggu

SEQ ID NO: 2923605 - RNA, 14 nt, Human
ucuucggaaaccuu

SEQ ID NO: 2923606 - RNA, 15 nt, Human
ugacuaaaaaacaaa

SEQ ID NO: 2923607 - RNA, 22 nt, Human
ugacuaaaaaacaaagaagaca

SEQ ID NO: 2923608 - RNA, 23 nt, Human
ugacuaauuguauaacagguuau

SEQ ID NO: 2923609 - RNA, 21 nt, Human
ugacuaauuguauaacagguu

SEQ ID NO: 2923610 - RNA, 22 nt, Human
ugacuaauuguauaacagguua

SEQ ID NO: 2923611 - RNA, 17 nt, Human
ugacuaauuguauaaca

SEQ ID NO: 2923612 - RNA, 18 nt, Human
ugacuaauuguauaacag

SEQ ID NO: 2923613 - RNA, 19 nt, Human
ugacuaauuguauaacagg

SEQ ID NO: 2923614 - RNA, 20 nt, Human
ugacuaauuguauaacaggu

SEQ ID NO: 2923615 - RNA, 13 nt, Human
ugacuaauuguau

SEQ ID NO: 2923616 - RNA, 14 nt, Human
ugacuaauuguaua

SEQ ID NO: 2923617 - RNA, 15 nt, Human
ugacuaauuguauaa

SEQ ID NO: 2923618 - RNA, 19 nt, Human
ugaagaguggguuucacaa

SEQ ID NO: 2923619 - RNA, 23 nt, Human
ugacaaauguguaucggaugcuu

SEQ ID NO: 2923620 - RNA, 20 nt, Human
uacucauguguaugggcaaa

SEQ ID NO: 2923621 - RNA, 22 nt, Human
uacucauguguaugggcaaaaa

SEQ ID NO: 2923622 - RNA, 12 nt, Human
uacucaugugua

SEQ ID NO: 2923623 - RNA, 13 nt, Human
uacucauguguau

SEQ ID NO: 2923624 - RNA, 14 nt, Human
uacucauguguaug

SEQ ID NO: 2923625 - RNA, 11 nt, Human
uacucaugugu

SEQ ID NO: 2923626 - RNA, 20 nt, Human
uacaucuuucacauuggcua

SEQ ID NO: 2923627 - RNA, 15 nt, Human
uacaucuuucacauu

SEQ ID NO: 2923628 - RNA, 12 nt, Human
uacaacagauuu

SEQ ID NO: 2923629 - RNA, 13 nt, Human
uacaacagauuug

SEQ ID NO: 2923630 - RNA, 14 nt, Human
uacaacagauuugu

SEQ ID NO: 2923631 - RNA, 15 nt, Human
uacaacagauuugug

SEQ ID NO: 2923632 - RNA, 16 nt, Human
uacaacagauuuguga

SEQ ID NO: 2923633 - RNA, 17 nt, Human
uacaacagauuugugaa

SEQ ID NO: 2923634 - RNA, 18 nt, Human
uacaacagauuugugaac

SEQ ID NO: 2923635 - RNA, 19 nt, Human
uacaacagauuugugaacu

SEQ ID NO: 2923636 - RNA, 20 nt, Human
uacaacagauuugugaacuc

SEQ ID NO: 2923637 - RNA, 21 nt, Human
uacaacagauuugugaacuca

SEQ ID NO: 2923638 - RNA, 12 nt, Human
uacaaccugcuu

SEQ ID NO: 2923639 - RNA, 16 nt, Human
uacaauugaaaugacu

SEQ ID NO: 2923640 - RNA, 19 nt, Human
uacaaagaagacauguuuu

SEQ ID NO: 2923641 - RNA, 22 nt, Human
uacaaagaagacauguuuuaga

SEQ ID NO: 2923642 - RNA, 15 nt, Human
uacaaagaagacaug

SEQ ID NO: 2923643 - RNA, 16 nt, Human
uacaaagaagacaugu

SEQ ID NO: 2923644 - RNA, 17 nt, Human
uacaaagaagacauguu

SEQ ID NO: 2923645 - RNA, 18 nt, Human
uacaaagaagacauguuu

SEQ ID NO: 2923646 - RNA, 13 nt, Human
uacaaagaagaca

SEQ ID NO: 2923647 - RNA, 14 nt, Human
uacaaagaagacau

SEQ ID NO: 2923648 - RNA, 16 nt, Human
uagaauuccuucaggg

SEQ ID NO: 2923649 - RNA, 23 nt, Human
uagaauuccuucagggugaugcc

SEQ ID NO: 2923650 - RNA, 21 nt, Human
uagcaggagaggagagccaga

SEQ ID NO: 2923651 - RNA, 22 nt, Human
uagcaggagaggagagccagag

SEQ ID NO: 2923652 - RNA, 17 nt, Human
uagcaggagaggagagc

SEQ ID NO: 2923653 - RNA, 19 nt, Human
uagcaggagaggagagcca

SEQ ID NO: 2923654 - RNA, 16 nt, Human
uaggugucauuuccau

SEQ ID NO: 2923655 - RNA, 20 nt, Human
uaguuucuguucuguggaaa

SEQ ID NO: 2923656 - RNA, 14 nt, Human
uaguugaacugaua

SEQ ID NO: 2923657 - RNA, 18 nt, Human
uaguugaacugauaguua

SEQ ID NO: 2923658 - RNA, 20 nt, Human
uaguugaacugauaguuacu

SEQ ID NO: 2923659 - RNA, 22 nt, Human
uaguugaacugauaguuacugu

SEQ ID NO: 2923660 - RNA, 19 nt, Human
uaucauguguaaucaauaa

SEQ ID NO: 2923661 - RNA, 20 nt, Human
uaucauguguaaucaauaaa

SEQ ID NO: 2923662 - RNA, 22 nt, Human
uaucauguguaaucaauaaacg

SEQ ID NO: 2923663 - RNA, 15 nt, Human
uaucaugcaaaugcu

SEQ ID NO: 2923664 - RNA, 17 nt, Human
uaucaugcaaaugcugu

SEQ ID NO: 2923665 - RNA, 16 nt, Human
uaucaugcaaaugcug

SEQ ID NO: 2923666 - RNA, 13 nt, Human
uaacugacaacuu

SEQ ID NO: 2923667 - RNA, 19 nt, Human
uaaauguaacagucugauc

SEQ ID NO: 2923668 - RNA, 17 nt, Human
uaaauguaacagucuga

SEQ ID NO: 2923669 - RNA, 18 nt, Human
uaaauguaacagucugau

SEQ ID NO: 2923670 - RNA, 13 nt, Human
uaaauguaacagu

SEQ ID NO: 2923671 - RNA, 14 nt, Human
uaaauguaacaguc

SEQ ID NO: 2923672 - RNA, 17 nt, Human
uaacacauuugauucug

SEQ ID NO: 2923673 - RNA, 22 nt, Human
uaaauuuccccaacagugugaa

SEQ ID NO: 2923674 - RNA, 20 nt, Human
uaaauuuccccaacagugug

SEQ ID NO: 2923675 - RNA, 21 nt, Human
uaaauuuccccaacaguguga

SEQ ID NO: 2923676 - RNA, 23 nt, Human
uaaauuuccccaacagugugaag

SEQ ID NO: 2923677 - RNA, 17 nt, Human
uaaauuuccccaacagu

SEQ ID NO: 2923678 - RNA, 18 nt, Human
uaaauuuccccaacagug

SEQ ID NO: 2923679 - RNA, 19 nt, Human
uaaauuuccccaacagugu

SEQ ID NO: 2923680 - RNA, 12 nt, Human
uaaauugaauaa

SEQ ID NO: 2923681 - RNA, 13 nt, Human
uaaauugaauaau

SEQ ID NO: 2923682 - RNA, 16 nt, Human
uaaauugaauaauggu

SEQ ID NO: 2923683 - RNA, 17 nt, Human
uaaauugaauaauggua

SEQ ID NO: 2923684 - RNA, 21 nt, Human
uaaaugucuuuuuuuuaaugu

SEQ ID NO: 2923685 - RNA, 22 nt, Human
uaaaugucuuuuuuuuaaugug

SEQ ID NO: 2923686 - RNA, 23 nt, Human
uaaaugucuuuuuuuuaaugugc

SEQ ID NO: 2923687 - RNA, 12 nt, Human
uaauaugagaau

SEQ ID NO: 2923688 - RNA, 15 nt, Human
uaauaucaauagaag

SEQ ID NO: 2923689 - RNA, 14 nt, Human
uaaugguaccagau

SEQ ID NO: 2923690 - RNA, 16 nt, Human
uaaugguaccagauaa

SEQ ID NO: 2923691 - RNA, 19 nt, Human
uaaugguaccagauaaaau

SEQ ID NO: 2923692 - RNA, 17 nt, Human
uaaugguaccagauaaa

SEQ ID NO: 2923693 - RNA, 18 nt, Human
uaaugguaccagauaaaa

SEQ ID NO: 2923694 - RNA, 20 nt, Human
uaaaguuagucuacucuuaa

SEQ ID NO: 2923695 - RNA, 16 nt, Human
uaaaguuagucuacuc

SEQ ID NO: 2923696 - RNA, 15 nt, Human
uaaaguuagucuacu

SEQ ID NO: 2923697 - RNA, 18 nt, Human
uaaaacaauauuguuucu

SEQ ID NO: 2923698 - RNA, 14 nt, Human
uaaaacaauauugu

SEQ ID NO: 2923699 - RNA, 21 nt, Human
uaaaagggauuacccaagcaa

SEQ ID NO: 2923700 - RNA, 19 nt, Human
uaaaagggauuacccaagc

SEQ ID NO: 2923701 - RNA, 20 nt, Human
uaaaagggauuacccaagca

SEQ ID NO: 2923702 - RNA, 18 nt, Human
guugugaccugaaguuca

SEQ ID NO: 2923703 - RNA, 13 nt, Human
guugugaccugaa

SEQ ID NO: 2923704 - RNA, 17 nt, Human
guugugaccugaaguuc

SEQ ID NO: 2923705 - RNA, 16 nt, Human
guuuaccugugaaaua

SEQ ID NO: 2923706 - RNA, 17 nt, Human
guguaguugaacugaua

SEQ ID NO: 2923707 - RNA, 15 nt, Human
guguaguugaacuga

SEQ ID NO: 2923708 - RNA, 22 nt, Human
guguauccauuaucauguguaa

SEQ ID NO: 2923709 - RNA, 23 nt, Human
guguauccauuaucauguguaau

SEQ ID NO: 2923710 - RNA, 16 nt, Human
guguauccauuaucau

SEQ ID NO: 2923711 - RNA, 20 nt, Human
guguauccauuaucaugugu

SEQ ID NO: 2923712 - RNA, 14 nt, Human
guguaaucaauaaa

SEQ ID NO: 2923713 - RNA, 15 nt, Human
guguaaucaauaaac

SEQ ID NO: 2923714 - RNA, 16 nt, Human
guguaaucaauaaacg

SEQ ID NO: 2923715 - RNA, 17 nt, Human
guguaaucaauaaacga

SEQ ID NO: 2923716 - RNA, 19 nt, Human
guguaaucaauaaacgauu

SEQ ID NO: 2923717 - RNA, 14 nt, Human
guguguuugugauu

SEQ ID NO: 2923718 - RNA, 18 nt, Human
guguguuuucauaauaaa

SEQ ID NO: 2923719 - RNA, 17 nt, Human
guguguuuucauaauaa

SEQ ID NO: 2923720 - RNA, 16 nt, Human
guguuuucauaauaaa

SEQ ID NO: 2923721 - RNA, 15 nt, Human
guguuuucauaauaa

SEQ ID NO: 2923722 - RNA, 14 nt, Human
guguuuucauaaua

SEQ ID NO: 2923723 - RNA, 13 nt, Human
guguuuucauaau

SEQ ID NO: 2923724 - RNA, 21 nt, Human
guuauuagggugguauuuagu

SEQ ID NO: 2923725 - RNA, 16 nt, Human
guuauaaaagugauug

SEQ ID NO: 2923726 - RNA, 12 nt, Human
guuauaaaagug

SEQ ID NO: 2923727 - RNA, 14 nt, Human
guuauaaaagugau

SEQ ID NO: 2923728 - RNA, 22 nt, Human
guuauaaaagugauuguuggca

SEQ ID NO: 2923729 - RNA, 14 nt, Human
guuacucugaaggg

SEQ ID NO: 2923730 - RNA, 11 nt, Human
guuacucugaa

SEQ ID NO: 2923731 - RNA, 12 nt, Human
guugauugcuaa

SEQ ID NO: 2923732 - RNA, 13 nt, Human
guugauugcuaaa

SEQ ID NO: 2923733 - RNA, 14 nt, Human
guugauugcuaaau

SEQ ID NO: 2923734 - RNA, 15 nt, Human
guugauugcuaaaug

SEQ ID NO: 2923735 - RNA, 16 nt, Human
guugauugcuaaaugu

SEQ ID NO: 2923736 - RNA, 17 nt, Human
guugauugcuaaaugua

SEQ ID NO: 2923737 - RNA, 22 nt, Human
guugauugcuaaauguaacagu

SEQ ID NO: 2923738 - RNA, 18 nt, Human
guugauugcuaaauguaa

SEQ ID NO: 2923739 - RNA, 20 nt, Human
guugauugcuaaauguaaca

SEQ ID NO: 2923740 - RNA, 17 nt, Human
guugccaaacagccaca

SEQ ID NO: 2923741 - RNA, 18 nt, Human
guugccaaacagccacac

SEQ ID NO: 2923742 - RNA, 21 nt, Human
guugaacugauaguuacuguu

SEQ ID NO: 2923743 - RNA, 17 nt, Human
gugacuaauuguauaac

SEQ ID NO: 2923744 - RNA, 15 nt, Human
gugacuaauuguaua

SEQ ID NO: 2923745 - RNA, 22 nt, Human
gugacuaauuguauaacagguu

SEQ ID NO: 2923746 - RNA, 23 nt, Human
gugacuaauuguauaacagguua

SEQ ID NO: 2923747 - RNA, 18 nt, Human
gugacuaauuguauaaca

SEQ ID NO: 2923748 - RNA, 19 nt, Human
gugacuaauuguauaacag

SEQ ID NO: 2923749 - RNA, 20 nt, Human
gugacuaauuguauaacagg

SEQ ID NO: 2923750 - RNA, 21 nt, Human
gugacuaauuguauaacaggu

SEQ ID NO: 2923751 - RNA, 19 nt, Human
gugacgcugaauaaauguc

SEQ ID NO: 2923752 - RNA, 15 nt, Human
gugacgcugaauaaa

SEQ ID NO: 2923753 - RNA, 17 nt, Human
gugacgcugaauaaaug

SEQ ID NO: 2923754 - RNA, 18 nt, Human
gugacgcugaauaaaugu

SEQ ID NO: 2923755 - RNA, 16 nt, Human
gucuuuuuuuuaaugu

SEQ ID NO: 2923756 - RNA, 17 nt, Human
gucuuuuuuuuaaugug

SEQ ID NO: 2923757 - RNA, 18 nt, Human
gucuuuuuuuuaaugugc

SEQ ID NO: 2923758 - RNA, 19 nt, Human
gucuuuuuuuuaaugugcu

SEQ ID NO: 2923759 - RNA, 22 nt, Human
gucuuuuuuuuaaugugcugug

SEQ ID NO: 2923760 - RNA, 23 nt, Human
guaucuuguuuuuccacuacugc

SEQ ID NO: 2923761 - RNA, 12 nt, Human
guccacugucac

SEQ ID NO: 2923762 - RNA, 11 nt, Human
uuuuucucuaa

SEQ ID NO: 2923763 - RNA, 22 nt, Human
uuucuguucuguggaaagugua

SEQ ID NO: 2923764 - RNA, 15 nt, Human
uuugguggagauaaa

SEQ ID NO: 2923765 - RNA, 11 nt, Human
uuuuaaugugc

SEQ ID NO: 2923766 - RNA, 12 nt, Human
uuuuaaugugcu

SEQ ID NO: 2923767 - RNA, 19 nt, Human
uuuuaaugugcuguguaaa

SEQ ID NO: 2923768 - RNA, 21 nt, Human
uuuuaaugugcuguguaaagu

SEQ ID NO: 2923769 - RNA, 13 nt, Human
uuuuaaugugcug

SEQ ID NO: 2923770 - RNA, 15 nt, Human
uuuuaaugugcugug

SEQ ID NO: 2923771 - RNA, 17 nt, Human
uuuuaaugugcugugua

SEQ ID NO: 2923772 - RNA, 18 nt, Human
uuuuaaugugcuguguaa

SEQ ID NO: 2923773 - RNA, 14 nt, Human
gccaucuugguaaa

SEQ ID NO: 2923774 - RNA, 15 nt, Human
gccaucuugguaaau

SEQ ID NO: 2923775 - RNA, 16 nt, Human
gccaucuugguaaauu

SEQ ID NO: 2923776 - RNA, 22 nt, Human
gccaucuugguaaauuucccca

SEQ ID NO: 2923777 - RNA, 12 nt, Human
gcuacagguuac

SEQ ID NO: 2923778 - RNA, 14 nt, Human
gcuacagguuacaa

SEQ ID NO: 2923779 - RNA, 15 nt, Human
gcuacagguuacaac

SEQ ID NO: 2923780 - RNA, 16 nt, Human
gcuacagguuacaaca

SEQ ID NO: 2923781 - RNA, 18 nt, Human
gcuacagguuacaacaga

SEQ ID NO: 2923782 - RNA, 19 nt, Human
gcuacagguuacaacagau

SEQ ID NO: 2923783 - RNA, 20 nt, Human
gcuacagguuacaacagauu

SEQ ID NO: 2923784 - RNA, 14 nt, Human
gcauucucugaaga

SEQ ID NO: 2923785 - RNA, 23 nt, Human
gcaucuuacugaagguaaaauug

SEQ ID NO: 2923786 - RNA, 16 nt, Human
gcaucuuacugaaggu

SEQ ID NO: 2923787 - RNA, 15 nt, Human
gcaucuuacugaagg

SEQ ID NO: 2923788 - RNA, 21 nt, Human
gcagggccuagcugcuacaaa

SEQ ID NO: 2923789 - RNA, 17 nt, Human
gcagggccuagcugcua

SEQ ID NO: 2923790 - RNA, 20 nt, Human
gcagggccuagcugcuacaa

SEQ ID NO: 2923791 - RNA, 11 nt, Human
gauuugugaac

SEQ ID NO: 2923792 - RNA, 20 nt, Human
gauuugugaacucagccaag

SEQ ID NO: 2923793 - RNA, 16 nt, Human
gauaaagauuucuuga

SEQ ID NO: 2923794 - RNA, 13 nt, Human
gauaaagauuucu

SEQ ID NO: 2923795 - RNA, 21 nt, Human
gauacacccaaaguaucagga

SEQ ID NO: 2923796 - RNA, 16 nt, Human
gaucgugacgcugaau

SEQ ID NO: 2923797 - RNA, 22 nt, Human
gaucgugacgcugaauaaaugu

SEQ ID NO: 2923798 - RNA, 19 nt, Human
gaucgugacgcugaauaaa

SEQ ID NO: 2923799 - RNA, 20 nt, Human
gaucgugacgcugaauaaau

SEQ ID NO: 2923800 - RNA, 13 nt, Human
gagaaugaggguc

SEQ ID NO: 2923801 - RNA, 16 nt, Human
gagaauucuuacaugu

SEQ ID NO: 2923802 - RNA, 11 nt, Human
gagaagccauu

SEQ ID NO: 2923803 - RNA, 15 nt, Human
gagaagccauugucu

SEQ ID NO: 2923804 - RNA, 20 nt, Human
gagaagccauugucuucgga

SEQ ID NO: 2923805 - RNA, 22 nt, Human
gagaauucuuacauguuuucuu

SEQ ID NO: 2923806 - RNA, 18 nt, Human
gagaauucuuacauguuu

SEQ ID NO: 2923807 - RNA, 22 nt, Human
gagagccagagaagugacaggg

SEQ ID NO: 2923808 - RNA, 15 nt, Human
gagagccagagaagu

SEQ ID NO: 2923809 - RNA, 19 nt, Human
gagagccagagaagugaca

SEQ ID NO: 2923810 - RNA, 15 nt, Human
gagauaauaugagaa

SEQ ID NO: 2923811 - RNA, 22 nt, Human
gacaagguucuucccuuuuaca

SEQ ID NO: 2923812 - RNA, 20 nt, Human
gacguaggaacgguaaauuu

SEQ ID NO: 2923813 - RNA, 21 nt, Human
gacuaauuguauaacagguua

SEQ ID NO: 2923814 - RNA, 22 nt, Human
gacuaauuguauaacagguuau

SEQ ID NO: 2923815 - RNA, 15 nt, Human
gacuaauuguauaac

SEQ ID NO: 2923816 - RNA, 19 nt, Human
gacuaauuguauaacaggu

SEQ ID NO: 2923817 - RNA, 20 nt, Human
gacuaauuguauaacagguu

SEQ ID NO: 2923818 - RNA, 13 nt, Human
gacuaauuguaua

SEQ ID NO: 2923819 - RNA, 19 nt, Human
cuuuccguggcacugcaua

SEQ ID NO: 2923820 - RNA, 17 nt, Human
cuuuccguggcacugca

SEQ ID NO: 2923821 - RNA, 23 nt, Human
cuuuuuuaugugccguguuauug

SEQ ID NO: 2923822 - RNA, 18 nt, Human
cuuuuuuaugugccgugu

SEQ ID NO: 2923823 - RNA, 22 nt, Human
cuuuuuccagacacuuuuuuga

SEQ ID NO: 2923824 - RNA, 23 nt, Human
gaaaguguaaagcauuccaacaa

SEQ ID NO: 2923825 - RNA, 15 nt, Human
gaaaguguaaagcau

SEQ ID NO: 2923826 - RNA, 16 nt, Human
gaaaguguaaagcauu

SEQ ID NO: 2923827 - RNA, 12 nt, Human
gaaaguguaaag

SEQ ID NO: 2923828 - RNA, 13 nt, Human
gaaaguguaaagc

SEQ ID NO: 2923829 - RNA, 14 nt, Human
gaaaguguaaagca

SEQ ID NO: 2923830 - RNA, 16 nt, Human
gaaaggaguagaaaaa

SEQ ID NO: 2923831 - RNA, 15 nt, Human
gaaaggaguagaaaa

SEQ ID NO: 2923832 - RNA, 22 nt, Human
gaaaccuugguguaguugaacu

SEQ ID NO: 2923833 - RNA, 17 nt, Human
gaaaccuugguguaguu

SEQ ID NO: 2923834 - RNA, 19 nt, Human
gaaaugacuaaaaaacaaa

SEQ ID NO: 2923835 - RNA, 17 nt, Human
gaaggucaccugagccc

SEQ ID NO: 2923836 - RNA, 20 nt, Human
gaaggauguacauuuccaaa

SEQ ID NO: 2923837 - RNA, 17 nt, Human
gaaggauguacauuucc

SEQ ID NO: 2923838 - RNA, 16 nt, Human
gaaggauguacauuuc

SEQ ID NO: 2923839 - RNA, 15 nt, Human
gaaggauguacauuu

SEQ ID NO: 2923840 - RNA, 18 nt, Human
gaagaguggguuucacaa

SEQ ID NO: 2923841 - RNA, 17 nt, Human
gaagaguggguuucaca

SEQ ID NO: 2923842 - RNA, 12 nt, Human
cuguauuuguga

SEQ ID NO: 2923843 - RNA, 13 nt, Human
cuguauuugugac

SEQ ID NO: 2923844 - RNA, 14 nt, Human
cuguauuugugacu

SEQ ID NO: 2923845 - RNA, 15 nt, Human
cuguauuugugacua

SEQ ID NO: 2923846 - RNA, 16 nt, Human
cuguauuugugacuaa

SEQ ID NO: 2923847 - RNA, 17 nt, Human
cuguauuugugacuaau

SEQ ID NO: 2923848 - RNA, 19 nt, Human
cuguauuugugacuaauug

SEQ ID NO: 2923849 - RNA, 23 nt, Human
cuguauuugugacuaauuguaua

SEQ ID NO: 2923850 - RNA, 20 nt, Human
cuguauuugugacuaauugu

SEQ ID NO: 2923851 - RNA, 21 nt, Human
cuguauuugugacuaauugua

SEQ ID NO: 2923852 - RNA, 21 nt, Human
cugucccuucucuuaauuuaa

SEQ ID NO: 2923853 - RNA, 16 nt, Human
cugucccuucucuuaa

SEQ ID NO: 2923854 - RNA, 20 nt, Human
cuggcgacaguuuuccuucu

SEQ ID NO: 2923855 - RNA, 19 nt, Human
cuggcgacaguuuuccuuc

SEQ ID NO: 2923856 - RNA, 14 nt, Human
cugcauacaaucug

SEQ ID NO: 2923857 - RNA, 22 nt, Human
cugcuuggguggagaagccauu

SEQ ID NO: 2923858 - RNA, 20 nt, Human
cugcuuggguggagaagcca

SEQ ID NO: 2923859 - RNA, 21 nt, Human
cugcuuggguggagaagccau

SEQ ID NO: 2923860 - RNA, 14 nt, Human
cugcuuggguggag

SEQ ID NO: 2923861 - RNA, 18 nt, Human
cugcuuggguggagaagc

SEQ ID NO: 2923862 - RNA, 19 nt, Human
cucuucuuaacuuaaauuu

SEQ ID NO: 2923863 - RNA, 20 nt, Human
cucucuccuguacuuuuucc

SEQ ID NO: 2923864 - RNA, 15 nt, Human
cucucuccuguacuu

SEQ ID NO: 2923865 - RNA, 20 nt, Human
cugaagaguggguuucacaa

SEQ ID NO: 2923866 - RNA, 21 nt, Human
cuccaugagacacaucuccuc

SEQ ID NO: 2923867 - RNA, 15 nt, Human
cggaaaccuuggugu

SEQ ID NO: 2923868 - RNA, 14 nt, Human
cuaaauguaacagu

SEQ ID NO: 2923869 - RNA, 15 nt, Human
cuaaauguaacaguc

SEQ ID NO: 2923870 - RNA, 16 nt, Human
cuaaauguaacagucu

SEQ ID NO: 2923871 - RNA, 18 nt, Human
cuaaauguaacagucuga

SEQ ID NO: 2923872 - RNA, 19 nt, Human
cuaaauguaacagucugau

SEQ ID NO: 2923873 - RNA, 20 nt, Human
cuacuuuguccuuuuuguua

SEQ ID NO: 2923874 - RNA, 14 nt, Human
cuacuuuguccuuu

SEQ ID NO: 2923875 - RNA, 22 nt, Human
cuacuuuguccuuuuuguuauu

SEQ ID NO: 2923876 - RNA, 15 nt, Human
cuacucuuaagccau

SEQ ID NO: 2923877 - RNA, 22 nt, Human
cuacucuguuccuucacauccu

SEQ ID NO: 2923878 - RNA, 19 nt, Human
cuacucuguuccuucacau

SEQ ID NO: 2923879 - RNA, 16 nt, Human
cuacucuguuccuuca

SEQ ID NO: 2923880 - RNA, 15 nt, Human
cuacucuguuccuuc

SEQ ID NO: 2923881 - RNA, 16 nt, Human
cuacucuuaagccauc

SEQ ID NO: 2923882 - RNA, 17 nt, Human
cuacucuuaagccaucu

SEQ ID NO: 2923883 - RNA, 18 nt, Human
cuacucuuaagccaucuu

SEQ ID NO: 2923884 - RNA, 22 nt, Human
cuacucuuaagccaucuuggua

SEQ ID NO: 2923885 - RNA, 12 nt, Human
cuauuuggaauu

SEQ ID NO: 2923886 - RNA, 16 nt, Human
cuauuuggaauuuaua

SEQ ID NO: 2923887 - RNA, 15 nt, Human
ccguggcacugcaua

SEQ ID NO: 2923888 - RNA, 13 nt, Human
ccaucuugguaaa

SEQ ID NO: 2923889 - RNA, 17 nt, Human
ccaucuugguaaauuuc

SEQ ID NO: 2923890 - RNA, 14 nt, Human
ccaucuugguaaau

SEQ ID NO: 2923891 - RNA, 18 nt, Human
cauugagaacugcauaug

SEQ ID NO: 2923892 - RNA, 23 nt, Human
cauugagaacugcauauguuucg

SEQ ID NO: 2923893 - RNA, 19 nt, Human
cauugagaacugcauaugu

SEQ ID NO: 2923894 - RNA, 12 nt, Human
ccaacaguguga

SEQ ID NO: 2923895 - RNA, 13 nt, Human
ccaacagugugaa

SEQ ID NO: 2923896 - RNA, 14 nt, Human
ccaacagugugaag

SEQ ID NO: 2923897 - RNA, 15 nt, Human
ccaacagugugaagu

SEQ ID NO: 2923898 - RNA, 16 nt, Human
ccaacagugugaaguu

SEQ ID NO: 2923899 - RNA, 19 nt, Human
ccaacagugugaaguuaga

SEQ ID NO: 2923900 - RNA, 22 nt, Human
ccaacagugugaaguuagaauu

SEQ ID NO: 2923901 - RNA, 16 nt, Human
cauguguaaucaauaa

SEQ ID NO: 2923902 - RNA, 23 nt, Human
cauguuuuagacaaauacucaug

SEQ ID NO: 2923903 - RNA, 17 nt, Human
caugcaucuuacugaag

SEQ ID NO: 2923904 - RNA, 16 nt, Human
caugcaucuuacugaa

SEQ ID NO: 2923905 - RNA, 14 nt, Human
caugcaucuuacug

SEQ ID NO: 2923906 - RNA, 19 nt, Human
cauggcaccaaagccacca

SEQ ID NO: 2923907 - RNA, 20 nt, Human
cauggcaccaaagccaccag

SEQ ID NO: 2923908 - RNA, 14 nt, Human
cauggaaugguuau

SEQ ID NO: 2923909 - RNA, 15 nt, Human
cauggaaugguuaua

SEQ ID NO: 2923910 - RNA, 17 nt, Human
cauggaaugguuauaaa

SEQ ID NO: 2923911 - RNA, 21 nt, Human
cauggaaugguuauaaaagug

SEQ ID NO: 2923912 - RNA, 16 nt, Human
caugcuguugauugcu

SEQ ID NO: 2923913 - RNA, 17 nt, Human
caugcuguugauugcua

SEQ ID NO: 2923914 - RNA, 18 nt, Human
caugcuguugauugcuaa

SEQ ID NO: 2923915 - RNA, 19 nt, Human
caugcuguugauugcuaaa

SEQ ID NO: 2923916 - RNA, 20 nt, Human
caugcuguugauugcuaaau

SEQ ID NO: 2923917 - RNA, 21 nt, Human
caugcuguugauugcuaaaug

SEQ ID NO: 2923918 - RNA, 22 nt, Human
caugcuguugauugcuaaaugu

SEQ ID NO: 2923919 - RNA, 23 nt, Human
caugcuguugauugcuaaaugua

SEQ ID NO: 2923920 - RNA, 11 nt, Human
cauacugcugu

SEQ ID NO: 2923921 - RNA, 14 nt, Human
caucuugguaaauu

SEQ ID NO: 2923922 - RNA, 12 nt, Human
caucuugguaaa

SEQ ID NO: 2923923 - RNA, 13 nt, Human
caucuugguaaau

SEQ ID NO: 2923924 - RNA, 15 nt, Human
cauccuaugcaauau

SEQ ID NO: 2923925 - RNA, 18 nt, Human
caucuagcaaauguuaug

SEQ ID NO: 2923926 - RNA, 14 nt, Human
caucuagcaaaugu

SEQ ID NO: 2923927 - RNA, 22 nt, Human
caguuuuccuucucaucuguga

SEQ ID NO: 2923928 - RNA, 13 nt, Human
caguuuuccuucu

SEQ ID NO: 2923929 - RNA, 15 nt, Human
cauaaagucagugcc

SEQ ID NO: 2923930 - RNA, 17 nt, Human
caguguguuugugauug

SEQ ID NO: 2923931 - RNA, 14 nt, Human
cagugguuauuuag

SEQ ID NO: 2923932 - RNA, 21 nt, Human
cagugugaaguuagaauuccu

SEQ ID NO: 2923933 - RNA, 13 nt, Human
cagugugaaguua

SEQ ID NO: 2923934 - RNA, 14 nt, Human
cagugugaaguuag

SEQ ID NO: 2923935 - RNA, 15 nt, Human
cagugugaaguuaga

SEQ ID NO: 2923936 - RNA, 17 nt, Human
cagugugaaguuagaau

SEQ ID NO: 2923937 - RNA, 20 nt, Human
cagugugaaguuagaauucc

SEQ ID NO: 2923938 - RNA, 21 nt, Human
agggugaugccagguucuauu

SEQ ID NO: 2923939 - RNA, 18 nt, Human
auuguauaacagguuauu

SEQ ID NO: 2923940 - RNA, 15 nt, Human T-lymphotropic virus 2
ccugacgucccuccc

SEQ ID NO: 2923941 - RNA, 17 nt, Human T-lymphotropic virus 2
cccucggggaucagcuc

SEQ ID NO: 2923942 - RNA, 21 nt, Human T-lymphotropic virus 2
gcaagcccuuugcgacuuccu

SEQ ID NO: 2923943 - RNA, 20 nt, Human T-lymphotropic virus 2
acuuccugaggaacuccccu

SEQ ID NO: 2923944 - RNA, 20 nt, Human T-lymphotropic virus 2
cccucuugggcagcuauccu

SEQ ID NO: 2923945 - RNA, 22 nt, Human T-lymphotropic virus 2
gcugaaaaacaaggcucugacg

SEQ ID NO: 2923946 - RNA, 16 nt, Human T-lymphotropic virus 2
ucucgguuccucucca

SEQ ID NO: 2923947 - RNA, 12 nt, Human T-lymphotropic virus 2
cuucuuuucccc

SEQ ID NO: 2923948 - RNA, 16 nt, Human T-lymphotropic virus 2
ccaggagcccccucag

SEQ ID NO: 2923949 - RNA, 22 nt, Human T-lymphotropic virus 2
uagacucugccuuaaacuucac

SEQ ID NO: 2923950 - RNA, 14 nt, Human T-lymphotropic virus 2
cagccucucauccu

SEQ ID NO: 2923951 - RNA, 19 nt, Human T-lymphotropic virus 2
agccacaccaaccuccccg

SEQ ID NO: 2923952 - RNA, 15 nt, Human T-lymphotropic virus 2
ccagccacccagggc

SEQ ID NO: 2923953 - RNA, 22 nt, Human T-lymphotropic virus 2
caacaguuugaccccaccgcca

SEQ ID NO: 2923954 - RNA, 15 nt, Human T-lymphotropic virus 2
gguaagucuccucuc

SEQ ID NO: 2923955 - RNA, 14 nt, Human T-lymphotropic virus 2
ggcucgcucccuca

SEQ ID NO: 2923956 - RNA, 16 nt, Human T-lymphotropic virus 2
uguauccguccuccag

SEQ ID NO: 2923957 - RNA, 17 nt, Human T-lymphotropic virus 2
caccucagaacccacuc

SEQ ID NO: 2923958 - RNA, 13 nt, Human T-lymphotropic virus 2
cuauaccucccag

SEQ ID NO: 2923959 - RNA, 15 nt, Human T-lymphotropic virus 2
gauagauccagccuc

SEQ ID NO: 2923960 - RNA, 13 nt, Human T-lymphotropic virus 2
cucuccucuccaa

SEQ ID NO: 2923961 - RNA, 20 nt, Human T-lymphotropic virus 2
uacaucccccaggagccccc

SEQ ID NO: 2923962 - RNA, 16 nt, Human T-lymphotropic virus 2
guaucuccuccuacca

SEQ ID NO: 2923963 - RNA, 18 nt, Human T-lymphotropic virus 2
ugccaagcauggacaucc

SEQ ID NO: 2923964 - RNA, 15 nt, Human T-lymphotropic virus 2
cccuuccaccucagg

SEQ ID NO: 2923965 - RNA, 22 nt, Human T-lymphotropic virus 2
acuuccccuagcgcugaaaaac

SEQ ID NO: 2923966 - RNA, 23 nt, Human T-lymphotropic virus 2
ggcgguacaacaguuugacccca

SEQ ID NO: 2923967 - RNA, 15 nt, Human T-lymphotropic virus 2
ucaucccccugcggc

SEQ ID NO: 2923968 - RNA, 16 nt, Human T-lymphotropic virus 2
cuuuugcuguccuucu

SEQ ID NO: 2923969 - RNA, 16 nt, Human T-lymphotropic virus 2
gcagcaaauccccuag

SEQ ID NO: 2923970 - RNA, 20 nt, Human T-lymphotropic virus 2
cugguggaguaacaggcucc

SEQ ID NO: 2923971 - RNA, 14 nt, Human T-lymphotropic virus 2
ccuggccaccuguc

SEQ ID NO: 2923972 - RNA, 20 nt, Human T-lymphotropic virus 2
auguaaauuucacccaggaa

SEQ ID NO: 2923973 - RNA, 15 nt, Human T-lymphotropic virus 2
gacuacgugcugcca

SEQ ID NO: 2923974 - RNA, 23 nt, Human T-lymphotropic virus 2
ucaacgccgcccucuuggcaggc

SEQ ID NO: 2923975 - RNA, 14 nt, Human T-lymphotropic virus 2
aacagcucuccaga

SEQ ID NO: 2923976 - RNA, 12 nt, Human T-lymphotropic virus 2
aguccuauacac

SEQ ID NO: 2923977 - RNA, 16 nt, Human T-lymphotropic virus 2
aucagcuccccucccu

SEQ ID NO: 2923978 - RNA, 23 nt, Human T-lymphotropic virus 2
gaagacucucuuacaccucccaa

SEQ ID NO: 2923979 - RNA, 21 nt, Human T-lymphotropic virus 2
cuccaggcacugaccacgcau

SEQ ID NO: 2923980 - RNA, 11 nt, Human T-lymphotropic virus 2
cauaggccucg

SEQ ID NO: 2923981 - RNA, 20 nt, Human T-lymphotropic virus 2
uuccgcccaucaaacccucc

SEQ ID NO: 2923982 - RNA, 12 nt, Human T-lymphotropic virus 2
aacaccuucccc

SEQ ID NO: 2923983 - RNA, 22 nt, Human T-lymphotropic virus 2
accuucccccaccuccccaagu

SEQ ID NO: 2923984 - RNA, 13 nt, Human T-lymphotropic virus 2
guccucccggagg

SEQ ID NO: 2923985 - RNA, 22 nt, Human T-lymphotropic virus 2
cucgucauauuguuuggccccu

SEQ ID NO: 2923986 - RNA, 12 nt, Human T-lymphotropic virus 2
uacaccucccaa

SEQ ID NO: 2923987 - RNA, 23 nt, Human T-lymphotropic virus 2
ggcccuccgauuucgacuuccag

SEQ ID NO: 2923988 - RNA, 13 nt, Human T-lymphotropic virus 2
uuccuucccuugc

SEQ ID NO: 2923989 - RNA, 13 nt, Human T-lymphotropic virus 2
ccagcccccacca

SEQ ID NO: 2923990 - RNA, 20 nt, Human T-lymphotropic virus 2
uuggcaggcgucccggggcc

SEQ ID NO: 2923991 - RNA, 17 nt, Human T-lymphotropic virus 2
gacccaaaaggucagac

SEQ ID NO: 2923992 - RNA, 14 nt, Human T-lymphotropic virus 2
ccuuaccccuccca

SEQ ID NO: 2923993 - RNA, 21 nt, Human T-lymphotropic virus 2
ugucagacucgccucucccug

SEQ ID NO: 2923994 - RNA, 12 nt, Human T-lymphotropic virus 2
gcccuccuggcc

SEQ ID NO: 2923995 - RNA, 13 nt, Human T-lymphotropic virus 2
uagccagccccac

SEQ ID NO: 2923996 - RNA, 17 nt, Human T-lymphotropic virus 2
uuccauaaccuucaccu

SEQ ID NO: 2923997 - RNA, 19 nt, Human T-lymphotropic virus 2
ucccgcugcuccuccgcca

SEQ ID NO: 2923998 - RNA, 22 nt, Human T-lymphotropic virus 2
ccguggagcgcagcaagggcua

SEQ ID NO: 2923999 - RNA, 18 nt, Human T-lymphotropic virus 2
ccugaacugcuccuccca

SEQ ID NO: 2924000 - RNA, 15 nt, Human T-lymphotropic virus 2
cuuuccccaacucca

SEQ ID NO: 2924001 - RNA, 18 nt, Human T-lymphotropic virus 2
cggggaucagcuccccuc

SEQ ID NO: 2924002 - RNA, 17 nt, Human T-lymphotropic virus 2
caaagccuuccaucccu

SEQ ID NO: 2924003 - RNA, 19 nt, Human T-lymphotropic virus 2
aaaacccgauggcaaaucc

SEQ ID NO: 2924004 - RNA, 13 nt, Human T-lymphotropic virus 2
uccaugacccucc

SEQ ID NO: 2924005 - RNA, 22 nt, Human T-lymphotropic virus 2
gguguacaggacuucuccccua

SEQ ID NO: 2924006 - RNA, 15 nt, Human T-lymphotropic virus 2
ucccucgccuccccu

SEQ ID NO: 2924007 - RNA, 17 nt, Human T-lymphotropic virus 2
cuguccuaaccuucccc

SEQ ID NO: 2924008 - RNA, 17 nt, Human T-lymphotropic virus 2
ccccuagcgcccccgcc

SEQ ID NO: 2924009 - RNA, 16 nt, Human T-lymphotropic virus 2
cgaccuuaauucccua

SEQ ID NO: 2924010 - RNA, 19 nt, Human T-lymphotropic virus 2
cccucgccuccccuccuuc

SEQ ID NO: 2924011 - RNA, 22 nt, Human T-lymphotropic virus 2
cugcacguggaaccucgaccuu

SEQ ID NO: 2924012 - RNA, 15 nt, Human T-lymphotropic virus 2
ccaaagcccccaggg

SEQ ID NO: 2924013 - RNA, 22 nt, Human T-lymphotropic virus 2
cagacgaccccagcccccacca

SEQ ID NO: 2924014 - RNA, 13 nt, Human T-lymphotropic virus 2
cucgccucucccu

SEQ ID NO: 2924015 - RNA, 23 nt, Human T-lymphotropic virus 2
gcuagggcuuccugaaccucucc

SEQ ID NO: 2924016 - RNA, 17 nt, Human T-lymphotropic virus 2
ccaucuaccuccaccau

SEQ ID NO: 2924017 - RNA, 17 nt, Human T-lymphotropic virus 2
uccuacacacagggaca

SEQ ID NO: 2924018 - RNA, 19 nt, Human T-lymphotropic virus 2
ugaccccaccgccaaggac

SEQ ID NO: 2924019 - RNA, 17 nt, Human T-lymphotropic virus 2
ucacggagacucaccuu

SEQ ID NO: 2924020 - RNA, 17 nt, Human T-lymphotropic virus 2
gcaagggcuagggcuuc

SEQ ID NO: 2924021 - RNA, 15 nt, Human T-lymphotropic virus 2
caaguaaaggcucug

SEQ ID NO: 2924022 - RNA, 16 nt, Human T-lymphotropic virus 2
ucaaacccccucagga

SEQ ID NO: 2924023 - RNA, 22 nt, Human T-lymphotropic virus 2
caagaccaucuaccuccaccau

SEQ ID NO: 2924024 - RNA, 16 nt, Human T-lymphotropic virus 2
acaggacaucacuccc

SEQ ID NO: 2924025 - RNA, 23 nt, Human T-lymphotropic virus 2
cucccaagguaagucuccucuca

SEQ ID NO: 2924026 - RNA, 18 nt, Human T-lymphotropic virus 2
gagccagccacccagggc

SEQ ID NO: 2924027 - RNA, 18 nt, Human T-lymphotropic virus 2
ucccagacgaccccagcc

SEQ ID NO: 2924028 - RNA, 18 nt, Human T-lymphotropic virus 2
uguaacuauggccccggg

SEQ ID NO: 2924029 - RNA, 12 nt, Human T-lymphotropic virus 2
cugucuccucuc

SEQ ID NO: 2924030 - RNA, 19 nt, Human T-lymphotropic virus 2
ccaggcggccuugccaccc

SEQ ID NO: 2924031 - RNA, 17 nt, Human T-lymphotropic virus 2
ccaacccuucuccagga

SEQ ID NO: 2924032 - RNA, 14 nt, Human T-lymphotropic virus 2
caagcccgcggaca

SEQ ID NO: 2924033 - RNA, 20 nt, Human T-lymphotropic virus 2
ucagacucgccucucccugg

SEQ ID NO: 2924034 - RNA, 23 nt, Human T-lymphotropic virus 2
aucucacuagccuaccgacagcc

SEQ ID NO: 2924035 - RNA, 16 nt, Human T-lymphotropic virus 2
cagccccaccaaugag

SEQ ID NO: 2924036 - RNA, 16 nt, Human T-lymphotropic virus 2
ucuccuuggccucauc

SEQ ID NO: 2924037 - RNA, 19 nt, Human T-lymphotropic virus 2
gcuucuauaccucccagac

SEQ ID NO: 2924038 - RNA, 23 nt, Human T-lymphotropic virus 2
ugcaacaacuccauuauccuccc

SEQ ID NO: 2924039 - RNA, 18 nt, Human T-lymphotropic virus 2
uuguaucacccucacccc

SEQ ID NO: 2924040 - RNA, 14 nt, Human T-lymphotropic virus 2
auuccccagccaug

SEQ ID NO: 2924041 - RNA, 13 nt, Human T-lymphotropic virus 2
caagaccaucuac

SEQ ID NO: 2924042 - RNA, 14 nt, Human T-lymphotropic virus 2
cugaaccucuccgg

SEQ ID NO: 2924043 - RNA, 14 nt, Human T-lymphotropic virus 2
caaaccuccucccg

SEQ ID NO: 2924044 - RNA, 13 nt, Human T-lymphotropic virus 2
agccaccaaugcc

SEQ ID NO: 2924045 - RNA, 19 nt, Human T-lymphotropic virus 2
guguacaggacuucucccc

SEQ ID NO: 2924046 - RNA, 23 nt, Human T-lymphotropic virus 2
cgaacaccuucccccaccucccc

SEQ ID NO: 2924047 - RNA, 20 nt, Human T-lymphotropic virus 2
ccuacuugggcugccaagca

SEQ ID NO: 2924048 - RNA, 16 nt, Human T-lymphotropic virus 2
ucccccaggagccccc

SEQ ID NO: 2924049 - RNA, 12 nt, Human T-lymphotropic virus 2
ucgcaccugcuc

SEQ ID NO: 2924050 - RNA, 14 nt, Human T-lymphotropic virus 2
aaaacgaaaccuca

SEQ ID NO: 2924051 - RNA, 15 nt, Human T-lymphotropic virus 2
agaugagucgccccc

SEQ ID NO: 2924052 - RNA, 17 nt, Human T-lymphotropic virus 2
gcagcuauccuacaggg

SEQ ID NO: 2924053 - RNA, 19 nt, Human T-lymphotropic virus 2
cauguccuaacccccucca

SEQ ID NO: 2924054 - RNA, 22 nt, Human T-lymphotropic virus 2
gcagccguccucaaccccauga

SEQ ID NO: 2924055 - RNA, 15 nt, Human T-lymphotropic virus 2
acucaggaccaggca

SEQ ID NO: 2924056 - RNA, 15 nt, Human T-lymphotropic virus 2
cuccuggccaccugu

SEQ ID NO: 2924057 - RNA, 22 nt, Human T-lymphotropic virus 2
cauguaacuauggccccgggac

SEQ ID NO: 2924058 - RNA, 17 nt, Human T-lymphotropic virus 2
ccauguccgcagccaca

SEQ ID NO: 2924059 - RNA, 15 nt, Human T-lymphotropic virus 2
acgugcugccaagcc

SEQ ID NO: 2924060 - RNA, 18 nt, Human T-lymphotropic virus 2
ggcuuccugaaccucucc

SEQ ID NO: 2924061 - RNA, 11 nt, Human T-lymphotropic virus 2
uaccucccaga

SEQ ID NO: 2924062 - RNA, 21 nt, Human T-lymphotropic virus 2
caaggccuccacggccucacc

SEQ ID NO: 2924063 - RNA, 18 nt, Human T-lymphotropic virus 2
ccuccgccaaauccaggc

SEQ ID NO: 2924064 - RNA, 20 nt, Human T-lymphotropic virus 2
gucagaccgucucacacaaa

SEQ ID NO: 2924065 - RNA, 19 nt, Human T-lymphotropic virus 2
agcagccguccucaacccc

SEQ ID NO: 2924066 - RNA, 20 nt, Human T-lymphotropic virus 2
gggguuuaaaaacagcccca

SEQ ID NO: 2924067 - RNA, 13 nt, Human T-lymphotropic virus 2
ucuugcccuuccg

SEQ ID NO: 2924068 - RNA, 15 nt, Human T-lymphotropic virus 2
caacccuucccuugg

SEQ ID NO: 2924069 - RNA, 14 nt, Human T-lymphotropic virus 2
uaggaacugaaacc

SEQ ID NO: 2924070 - RNA, 23 nt, Human T-lymphotropic virus 2
accuacccaccacaauguuccaa

SEQ ID NO: 2924071 - RNA, 18 nt, Human T-lymphotropic virus 2
ggcccccccccacacagc

SEQ ID NO: 2924072 - RNA, 21 nt, Human T-lymphotropic virus 2
ccaccauguccgcagccacac

SEQ ID NO: 2924073 - RNA, 20 nt, Human T-lymphotropic virus 2
cagcgccguucuucaggcca

SEQ ID NO: 2924074 - RNA, 13 nt, Human T-lymphotropic virus 2
uuucuccacccug

SEQ ID NO: 2924075 - RNA, 16 nt, Human T-lymphotropic virus 2
gucaucuuucaaccca

SEQ ID NO: 2924076 - RNA, 21 nt, Human T-lymphotropic virus 2
gaacauguccuaacccccucc

SEQ ID NO: 2924077 - RNA, 12 nt, Human T-lymphotropic virus 2
ccacuagcccag

SEQ ID NO: 2924078 - RNA, 18 nt, Human T-lymphotropic virus 2
aauuacaacaacucuccc

SEQ ID NO: 2924079 - RNA, 15 nt, Human T-lymphotropic virus 2
gcucccucaccgacc

SEQ ID NO: 2924080 - RNA, 19 nt, Human T-lymphotropic virus 2
ccaauggacacucacugaa

SEQ ID NO: 2924081 - RNA, 13 nt, Human T-lymphotropic virus 2
cccugauccuagg

SEQ ID NO: 2924082 - RNA, 15 nt, Human T-lymphotropic virus 2
uucaaacuccuccaa

SEQ ID NO: 2924083 - RNA, 13 nt, Human T-lymphotropic virus 2
augccauucacaa

SEQ ID NO: 2924084 - RNA, 12 nt, Human T-lymphotropic virus 2
ccgcuccucacg

SEQ ID NO: 2924085 - RNA, 16 nt, Human T-lymphotropic virus 2
ccuauacacuccaacu

SEQ ID NO: 2924086 - RNA, 22 nt, Human T-lymphotropic virus 2
accucaacgccgcccucuuggc

SEQ ID NO: 2924087 - RNA, 15 nt, Human T-lymphotropic virus 2
ugcggcuccuccaug

SEQ ID NO: 2924088 - RNA, 16 nt, Human T-lymphotropic virus 2
cuccccccccuucccc

SEQ ID NO: 2924089 - RNA, 18 nt, Human T-lymphotropic virus 2
cauguacucuacaccccc

SEQ ID NO: 2924090 - RNA, 20 nt, Human T-lymphotropic virus 2
cuuccccacccagagaaccu

SEQ ID NO: 2924091 - RNA, 13 nt, Human T-lymphotropic virus 2
acaaaccuccucc

SEQ ID NO: 2924092 - RNA, 15 nt, Human T-lymphotropic virus 2
caauguugcuuccuc

SEQ ID NO: 2924093 - RNA, 15 nt, Human T-lymphotropic virus 2
cuccaguccauccug

SEQ ID NO: 2924094 - RNA, 22 nt, Human T-lymphotropic virus 2
uauaaacuccccggccuuacca

SEQ ID NO: 2924095 - RNA, 20 nt, Human T-lymphotropic virus 2
accccucccaaaccaccucc

SEQ ID NO: 2924096 - RNA, 13 nt, Human T-lymphotropic virus 2
auccuccccccuu

SEQ ID NO: 2924097 - RNA, 21 nt, Human T-lymphotropic virus 2
ccuccgauuucgacuuccagc

SEQ ID NO: 2924098 - RNA, 14 nt, Human T-lymphotropic virus 2
accacuccugucuc

SEQ ID NO: 2924099 - RNA, 13 nt, Human T-lymphotropic virus 2
uagggcuuccuga

SEQ ID NO: 2924100 - RNA, 20 nt, Human T-lymphotropic virus 2
cuccuccaucccaacccuuc

SEQ ID NO: 2924101 - RNA, 20 nt, Human T-lymphotropic virus 2
augucagacucgccucuccc

SEQ ID NO: 2924102 - RNA, 19 nt, Human T-lymphotropic virus 2
aaccugagcgccuccaggc

SEQ ID NO: 2924103 - RNA, 21 nt, Human T-lymphotropic virus 2
ccccaggucuaauauggaccu

SEQ ID NO: 2924104 - RNA, 12 nt, Human T-lymphotropic virus 2
cuccucucagcc

SEQ ID NO: 2924105 - RNA, 23 nt, Human T-lymphotropic virus 2
cuccccaagcaguaccagccaua

SEQ ID NO: 2924106 - RNA, 17 nt, Human T-lymphotropic virus 2
ccucccagacgacccca

SEQ ID NO: 2924107 - RNA, 17 nt, Human T-lymphotropic virus 2
agccacgccccccuccu

SEQ ID NO: 2924108 - RNA, 14 nt, Human T-lymphotropic virus 2
gcucuacuccuccu

SEQ ID NO: 2924109 - RNA, 16 nt, Human T-lymphotropic virus 2
ccuacaacaaugccag

SEQ ID NO: 2924110 - RNA, 18 nt, Human T-lymphotropic virus 2
cugccucuuagacaccca

SEQ ID NO: 2924111 - RNA, 15 nt, Human T-lymphotropic virus 2
cuccugucuccccca

SEQ ID NO: 2924112 - RNA, 19 nt, Human T-lymphotropic virus 2
gcccagcaaggucuuagac

SEQ ID NO: 2924113 - RNA, 17 nt, Human T-lymphotropic virus 2
cuuuuccccuucaggaa

SEQ ID NO: 2924114 - RNA, 23 nt, Human T-lymphotropic virus 2
cuccaggaaccacgacuccucag

SEQ ID NO: 2924115 - RNA, 23 nt, Human T-lymphotropic virus 2
ccaccuccccccccuuccccgga

SEQ ID NO: 2924116 - RNA, 23 nt, Human T-lymphotropic virus 2
gccauguaacuauggccccggga

SEQ ID NO: 2924117 - RNA, 12 nt, Human T-lymphotropic virus 2
cagccuccacca

SEQ ID NO: 2924118 - RNA, 21 nt, Human T-lymphotropic virus 2
ugccuuucuucccucucccgg

SEQ ID NO: 2924119 - RNA, 12 nt, Human T-lymphotropic virus 2
ccuucccuugcc

SEQ ID NO: 2924120 - RNA, 19 nt, Human T-lymphotropic virus 2
uccuccaugacccuccuag

SEQ ID NO: 2924121 - RNA, 21 nt, Human T-lymphotropic virus 2
ccccuggcuuggcuccacacc

SEQ ID NO: 2924122 - RNA, 18 nt, Human T-lymphotropic virus 2
ucugccuuaaacuucacu

SEQ ID NO: 2924123 - RNA, 19 nt, Human T-lymphotropic virus 2
auaacugcaacaacuccau

SEQ ID NO: 2924124 - RNA, 13 nt, Human T-lymphotropic virus 2
aaccaacacccag

SEQ ID NO: 2924125 - RNA, 19 nt, Human T-lymphotropic virus 2
cucagccuccaccaacuuc

SEQ ID NO: 2924126 - RNA, 23 nt, Human T-lymphotropic virus 2
gauuccauaaccuuggcagccaa

SEQ ID NO: 2924127 - RNA, 15 nt, Human T-lymphotropic virus 2
cacaauguuccaacc

SEQ ID NO: 2924128 - RNA, 19 nt, Human T-lymphotropic virus 2
cgacuagccucccgagcca

SEQ ID NO: 2924129 - RNA, 22 nt, Human T-lymphotropic virus 2
ccaauacccaaagcccccaggg

SEQ ID NO: 2924130 - RNA, 11 nt, Human T-lymphotropic virus 2
caaugaggaau

SEQ ID NO: 2924131 - RNA, 23 nt, Human T-lymphotropic virus 2
uccgcauacacgggccccgucuc

SEQ ID NO: 2924132 - RNA, 21 nt, Human T-lymphotropic virus 2
uggcaggcgucccggggccaa

SEQ ID NO: 2924133 - RNA, 16 nt, Human T-lymphotropic virus 2
ccucuccuuccccagg

SEQ ID NO: 2924134 - RNA, 20 nt, Human T-lymphotropic virus 2
acuugacacaggagccgacc

SEQ ID NO: 2924135 - RNA, 18 nt, Human T-lymphotropic virus 2
uaccacuccagccccugu

SEQ ID NO: 2924136 - RNA, 19 nt, Human T-lymphotropic virus 2
aggaguuuuguaccuccua

SEQ ID NO: 2924137 - RNA, 15 nt, Human T-lymphotropic virus 2
ugaagccucuacccc

SEQ ID NO: 2924138 - RNA, 24 nt, Human T-lymphotropic virus 2
ggcaccuccugaacugcuccuccc

SEQ ID NO: 2924139 - RNA, 17 nt, Human T-lymphotropic virus 2
caguaaaagccuucucc

SEQ ID NO: 2924140 - RNA, 19 nt, Human T-lymphotropic virus 2
caccccacaacaacuccau

SEQ ID NO: 2924141 - RNA, 15 nt, Human T-lymphotropic virus 2
cucuugcccaaccac

SEQ ID NO: 2924142 - RNA, 21 nt, Human T-lymphotropic virus 2
uucucgcucuacuccuccucg

SEQ ID NO: 2924143 - RNA, 17 nt, Human T-lymphotropic virus 2
agccaccaaugccauua

SEQ ID NO: 2924144 - RNA, 14 nt, Human T-lymphotropic virus 2
ucuccucucagccc

SEQ ID NO: 2924145 - RNA, 12 nt, Human T-lymphotropic virus 2
ccacaccaaggg

SEQ ID NO: 2924146 - RNA, 21 nt, Human T-lymphotropic virus 2
cuccaugcguuacaugccauu

SEQ ID NO: 2924147 - RNA, 20 nt, Human T-lymphotropic virus 2
ccaucuuacguucccuagcg

SEQ ID NO: 2924148 - RNA, 13 nt, Human T-lymphotropic virus 2
caggagcccccuc

SEQ ID NO: 2924149 - RNA, 16 nt, Human T-lymphotropic virus 2
cucccucgccuucccc

SEQ ID NO: 2924150 - RNA, 13 nt, Human T-lymphotropic virus 2
ccucggcaccucc

SEQ ID NO: 2924151 - RNA, 13 nt, Human T-lymphotropic virus 2
ccuggccccugcc

SEQ ID NO: 2924152 - RNA, 13 nt, Human T-lymphotropic virus 2
acaacaacuccau

SEQ ID NO: 2924153 - RNA, 21 nt, Human T-lymphotropic virus 2
uccccagggccccccgaucuc

SEQ ID NO: 2924154 - RNA, 13 nt, Human T-lymphotropic virus 2
uacuaccacccuc

SEQ ID NO: 2924155 - RNA, 16 nt, Human T-lymphotropic virus 2
gcggcuccuccaugac

SEQ ID NO: 2924156 - RNA, 17 nt, Human T-lymphotropic virus 2
gcugccaagccauggcc

SEQ ID NO: 2924157 - RNA, 15 nt, Human T-lymphotropic virus 2
accuucccccaccuc

SEQ ID NO: 2924158 - RNA, 18 nt, Human T-lymphotropic virus 2
ccauacuucgccuucacc

SEQ ID NO: 2924159 - RNA, 21 nt, Human T-lymphotropic virus 2
gauguaaauuucacccaggaa

SEQ ID NO: 2924160 - RNA, 17 nt, Human T-lymphotropic virus 2
acccacucagccuccac

SEQ ID NO: 2924161 - RNA, 20 nt, Human T-lymphotropic virus 2
auucagucucacacauuuuc

SEQ ID NO: 2924162 - RNA, 13 nt, Human T-lymphotropic virus 2
ucagaacccacuc

SEQ ID NO: 2924163 - RNA, 13 nt, Human T-lymphotropic virus 2
ccccauggcaggg

SEQ ID NO: 2924164 - RNA, 14 nt, Human T-lymphotropic virus 2
cucaaggacccuca

SEQ ID NO: 2924165 - RNA, 23 nt, Human T-lymphotropic virus 2
acacauaauuacaauccugucuc

SEQ ID NO: 2924166 - RNA, 22 nt, Human T-lymphotropic virus 2
ucucccagcuaacccuccaggc

SEQ ID NO: 2924167 - RNA, 13 nt, Human T-lymphotropic virus 2
cucaccuugggga

SEQ ID NO: 2924168 - RNA, 23 nt, Human T-lymphotropic virus 2
caggaaccacgacuccucaggcc

SEQ ID NO: 2924169 - RNA, 11 nt, Human T-lymphotropic virus 2
uagccagcccc

SEQ ID NO: 2924170 - RNA, 16 nt, Human T-lymphotropic virus 2
agacgaccccagcccc

SEQ ID NO: 2924171 - RNA, 21 nt, Human T-lymphotropic virus 2
accucccagacgaccccagcc

SEQ ID NO: 2924172 - RNA, 14 nt, Human T-lymphotropic virus 2
ccuacacacaggga

SEQ ID NO: 2924173 - RNA, 22 nt, Human T-lymphotropic virus 2
cugaagccucuaccccucccaa

SEQ ID NO: 2924174 - RNA, 14 nt, Human T-lymphotropic virus 2
caugcccuccuggc

SEQ ID NO: 2924175 - RNA, 17 nt, Human T-lymphotropic virus 2
agggucuuuagagacac

SEQ ID NO: 2924176 - RNA, 16 nt, Human T-lymphotropic virus 2
cucuuagacacccaca

SEQ ID NO: 2924177 - RNA, 16 nt, Human T-lymphotropic virus 2
acaccuucccccaccu

SEQ ID NO: 2924178 - RNA, 16 nt, Human T-lymphotropic virus 2
ccugcccgcuccucca

SEQ ID NO: 2924179 - RNA, 20 nt, Human T-lymphotropic virus 2
cguggagcgcagcaagggcu

SEQ ID NO: 2924180 - RNA, 15 nt, Human T-lymphotropic virus 2
uucgaaaccaaagcc

SEQ ID NO: 2924181 - RNA, 22 nt, Human T-lymphotropic virus 2
uuccccaacaaaccuccucccg

SEQ ID NO: 2924182 - RNA, 22 nt, Human T-lymphotropic virus 2
cuccuuccauaaccuucaccuu

SEQ ID NO: 2924183 - RNA, 18 nt, Human T-lymphotropic virus 2
acacccaguucaaacucc

SEQ ID NO: 2924184 - RNA, 14 nt, Human T-lymphotropic virus 2
cuacuccuccgcca

SEQ ID NO: 2924185 - RNA, 22 nt, Human T-lymphotropic virus 2
cagccuuaccccaccuacagac

SEQ ID NO: 2924186 - RNA, 16 nt, Human T-lymphotropic virus 2
ggcuaucaacccacca

SEQ ID NO: 2924187 - RNA, 13 nt, Human T-lymphotropic virus 2
cucacauuccucc

SEQ ID NO: 2924188 - RNA, 18 nt, Human T-lymphotropic virus 2
gauguaaauuucacccag

SEQ ID NO: 2924189 - RNA, 21 nt, Human T-lymphotropic virus 2
caggagguggcucgcucccuc

SEQ ID NO: 2924190 - RNA, 22 nt, Human T-lymphotropic virus 2
agucucuuuuggcgccacacca

SEQ ID NO: 2924191 - RNA, 16 nt, Human T-lymphotropic virus 2
uuaaacuucacuuccg

SEQ ID NO: 2924192 - RNA, 18 nt, Human T-lymphotropic virus 2
gccaacaaagaaugccaa

SEQ ID NO: 2924193 - RNA, 14 nt, Human T-lymphotropic virus 2
uccccggaggccca

SEQ ID NO: 2924194 - RNA, 19 nt, Human T-lymphotropic virus 2
cuugacacggcccccugcc

SEQ ID NO: 2924195 - RNA, 15 nt, Human T-lymphotropic virus 2
cugacgucucccccu

SEQ ID NO: 2924196 - RNA, 12 nt, Human T-lymphotropic virus 2
cuuuccuccugc

SEQ ID NO: 2924197 - RNA, 12 nt, Human T-lymphotropic virus 2
acucaccuggga

SEQ ID NO: 2924198 - RNA, 18 nt, Human T-lymphotropic virus 2
agggcuagggcuuccuga

SEQ ID NO: 2924199 - RNA, 17 nt, Human T-lymphotropic virus 2
ccauuggggccuuccuc

SEQ ID NO: 2924200 - RNA, 19 nt, Human T-lymphotropic virus 2
gcaggcgucccggggccaa

SEQ ID NO: 2924201 - RNA, 16 nt, Human T-lymphotropic virus 2
acggcccccugccuuu

SEQ ID NO: 2924202 - RNA, 14 nt, Human T-lymphotropic virus 2
caguccauccugga

SEQ ID NO: 2924203 - RNA, 13 nt, Human T-lymphotropic virus 2
gugcggcuccucc

SEQ ID NO: 2924204 - RNA, 14 nt, Human T-lymphotropic virus 2
gauccuaggcgcca

SEQ ID NO: 2924205 - RNA, 20 nt, Human T-lymphotropic virus 2
ucuccuuccccagggccccc

SEQ ID NO: 2924206 - RNA, 18 nt, Human T-lymphotropic virus 2
caagccauggccuucccu

SEQ ID NO: 2924207 - RNA, 19 nt, Human T-lymphotropic virus 2
aagggcuagggcuuccuga

SEQ ID NO: 2924208 - RNA, 18 nt, Human T-lymphotropic virus 2
cccacucagccuccacca

SEQ ID NO: 2924209 - RNA, 13 nt, Human T-lymphotropic virus 2
acgcccuacaaca

SEQ ID NO: 2924210 - RNA, 21 nt, Human T-lymphotropic virus 2
guccucaaccccaugaggaaa

SEQ ID NO: 2924211 - RNA, 22 nt, Human T-lymphotropic virus 2
ccagcagagccgaugcacacuc

SEQ ID NO: 2924212 - RNA, 21 nt, Human T-lymphotropic virus 2
uaccccucccaccacuccugu

SEQ ID NO: 2924213 - RNA, 20 nt, Human T-lymphotropic virus 2
caaggugauguaacccauua

SEQ ID NO: 2924214 - RNA, 12 nt, Human T-lymphotropic virus 2
uucacccaggaa

SEQ ID NO: 2924215 - RNA, 19 nt, Human T-lymphotropic virus 2
acuagccuaccgacagccu

SEQ ID NO: 2924216 - RNA, 18 nt, Human T-lymphotropic virus 2
gacacccugauccuaggc

SEQ ID NO: 2924217 - RNA, 12 nt, Human T-lymphotropic virus 2
aucucccuucca

SEQ ID NO: 2924218 - RNA, 16 nt, Human T-lymphotropic virus 2
uacaacaacucuccca

SEQ ID NO: 2924219 - RNA, 22 nt, Human T-lymphotropic virus 2
aggcaauaaccccgucuucccc

SEQ ID NO: 2924220 - RNA, 14 nt, Human T-lymphotropic virus 2
auucugcccuucac

SEQ ID NO: 2924221 - RNA, 22 nt, Human T-lymphotropic virus 2
guuuaaaaacagccccacccuc

SEQ ID NO: 2924222 - RNA, 18 nt, Human T-lymphotropic virus 2
ccccaacaucuccauucc

SEQ ID NO: 2924223 - RNA, 16 nt, Human T-lymphotropic virus 2
cugcugaugccuuucu

SEQ ID NO: 2924224 - RNA, 16 nt, Human T-lymphotropic virus 2
ggggaaccccuccugu

SEQ ID NO: 2924225 - RNA, 15 nt, Human T-lymphotropic virus 2
ccccacacagcccug

SEQ ID NO: 2924226 - RNA, 12 nt, Human T-lymphotropic virus 2
ucuccccuagcg

SEQ ID NO: 2924227 - RNA, 13 nt, Human T-lymphotropic virus 2
uaacagcccccuu

SEQ ID NO: 2924228 - RNA, 21 nt, Human T-lymphotropic virus 2
ccccuuagguagucgcucccc

SEQ ID NO: 2924229 - RNA, 15 nt, Human T-lymphotropic virus 2
acccucaccucuccu

SEQ ID NO: 2924230 - RNA, 18 nt, Human T-lymphotropic virus 2
caucucgauacucccacu

SEQ ID NO: 2924231 - RNA, 13 nt, Human T-lymphotropic virus 2
uuguguacaggcc

SEQ ID NO: 2924232 - RNA, 13 nt, Human T-lymphotropic virus 2
acucaccuugggg

SEQ ID NO: 2924233 - RNA, 22 nt, Human T-lymphotropic virus 2
cugguggaguaacaggcucccu

SEQ ID NO: 2924234 - RNA, 18 nt, Human T-lymphotropic virus 2
caccucagaacccacuca

SEQ ID NO: 2924235 - RNA, 19 nt, Human T-lymphotropic virus 2
acgccgcaacagaccacca

SEQ ID NO: 2924236 - RNA, 20 nt, Human T-lymphotropic virus 2
ucucccagcuaacccuccag

SEQ ID NO: 2924237 - RNA, 20 nt, Human T-lymphotropic virus 2
gcaggcccgcccuaggagca

SEQ ID NO: 2924238 - RNA, 19 nt, Human T-lymphotropic virus 2
uuacaacaacucucccagc

SEQ ID NO: 2924239 - RNA, 18 nt, Human T-lymphotropic virus 2
ccccaaagagcccaucuu

SEQ ID NO: 2924240 - RNA, 23 nt, Human T-lymphotropic virus 2
uaacugcaacaacuccauuaucc

SEQ ID NO: 2924241 - RNA, 21 nt, Human T-lymphotropic virus 2
caggcuacaaccccauggcag

SEQ ID NO: 2924242 - RNA, 19 nt, Human T-lymphotropic virus 2
acccgugagggcucccugu

SEQ ID NO: 2924243 - RNA, 14 nt, Human T-lymphotropic virus 2
auccaggcccuucc

SEQ ID NO: 2924244 - RNA, 13 nt, Human T-lymphotropic virus 2
auuggggccuucc

SEQ ID NO: 2924245 - RNA, 14 nt, Human T-lymphotropic virus 2
gucucccggccucg

SEQ ID NO: 2924246 - RNA, 17 nt, Human T-lymphotropic virus 2
cccuccuggccccugcc

SEQ ID NO: 2924247 - RNA, 19 nt, Human T-lymphotropic virus 2
gacaucucgauacucccac

SEQ ID NO: 2924248 - RNA, 15 nt, Human T-lymphotropic virus 2
aucccucgccucccc

SEQ ID NO: 2924249 - RNA, 15 nt, Human T-lymphotropic virus 2
ccucccucgccuucc

SEQ ID NO: 2924250 - RNA, 19 nt, Human T-lymphotropic virus 2
guugagacgccuuccgugg

SEQ ID NO: 2924251 - RNA, 16 nt, Human T-lymphotropic virus 2
cgccccccuccuggcc

SEQ ID NO: 2924252 - RNA, 16 nt, Human T-lymphotropic virus 2
uggacagagccuccua

SEQ ID NO: 2924253 - RNA, 16 nt, Human T-lymphotropic virus 2
gccaauuuucacccuc

SEQ ID NO: 2924254 - RNA, 19 nt, Human T-lymphotropic virus 2
augccaaaaaaucuuacaa

SEQ ID NO: 2924255 - RNA, 24 nt, Human T-lymphotropic virus 2
ucccucgccauuggggccuuccuc

SEQ ID NO: 2924256 - RNA, 12 nt, Human T-lymphotropic virus 2
ccugcccgcucc

SEQ ID NO: 2924257 - RNA, 16 nt, Human T-lymphotropic virus 2
guaguucaguccuccc

SEQ ID NO: 2924258 - RNA, 15 nt, Human T-lymphotropic virus 2
ucucuuacaccuccc

SEQ ID NO: 2924259 - RNA, 22 nt, Human T-lymphotropic virus 2
uccuccccccuuuuucccucgc

SEQ ID NO: 2924260 - RNA, 22 nt, Human T-lymphotropic virus 2
ucccucaccgacccucugguca

SEQ ID NO: 2924261 - RNA, 17 nt, Human T-lymphotropic virus 2
cucugacgucucccccu

SEQ ID NO: 2924262 - RNA, 19 nt, Human T-lymphotropic virus 2
cccagcuaacccuccaggc

SEQ ID NO: 2924263 - RNA, 13 nt, Human T-lymphotropic virus 2
uuaggagccuucc

SEQ ID NO: 2924264 - RNA, 18 nt, Human T-lymphotropic virus 2
ccuccaugacccuccuag

SEQ ID NO: 2924265 - RNA, 13 nt, Human T-lymphotropic virus 2
uuaguaguucagu

SEQ ID NO: 2924266 - RNA, 18 nt, Human T-lymphotropic virus 2
cagcuccucugcucuugg

SEQ ID NO: 2924267 - RNA, 16 nt, Human T-lymphotropic virus 2
uaaugggccagccuuc

SEQ ID NO: 2924268 - RNA, 23 nt, Human T-lymphotropic virus 2
uagaccucacccuuacccacuuc

SEQ ID NO: 2924269 - RNA, 21 nt, Human T-lymphotropic virus 2
ucucacauuaugggacaaauc

SEQ ID NO: 2924270 - RNA, 14 nt, Human T-lymphotropic virus 2
acaagcucuacaac

SEQ ID NO: 2924271 - RNA, 15 nt, Human T-lymphotropic virus 2
uccugaacugcuccu

SEQ ID NO: 2924272 - RNA, 14 nt, Human T-lymphotropic virus 2
gagcucggcugccc

SEQ ID NO: 2924273 - RNA, 22 nt, Human T-lymphotropic virus 2
gccuuaccccaccuacagacca

SEQ ID NO: 2924274 - RNA, 17 nt, Human T-lymphotropic virus 2
cagucauaguccucccg

SEQ ID NO: 2924275 - RNA, 14 nt, Human T-lymphotropic virus 2
agaagcccuccaga

SEQ ID NO: 2924276 - RNA, 22 nt, Human T-lymphotropic virus 2
ucaccuuggggauccauccucu

SEQ ID NO: 2924277 - RNA, 18 nt, Human T-lymphotropic virus 2
ucuccauagacggcuccc

SEQ ID NO: 2924278 - RNA, 12 nt, Human T-lymphotropic virus 2
agcucuccucuc

SEQ ID NO: 2924279 - RNA, 17 nt, Human T-lymphotropic virus 2
gccaaaaaaucuuacaa

SEQ ID NO: 2924280 - RNA, 19 nt, Human T-lymphotropic virus 2
caaccacggaggccccccc

SEQ ID NO: 2924281 - RNA, 13 nt, Human T-lymphotropic virus 2
cuccccccuagga

SEQ ID NO: 2924282 - RNA, 13 nt, Human T-lymphotropic virus 2
gccagcucugcca

SEQ ID NO: 2924283 - RNA, 21 nt, Human T-lymphotropic virus 2
ccuaaccuaauuacuuacucu

SEQ ID NO: 2924284 - RNA, 16 nt, Human T-lymphotropic virus 2
uauacuuauucccaca

SEQ ID NO: 2924285 - RNA, 15 nt, Human T-lymphotropic virus 2
uggaucucccuucca

SEQ ID NO: 2924286 - RNA, 17 nt, Human T-lymphotropic virus 2
cuccuccgccaccuccc

SEQ ID NO: 2924287 - RNA, 16 nt, Human T-lymphotropic virus 2
ucuucccggggaagac

SEQ ID NO: 2924288 - RNA, 16 nt, Human T-lymphotropic virus 2
aguccauccuggaagu

SEQ ID NO: 2924289 - RNA, 22 nt, Human T-lymphotropic virus 2
caggaaccacgacuccucaggc

SEQ ID NO: 2924290 - RNA, 17 nt, Human T-lymphotropic virus 2
cucaaggacccucaagg

SEQ ID NO: 2924291 - RNA, 23 nt, Human T-lymphotropic virus 2
acuagccucccgagccagccacc

SEQ ID NO: 2924292 - RNA, 14 nt, Human T-lymphotropic virus 2
agccuccaccaacu

SEQ ID NO: 2924293 - RNA, 16 nt, Human T-lymphotropic virus 2
uggacuguccuuccac

SEQ ID NO: 2924294 - RNA, 17 nt, Human T-lymphotropic virus 2
gaugucagacucgccuc

SEQ ID NO: 2924295 - RNA, 17 nt, Human T-lymphotropic virus 2
agguggucuauguucca

SEQ ID NO: 2924296 - RNA, 16 nt, Human T-lymphotropic virus 2
accccucuugggcagc

SEQ ID NO: 2924297 - RNA, 20 nt, Human T-lymphotropic virus 2
uccccuagcgcccccgccgc

SEQ ID NO: 2924298 - RNA, 17 nt, Human T-lymphotropic virus 2
agugcggcuccuccaug

SEQ ID NO: 2924299 - RNA, 15 nt, Human T-lymphotropic virus 2
acuagacuguccuaa

SEQ ID NO: 2924300 - RNA, 15 nt, Human T-lymphotropic virus 2
uucccucgcucccgu

SEQ ID NO: 2924301 - RNA, 22 nt, Human T-lymphotropic virus 2
gcagcaagggcuagggcuuccu

SEQ ID NO: 2924302 - RNA, 20 nt, Human T-lymphotropic virus 2
caagguccuuaccccuccca

SEQ ID NO: 2924303 - RNA, 21 nt, Human T-lymphotropic virus 2
cgccucaaccccgcccuaccu

SEQ ID NO: 2924304 - RNA, 18 nt, Human T-lymphotropic virus 2
cacauuaugggacaaauc

SEQ ID NO: 2924305 - RNA, 19 nt, Human T-lymphotropic virus 2
acgauuacccccugcccau

SEQ ID NO: 2924306 - RNA, 16 nt, Human T-lymphotropic virus 2
ccagcuaacccuccag

SEQ ID NO: 2924307 - RNA, 18 nt, Human T-lymphotropic virus 2
aaggacaaaaccaagguc

SEQ ID NO: 2924308 - RNA, 12 nt, Human T-lymphotropic virus 2
uccugucuccuc

SEQ ID NO: 2924309 - RNA, 20 nt, Human T-lymphotropic virus 2
cuuguuccccugacgcccca

SEQ ID NO: 2924310 - RNA, 13 nt, Human T-lymphotropic virus 2
cuccuccuaccac

SEQ ID NO: 2924311 - RNA, 15 nt, Human T-lymphotropic virus 2
gcccgcccuaggagc

SEQ ID NO: 2924312 - RNA, 20 nt, Human T-lymphotropic virus 2
cauugcuaccaaccucgccu

SEQ ID NO: 2924313 - RNA, 17 nt, Human T-lymphotropic virus 2
cuuucuccacccugcca

SEQ ID NO: 2924314 - RNA, 15 nt, Human T-lymphotropic virus 2
ugucauauucugcca

SEQ ID NO: 2924315 - RNA, 23 nt, Human T-lymphotropic virus 2
caccucccaacccuucuccagga

SEQ ID NO: 2924316 - RNA, 17 nt, Human T-lymphotropic virus 2
cucccgagccagccacc

SEQ ID NO: 2924317 - RNA, 20 nt, Human T-lymphotropic virus 2
accaagggaagccaaguccc

SEQ ID NO: 2924318 - RNA, 17 nt, Human T-lymphotropic virus 2
uugacaacggccucccc

SEQ ID NO: 2924319 - RNA, 19 nt, Human T-lymphotropic virus 2
accauacucaggaccaggc

SEQ ID NO: 2924320 - RNA, 14 nt, Human T-lymphotropic virus 2
aucccgaccccaga

SEQ ID NO: 2924321 - RNA, 17 nt, Human T-lymphotropic virus 2
uccuuuccuccugccuc

SEQ ID NO: 2924322 - RNA, 16 nt, Human T-lymphotropic virus 2
cagcucauaggcccug

SEQ ID NO: 2924323 - RNA, 23 nt, Human T-lymphotropic virus 2
ccaauaccuuaucccucgccucc

SEQ ID NO: 2924324 - RNA, 21 nt, Human T-lymphotropic virus 2
cgcaucaagcauucuacccau

SEQ ID NO: 2924325 - RNA, 15 nt, Human T-lymphotropic virus 2
aucgacaugcccucc

SEQ ID NO: 2924326 - RNA, 20 nt, Human T-lymphotropic virus 2
aaggccuccacggccucacc

SEQ ID NO: 2924327 - RNA, 20 nt, Human T-lymphotropic virus 2
ugaccacgcauggccuucca

SEQ ID NO: 2924328 - RNA, 19 nt, Human T-lymphotropic virus 2
ccuccuaccacuccagccc

SEQ ID NO: 2924329 - RNA, 14 nt, Human T-lymphotropic virus 2
ccauuccccagcca

SEQ ID NO: 2924330 - RNA, 23 nt, Human T-lymphotropic virus 2
cagacccuccggcuggcgguaca

SEQ ID NO: 2924331 - RNA, 12 nt, Human T-lymphotropic virus 2
aaucccccuccc

SEQ ID NO: 2924332 - RNA, 17 nt, Human T-lymphotropic virus 2
ccccgucuccaguccau

SEQ ID NO: 2924333 - RNA, 12 nt, Human T-lymphotropic virus 2
auccugucuccu

SEQ ID NO: 2924334 - RNA, 14 nt, Human T-lymphotropic virus 2
cagacgaccccagc

SEQ ID NO: 2924335 - RNA, 12 nt, Human T-lymphotropic virus 2
cccgucucaggu

SEQ ID NO: 2924336 - RNA, 21 nt, Human T-lymphotropic virus 2
cagaacccacucagccuccac

SEQ ID NO: 2924337 - RNA, 19 nt, Human T-lymphotropic virus 2
cccccuuuuucccucgcuc

SEQ ID NO: 2924338 - RNA, 13 nt, Human T-lymphotropic virus 2
caggcauaaccau

SEQ ID NO: 2924339 - RNA, 16 nt, Human T-lymphotropic virus 2
gucccggggccaacau

SEQ ID NO: 2924340 - RNA, 14 nt, Human T-lymphotropic virus 2
aauacacagacucc

SEQ ID NO: 2924341 - RNA, 21 nt, Human T-lymphotropic virus 2
uccgccaccuccccccccuuc

SEQ ID NO: 2924342 - RNA, 14 nt, Human T-lymphotropic virus 2
cucguucuuuccuc

SEQ ID NO: 2924343 - RNA, 16 nt, Human T-lymphotropic virus 2
ccgccgugccguucca

SEQ ID NO: 2924344 - RNA, 18 nt, Human T-lymphotropic virus 2
uuaucccucgccuccccu

SEQ ID NO: 2924345 - RNA, 19 nt, Human T-lymphotropic virus 2
gccacaccaagggaagcca

SEQ ID NO: 2924346 - RNA, 17 nt, Human T-lymphotropic virus 2
cacacuaacagcccccu

SEQ ID NO: 2924347 - RNA, 15 nt, Human T-lymphotropic virus 2
gucccggggccaaca

SEQ ID NO: 2924348 - RNA, 21 nt, Human T-lymphotropic virus 2
ucccuaucuuacaucccccag

SEQ ID NO: 2924349 - RNA, 17 nt, Human T-lymphotropic virus 2
acaguccuccacuacca

SEQ ID NO: 2924350 - RNA, 14 nt, Human T-lymphotropic virus 2
cccaaagcccccag

SEQ ID NO: 2924351 - RNA, 19 nt, Human T-lymphotropic virus 2
cagcucugccaaucuuucc

SEQ ID NO: 2924352 - RNA, 13 nt, Human T-lymphotropic virus 2
uuuccuucccuug

SEQ ID NO: 2924353 - RNA, 12 nt, Human T-lymphotropic virus 2
caucccccagga

SEQ ID NO: 2924354 - RNA, 12 nt, Human T-lymphotropic virus 2
ugcagacccucc

SEQ ID NO: 2924355 - RNA, 16 nt, Human T-lymphotropic virus 2
acacaacaaaccccag

SEQ ID NO: 2924356 - RNA, 21 nt, Human T-lymphotropic virus 2
acgccaacaaagaaugccaaa

SEQ ID NO: 2924357 - RNA, 18 nt, Human T-lymphotropic virus 2
gcuccacaccccccaccc

SEQ ID NO: 2924358 - RNA, 14 nt, Human T-lymphotropic virus 2
cuaacccuccaggc

SEQ ID NO: 2924359 - RNA, 18 nt, Human T-lymphotropic virus 2
uacugaggaaaaaaacuc

SEQ ID NO: 2924360 - RNA, 20 nt, Human T-lymphotropic virus 2
cccaacaaaccuccucccga

SEQ ID NO: 2924361 - RNA, 13 nt, Human T-lymphotropic virus 2
ugcagccuaggcc

SEQ ID NO: 2924362 - RNA, 21 nt, Human T-lymphotropic virus 2
agucuccccuagcgcccccgc

SEQ ID NO: 2924363 - RNA, 18 nt, Human T-lymphotropic virus 2
agcuccucugcucuuggc

SEQ ID NO: 2924364 - RNA, 13 nt, Human T-lymphotropic virus 2
ccucgccuccccu

SEQ ID NO: 2924365 - RNA, 16 nt, Human T-lymphotropic virus 2
gcugccaagccauggc

SEQ ID NO: 2924366 - RNA, 13 nt, Human T-lymphotropic virus 2
gaaaaacaaggcu

SEQ ID NO: 2924367 - RNA, 17 nt, Human T-lymphotropic virus 2
ccaccacaguccuccac

SEQ ID NO: 2924368 - RNA, 23 nt, Human T-lymphotropic virus 2
agcucaggccuggucgagagaac

SEQ ID NO: 2924369 - RNA, 21 nt, Human T-lymphotropic virus 2
cccucggggaucagcuccccu

SEQ ID NO: 2924370 - RNA, 23 nt, Human T-lymphotropic virus 2
uaccccucccaaaccaccuccca

SEQ ID NO: 2924371 - RNA, 22 nt, Human T-lymphotropic virus 2
gacucaccuuggggauccaucc

SEQ ID NO: 2924372 - RNA, 15 nt, Human T-lymphotropic virus 2
acccuucccuuggac

SEQ ID NO: 2924373 - RNA, 22 nt, Human T-lymphotropic virus 2
uacccaagcgcuacuugacaca

SEQ ID NO: 2924374 - RNA, 20 nt, Human T-lymphotropic virus 2
cagacaauuaggagccuucc

SEQ ID NO: 2924375 - RNA, 17 nt, Human T-lymphotropic virus 2
acgccccaaggccucca

SEQ ID NO: 2924376 - RNA, 20 nt, Human T-lymphotropic virus 2
cacaccccccacccuccgac

SEQ ID NO: 2924377 - RNA, 12 nt, Human T-lymphotropic virus 2
cucggcaccucc

SEQ ID NO: 2924378 - RNA, 14 nt, Human T-lymphotropic virus 2
ccugaaccucuccg

SEQ ID NO: 2924379 - RNA, 17 nt, Human T-lymphotropic virus 2
agacgccuuccguggga

SEQ ID NO: 2924380 - RNA, 19 nt, Human T-lymphotropic virus 2
cacuccaacugcugaugcc

SEQ ID NO: 2924381 - RNA, 21 nt, Human T-lymphotropic virus 2
acaacuccauuauccuccccc

SEQ ID NO: 2924382 - RNA, 12 nt, Human T-lymphotropic virus 2
cucaccugggac

SEQ ID NO: 2924383 - RNA, 19 nt, Human T-lymphotropic virus 2
gccuuccccgaaccuggcc

SEQ ID NO: 2924384 - RNA, 17 nt, Human T-lymphotropic virus 2
augccuuucuucccucu

SEQ ID NO: 2924385 - RNA, 15 nt, Human T-lymphotropic virus 2
gaauacaccaacauc

SEQ ID NO: 2924386 - RNA, 19 nt, Human T-lymphotropic virus 2
ccagcuuuccccacccaug

SEQ ID NO: 2924387 - RNA, 22 nt, Human T-lymphotropic virus 2
cucgagguugacaaagacaucu

SEQ ID NO: 2924388 - RNA, 17 nt, Human T-lymphotropic virus 2
cagcccauuucccagga

SEQ ID NO: 2924389 - RNA, 16 nt, Human T-lymphotropic virus 2
cuccccgacccaauuu

SEQ ID NO: 2924390 - RNA, 12 nt, Human T-lymphotropic virus 2
cuuccccuagcg

SEQ ID NO: 2924391 - RNA, 14 nt, Human T-lymphotropic virus 2
aggacuucuccccu

SEQ ID NO: 2924392 - RNA, 14 nt, Human T-lymphotropic virus 2
ccacgggcuuuccc

SEQ ID NO: 2924393 - RNA, 19 nt, Human T-lymphotropic virus 2
gucuccaaggcccuggagg

SEQ ID NO: 2924394 - RNA, 15 nt, Human T-lymphotropic virus 2
augcccuccuggcca

SEQ ID NO: 2924395 - RNA, 22 nt, Human T-lymphotropic virus 2
ugacgucccuccccccuaggaa

SEQ ID NO: 2924396 - RNA, 17 nt, Human T-lymphotropic virus 2
cuucaccauuccccagc

SEQ ID NO: 2924397 - RNA, 21 nt, Human T-lymphotropic virus 2
ucccagcuaacccuccaggca

SEQ ID NO: 2924398 - RNA, 14 nt, Human T-lymphotropic virus 2
ugguguacaggacu

SEQ ID NO: 2924399 - RNA, 16 nt, Human T-lymphotropic virus 2
caucaccucagaaccc

SEQ ID NO: 2924400 - RNA, 20 nt, Human T-lymphotropic virus 2
ccucucaggucgagcucggc

SEQ ID NO: 2924401 - RNA, 17 nt, Human T-lymphotropic virus 2
caggaacagcucuccag

SEQ ID NO: 2924402 - RNA, 12 nt, Human T-lymphotropic virus 2
aaacccaggagu

SEQ ID NO: 2924403 - RNA, 15 nt, Human T-lymphotropic virus 2
cccaggagcccccuc

SEQ ID NO: 2924404 - RNA, 21 nt, Human T-lymphotropic virus 2
gcaauguugcuuccucaacau

SEQ ID NO: 2924405 - RNA, 13 nt, Human T-lymphotropic virus 2
ccuccuggccccu

SEQ ID NO: 2924406 - RNA, 13 nt, Human T-lymphotropic virus 2
acccacucagccu

SEQ ID NO: 2924407 - RNA, 18 nt, Human T-lymphotropic virus 2
cgcucccgcuccucacgc

SEQ ID NO: 2924408 - RNA, 15 nt, Human T-lymphotropic virus 2
caucgaccauugucc

SEQ ID NO: 2924409 - RNA, 14 nt, Human T-lymphotropic virus 2
caacaaaccuccuc

SEQ ID NO: 2924410 - RNA, 14 nt, Human T-lymphotropic virus 2
ccacaacaacucca

SEQ ID NO: 2924411 - RNA, 20 nt, Human T-lymphotropic virus 2
uccugaacugcuccucccaa

SEQ ID NO: 2924412 - RNA, 13 nt, Human T-lymphotropic virus 2
acuguccuuccac

SEQ ID NO: 2924413 - RNA, 17 nt, Human T-lymphotropic virus 2
ccgcucccgcuccucac

SEQ ID NO: 2924414 - RNA, 17 nt, Human T-lymphotropic virus 2
cacccucaccucuccuu

SEQ ID NO: 2924415 - RNA, 14 nt, Human T-lymphotropic virus 2
guaaaggcucugac

SEQ ID NO: 2924416 - RNA, 15 nt, Human T-lymphotropic virus 2
ggucuuuagagacac

SEQ ID NO: 2924417 - RNA, 18 nt, Human T-lymphotropic virus 2
cgccauuggggccuuccu

SEQ ID NO: 2924418 - RNA, 17 nt, Human T-lymphotropic virus 2
gaccagacuauccuuca

SEQ ID NO: 2924419 - RNA, 23 nt, Human T-lymphotropic virus 2
cccaaugggcacgagaagcccuc

SEQ ID NO: 2924420 - RNA, 18 nt, Human T-lymphotropic virus 2
accuccugaacugcuccu

SEQ ID NO: 2924421 - RNA, 20 nt, Human T-lymphotropic virus 2
cugcuuucuccacccugcca

SEQ ID NO: 2924422 - RNA, 21 nt, Human T-lymphotropic virus 2
ucgauacucccacucaucccc

SEQ ID NO: 2924423 - RNA, 20 nt, Human T-lymphotropic virus 2
uccagccucucauccuggca

SEQ ID NO: 2924424 - RNA, 18 nt, Human T-lymphotropic virus 2
ugccaaaaaaucuuacaa

SEQ ID NO: 2924425 - RNA, 22 nt, Human T-lymphotropic virus 2
cagccauguaacuauggccccg

SEQ ID NO: 2924426 - RNA, 12 nt, Human T-lymphotropic virus 2
ccccccccuucc

SEQ ID NO: 2924427 - RNA, 17 nt, Human T-lymphotropic virus 2
auccucuuuccuucccu

SEQ ID NO: 2924428 - RNA, 18 nt, Human T-lymphotropic virus 2
cccagcuaacccuccagg

SEQ ID NO: 2924429 - RNA, 16 nt, Human T-lymphotropic virus 2
gauuacccccugccca

SEQ ID NO: 2924430 - RNA, 18 nt, Human T-lymphotropic virus 2
uacuuuuagccagcccca

SEQ ID NO: 2924431 - RNA, 23 nt, Human T-lymphotropic virus 2
aaccugagcgccuccaggccuua

SEQ ID NO: 2924432 - RNA, 21 nt, Human T-lymphotropic virus 2
cccgauguccagcccuaacuc

SEQ ID NO: 2924433 - RNA, 14 nt, Human T-lymphotropic virus 2
acggccucacccau

SEQ ID NO: 2924434 - RNA, 16 nt, Human T-lymphotropic virus 2
acuguacccagccacg

SEQ ID NO: 2924435 - RNA, 21 nt, Human T-lymphotropic virus 2
uccuccaggaacggcccccuc

SEQ ID NO: 2924436 - RNA, 22 nt, Human T-lymphotropic virus 2
aggagguggcucgcucccucac

SEQ ID NO: 2924437 - RNA, 14 nt, Human T-lymphotropic virus 2
aucaaaacauccuc

SEQ ID NO: 2924438 - RNA, 19 nt, Human T-lymphotropic virus 2
cuccguccccaaaacaucu

SEQ ID NO: 2924439 - RNA, 21 nt, Human T-lymphotropic virus 2
cuccuagggaaaccacuccac

SEQ ID NO: 2924440 - RNA, 16 nt, Human T-lymphotropic virus 2
cuuaucuuagcucccc

SEQ ID NO: 2924441 - RNA, 21 nt, Human T-lymphotropic virus 2
cucccagacgaccccagcccc

SEQ ID NO: 2924442 - RNA, 23 nt, Human T-lymphotropic virus 2
ucaccucagaacccacucagccu

SEQ ID NO: 2924443 - RNA, 14 nt, Human T-lymphotropic virus 2
agaugccccuggau

SEQ ID NO: 2924444 - RNA, 16 nt, Human T-lymphotropic virus 2
gugggaccgucucccg

SEQ ID NO: 2924445 - RNA, 21 nt, Human T-lymphotropic virus 2
uccaagugucggcauccucau

SEQ ID NO: 2924446 - RNA, 15 nt, Human T-lymphotropic virus 2
ucgccgucacugaaa

SEQ ID NO: 2924447 - RNA, 15 nt, Human T-lymphotropic virus 2
cuaacccccuccacg

SEQ ID NO: 2924448 - RNA, 15 nt, Human T-lymphotropic virus 2
aagccauggccuucc

SEQ ID NO: 2924449 - RNA, 16 nt, Human T-lymphotropic virus 2
uauccguccuccagga

SEQ ID NO: 2924450 - RNA, 20 nt, Human T-lymphotropic virus 2
agacucucuuacaccuccca

SEQ ID NO: 2924451 - RNA, 20 nt, Human T-lymphotropic virus 2
cagacgaccccagcccccac

SEQ ID NO: 2924452 - RNA, 20 nt, Human T-lymphotropic virus 2
augccuuucuucccucuccc

SEQ ID NO: 2924453 - RNA, 16 nt, Human T-lymphotropic virus 2
cagccacaccaaccuc

SEQ ID NO: 2924454 - RNA, 23 nt, Human T-lymphotropic virus 2
aacaaucccaaguaaaggcucug

SEQ ID NO: 2924455 - RNA, 18 nt, Human T-lymphotropic virus 2
agagcaccaacucaccug

SEQ ID NO: 2924456 - RNA, 20 nt, Human T-lymphotropic virus 2
uguuccuacacacagggaca

SEQ ID NO: 2924457 - RNA, 17 nt, Human T-lymphotropic virus 2
gguccuuaccccuccca

SEQ ID NO: 2924458 - RNA, 17 nt, Human T-lymphotropic virus 2
cgcucacauuccuccca

SEQ ID NO: 2924459 - RNA, 22 nt, Human T-lymphotropic virus 2
uccgcccaucaaacccuccagg

SEQ ID NO: 2924460 - RNA, 13 nt, Human T-lymphotropic virus 2
ucacacauuuucc

SEQ ID NO: 2924461 - RNA, 15 nt, Human T-lymphotropic virus 2
cucuccaagcggccu

SEQ ID NO: 2924462 - RNA, 20 nt, Human T-lymphotropic virus 2
aacacaacaaaccccaggcc

SEQ ID NO: 2924463 - RNA, 18 nt, Human T-lymphotropic virus 2
caucuuucaacccaagca

SEQ ID NO: 2924464 - RNA, 19 nt, Human T-lymphotropic virus 2
caucuuaacaaccccaggu

SEQ ID NO: 2924465 - RNA, 22 nt, Human T-lymphotropic virus 2
ucauccaagugucggcauccuc

SEQ ID NO: 2924466 - RNA, 19 nt, Human T-lymphotropic virus 2
cuaagugcggcuccuccau

SEQ ID NO: 2924467 - RNA, 20 nt, Human T-lymphotropic virus 2
uuccauaaccuuggcagcca

SEQ ID NO: 2924468 - RNA, 14 nt, Human T-lymphotropic virus 2
ucuccaaggcccug

SEQ ID NO: 2924469 - RNA, 22 nt, Human T-lymphotropic virus 2
gccuccccuccuuccccaccca

SEQ ID NO: 2924470 - RNA, 13 nt, Human T-lymphotropic virus 2
acauuccucccau

SEQ ID NO: 2924471 - RNA, 14 nt, Human T-lymphotropic virus 2
cccaggagcccccu

SEQ ID NO: 2924472 - RNA, 21 nt, Human T-lymphotropic virus 2
cuaacccccgcucacauuccu

SEQ ID NO: 2924473 - RNA, 19 nt, Human T-lymphotropic virus 2
ccucgcucccguaccuccu

SEQ ID NO: 2924474 - RNA, 16 nt, Human T-lymphotropic virus 2
ugggaccgucucccgg

SEQ ID NO: 2924475 - RNA, 20 nt, Human T-lymphotropic virus 2
acaucucgauacucccacuc

SEQ ID NO: 2924476 - RNA, 22 nt, Human T-lymphotropic virus 2
acaacggaccaacgacuacacc

SEQ ID NO: 2924477 - RNA, 15 nt, Human T-lymphotropic virus 2
cccucaccgacccuc

SEQ ID NO: 2924478 - RNA, 16 nt, Human T-lymphotropic virus 2
agacaauuaggagccu

SEQ ID NO: 2924479 - RNA, 15 nt, Human T-lymphotropic virus 2
aucaaugcgaaagca

SEQ ID NO: 2924480 - RNA, 16 nt, Human T-lymphotropic virus 2
ugacaaagacaucucc

SEQ ID NO: 2924481 - RNA, 21 nt, Human T-lymphotropic virus 2
cccccagggggcuaucaaccc

SEQ ID NO: 2924482 - RNA, 13 nt, Human T-lymphotropic virus 2
ccaaacagacagg

SEQ ID NO: 2924483 - RNA, 17 nt, Human T-lymphotropic virus 2
cggccucggcaccuccu

SEQ ID NO: 2924484 - RNA, 17 nt, Human T-lymphotropic virus 2
ggcucccuaucucuggc

SEQ ID NO: 2924485 - RNA, 16 nt, Human T-lymphotropic virus 2
cacaccaaccuccccg

SEQ ID NO: 2924486 - RNA, 15 nt, Human T-lymphotropic virus 2
cguggagcgcagcaa

SEQ ID NO: 2924487 - RNA, 21 nt, Human T-lymphotropic virus 2
uaacacacuaauuaccgaggc

SEQ ID NO: 2924488 - RNA, 15 nt, Human T-lymphotropic virus 2
ccuaccucuccuugg

SEQ ID NO: 2924489 - RNA, 22 nt, Human T-lymphotropic virus 2
ccauucucgcucuacuccuccu

SEQ ID NO: 2924490 - RNA, 13 nt, Human T-lymphotropic virus 2
ccaacccuucccu

SEQ ID NO: 2924491 - RNA, 18 nt, Human T-lymphotropic virus 2
ccuucucgguuccucucc

SEQ ID NO: 2924492 - RNA, 17 nt, Human T-lymphotropic virus 2
uugaaccauacucagga

SEQ ID NO: 2924493 - RNA, 15 nt, Human T-lymphotropic virus 2
uccgauggcuccccu

SEQ ID NO: 2924494 - RNA, 16 nt, Human T-lymphotropic virus 2
cauugcaaucccucca

SEQ ID NO: 2924495 - RNA, 13 nt, Human T-lymphotropic virus 2
cuuaccccaaagc

SEQ ID NO: 2924496 - RNA, 22 nt, Human T-lymphotropic virus 2
agcgcccccgccgccccaguuc

SEQ ID NO: 2924497 - RNA, 14 nt, Human T-lymphotropic virus 2
cagccuugcucucc

SEQ ID NO: 2924498 - RNA, 20 nt, Human T-lymphotropic virus 2
uaggccucgaacaccuuccc

SEQ ID NO: 2924499 - RNA, 15 nt, Human T-lymphotropic virus 2
cggccuugccacccc

SEQ ID NO: 2924500 - RNA, 16 nt, Human T-lymphotropic virus 2
cacaauguuccaaccc

SEQ ID NO: 2924501 - RNA, 19 nt, Human T-lymphotropic virus 2
ugaauuccuccauucucac

SEQ ID NO: 2924502 - RNA, 12 nt, Human T-lymphotropic virus 2
ccacuuccccua

SEQ ID NO: 2924503 - RNA, 18 nt, Human T-lymphotropic virus 2
ugccugguguacaggacu

SEQ ID NO: 2924504 - RNA, 22 nt, Human T-lymphotropic virus 2
ugcggcuccuccaugacccucc

SEQ ID NO: 2924505 - RNA, 18 nt, Human T-lymphotropic virus 2
cuccugaacugcuccucc

SEQ ID NO: 2924506 - RNA, 23 nt, Human T-lymphotropic virus 2
gcagggccccuaagaaugcaggc

SEQ ID NO: 2924507 - RNA, 13 nt, Human T-lymphotropic virus 2
acggagacucacc

SEQ ID NO: 2924508 - RNA, 17 nt, Human T-lymphotropic virus 2
ccauccucuuuccuucc

SEQ ID NO: 2924509 - RNA, 13 nt, Human T-lymphotropic virus 2
aucccucgccucc

SEQ ID NO: 2924510 - RNA, 12 nt, Human T-lymphotropic virus 2
ccccccuucccc

SEQ ID NO: 2924511 - RNA, 20 nt, Human T-lymphotropic virus 2
ccuacuacuacuccuccgcc

SEQ ID NO: 2924512 - RNA, 12 nt, Human T-lymphotropic virus 2
uuccuccugccu

SEQ ID NO: 2924513 - RNA, 15 nt, Human T-lymphotropic virus 2
cagucucacacauuu

SEQ ID NO: 2924514 - RNA, 15 nt, Human T-lymphotropic virus 2
acaucccccaggagc

SEQ ID NO: 2924515 - RNA, 16 nt, Human T-lymphotropic virus 2
acccgugaccccucuu

SEQ ID NO: 2924516 - RNA, 19 nt, Human T-lymphotropic virus 2
accaguuuauguccuuggg

SEQ ID NO: 2924517 - RNA, 22 nt, Human T-lymphotropic virus 2
acagucauaguccucccggagg

SEQ ID NO: 2924518 - RNA, 19 nt, Human T-lymphotropic virus 2
ucaaggacccucaaggucc

SEQ ID NO: 2924519 - RNA, 14 nt, Human T-lymphotropic virus 2
auuucacccaggaa

SEQ ID NO: 2924520 - RNA, 13 nt, Human T-lymphotropic virus 2
acuuccagcagcu

SEQ ID NO: 2924521 - RNA, 23 nt, Human T-lymphotropic virus 2
uuccaguaaaagccuucuccucg

SEQ ID NO: 2924522 - RNA, 19 nt, Human T-lymphotropic virus 2
auugcaaucccuccaggaa

SEQ ID NO: 2924523 - RNA, 19 nt, Human T-lymphotropic virus 2
aaccccaccagcucaggcc

SEQ ID NO: 2924524 - RNA, 20 nt, Human T-lymphotropic virus 2
uguacaggacuucuccccua

SEQ ID NO: 2924525 - RNA, 17 nt, Human T-lymphotropic virus 2
aggaacuccccucaucc

SEQ ID NO: 2924526 - RNA, 18 nt, Human T-lymphotropic virus 2
ucaccucagaacccacuc

SEQ ID NO: 2924527 - RNA, 15 nt, Human T-lymphotropic virus 2
cccugacgucccucc

SEQ ID NO: 2924528 - RNA, 17 nt, Human T-lymphotropic virus 2
accccauggcagggccc

SEQ ID NO: 2924529 - RNA, 22 nt, Human T-lymphotropic virus 2
ccuucaacaggacaucacuccc

SEQ ID NO: 2924530 - RNA, 16 nt, Human T-lymphotropic virus 2
cuccucugcucuuggc

SEQ ID NO: 2924531 - RNA, 18 nt, Human T-lymphotropic virus 2
aauccugucuccucucag

SEQ ID NO: 2924532 - RNA, 16 nt, Human T-lymphotropic virus 2
cuccccucaaaaggca

SEQ ID NO: 2924533 - RNA, 16 nt, Human T-lymphotropic virus 2
caacaacucucccagc

SEQ ID NO: 2924534 - RNA, 21 nt, Human T-lymphotropic virus 2
aaccauccucuuuccuucccu

SEQ ID NO: 2924535 - RNA, 19 nt, Human T-lymphotropic virus 2
gcagccacaccaaccuccc

SEQ ID NO: 2924536 - RNA, 17 nt, Human T-lymphotropic virus 2
cccuaucucuggcuucc

SEQ ID NO: 2924537 - RNA, 20 nt, Human T-lymphotropic virus 2
cgcucggcuagacucugccu

SEQ ID NO: 2924538 - RNA, 21 nt, Human T-lymphotropic virus 2
uucaacaggacaucacucccc

SEQ ID NO: 2924539 - RNA, 17 nt, Human T-lymphotropic virus 2
acaccucagccuaccca

SEQ ID NO: 2924540 - RNA, 16 nt, Human T-lymphotropic virus 2
ggcucugacgucuccc

SEQ ID NO: 2924541 - RNA, 13 nt, Human T-lymphotropic virus 2
acccgccuacauc

SEQ ID NO: 2924542 - RNA, 16 nt, Human T-lymphotropic virus 2
caucccaacccuuccc

SEQ ID NO: 2924543 - RNA, 15 nt, Human T-lymphotropic virus 2
caacaacucucccag

SEQ ID NO: 2924544 - RNA, 18 nt, Human T-lymphotropic virus 2
ugcucuuggcagccccca

SEQ ID NO: 2924545 - RNA, 22 nt, Human T-lymphotropic virus 2
cauggccuuccaauuucccagg

SEQ ID NO: 2924546 - RNA, 20 nt, Human T-lymphotropic virus 2
gcuacuugacacaggagccg

SEQ ID NO: 2924547 - RNA, 22 nt, Human T-lymphotropic virus 2
ucccucucccggcgcuuuugau

SEQ ID NO: 2924548 - RNA, 21 nt, Human T-lymphotropic virus 2
auuacaauccugucuccucuc

SEQ ID NO: 2924549 - RNA, 15 nt, Human T-lymphotropic virus 2
cugcacguggaaccu

SEQ ID NO: 2924550 - RNA, 22 nt, Human T-lymphotropic virus 2
ucuccaggaaccacgacuccuc

SEQ ID NO: 2924551 - RNA, 22 nt, Human T-lymphotropic virus 2
ccuuaaaugaccuggucuccaa

SEQ ID NO: 2924552 - RNA, 22 nt, Human T-lymphotropic virus 2
cgcugguggaguaacaggcucc

SEQ ID NO: 2924553 - RNA, 20 nt, Human T-lymphotropic virus 2
ccccuccuguuggaucuccc

SEQ ID NO: 2924554 - RNA, 23 nt, Human T-lymphotropic virus 2
ccuccggcgacaagacgccgccg

SEQ ID NO: 2924555 - RNA, 22 nt, Human T-lymphotropic virus 2
caccagaugucagacucgccuc

SEQ ID NO: 2924556 - RNA, 18 nt, Human T-lymphotropic virus 2
uacacccccaacaucucc

SEQ ID NO: 2924557 - RNA, 16 nt, Human T-lymphotropic virus 2
gaacccacucagccuc

SEQ ID NO: 2924558 - RNA, 23 nt, Human T-lymphotropic virus 2
acaggcucccuaucucuggcuuc

SEQ ID NO: 2924559 - RNA, 19 nt, Human T-lymphotropic virus 2
cgccgcccucuuggcaggc

SEQ ID NO: 2924560 - RNA, 14 nt, Human T-lymphotropic virus 2
cucagccuccacca

SEQ ID NO: 2924561 - RNA, 16 nt, Human T-lymphotropic virus 2
uucaugcagacccucc

SEQ ID NO: 2924562 - RNA, 17 nt, Human T-lymphotropic virus 2
ccucccaacccuucucc

SEQ ID NO: 2924563 - RNA, 15 nt, Human T-lymphotropic virus 2
cuucgaacaacaauu

SEQ ID NO: 2924564 - RNA, 22 nt, Human T-lymphotropic virus 2
augacauacuuuuagccagccc

SEQ ID NO: 2924565 - RNA, 13 nt, Human T-lymphotropic virus 2
ccagccucucauc

SEQ ID NO: 2924566 - RNA, 19 nt, Human T-lymphotropic virus 2
ccugccucuuagacaccca

SEQ ID NO: 2924567 - RNA, 13 nt, Human T-lymphotropic virus 2
aaggcccuggagg

SEQ ID NO: 2924568 - RNA, 22 nt, Human T-lymphotropic virus 2
cgccagugggcaaaccaacacc

SEQ ID NO: 2924569 - RNA, 18 nt, Human T-lymphotropic virus 2
aaccacggcccugacguc

SEQ ID NO: 2924570 - RNA, 16 nt, Human T-lymphotropic virus 2
cagcuuuccccaccca

SEQ ID NO: 2924571 - RNA, 18 nt, Human T-lymphotropic virus 2
gcuccucacgcuccugca

SEQ ID NO: 2924572 - RNA, 20 nt, Human T-lymphotropic virus 2
cugccaagccauggccuucc

SEQ ID NO: 2924573 - RNA, 17 nt, Human T-lymphotropic virus 2
ccugagcgccuccaggc

SEQ ID NO: 2924574 - RNA, 18 nt, Human T-lymphotropic virus 2
gccccuggcuuggcucca

SEQ ID NO: 2924575 - RNA, 23 nt, Human T-lymphotropic virus 2
uacacuccaacugcugaugccuu

SEQ ID NO: 2924576 - RNA, 21 nt, Human T-lymphotropic virus 2
cacccaguucaaacuccucca

SEQ ID NO: 2924577 - RNA, 16 nt, Human T-lymphotropic virus 2
cucacauuccucccau

SEQ ID NO: 2924578 - RNA, 19 nt, Human T-lymphotropic virus 2
gccaagauccuucucacug

SEQ ID NO: 2924579 - RNA, 18 nt, Human T-lymphotropic virus 2
ucccacucaucccccugc

SEQ ID NO: 2924580 - RNA, 15 nt, Human T-lymphotropic virus 2
uggcuggcugcuuuc

SEQ ID NO: 2924581 - RNA, 13 nt, Human T-lymphotropic virus 2
ucccccguuaucc

SEQ ID NO: 2924582 - RNA, 20 nt, Human T-lymphotropic virus 2
cuucaccauuccccagccau

SEQ ID NO: 2924583 - RNA, 17 nt, Human T-lymphotropic virus 2
accagcucaggccuggu

SEQ ID NO: 2924584 - RNA, 17 nt, Human T-lymphotropic virus 2
uccuaucuacucucuca

SEQ ID NO: 2924585 - RNA, 15 nt, Human T-lymphotropic virus 2
agcgcagcaagggcu

SEQ ID NO: 2924586 - RNA, 18 nt, Human T-lymphotropic virus 2
gauugguaucuccuccua

SEQ ID NO: 2924587 - RNA, 23 nt, Human T-lymphotropic virus 2
uaccauugacccauccacagucc

SEQ ID NO: 2924588 - RNA, 13 nt, Human T-lymphotropic virus 2
ccucucaggucga

SEQ ID NO: 2924589 - RNA, 14 nt, Human T-lymphotropic virus 2
caauuucccaggaa

SEQ ID NO: 2924590 - RNA, 16 nt, Human T-lymphotropic virus 2
accuuggcagccaacc

SEQ ID NO: 2924591 - RNA, 19 nt, Human T-lymphotropic virus 2
uagacaaugccauucacaa

SEQ ID NO: 2924592 - RNA, 17 nt, Human T-lymphotropic virus 2
ucucgguuccucuccag

SEQ ID NO: 2924593 - RNA, 14 nt, Human T-lymphotropic virus 2
ucaagucuccccua

SEQ ID NO: 2924594 - RNA, 19 nt, Human T-lymphotropic virus 2
ggccgguaaagcuccacga

SEQ ID NO: 2924595 - RNA, 14 nt, Human T-lymphotropic virus 2
ccuccgccaccucc

SEQ ID NO: 2924596 - RNA, 17 nt, Human T-lymphotropic virus 2
caucaccggcuggggac

SEQ ID NO: 2924597 - RNA, 14 nt, Human T-lymphotropic virus 2
cccucuuggcaggc

SEQ ID NO: 2924598 - RNA, 15 nt, Human T-lymphotropic virus 2
cugagcgccuccagg

SEQ ID NO: 2924599 - RNA, 22 nt, Human T-lymphotropic virus 2
acccggguuuccgccugcgcuc

SEQ ID NO: 2924600 - RNA, 14 nt, Human T-lymphotropic virus 2
gcaaucccuccagg

SEQ ID NO: 2924601 - RNA, 14 nt, Human T-lymphotropic virus 2
cugaaaccacggcc

SEQ ID NO: 2924602 - RNA, 19 nt, Human T-lymphotropic virus 2
ccaaccgucugguccgugg

SEQ ID NO: 2924603 - RNA, 21 nt, Human T-lymphotropic virus 2
ccgggauuugaauuccuccau

SEQ ID NO: 2924604 - RNA, 14 nt, Human T-lymphotropic virus 2
uccacggccucacc

SEQ ID NO: 2924605 - RNA, 17 nt, Human T-lymphotropic virus 2
caccaauuacuccugca

SEQ ID NO: 2924606 - RNA, 20 nt, Human T-lymphotropic virus 2
uccacagcgguuacaaaacc

SEQ ID NO: 2924607 - RNA, 16 nt, Human T-lymphotropic virus 2
ccgccugcgcucggcu

SEQ ID NO: 2924608 - RNA, 16 nt, Human T-lymphotropic virus 2
gaccuacccaccacaa

SEQ ID NO: 2924609 - RNA, 12 nt, Human T-lymphotropic virus 2
aggcccuuccac

SEQ ID NO: 2924610 - RNA, 14 nt, Human T-lymphotropic virus 2
aucagcuccccucc

SEQ ID NO: 2924611 - RNA, 13 nt, Human T-lymphotropic virus 2
aacugaaaccacg

SEQ ID NO: 2924612 - RNA, 13 nt, Human T-lymphotropic virus 2
cuggucacggaga

SEQ ID NO: 2924613 - RNA, 18 nt, Human T-lymphotropic virus 2
aucaaauaccuacauucc

SEQ ID NO: 2924614 - RNA, 17 nt, Human T-lymphotropic virus 2
guccaugacuccgaccu

SEQ ID NO: 2924615 - RNA, 15 nt, Human T-lymphotropic virus 2
guucaucaccucaga

SEQ ID NO: 2924616 - RNA, 18 nt, Human T-lymphotropic virus 2
caaacaccauaggccucg

SEQ ID NO: 2924617 - RNA, 18 nt, Human T-lymphotropic virus 2
ucaaacgccaacaaagaa

SEQ ID NO: 2924618 - RNA, 19 nt, Human T-lymphotropic virus 2
acucgcuuuuagcuagccu

SEQ ID NO: 2924619 - RNA, 22 nt, Human T-lymphotropic virus 2
ccuccuaguagaugccccugga

SEQ ID NO: 2924620 - RNA, 16 nt, Human T-lymphotropic virus 2
cuccucaggccaauuu

SEQ ID NO: 2924621 - RNA, 18 nt, Human T-lymphotropic virus 2
uauaccagcuuuccccac

SEQ ID NO: 2924622 - RNA, 21 nt, Human T-lymphotropic virus 2
ccacgacuccucaggccaauu

SEQ ID NO: 2924623 - RNA, 22 nt, Human T-lymphotropic virus 2
uuugcguggauagauccagccu

SEQ ID NO: 2924624 - RNA, 16 nt, Human T-lymphotropic virus 2
uugguaucuccuccua

SEQ ID NO: 2924625 - RNA, 19 nt, Human T-lymphotropic virus 2
gauguaaauuucacccagg

SEQ ID NO: 2924626 - RNA, 19 nt, Human T-lymphotropic virus 2
cacuucucuaagugcggcu

SEQ ID NO: 2924627 - RNA, 13 nt, Human T-lymphotropic virus 2
acugcuccuccca

SEQ ID NO: 2924628 - RNA, 18 nt, Human T-lymphotropic virus 2
ccccgauguccagcccua

SEQ ID NO: 2924629 - RNA, 20 nt, Human T-lymphotropic virus 2
ccagacaggcauaaccauuc

SEQ ID NO: 2924630 - RNA, 23 nt, Human T-lymphotropic virus 2
ccgcagccacaccaaccuccccg

SEQ ID NO: 2924631 - RNA, 16 nt, Human T-lymphotropic virus 2
cauugcuaccaaccuc

SEQ ID NO: 2924632 - RNA, 11 nt, Human T-lymphotropic virus 2
uuccuuacacc

SEQ ID NO: 2924633 - RNA, 13 nt, Human T-lymphotropic virus 2
ccguccucaaccc

SEQ ID NO: 2924634 - RNA, 13 nt, Human T-lymphotropic virus 2
acgccccaaggcc

SEQ ID NO: 2924635 - RNA, 22 nt, Human T-lymphotropic virus 2
cuccccgacccaauuuccaccu

SEQ ID NO: 2924636 - RNA, 13 nt, Human T-lymphotropic virus 2
cuguccuuccaca

SEQ ID NO: 2924637 - RNA, 23 nt, Human T-lymphotropic virus 2
gcuuaacuuucuccaggcugcuu

SEQ ID NO: 2924638 - RNA, 15 nt, Human T-lymphotropic virus 2
uacucuacaccccca

SEQ ID NO: 2924639 - RNA, 17 nt, Human T-lymphotropic virus 2
ucaggcacuacugagga

SEQ ID NO: 2924640 - RNA, 16 nt, Human T-lymphotropic virus 2
acagacucccuuaucu

SEQ ID NO: 2924641 - RNA, 15 nt, Human T-lymphotropic virus 2
cuguccagagcacca

SEQ ID NO: 2924642 - RNA, 21 nt, Human T-lymphotropic virus 2
ccuccugaacugcuccuccca

SEQ ID NO: 2924643 - RNA, 19 nt, Human T-lymphotropic virus 2
ccuccccgacccaauuucc

SEQ ID NO: 2924644 - RNA, 21 nt, Human T-lymphotropic virus 2
cagccacgccccccuccuggc

SEQ ID NO: 2924645 - RNA, 19 nt, Human T-lymphotropic virus 2
caaaucccccuccccaagc

SEQ ID NO: 2924646 - RNA, 20 nt, Human T-lymphotropic virus 2
cucccucaccgacccucugg

SEQ ID NO: 2924647 - RNA, 20 nt, Human T-lymphotropic virus 2
acacauauucuugcccuucc

SEQ ID NO: 2924648 - RNA, 14 nt, Human T-lymphotropic virus 2
cgguuccucuccag

SEQ ID NO: 2924649 - RNA, 18 nt, Human T-lymphotropic virus 2
ucccggccucggcaccuc

SEQ ID NO: 2924650 - RNA, 14 nt, Human T-lymphotropic virus 2
aagucuccucucag

SEQ ID NO: 2924651 - RNA, 22 nt, Human T-lymphotropic virus 2
ucucccggcgcuuuugauccuu

SEQ ID NO: 2924652 - RNA, 18 nt, Human T-lymphotropic virus 2
ccuccuggccaccugucc

SEQ ID NO: 2924653 - RNA, 22 nt, Human T-lymphotropic virus 2
caccucagaacccacucagccu

SEQ ID NO: 2924654 - RNA, 14 nt, Human T-lymphotropic virus 2
cccuaccucuccuu

SEQ ID NO: 2924655 - RNA, 17 nt, Human T-lymphotropic virus 2
ucccuauauucugcccu

SEQ ID NO: 2924656 - RNA, 17 nt, Human T-lymphotropic virus 2
cccagccacgccccccu

SEQ ID NO: 2924657 - RNA, 15 nt, Human T-lymphotropic virus 2
guggagcgcagcaag

SEQ ID NO: 2924658 - RNA, 22 nt, Human T-lymphotropic virus 2
ucaccucuccuuccccagggcc

SEQ ID NO: 2924659 - RNA, 19 nt, Human T-lymphotropic virus 2
gagcuuguaucacccucac

SEQ ID NO: 2924660 - RNA, 20 nt, Human T-lymphotropic virus 2
cccucucacgaaacacauuc

SEQ ID NO: 2924661 - RNA, 12 nt, Human T-lymphotropic virus 2
cuccuccaugac

SEQ ID NO: 2924662 - RNA, 13 nt, Human T-lymphotropic virus 2
cccgcugcuccuc

SEQ ID NO: 2924663 - RNA, 16 nt, Human T-lymphotropic virus 2
uccccagggccccccg

SEQ ID NO: 2924664 - RNA, 22 nt, Human T-lymphotropic virus 2
cucaccuuggggauccauccuc

SEQ ID NO: 2924665 - RNA, 15 nt, Human T-lymphotropic virus 2
gaacugaaaccacgg

SEQ ID NO: 2924666 - RNA, 23 nt, Human T-lymphotropic virus 2
uaugcauggacuguccuuccaca

SEQ ID NO: 2924667 - RNA, 17 nt, Human T-lymphotropic virus 2
caacauaacugccgugg

SEQ ID NO: 2924668 - RNA, 17 nt, Human T-lymphotropic virus 2
uguauccguccuccagg

SEQ ID NO: 2924669 - RNA, 15 nt, Human T-lymphotropic virus 2
aaagaaagaaaccag

SEQ ID NO: 2924670 - RNA, 15 nt, Human T-lymphotropic virus 2
cguugucagcucucc

SEQ ID NO: 2924671 - RNA, 14 nt, Human T-lymphotropic virus 2
augggacaaacacc

SEQ ID NO: 2924672 - RNA, 17 nt, Human T-lymphotropic virus 2
accuacauucccucgcc

SEQ ID NO: 2924673 - RNA, 17 nt, Human T-lymphotropic virus 2
cauugcuaccaaccucg

SEQ ID NO: 2924674 - RNA, 12 nt, Human T-lymphotropic virus 2
ugcccuccuggc

SEQ ID NO: 2924675 - RNA, 18 nt, Human T-lymphotropic virus 2
ccuccgccaacagucucc

SEQ ID NO: 2924676 - RNA, 13 nt, Human T-lymphotropic virus 2
uuccuccugccuc

SEQ ID NO: 2924677 - RNA, 13 nt, Human T-lymphotropic virus 2
uaggcaggcccgc

SEQ ID NO: 2924678 - RNA, 22 nt, Human T-lymphotropic virus 2
ccaacuccaauacccaaagccc

SEQ ID NO: 2924679 - RNA, 21 nt, Human T-lymphotropic virus 2
ccccaguucaugcagacccuc

SEQ ID NO: 2924680 - RNA, 21 nt, Human T-lymphotropic virus 2
gcuuccugaaccucuccggga

SEQ ID NO: 2924681 - RNA, 16 nt, Human T-lymphotropic virus 2
cagcccccaccaauug

SEQ ID NO: 2924682 - RNA, 18 nt, Human T-lymphotropic virus 2
uacaagaucuccuccagu

SEQ ID NO: 2924683 - RNA, 16 nt, Human T-lymphotropic virus 2
ccugaggaacuccccu

SEQ ID NO: 2924684 - RNA, 15 nt, Human T-lymphotropic virus 2
caccgacccucuggu

SEQ ID NO: 2924685 - RNA, 11 nt, Human T-lymphotropic virus 2
acuccagcccc

SEQ ID NO: 2924686 - RNA, 21 nt, Human T-lymphotropic virus 2
ccccaaaacaucuacaccacc

SEQ ID NO: 2924687 - RNA, 14 nt, Human T-lymphotropic virus 2
ccaugacuccgacc

SEQ ID NO: 2924688 - RNA, 15 nt, Human T-lymphotropic virus 2
gaaaaaaauagaccu

SEQ ID NO: 2924689 - RNA, 15 nt, Human T-lymphotropic virus 2
uccacccugccaggc

SEQ ID NO: 2924690 - RNA, 16 nt, Human T-lymphotropic virus 2
caucccccaggagccc

SEQ ID NO: 2924691 - RNA, 13 nt, Human T-lymphotropic virus 2
gccagccacccag

SEQ ID NO: 2924692 - RNA, 17 nt, Human T-lymphotropic virus 2
auuuccggcccuuaccc

SEQ ID NO: 2924693 - RNA, 13 nt, Human T-lymphotropic virus 2
uaguccucccgga

SEQ ID NO: 2924694 - RNA, 19 nt, Human T-lymphotropic virus 2
cacugaaaacgaaaccuca

SEQ ID NO: 2924695 - RNA, 13 nt, Human T-lymphotropic virus 2
uauaccucccaga

SEQ ID NO: 2924696 - RNA, 20 nt, Human T-lymphotropic virus 2
cugcuccuccgccaacaguc

SEQ ID NO: 2924697 - RNA, 18 nt, Human T-lymphotropic virus 2
caagcgcuacuugacaca

SEQ ID NO: 2924698 - RNA, 16 nt, Human T-lymphotropic virus 2
uacaauccugucuccu

SEQ ID NO: 2924699 - RNA, 19 nt, Human T-lymphotropic virus 2
uggaagacucucuuacacc

SEQ ID NO: 2924700 - RNA, 14 nt, Human T-lymphotropic virus 2
gcccagcagagccg

SEQ ID NO: 2924701 - RNA, 17 nt, Human T-lymphotropic virus 2
caccauuccccagccau

SEQ ID NO: 2924702 - RNA, 20 nt, Human T-lymphotropic virus 2
ccuccuuccccacccagaga

SEQ ID NO: 2924703 - RNA, 22 nt, Human T-lymphotropic virus 2
caaaacaucuacaccaccuggg

SEQ ID NO: 2924704 - RNA, 21 nt, Human T-lymphotropic virus 2
gcauacacgggccccgucucc

SEQ ID NO: 2924705 - RNA, 15 nt, Human T-lymphotropic virus 2
gucagcucuccucuc

SEQ ID NO: 2924706 - RNA, 15 nt, Human T-lymphotropic virus 2
ccucgaacaccuucc

SEQ ID NO: 2924707 - RNA, 21 nt, Human T-lymphotropic virus 2
caggccaauuuucacccucuc

SEQ ID NO: 2924708 - RNA, 21 nt, Human T-lymphotropic virus 2
uccuccaucccaacccuuccc

SEQ ID NO: 2924709 - RNA, 15 nt, Human T-lymphotropic virus 2
uaccuuaucccucgc

SEQ ID NO: 2924710 - RNA, 17 nt, Human T-lymphotropic virus 2
auacaauacuccuccuu

SEQ ID NO: 2924711 - RNA, 15 nt, Human T-lymphotropic virus 2
caucaaaacccagga

SEQ ID NO: 2924712 - RNA, 15 nt, Human T-lymphotropic virus 2
aaagccuucuccucg

SEQ ID NO: 2924713 - RNA, 18 nt, Human T-lymphotropic virus 2
gccccuggauaugauccu

SEQ ID NO: 2924714 - RNA, 23 nt, Human T-lymphotropic virus 2
cagcaagggcuagggcuuccuga

SEQ ID NO: 2924715 - RNA, 22 nt, Human T-lymphotropic virus 2
agacaucucgauacucccacuc

SEQ ID NO: 2924716 - RNA, 17 nt, Human T-lymphotropic virus 2
acguggaacccaccacc

SEQ ID NO: 2924717 - RNA, 14 nt, Human T-lymphotropic virus 2
cugccuuaaacuuc

SEQ ID NO: 2924718 - RNA, 18 nt, Human T-lymphotropic virus 2
uucaccauuccccagcca

SEQ ID NO: 2924719 - RNA, 15 nt, Human T-lymphotropic virus 2
auccucuuuccuucc

SEQ ID NO: 2924720 - RNA, 22 nt, Human T-lymphotropic virus 2
caacaccauggguaauguuuuc

SEQ ID NO: 2924721 - RNA, 18 nt, Human T-lymphotropic virus 2
caggcacuacugaggaaa

SEQ ID NO: 2924722 - RNA, 11 nt, Human T-lymphotropic virus 2
accucagccua

SEQ ID NO: 2924723 - RNA, 15 nt, Human T-lymphotropic virus 2
agggaagccaagucc

SEQ ID NO: 2924724 - RNA, 13 nt, Human T-lymphotropic virus 2
ccuuccaauuucc

SEQ ID NO: 2924725 - RNA, 19 nt, Human T-lymphotropic virus 2
auccucuuuccuucccuug

SEQ ID NO: 2924726 - RNA, 18 nt, Human T-lymphotropic virus 2
guccucaaccccaugagg

SEQ ID NO: 2924727 - RNA, 23 nt, Human T-lymphotropic virus 2
cccuugcucgcuacaaugccccu

SEQ ID NO: 2924728 - RNA, 17 nt, Human T-lymphotropic virus 2
ccaagguuccaccugcc

SEQ ID NO: 2924729 - RNA, 15 nt, Human T-lymphotropic virus 2
uugacaaagacaucu

SEQ ID NO: 2924730 - RNA, 21 nt, Human T-lymphotropic virus 2
cucacgaaacacauuccgcac

SEQ ID NO: 2924731 - RNA, 18 nt, Human T-lymphotropic virus 2
cucucccagcuaacccuc

SEQ ID NO: 2924732 - RNA, 14 nt, Human T-lymphotropic virus 2
cgaucccgacccca

SEQ ID NO: 2924733 - RNA, 21 nt, Human T-lymphotropic virus 2
agcaggaggucagcuccucug

SEQ ID NO: 2924734 - RNA, 18 nt, Human T-lymphotropic virus 2
cgcguugucagcucuccu

SEQ ID NO: 2924735 - RNA, 12 nt, Human T-lymphotropic virus 2
ggggccaacaua

SEQ ID NO: 2924736 - RNA, 15 nt, Human T-lymphotropic virus 2
gucuccucucagccc

SEQ ID NO: 2924737 - RNA, 22 nt, Human T-lymphotropic virus 2
ugccauucaacaagcucuacaa

SEQ ID NO: 2924738 - RNA, 20 nt, Human T-lymphotropic virus 2
uggcuuaacuuucuccaggc

SEQ ID NO: 2924739 - RNA, 23 nt, Human T-lymphotropic virus 2
uacaccucccaacccuucuccag

SEQ ID NO: 2924740 - RNA, 22 nt, Human T-lymphotropic virus 2
uuuuccaaaucccccuccccaa

SEQ ID NO: 2924741 - RNA, 15 nt, Human T-lymphotropic virus 2
agggauauccaggaa

SEQ ID NO: 2924742 - RNA, 21 nt, Human T-lymphotropic virus 2
acugaccacgcauggccuucc

SEQ ID NO: 2924743 - RNA, 17 nt, Human T-lymphotropic virus 2
gccguccucaaccccau

SEQ ID NO: 2924744 - RNA, 23 nt, Human T-lymphotropic virus 2
ugcccuccuggccaccuguccag

SEQ ID NO: 2924745 - RNA, 22 nt, Human T-lymphotropic virus 2
agacgccgccgugccguuccaa

SEQ ID NO: 2924746 - RNA, 11 nt, Human T-lymphotropic virus 2
cgccgcccucu

SEQ ID NO: 2924747 - RNA, 19 nt, Human T-lymphotropic virus 2
uuuuuccgauggcuccccu

SEQ ID NO: 2924748 - RNA, 18 nt, Human T-lymphotropic virus 2
ugcugccaauagccacuc

SEQ ID NO: 2924749 - RNA, 19 nt, Human T-lymphotropic virus 2
aagguaagucuccucucag

SEQ ID NO: 2924750 - RNA, 16 nt, Human T-lymphotropic virus 2
aucuuggacuguccca

SEQ ID NO: 2924751 - RNA, 17 nt, Human T-lymphotropic virus 2
agcuaacccuccaggca

SEQ ID NO: 2924752 - RNA, 15 nt, Human T-lymphotropic virus 2
ccgguaaagcuccac

SEQ ID NO: 2924753 - RNA, 22 nt, Human T-lymphotropic virus 2
caagcaggaggucagcuccucu

SEQ ID NO: 2924754 - RNA, 15 nt, Human T-lymphotropic virus 2
ugacacggcccccug

SEQ ID NO: 2924755 - RNA, 20 nt, Human T-lymphotropic virus 2
acgcguugucagcucuccuc

SEQ ID NO: 2924756 - RNA, 14 nt, Human T-lymphotropic virus 2
ugagcgccuccagg

SEQ ID NO: 2924757 - RNA, 20 nt, Human T-lymphotropic virus 2
ccagcugaccuuacagagca

SEQ ID NO: 2924758 - RNA, 16 nt, Human T-lymphotropic virus 2
cucaaacccccucagg

SEQ ID NO: 2924759 - RNA, 15 nt, Human T-lymphotropic virus 2
uucaugcagacccuc

SEQ ID NO: 2924760 - RNA, 21 nt, Human T-lymphotropic virus 2
acuucuccccuaucacuccau

SEQ ID NO: 2924761 - RNA, 21 nt, Human T-lymphotropic virus 2
uacaugccauucaacaagcuc

SEQ ID NO: 2924762 - RNA, 17 nt, Human T-lymphotropic virus 2
uccgauggcuccccuca

SEQ ID NO: 2924763 - RNA, 15 nt, Human T-lymphotropic virus 2
cauccucauucacca

SEQ ID NO: 2924764 - RNA, 13 nt, Human T-lymphotropic virus 2
acaaaaccaaggu

SEQ ID NO: 2924765 - RNA, 22 nt, Human T-lymphotropic virus 2
ugccuuucuucccucucccggc

SEQ ID NO: 2924766 - RNA, 21 nt, Human T-lymphotropic virus 2
cuugacacggcccccugccuu

SEQ ID NO: 2924767 - RNA, 22 nt, Human T-lymphotropic virus 2
ucugcgccgcucccgcuccuca

SEQ ID NO: 2924768 - RNA, 20 nt, Human T-lymphotropic virus 2
caccuccugaacugcuccuc

SEQ ID NO: 2924769 - RNA, 22 nt, Human T-lymphotropic virus 2
acauucgccggggccucuugcc

SEQ ID NO: 2924770 - RNA, 22 nt, Human T-lymphotropic virus 2
uggcccuugacaacggccuccc

SEQ ID NO: 2924771 - RNA, 17 nt, Human T-lymphotropic virus 2
gccucuuagacacccac

SEQ ID NO: 2924772 - RNA, 21 nt, Human T-lymphotropic virus 2
uccacgggcuuuccccaacuc

SEQ ID NO: 2924773 - RNA, 14 nt, Human T-lymphotropic virus 2
ccucuucgccguca

SEQ ID NO: 2924774 - RNA, 14 nt, Human T-lymphotropic virus 2
uccccugcccucuc

SEQ ID NO: 2924775 - RNA, 14 nt, Human T-lymphotropic virus 2
uacuuauucccaca

SEQ ID NO: 2924776 - RNA, 18 nt, Human T-lymphotropic virus 2
aaauucgaaaccaaagcc

SEQ ID NO: 2924777 - RNA, 13 nt, Human T-lymphotropic virus 2
guaaaggcucuga

SEQ ID NO: 2924778 - RNA, 23 nt, Human T-lymphotropic virus 2
gccaauuuucacccucucccccg

SEQ ID NO: 2924779 - RNA, 23 nt, Human T-lymphotropic virus 2
cccacaacucaaacccccucagg

SEQ ID NO: 2924780 - RNA, 18 nt, Human T-lymphotropic virus 2
caccaauuacuccugcau

SEQ ID NO: 2924781 - RNA, 13 nt, Human T-lymphotropic virus 2
cucuagacaaaua

SEQ ID NO: 2924782 - RNA, 20 nt, Human T-lymphotropic virus 2
agcuuguaucacccucaccc

SEQ ID NO: 2924783 - RNA, 16 nt, Human T-lymphotropic virus 2
cccggguuuccgccug

SEQ ID NO: 2924784 - RNA, 21 nt, Human T-lymphotropic virus 2
uccgcccaucaaacccuccag

SEQ ID NO: 2924785 - RNA, 12 nt, Human T-lymphotropic virus 2
uccuaaccuucc

SEQ ID NO: 2924786 - RNA, 21 nt, Human T-lymphotropic virus 2
ccuccacggccucacccauug

SEQ ID NO: 2924787 - RNA, 23 nt, Human T-lymphotropic virus 2
uacucucucaucagcuuauacaa

SEQ ID NO: 2924788 - RNA, 16 nt, Human T-lymphotropic virus 2
acaggucaucuccccu

SEQ ID NO: 2924789 - RNA, 16 nt, Human T-lymphotropic virus 2
gucccuccccccuagg

SEQ ID NO: 2924790 - RNA, 12 nt, Human T-lymphotropic virus 2
ucaucuccccua

SEQ ID NO: 2924791 - RNA, 22 nt, Human T-lymphotropic virus 2
uaccucccagacgaccccagcc

SEQ ID NO: 2924792 - RNA, 20 nt, Human T-lymphotropic virus 2
caggcuacaaccccauggca

SEQ ID NO: 2924793 - RNA, 18 nt, Human T-lymphotropic virus 2
cuaagugcggcuccucca

SEQ ID NO: 2924794 - RNA, 16 nt, Human T-lymphotropic virus 2
ccaccuguccagagca

SEQ ID NO: 2924795 - RNA, 14 nt, Human T-lymphotropic virus 2
auccauccucucca

SEQ ID NO: 2924796 - RNA, 13 nt, Human T-lymphotropic virus 2
agacaccuucucc

SEQ ID NO: 2924797 - RNA, 22 nt, Human T-lymphotropic virus 2
agaggucuauugcuauaggcag

SEQ ID NO: 2924798 - RNA, 18 nt, Human T-lymphotropic virus 2
ggcggccuugccaccccu

SEQ ID NO: 2924799 - RNA, 19 nt, Human T-lymphotropic virus 2
cggcccuuaccccaaagca

SEQ ID NO: 2924800 - RNA, 20 nt, Human T-lymphotropic virus 2
agucuccgacgagagucucg

SEQ ID NO: 2924801 - RNA, 13 nt, Human T-lymphotropic virus 2
accuccaccaugu

SEQ ID NO: 2924802 - RNA, 14 nt, Human T-lymphotropic virus 2
cucuuggcagcccc

SEQ ID NO: 2924803 - RNA, 19 nt, Human T-lymphotropic virus 2
uaaaccugagcgccuccag

SEQ ID NO: 2924804 - RNA, 17 nt, Human T-lymphotropic virus 2
ccuagguucgucccccu

SEQ ID NO: 2924805 - RNA, 14 nt, Human T-lymphotropic virus 2
cuagacucugccuu

SEQ ID NO: 2924806 - RNA, 14 nt, Human T-lymphotropic virus 2
accuggccuccguc

SEQ ID NO: 2924807 - RNA, 17 nt, Human T-lymphotropic virus 2
cccccaagguuccaccu

SEQ ID NO: 2924808 - RNA, 21 nt, Human T-lymphotropic virus 2
ucccggccucggcaccuccug

SEQ ID NO: 2924809 - RNA, 19 nt, Human T-lymphotropic virus 2
gguaucuccuccuaccacu

SEQ ID NO: 2924810 - RNA, 21 nt, Human T-lymphotropic virus 2
caacaggacaucacuccccug

SEQ ID NO: 2924811 - RNA, 19 nt, Human T-lymphotropic virus 2
uaggacaggucaucucccc

SEQ ID NO: 2924812 - RNA, 21 nt, Human T-lymphotropic virus 2
gguggaguaacaggcucccua

SEQ ID NO: 2924813 - RNA, 17 nt, Human T-lymphotropic virus 2
cuccaggcggccuugcc

SEQ ID NO: 2924814 - RNA, 18 nt, Human T-lymphotropic virus 2
ccuccaucccaacccuuc

SEQ ID NO: 2924815 - RNA, 15 nt, Human T-lymphotropic virus 2
cuccuccgccaccuc

SEQ ID NO: 2924816 - RNA, 13 nt, Human T-lymphotropic virus 2
uauauucugcccu

SEQ ID NO: 2924817 - RNA, 12 nt, Human T-lymphotropic virus 2
auggacacucac

SEQ ID NO: 2924818 - RNA, 12 nt, Human T-lymphotropic virus 2
ggcaccuccuga

SEQ ID NO: 2924819 - RNA, 19 nt, Human T-lymphotropic virus 2
cucggcugccccuuaggua

SEQ ID NO: 2924820 - RNA, 23 nt, Human T-lymphotropic virus 2
ccucaagguccuuaccccuccca

SEQ ID NO: 2924821 - RNA, 22 nt, Human T-lymphotropic virus 2
cacaccaagggaagccaagucc

SEQ ID NO: 2924822 - RNA, 20 nt, Human T-lymphotropic virus 2
ucaccucuccuuccccaggg

SEQ ID NO: 2924823 - RNA, 21 nt, Human T-lymphotropic virus 2
gucuucccggggaagacaaac

SEQ ID NO: 2924824 - RNA, 17 nt, Human T-lymphotropic virus 2
aguguggcuugucuccg

SEQ ID NO: 2924825 - RNA, 19 nt, Human T-lymphotropic virus 2
ucgcucccguaccuccucc

SEQ ID NO: 2924826 - RNA, 20 nt, Human T-lymphotropic virus 2
cucagaacccacucagccuc

SEQ ID NO: 2924827 - RNA, 16 nt, Human T-lymphotropic virus 2
cacacaaacaauccca

SEQ ID NO: 2924828 - RNA, 18 nt, Human T-lymphotropic virus 2
uacucaaauuuauccagc

SEQ ID NO: 2924829 - RNA, 16 nt, Human T-lymphotropic virus 2
cccaaggccuccacgg

SEQ ID NO: 2924830 - RNA, 13 nt, Human T-lymphotropic virus 2
ccacggccucacc

SEQ ID NO: 2924831 - RNA, 18 nt, Human T-lymphotropic virus 2
cagacucgccucucccug

SEQ ID NO: 2924832 - RNA, 18 nt, Human T-lymphotropic virus 2
uccccaacaaaccuccuc

SEQ ID NO: 2924833 - RNA, 14 nt, Human T-lymphotropic virus 2
ccauaaccuuggca

SEQ ID NO: 2924834 - RNA, 19 nt, Human T-lymphotropic virus 2
ggccgccucaaccccgccc

SEQ ID NO: 2924835 - RNA, 14 nt, Human T-lymphotropic virus 2
cuccuuccccaggg

SEQ ID NO: 2924836 - RNA, 13 nt, Human T-lymphotropic virus 2
ucagcuccccucc

SEQ ID NO: 2924837 - RNA, 17 nt, Human T-lymphotropic virus 2
guaguucaguccucccu

SEQ ID NO: 2924838 - RNA, 13 nt, Human T-lymphotropic virus 2
acaggcuacaacc

SEQ ID NO: 2924839 - RNA, 14 nt, Human T-lymphotropic virus 2
aagccaagucccuu

SEQ ID NO: 2924840 - RNA, 12 nt, Human T-lymphotropic virus 2
uccaccugccuu

SEQ ID NO: 2924841 - RNA, 15 nt, Human T-lymphotropic virus 2
gccguccucaacccc

SEQ ID NO: 2924842 - RNA, 21 nt, Human T-lymphotropic virus 2
cccaccacaauguuccaaccc

SEQ ID NO: 2924843 - RNA, 15 nt, Human T-lymphotropic virus 2
gcagccacaccaacc

SEQ ID NO: 2924844 - RNA, 14 nt, Human T-lymphotropic virus 2
cuuccgugggaccg

SEQ ID NO: 2924845 - RNA, 17 nt, Human T-lymphotropic virus 2
guggcaagguaggacac

SEQ ID NO: 2924846 - RNA, 14 nt, Human T-lymphotropic virus 2
ugcggcuccuccau

SEQ ID NO: 2924847 - RNA, 17 nt, Human T-lymphotropic virus 2
uucgaaaccaaagccuu

SEQ ID NO: 2924848 - RNA, 21 nt, Human T-lymphotropic virus 2
ugacccuugcucgcuacaaug

SEQ ID NO: 2924849 - RNA, 21 nt, Human T-lymphotropic virus 2
ccagcuaacccuccaggcacu

SEQ ID NO: 2924850 - RNA, 16 nt, Human T-lymphotropic virus 2
cgcauacacgggcccc

SEQ ID NO: 2924851 - RNA, 14 nt, Human T-lymphotropic virus 2
ccaacccuucccuu

SEQ ID NO: 2924852 - RNA, 22 nt, Human T-lymphotropic virus 2
augccuggaaccaacccucggg

SEQ ID NO: 2924853 - RNA, 19 nt, Human T-lymphotropic virus 2
ccucuucgccgucacugaa

SEQ ID NO: 2924854 - RNA, 17 nt, Human T-lymphotropic virus 2
ccacgcauggccuucca

SEQ ID NO: 2924855 - RNA, 19 nt, Human T-lymphotropic virus 2
aggaaggggaaccccuccu

SEQ ID NO: 2924856 - RNA, 13 nt, Human T-lymphotropic virus 2
cgccacaccaagg

SEQ ID NO: 2924857 - RNA, 13 nt, Human T-lymphotropic virus 2
cuaccccucccaa

SEQ ID NO: 2924858 - RNA, 17 nt, Human T-lymphotropic virus 2
cuccccucauccaagug

SEQ ID NO: 2924859 - RNA, 22 nt, Human T-lymphotropic virus 2
cagccauacuucgccuucacca

SEQ ID NO: 2924860 - RNA, 14 nt, Human T-lymphotropic virus 2
ggacgaccuaccca

SEQ ID NO: 2924861 - RNA, 23 nt, Human T-lymphotropic virus 2
ccgacgagagucucgcaccugcu

SEQ ID NO: 2924862 - RNA, 22 nt, Human T-lymphotropic virus 2
ccauacuucgccuucaccauuc

SEQ ID NO: 2924863 - RNA, 18 nt, Human T-lymphotropic virus 2
ggccucggcaccuccuga

SEQ ID NO: 2924864 - RNA, 17 nt, Human T-lymphotropic virus 2
cgagcucggcugccccu

SEQ ID NO: 2924865 - RNA, 17 nt, Human T-lymphotropic virus 2
caaagacaucucccacc

SEQ ID NO: 2924866 - RNA, 16 nt, Human T-lymphotropic virus 2
cucccgaaccauccuc

SEQ ID NO: 2924867 - RNA, 17 nt, Human T-lymphotropic virus 2
ccuccuggccccugccc

SEQ ID NO: 2924868 - RNA, 19 nt, Human T-lymphotropic virus 2
cucaaccccgcccuaccuc

SEQ ID NO: 2924869 - RNA, 21 nt, Human T-lymphotropic virus 2
cuccuguuggaucucccuucc

SEQ ID NO: 2924870 - RNA, 21 nt, Human T-lymphotropic virus 2
acaacaugucaaagcaagccc

SEQ ID NO: 2924871 - RNA, 23 nt, Human T-lymphotropic virus 2
caggaggaaggggaaccccuccu

SEQ ID NO: 2924872 - RNA, 19 nt, Human T-lymphotropic virus 2
cguucuuuccucuucgccg

SEQ ID NO: 2924873 - RNA, 14 nt, Human T-lymphotropic virus 2
cugccaccccagac

SEQ ID NO: 2924874 - RNA, 15 nt, Human T-lymphotropic virus 2
ugcccgcuccuccau

SEQ ID NO: 2924875 - RNA, 20 nt, Human T-lymphotropic virus 2
cuuacaccucccaacccuuc

SEQ ID NO: 2924876 - RNA, 18 nt, Human T-lymphotropic virus 2
ugcuuucuccacccugcc

SEQ ID NO: 2924877 - RNA, 17 nt, Human T-lymphotropic virus 2
caucccaacccuucccu

SEQ ID NO: 2924878 - RNA, 22 nt, Human T-lymphotropic virus 2
cagauguaaauuucacccagga

SEQ ID NO: 2924879 - RNA, 12 nt, Human T-lymphotropic virus 2
ugcccgcuccuc

SEQ ID NO: 2924880 - RNA, 12 nt, Human T-lymphotropic virus 2
acaacaacucca

SEQ ID NO: 2924881 - RNA, 21 nt, Human T-lymphotropic virus 2
ucauucaugaccuaagagcca

SEQ ID NO: 2924882 - RNA, 17 nt, Human T-lymphotropic virus 2
cucaccucuccuucccc

SEQ ID NO: 2924883 - RNA, 16 nt, Human T-lymphotropic virus 2
ccaucaaaacccagga

SEQ ID NO: 2924884 - RNA, 14 nt, Human T-lymphotropic virus 2
ugacgccccaaggc

SEQ ID NO: 2924885 - RNA, 16 nt, Human T-lymphotropic virus 2
cugucccaaugggcac

SEQ ID NO: 2924886 - RNA, 19 nt, Human T-lymphotropic virus 2
ccaacccgucugcacgugg

SEQ ID NO: 2924887 - RNA, 13 nt, Human T-lymphotropic virus 2
aguaccagccaua

SEQ ID NO: 2924888 - RNA, 22 nt, Human T-lymphotropic virus 2
cacccaggaagucagccaagug

SEQ ID NO: 2924889 - RNA, 14 nt, Human T-lymphotropic virus 2
ucuccccuaucacu

SEQ ID NO: 2924890 - RNA, 20 nt, Human T-lymphotropic virus 2
ucuccgggagaggucuauug

SEQ ID NO: 2924891 - RNA, 21 nt, Human T-lymphotropic virus 2
cucuaagugcggcuccuccau

SEQ ID NO: 2924892 - RNA, 15 nt, Human T-lymphotropic virus 2
gccagccacccaggg

SEQ ID NO: 2924893 - RNA, 14 nt, Human T-lymphotropic virus 2
ucccaacccuucuc

SEQ ID NO: 2924894 - RNA, 19 nt, Human T-lymphotropic virus 2
uaagugcggcuccuccaug

SEQ ID NO: 2924895 - RNA, 16 nt, Human T-lymphotropic virus 2
ccuucuuuuccccuuc

SEQ ID NO: 2924896 - RNA, 19 nt, Human T-lymphotropic virus 2
cgucucccggccucggcac

SEQ ID NO: 2924897 - RNA, 11 nt, Human T-lymphotropic virus 2
aacccccucca

SEQ ID NO: 2924898 - RNA, 16 nt, Human T-lymphotropic virus 2
uccaaacaccauaggc

SEQ ID NO: 2924899 - RNA, 12 nt, Human T-lymphotropic virus 2
caaggcucugac

SEQ ID NO: 2924900 - RNA, 16 nt, Human T-lymphotropic virus 2
ccuccuaccacuccag

SEQ ID NO: 2924901 - RNA, 22 nt, Human T-lymphotropic virus 2
ccagccccuguagcccaaccca

SEQ ID NO: 2924902 - RNA, 15 nt, Human T-lymphotropic virus 2
ucacauuccucccau

SEQ ID NO: 2924903 - RNA, 11 nt, Human T-lymphotropic virus 2
cacuccagccc

SEQ ID NO: 2924904 - RNA, 18 nt, Human T-lymphotropic virus 2
uccguccccaaaacaucu

SEQ ID NO: 2924905 - RNA, 23 nt, Human T-lymphotropic virus 2
cucaaaaggcagcguacguucuc

SEQ ID NO: 2924906 - RNA, 13 nt, Human T-lymphotropic virus 2
gcuauaggcaggc

SEQ ID NO: 2924907 - RNA, 15 nt, Human T-lymphotropic virus 2
caccaauugcugcca

SEQ ID NO: 2924908 - RNA, 20 nt, Human T-lymphotropic virus 2
ccaauuuucacccucucccc

SEQ ID NO: 2924909 - RNA, 14 nt, Human T-lymphotropic virus 2
ccuuacccaggcca

SEQ ID NO: 2924910 - RNA, 12 nt, Human T-lymphotropic virus 2
cauucccucgcc

SEQ ID NO: 2924911 - RNA, 22 nt, Human T-lymphotropic virus 2
ugcuccuccgccaacagucucc

SEQ ID NO: 2924912 - RNA, 20 nt, Human T-lymphotropic virus 2
cccagcuaacccuccaggca

SEQ ID NO: 2924913 - RNA, 16 nt, Human T-lymphotropic virus 2
accuuaucccucgccu

SEQ ID NO: 2924914 - RNA, 22 nt, Human T-lymphotropic virus 2
gacagccuuaccccaccuacag

SEQ ID NO: 2924915 - RNA, 13 nt, Human T-lymphotropic virus 2
agcgccuccaggc

SEQ ID NO: 2924916 - RNA, 15 nt, Human T-lymphotropic virus 2
cuggucuccaaggcc

SEQ ID NO: 2924917 - RNA, 14 nt, Human T-lymphotropic virus 2
caugccauucaaca

SEQ ID NO: 2924918 - RNA, 13 nt, Human T-lymphotropic virus 2
aucaagacaucuc

SEQ ID NO: 2924919 - RNA, 21 nt, Human T-lymphotropic virus 2
acagagcaccaauuacuccug

SEQ ID NO: 2924920 - RNA, 15 nt, Human T-lymphotropic virus 2
ccgcucccgcuccuc

SEQ ID NO: 2924921 - RNA, 22 nt, Human T-lymphotropic virus 2
ccauuacuaccacccucaccuc

SEQ ID NO: 2924922 - RNA, 16 nt, Human T-lymphotropic virus 2
gccguucuucaggcca

SEQ ID NO: 2924923 - RNA, 19 nt, Human T-lymphotropic virus 2
accgcuugcagccuaggcc

SEQ ID NO: 2924924 - RNA, 21 nt, Human T-lymphotropic virus 2
cucccuuaucuuagcuccccu

SEQ ID NO: 2924925 - RNA, 21 nt, Human T-lymphotropic virus 2
gcuccccucccucgccuuccc

SEQ ID NO: 2924926 - RNA, 19 nt, Human T-lymphotropic virus 2
acccuccaggcacugacca

SEQ ID NO: 2924927 - RNA, 11 nt, Human T-lymphotropic virus 2
caccucagccu

SEQ ID NO: 2924928 - RNA, 17 nt, Human T-lymphotropic virus 2
cacaacaaaccccaggc

SEQ ID NO: 2924929 - RNA, 17 nt, Human T-lymphotropic virus 2
cuuccaucccuccuauc

SEQ ID NO: 2924930 - RNA, 18 nt, Human T-lymphotropic virus 2
gcaggcgucccggggcca

SEQ ID NO: 2924931 - RNA, 14 nt, Human T-lymphotropic virus 2
auccuucucacugg

SEQ ID NO: 2924932 - RNA, 14 nt, Human T-lymphotropic virus 2
ugcaaucccuccag

SEQ ID NO: 2924933 - RNA, 20 nt, Human T-lymphotropic virus 2
cagcucauaggcccuggcag

SEQ ID NO: 2924934 - RNA, 21 nt, Human T-lymphotropic virus 2
cagguggucuauguuccaccc

SEQ ID NO: 2924935 - RNA, 15 nt, Human T-lymphotropic virus 2
uccugaaccucuccg

SEQ ID NO: 2924936 - RNA, 18 nt, Human T-lymphotropic virus 2
gacaaacaccucagccua

SEQ ID NO: 2924937 - RNA, 13 nt, Human T-lymphotropic virus 2
ugaccccucuugg

SEQ ID NO: 2924938 - RNA, 12 nt, Human T-lymphotropic virus 2
cguaccuccucc

SEQ ID NO: 2924939 - RNA, 18 nt, Human T-lymphotropic virus 2
cggccucggcaccuccug

SEQ ID NO: 2924940 - RNA, 18 nt, Human T-lymphotropic virus 2
ccgucuccaguccauccu

SEQ ID NO: 2924941 - RNA, 21 nt, Human T-lymphotropic virus 2
cagacaauuaggagccuuccu

SEQ ID NO: 2924942 - RNA, 15 nt, Human T-lymphotropic virus 2
ccauuacuaccaccc

SEQ ID NO: 2924943 - RNA, 18 nt, Human T-lymphotropic virus 2
ugcugccaagccauggcc

SEQ ID NO: 2924944 - RNA, 21 nt, Human T-lymphotropic virus 2
cucacgauugguaucuccucc

SEQ ID NO: 2924945 - RNA, 22 nt, Human T-lymphotropic virus 2
caccucuccuuccccagggccc

SEQ ID NO: 2924946 - RNA, 19 nt, Human T-lymphotropic virus 2
gcuccucacgcuccugcag

SEQ ID NO: 2924947 - RNA, 21 nt, Human T-lymphotropic virus 2
caucacuccccugcccucuca

SEQ ID NO: 2924948 - RNA, 12 nt, Human T-lymphotropic virus 2
uccucucagccc

SEQ ID NO: 2924949 - RNA, 17 nt, Human T-lymphotropic virus 2
caagcaguaccagccau

SEQ ID NO: 2924950 - RNA, 18 nt, Human T-lymphotropic virus 2
ccaccauguccgcagcca

SEQ ID NO: 2924951 - RNA, 21 nt, Human T-lymphotropic virus 2
ccuugacaacggccuccccga

SEQ ID NO: 2924952 - RNA, 13 nt, Human T-lymphotropic virus 2
ccaacucaccugg

SEQ ID NO: 2924953 - RNA, 22 nt, Human T-lymphotropic virus 2
cucuccagggggaggcacacca

SEQ ID NO: 2924954 - RNA, 21 nt, Human T-lymphotropic virus 2
augaccuggucuccaaggccc

SEQ ID NO: 2924955 - RNA, 17 nt, Human T-lymphotropic virus 2
ugaccuggucuccaagg

SEQ ID NO: 2924956 - RNA, 18 nt, Human T-lymphotropic virus 2
agccacgccccccuccug

SEQ ID NO: 2924957 - RNA, 20 nt, Human T-lymphotropic virus 2
agccucccgagccagccacc

SEQ ID NO: 2924958 - RNA, 14 nt, Human T-lymphotropic virus 2
ccuguauccagacu

SEQ ID NO: 2924959 - RNA, 13 nt, Human T-lymphotropic virus 2
gaaccccuccugu

SEQ ID NO: 2924960 - RNA, 17 nt, Human T-lymphotropic virus 2
ccauugcuaccaaccuc

SEQ ID NO: 2924961 - RNA, 15 nt, Human T-lymphotropic virus 2
cuaacccuccaggca

SEQ ID NO: 2924962 - RNA, 16 nt, Human T-lymphotropic virus 2
cgcugcuccuccgcca

SEQ ID NO: 2924963 - RNA, 13 nt, Human T-lymphotropic virus 2
cuacgugcugcca

SEQ ID NO: 2924964 - RNA, 16 nt, Human T-lymphotropic virus 2
cuacaccaccugggga

SEQ ID NO: 2924965 - RNA, 18 nt, Human T-lymphotropic virus 2
accccucccaccacuccu

SEQ ID NO: 2924966 - RNA, 20 nt, Human T-lymphotropic virus 2
ucgcccccgauguccagccc

SEQ ID NO: 2924967 - RNA, 16 nt, Human T-lymphotropic virus 2
ucaccauuccccagcc

SEQ ID NO: 2924968 - RNA, 19 nt, Human T-lymphotropic virus 2
ccuuugcgacuuccugagg

SEQ ID NO: 2924969 - RNA, 20 nt, Human T-lymphotropic virus 2
cuggucuccaaggcccugga

SEQ ID NO: 2924970 - RNA, 18 nt, Human T-lymphotropic virus 2
agcgcugaaaaacaaggc

SEQ ID NO: 2924971 - RNA, 19 nt, Human T-lymphotropic virus 2
ggaggaaggggaaccccuc

SEQ ID NO: 2924972 - RNA, 18 nt, Human T-lymphotropic virus 2
gcccugcccgcuccucca

SEQ ID NO: 2924973 - RNA, 23 nt, Human T-lymphotropic virus 2
uaaaugaccuggucuccaaggcc

SEQ ID NO: 2924974 - RNA, 16 nt, Human T-lymphotropic virus 2
uugccaccccuacugc

SEQ ID NO: 2924975 - RNA, 13 nt, Human T-lymphotropic virus 2
guccgcagccaca

SEQ ID NO: 2924976 - RNA, 21 nt, Human T-lymphotropic virus 2
agcccccaccaauugcugcca

SEQ ID NO: 2924977 - RNA, 18 nt, Human T-lymphotropic virus 2
gagucucgcaccugcucg

SEQ ID NO: 2924978 - RNA, 21 nt, Human T-lymphotropic virus 2
accccaugaggaaaauguuuc

SEQ ID NO: 2924979 - RNA, 16 nt, Human T-lymphotropic virus 2
ccauaaccuuggcagc

SEQ ID NO: 2924980 - RNA, 19 nt, Human T-lymphotropic virus 2
cccacucagccuccaccaa

SEQ ID NO: 2924981 - RNA, 23 nt, Human T-lymphotropic virus 2
ccuuccuacaaugacccuugcuc

SEQ ID NO: 2924982 - RNA, 23 nt, Human T-lymphotropic virus 2
ccaacccucggggaucagcuccc

SEQ ID NO: 2924983 - RNA, 14 nt, Human T-lymphotropic virus 2
gaacugaaaccacg

SEQ ID NO: 2924984 - RNA, 15 nt, Human T-lymphotropic virus 2
gaccuggucuccaag

SEQ ID NO: 2924985 - RNA, 16 nt, Human T-lymphotropic virus 2
ugagcgccuccaggcc

SEQ ID NO: 2924986 - RNA, 18 nt, Human T-lymphotropic virus 2
ccuacuuuuauucagucu

SEQ ID NO: 2924987 - RNA, 16 nt, Human T-lymphotropic virus 2
cacucaucccccugcg

SEQ ID NO: 2924988 - RNA, 14 nt, Human T-lymphotropic virus 2
uuagccagccccac

SEQ ID NO: 2924989 - RNA, 14 nt, Human T-lymphotropic virus 2
ccaagcggccucgg

SEQ ID NO: 2924990 - RNA, 17 nt, Human T-lymphotropic virus 2
cugacgauuacccccug

SEQ ID NO: 2924991 - RNA, 15 nt, Human T-lymphotropic virus 2
gaacccacucagccu

SEQ ID NO: 2924992 - RNA, 21 nt, Human T-lymphotropic virus 2
aucagcuccccucccucgccu

SEQ ID NO: 2924993 - RNA, 15 nt, Human T-lymphotropic virus 2
cacucagccuccacc

SEQ ID NO: 2924994 - RNA, 20 nt, Human T-lymphotropic virus 2
accgaucccgaccccagagg

SEQ ID NO: 2924995 - RNA, 20 nt, Human T-lymphotropic virus 2
cuucgccgucacugaaaacg

SEQ ID NO: 2924996 - RNA, 23 nt, Human T-lymphotropic virus 2
auagaccucacccuuacccacuu

SEQ ID NO: 2924997 - RNA, 18 nt, Human T-lymphotropic virus 2
aaccccaugaggaaaaug

SEQ ID NO: 2924998 - RNA, 18 nt, Human T-lymphotropic virus 2
gcacgagaagcccuccag

SEQ ID NO: 2924999 - RNA, 18 nt, Human T-lymphotropic virus 2
uccuaccacuccagcccc

SEQ ID NO: 2925000 - RNA, 17 nt, Human T-lymphotropic virus 2
cccuuuuucccucgcuc

SEQ ID NO: 2925001 - RNA, 20 nt, Human T-lymphotropic virus 2
gccccccgaucucacuagcc

SEQ ID NO: 2925002 - RNA, 17 nt, Human T-lymphotropic virus 2
uccccuagguucguccc

SEQ ID NO: 2925003 - RNA, 12 nt, Human T-lymphotropic virus 2
accccaccuaca

SEQ ID NO: 2925004 - RNA, 21 nt, Human T-lymphotropic virus 2
cgggccgguaaagcuccacga

SEQ ID NO: 2925005 - RNA, 22 nt, Human T-lymphotropic virus 2
auguaaauuucacccaggaagu

SEQ ID NO: 2925006 - RNA, 19 nt, Human T-lymphotropic virus 2
cucaacgccgcccucuugg

SEQ ID NO: 2925007 - RNA, 16 nt, Human T-lymphotropic virus 2
caccauuccccagcca

SEQ ID NO: 2925008 - RNA, 22 nt, Human T-lymphotropic virus 2
gaccuuacgguuauaccccaga

SEQ ID NO: 2925009 - RNA, 13 nt, Human T-lymphotropic virus 2
auucugccacccc

SEQ ID NO: 2925010 - RNA, 21 nt, Human T-lymphotropic virus 2
aacaccuucccccaccucccc

SEQ ID NO: 2925011 - RNA, 16 nt, Human T-lymphotropic virus 2
agccacuccaaacacc

SEQ ID NO: 2925012 - RNA, 16 nt, Human T-lymphotropic virus 2
uggcagcccccaguuc

SEQ ID NO: 2925013 - RNA, 16 nt, Human T-lymphotropic virus 2
cacgcaaugcuucccu

SEQ ID NO: 2925014 - RNA, 17 nt, Human T-lymphotropic virus 2
uacaccaacaucccugu

SEQ ID NO: 2925015 - RNA, 18 nt, Human T-lymphotropic virus 2
gauaacugcaacaacucc

SEQ ID NO: 2925016 - RNA, 18 nt, Human T-lymphotropic virus 2
cauauucuugcccuuccg

SEQ ID NO: 2925017 - RNA, 15 nt, Human T-lymphotropic virus 2
ccuuccaucccuccu

SEQ ID NO: 2925018 - RNA, 19 nt, Human T-lymphotropic virus 2
auguauccguccuccagga

SEQ ID NO: 2925019 - RNA, 21 nt, Human T-lymphotropic virus 2
cucugacgauuacccccugcc

SEQ ID NO: 2925020 - RNA, 17 nt, Human T-lymphotropic virus 2
ccaucccaacccuuccc

SEQ ID NO: 2925021 - RNA, 19 nt, Human T-lymphotropic virus 2
cugacgauuacccccugcc

SEQ ID NO: 2925022 - RNA, 23 nt, Human T-lymphotropic virus 2
uacaccaucagcagcuuaacaca

SEQ ID NO: 2925023 - RNA, 17 nt, Human T-lymphotropic virus 2
aagaacuucuauacaaa

SEQ ID NO: 2925024 - RNA, 12 nt, Human T-lymphotropic virus 2
cuugcccuuccg

SEQ ID NO: 2925025 - RNA, 17 nt, Human T-lymphotropic virus 2
ccauugcaaucccucca

SEQ ID NO: 2925026 - RNA, 16 nt, Human T-lymphotropic virus 2
cacuccaacugcugau

SEQ ID NO: 2925027 - RNA, 16 nt, Human T-lymphotropic virus 2
cugacgucucccccuu

SEQ ID NO: 2925028 - RNA, 20 nt, Human T-lymphotropic virus 2
aggcucugacgucucccccu

SEQ ID NO: 2925029 - RNA, 23 nt, Human T-lymphotropic virus 2
cuuccuacuuuuauucagucuca

SEQ ID NO: 2925030 - RNA, 16 nt, Human T-lymphotropic virus 2
caaaacauccuccggg

SEQ ID NO: 2925031 - RNA, 20 nt, Human T-lymphotropic virus 2
cacccagagaaccucaagga

SEQ ID NO: 2925032 - RNA, 18 nt, Human T-lymphotropic virus 2
ccucuccuuccccagggc

SEQ ID NO: 2925033 - RNA, 14 nt, Human T-lymphotropic virus 2
ucuccccccauccc

SEQ ID NO: 2925034 - RNA, 19 nt, Human T-lymphotropic virus 2
ugcccgcuccuccauccca

SEQ ID NO: 2925035 - RNA, 13 nt, Human T-lymphotropic virus 2
ccacaccaaccuc

SEQ ID NO: 2925036 - RNA, 16 nt, Human T-lymphotropic virus 2
caaaccaccucccaaa

SEQ ID NO: 2925037 - RNA, 13 nt, Human T-lymphotropic virus 2
cuaacccuccagg

SEQ ID NO: 2925038 - RNA, 19 nt, Human T-lymphotropic virus 2
acaaacaccucagccuacc

SEQ ID NO: 2925039 - RNA, 22 nt, Human T-lymphotropic virus 2
acuccaauacccaaagccccca

SEQ ID NO: 2925040 - RNA, 22 nt, Human T-lymphotropic virus 2
gucggcauccucauucaccaca

SEQ ID NO: 2925041 - RNA, 19 nt, Human T-lymphotropic virus 2
gccccuguauccuccgcca

SEQ ID NO: 2925042 - RNA, 15 nt, Human T-lymphotropic virus 2
caugacccuccuagu

SEQ ID NO: 2925043 - RNA, 16 nt, Human T-lymphotropic virus 2
agaccaccaacaccau

SEQ ID NO: 2925044 - RNA, 18 nt, Human T-lymphotropic virus 2
aagccauggccuucccuu

SEQ ID NO: 2925045 - RNA, 22 nt, Human T-lymphotropic virus 2
gcacugaccacgcauggccuuc

SEQ ID NO: 2925046 - RNA, 19 nt, Human T-lymphotropic virus 2
cuuaucccucgccuccccu

SEQ ID NO: 2925047 - RNA, 17 nt, Human T-lymphotropic virus 2
caggccauuucccuccu

SEQ ID NO: 2925048 - RNA, 14 nt, Human T-lymphotropic virus 2
agugucccuucgac

SEQ ID NO: 2925049 - RNA, 19 nt, Human T-lymphotropic virus 2
gccuucaccauuccccagc

SEQ ID NO: 2925050 - RNA, 14 nt, Human T-lymphotropic virus 2
ucaaaacccaggag

SEQ ID NO: 2925051 - RNA, 15 nt, Human T-lymphotropic virus 2
uggacuguccuucca

SEQ ID NO: 2925052 - RNA, 16 nt, Human T-lymphotropic virus 2
ccaacccuucuccagg

SEQ ID NO: 2925053 - RNA, 20 nt, Human T-lymphotropic virus 2
cuccugaacugcuccuccca

SEQ ID NO: 2925054 - RNA, 22 nt, Human T-lymphotropic virus 2
ucaagcaggaggucagcuccuc

SEQ ID NO: 2925055 - RNA, 21 nt, Human T-lymphotropic virus 2
ugccaagcauggacauccgca

SEQ ID NO: 2925056 - RNA, 22 nt, Human T-lymphotropic virus 2
gcugccaagccauggccuuccc

SEQ ID NO: 2925057 - RNA, 16 nt, Human T-lymphotropic virus 2
auccuucgcaaacacc

SEQ ID NO: 2925058 - RNA, 14 nt, Human T-lymphotropic virus 2
aaagcccccagggg

SEQ ID NO: 2925059 - RNA, 13 nt, Human T-lymphotropic virus 2
gccgcccucuugg

SEQ ID NO: 2925060 - RNA, 19 nt, Human T-lymphotropic virus 2
ggaauuacaacaacucucc

SEQ ID NO: 2925061 - RNA, 14 nt, Human T-lymphotropic virus 2
gucgcuccccgagg

SEQ ID NO: 2925062 - RNA, 22 nt, Human T-lymphotropic virus 2
acagggccuaggguacuacucg

SEQ ID NO: 2925063 - RNA, 21 nt, Human T-lymphotropic virus 2
ccuuacgguuauaccccagac

SEQ ID NO: 2925064 - RNA, 20 nt, Human T-lymphotropic virus 2
caccuuggggauccauccuc

SEQ ID NO: 2925065 - RNA, 16 nt, Human T-lymphotropic virus 2
augucaugaaccccag

SEQ ID NO: 2925066 - RNA, 15 nt, Human T-lymphotropic virus 2
agcaccaacucaccu

SEQ ID NO: 2925067 - RNA, 21 nt, Human T-lymphotropic virus 2
ccuacuacuacuccuccgcca

SEQ ID NO: 2925068 - RNA, 9 nt, Human T-lymphotropic virus 2
accucccaa

SEQ ID NO: 2925069 - RNA, 13 nt, Human T-lymphotropic virus 2
uuacccacuuccc

SEQ ID NO: 2925070 - RNA, 16 nt, Human T-lymphotropic virus 2
uccuuaccccucccac

SEQ ID NO: 2925071 - RNA, 16 nt, Human T-lymphotropic virus 2
ccuccaccaacuucuc

SEQ ID NO: 2925072 - RNA, 17 nt, Human T-lymphotropic virus 2
aauuuucacccucuccc

SEQ ID NO: 2925073 - RNA, 19 nt, Human T-lymphotropic virus 2
ccaacaaaccuccucccga

SEQ ID NO: 2925074 - RNA, 16 nt, Human T-lymphotropic virus 2
aguuauccuaggagag

SEQ ID NO: 2925075 - RNA, 13 nt, Human T-lymphotropic virus 2
acuguccuaaccu

SEQ ID NO: 2925076 - RNA, 23 nt, Human T-lymphotropic virus 2
ugccuggaaccaacccucgggga

SEQ ID NO: 2925077 - RNA, 14 nt, Human T-lymphotropic virus 2
gcaggcgucccggg

SEQ ID NO: 2925078 - RNA, 18 nt, Human T-lymphotropic virus 2
cucccuguauccagacug

SEQ ID NO: 2925079 - RNA, 21 nt, Human T-lymphotropic virus 2
ccgcagccacaccaaccuccc

SEQ ID NO: 2925080 - RNA, 14 nt, Human T-lymphotropic virus 2
guuccuacacacag

SEQ ID NO: 2925081 - RNA, 21 nt, Human T-lymphotropic virus 2
cccucgcucccguaccuccuc

SEQ ID NO: 2925082 - RNA, 13 nt, Human T-lymphotropic virus 2
ccauccucuccaa

SEQ ID NO: 2925083 - RNA, 11 nt, Human T-lymphotropic virus 2
auuggccccug

SEQ ID NO: 2925084 - RNA, 15 nt, Human T-lymphotropic virus 2
cacuaccacccauuc

SEQ ID NO: 2925085 - RNA, 16 nt, Human T-lymphotropic virus 2
ucagcuccccucccuc

SEQ ID NO: 2925086 - RNA, 20 nt, Human T-lymphotropic virus 2
ccacuagcccagcagagccg

SEQ ID NO: 2925087 - RNA, 17 nt, Human T-lymphotropic virus 2
ccacaacaacuccaugc

SEQ ID NO: 2925088 - RNA, 13 nt, Human T-lymphotropic virus 2
ccgucuccagucc

SEQ ID NO: 2925089 - RNA, 13 nt, Human T-lymphotropic virus 2
gcagccguccuca

SEQ ID NO: 2925090 - RNA, 18 nt, Human T-lymphotropic virus 2
cccaacccuucuccagga

SEQ ID NO: 2925091 - RNA, 15 nt, Human T-lymphotropic virus 2
cuacaccaccugggg

SEQ ID NO: 2925092 - RNA, 15 nt, Human T-lymphotropic virus 2
caacaaagaaugcca

SEQ ID NO: 2925093 - RNA, 18 nt, Human T-lymphotropic virus 2
uagcagccguccucaacc

SEQ ID NO: 2925094 - RNA, 23 nt, Human T-lymphotropic virus 2
cuucgaacaacaauuagcagccg

SEQ ID NO: 2925095 - RNA, 14 nt, Human T-lymphotropic virus 2
ccacgcauggccuu

SEQ ID NO: 2925096 - RNA, 23 nt, Human T-lymphotropic virus 2
ccaaugccauuacuaccacccuc

SEQ ID NO: 2925097 - RNA, 13 nt, Human T-lymphotropic virus 2
cuaaucucccccc

SEQ ID NO: 2925098 - RNA, 13 nt, Human T-lymphotropic virus 2
cuuccccacccag

SEQ ID NO: 2925099 - RNA, 17 nt, Human T-lymphotropic virus 2
ucauguauccguccucc

SEQ ID NO: 2925100 - RNA, 18 nt, Human T-lymphotropic virus 2
ccgaaccuggccuccguc

SEQ ID NO: 2925101 - RNA, 16 nt, Human T-lymphotropic virus 2
gacuacacccccccug

SEQ ID NO: 2925102 - RNA, 14 nt, Human T-lymphotropic virus 2
ccucgaacaccuuc

SEQ ID NO: 2925103 - RNA, 23 nt, Human T-lymphotropic virus 2
cuagucucuuuuggcgccacacc

SEQ ID NO: 2925104 - RNA, 19 nt, Human T-lymphotropic virus 2
caccacaauguuccaaccc

SEQ ID NO: 2925105 - RNA, 22 nt, Human T-lymphotropic virus 2
cuccccaagcaguaccagccau

SEQ ID NO: 2925106 - RNA, 17 nt, Human T-lymphotropic virus 2
gccuuucuucccucucc

SEQ ID NO: 2925107 - RNA, 19 nt, Human T-lymphotropic virus 2
gcccccgauguccagcccu

SEQ ID NO: 2925108 - RNA, 14 nt, Human T-lymphotropic virus 2
cuccucucagccca

SEQ ID NO: 2925109 - RNA, 12 nt, Human T-lymphotropic virus 2
ucgguuccucuc

SEQ ID NO: 2925110 - RNA, 14 nt, Human T-lymphotropic virus 2
ucgaaaccaaagcc

SEQ ID NO: 2925111 - RNA, 13 nt, Human T-lymphotropic virus 2
gucuccucucagc

SEQ ID NO: 2925112 - RNA, 18 nt, Human T-lymphotropic virus 2
cucucacgaaacacauuc

SEQ ID NO: 2925113 - RNA, 16 nt, Human T-lymphotropic virus 2
caacccuucuccagga

SEQ ID NO: 2925114 - RNA, 20 nt, Human T-lymphotropic virus 2
accauguccgcagccacacc

SEQ ID NO: 2925115 - RNA, 14 nt, Human T-lymphotropic virus 2
acccacucagccuc

SEQ ID NO: 2925116 - RNA, 17 nt, Human T-lymphotropic virus 2
gacgucccuccccccua

SEQ ID NO: 2925117 - RNA, 23 nt, Human T-lymphotropic virus 2
ccccuuacguggaacccaccacc

SEQ ID NO: 2925118 - RNA, 15 nt, Human T-lymphotropic virus 2
ccuuaccccaaagca

SEQ ID NO: 2925119 - RNA, 15 nt, Human T-lymphotropic virus 2
caugcagacccuccg

SEQ ID NO: 2925120 - RNA, 13 nt, Human T-lymphotropic virus 2
agacucugccuua

SEQ ID NO: 2925121 - RNA, 14 nt, Human T-lymphotropic virus 2
ucaaaacauccucc

SEQ ID NO: 2925122 - RNA, 23 nt, Human T-lymphotropic virus 2
ucgcugguggaguaacaggcucc

SEQ ID NO: 2925123 - RNA, 19 nt, Human T-lymphotropic virus 2
uuaucccucgccuccccuc

SEQ ID NO: 2925124 - RNA, 17 nt, Human T-lymphotropic virus 2
uccgcccaucaaacccu

SEQ ID NO: 2925125 - RNA, 15 nt, Human T-lymphotropic virus 2
ucucgcaccugcucg

SEQ ID NO: 2925126 - RNA, 12 nt, Human T-lymphotropic virus 2
ccuccccaagca

SEQ ID NO: 2925127 - RNA, 15 nt, Human T-lymphotropic virus 2
cuuaacaaccccagg

SEQ ID NO: 2925128 - RNA, 14 nt, Human T-lymphotropic virus 2
ccuccaccaugucc

SEQ ID NO: 2925129 - RNA, 21 nt, Human T-lymphotropic virus 2
cauucgccggggccucuugcc

SEQ ID NO: 2925130 - RNA, 20 nt, Human T-lymphotropic virus 2
cccuccuaguagaugccccu

SEQ ID NO: 2925131 - RNA, 15 nt, Human T-lymphotropic virus 2
aguucaguccucccu

SEQ ID NO: 2925132 - RNA, 17 nt, Human T-lymphotropic virus 2
gccaccuccccccccuu

SEQ ID NO: 2925133 - RNA, 15 nt, Human T-lymphotropic virus 2
cgaucucacuagccu

SEQ ID NO: 2925134 - RNA, 16 nt, Human T-lymphotropic virus 2
cgacaccuaucugccc

SEQ ID NO: 2925135 - RNA, 17 nt, Human T-lymphotropic virus 2
ccgauggcuccccucaa

SEQ ID NO: 2925136 - RNA, 18 nt, Human T-lymphotropic virus 2
cacgauugguaucuccuc

SEQ ID NO: 2925137 - RNA, 16 nt, Human T-lymphotropic virus 2
ucucccgcugcuccuc

SEQ ID NO: 2925138 - RNA, 14 nt, Human T-lymphotropic virus 2
caacucucccagcu

SEQ ID NO: 2925139 - RNA, 13 nt, Human T-lymphotropic virus 2
gcuccacaccccc

SEQ ID NO: 2925140 - RNA, 14 nt, Human T-lymphotropic virus 2
ccaacucaccuggg

SEQ ID NO: 2925141 - RNA, 14 nt, Human T-lymphotropic virus 2
agcucuccucucca

SEQ ID NO: 2925142 - RNA, 15 nt, Human T-lymphotropic virus 2
agacuauccuucaac

SEQ ID NO: 2925143 - RNA, 22 nt, Human T-lymphotropic virus 2
ggucucuaaaggaacacccauc

SEQ ID NO: 2925144 - RNA, 15 nt, Human T-lymphotropic virus 2
cucuacuccuccucg

SEQ ID NO: 2925145 - RNA, 13 nt, Human T-lymphotropic virus 2
cccguaccuccuc

SEQ ID NO: 2925146 - RNA, 14 nt, Human T-lymphotropic virus 2
ucuuaacaacccca

SEQ ID NO: 2925147 - RNA, 16 nt, Human T-lymphotropic virus 2
gagccagccacccagg

SEQ ID NO: 2925148 - RNA, 22 nt, Human T-lymphotropic virus 2
auccuuuaugguucaucaccuc

SEQ ID NO: 2925149 - RNA, 14 nt, Human T-lymphotropic virus 2
uaccuaugcuccuc

SEQ ID NO: 2925150 - RNA, 13 nt, Human T-lymphotropic virus 2
uccucauucacca

SEQ ID NO: 2925151 - RNA, 17 nt, Human T-lymphotropic virus 2
acccaucaaaacccagg

SEQ ID NO: 2925152 - RNA, 17 nt, Human T-lymphotropic virus 2
gccacgccccccuccug

SEQ ID NO: 2925153 - RNA, 17 nt, Human T-lymphotropic virus 2
ggccucggcaccuccug

SEQ ID NO: 2925154 - RNA, 17 nt, Human T-lymphotropic virus 2
cuauugcuauaggcagg

SEQ ID NO: 2925155 - RNA, 15 nt, Human T-lymphotropic virus 2
acgauuacccccugc

SEQ ID NO: 2925156 - RNA, 13 nt, Human T-lymphotropic virus 2
ucccacucauccc

SEQ ID NO: 2925157 - RNA, 19 nt, Human T-lymphotropic virus 2
cuccauagacggcuccccc

SEQ ID NO: 2925158 - RNA, 18 nt, Human T-lymphotropic virus 2
agccguccucaaccccau

SEQ ID NO: 2925159 - RNA, 15 nt, Human T-lymphotropic virus 2
aagcagggcagccau

SEQ ID NO: 2925160 - RNA, 15 nt, Human T-lymphotropic virus 2
ccuagacaaugccau

SEQ ID NO: 2925161 - RNA, 19 nt, Human T-lymphotropic virus 2
ccuuccccuagacaaugcc

SEQ ID NO: 2925162 - RNA, 15 nt, Human T-lymphotropic virus 2
ccagccucucauccu

SEQ ID NO: 2925163 - RNA, 17 nt, Human T-lymphotropic virus 2
guggccgccucaacccc

SEQ ID NO: 2925164 - RNA, 12 nt, Human T-lymphotropic virus 2
cgacauaaccag

SEQ ID NO: 2925165 - RNA, 13 nt, Human T-lymphotropic virus 2
gcauggccuucca

SEQ ID NO: 2925166 - RNA, 15 nt, Human T-lymphotropic virus 2
gacuccucaggccaa

SEQ ID NO: 2925167 - RNA, 15 nt, Human T-lymphotropic virus 2
ccacggccucaccca

SEQ ID NO: 2925168 - RNA, 23 nt, Human T-lymphotropic virus 2
ccaccaauugcugccaauagcca

SEQ ID NO: 2925169 - RNA, 18 nt, Human T-lymphotropic virus 2
gccuucaccauuccccag

SEQ ID NO: 2925170 - RNA, 14 nt, Human T-lymphotropic virus 2
guucaucaccucag

SEQ ID NO: 2925171 - RNA, 15 nt, Human T-lymphotropic virus 2
ccucuuuccuucccu

SEQ ID NO: 2925172 - RNA, 13 nt, Human T-lymphotropic virus 2
caacaaaccuccu

SEQ ID NO: 2925173 - RNA, 24 nt, Human T-lymphotropic virus 2
caggggcuucuauaccucccagac

SEQ ID NO: 2925174 - RNA, 17 nt, Human T-lymphotropic virus 2
gaaaaacaaggcucuga

SEQ ID NO: 2925175 - RNA, 20 nt, Human T-lymphotropic virus 2
cuccccaaguggaccaauuu

SEQ ID NO: 2925176 - RNA, 16 nt, Human T-lymphotropic virus 2
cuccccuaucacucca

SEQ ID NO: 2925177 - RNA, 18 nt, Human T-lymphotropic virus 2
gcccaucaaacccuccag

SEQ ID NO: 2925178 - RNA, 19 nt, Human T-lymphotropic virus 2
ccguggagcgcagcaaggg

SEQ ID NO: 2925179 - RNA, 20 nt, Human T-lymphotropic virus 2
gaagccucuaccccucccaa

SEQ ID NO: 2925180 - RNA, 17 nt, Human T-lymphotropic virus 2
ucccccaggagcccccu

SEQ ID NO: 2925181 - RNA, 16 nt, Human T-lymphotropic virus 2
caacaaaccccaggcc

SEQ ID NO: 2925182 - RNA, 23 nt, Human T-lymphotropic virus 2
ccuggcauguacucuacaccccc

SEQ ID NO: 2925183 - RNA, 18 nt, Human T-lymphotropic virus 2
cccuaccauugacccauc

SEQ ID NO: 2925184 - RNA, 17 nt, Human T-lymphotropic virus 2
ccaaccucgccuacagg

SEQ ID NO: 2925185 - RNA, 13 nt, Human T-lymphotropic virus 2
auucagucucaca

SEQ ID NO: 2925186 - RNA, 18 nt, Human T-lymphotropic virus 2
caggagcccccucagcuc

SEQ ID NO: 2925187 - RNA, 15 nt, Human T-lymphotropic virus 2
uggccugcaccaucu

SEQ ID NO: 2925188 - RNA, 21 nt, Human T-lymphotropic virus 2
gcccaucaaacccuccaggcg

SEQ ID NO: 2925189 - RNA, 16 nt, Human T-lymphotropic virus 2
ccgccucaaccccgcc

SEQ ID NO: 2925190 - RNA, 18 nt, Human T-lymphotropic virus 2
agagauuauaaauauccu

SEQ ID NO: 2925191 - RNA, 18 nt, Human T-lymphotropic virus 2
ggcuucuauaccucccag

SEQ ID NO: 2925192 - RNA, 23 nt, Human T-lymphotropic virus 2
uccgccaccuccccccccuuccc

SEQ ID NO: 2925193 - RNA, 22 nt, Human T-lymphotropic virus 2
cacgucuggguagacaccuucu

SEQ ID NO: 2925194 - RNA, 18 nt, Human T-lymphotropic virus 2
uaccgacagccuuacccc

SEQ ID NO: 2925195 - RNA, 15 nt, Human T-lymphotropic virus 2
gacgaccccagcccc

SEQ ID NO: 2925196 - RNA, 14 nt, Human T-lymphotropic virus 2
gcccugcccgcucc

SEQ ID NO: 2925197 - RNA, 13 nt, Human T-lymphotropic virus 2
uccacccugccag

SEQ ID NO: 2925198 - RNA, 16 nt, Human T-lymphotropic virus 2
agaccaucuaccucca

SEQ ID NO: 2925199 - RNA, 16 nt, Human T-lymphotropic virus 2
ccuuaccccucccacc

SEQ ID NO: 2925200 - RNA, 23 nt, Human T-lymphotropic virus 2
acaauccugucuccucucagccc

SEQ ID NO: 2925201 - RNA, 17 nt, Human T-lymphotropic virus 2
cucaaacccccucagga

SEQ ID NO: 2925202 - RNA, 18 nt, Human T-lymphotropic virus 2
guaucacccucaccccac

SEQ ID NO: 2925203 - RNA, 21 nt, Human T-lymphotropic virus 2
acucuacacccccaacaucuc

SEQ ID NO: 2925204 - RNA, 18 nt, Human T-lymphotropic virus 2
ccuucgacuacacuucuc

SEQ ID NO: 2925205 - RNA, 23 nt, Human T-lymphotropic virus 2
ccgccaaauccaggcccuuccac

SEQ ID NO: 2925206 - RNA, 23 nt, Human T-lymphotropic virus 2
cgaaccauccucuuuccuucccu

SEQ ID NO: 2925207 - RNA, 14 nt, Human T-lymphotropic virus 2
ccagcucugccaau

SEQ ID NO: 2925208 - RNA, 19 nt, Human T-lymphotropic virus 2
acccucaagguccuuaccc

SEQ ID NO: 2925209 - RNA, 22 nt, Human T-lymphotropic virus 2
gaaaaauucgaaaccaaagccu

SEQ ID NO: 2925210 - RNA, 17 nt, Human T-lymphotropic virus 2
gccugcaccaucuuaac

SEQ ID NO: 2925211 - RNA, 12 nt, Human T-lymphotropic virus 2
cacccucucccc

SEQ ID NO: 2925212 - RNA, 21 nt, Human T-lymphotropic virus 2
ccuaagagccaccaaugccau

SEQ ID NO: 2925213 - RNA, 23 nt, Human T-lymphotropic virus 2
caucaagcaggaggucagcuccu

SEQ ID NO: 2925214 - RNA, 21 nt, Human T-lymphotropic virus 2
ucucagcccauuucccaggau

SEQ ID NO: 2925215 - RNA, 14 nt, Human T-lymphotropic virus 2
ccucgccuacaggc

SEQ ID NO: 2925216 - RNA, 16 nt, Human T-lymphotropic virus 2
uccuaccacuccagcc

SEQ ID NO: 2925217 - RNA, 14 nt, Human T-lymphotropic virus 2
gccuaggcccuccg

SEQ ID NO: 2925218 - RNA, 14 nt, Human T-lymphotropic virus 2
ucuucgaacaacaa

SEQ ID NO: 2925219 - RNA, 23 nt, Human T-lymphotropic virus 2
uccgccaaauccaggcccuucca

SEQ ID NO: 2925220 - RNA, 11 nt, Human T-lymphotropic virus 2
acuccccggcc

SEQ ID NO: 2925221 - RNA, 17 nt, Human T-lymphotropic virus 2
ccgccaaauccaggccc

SEQ ID NO: 2925222 - RNA, 22 nt, Human T-lymphotropic virus 2
uuccugaagccucuaccccucc

SEQ ID NO: 2925223 - RNA, 14 nt, Human T-lymphotropic virus 2
gcaaaccaacaccc

SEQ ID NO: 2925224 - RNA, 11 nt, Human T-lymphotropic virus 2
accccaaagca

SEQ ID NO: 2925225 - RNA, 15 nt, Human T-lymphotropic virus 2
ugaccuuacagagca

SEQ ID NO: 2925226 - RNA, 19 nt, Human T-lymphotropic virus 2
aucucccaccuuacccagg

SEQ ID NO: 2925227 - RNA, 14 nt, Human T-lymphotropic virus 2
aggcgucccggggc

SEQ ID NO: 2925228 - RNA, 16 nt, Human T-lymphotropic virus 2
cugacgccccaaggcc

SEQ ID NO: 2925229 - RNA, 18 nt, Human T-lymphotropic virus 2
uccuauauggauaccccg

SEQ ID NO: 2925230 - RNA, 17 nt, Human T-lymphotropic virus 2
cgccgcucccgcuccuc

SEQ ID NO: 2925231 - RNA, 12 nt, Human T-lymphotropic virus 2
cuuuccuucccu

SEQ ID NO: 2925232 - RNA, 20 nt, Human T-lymphotropic virus 2
agccuuccaucccuccuauc

SEQ ID NO: 2925233 - RNA, 17 nt, Human T-lymphotropic virus 2
acuccccugcccucuca

SEQ ID NO: 2925234 - RNA, 16 nt, Human T-lymphotropic virus 2
gcccaucaaacccucc

SEQ ID NO: 2925235 - RNA, 16 nt, Human T-lymphotropic virus 2
ccaaagccuuccaucc

SEQ ID NO: 2925236 - RNA, 22 nt, Human T-lymphotropic virus 2
caccuguccagagcaccaacuc

SEQ ID NO: 2925237 - RNA, 20 nt, Human T-lymphotropic virus 2
cucaccucuccuuccccagg

SEQ ID NO: 2925238 - RNA, 18 nt, Human T-lymphotropic virus 2
cacaccccccacccuccg

SEQ ID NO: 2925239 - RNA, 22 nt, Human T-lymphotropic virus 2
ccuguccagagcaccaacucac

SEQ ID NO: 2925240 - RNA, 15 nt, Human T-lymphotropic virus 2
cauaacccugaagca

SEQ ID NO: 2925241 - RNA, 18 nt, Human T-lymphotropic virus 2
cugaaccucuccgggaga

SEQ ID NO: 2925242 - RNA, 19 nt, Human T-lymphotropic virus 2
caaucccuauauucugccc

SEQ ID NO: 2925243 - RNA, 15 nt, Human T-lymphotropic virus 2
ccucccaccacuccu

SEQ ID NO: 2925244 - RNA, 15 nt, Human T-lymphotropic virus 2
caggcccgcccuagg

SEQ ID NO: 2925245 - RNA, 22 nt, Human T-lymphotropic virus 2
uggcuccacaccccccacccuc

SEQ ID NO: 2925246 - RNA, 16 nt, Human T-lymphotropic virus 2
caggcgucccggggcc

SEQ ID NO: 2925247 - RNA, 15 nt, Human T-lymphotropic virus 2
uacaauacuccuccu

SEQ ID NO: 2925248 - RNA, 19 nt, Human T-lymphotropic virus 2
ucaccucuccuuccccagg

SEQ ID NO: 2925249 - RNA, 14 nt, Human T-lymphotropic virus 2
aucaagcaggaggu

SEQ ID NO: 2925250 - RNA, 14 nt, Human T-lymphotropic virus 2
acagcucuccagaa

SEQ ID NO: 2925251 - RNA, 16 nt, Human T-lymphotropic virus 2
cccucccaccacuccu

SEQ ID NO: 2925252 - RNA, 18 nt, Human T-lymphotropic virus 2
auggcgacuagccucccg

SEQ ID NO: 2925253 - RNA, 16 nt, Human T-lymphotropic virus 2
cuaaccuuccccuaga

SEQ ID NO: 2925254 - RNA, 11 nt, Human T-lymphotropic virus 2
auuccucccau

SEQ ID NO: 2925255 - RNA, 13 nt, Human T-lymphotropic virus 2
cgcauggccuucc

SEQ ID NO: 2925256 - RNA, 17 nt, Human T-lymphotropic virus 2
cacccuuacccacuucc

SEQ ID NO: 2925257 - RNA, 15 nt, Human T-lymphotropic virus 2
ugccaagccauggcc

SEQ ID NO: 2925258 - RNA, 17 nt, Human T-lymphotropic virus 2
ggcccugacgucccucc

SEQ ID NO: 2925259 - RNA, 15 nt, Human T-lymphotropic virus 2
uuuucccucgcuccc

SEQ ID NO: 2925260 - RNA, 17 nt, Human T-lymphotropic virus 2
gcaccaacucaccuggg

SEQ ID NO: 2925261 - RNA, 12 nt, Human T-lymphotropic virus 2
acuaacagcccc

SEQ ID NO: 2925262 - RNA, 16 nt, Human T-lymphotropic virus 2
cccuuccaccucaggc

SEQ ID NO: 2925263 - RNA, 13 nt, Human T-lymphotropic virus 2
cgacuacaccccc

SEQ ID NO: 2925264 - RNA, 17 nt, Human T-lymphotropic virus 2
ccucaaauaguuccucu

SEQ ID NO: 2925265 - RNA, 18 nt, Human T-lymphotropic virus 2
ccaaguaaaggcucugac

SEQ ID NO: 2925266 - RNA, 16 nt, Human T-lymphotropic virus 2
ccucgccuccccuccu

SEQ ID NO: 2925267 - RNA, 15 nt, Human T-lymphotropic virus 2
agccacaccaaccuc

SEQ ID NO: 2925268 - RNA, 21 nt, Human T-lymphotropic virus 2
caggggcuucuauaccuccca

SEQ ID NO: 2925269 - RNA, 17 nt, Human T-lymphotropic virus 2
cuaucuuacauccccca

SEQ ID NO: 2925270 - RNA, 17 nt, Human T-lymphotropic virus 2
cuuuccaccacaacaug

SEQ ID NO: 2925271 - RNA, 23 nt, Human T-lymphotropic virus 2
uucaacaggacaucacuccccug

SEQ ID NO: 2925272 - RNA, 15 nt, Human T-lymphotropic virus 2
caucucccaccuuac

SEQ ID NO: 2925273 - RNA, 15 nt, Human T-lymphotropic virus 2
agucuauaaaagcgc

SEQ ID NO: 2925274 - RNA, 15 nt, Human T-lymphotropic virus 2
cccuuacccacuucc

SEQ ID NO: 2925275 - RNA, 18 nt, Human T-lymphotropic virus 2
gcuuccugaaccucuccg

SEQ ID NO: 2925276 - RNA, 18 nt, Human T-lymphotropic virus 2
ucaccauuccccagccau

SEQ ID NO: 2925277 - RNA, 17 nt, Human T-lymphotropic virus 2
accaucuaccuccacca

SEQ ID NO: 2925278 - RNA, 22 nt, Human T-lymphotropic virus 2
cccucaagguccuuaccccucc

SEQ ID NO: 2925279 - RNA, 20 nt, Human T-lymphotropic virus 2
caggaguccuauacacucca

SEQ ID NO: 2925280 - RNA, 13 nt, Human T-lymphotropic virus 2
cagcaagggcuag

SEQ ID NO: 2925281 - RNA, 21 nt, Human T-lymphotropic virus 2
ugaccgaucccgaccccagag

SEQ ID NO: 2925282 - RNA, 17 nt, Human T-lymphotropic virus 2
acagccuuaccccaccu

SEQ ID NO: 2925283 - RNA, 16 nt, Human T-lymphotropic virus 2
accuccuauucuggga

SEQ ID NO: 2925284 - RNA, 19 nt, Human T-lymphotropic virus 2
ccuucccccaccuccccaa

SEQ ID NO: 2925285 - RNA, 24 nt, Human T-lymphotropic virus 2
uagccacuccaaacaccauaggcc

SEQ ID NO: 2925286 - RNA, 12 nt, Human T-lymphotropic virus 2
ccgucucccggc

SEQ ID NO: 2925287 - RNA, 17 nt, Human T-lymphotropic virus 2
gcccuuaccccaaagca

SEQ ID NO: 2925288 - RNA, 17 nt, Human T-lymphotropic virus 2
auacuucgccuucacca

SEQ ID NO: 2925289 - RNA, 17 nt, Human T-lymphotropic virus 2
caguucaaacuccucca

SEQ ID NO: 2925290 - RNA, 22 nt, Human T-lymphotropic virus 2
cuccuuccccagggccccccga

SEQ ID NO: 2925291 - RNA, 13 nt, Human T-lymphotropic virus 2
accucuccuuggc

SEQ ID NO: 2925292 - RNA, 11 nt, Human T-lymphotropic virus 2
caccugccuuc

SEQ ID NO: 2925293 - RNA, 14 nt, Human T-lymphotropic virus 2
cagccccaccaaug

SEQ ID NO: 2925294 - RNA, 17 nt, Human T-lymphotropic virus 2
ugagacgccuuccgugg

SEQ ID NO: 2925295 - RNA, 17 nt, Human T-lymphotropic virus 2
agccccuguagcccaac

SEQ ID NO: 2925296 - RNA, 20 nt, Human T-lymphotropic virus 2
augccauuacuaccacccuc

SEQ ID NO: 2925297 - RNA, 15 nt, Human T-lymphotropic virus 2
caacaaaccccaggc

SEQ ID NO: 2925298 - RNA, 13 nt, Human T-lymphotropic virus 2
cugccaccccaga

SEQ ID NO: 2925299 - RNA, 15 nt, Human T-lymphotropic virus 2
cccccaccuccccaa

SEQ ID NO: 2925300 - RNA, 14 nt, Human T-lymphotropic virus 2
caaucccuccagga

SEQ ID NO: 2925301 - RNA, 17 nt, Human T-lymphotropic virus 2
cuccuccaucccaaccc

SEQ ID NO: 2925302 - RNA, 22 nt, Human T-lymphotropic virus 2
gcgcuccuuucugcgccgcucc

SEQ ID NO: 2925303 - RNA, 20 nt, Human T-lymphotropic virus 2
cgcccuaccucuccuuggcc

SEQ ID NO: 2925304 - RNA, 12 nt, Human T-lymphotropic virus 2
aggaacugaaac

SEQ ID NO: 2925305 - RNA, 16 nt, Human T-lymphotropic virus 2
gggauccauccucucc

SEQ ID NO: 2925306 - RNA, 15 nt, Human T-lymphotropic virus 2
agcuaacccuccagg

SEQ ID NO: 2925307 - RNA, 14 nt, Human T-lymphotropic virus 2
caaacuccuccaaa

SEQ ID NO: 2925308 - RNA, 16 nt, Human T-lymphotropic virus 2
gccagccacccagggc

SEQ ID NO: 2925309 - RNA, 17 nt, Human T-lymphotropic virus 2
cgagguugacaaagaca

SEQ ID NO: 2925310 - RNA, 20 nt, Human T-lymphotropic virus 2
caacagaccaccaacaccau

SEQ ID NO: 2925311 - RNA, 17 nt, Human T-lymphotropic virus 2
cugacgccccaaggccu

SEQ ID NO: 2925312 - RNA, 15 nt, Human T-lymphotropic virus 2
cgcccuacaacaaug

SEQ ID NO: 2925313 - RNA, 17 nt, Human T-lymphotropic virus 2
cagcuaacccuccaggc

SEQ ID NO: 2925314 - RNA, 17 nt, Human T-lymphotropic virus 2
cucacacauuuuccacu

SEQ ID NO: 2925315 - RNA, 17 nt, Human T-lymphotropic virus 2
ccucugcucuuggcagc

SEQ ID NO: 2925316 - RNA, 16 nt, Human T-lymphotropic virus 2
uacguggaacccacca

SEQ ID NO: 2925317 - RNA, 21 nt, Human T-lymphotropic virus 2
uggcagggccccuaagaaugc

SEQ ID NO: 2925318 - RNA, 21 nt, Human T-lymphotropic virus 2
cagcccccaccaauugcugcc

SEQ ID NO: 2925319 - RNA, 17 nt, Human T-lymphotropic virus 2
ugggaccgucucccggc

SEQ ID NO: 2925320 - RNA, 23 nt, Human T-lymphotropic virus 2
caacauacgccguggagcgcagc

SEQ ID NO: 2925321 - RNA, 14 nt, Human T-lymphotropic virus 2
ggaacagcucucca

SEQ ID NO: 2925322 - RNA, 12 nt, Human T-lymphotropic virus 2
aagucuccucuc

SEQ ID NO: 2925323 - RNA, 20 nt, Human T-lymphotropic virus 2
uacacgggccccgucuccag

SEQ ID NO: 2925324 - RNA, 13 nt, Human T-lymphotropic virus 2
auuauccuccccc

SEQ ID NO: 2925325 - RNA, 14 nt, Human T-lymphotropic virus 2
ucgccucucccugg

SEQ ID NO: 2925326 - RNA, 17 nt, Human T-lymphotropic virus 2
acuacuccuccgccacc

SEQ ID NO: 2925327 - RNA, 12 nt, Human T-lymphotropic virus 2
caauugcugcca

SEQ ID NO: 2925328 - RNA, 22 nt, Human T-lymphotropic virus 2
caccuccccccccuuccccgga

SEQ ID NO: 2925329 - RNA, 17 nt, Human T-lymphotropic virus 2
uagggcuuccugaaccu

SEQ ID NO: 2925330 - RNA, 19 nt, Human T-lymphotropic virus 2
cagagcaccaacucaccug

SEQ ID NO: 2925331 - RNA, 17 nt, Human T-lymphotropic virus 2
cuuggcuccacaccccc

SEQ ID NO: 2925332 - RNA, 16 nt, Human T-lymphotropic virus 2
gccaccuguccagagc

SEQ ID NO: 2925333 - RNA, 15 nt, Human T-lymphotropic virus 2
ugacgccccaaggcc

SEQ ID NO: 2925334 - RNA, 14 nt, Human T-lymphotropic virus 2
uggugucccgucuc

SEQ ID NO: 2925335 - RNA, 16 nt, Human T-lymphotropic virus 2
ggcagcuauccuacag

SEQ ID NO: 2925336 - RNA, 18 nt, Human T-lymphotropic virus 2
cuacgugcugccaagcca

SEQ ID NO: 2925337 - RNA, 18 nt, Human T-lymphotropic virus 2
accauucucgcucuacuc

SEQ ID NO: 2925338 - RNA, 17 nt, Human T-lymphotropic virus 2
ucccagcuaacccucca

SEQ ID NO: 2925339 - RNA, 18 nt, Human T-lymphotropic virus 2
ggagccuuccucaccaag

SEQ ID NO: 2925340 - RNA, 18 nt, Human T-lymphotropic virus 2
gguccuuaccccucccac

SEQ ID NO: 2925341 - RNA, 16 nt, Human T-lymphotropic virus 2
ucauaguccucccgga

SEQ ID NO: 2925342 - RNA, 11 nt, Human T-lymphotropic virus 2
caaccccacca

SEQ ID NO: 2925343 - RNA, 14 nt, Human T-lymphotropic virus 2
agcccccucagcuc

SEQ ID NO: 2925344 - RNA, 19 nt, Human T-lymphotropic virus 2
cuuacaagaucuccuccag

SEQ ID NO: 2925345 - RNA, 15 nt, Human T-lymphotropic virus 2
auuacuaccacccuc

SEQ ID NO: 2925346 - RNA, 14 nt, Human T-lymphotropic virus 2
gggcuaucaaccca

SEQ ID NO: 2925347 - RNA, 15 nt, Human T-lymphotropic virus 2
ggaggucagcuccuc

SEQ ID NO: 2925348 - RNA, 20 nt, Human T-lymphotropic virus 2
ggaggcccauguuccccccc

SEQ ID NO: 2925349 - RNA, 19 nt, Human T-lymphotropic virus 2
agacuguccuaaccuuccc

SEQ ID NO: 2925350 - RNA, 21 nt, Human T-lymphotropic virus 2
ugccauuacuaccacccucac

SEQ ID NO: 2925351 - RNA, 20 nt, Human T-lymphotropic virus 2
gcggccggggcagccuugcu

SEQ ID NO: 2925352 - RNA, 19 nt, Human T-lymphotropic virus 2
ccuccaucccaacccuucc

SEQ ID NO: 2925353 - RNA, 20 nt, Human T-lymphotropic virus 2
ugccauuacuaccacccuca

SEQ ID NO: 2925354 - RNA, 15 nt, Human T-lymphotropic virus 2
cuacuccuccgccac

SEQ ID NO: 2925355 - RNA, 13 nt, Human T-lymphotropic virus 2
aaaauagaccuca

SEQ ID NO: 2925356 - RNA, 15 nt, Human T-lymphotropic virus 2
cuacaaugccccuac

SEQ ID NO: 2925357 - RNA, 15 nt, Human T-lymphotropic virus 2
agugcggcuccucca

SEQ ID NO: 2925358 - RNA, 15 nt, Human T-lymphotropic virus 2
cauggccuucccuua

SEQ ID NO: 2925359 - RNA, 23 nt, Human T-lymphotropic virus 2
caagagcuuguaucacccucacc

SEQ ID NO: 2925360 - RNA, 19 nt, Human T-lymphotropic virus 2
ucugcucuuggcagccccc

SEQ ID NO: 2925361 - RNA, 14 nt, Human T-lymphotropic virus 2
ccuuccaccucagg

SEQ ID NO: 2925362 - RNA, 23 nt, Human T-lymphotropic virus 2
cccuccuguuggaucucccuucc

SEQ ID NO: 2925363 - RNA, 19 nt, Human T-lymphotropic virus 2
cuggcugcuuucuccaccc

SEQ ID NO: 2925364 - RNA, 16 nt, Human T-lymphotropic virus 2
gcucuuggcagccccc

SEQ ID NO: 2925365 - RNA, 13 nt, Human T-lymphotropic virus 2
cucucauccuggc

SEQ ID NO: 2925366 - RNA, 21 nt, Human T-lymphotropic virus 2
gaacccacucagccuccacca

SEQ ID NO: 2925367 - RNA, 16 nt, Human T-lymphotropic virus 2
ucccagcuaacccucc

SEQ ID NO: 2925368 - RNA, 21 nt, Human T-lymphotropic virus 2
acccaagcaaaauuggccccu

SEQ ID NO: 2925369 - RNA, 17 nt, Human T-lymphotropic virus 2
uaaacuccccggccuua

SEQ ID NO: 2925370 - RNA, 16 nt, Human T-lymphotropic virus 2
ccaugacuccgaccuu

SEQ ID NO: 2925371 - RNA, 23 nt, Human T-lymphotropic virus 2
ccucuaacccccgcucacauucc

SEQ ID NO: 2925372 - RNA, 19 nt, Human T-lymphotropic virus 2
cucgccuccccuccuuccc

SEQ ID NO: 2925373 - RNA, 15 nt, Human T-lymphotropic virus 2
cccauggcagggccc

SEQ ID NO: 2925374 - RNA, 19 nt, Human T-lymphotropic virus 2
ucucgcucuacuccuccuc

SEQ ID NO: 2925375 - RNA, 18 nt, Human T-lymphotropic virus 2
agucaaaauaaaagaugc

SEQ ID NO: 2925376 - RNA, 16 nt, Human T-lymphotropic virus 2
uacuucgccuucacca

SEQ ID NO: 2925377 - RNA, 22 nt, Human T-lymphotropic virus 2
ccagccauacuucgccuucacc

SEQ ID NO: 2925378 - RNA, 13 nt, Human T-lymphotropic virus 2
cacuuauacccca

SEQ ID NO: 2925379 - RNA, 20 nt, Human T-lymphotropic virus 2
caaucccuauauucugcccu

SEQ ID NO: 2925380 - RNA, 15 nt, Human T-lymphotropic virus 2
uccacaccccccacc

SEQ ID NO: 2925381 - RNA, 20 nt, Human T-lymphotropic virus 2
gccuucaccauuccccagcc

SEQ ID NO: 2925382 - RNA, 12 nt, Human T-lymphotropic virus 2
aguucaggaggu

SEQ ID NO: 2925383 - RNA, 13 nt, Human T-lymphotropic virus 2
acuucucccccau

SEQ ID NO: 2925384 - RNA, 17 nt, Human T-lymphotropic virus 2
cuaacccuccaggcacu

SEQ ID NO: 2925385 - RNA, 13 nt, Human T-lymphotropic virus 2
uccugaaccucuc

SEQ ID NO: 2925386 - RNA, 14 nt, Human T-lymphotropic virus 2
uaucaacccaccac

SEQ ID NO: 2925387 - RNA, 15 nt, Human T-lymphotropic virus 2
uagacaccuucuccg

SEQ ID NO: 2925388 - RNA, 20 nt, Human T-lymphotropic virus 2
cccauugguccaugacuccg

SEQ ID NO: 2925389 - RNA, 15 nt, Human T-lymphotropic virus 2
uuagccagccccacc

SEQ ID NO: 2925390 - RNA, 15 nt, Human T-lymphotropic virus 2
gacuuccugaggaac

SEQ ID NO: 2925391 - RNA, 16 nt, Human T-lymphotropic virus 2
agauccagccucucau

SEQ ID NO: 2925392 - RNA, 20 nt, Human T-lymphotropic virus 2
gacucucuuacaccucccaa

SEQ ID NO: 2925393 - RNA, 18 nt, Human T-lymphotropic virus 2
accuugaacauguccuaa

SEQ ID NO: 2925394 - RNA, 22 nt, Human T-lymphotropic virus 2
ggaugacaauggcgacuagccu

SEQ ID NO: 2925395 - RNA, 13 nt, Human T-lymphotropic virus 2
gccaagauccuuc

SEQ ID NO: 2925396 - RNA, 21 nt, Human T-lymphotropic virus 2
ccuuuaugguucaucaccuca

SEQ ID NO: 2925397 - RNA, 14 nt, Human T-lymphotropic virus 2
acuacgugcugcca

SEQ ID NO: 2925398 - RNA, 18 nt, Human T-lymphotropic virus 2
agaaguuuuaagaucucc

SEQ ID NO: 2925399 - RNA, 20 nt, Human T-lymphotropic virus 2
cccacaacucaaacccccuc

SEQ ID NO: 2925400 - RNA, 17 nt, Human T-lymphotropic virus 2
auccucauucaccacau

SEQ ID NO: 2925401 - RNA, 20 nt, Human T-lymphotropic virus 2
caucucgauacucccacuca

SEQ ID NO: 2925402 - RNA, 22 nt, Human T-lymphotropic virus 2
gcugcuuucuccacccugccag

SEQ ID NO: 2925403 - RNA, 15 nt, Human T-lymphotropic virus 2
ccucaccucuccuuc

SEQ ID NO: 2925404 - RNA, 23 nt, Human T-lymphotropic virus 2
cuccucuccaauaccuuaucccu

SEQ ID NO: 2925405 - RNA, 20 nt, Human T-lymphotropic virus 2
uccaguaaaagccuucuccu

SEQ ID NO: 2925406 - RNA, 18 nt, Human T-lymphotropic virus 2
gcuagccuuauccccaag

SEQ ID NO: 2925407 - RNA, 20 nt, Human T-lymphotropic virus 2
auuggugucccgucucaggu

SEQ ID NO: 2925408 - RNA, 17 nt, Human T-lymphotropic virus 2
guacuacucgccuuccu

SEQ ID NO: 2925409 - RNA, 23 nt, Human T-lymphotropic virus 2
cagcucugccaaucuuuccacca

SEQ ID NO: 2925410 - RNA, 18 nt, Human T-lymphotropic virus 2
uacaacaacucucccagc

SEQ ID NO: 2925411 - RNA, 12 nt, Human T-lymphotropic virus 2
acuucuauacaa

SEQ ID NO: 2925412 - RNA, 18 nt, Human T-lymphotropic virus 2
cucccaaaccaccuccca

SEQ ID NO: 2925413 - RNA, 15 nt, Human T-lymphotropic virus 2
ccgccugcgcucggc

SEQ ID NO: 2925414 - RNA, 14 nt, Human T-lymphotropic virus 2
gcgauuguguacag

SEQ ID NO: 2925415 - RNA, 18 nt, Human T-lymphotropic virus 2
uccaccacaguccuccac

SEQ ID NO: 2925416 - RNA, 14 nt, Human T-lymphotropic virus 2
cacuccccugcccu

SEQ ID NO: 2925417 - RNA, 19 nt, Human T-lymphotropic virus 2
ccauguuccccccccuuac

SEQ ID NO: 2925418 - RNA, 15 nt, Human T-lymphotropic virus 2
uccaguaaaagccuu

SEQ ID NO: 2925419 - RNA, 14 nt, Human T-lymphotropic virus 2
auggccuucccuua

SEQ ID NO: 2925420 - RNA, 12 nt, Human T-lymphotropic virus 2
uccuggccccug

SEQ ID NO: 2925421 - RNA, 14 nt, Human T-lymphotropic virus 2
acagagccuccuau

SEQ ID NO: 2925422 - RNA, 15 nt, Human T-lymphotropic virus 2
acccaguucaaacuc

SEQ ID NO: 2925423 - RNA, 13 nt, Human T-lymphotropic virus 2
cagggcaagacca

SEQ ID NO: 2925424 - RNA, 23 nt, Human T-lymphotropic virus 2
ccgcuccuccaucccaacccuuc

SEQ ID NO: 2925425 - RNA, 14 nt, Human T-lymphotropic virus 2
caccaacaucccug

SEQ ID NO: 2925426 - RNA, 19 nt, Human T-lymphotropic virus 2
accuucccccaccucccca

SEQ ID NO: 2925427 - RNA, 21 nt, Human T-lymphotropic virus 2
uccuccuaccacuccagcccc

SEQ ID NO: 2925428 - RNA, 13 nt, Human T-lymphotropic virus 2
ucuccuuccccag

SEQ ID NO: 2925429 - RNA, 19 nt, Human T-lymphotropic virus 2
gaggaaggggaaccccucc

SEQ ID NO: 2925430 - RNA, 16 nt, Human T-lymphotropic virus 2
gaacaggaacagcucu

SEQ ID NO: 2925431 - RNA, 17 nt, Human T-lymphotropic virus 2
ccagcuuuccccaccca

SEQ ID NO: 2925432 - RNA, 19 nt, Human T-lymphotropic virus 2
cucucacgaaacacauucc

SEQ ID NO: 2925433 - RNA, 19 nt, Human T-lymphotropic virus 2
ugcccuccuggccaccugu

SEQ ID NO: 2925434 - RNA, 15 nt, Human T-lymphotropic virus 2
gcgcagcaagggcua

SEQ ID NO: 2925435 - RNA, 17 nt, Human T-lymphotropic virus 2
uaccccaccuacagacc

SEQ ID NO: 2925436 - RNA, 20 nt, Human T-lymphotropic virus 2
ccaugcguuacaugccauuc

SEQ ID NO: 2925437 - RNA, 24 nt, Human T-lymphotropic virus 2
ucccccaggagcccccucagcuca

SEQ ID NO: 2925438 - RNA, 15 nt, Human T-lymphotropic virus 2
agccagccacccagg

SEQ ID NO: 2925439 - RNA, 19 nt, Human T-lymphotropic virus 2
uccuggccccugcccccua

SEQ ID NO: 2925440 - RNA, 20 nt, Human T-lymphotropic virus 2
augacaggcuacaaccccau

SEQ ID NO: 2925441 - RNA, 13 nt, Human T-lymphotropic virus 2
agcauucuaccca

SEQ ID NO: 2925442 - RNA, 15 nt, Human T-lymphotropic virus 2
ccuccuaccacucca

SEQ ID NO: 2925443 - RNA, 18 nt, Human T-lymphotropic virus 2
cagcuccccucccucgcc

SEQ ID NO: 2925444 - RNA, 13 nt, Human T-lymphotropic virus 2
cagccacccaggg

SEQ ID NO: 2925445 - RNA, 17 nt, Human T-lymphotropic virus 2
uacaagaucuccuccag

SEQ ID NO: 2925446 - RNA, 13 nt, Human T-lymphotropic virus 2
agcucggcugccc

SEQ ID NO: 2925447 - RNA, 14 nt, Human T-lymphotropic virus 2
gucuccucucaggu

SEQ ID NO: 2925448 - RNA, 18 nt, Human T-lymphotropic virus 2
cuccuccuaccacuccag

SEQ ID NO: 2925449 - RNA, 15 nt, Human T-lymphotropic virus 2
uccugaagccucuac

SEQ ID NO: 2925450 - RNA, 20 nt, Human T-lymphotropic virus 2
acuccaugcguuacaugcca

SEQ ID NO: 2925451 - RNA, 13 nt, Human T-lymphotropic virus 2
ucgacuuccagca

SEQ ID NO: 2925452 - RNA, 13 nt, Human T-lymphotropic virus 2
ucacuccccugcc

SEQ ID NO: 2925453 - RNA, 14 nt, Human T-lymphotropic virus 2
aaucccccucccca

SEQ ID NO: 2925454 - RNA, 17 nt, Human T-lymphotropic virus 2
uuaucuuagcuccccuu

SEQ ID NO: 2925455 - RNA, 14 nt, Human T-lymphotropic virus 2
cgccgcccucuugg

SEQ ID NO: 2925456 - RNA, 22 nt, Human T-lymphotropic virus 2
guuaugggacaaacaccucagc

SEQ ID NO: 2925457 - RNA, 18 nt, Human T-lymphotropic virus 2
aaaggcucugacgucucc

SEQ ID NO: 2925458 - RNA, 15 nt, Human T-lymphotropic virus 2
cccaagcaguaccag

SEQ ID NO: 2925459 - RNA, 13 nt, Human T-lymphotropic virus 2
ucccaacccuucu

SEQ ID NO: 2925460 - RNA, 19 nt, Human T-lymphotropic virus 2
uaacugccguggccgccuc

SEQ ID NO: 2925461 - RNA, 12 nt, Human T-lymphotropic virus 2
ucacuccccugc

SEQ ID NO: 2925462 - RNA, 18 nt, Human T-lymphotropic virus 2
cacgagaagcccuccaga

SEQ ID NO: 2925463 - RNA, 20 nt, Human T-lymphotropic virus 2
cucccggccucggcaccucc

SEQ ID NO: 2925464 - RNA, 13 nt, Human T-lymphotropic virus 2
ccaguccauccug

SEQ ID NO: 2925465 - RNA, 20 nt, Human T-lymphotropic virus 2
auagccacuccaaacaccau

SEQ ID NO: 2925466 - RNA, 16 nt, Human T-lymphotropic virus 2
gcccauuucccaggau

SEQ ID NO: 2925467 - RNA, 15 nt, Human T-lymphotropic virus 2
cucacauuccuccca

SEQ ID NO: 2925468 - RNA, 20 nt, Human T-lymphotropic virus 2
uagacuguccuaaccuuccc

SEQ ID NO: 2925469 - RNA, 22 nt, Human T-lymphotropic virus 2
cgccaccuccccccccuucccc

SEQ ID NO: 2925470 - RNA, 22 nt, Human T-lymphotropic virus 2
cuucaggccauuucccuccuag

SEQ ID NO: 2925471 - RNA, 13 nt, Human T-lymphotropic virus 2
cucccgcuccuca

SEQ ID NO: 2925472 - RNA, 22 nt, Human T-lymphotropic virus 2
acuccuccgccaccuccccccc

SEQ ID NO: 2925473 - RNA, 16 nt, Human T-lymphotropic virus 2
uccacaccccccaccc

SEQ ID NO: 2925474 - RNA, 16 nt, Human T-lymphotropic virus 2
ccgcuccuccauccca

SEQ ID NO: 2925475 - RNA, 22 nt, Human T-lymphotropic virus 2
ugggcaaaccaacacccaguuc

SEQ ID NO: 2925476 - RNA, 15 nt, Human T-lymphotropic virus 2
ccuccaggccuuaaa

SEQ ID NO: 2925477 - RNA, 18 nt, Human T-lymphotropic virus 2
accacggcccugacgucc

SEQ ID NO: 2925478 - RNA, 13 nt, Human T-lymphotropic virus 2
gagacucaccuug

SEQ ID NO: 2925479 - RNA, 18 nt, Human T-lymphotropic virus 2
cuacucucucaucagcuu

SEQ ID NO: 2925480 - RNA, 14 nt, Human T-lymphotropic virus 2
uccacccugccagg

SEQ ID NO: 2925481 - RNA, 14 nt, Human T-lymphotropic virus 2
guucaguccucccu

SEQ ID NO: 2925482 - RNA, 21 nt, Human T-lymphotropic virus 2
acgacacccugauccuaggcg

SEQ ID NO: 2925483 - RNA, 17 nt, Human T-lymphotropic virus 2
cccauugguccaugacu

SEQ ID NO: 2925484 - RNA, 21 nt, Human T-lymphotropic virus 2
ccccgcucacauuccucccau

SEQ ID NO: 2925485 - RNA, 18 nt, Human T-lymphotropic virus 2
ccuuucuucccucucccg

SEQ ID NO: 2925486 - RNA, 21 nt, Human T-lymphotropic virus 2
cugccguggccgccucaaccc

SEQ ID NO: 2925487 - RNA, 16 nt, Human T-lymphotropic virus 2
cagacgaccccagccc

SEQ ID NO: 2925488 - RNA, 18 nt, Human T-lymphotropic virus 2
ucccagcuaacccuccag

SEQ ID NO: 2925489 - RNA, 16 nt, Human T-lymphotropic virus 2
accccccacccuccga

SEQ ID NO: 2925490 - RNA, 16 nt, Human T-lymphotropic virus 2
gcuuggcuccacaccc

SEQ ID NO: 2925491 - RNA, 22 nt, Human T-lymphotropic virus 2
cucacgauugguaucuccuccu

SEQ ID NO: 2925492 - RNA, 20 nt, Human T-lymphotropic virus 2
caggagcaauguugcuuccu

SEQ ID NO: 2925493 - RNA, 20 nt, Human T-lymphotropic virus 2
cugagcgccuccaggccuua

SEQ ID NO: 2925494 - RNA, 15 nt, Human T-lymphotropic virus 2
cuccuaccacuccag

SEQ ID NO: 2925495 - RNA, 22 nt, Human T-lymphotropic virus 2
caacgacuacacccccccugcc

SEQ ID NO: 2925496 - RNA, 18 nt, Human T-lymphotropic virus 2
cgccuuaacguggcccuu

SEQ ID NO: 2925497 - RNA, 13 nt, Human T-lymphotropic virus 2
caccuccccaagu

SEQ ID NO: 2925498 - RNA, 15 nt, Human T-lymphotropic virus 2
cucacgcuccugcag

SEQ ID NO: 2925499 - RNA, 17 nt, Human T-lymphotropic virus 2
cccgcgggaugacaggc

SEQ ID NO: 2925500 - RNA, 14 nt, Human T-lymphotropic virus 2
accuacaaucccua

SEQ ID NO: 2925501 - RNA, 14 nt, Human T-lymphotropic virus 2
cacggcccccugcc

SEQ ID NO: 2925502 - RNA, 14 nt, Human T-lymphotropic virus 2
acacagacucccuu

SEQ ID NO: 2925503 - RNA, 19 nt, Human T-lymphotropic virus 2
acaccucagccuacccaag

SEQ ID NO: 2925504 - RNA, 22 nt, Human T-lymphotropic virus 2
cccucaccucuccuuccccagg

SEQ ID NO: 2925505 - RNA, 15 nt, Human T-lymphotropic virus 2
ugagcgccuccaggc

SEQ ID NO: 2925506 - RNA, 14 nt, Human T-lymphotropic virus 2
gacgucccuccccc

SEQ ID NO: 2925507 - RNA, 19 nt, Human T-lymphotropic virus 2
cauacuuuuagccagcccc

SEQ ID NO: 2925508 - RNA, 14 nt, Human T-lymphotropic virus 2
ccuuucuucccucu

SEQ ID NO: 2925509 - RNA, 15 nt, Human T-lymphotropic virus 2
cccugcccgcuccuc

SEQ ID NO: 2925510 - RNA, 17 nt, Human T-lymphotropic virus 2
agcaccaauuacuccug

SEQ ID NO: 2925511 - RNA, 14 nt, Human T-lymphotropic virus 2
acuccuccuuccau

SEQ ID NO: 2925512 - RNA, 23 nt, Human T-lymphotropic virus 2
cauuccccaacaaaccuccuccc

SEQ ID NO: 2925513 - RNA, 18 nt, Human T-lymphotropic virus 2
accacccucaccucuccu

SEQ ID NO: 2925514 - RNA, 16 nt, Human T-lymphotropic virus 2
acaucacuccccugcc

SEQ ID NO: 2925515 - RNA, 15 nt, Human T-lymphotropic virus 2
cguaccuccuccggc

SEQ ID NO: 2925516 - RNA, 14 nt, Human T-lymphotropic virus 2
cccugcccucucac

SEQ ID NO: 2925517 - RNA, 23 nt, Human T-lymphotropic virus 2
guccguggaagacucucuuacac

SEQ ID NO: 2925518 - RNA, 21 nt, Human T-lymphotropic virus 2
gucuauugcuauaggcaggcc

SEQ ID NO: 2925519 - RNA, 17 nt, Human T-lymphotropic virus 2
acuacacccccccugcc

SEQ ID NO: 2925520 - RNA, 20 nt, Human T-lymphotropic virus 2
uaaaagcgcaaggacaguuc

SEQ ID NO: 2925521 - RNA, 20 nt, Human T-lymphotropic virus 2
aaaggcucugacgucucccc

SEQ ID NO: 2925522 - RNA, 20 nt, Human T-lymphotropic virus 2
gacgccuuuuuccaaauccc

SEQ ID NO: 2925523 - RNA, 17 nt, Human T-lymphotropic virus 2
uccaaacaccauaggcc

SEQ ID NO: 2925524 - RNA, 14 nt, Human T-lymphotropic virus 2
ucaucaaaacaucc

SEQ ID NO: 2925525 - RNA, 16 nt, Human T-lymphotropic virus 2
acgcuucuuaggacag

SEQ ID NO: 2925526 - RNA, 18 nt, Human T-lymphotropic virus 2
ucuccuuggccucaucuc

SEQ ID NO: 2925527 - RNA, 22 nt, Human T-lymphotropic virus 2
uucuuaggacaggucaucuccc

SEQ ID NO: 2925528 - RNA, 14 nt, Human T-lymphotropic virus 2
ggaggccccccccc

SEQ ID NO: 2925529 - RNA, 14 nt, Human T-lymphotropic virus 2
uauaccauacaacc

SEQ ID NO: 2925530 - RNA, 18 nt, Human T-lymphotropic virus 2
ccuuaaacuucacuuccg

SEQ ID NO: 2925531 - RNA, 15 nt, Human T-lymphotropic virus 2
caacccuucuccagg

SEQ ID NO: 2925532 - RNA, 21 nt, Human T-lymphotropic virus 2
ggcccuugacaacggccuccc

SEQ ID NO: 2925533 - RNA, 19 nt, Human T-lymphotropic virus 2
caauaccuuaucccucgcc

SEQ ID NO: 2925534 - RNA, 16 nt, Human T-lymphotropic virus 2
acaacaaugccagggg

SEQ ID NO: 2925535 - RNA, 21 nt, Human T-lymphotropic virus 2
gauccagccucucauccuggc

SEQ ID NO: 2925536 - RNA, 14 nt, Human T-lymphotropic virus 2
aacucucccagcua

SEQ ID NO: 2925537 - RNA, 18 nt, Human T-lymphotropic virus 2
ucgagcucggcugccccu

SEQ ID NO: 2925538 - RNA, 23 nt, Human T-lymphotropic virus 2
cauggccuuccaauuucccagga

SEQ ID NO: 2925539 - RNA, 18 nt, Human T-lymphotropic virus 2
ucucagcccauuucccag

SEQ ID NO: 2925540 - RNA, 20 nt, Human T-lymphotropic virus 2
ugggacaaacaccucagccu

SEQ ID NO: 2925541 - RNA, 16 nt, Human T-lymphotropic virus 2
cucucagcccauuucc

SEQ ID NO: 2925542 - RNA, 12 nt, Human T-lymphotropic virus 2
cgcucccucacc

SEQ ID NO: 2925543 - RNA, 14 nt, Human T-lymphotropic virus 2
caaagcccccaggg

SEQ ID NO: 2925544 - RNA, 20 nt, Human T-lymphotropic virus 2
acccaggaagucagccaagu

SEQ ID NO: 2925545 - RNA, 15 nt, Human T-lymphotropic virus 2
ccacgacuccucagg

SEQ ID NO: 2925546 - RNA, 18 nt, Human T-lymphotropic virus 2
cccaucaaacccuccagg

SEQ ID NO: 2925547 - RNA, 22 nt, Human T-lymphotropic virus 2
ggccuccccgaggguaccccca

SEQ ID NO: 2925548 - RNA, 21 nt, Human T-lymphotropic virus 2
ucucuaaaggaacacccaucc

SEQ ID NO: 2925549 - RNA, 14 nt, Human T-lymphotropic virus 2
ccuggggaaaaacc

SEQ ID NO: 2925550 - RNA, 19 nt, Human T-lymphotropic virus 2
cgccauuggggccuuccuc

SEQ ID NO: 2925551 - RNA, 16 nt, Human T-lymphotropic virus 2
cugcccgcuccuccau

SEQ ID NO: 2925552 - RNA, 24 nt, Human T-lymphotropic virus 2
ccaucuuuaguaguucaguccucc

SEQ ID NO: 2925553 - RNA, 18 nt, Human T-lymphotropic virus 2
ucaaaacauccuccgggu

SEQ ID NO: 2925554 - RNA, 21 nt, Human T-lymphotropic virus 2
gaagacucucuuacaccuccc

SEQ ID NO: 2925555 - RNA, 22 nt, Human T-lymphotropic virus 2
ucaaacuccuccaaaccccccu

SEQ ID NO: 2925556 - RNA, 23 nt, Human T-lymphotropic virus 2
gccccuaagaaugcaggcuaaua

SEQ ID NO: 2925557 - RNA, 21 nt, Human T-lymphotropic virus 2
cccuccaggcggccuugccac

SEQ ID NO: 2925558 - RNA, 20 nt, Human T-lymphotropic virus 2
ccuacuuuuauucagucuca

SEQ ID NO: 2925559 - RNA, 21 nt, Human T-lymphotropic virus 2
ccuccuagggaaaccacucca

SEQ ID NO: 2925560 - RNA, 17 nt, Human T-lymphotropic virus 2
uuccaaaucccccuccc

SEQ ID NO: 2925561 - RNA, 20 nt, Human T-lymphotropic virus 2
aauacuccuccuuccauaac

SEQ ID NO: 2925562 - RNA, 18 nt, Human T-lymphotropic virus 2
ucccccaggagcccccuc

SEQ ID NO: 2925563 - RNA, 16 nt, Human T-lymphotropic virus 2
cauuacuaccacccuc

SEQ ID NO: 2925564 - RNA, 21 nt, Human T-lymphotropic virus 2
gggucucuaaaggaacaccca

SEQ ID NO: 2925565 - RNA, 21 nt, Human T-lymphotropic virus 2
cugacgccccaaggccuccac

SEQ ID NO: 2925566 - RNA, 15 nt, Human T-lymphotropic virus 2
cgcccucuuggcagg

SEQ ID NO: 2925567 - RNA, 21 nt, Human T-lymphotropic virus 2
ccugucaaaccaucaacucac

SEQ ID NO: 2925568 - RNA, 18 nt, Human T-lymphotropic virus 2
cuuacccaggccauaguc

SEQ ID NO: 2925569 - RNA, 19 nt, Human T-lymphotropic virus 2
ucccgagccagccacccag

SEQ ID NO: 2925570 - RNA, 20 nt, Human T-lymphotropic virus 2
agccuccaccaacuucuccc

SEQ ID NO: 2925571 - RNA, 22 nt, Human T-lymphotropic virus 2
cuuccgcccaucaaacccucca

SEQ ID NO: 2925572 - RNA, 16 nt, Human T-lymphotropic virus 2
uccauaaccuucaccu

SEQ ID NO: 2925573 - RNA, 24 nt, Human T-lymphotropic virus 2
gccaggggcuucuauaccucccag

SEQ ID NO: 2925574 - RNA, 22 nt, Human T-lymphotropic virus 2
cacccucaccccacaacaacuc

SEQ ID NO: 2925575 - RNA, 16 nt, Human T-lymphotropic virus 2
uacacccccaacaucu

SEQ ID NO: 2925576 - RNA, 20 nt, Human T-lymphotropic virus 2
uccucuuuccuucccuugcc

SEQ ID NO: 2925577 - RNA, 17 nt, Human T-lymphotropic virus 2
cugcuuucuccacccug

SEQ ID NO: 2925578 - RNA, 19 nt, Human T-lymphotropic virus 2
ggccagccuuccuaucaca

SEQ ID NO: 2925579 - RNA, 20 nt, Human T-lymphotropic virus 2
cuggcauguacucuacaccc

SEQ ID NO: 2925580 - RNA, 16 nt, Human T-lymphotropic virus 2
auccuuuccuccugcc

SEQ ID NO: 2925581 - RNA, 20 nt, Human T-lymphotropic virus 2
uuccccaacaaaccuccucc

SEQ ID NO: 2925582 - RNA, 14 nt, Human T-lymphotropic virus 2
accuaagagccacc

SEQ ID NO: 2925583 - RNA, 17 nt, Human T-lymphotropic virus 2
cccucaccucuccuucc

SEQ ID NO: 2925584 - RNA, 19 nt, Human T-lymphotropic virus 2
cuagccuaccgacagccuu

SEQ ID NO: 2925585 - RNA, 17 nt, Human T-lymphotropic virus 2
acuccuccgccaccucc

SEQ ID NO: 2925586 - RNA, 17 nt, Human T-lymphotropic virus 2
uauguuccacccgccua

SEQ ID NO: 2925587 - RNA, 16 nt, Human T-lymphotropic virus 2
gcucccguaccuccuc

SEQ ID NO: 2925588 - RNA, 12 nt, Human T-lymphotropic virus 2
cuacuccuccuc

SEQ ID NO: 2925589 - RNA, 15 nt, Human T-lymphotropic virus 2
cuccacuaccaccca

SEQ ID NO: 2925590 - RNA, 19 nt, Human T-lymphotropic virus 2
uaucagcgccguucuucag

SEQ ID NO: 2925591 - RNA, 14 nt, Human T-lymphotropic virus 2
cagagcaccaacuc

SEQ ID NO: 2925592 - RNA, 14 nt, Human T-lymphotropic virus 2
ugccugguguacag

SEQ ID NO: 2925593 - RNA, 23 nt, Human T-lymphotropic virus 2
aaauucgaaaccaaagccuucca

SEQ ID NO: 2925594 - RNA, 22 nt, Human T-lymphotropic virus 2
aucacauuacauaugagaguac

SEQ ID NO: 2925595 - RNA, 16 nt, Human T-lymphotropic virus 2
caugaccuaagagcca

SEQ ID NO: 2925596 - RNA, 15 nt, Human T-lymphotropic virus 2
ccgcuccuccauccc

SEQ ID NO: 2925597 - RNA, 21 nt, Human T-lymphotropic virus 2
cgccccaaggccuccacggcc

SEQ ID NO: 2925598 - RNA, 13 nt, Human T-lymphotropic virus 2
ccuccuaccacuc

SEQ ID NO: 2925599 - RNA, 22 nt, Human T-lymphotropic virus 2
ucaaauuuauccagcugaccuu

SEQ ID NO: 2925600 - RNA, 19 nt, Human T-lymphotropic virus 2
uccgacaccuaucugcccu

SEQ ID NO: 2925601 - RNA, 23 nt, Human T-lymphotropic virus 2
aaccccaugaggaaaauguuucc

SEQ ID NO: 2925602 - RNA, 17 nt, Human T-lymphotropic virus 2
ccaccuuacccaggcca

SEQ ID NO: 2925603 - RNA, 19 nt, Human T-lymphotropic virus 2
ccaguucaaacuccuccaa

SEQ ID NO: 2925604 - RNA, 23 nt, Human T-lymphotropic virus 2
ggaggcccauguuccccccccuu

SEQ ID NO: 2925605 - RNA, 18 nt, Human T-lymphotropic virus 2
ugccauuacuaccacccu

SEQ ID NO: 2925606 - RNA, 19 nt, Human T-lymphotropic virus 2
gcccugcccgcuccuccau

SEQ ID NO: 2925607 - RNA, 23 nt, Human T-lymphotropic virus 2
ccuaauuacuuacucuggcuucc

SEQ ID NO: 2925608 - RNA, 16 nt, Human T-lymphotropic virus 2
uccuccgccaccuccc

SEQ ID NO: 2925609 - RNA, 13 nt, Human T-lymphotropic virus 2
acucugccuuaaa

SEQ ID NO: 2925610 - RNA, 19 nt, Human T-lymphotropic virus 2
accucuccuuggccucauc

SEQ ID NO: 2925611 - RNA, 15 nt, Human T-lymphotropic virus 2
agccuuccaucccuc

SEQ ID NO: 2925612 - RNA, 15 nt, Human T-lymphotropic virus 2
ucaaacccuccaggc

SEQ ID NO: 2925613 - RNA, 20 nt, Human T-lymphotropic virus 2
ucccgagccagccacccagg

SEQ ID NO: 2925614 - RNA, 13 nt, Human T-lymphotropic virus 2
ucccggggccaac

SEQ ID NO: 2925615 - RNA, 19 nt, Human T-lymphotropic virus 2
cccucaccgacccucuggu

SEQ ID NO: 2925616 - RNA, 24 nt, Human T-lymphotropic virus 2
ccuucaaugaauacacagacuccc

SEQ ID NO: 2925617 - RNA, 13 nt, Human T-lymphotropic virus 2
gcucccgcuccuc

SEQ ID NO: 2925618 - RNA, 12 nt, Human T-lymphotropic virus 2
uccccaacucca

SEQ ID NO: 2925619 - RNA, 15 nt, Human T-lymphotropic virus 2
caaaccuccucccga

SEQ ID NO: 2925620 - RNA, 17 nt, Human T-lymphotropic virus 2
ccauaaccuucaccuuc

SEQ ID NO: 2925621 - RNA, 19 nt, Human T-lymphotropic virus 2
auacccaaagcccccaggg

SEQ ID NO: 2925622 - RNA, 21 nt, Human T-lymphotropic virus 2
ugcccacaacucaaacccccu

SEQ ID NO: 2925623 - RNA, 13 nt, Human T-lymphotropic virus 2
acaauacuccucc

SEQ ID NO: 2925624 - RNA, 16 nt, Human T-lymphotropic virus 2
ccccaagguuccaccu

SEQ ID NO: 2925625 - RNA, 19 nt, Human T-lymphotropic virus 2
ccaccaauugcugccaaua

SEQ ID NO: 2925626 - RNA, 14 nt, Human T-lymphotropic virus 2
agccuuccucacca

SEQ ID NO: 2925627 - RNA, 19 nt, Human T-lymphotropic virus 2
auccagcugaccuuacaga

SEQ ID NO: 2925628 - RNA, 22 nt, Human T-lymphotropic virus 2
uuggccccuguauccuccgcca

SEQ ID NO: 2925629 - RNA, 16 nt, Human T-lymphotropic virus 2
cacuaccacccauucc

SEQ ID NO: 2925630 - RNA, 22 nt, Human T-lymphotropic virus 2
auacucccacucaucccccugc

SEQ ID NO: 2925631 - RNA, 15 nt, Human T-lymphotropic virus 2
caagaucuccuccag

SEQ ID NO: 2925632 - RNA, 16 nt, Human T-lymphotropic virus 2
ccuuucuucccucucc

SEQ ID NO: 2925633 - RNA, 16 nt, Human T-lymphotropic virus 2
ccuuccuacaaugacc

SEQ ID NO: 2925634 - RNA, 16 nt, Human T-lymphotropic virus 2
cuuaacuuucuccagg

SEQ ID NO: 2925635 - RNA, 20 nt, Human T-lymphotropic virus 2
caaaagggggagcuccuugc

SEQ ID NO: 2925636 - RNA, 21 nt, Human T-lymphotropic virus 2
auccucuuuccuucccuugcc

SEQ ID NO: 2925637 - RNA, 16 nt, Human T-lymphotropic virus 2
cccucgccuccccucc

SEQ ID NO: 2925638 - RNA, 18 nt, Human T-lymphotropic virus 2
cguggagcgcagcaaggg

SEQ ID NO: 2925639 - RNA, 14 nt, Human T-lymphotropic virus 2
ugcagacccuccgg

SEQ ID NO: 2925640 - RNA, 16 nt, Human T-lymphotropic virus 2
ucuacaacauaacugc

SEQ ID NO: 2925641 - RNA, 18 nt, Human T-lymphotropic virus 2
uagccuuauccccaaggg

SEQ ID NO: 2925642 - RNA, 16 nt, Human T-lymphotropic virus 2
uaucucuggcuuccag

SEQ ID NO: 2925643 - RNA, 20 nt, Human T-lymphotropic virus 2
gcugaaaaacaaggcucuga

SEQ ID NO: 2925644 - RNA, 21 nt, Human T-lymphotropic virus 2
gcucccucaccgacccucugg

SEQ ID NO: 2925645 - RNA, 15 nt, Human T-lymphotropic virus 2
ccuccuggccaccug

SEQ ID NO: 2925646 - RNA, 18 nt, Human T-lymphotropic virus 2
accccagcccccaccaau

SEQ ID NO: 2925647 - RNA, 17 nt, Human T-lymphotropic virus 2
ucccauaggaccuucuu

SEQ ID NO: 2925648 - RNA, 13 nt, Human T-lymphotropic virus 2
ccauguccgcagc

SEQ ID NO: 2925649 - RNA, 16 nt, Human T-lymphotropic virus 2
ggcuagacucugccuu

SEQ ID NO: 2925650 - RNA, 20 nt, Human T-lymphotropic virus 2
cagccacgccccccuccugg

SEQ ID NO: 2925651 - RNA, 23 nt, Human T-lymphotropic virus 2
acugaccacgcauggccuuccaa

SEQ ID NO: 2925652 - RNA, 21 nt, Human T-lymphotropic virus 2
uguccuaaccuuccccuagac

SEQ ID NO: 2925653 - RNA, 18 nt, Human T-lymphotropic virus 2
cucguaguuuccuuacac

SEQ ID NO: 2925654 - RNA, 15 nt, Human T-lymphotropic virus 2
gcgaaagcacacccc

SEQ ID NO: 2925655 - RNA, 20 nt, Human T-lymphotropic virus 2
uccccuccuuccccacccag

SEQ ID NO: 2925656 - RNA, 19 nt, Human T-lymphotropic virus 2
cuaagagccaccaaugcca

SEQ ID NO: 2925657 - RNA, 20 nt, Human T-lymphotropic virus 2
acaaauggaccaucauugga

SEQ ID NO: 2925658 - RNA, 17 nt, Human T-lymphotropic virus 2
cccgugaccccucuugg

SEQ ID NO: 2925659 - RNA, 19 nt, Human T-lymphotropic virus 2
ccucucaggucgagcucgg

SEQ ID NO: 2925660 - RNA, 20 nt, Human T-lymphotropic virus 2
gccucgguugagacgccuuc

SEQ ID NO: 2925661 - RNA, 16 nt, Human T-lymphotropic virus 2
ggcgacuagccucccg

SEQ ID NO: 2925662 - RNA, 15 nt, Human T-lymphotropic virus 2
agccacgccccccuc

SEQ ID NO: 2925663 - RNA, 16 nt, Human T-lymphotropic virus 2
auugcuauaggcaggc

SEQ ID NO: 2925664 - RNA, 18 nt, Human T-lymphotropic virus 2
ccacgcauggccuuccaa

SEQ ID NO: 2925665 - RNA, 13 nt, Human T-lymphotropic virus 2
accaaccucgccu

SEQ ID NO: 2925666 - RNA, 22 nt, Human T-lymphotropic virus 2
ggccucacccauugcaaucaaa

SEQ ID NO: 2925667 - RNA, 20 nt, Human T-lymphotropic virus 2
ugcacguggaaccucgaccu

SEQ ID NO: 2925668 - RNA, 21 nt, Human T-lymphotropic virus 2
aggucgagcucggcugccccu

SEQ ID NO: 2925669 - RNA, 17 nt, Human T-lymphotropic virus 2
caauacuccuccuucca

SEQ ID NO: 2925670 - RNA, 14 nt, Human T-lymphotropic virus 2
cguccucaacccca

SEQ ID NO: 2925671 - RNA, 11 nt, Human T-lymphotropic virus 2
aauuuccaccu

SEQ ID NO: 2925672 - RNA, 22 nt, Human T-lymphotropic virus 2
cuucucuaagugcggcuccucc

SEQ ID NO: 2925673 - RNA, 23 nt, Human T-lymphotropic virus 2
ccccgucuccaguccauccugga

SEQ ID NO: 2925674 - RNA, 18 nt, Human T-lymphotropic virus 2
agguggucuauguuccac

SEQ ID NO: 2925675 - RNA, 22 nt, Human T-lymphotropic virus 2
acuucgccuucaccauucccca

SEQ ID NO: 2925676 - RNA, 14 nt, Human T-lymphotropic virus 2
acaucuacaccacc

SEQ ID NO: 2925677 - RNA, 19 nt, Human T-lymphotropic virus 2
cucagcccauuucccagga

SEQ ID NO: 2925678 - RNA, 16 nt, Human T-lymphotropic virus 2
accucagaacccacuc

SEQ ID NO: 2925679 - RNA, 16 nt, Human T-lymphotropic virus 2
cagccacccagggcga

SEQ ID NO: 2925680 - RNA, 19 nt, Human T-lymphotropic virus 2
cuuccccguuaaaaaacca

SEQ ID NO: 2925681 - RNA, 13 nt, Human T-lymphotropic virus 2
acugcaacaacuc

SEQ ID NO: 2925682 - RNA, 22 nt, Human T-lymphotropic virus 2
cucccuuaucuuagcuccccuu

SEQ ID NO: 2925683 - RNA, 12 nt, Human T-lymphotropic virus 2
ccuaucuuacau

SEQ ID NO: 2925684 - RNA, 13 nt, Human T-lymphotropic virus 2
caacucaccuggg

SEQ ID NO: 2925685 - RNA, 14 nt, Human T-lymphotropic virus 2
gagccaccaaugcc

SEQ ID NO: 2925686 - RNA, 23 nt, Human T-lymphotropic virus 2
ucaaacuccuccaaaccccccua

SEQ ID NO: 2925687 - RNA, 14 nt, Human T-lymphotropic virus 2
cucaccugggaccc

SEQ ID NO: 2925688 - RNA, 17 nt, Human T-lymphotropic virus 2
caacuccaugcguuaca

SEQ ID NO: 2925689 - RNA, 19 nt, Human T-lymphotropic virus 2
agcugcaugcccaagacca

SEQ ID NO: 2925690 - RNA, 22 nt, Human T-lymphotropic virus 2
uaagaucucccgcugcuccucc

SEQ ID NO: 2925691 - RNA, 20 nt, Human T-lymphotropic virus 2
acugaaaacgaaaccucaac

SEQ ID NO: 2925692 - RNA, 12 nt, Human T-lymphotropic virus 2
cgccccaaggcc

SEQ ID NO: 2925693 - RNA, 20 nt, Human T-lymphotropic virus 2
gcaggcuaauaaccccgccc

SEQ ID NO: 2925694 - RNA, 14 nt, Human T-lymphotropic virus 2
cggcccccucuuga

SEQ ID NO: 2925695 - RNA, 12 nt, Human T-lymphotropic virus 2
cucgcucccuca

SEQ ID NO: 2925696 - RNA, 13 nt, Human T-lymphotropic virus 2
ucuccacccugcc

SEQ ID NO: 2925697 - RNA, 21 nt, Human T-lymphotropic virus 2
cccuugcccugcccgcuccuc

SEQ ID NO: 2925698 - RNA, 23 nt, Human T-lymphotropic virus 2
cccgagccagccacccagggcga

SEQ ID NO: 2925699 - RNA, 21 nt, Human T-lymphotropic virus 2
cgucuccaguccauccuggaa

SEQ ID NO: 2925700 - RNA, 13 nt, Human T-lymphotropic virus 2
uaggaacugaaac

SEQ ID NO: 2925701 - RNA, 14 nt, Human T-lymphotropic virus 2
cuacaacaaugcca

SEQ ID NO: 2925702 - RNA, 22 nt, Human T-lymphotropic virus 2
ccgcggacacacuaacagcccc

SEQ ID NO: 2925703 - RNA, 19 nt, Human T-lymphotropic virus 2
cugccaauagccacuccaa

SEQ ID NO: 2925704 - RNA, 21 nt, Human T-lymphotropic virus 2
ccaagcaaaauuggccccugg

SEQ ID NO: 2925705 - RNA, 20 nt, Human T-lymphotropic virus 2
ccaucuuaacaaccccaggu

SEQ ID NO: 2925706 - RNA, 19 nt, Human T-lymphotropic virus 2
accucagaacccacucagc

SEQ ID NO: 2925707 - RNA, 20 nt, Human T-lymphotropic virus 2
cccauaaaauuugccuaguc

SEQ ID NO: 2925708 - RNA, 17 nt, Human T-lymphotropic virus 2
cauugcaaucccuccag

SEQ ID NO: 2925709 - RNA, 19 nt, Human T-lymphotropic virus 2
uccacgacacccugauccu

SEQ ID NO: 2925710 - RNA, 20 nt, Human T-lymphotropic virus 2
ccuaucacaagaauuccagg

SEQ ID NO: 2925711 - RNA, 22 nt, Human T-lymphotropic virus 2
ccaggggcuucuauaccuccca

SEQ ID NO: 2925712 - RNA, 20 nt, Human T-lymphotropic virus 2
aaccucgaccuuaauucccu

SEQ ID NO: 2925713 - RNA, 20 nt, Human T-lymphotropic virus 2
uccccaagcaguaccagcca

SEQ ID NO: 2925714 - RNA, 19 nt, Human T-lymphotropic virus 2
gccuuaccccaccuacaga

SEQ ID NO: 2925715 - RNA, 15 nt, Human T-lymphotropic virus 2
accugggaccccauc

SEQ ID NO: 2925716 - RNA, 22 nt, Human T-lymphotropic virus 2
ggacuuacaagaucuccuccag

SEQ ID NO: 2925717 - RNA, 18 nt, Human T-lymphotropic virus 2
ucaccucuccuuccccag

SEQ ID NO: 2925718 - RNA, 24 nt, Human T-lymphotropic virus 2
acccgauggcaaauccaccacagu

SEQ ID NO: 2925719 - RNA, 20 nt, Human T-lymphotropic virus 2
ccauugcaaucccuccagga

SEQ ID NO: 2925720 - RNA, 17 nt, Human T-lymphotropic virus 2
guggcuugucuccgccc

SEQ ID NO: 2925721 - RNA, 17 nt, Human T-lymphotropic virus 2
cccuaccucuccuuggc

SEQ ID NO: 2925722 - RNA, 23 nt, Human T-lymphotropic virus 2
cuccgccaccuccccccccuucc

SEQ ID NO: 2925723 - RNA, 17 nt, Human T-lymphotropic virus 2
gcucccuguauccagac

SEQ ID NO: 2925724 - RNA, 17 nt, Human T-lymphotropic virus 2
cgagaagcccuccagac

SEQ ID NO: 2925725 - RNA, 18 nt, Human T-lymphotropic virus 2
auaacugcaacaacucca

SEQ ID NO: 2925726 - RNA, 23 nt, Human T-lymphotropic virus 2
agcgcugaaaaacaaggcucuga

SEQ ID NO: 2925727 - RNA, 21 nt, Human T-lymphotropic virus 2
uccccgaaccuggccuccguc

SEQ ID NO: 2925728 - RNA, 20 nt, Human T-lymphotropic virus 2
cgugggaccgucucccggcc

SEQ ID NO: 2925729 - RNA, 22 nt, Human T-lymphotropic virus 2
acaaaagggggagcuccuugca

SEQ ID NO: 2925730 - RNA, 10 nt, Human T-lymphotropic virus 2
gaaccccagu

SEQ ID NO: 2925731 - RNA, 22 nt, Human T-lymphotropic virus 2
uacaacaguuugaccccaccgc

SEQ ID NO: 2925732 - RNA, 17 nt, Human T-lymphotropic virus 2
accucaacgccgcccuc

SEQ ID NO: 2925733 - RNA, 19 nt, Human T-lymphotropic virus 2
cucccagcuaacccuccag

SEQ ID NO: 2925734 - RNA, 17 nt, Human T-lymphotropic virus 2
agcccauuucccaggau

SEQ ID NO: 2925735 - RNA, 13 nt, Human T-lymphotropic virus 2
caggcuacaaccc

SEQ ID NO: 2925736 - RNA, 14 nt, Human T-lymphotropic virus 2
cugagcgccuccag

SEQ ID NO: 2925737 - RNA, 20 nt, Human T-lymphotropic virus 2
gcggacacacuaacagcccc

SEQ ID NO: 2925738 - RNA, 14 nt, Human T-lymphotropic virus 2
ucuauaccucccag

SEQ ID NO: 2925739 - RNA, 20 nt, Human T-lymphotropic virus 2
ccucccaaaccaccucccaa

SEQ ID NO: 2925740 - RNA, 16 nt, Human T-lymphotropic virus 2
ucccgaaccauccucu

SEQ ID NO: 2925741 - RNA, 13 nt, Human T-lymphotropic virus 2
uuagccagcccca

SEQ ID NO: 2925742 - RNA, 12 nt, Human T-lymphotropic virus 2
cccccuccccaa

SEQ ID NO: 2925743 - RNA, 12 nt, Human T-lymphotropic virus 2
uaaaaacagccc

SEQ ID NO: 2925744 - RNA, 16 nt, Human T-lymphotropic virus 2
aucucuggcuuccagu

SEQ ID NO: 2925745 - RNA, 16 nt, Human T-lymphotropic virus 2
cuggccaccuguccag

SEQ ID NO: 2925746 - RNA, 13 nt, Human T-lymphotropic virus 2
gaagccaaguccc

SEQ ID NO: 2925747 - RNA, 23 nt, Human T-lymphotropic virus 2
gggcuuccugaaccucuccggga

SEQ ID NO: 2925748 - RNA, 12 nt, Human T-lymphotropic virus 2
uaccccaaagca

SEQ ID NO: 2925749 - RNA, 15 nt, Human T-lymphotropic virus 2
ugagggcucccugua

SEQ ID NO: 2925750 - RNA, 17 nt, Human T-lymphotropic virus 2
aaaaucacacauaauua

SEQ ID NO: 2925751 - RNA, 20 nt, Human T-lymphotropic virus 2
uagcagccguccucaacccc

SEQ ID NO: 2925752 - RNA, 15 nt, Human T-lymphotropic virus 2
ugaaccucuccggga

SEQ ID NO: 2925753 - RNA, 19 nt, Human T-lymphotropic virus 2
cagccacaccaaccucccc

SEQ ID NO: 2925754 - RNA, 16 nt, Human T-lymphotropic virus 2
ugcagccuaggcccuc

SEQ ID NO: 2925755 - RNA, 12 nt, Human T-lymphotropic virus 2
uuggacagagcc

SEQ ID NO: 2925756 - RNA, 14 nt, Human T-lymphotropic virus 2
ucuucgccgucacu

SEQ ID NO: 2925757 - RNA, 14 nt, Human T-lymphotropic virus 2
gccagccacccagg

SEQ ID NO: 2925758 - RNA, 12 nt, Human T-lymphotropic virus 2
agacaaugccau

SEQ ID NO: 2925759 - RNA, 13 nt, Human T-lymphotropic virus 2
uccucacgcuccu

SEQ ID NO: 2925760 - RNA, 14 nt, Human T-lymphotropic virus 2
auccguccuccagg

SEQ ID NO: 2925761 - RNA, 21 nt, Human T-lymphotropic virus 2
uccgcagccacaccaaccucc

SEQ ID NO: 2925762 - RNA, 20 nt, Human T-lymphotropic virus 2
caggccaauuuucacccucu

SEQ ID NO: 2925763 - RNA, 19 nt, Human T-lymphotropic virus 2
accccgcccuaccucuccu

SEQ ID NO: 2925764 - RNA, 18 nt, Human T-lymphotropic virus 2
ccuccugaacugcuccuc

SEQ ID NO: 2925765 - RNA, 15 nt, Human T-lymphotropic virus 2
agccccacccucuuc

SEQ ID NO: 2925766 - RNA, 13 nt, Human T-lymphotropic virus 2
accaguauucccu

SEQ ID NO: 2925767 - RNA, 19 nt, Human T-lymphotropic virus 2
gccuccccuccuuccccac

SEQ ID NO: 2925768 - RNA, 19 nt, Human T-lymphotropic virus 2
gcacaguaugcagcccaaa

SEQ ID NO: 2925769 - RNA, 13 nt, Human T-lymphotropic virus 2
ucccgcugcuccu

SEQ ID NO: 2925770 - RNA, 17 nt, Human T-lymphotropic virus 2
cagacucgccucucccu

SEQ ID NO: 2925771 - RNA, 16 nt, Human T-lymphotropic virus 2
ggacaguucaggaggu

SEQ ID NO: 2925772 - RNA, 12 nt, Human T-lymphotropic virus 2
cuccgccaccuc

SEQ ID NO: 2925773 - RNA, 23 nt, Human T-lymphotropic virus 2
ccuccaccauguccgcagccaca

SEQ ID NO: 2925774 - RNA, 21 nt, Human T-lymphotropic virus 2
ggucucuaaaggaacacccau

SEQ ID NO: 2925775 - RNA, 16 nt, Human T-lymphotropic virus 2
guccuccacuaccacc

SEQ ID NO: 2925776 - RNA, 12 nt, Human T-lymphotropic virus 2
aaacccuccagg

SEQ ID NO: 2925777 - RNA, 11 nt, Human T-lymphotropic virus 2
gcccuccuggc

SEQ ID NO: 2925778 - RNA, 22 nt, Human T-lymphotropic virus 2
acuccagccccuguagcccaac

SEQ ID NO: 2925779 - RNA, 17 nt, Human T-lymphotropic virus 2
ccccaagguuccaccug

SEQ ID NO: 2925780 - RNA, 18 nt, Human T-lymphotropic virus 2
ugacccauccacaguccu

SEQ ID NO: 2925781 - RNA, 21 nt, Human T-lymphotropic virus 2
gcuuccaguaaaagccuucuc

SEQ ID NO: 2925782 - RNA, 21 nt, Human T-lymphotropic virus 2
caacgccgcccucuuggcagg

SEQ ID NO: 2925783 - RNA, 19 nt, Human T-lymphotropic virus 2
cacuccaucuuaacaaccc

SEQ ID NO: 2925784 - RNA, 20 nt, Human T-lymphotropic virus 2
uccuccgccaaauccaggcc

SEQ ID NO: 2925785 - RNA, 22 nt, Human T-lymphotropic virus 2
ucaggcguggacacccaaggac

SEQ ID NO: 2925786 - RNA, 20 nt, Human T-lymphotropic virus 2
guuuaaaaacagccccaccc

SEQ ID NO: 2925787 - RNA, 20 nt, Human T-lymphotropic virus 2
caggacaucacuccccugcc

SEQ ID NO: 2925788 - RNA, 22 nt, Human T-lymphotropic virus 2
agauguaaauuucacccaggaa

SEQ ID NO: 2925789 - RNA, 15 nt, Human T-lymphotropic virus 2
ggcuagggcuuccug

SEQ ID NO: 2925790 - RNA, 22 nt, Human T-lymphotropic virus 2
cugccaagccauggccuucccu

SEQ ID NO: 2925791 - RNA, 14 nt, Human T-lymphotropic virus 2
cggagacucaccuu

SEQ ID NO: 2925792 - RNA, 20 nt, Human T-lymphotropic virus 2
cgggcuuuccccaacuccaa

SEQ ID NO: 2925793 - RNA, 13 nt, Human T-lymphotropic virus 2
guccucaacccca

SEQ ID NO: 2925794 - RNA, 13 nt, Human T-lymphotropic virus 2
ucuucccucuccc

SEQ ID NO: 2925795 - RNA, 13 nt, Human T-lymphotropic virus 2
acauuuuccacua

SEQ ID NO: 2925796 - RNA, 16 nt, Human T-lymphotropic virus 2
ugucagcucuccucuc

SEQ ID NO: 2925797 - RNA, 19 nt, Human T-lymphotropic virus 2
uucgaaaccaaagccuucc

SEQ ID NO: 2925798 - RNA, 15 nt, Human T-lymphotropic virus 2
ucacuccccugcccu

SEQ ID NO: 2925799 - RNA, 22 nt, Human T-lymphotropic virus 2
gaugucagacucgccucucccu

SEQ ID NO: 2925800 - RNA, 19 nt, Human T-lymphotropic virus 2
uacaacaacucucccagcu

SEQ ID NO: 2925801 - RNA, 23 nt, Human T-lymphotropic virus 2
guugacaaagacaucucccaccu

SEQ ID NO: 2925802 - RNA, 18 nt, Human T-lymphotropic virus 2
aacauacgccguggagcg

SEQ ID NO: 2925803 - RNA, 13 nt, Human T-lymphotropic virus 2
ccccuccccaagc

SEQ ID NO: 2925804 - RNA, 18 nt, Human T-lymphotropic virus 2
auguaaauuucacccagg

SEQ ID NO: 2925805 - RNA, 19 nt, Human T-lymphotropic virus 2
aucccucgccuccccuccu

SEQ ID NO: 2925806 - RNA, 21 nt, Human T-lymphotropic virus 2
ccucagaacccacucagccuc

SEQ ID NO: 2925807 - RNA, 19 nt, Human T-lymphotropic virus 2
uuccuacaaugacccuugc

SEQ ID NO: 2925808 - RNA, 22 nt, Human T-lymphotropic virus 2
gauaugcauggacuguccuucc

SEQ ID NO: 2925809 - RNA, 15 nt, Human T-lymphotropic virus 2
uuauccuccccccuu

SEQ ID NO: 2925810 - RNA, 21 nt, Human T-lymphotropic virus 2
cggcuccuccaugacccuccu

SEQ ID NO: 2925811 - RNA, 18 nt, Human T-lymphotropic virus 2
ucccuuaucuuagcuccc

SEQ ID NO: 2925812 - RNA, 18 nt, Human T-lymphotropic virus 2
gccacgccccccuccugg

SEQ ID NO: 2925813 - RNA, 12 nt, Human T-lymphotropic virus 2
acaccucagccu

SEQ ID NO: 2925814 - RNA, 15 nt, Human T-lymphotropic virus 2
accccacaacaacuc

SEQ ID NO: 2925815 - RNA, 17 nt, Human T-lymphotropic virus 2
cuucuauaccucccaga

SEQ ID NO: 2925816 - RNA, 20 nt, Human T-lymphotropic virus 2
cuuguaucacccucacccca

SEQ ID NO: 2925817 - RNA, 19 nt, Human T-lymphotropic virus 2
cuuacccacuuccccuagc

SEQ ID NO: 2925818 - RNA, 17 nt, Human T-lymphotropic virus 2
cucgccucucccugguc

SEQ ID NO: 2925819 - RNA, 21 nt, Human T-lymphotropic virus 2
gccucccgagccagccaccca

SEQ ID NO: 2925820 - RNA, 21 nt, Human T-lymphotropic virus 2
ggccccuggcuuggcuccaca

SEQ ID NO: 2925821 - RNA, 17 nt, Human T-lymphotropic virus 2
cuugucuccgcccuagc

SEQ ID NO: 2925822 - RNA, 17 nt, Human T-lymphotropic virus 2
aggagccuuccucacca

SEQ ID NO: 2925823 - RNA, 17 nt, Human T-lymphotropic virus 2
ccauuacuaccacccuc

SEQ ID NO: 2925824 - RNA, 15 nt, Human T-lymphotropic virus 2
cccccaacaucucca

SEQ ID NO: 2925825 - RNA, 23 nt, Human T-lymphotropic virus 2
cacaguccuccacuaccacccau

SEQ ID NO: 2925826 - RNA, 21 nt, Human T-lymphotropic virus 2
uaaaccugagcgccuccaggc

SEQ ID NO: 2925827 - RNA, 19 nt, Human T-lymphotropic virus 2
gaacugcuccucccaaggu

SEQ ID NO: 2925828 - RNA, 15 nt, Human T-lymphotropic virus 2
acucgccuuccuaca

SEQ ID NO: 2925829 - RNA, 16 nt, Human T-lymphotropic virus 2
caucagcuuauacaau

SEQ ID NO: 2925830 - RNA, 14 nt, Human T-lymphotropic virus 2
ccacgcaaugcuuc

SEQ ID NO: 2925831 - RNA, 20 nt, Human T-lymphotropic virus 2
augccaagauccuucucacu

SEQ ID NO: 2925832 - RNA, 13 nt, Human T-lymphotropic virus 2
ucccucucccggc

SEQ ID NO: 2925833 - RNA, 15 nt, Human T-lymphotropic virus 2
cagacgaccccagcc

SEQ ID NO: 2925834 - RNA, 22 nt, Human T-lymphotropic virus 2
caauagccacuccaaacaccau

SEQ ID NO: 2925835 - RNA, 15 nt, Human T-lymphotropic virus 2
caccccccacccucc

SEQ ID NO: 2925836 - RNA, 20 nt, Human T-lymphotropic virus 2
ugcgccgcucccgcuccuca

SEQ ID NO: 2925837 - RNA, 23 nt, Human T-lymphotropic virus 2
ccuccccaaguggaccaauuucc

SEQ ID NO: 2925838 - RNA, 17 nt, Human T-lymphotropic virus 2
uuucacccaggaaguca

SEQ ID NO: 2925839 - RNA, 13 nt, Human T-lymphotropic virus 2
aaaccaaagccuu

SEQ ID NO: 2925840 - RNA, 17 nt, Human T-lymphotropic virus 2
ccuccugaacugcuccu

SEQ ID NO: 2925841 - RNA, 22 nt, Human T-lymphotropic virus 2
uaaaccugagcgccuccaggcc

SEQ ID NO: 2925842 - RNA, 15 nt, Human T-lymphotropic virus 2
ccgaucucacuagcc

SEQ ID NO: 2925843 - RNA, 13 nt, Human T-lymphotropic virus 2
acuccugucuccc

SEQ ID NO: 2925844 - RNA, 13 nt, Human T-lymphotropic virus 2
aacagcucuccag

SEQ ID NO: 2925845 - RNA, 23 nt, Human T-lymphotropic virus 2
gccaggcaauacccgugaccccu

SEQ ID NO: 2925846 - RNA, 23 nt, Human T-lymphotropic virus 2
cuaacccccuccacguccuggac

SEQ ID NO: 2925847 - RNA, 13 nt, Human T-lymphotropic virus 2
gcccugcuuucgu

SEQ ID NO: 2925848 - RNA, 13 nt, Human T-lymphotropic virus 2
cacuagcccagca

SEQ ID NO: 2925849 - RNA, 20 nt, Human T-lymphotropic virus 2
acaggccaucaagcaggagg

SEQ ID NO: 2925850 - RNA, 17 nt, Human T-lymphotropic virus 2
caauagccacuccaaac

SEQ ID NO: 2925851 - RNA, 15 nt, Human T-lymphotropic virus 2
cagccacaccaaccu

SEQ ID NO: 2925852 - RNA, 21 nt, Human T-lymphotropic virus 2
cagccguccucaaccccauga

SEQ ID NO: 2925853 - RNA, 14 nt, Human T-lymphotropic virus 2
ccagaugucagacu

SEQ ID NO: 2925854 - RNA, 20 nt, Human T-lymphotropic virus 2
agcccuuugcgacuuccuga

SEQ ID NO: 2925855 - RNA, 16 nt, Human T-lymphotropic virus 2
cccuguagcccaaccc

SEQ ID NO: 2925856 - RNA, 15 nt, Human T-lymphotropic virus 2
cagccuaggcccucc

SEQ ID NO: 2925857 - RNA, 23 nt, Human T-lymphotropic virus 2
acaacucaaacccccucaggagg

SEQ ID NO: 2925858 - RNA, 17 nt, Human T-lymphotropic virus 2
aaucagcuaaaugucau

SEQ ID NO: 2925859 - RNA, 18 nt, Human T-lymphotropic virus 2
gaccaucuaccuccacca

SEQ ID NO: 2925860 - RNA, 15 nt, Human T-lymphotropic virus 2
uccgccaccuccccc

SEQ ID NO: 2925861 - RNA, 23 nt, Human T-lymphotropic virus 2
auuucacccaggaagucagccaa

SEQ ID NO: 2925862 - RNA, 19 nt, Human T-lymphotropic virus 2
ccucacccuuacccacuuc

SEQ ID NO: 2925863 - RNA, 15 nt, Human T-lymphotropic virus 2
ccaccaacuucuccc

SEQ ID NO: 2925864 - RNA, 21 nt, Human T-lymphotropic virus 2
accauccucuuuccuucccuu

SEQ ID NO: 2925865 - RNA, 20 nt, Human T-lymphotropic virus 2
cacauuggauaaaaaagcca

SEQ ID NO: 2925866 - RNA, 18 nt, Human T-lymphotropic virus 2
uccugaggaacuccccuc

SEQ ID NO: 2925867 - RNA, 21 nt, Human T-lymphotropic virus 2
ggccuccacggccucacccau

SEQ ID NO: 2925868 - RNA, 23 nt, Human T-lymphotropic virus 2
cuguccuaaccuuccccuagaca

SEQ ID NO: 2925869 - RNA, 18 nt, Human T-lymphotropic virus 2
cccuagguucgucccccu

SEQ ID NO: 2925870 - RNA, 22 nt, Human T-lymphotropic virus 2
aaaccacuccacauuaacacag

SEQ ID NO: 2925871 - RNA, 13 nt, Human T-lymphotropic virus 2
cagcuaacccucc

SEQ ID NO: 2925872 - RNA, 13 nt, Human T-lymphotropic virus 2
caaaccaccuccc

SEQ ID NO: 2925873 - RNA, 19 nt, Human T-lymphotropic virus 2
agcccaucuuacguucccu

SEQ ID NO: 2925874 - RNA, 21 nt, Human T-lymphotropic virus 2
cacgggccccgucuccagucc

SEQ ID NO: 2925875 - RNA, 16 nt, Human T-lymphotropic virus 2
guaccuaugcuccucc

SEQ ID NO: 2925876 - RNA, 22 nt, Human T-lymphotropic virus 2
ggcuuccugaaccucuccggga

SEQ ID NO: 2925877 - RNA, 19 nt, Human T-lymphotropic virus 2
cgacagccuuaccccaccu

SEQ ID NO: 2925878 - RNA, 18 nt, Human T-lymphotropic virus 2
ccuccaggcggccuugcc

SEQ ID NO: 2925879 - RNA, 13 nt, Human T-lymphotropic virus 2
uggccccugcccc

SEQ ID NO: 2925880 - RNA, 23 nt, Human T-lymphotropic virus 2
aagcgcaaggacaguucaggagg

SEQ ID NO: 2925881 - RNA, 15 nt, Human T-lymphotropic virus 2
caccaaccuccccga

SEQ ID NO: 2925882 - RNA, 16 nt, Human T-lymphotropic virus 2
gaaauggaugccugga

SEQ ID NO: 2925883 - RNA, 17 nt, Human T-lymphotropic virus 2
acaccuucccccaccuc

SEQ ID NO: 2925884 - RNA, 16 nt, Human T-lymphotropic virus 2
cugaggaacuccccuc

SEQ ID NO: 2925885 - RNA, 23 nt, Human T-lymphotropic virus 2
ccugacgucccuccccccuagga

SEQ ID NO: 2925886 - RNA, 19 nt, Human T-lymphotropic virus 2
caacugcugaugccuuucu

SEQ ID NO: 2925887 - RNA, 17 nt, Human T-lymphotropic virus 2
ggcugcuuucuccaccc

SEQ ID NO: 2925888 - RNA, 19 nt, Human T-lymphotropic virus 2
caccucuccuuccccaggg

SEQ ID NO: 2925889 - RNA, 14 nt, Human T-lymphotropic virus 2
auuagaccuccuau

SEQ ID NO: 2925890 - RNA, 17 nt, Human T-lymphotropic virus 2
cucgcucuacuccuccu

SEQ ID NO: 2925891 - RNA, 17 nt, Human T-lymphotropic virus 2
ccaaaucccccucccca

SEQ ID NO: 2925892 - RNA, 22 nt, Human T-lymphotropic virus 2
gccaccuguccagagcaccaac

SEQ ID NO: 2925893 - RNA, 17 nt, Human T-lymphotropic virus 2
cuuaacuuucuccaggc

SEQ ID NO: 2925894 - RNA, 17 nt, Human T-lymphotropic virus 2
auccaggcccuuccaca

SEQ ID NO: 2925895 - RNA, 19 nt, Human T-lymphotropic virus 2
gccucaaccccgcccuacc

SEQ ID NO: 2925896 - RNA, 15 nt, Human T-lymphotropic virus 2
uccaaaccccccuac

SEQ ID NO: 2925897 - RNA, 17 nt, Human T-lymphotropic virus 2
cccguuauccuuuccuc

SEQ ID NO: 2925898 - RNA, 16 nt, Human T-lymphotropic virus 2
cucucuuacaccuccc

SEQ ID NO: 2925899 - RNA, 18 nt, Human T-lymphotropic virus 2
gaggaacuccccucaucc

SEQ ID NO: 2925900 - RNA, 15 nt, Human T-lymphotropic virus 2
ugcaugcccaagacc

SEQ ID NO: 2925901 - RNA, 18 nt, Human T-lymphotropic virus 2
cgauuccauaaccuuggc

SEQ ID NO: 2925902 - RNA, 15 nt, Human T-lymphotropic virus 2
accaucuaccuccac

SEQ ID NO: 2925903 - RNA, 17 nt, Human T-lymphotropic virus 2
auccaccacaguccucc

SEQ ID NO: 2925904 - RNA, 16 nt, Human T-lymphotropic virus 2
ucccacucaucccccu

SEQ ID NO: 2925905 - RNA, 16 nt, Human T-lymphotropic virus 2
cuccacuaccacccau

SEQ ID NO: 2925906 - RNA, 14 nt, Human T-lymphotropic virus 2
ccccgucuccaguc

SEQ ID NO: 2925907 - RNA, 19 nt, Human T-lymphotropic virus 2
acuuccugaggaacucccc

SEQ ID NO: 2925908 - RNA, 13 nt, Human T-lymphotropic virus 2
cccccucagcuca

SEQ ID NO: 2925909 - RNA, 16 nt, Human T-lymphotropic virus 2
uauucagucucacaca

SEQ ID NO: 2925910 - RNA, 23 nt, Human T-lymphotropic virus 2
uccgcccaucaaacccuccaggc

SEQ ID NO: 2925911 - RNA, 21 nt, Human T-lymphotropic virus 2
cacccucaccucuccuucccc

SEQ ID NO: 2925912 - RNA, 17 nt, Human T-lymphotropic virus 2
aacaucuccauucccca

SEQ ID NO: 2925913 - RNA, 22 nt, Human T-lymphotropic virus 2
uccuccaguaccuaugcuccuc

SEQ ID NO: 2925914 - RNA, 19 nt, Human T-lymphotropic virus 2
aauccugucuccucucagc

SEQ ID NO: 2925915 - RNA, 19 nt, Human T-lymphotropic virus 2
uccaccauguccgcagcca

SEQ ID NO: 2925916 - RNA, 20 nt, Human T-lymphotropic virus 2
gauccagccucucauccugg

SEQ ID NO: 2925917 - RNA, 20 nt, Human T-lymphotropic virus 2
auuccccaacaaaccuccuc

SEQ ID NO: 2925918 - RNA, 18 nt, Human T-lymphotropic virus 2
gguuuaaaaacagcccca

SEQ ID NO: 2925919 - RNA, 22 nt, Human T-lymphotropic virus 2
cgcagccacaccaaccuccccg

SEQ ID NO: 2925920 - RNA, 13 nt, Human T-lymphotropic virus 2
aucagcuccccuc

SEQ ID NO: 2925921 - RNA, 18 nt, Human T-lymphotropic virus 2
cguggauagauccagccu

SEQ ID NO: 2925922 - RNA, 17 nt, Human T-lymphotropic virus 2
ucuccaguccauccugg

SEQ ID NO: 2925923 - RNA, 20 nt, Human T-lymphotropic virus 2
ucaugaccuaagagccacca

SEQ ID NO: 2925924 - RNA, 20 nt, Human T-lymphotropic virus 2
cguugucagcucuccucucc

SEQ ID NO: 2925925 - RNA, 18 nt, Human T-lymphotropic virus 2
cuggcuuggcuccacacc

SEQ ID NO: 2925926 - RNA, 22 nt, Human T-lymphotropic virus 2
cucgaacaccuucccccaccuc

SEQ ID NO: 2925927 - RNA, 14 nt, Human T-lymphotropic virus 2
gaccccagccccca

SEQ ID NO: 2925928 - RNA, 15 nt, Human T-lymphotropic virus 2
ccaagguuccaccug

SEQ ID NO: 2925929 - RNA, 21 nt, Human T-lymphotropic virus 2
gcccaucuuacguucccuagc

SEQ ID NO: 2925930 - RNA, 15 nt, Human T-lymphotropic virus 2
cccucguaguuuccu

SEQ ID NO: 2925931 - RNA, 16 nt, Human T-lymphotropic virus 2
caaccccaugaggaaa

SEQ ID NO: 2925932 - RNA, 22 nt, Human T-lymphotropic virus 2
ggaacugaaaccacggcccuga

SEQ ID NO: 2925933 - RNA, 17 nt, Human T-lymphotropic virus 2
cccucuuggcaggcguc

SEQ ID NO: 2925934 - RNA, 16 nt, Human T-lymphotropic virus 2
cuauguuccacccgcc

SEQ ID NO: 2925935 - RNA, 15 nt, Human T-lymphotropic virus 2
cucccguaccuccuc

SEQ ID NO: 2925936 - RNA, 18 nt, Human T-lymphotropic virus 2
gguagucgcuccccgagg

SEQ ID NO: 2925937 - RNA, 17 nt, Human T-lymphotropic virus 2
ccaacccgucugcacgu

SEQ ID NO: 2925938 - RNA, 18 nt, Human T-lymphotropic virus 2
caguuugaccccaccgcc

SEQ ID NO: 2925939 - RNA, 12 nt, Human T-lymphotropic virus 2
cuccucucaggu

SEQ ID NO: 2925940 - RNA, 20 nt, Human T-lymphotropic virus 2
uucacccaggaagucagcca

SEQ ID NO: 2925941 - RNA, 13 nt, Human T-lymphotropic virus 2
accaacacccagu

SEQ ID NO: 2925942 - RNA, 11 nt, Human T-lymphotropic virus 2
gccccacccuc

SEQ ID NO: 2925943 - RNA, 16 nt, Human T-lymphotropic virus 2
uucccccaccucccca

SEQ ID NO: 2925944 - RNA, 23 nt, Human T-lymphotropic virus 2
caguuccgacaccuaucugcccu

SEQ ID NO: 2925945 - RNA, 15 nt, Human T-lymphotropic virus 2
ccucagaacccacuc

SEQ ID NO: 2925946 - RNA, 19 nt, Human T-lymphotropic virus 2
cgcguugucagcucuccuc

SEQ ID NO: 2925947 - RNA, 12 nt, Human T-lymphotropic virus 2
uuagacacccac

SEQ ID NO: 2925948 - RNA, 21 nt, Human T-lymphotropic virus 2
cugcccuacuacuacuccucc

SEQ ID NO: 2925949 - RNA, 21 nt, Human T-lymphotropic virus 2
acaucacuccccugcccucuc

SEQ ID NO: 2925950 - RNA, 15 nt, Human T-lymphotropic virus 2
caacaucccugucuc

SEQ ID NO: 2925951 - RNA, 16 nt, Human T-lymphotropic virus 2
cuaccacccucaccuc

SEQ ID NO: 2925952 - RNA, 11 nt, Human T-lymphotropic virus 2
acuaccacccu

SEQ ID NO: 2925953 - RNA, 22 nt, Human T-lymphotropic virus 2
aguuauccuaggagagauccag

SEQ ID NO: 2925954 - RNA, 19 nt, Human T-lymphotropic virus 2
acuccaaacaccauaggcc

SEQ ID NO: 2925955 - RNA, 13 nt, Human T-lymphotropic virus 2
cccuccagacagg

SEQ ID NO: 2925956 - RNA, 17 nt, Human T-lymphotropic virus 2
cggggaucagcuccccu

SEQ ID NO: 2925957 - RNA, 13 nt, Human T-lymphotropic virus 2
acuacugaggaaa

SEQ ID NO: 2925958 - RNA, 20 nt, Human T-lymphotropic virus 2
ucagccaagugucccuucga

SEQ ID NO: 2925959 - RNA, 20 nt, Human T-lymphotropic virus 2
ucccuuaucuuagcuccccu

SEQ ID NO: 2925960 - RNA, 18 nt, Human T-lymphotropic virus 2
cccccuccacguccugga

SEQ ID NO: 2925961 - RNA, 21 nt, Human T-lymphotropic virus 2
ccccaggagcccccucagcuc

SEQ ID NO: 2925962 - RNA, 15 nt, Human T-lymphotropic virus 2
cgccccccuccuggc

SEQ ID NO: 2925963 - RNA, 13 nt, Human T-lymphotropic virus 2
cauaaaaucccaa

SEQ ID NO: 2925964 - RNA, 14 nt, Human T-lymphotropic virus 2
cuccuccgccaccu

SEQ ID NO: 2925965 - RNA, 18 nt, Human T-lymphotropic virus 2
uccuuccauaaccuucac

SEQ ID NO: 2925966 - RNA, 20 nt, Human T-lymphotropic virus 2
cacccaggaagucagccaag

SEQ ID NO: 2925967 - RNA, 20 nt, Human T-lymphotropic virus 2
gagucgggacuguacccagc

SEQ ID NO: 2925968 - RNA, 23 nt, Human T-lymphotropic virus 2
uaccgacagccuuaccccaccua

SEQ ID NO: 2925969 - RNA, 15 nt, Human T-lymphotropic virus 2
ccuuacccacuuccc

SEQ ID NO: 2925970 - RNA, 21 nt, Human T-lymphotropic virus 2
cccgggccgguaaagcuccac

SEQ ID NO: 2925971 - RNA, 17 nt, Human T-lymphotropic virus 2
cuccaugacccuccuag

SEQ ID NO: 2925972 - RNA, 19 nt, Human T-lymphotropic virus 2
gacuacacccccccugccc

SEQ ID NO: 2925973 - RNA, 20 nt, Human T-lymphotropic virus 2
uccuucccuugcccugcccg

SEQ ID NO: 2925974 - RNA, 20 nt, Human T-lymphotropic virus 2
acccccuccacguccuggac

SEQ ID NO: 2925975 - RNA, 17 nt, Human T-lymphotropic virus 2
uaagucuccucucaggu

SEQ ID NO: 2925976 - RNA, 14 nt, Human T-lymphotropic virus 2
caaacccuccaggc

SEQ ID NO: 2925977 - RNA, 18 nt, Human T-lymphotropic virus 2
cuggaaccaacccucggg

SEQ ID NO: 2925978 - RNA, 19 nt, Human T-lymphotropic virus 2
cccaacaaaccuccucccg

SEQ ID NO: 2925979 - RNA, 16 nt, Human T-lymphotropic virus 2
cuagccuuauccccaa

SEQ ID NO: 2925980 - RNA, 20 nt, Human T-lymphotropic virus 2
ccccaugucauauucugcca

SEQ ID NO: 2925981 - RNA, 16 nt, Human T-lymphotropic virus 2
uuguaucacccucacc

SEQ ID NO: 2925982 - RNA, 15 nt, Human T-lymphotropic virus 2
accucacccuuaccc

SEQ ID NO: 2925983 - RNA, 19 nt, Human T-lymphotropic virus 2
ucauguauccguccuccag

SEQ ID NO: 2925984 - RNA, 20 nt, Human T-lymphotropic virus 2
ucuccauuccccaacaaacc

SEQ ID NO: 2925985 - RNA, 21 nt, Human T-lymphotropic virus 2
caugucaggcguggacaccca

SEQ ID NO: 2925986 - RNA, 14 nt, Human T-lymphotropic virus 2
cucccauaggaccu

SEQ ID NO: 2925987 - RNA, 14 nt, Human T-lymphotropic virus 2
uucacccucucccc

SEQ ID NO: 2925988 - RNA, 14 nt, Human T-lymphotropic virus 2
uacaaugccccuac

SEQ ID NO: 2925989 - RNA, 14 nt, Human T-lymphotropic virus 2
cacccaugacaugg

SEQ ID NO: 2925990 - RNA, 23 nt, Human T-lymphotropic virus 2
caagguaagucuccucucagguc

SEQ ID NO: 2925991 - RNA, 15 nt, Human T-lymphotropic virus 2
cccuccccccuagga

SEQ ID NO: 2925992 - RNA, 22 nt, Human T-lymphotropic virus 2
caccaacucaccugggacccca

SEQ ID NO: 2925993 - RNA, 14 nt, Human T-lymphotropic virus 2
caacuucuccccca

SEQ ID NO: 2925994 - RNA, 21 nt, Human T-lymphotropic virus 2
acuacacccccccugcccuaa

SEQ ID NO: 2925995 - RNA, 15 nt, Human T-lymphotropic virus 2
ucaccuacuggccug

SEQ ID NO: 2925996 - RNA, 18 nt, Human T-lymphotropic virus 2
ucaggcguggacacccaa

SEQ ID NO: 2925997 - RNA, 18 nt, Human T-lymphotropic virus 2
cagucauaguccucccgg

SEQ ID NO: 2925998 - RNA, 15 nt, Human T-lymphotropic virus 2
gcuacgacgcuuucu

SEQ ID NO: 2925999 - RNA, 16 nt, Human T-lymphotropic virus 2
cccuaucuuacauccc

SEQ ID NO: 2926000 - RNA, 16 nt, Human T-lymphotropic virus 2
ccuguauccuccgcca

SEQ ID NO: 2926001 - RNA, 18 nt, Human T-lymphotropic virus 2
uccaguaccuaugcuccu

SEQ ID NO: 2926002 - RNA, 22 nt, Human T-lymphotropic virus 2
cagcuuauacaauacuccuccu

SEQ ID NO: 2926003 - RNA, 22 nt, Human T-lymphotropic virus 2
gaugccuuucuucccucucccg

SEQ ID NO: 2926004 - RNA, 14 nt, Human T-lymphotropic virus 2
cucccuuccaccuc

SEQ ID NO: 2926005 - RNA, 20 nt, Human T-lymphotropic virus 2
uauccagcugaccuuacaga

SEQ ID NO: 2926006 - RNA, 11 nt, Human T-lymphotropic virus 2
agacacccggg

SEQ ID NO: 2926007 - RNA, 19 nt, Human T-lymphotropic virus 2
accuccugaacugcuccuc

SEQ ID NO: 2926008 - RNA, 20 nt, Human T-lymphotropic virus 2
agggcaagaccaucuaccuc

SEQ ID NO: 2926009 - RNA, 12 nt, Human T-lymphotropic virus 2
ucuuuccaccac

SEQ ID NO: 2926010 - RNA, 14 nt, Human T-lymphotropic virus 2
ccgauguccagccc

SEQ ID NO: 2926011 - RNA, 18 nt, Human T-lymphotropic virus 2
cccagccacgccccccuc

SEQ ID NO: 2926012 - RNA, 12 nt, Human T-lymphotropic virus 2
cuauaauagacc

SEQ ID NO: 2926013 - RNA, 14 nt, Human T-lymphotropic virus 2
ccucaacgccgccc

SEQ ID NO: 2926014 - RNA, 17 nt, Human T-lymphotropic virus 2
uauggccagcucugcca

SEQ ID NO: 2926015 - RNA, 14 nt, Human T-lymphotropic virus 2
ucacuccccugccc

SEQ ID NO: 2926016 - RNA, 14 nt, Human T-lymphotropic virus 2
ccucccgaaccauc

SEQ ID NO: 2926017 - RNA, 14 nt, Human T-lymphotropic virus 2
acccuucuccagga

SEQ ID NO: 2926018 - RNA, 19 nt, Human T-lymphotropic virus 2
ucuuagacacccacaacaa

SEQ ID NO: 2926019 - RNA, 22 nt, Human T-lymphotropic virus 2
ucacccaggaagucagccaagu

SEQ ID NO: 2926020 - RNA, 19 nt, Human T-lymphotropic virus 2
cugcccgcuccuccauccc

SEQ ID NO: 2926021 - RNA, 18 nt, Human T-lymphotropic virus 2
aagagccaccaaugccau

SEQ ID NO: 2926022 - RNA, 15 nt, Human T-lymphotropic virus 2
cgauuacccccugcc

SEQ ID NO: 2926023 - RNA, 20 nt, Human T-lymphotropic virus 2
cuuuuuccaaaucccccucc

SEQ ID NO: 2926024 - RNA, 17 nt, Human T-lymphotropic virus 2
ccugcccgcuccuccau

SEQ ID NO: 2926025 - RNA, 23 nt, Human T-lymphotropic virus 2
ucccccuaccauugacccaucca

SEQ ID NO: 2926026 - RNA, 20 nt, Human T-lymphotropic virus 2
agcggccucgguugagacgc

SEQ ID NO: 2926027 - RNA, 17 nt, Human T-lymphotropic virus 2
ccacaccccccacccuc

SEQ ID NO: 2926028 - RNA, 16 nt, Human T-lymphotropic virus 2
cggcacuuccgcccau

SEQ ID NO: 2926029 - RNA, 23 nt, Human T-lymphotropic virus 2
cagccacaccaaccuccccgacc

SEQ ID NO: 2926030 - RNA, 15 nt, Human T-lymphotropic virus 2
acccuucuccaggaa

SEQ ID NO: 2926031 - RNA, 20 nt, Human T-lymphotropic virus 2
ggcaggcgucccggggccaa

SEQ ID NO: 2926032 - RNA, 15 nt, Human T-lymphotropic virus 2
acuacucgccuuccu

SEQ ID NO: 2926033 - RNA, 18 nt, Human T-lymphotropic virus 2
aagcccgcggacacacua

SEQ ID NO: 2926034 - RNA, 21 nt, Human T-lymphotropic virus 2
cuacaucgacaugcccuccug

SEQ ID NO: 2926035 - RNA, 22 nt, Human T-lymphotropic virus 2
acacauuuuccacuagcccagc

SEQ ID NO: 2926036 - RNA, 14 nt, Human T-lymphotropic virus 2
ccuugccaccccua

SEQ ID NO: 2926037 - RNA, 21 nt, Human T-lymphotropic virus 2
cacggcccugacgucccuccc

SEQ ID NO: 2926038 - RNA, 15 nt, Human T-lymphotropic virus 2
acccccugcccauaa

SEQ ID NO: 2926039 - RNA, 19 nt, Human T-lymphotropic virus 2
acggcccugacgucccucc

SEQ ID NO: 2926040 - RNA, 20 nt, Human T-lymphotropic virus 2
cacaacaaauggaccaucau

SEQ ID NO: 2926041 - RNA, 23 nt, Human T-lymphotropic virus 2
caguaugcagcccaaaauagacg

SEQ ID NO: 2926042 - RNA, 23 nt, Human T-lymphotropic virus 2
ccuugcccugcccgcuccuccau

SEQ ID NO: 2926043 - RNA, 21 nt, Human T-lymphotropic virus 2
ucuccguuaugggacaaacac

SEQ ID NO: 2926044 - RNA, 20 nt, Human T-lymphotropic virus 2
ucgaaaccaaagccuuccau

SEQ ID NO: 2926045 - RNA, 16 nt, Human T-lymphotropic virus 2
caccaacaucccuguc

SEQ ID NO: 2926046 - RNA, 19 nt, Human T-lymphotropic virus 2
auccacgggcuuuccccaa

SEQ ID NO: 2926047 - RNA, 18 nt, Human T-lymphotropic virus 2
caagggcuagggcuuccu

SEQ ID NO: 2926048 - RNA, 22 nt, Human T-lymphotropic virus 2
cagcaagggcuagggcuuccug

SEQ ID NO: 2926049 - RNA, 17 nt, Human T-lymphotropic virus 2
uccacuaccacccauuc

SEQ ID NO: 2926050 - RNA, 20 nt, Human T-lymphotropic virus 2
cucacgauugguaucuccuc

SEQ ID NO: 2926051 - RNA, 14 nt, Human T-lymphotropic virus 2
cuuacaccucccaa

SEQ ID NO: 2926052 - RNA, 14 nt, Human T-lymphotropic virus 2
cuuaccccucccac

SEQ ID NO: 2926053 - RNA, 21 nt, Human T-lymphotropic virus 2
ucaggccauuucccuccuagg

SEQ ID NO: 2926054 - RNA, 15 nt, Human T-lymphotropic virus 2
aucuccauuccccaa

SEQ ID NO: 2926055 - RNA, 14 nt, Human T-lymphotropic virus 2
ucuacaccaccugg

SEQ ID NO: 2926056 - RNA, 16 nt, Human T-lymphotropic virus 2
auuccccaacaaaccu

SEQ ID NO: 2926057 - RNA, 24 nt, Human T-lymphotropic virus 2
gccaucuuuaguaguucaguccuc

SEQ ID NO: 2926058 - RNA, 11 nt, Human T-lymphotropic virus 2
gcccugcuuuc

SEQ ID NO: 2926059 - RNA, 22 nt, Human T-lymphotropic virus 2
ccaacccgugagggcucccugu

SEQ ID NO: 2926060 - RNA, 22 nt, Human T-lymphotropic virus 2
ccauuccccaacaaaccuccuc

SEQ ID NO: 2926061 - RNA, 19 nt, Human T-lymphotropic virus 2
ccuuccgugggaccgucuc

SEQ ID NO: 2926062 - RNA, 15 nt, Human T-lymphotropic virus 2
cuguacccagccacg

SEQ ID NO: 2926063 - RNA, 14 nt, Human T-lymphotropic virus 2
cuuaaacuucacuu

SEQ ID NO: 2926064 - RNA, 16 nt, Human T-lymphotropic virus 2
accucaacgccgcccu

SEQ ID NO: 2926065 - RNA, 14 nt, Human T-lymphotropic virus 2
ccaccucaggcacu

SEQ ID NO: 2926066 - RNA, 16 nt, Human T-lymphotropic virus 2
ucuccaagcggccucg

SEQ ID NO: 2926067 - RNA, 17 nt, Human T-lymphotropic virus 2
cgccauuggggccuucc

SEQ ID NO: 2926068 - RNA, 17 nt, Human T-lymphotropic virus 2
acagacuugccauaccu

SEQ ID NO: 2926069 - RNA, 22 nt, Human T-lymphotropic virus 2
ccuucgcaaacaccuacaaucc

SEQ ID NO: 2926070 - RNA, 22 nt, Human T-lymphotropic virus 2
cuguccuucucgguuccucucc

SEQ ID NO: 2926071 - RNA, 18 nt, Human T-lymphotropic virus 2
cucccagacgaccccagc

SEQ ID NO: 2926072 - RNA, 19 nt, Human T-lymphotropic virus 2
uccuaccacuccagccccu

SEQ ID NO: 2926073 - RNA, 18 nt, Human T-lymphotropic virus 2
ccauccacaguccucuau

SEQ ID NO: 2926074 - RNA, 23 nt, Human T-lymphotropic virus 2
cuccgccaaauccaggcccuucc

SEQ ID NO: 2926075 - RNA, 15 nt, Human T-lymphotropic virus 2
ccuucccccaccucc

SEQ ID NO: 2926076 - RNA, 13 nt, Human T-lymphotropic virus 2
gccagccccacca

SEQ ID NO: 2926077 - RNA, 19 nt, Human T-lymphotropic virus 2
uccuccgccaaauccaggc

SEQ ID NO: 2926078 - RNA, 17 nt, Human T-lymphotropic virus 2
ccucggggaucagcucc

SEQ ID NO: 2926079 - RNA, 16 nt, Human T-lymphotropic virus 2
caauagcaguguggcu

SEQ ID NO: 2926080 - RNA, 23 nt, Human T-lymphotropic virus 2
accccuccuguuggaucucccuu

SEQ ID NO: 2926081 - RNA, 15 nt, Human T-lymphotropic virus 2
cugccaauagccacu

SEQ ID NO: 2926082 - RNA, 14 nt, Human T-lymphotropic virus 2
uacuacuccuccgc

SEQ ID NO: 2926083 - RNA, 15 nt, Human T-lymphotropic virus 2
aucagcuccccuccc

SEQ ID NO: 2926084 - RNA, 23 nt, Human T-lymphotropic virus 2
uguccuaacccccuccacguccu

SEQ ID NO: 2926085 - RNA, 18 nt, Human T-lymphotropic virus 2
ccucccgagccagccacc

SEQ ID NO: 2926086 - RNA, 20 nt, Human T-lymphotropic virus 2
cccuggcuuggcuccacacc

SEQ ID NO: 2926087 - RNA, 17 nt, Human T-lymphotropic virus 2
cuccccccuuuuucccu

SEQ ID NO: 2926088 - RNA, 17 nt, Human T-lymphotropic virus 2
cuucgacuacacuucuc

SEQ ID NO: 2926089 - RNA, 20 nt, Human T-lymphotropic virus 2
ucuauucgaugaauacacca

SEQ ID NO: 2926090 - RNA, 19 nt, Human T-lymphotropic virus 2
cccgcugcuccuccgccaa

SEQ ID NO: 2926091 - RNA, 12 nt, Human T-lymphotropic virus 2
auaguuccucua

SEQ ID NO: 2926092 - RNA, 19 nt, Human T-lymphotropic virus 2
cugacgccccaaggccucc

SEQ ID NO: 2926093 - RNA, 11 nt, Human T-lymphotropic virus 2
gcucuccagaa

SEQ ID NO: 2926094 - RNA, 15 nt, Human T-lymphotropic virus 2
aggcaggcccgcccu

SEQ ID NO: 2926095 - RNA, 20 nt, Human T-lymphotropic virus 2
gccuuaccccaccuacagac

SEQ ID NO: 2926096 - RNA, 13 nt, Human T-lymphotropic virus 2
gcagcaagggcua

SEQ ID NO: 2926097 - RNA, 18 nt, Human T-lymphotropic virus 2
cuucgccgucacugaaaa

SEQ ID NO: 2926098 - RNA, 22 nt, Human T-lymphotropic virus 2
caagacgccgccgugccguucc

SEQ ID NO: 2926099 - RNA, 17 nt, Human T-lymphotropic virus 2
gccaagccauggccuuc

SEQ ID NO: 2926100 - RNA, 15 nt, Human T-lymphotropic virus 2
caaagacaucuccca

SEQ ID NO: 2926101 - RNA, 14 nt, Human T-lymphotropic virus 2
ucacaaaacccauc

SEQ ID NO: 2926102 - RNA, 12 nt, Human T-lymphotropic virus 2
acgucccucccc

SEQ ID NO: 2926103 - RNA, 21 nt, Human T-lymphotropic virus 2
gacgcccuacaacaaugccag

SEQ ID NO: 2926104 - RNA, 17 nt, Human T-lymphotropic virus 2
caggagguggcucgcuc

SEQ ID NO: 2926105 - RNA, 17 nt, Human T-lymphotropic virus 2
uccucccgaaccauccu

SEQ ID NO: 2926106 - RNA, 18 nt, Human T-lymphotropic virus 2
gccgcccucuuggcaggc

SEQ ID NO: 2926107 - RNA, 17 nt, Human T-lymphotropic virus 2
ccagacgaccccagccc

SEQ ID NO: 2926108 - RNA, 14 nt, Human T-lymphotropic virus 2
ugacacggcccccu

SEQ ID NO: 2926109 - RNA, 12 nt, Human T-lymphotropic virus 2
aguccauccugg

SEQ ID NO: 2926110 - RNA, 21 nt, Human T-lymphotropic virus 2
gcggacacacuaacagccccc

SEQ ID NO: 2926111 - RNA, 13 nt, Human T-lymphotropic virus 2
cuccauuccccaa

SEQ ID NO: 2926112 - RNA, 15 nt, Human T-lymphotropic virus 2
cugaggaacuccccu

SEQ ID NO: 2926113 - RNA, 17 nt, Human T-lymphotropic virus 2
cucccauaggaccuucu

SEQ ID NO: 2926114 - RNA, 15 nt, Human T-lymphotropic virus 2
uuugaauuccuccau

SEQ ID NO: 2926115 - RNA, 18 nt, Human T-lymphotropic virus 2
cuacaacauaacugccgu

SEQ ID NO: 2926116 - RNA, 16 nt, Human T-lymphotropic virus 2
caggcccgcccuagga

SEQ ID NO: 2926117 - RNA, 22 nt, Human T-lymphotropic virus 2
guggacuacgugcugccaagcc

SEQ ID NO: 2926118 - RNA, 17 nt, Human T-lymphotropic virus 2
gaacccacucagccucc

SEQ ID NO: 2926119 - RNA, 21 nt, Human T-lymphotropic virus 2
gauuuccggcccuuaccccaa

SEQ ID NO: 2926120 - RNA, 19 nt, Human T-lymphotropic virus 2
cgaacaccuucccccaccu

SEQ ID NO: 2926121 - RNA, 20 nt, Human T-lymphotropic virus 2
ccuccccgaggguaccccca

SEQ ID NO: 2926122 - RNA, 17 nt, Human T-lymphotropic virus 2
ccuuccaauuucccagg

SEQ ID NO: 2926123 - RNA, 19 nt, Human T-lymphotropic virus 2
ccuuaccccucccaccacu

SEQ ID NO: 2926124 - RNA, 14 nt, Human T-lymphotropic virus 2
accagcucaggccu

SEQ ID NO: 2926125 - RNA, 18 nt, Human T-lymphotropic virus 2
ggccaucaagcaggaggu

SEQ ID NO: 2926126 - RNA, 22 nt, Human T-lymphotropic virus 2
caauccugucuccucucagccc

SEQ ID NO: 2926127 - RNA, 12 nt, Human T-lymphotropic virus 2
cuuccaucccuc

SEQ ID NO: 2926128 - RNA, 15 nt, Human T-lymphotropic virus 2
uguuccccccccuua

SEQ ID NO: 2926129 - RNA, 12 nt, Human T-lymphotropic virus 2
cugcuccuccca

SEQ ID NO: 2926130 - RNA, 23 nt, Human T-lymphotropic virus 2
ccaggcacugaccacgcauggcc

SEQ ID NO: 2926131 - RNA, 19 nt, Human T-lymphotropic virus 2
gccaauuuucacccucucc

SEQ ID NO: 2926132 - RNA, 15 nt, Human T-lymphotropic virus 2
auggcagggccccua

SEQ ID NO: 2926133 - RNA, 14 nt, Human T-lymphotropic virus 2
ccgaucccgacccc

SEQ ID NO: 2926134 - RNA, 16 nt, Human T-lymphotropic virus 2
uaccacuccagccccu

SEQ ID NO: 2926135 - RNA, 17 nt, Human T-lymphotropic virus 2
cuccacccugccaggca

SEQ ID NO: 2926136 - RNA, 14 nt, Human T-lymphotropic virus 2
guggacacccaagg

SEQ ID NO: 2926137 - RNA, 18 nt, Human T-lymphotropic virus 2
caccaaugauuuccggcc

SEQ ID NO: 2926138 - RNA, 16 nt, Human T-lymphotropic virus 2
uacucaggaccaggca

SEQ ID NO: 2926139 - RNA, 15 nt, Human T-lymphotropic virus 2
uacccaaagccccca

SEQ ID NO: 2926140 - RNA, 23 nt, Human T-lymphotropic virus 2
gucucccccaagguuccaccugc

SEQ ID NO: 2926141 - RNA, 24 nt, Human T-lymphotropic virus 2
cgacuuccugaggaacuccccuca

SEQ ID NO: 2926142 - RNA, 22 nt, Human T-lymphotropic virus 2
ugcccacaacucaaacccccuc

SEQ ID NO: 2926143 - RNA, 17 nt, Human T-lymphotropic virus 2
ccucggcacuuccgccc

SEQ ID NO: 2926144 - RNA, 20 nt, Human T-lymphotropic virus 2
ccuuaccccucccaccacuc

SEQ ID NO: 2926145 - RNA, 19 nt, Human T-lymphotropic virus 2
ccuacacacagggacaguc

SEQ ID NO: 2926146 - RNA, 13 nt, Human T-lymphotropic virus 2
uaacccuccaggc

SEQ ID NO: 2926147 - RNA, 21 nt, Human T-lymphotropic virus 2
uccaggaaccacgacuccuca

SEQ ID NO: 2926148 - RNA, 13 nt, Human T-lymphotropic virus 2
cacccugccaggc

SEQ ID NO: 2926149 - RNA, 22 nt, Human T-lymphotropic virus 2
acucagccuccaccaacuucuc

SEQ ID NO: 2926150 - RNA, 18 nt, Human T-lymphotropic virus 2
ccucaccgacccucuggu

SEQ ID NO: 2926151 - RNA, 18 nt, Human T-lymphotropic virus 2
cauguccuaacccccucc

SEQ ID NO: 2926152 - RNA, 16 nt, Human T-lymphotropic virus 2
caagguuccaccugcc

SEQ ID NO: 2926153 - RNA, 14 nt, Human T-lymphotropic virus 2
ggcaggcccgcccu

SEQ ID NO: 2926154 - RNA, 18 nt, Human T-lymphotropic virus 2
cuccccuccuuccccacc

SEQ ID NO: 2926155 - RNA, 16 nt, Human T-lymphotropic virus 2
aauccugucuccucuc

SEQ ID NO: 2926156 - RNA, 19 nt, Human T-lymphotropic virus 2
gacaauggcgacuagccuc

SEQ ID NO: 2926157 - RNA, 15 nt, Human T-lymphotropic virus 2
caaggacaguucagg

SEQ ID NO: 2926158 - RNA, 15 nt, Human T-lymphotropic virus 2
ccaccuuacccaggc

SEQ ID NO: 2926159 - RNA, 22 nt, Human T-lymphotropic virus 2
aacaaauggaccaucauuggaa

SEQ ID NO: 2926160 - RNA, 12 nt, Human T-lymphotropic virus 2
uuggcagccccc

SEQ ID NO: 2926161 - RNA, 12 nt, Human T-lymphotropic virus 2
auugucuucccg

SEQ ID NO: 2926162 - RNA, 17 nt, Human T-lymphotropic virus 2
acuccccggccuuacca

SEQ ID NO: 2926163 - RNA, 22 nt, Human T-lymphotropic virus 2
cacccaguucaaacuccuccaa

SEQ ID NO: 2926164 - RNA, 19 nt, Human T-lymphotropic virus 2
ccgucucccggccucggca

SEQ ID NO: 2926165 - RNA, 21 nt, Human T-lymphotropic virus 2
ucucuaagugcggcuccucca

SEQ ID NO: 2926166 - RNA, 16 nt, Human T-lymphotropic virus 2
cccgcuccucacgcuc

SEQ ID NO: 2926167 - RNA, 19 nt, Human T-lymphotropic virus 2
ccuucaccauuccccagcc

SEQ ID NO: 2926168 - RNA, 20 nt, Human T-lymphotropic virus 2
gcaaacaccuacaaucccua

SEQ ID NO: 2926169 - RNA, 20 nt, Human T-lymphotropic virus 2
ccuucuuucaaucaaugcga

SEQ ID NO: 2926170 - RNA, 17 nt, Human T-lymphotropic virus 2
cagccuugcucuccaua

SEQ ID NO: 2926171 - RNA, 16 nt, Human T-lymphotropic virus 2
ucuccuuccccagggc

SEQ ID NO: 2926172 - RNA, 16 nt, Human T-lymphotropic virus 2
cagaaaaaaauagacc

SEQ ID NO: 2926173 - RNA, 21 nt, Human T-lymphotropic virus 2
cagcuccucugcucuuggcag

SEQ ID NO: 2926174 - RNA, 14 nt, Human T-lymphotropic virus 2
cgaacaccuucccc

SEQ ID NO: 2926175 - RNA, 22 nt, Human T-lymphotropic virus 2
cucccucaccgacccucugguc

SEQ ID NO: 2926176 - RNA, 19 nt, Human T-lymphotropic virus 2
aauagccacuccaaacacc

SEQ ID NO: 2926177 - RNA, 19 nt, Human T-lymphotropic virus 2
cuaggaacaggaacagcuc

SEQ ID NO: 2926178 - RNA, 15 nt, Human T-lymphotropic virus 2
cucacacaaacaauc

SEQ ID NO: 2926179 - RNA, 17 nt, Human T-lymphotropic virus 2
ugcuucccuaucuuaca

SEQ ID NO: 2926180 - RNA, 20 nt, Human T-lymphotropic virus 2
cuuccugaaccucuccggga

SEQ ID NO: 2926181 - RNA, 15 nt, Human T-lymphotropic virus 2
aucuuuccaccacaa

SEQ ID NO: 2926182 - RNA, 17 nt, Human T-lymphotropic virus 2
ccaagcaguaccagcca

SEQ ID NO: 2926183 - RNA, 13 nt, Human T-lymphotropic virus 2
cauccucuccaag

SEQ ID NO: 2926184 - RNA, 16 nt, Human T-lymphotropic virus 2
cuuccugaaccucucc

SEQ ID NO: 2926185 - RNA, 11 nt, Human T-lymphotropic virus 2
ugaccccaccg

SEQ ID NO: 2926186 - RNA, 14 nt, Human T-lymphotropic virus 2
gccuggaaccaacc

SEQ ID NO: 2926187 - RNA, 15 nt, Human T-lymphotropic virus 2
cauaguccucccgga

SEQ ID NO: 2926188 - RNA, 18 nt, Human T-lymphotropic virus 2
ucuccaauaccuuauccc

SEQ ID NO: 2926189 - RNA, 15 nt, Human T-lymphotropic virus 2
cuccccccccuuccc

SEQ ID NO: 2926190 - RNA, 19 nt, Human T-lymphotropic virus 2
cucuaaaggaacacccauc

SEQ ID NO: 2926191 - RNA, 21 nt, Human T-lymphotropic virus 2
cauuccccaacaaaccuccuc

SEQ ID NO: 2926192 - RNA, 15 nt, Human T-lymphotropic virus 2
cgacuagccucccga

SEQ ID NO: 2926193 - RNA, 16 nt, Human T-lymphotropic virus 2
gagcgcagcaagggcu

SEQ ID NO: 2926194 - RNA, 20 nt, Human T-lymphotropic virus 2
auuuccggcccuuaccccaa

SEQ ID NO: 2926195 - RNA, 19 nt, Human T-lymphotropic virus 2
caggaguuuuguaccuccu

SEQ ID NO: 2926196 - RNA, 17 nt, Human T-lymphotropic virus 2
ccuguuggaucucccuu

SEQ ID NO: 2926197 - RNA, 22 nt, Human T-lymphotropic virus 2
acuccaucuuaacaaccccagg

SEQ ID NO: 2926198 - RNA, 16 nt, Human T-lymphotropic virus 2
cucauaggcccuggca

SEQ ID NO: 2926199 - RNA, 16 nt, Human T-lymphotropic virus 2
ccucaacgccgcccuc

SEQ ID NO: 2926200 - RNA, 14 nt, Human T-lymphotropic virus 2
aacaaggcucugac

SEQ ID NO: 2926201 - RNA, 19 nt, Human T-lymphotropic virus 2
accuaagagccaccaaugc

SEQ ID NO: 2926202 - RNA, 20 nt, Human T-lymphotropic virus 2
ccucaaccccgcccuaccuc

SEQ ID NO: 2926203 - RNA, 14 nt, Human T-lymphotropic virus 2
accccccacccucc

SEQ ID NO: 2926204 - RNA, 11 nt, Human T-lymphotropic virus 2
cuaucugcccu

SEQ ID NO: 2926205 - RNA, 23 nt, Human T-lymphotropic virus 2
uccucaggccaauuuucacccuc

SEQ ID NO: 2926206 - RNA, 16 nt, Human T-lymphotropic virus 2
acugcaacaacuccau

SEQ ID NO: 2926207 - RNA, 13 nt, Human T-lymphotropic virus 2
cccagcccccacc

SEQ ID NO: 2926208 - RNA, 18 nt, Human T-lymphotropic virus 2
ucccaaaccaccucccaa

SEQ ID NO: 2926209 - RNA, 15 nt, Human T-lymphotropic virus 2
augccauuacuacca

SEQ ID NO: 2926210 - RNA, 16 nt, Human T-lymphotropic virus 2
uacucuggcuuccaua

SEQ ID NO: 2926211 - RNA, 17 nt, Human T-lymphotropic virus 2
ggcuuuccccaacucca

SEQ ID NO: 2926212 - RNA, 15 nt, Human T-lymphotropic virus 2
uaccacccucaccuc

SEQ ID NO: 2926213 - RNA, 20 nt, Human T-lymphotropic virus 2
ugccuuucuucccucucccg

SEQ ID NO: 2926214 - RNA, 19 nt, Human T-lymphotropic virus 2
ugcccaagaccagacgcca

SEQ ID NO: 2926215 - RNA, 19 nt, Human T-lymphotropic virus 2
caagguccuuaccccuccc

SEQ ID NO: 2926216 - RNA, 18 nt, Human T-lymphotropic virus 2
ccaucaaacccuccaggc

SEQ ID NO: 2926217 - RNA, 14 nt, Human T-lymphotropic virus 2
cugcccgcuccucc

SEQ ID NO: 2926218 - RNA, 20 nt, Human T-lymphotropic virus 2
acucauguauccguccucca

SEQ ID NO: 2926219 - RNA, 20 nt, Human T-lymphotropic virus 2
uguccuaacccccuccacgu

SEQ ID NO: 2926220 - RNA, 20 nt, Human T-lymphotropic virus 2
cccccguuauccuuuccucc

SEQ ID NO: 2926221 - RNA, 17 nt, Human T-lymphotropic virus 2
cugacgucccucccccc

SEQ ID NO: 2926222 - RNA, 19 nt, Human T-lymphotropic virus 2
cauaaccuuggcagccaac

SEQ ID NO: 2926223 - RNA, 15 nt, Human T-lymphotropic virus 2
cuccccuccuucccc

SEQ ID NO: 2926224 - RNA, 15 nt, Human T-lymphotropic virus 2
cauuauccucccccc

SEQ ID NO: 2926225 - RNA, 19 nt, Human T-lymphotropic virus 2
ccagacacucgugcccggg

SEQ ID NO: 2926226 - RNA, 19 nt, Human T-lymphotropic virus 2
auggccacuuauaccccau

SEQ ID NO: 2926227 - RNA, 19 nt, Human T-lymphotropic virus 2
ugcuuucuccacccugcca

SEQ ID NO: 2926228 - RNA, 18 nt, Human T-lymphotropic virus 2
cuccacggccucacccau

SEQ ID NO: 2926229 - RNA, 21 nt, Human T-lymphotropic virus 2
ccuacuuuuauucagucucac

SEQ ID NO: 2926230 - RNA, 20 nt, Human T-lymphotropic virus 2
gcugcuuucuccacccugcc

SEQ ID NO: 2926231 - RNA, 16 nt, Human T-lymphotropic virus 2
agccucccgagccagc

SEQ ID NO: 2926232 - RNA, 15 nt, Human T-lymphotropic virus 2
auucugccaccccag

SEQ ID NO: 2926233 - RNA, 16 nt, Human T-lymphotropic virus 2
gaacacccauccuucg

SEQ ID NO: 2926234 - RNA, 17 nt, Human T-lymphotropic virus 2
caacccaccacuggcuu

SEQ ID NO: 2926235 - RNA, 22 nt, Human T-lymphotropic virus 2
ggucuaauauggaccuucaaug

SEQ ID NO: 2926236 - RNA, 17 nt, Human T-lymphotropic virus 2
cacuuauaccccauguc

SEQ ID NO: 2926237 - RNA, 19 nt, Human T-lymphotropic virus 2
ucucguucuuuccucuucg

SEQ ID NO: 2926238 - RNA, 19 nt, Human T-lymphotropic virus 2
ggcucugacgucucccccu

SEQ ID NO: 2926239 - RNA, 21 nt, Human T-lymphotropic virus 2
ucucccgcugcuccuccgcca

SEQ ID NO: 2926240 - RNA, 19 nt, Human T-lymphotropic virus 2
agccccaccaaugaggaau

SEQ ID NO: 2926241 - RNA, 14 nt, Human T-lymphotropic virus 2
cuauguuccacccg

SEQ ID NO: 2926242 - RNA, 17 nt, Human T-lymphotropic virus 2
ccuucaaugacggcuca

SEQ ID NO: 2926243 - RNA, 21 nt, Human T-lymphotropic virus 2
caauggcgacuagccucccga

SEQ ID NO: 2926244 - RNA, 12 nt, Human T-lymphotropic virus 2
uccccagccaug

SEQ ID NO: 2926245 - RNA, 15 nt, Human T-lymphotropic virus 2
ggaagccaagucccu

SEQ ID NO: 2926246 - RNA, 18 nt, Human T-lymphotropic virus 2
ugggaccgucucccggcc

SEQ ID NO: 2926247 - RNA, 16 nt, Human T-lymphotropic virus 2
agccacgccccccucc

SEQ ID NO: 2926248 - RNA, 19 nt, Human T-lymphotropic virus 2
ccgcucacauuccucccau

SEQ ID NO: 2926249 - RNA, 13 nt, Human T-lymphotropic virus 2
cagccccacccuc

SEQ ID NO: 2926250 - RNA, 17 nt, Human T-lymphotropic virus 2
uccuauacacuccaacu

SEQ ID NO: 2926251 - RNA, 22 nt, Human T-lymphotropic virus 2
gagagucucgcaccugcucgcu

SEQ ID NO: 2926252 - RNA, 16 nt, Human T-lymphotropic virus 2
cucgcucccguaccuc

SEQ ID NO: 2926253 - RNA, 15 nt, Human T-lymphotropic virus 2
acugaaaccacggcc

SEQ ID NO: 2926254 - RNA, 22 nt, Human T-lymphotropic virus 2
gggagaucuaaucuccccccau

SEQ ID NO: 2926255 - RNA, 12 nt, Human T-lymphotropic virus 2
uccccagggccc

SEQ ID NO: 2926256 - RNA, 16 nt, Human T-lymphotropic virus 2
gaccaucuaccuccac

SEQ ID NO: 2926257 - RNA, 15 nt, Human T-lymphotropic virus 2
ccucuggucacggag

SEQ ID NO: 2926258 - RNA, 14 nt, Human T-lymphotropic virus 2
guaagucuccucuc

SEQ ID NO: 2926259 - RNA, 11 nt, Human T-lymphotropic virus 2
ccuuccucacc

SEQ ID NO: 2926260 - RNA, 17 nt, Human T-lymphotropic virus 2
accaacaucccugucuc

SEQ ID NO: 2926261 - RNA, 12 nt, Human T-lymphotropic virus 2
ggcuggcugcuu

SEQ ID NO: 2926262 - RNA, 14 nt, Human T-lymphotropic virus 2
ucuacuccuccucg

SEQ ID NO: 2926263 - RNA, 20 nt, Human T-lymphotropic virus 2
ccacgggcuuuccccaacuc

SEQ ID NO: 2926264 - RNA, 17 nt, Human T-lymphotropic virus 2
cccgcccuaccucuccu

SEQ ID NO: 2926265 - RNA, 16 nt, Human T-lymphotropic virus 2
ccuccccccccuuccc

SEQ ID NO: 2926266 - RNA, 13 nt, Human T-lymphotropic virus 2
caguccuccacua

SEQ ID NO: 2926267 - RNA, 17 nt, Human T-lymphotropic virus 2
cuuccaauuucccagga

SEQ ID NO: 2926268 - RNA, 17 nt, Human T-lymphotropic virus 2
aauucgaaaccaaagcc

SEQ ID NO: 2926269 - RNA, 15 nt, Human T-lymphotropic virus 2
cgguuauaccccaga

SEQ ID NO: 2926270 - RNA, 13 nt, Human T-lymphotropic virus 2
ucccucgccuccc

SEQ ID NO: 2926271 - RNA, 18 nt, Human T-lymphotropic virus 2
caccccacaacaacucca

SEQ ID NO: 2926272 - RNA, 14 nt, Human T-lymphotropic virus 2
cuggccuccguccc

SEQ ID NO: 2926273 - RNA, 21 nt, Human T-lymphotropic virus 2
cauauucugccaccccagaca

SEQ ID NO: 2926274 - RNA, 23 nt, Human T-lymphotropic virus 2
cccuccuaguagaugccccugga

SEQ ID NO: 2926275 - RNA, 15 nt, Human T-lymphotropic virus 2
cgugagggcucccug

SEQ ID NO: 2926276 - RNA, 15 nt, Human T-lymphotropic virus 2
cuacuccuccucguc

SEQ ID NO: 2926277 - RNA, 12 nt, Human T-lymphotropic virus 2
guggcucgcucc

SEQ ID NO: 2926278 - RNA, 15 nt, Human T-lymphotropic virus 2
ucgaacaccuucccc

SEQ ID NO: 2926279 - RNA, 13 nt, Human T-lymphotropic virus 2
guucuuuccucuu

SEQ ID NO: 2926280 - RNA, 12 nt, Human T-lymphotropic virus 2
acucccuuaucu

SEQ ID NO: 2926281 - RNA, 14 nt, Human T-lymphotropic virus 2
accauuccccagcc

SEQ ID NO: 2926282 - RNA, 15 nt, Human T-lymphotropic virus 2
ccauuccccagccau

SEQ ID NO: 2926283 - RNA, 23 nt, Human T-lymphotropic virus 2
acaaucccaaguaaaggcucuga

SEQ ID NO: 2926284 - RNA, 14 nt, Human T-lymphotropic virus 2
uuacccccugccca

SEQ ID NO: 2926285 - RNA, 22 nt, Human T-lymphotropic virus 2
ccucaaccccgcccuaccucuc

SEQ ID NO: 2926286 - RNA, 19 nt, Human T-lymphotropic virus 2
gauggcaaauccaccacag

SEQ ID NO: 2926287 - RNA, 21 nt, Human T-lymphotropic virus 2
cuaacccccuccacguccugg

SEQ ID NO: 2926288 - RNA, 18 nt, Human T-lymphotropic virus 2
aucccaacccuucccuug

SEQ ID NO: 2926289 - RNA, 16 nt, Human T-lymphotropic virus 2
cucgaacaccuucccc

SEQ ID NO: 2926290 - RNA, 19 nt, Human T-lymphotropic virus 2
cuguuggaucucccuucca

SEQ ID NO: 2926291 - RNA, 15 nt, Human T-lymphotropic virus 2
cugcccgcuccucca

SEQ ID NO: 2926292 - RNA, 18 nt, Human T-lymphotropic virus 2
aacuccauuauccucccc

SEQ ID NO: 2926293 - RNA, 14 nt, Human T-lymphotropic virus 2
cucacgcuccugca

SEQ ID NO: 2926294 - RNA, 19 nt, Human T-lymphotropic virus 2
gacgauuacccccugccca

SEQ ID NO: 2926295 - RNA, 10 nt, Human T-lymphotropic virus 2
cccucucccg

SEQ ID NO: 2926296 - RNA, 14 nt, Human T-lymphotropic virus 2
cauauucugccacc

SEQ ID NO: 2926297 - RNA, 21 nt, Human T-lymphotropic virus 2
uccuguuggaucucccuucca

SEQ ID NO: 2926298 - RNA, 20 nt, Human T-lymphotropic virus 2
accucgaccuuaauucccua

SEQ ID NO: 2926299 - RNA, 16 nt, Human T-lymphotropic virus 2
caggucgagcucggcu

SEQ ID NO: 2926300 - RNA, 18 nt, Human T-lymphotropic virus 2
cgagaagcccuccagaca

SEQ ID NO: 2926301 - RNA, 20 nt, Human T-lymphotropic virus 2
aaugaccuggucuccaaggc

SEQ ID NO: 2926302 - RNA, 18 nt, Human T-lymphotropic virus 2
ugucucccccaagguucc

SEQ ID NO: 2926303 - RNA, 14 nt, Human T-lymphotropic virus 2
ccucccaacccuuc

SEQ ID NO: 2926304 - RNA, 14 nt, Human T-lymphotropic virus 2
caucaaacccucca

SEQ ID NO: 2926305 - RNA, 15 nt, Human T-lymphotropic virus 2
cacccucaccucucc

SEQ ID NO: 2926306 - RNA, 20 nt, Human T-lymphotropic virus 2
aagcggccggggcagccuug

SEQ ID NO: 2926307 - RNA, 16 nt, Human T-lymphotropic virus 2
augccaagauccuucu

SEQ ID NO: 2926308 - RNA, 13 nt, Human T-lymphotropic virus 2
ccuccaccauguc

SEQ ID NO: 2926309 - RNA, 13 nt, Human T-lymphotropic virus 2
gacggcucccccc

SEQ ID NO: 2926310 - RNA, 21 nt, Human T-lymphotropic virus 2
cuaucacaagaauuccaggag

SEQ ID NO: 2926311 - RNA, 14 nt, Human T-lymphotropic virus 2
cuauaccucccaga

SEQ ID NO: 2926312 - RNA, 18 nt, Human T-lymphotropic virus 2
caggcuaauaaccccgcc

SEQ ID NO: 2926313 - RNA, 19 nt, Human T-lymphotropic virus 2
caaugcgaaagcacacccc

SEQ ID NO: 2926314 - RNA, 24 nt, Human T-lymphotropic virus 2
acucuacacccccaacaucuccau

SEQ ID NO: 2926315 - RNA, 21 nt, Human T-lymphotropic virus 2
cagggggcuaucaacccacca

SEQ ID NO: 2926316 - RNA, 16 nt, Human T-lymphotropic virus 2
ugacccauccacaguc

SEQ ID NO: 2926317 - RNA, 19 nt, Human T-lymphotropic virus 2
ucucccaccuuacccaggc

SEQ ID NO: 2926318 - RNA, 21 nt, Human T-lymphotropic virus 2
cccagccauguaacuauggcc

SEQ ID NO: 2926319 - RNA, 16 nt, Human T-lymphotropic virus 2
acaucuccauucccca

SEQ ID NO: 2926320 - RNA, 16 nt, Human T-lymphotropic virus 2
uggccccugcccccua

SEQ ID NO: 2926321 - RNA, 13 nt, Human T-lymphotropic virus 2
cugauccuaggcg

SEQ ID NO: 2926322 - RNA, 19 nt, Human T-lymphotropic virus 2
gcuuaacuuucuccaggcu

SEQ ID NO: 2926323 - RNA, 22 nt, Human T-lymphotropic virus 2
accacaugggucgauuccauaa

SEQ ID NO: 2926324 - RNA, 14 nt, Human T-lymphotropic virus 2
ccuccccuccuucc

SEQ ID NO: 2926325 - RNA, 16 nt, Human T-lymphotropic virus 2
agucuccucucagguc

SEQ ID NO: 2926326 - RNA, 14 nt, Human T-lymphotropic virus 2
ugauccuuuucccg

SEQ ID NO: 2926327 - RNA, 18 nt, Human T-lymphotropic virus 2
caaauccaggcccuucca

SEQ ID NO: 2926328 - RNA, 16 nt, Human T-lymphotropic virus 2
gccccaaggccuccac

SEQ ID NO: 2926329 - RNA, 14 nt, Human T-lymphotropic virus 2
caccuccccaagug

SEQ ID NO: 2926330 - RNA, 20 nt, Human T-lymphotropic virus 2
ccuccaguaccuaugcuccu

SEQ ID NO: 2926331 - RNA, 21 nt, Human T-lymphotropic virus 2
auccuccccccuuuuucccuc

SEQ ID NO: 2926332 - RNA, 20 nt, Human T-lymphotropic virus 2
ggcauccucauucaccacau

SEQ ID NO: 2926333 - RNA, 14 nt, Human T-lymphotropic virus 2
aaaacaaggcucug

SEQ ID NO: 2926334 - RNA, 20 nt, Human T-lymphotropic virus 2
aggaaggggaaccccuccug

SEQ ID NO: 2926335 - RNA, 15 nt, Human T-lymphotropic virus 2
gccacaccaaccucc

SEQ ID NO: 2926336 - RNA, 17 nt, Human T-lymphotropic virus 2
gacaaacaccucagccu

SEQ ID NO: 2926337 - RNA, 19 nt, Human T-lymphotropic virus 2
uguggacuacgugcugcca

SEQ ID NO: 2926338 - RNA, 22 nt, Human T-lymphotropic virus 2
gccuccaccaacuucuccccca

SEQ ID NO: 2926339 - RNA, 14 nt, Human T-lymphotropic virus 2
accauccucuuucc

SEQ ID NO: 2926340 - RNA, 13 nt, Human T-lymphotropic virus 2
cagcucuccagaa

SEQ ID NO: 2926341 - RNA, 15 nt, Human T-lymphotropic virus 2
auccuaggagagauc

SEQ ID NO: 2926342 - RNA, 23 nt, Human T-lymphotropic virus 2
gcgagucaucgacccaaaagguc

SEQ ID NO: 2926343 - RNA, 14 nt, Human T-lymphotropic virus 2
ucuauguuccaccc

SEQ ID NO: 2926344 - RNA, 23 nt, Human T-lymphotropic virus 2
cacucacgauugguaucuccucc

SEQ ID NO: 2926345 - RNA, 21 nt, Human T-lymphotropic virus 2
cuccaccaacuucucccccau

SEQ ID NO: 2926346 - RNA, 17 nt, Human T-lymphotropic virus 2
uacacccccccugcccu

SEQ ID NO: 2926347 - RNA, 16 nt, Human T-lymphotropic virus 2
cuggucuccaaggccc

SEQ ID NO: 2926348 - RNA, 19 nt, Human T-lymphotropic virus 2
ggcacgagaagcccuccag

SEQ ID NO: 2926349 - RNA, 13 nt, Human T-lymphotropic virus 2
cgccgcccucuug

SEQ ID NO: 2926350 - RNA, 16 nt, Human T-lymphotropic virus 2
ucgccuucaccauucc

SEQ ID NO: 2926351 - RNA, 18 nt, Human T-lymphotropic virus 2
ccacgacuccucaggcca

SEQ ID NO: 2926352 - RNA, 19 nt, Human T-lymphotropic virus 2
gcacgagaagcccuccaga

SEQ ID NO: 2926353 - RNA, 17 nt, Human T-lymphotropic virus 2
gcgacuagccucccgag

SEQ ID NO: 2926354 - RNA, 14 nt, Human T-lymphotropic virus 2
uggauaugauccuu

SEQ ID NO: 2926355 - RNA, 12 nt, Human T-lymphotropic virus 2
ccuuauccccaa

SEQ ID NO: 2926356 - RNA, 13 nt, Human T-lymphotropic virus 2
cgccggggccucu

SEQ ID NO: 2926357 - RNA, 20 nt, Human T-lymphotropic virus 2
ugaacauguccuaacccccu

SEQ ID NO: 2926358 - RNA, 16 nt, Human T-lymphotropic virus 2
gaacugcuccucccaa

SEQ ID NO: 2926359 - RNA, 14 nt, Human T-lymphotropic virus 2
cauaaccuucaccu

SEQ ID NO: 2926360 - RNA, 20 nt, Human T-lymphotropic virus 2
gaagucagccaagugucccu

SEQ ID NO: 2926361 - RNA, 12 nt, Human T-lymphotropic virus 2
cgccgucacuga

SEQ ID NO: 2926362 - RNA, 16 nt, Human T-lymphotropic virus 2
aacucuagacaaauau

SEQ ID NO: 2926363 - RNA, 23 nt, Human T-lymphotropic virus 2
gaggaauuacaacaacucuccca

SEQ ID NO: 2926364 - RNA, 21 nt, Human T-lymphotropic virus 2
gcguugucagcucuccucucc

SEQ ID NO: 2926365 - RNA, 18 nt, Human T-lymphotropic virus 2
ggcuuaacuuucuccagg

SEQ ID NO: 2926366 - RNA, 17 nt, Human T-lymphotropic virus 2
ucccgagccagccaccc

SEQ ID NO: 2926367 - RNA, 15 nt, Human T-lymphotropic virus 2
acaccaaccuccccg

SEQ ID NO: 2926368 - RNA, 19 nt, Human T-lymphotropic virus 2
cccccugcggcagcaacag

SEQ ID NO: 2926369 - RNA, 14 nt, Human T-lymphotropic virus 2
cccucgccuccccu

SEQ ID NO: 2926370 - RNA, 12 nt, Human T-lymphotropic virus 2
caaacccuccag

SEQ ID NO: 2926371 - RNA, 18 nt, Human T-lymphotropic virus 2
cuagggcuuccugaaccu

SEQ ID NO: 2926372 - RNA, 16 nt, Human T-lymphotropic virus 2
ugcuuucuccacccug

SEQ ID NO: 2926373 - RNA, 14 nt, Human T-lymphotropic virus 2
gacucgccucuccc

SEQ ID NO: 2926374 - RNA, 10 nt, Human T-lymphotropic virus 2
auccagccuc

SEQ ID NO: 2926375 - RNA, 17 nt, Human T-lymphotropic virus 2
ucagcucauaggcccug

SEQ ID NO: 2926376 - RNA, 19 nt, Human T-lymphotropic virus 2
ccccuguauccuccgccaa

SEQ ID NO: 2926377 - RNA, 22 nt, Human T-lymphotropic virus 2
acacauauucuugcccuuccga

SEQ ID NO: 2926378 - RNA, 14 nt, Human T-lymphotropic virus 2
agcgccuccaggcc

SEQ ID NO: 2926379 - RNA, 21 nt, Human T-lymphotropic virus 2
agucgggacuguacccagcca

SEQ ID NO: 2926380 - RNA, 22 nt, Human T-lymphotropic virus 2
ccagacaauuaggagccuuccu

SEQ ID NO: 2926381 - RNA, 15 nt, Human T-lymphotropic virus 2
ucagaccgucucaca

SEQ ID NO: 2926382 - RNA, 23 nt, Human T-lymphotropic virus 2
cgaaccuggccuccguccccaaa

SEQ ID NO: 2926383 - RNA, 16 nt, Human T-lymphotropic virus 2
cucaccgacccucugg

SEQ ID NO: 2926384 - RNA, 13 nt, Human T-lymphotropic virus 2
acuccccucaucc

SEQ ID NO: 2926385 - RNA, 20 nt, Human T-lymphotropic virus 2
ccaugucauauucugccacc

SEQ ID NO: 2926386 - RNA, 17 nt, Human T-lymphotropic virus 2
uggguagacaccuucuc

SEQ ID NO: 2926387 - RNA, 21 nt, Human T-lymphotropic virus 2
gcgcccccgccgccccaguuc

SEQ ID NO: 2926388 - RNA, 14 nt, Human T-lymphotropic virus 2
cagcaagggcuagg

SEQ ID NO: 2926389 - RNA, 13 nt, Human T-lymphotropic virus 2
cggcaccuccuga

SEQ ID NO: 2926390 - RNA, 17 nt, Human T-lymphotropic virus 2
ccucuccuuccccaggg

SEQ ID NO: 2926391 - RNA, 13 nt, Human T-lymphotropic virus 2
gaacugcuccucc

SEQ ID NO: 2926392 - RNA, 23 nt, Human T-lymphotropic virus 2
ccgaaccauccucuuuccuuccc

SEQ ID NO: 2926393 - RNA, 13 nt, Human T-lymphotropic virus 2
ugcccgcuccucc

SEQ ID NO: 2926394 - RNA, 17 nt, Human T-lymphotropic virus 2
auuuuccacuagcccag

SEQ ID NO: 2926395 - RNA, 21 nt, Human T-lymphotropic virus 2
agacucaccuuggggauccau

SEQ ID NO: 2926396 - RNA, 13 nt, Human T-lymphotropic virus 2
cccgcuccuccau

SEQ ID NO: 2926397 - RNA, 19 nt, Human T-lymphotropic virus 2
caccaucuuaacucuagac

SEQ ID NO: 2926398 - RNA, 14 nt, Human T-lymphotropic virus 2
augcccuccuggcc

SEQ ID NO: 2926399 - RNA, 16 nt, Human T-lymphotropic virus 2
caggcuacaaccccau

SEQ ID NO: 2926400 - RNA, 20 nt, Human T-lymphotropic virus 2
cccuucccuuggacccauug

SEQ ID NO: 2926401 - RNA, 16 nt, Human T-lymphotropic virus 2
uguccgcagccacacc

SEQ ID NO: 2926402 - RNA, 13 nt, Human T-lymphotropic virus 2
uccuggccaccug

SEQ ID NO: 2926403 - RNA, 16 nt, Human T-lymphotropic virus 2
cccauugguccaugac

SEQ ID NO: 2926404 - RNA, 22 nt, Human T-lymphotropic virus 2
ggguacccccaaagagcccauc

SEQ ID NO: 2926405 - RNA, 19 nt, Human T-lymphotropic virus 2
aaaccugagcgccuccagg

SEQ ID NO: 2926406 - RNA, 15 nt, Human T-lymphotropic virus 2
uaaaggaacacccau

SEQ ID NO: 2926407 - RNA, 16 nt, Human T-lymphotropic virus 2
cacaacaaaccccagg

SEQ ID NO: 2926408 - RNA, 15 nt, Human T-lymphotropic virus 2
ccucuaccccuccca

SEQ ID NO: 2926409 - RNA, 22 nt, Human T-lymphotropic virus 2
auccuacaggggcuggaggaac

SEQ ID NO: 2926410 - RNA, 18 nt, Human T-lymphotropic virus 2
acccaauuuccaccuuca

SEQ ID NO: 2926411 - RNA, 23 nt, Human T-lymphotropic virus 2
cuccaggcggccuugccaccccu

SEQ ID NO: 2926412 - RNA, 13 nt, Human T-lymphotropic virus 2
cccacacagcccu

SEQ ID NO: 2926413 - RNA, 12 nt, Human T-lymphotropic virus 2
ucuuggcaggcg

SEQ ID NO: 2926414 - RNA, 21 nt, Human T-lymphotropic virus 2
ugccccuuagguagucgcucc

SEQ ID NO: 2926415 - RNA, 18 nt, Human T-lymphotropic virus 2
cuaguagaugccccugga

SEQ ID NO: 2926416 - RNA, 20 nt, Human T-lymphotropic virus 2
caaagccuuccaucccuccu

SEQ ID NO: 2926417 - RNA, 13 nt, Human T-lymphotropic virus 2
accacccucaccu

SEQ ID NO: 2926418 - RNA, 23 nt, Human T-lymphotropic virus 2
cuccaauacccaaagcccccagg

SEQ ID NO: 2926419 - RNA, 15 nt, Human T-lymphotropic virus 2
ugcccaaccacauau

SEQ ID NO: 2926420 - RNA, 16 nt, Human T-lymphotropic virus 2
ugaaccauacucagga

SEQ ID NO: 2926421 - RNA, 12 nt, Human T-lymphotropic virus 2
uuucacccucuc

SEQ ID NO: 2926422 - RNA, 21 nt, Human T-lymphotropic virus 2
accuuccccuagacaaugcca

SEQ ID NO: 2926423 - RNA, 14 nt, Human T-lymphotropic virus 2
acagcccugcuuuc

SEQ ID NO: 2926424 - RNA, 13 nt, Human T-lymphotropic virus 2
ccuucaccauucc

SEQ ID NO: 2926425 - RNA, 16 nt, Human T-lymphotropic virus 2
caucccgaucaagaca

SEQ ID NO: 2926426 - RNA, 17 nt, Human T-lymphotropic virus 2
uacacacagggacaguc

SEQ ID NO: 2926427 - RNA, 21 nt, Human T-lymphotropic virus 2
cucucuuacaccucccaaccc

SEQ ID NO: 2926428 - RNA, 16 nt, Human T-lymphotropic virus 2
gcaagggcuagggcuu

SEQ ID NO: 2926429 - RNA, 16 nt, Human T-lymphotropic virus 2
cccucccucgccuucc

SEQ ID NO: 2926430 - RNA, 13 nt, Human T-lymphotropic virus 2
ggccagccuuccu

SEQ ID NO: 2926431 - RNA, 13 nt, Human T-lymphotropic virus 2
acaucacuccccu

SEQ ID NO: 2926432 - RNA, 21 nt, Human T-lymphotropic virus 2
accccucccaaaccaccuccc

SEQ ID NO: 2926433 - RNA, 13 nt, Human T-lymphotropic virus 2
acucaccugggac

SEQ ID NO: 2926434 - RNA, 14 nt, Human T-lymphotropic virus 2
ccccagcccccacc

SEQ ID NO: 2926435 - RNA, 16 nt, Human T-lymphotropic virus 2
cacucagccuccacca

SEQ ID NO: 2926436 - RNA, 21 nt, Human T-lymphotropic virus 2
cccaggauuuggacagagccu

SEQ ID NO: 2926437 - RNA, 22 nt, Human T-lymphotropic virus 2
auucgaaaccaaagccuuccau

SEQ ID NO: 2926438 - RNA, 13 nt, Human T-lymphotropic virus 2
aauguugcuuccu

SEQ ID NO: 2926439 - RNA, 16 nt, Human T-lymphotropic virus 2
ccuucccccaccuccc

SEQ ID NO: 2926440 - RNA, 22 nt, Human T-lymphotropic virus 2
cacgggcuuuccccaacuccaa

SEQ ID NO: 2926441 - RNA, 20 nt, Human T-lymphotropic virus 2
cucucccagcuaacccucca

SEQ ID NO: 2926442 - RNA, 16 nt, Human T-lymphotropic virus 2
gcgcucggcuagacuc

SEQ ID NO: 2926443 - RNA, 23 nt, Human T-lymphotropic virus 2
ccuccuguuggaucucccuucca

SEQ ID NO: 2926444 - RNA, 13 nt, Human T-lymphotropic virus 2
gaccccagccccc

SEQ ID NO: 2926445 - RNA, 16 nt, Human T-lymphotropic virus 2
ugcaaucccuccagga

SEQ ID NO: 2926446 - RNA, 20 nt, Human T-lymphotropic virus 2
caggaacggcccccucuuga

SEQ ID NO: 2926447 - RNA, 17 nt, Human T-lymphotropic virus 2
gaaaccaaagccuucca

SEQ ID NO: 2926448 - RNA, 20 nt, Human T-lymphotropic virus 2
gcuuauacaauacuccuccu

SEQ ID NO: 2926449 - RNA, 18 nt, Human T-lymphotropic virus 2
uauacaauacuccuccuu

SEQ ID NO: 2926450 - RNA, 17 nt, Human T-lymphotropic virus 2
acccuuacccacuuccc

SEQ ID NO: 2926451 - RNA, 23 nt, Human T-lymphotropic virus 2
ccagccauacuucgccuucacca

SEQ ID NO: 2926452 - RNA, 17 nt, Human T-lymphotropic virus 2
ugacaacggccuccccg

SEQ ID NO: 2926453 - RNA, 17 nt, Human T-lymphotropic virus 2
gccccgucuccagucca

SEQ ID NO: 2926454 - RNA, 14 nt, Human T-lymphotropic virus 2
ggaacccaccacca

SEQ ID NO: 2926455 - RNA, 17 nt, Human T-lymphotropic virus 2
accccuacuauucccau

SEQ ID NO: 2926456 - RNA, 21 nt, Human T-lymphotropic virus 2
accucuccuuccccagggccc

SEQ ID NO: 2926457 - RNA, 20 nt, Human T-lymphotropic virus 2
auuacaauccugucuccucu

SEQ ID NO: 2926458 - RNA, 20 nt, Human T-lymphotropic virus 2
gaaaccaaagccuuccaucc

SEQ ID NO: 2926459 - RNA, 20 nt, Human T-lymphotropic virus 2
accuuuugcuguccuucucg

SEQ ID NO: 2926460 - RNA, 13 nt, Human T-lymphotropic virus 2
caguaccagccau

SEQ ID NO: 2926461 - RNA, 14 nt, Human T-lymphotropic virus 2
caauccugucuccu

SEQ ID NO: 2926462 - RNA, 22 nt, Human T-lymphotropic virus 2
aacugccguggccgccucaacc

SEQ ID NO: 2926463 - RNA, 21 nt, Human T-lymphotropic virus 2
cgccuacaucgacaugcccuc

SEQ ID NO: 2926464 - RNA, 14 nt, Human T-lymphotropic virus 2
ucuuuccuucccuu

SEQ ID NO: 2926465 - RNA, 20 nt, Human T-lymphotropic virus 2
cacccaguucaaacuccucc

SEQ ID NO: 2926466 - RNA, 20 nt, Human T-lymphotropic virus 2
cagacacucgugcccgggcc

SEQ ID NO: 2926467 - RNA, 15 nt, Human T-lymphotropic virus 2
ccguggccgccucaa

SEQ ID NO: 2926468 - RNA, 12 nt, Human T-lymphotropic virus 2
accacuccagcc

SEQ ID NO: 2926469 - RNA, 17 nt, Human T-lymphotropic virus 2
ugaccuaagagccacca

SEQ ID NO: 2926470 - RNA, 16 nt, Human T-lymphotropic virus 2
aacuccccucauccaa

SEQ ID NO: 2926471 - RNA, 22 nt, Human T-lymphotropic virus 2
caugaggaaaauguuucccaca

SEQ ID NO: 2926472 - RNA, 17 nt, Human T-lymphotropic virus 2
ccagaugagucgccccc

SEQ ID NO: 2926473 - RNA, 15 nt, Human T-lymphotropic virus 2
gaggucagcuccucu

SEQ ID NO: 2926474 - RNA, 21 nt, Human T-lymphotropic virus 2
gccuuuuuuccgauggcuccc

SEQ ID NO: 2926475 - RNA, 19 nt, Human T-lymphotropic virus 2
gggcuuccugaaccucucc

SEQ ID NO: 2926476 - RNA, 17 nt, Human T-lymphotropic virus 2
aacaggaacagcucucc

SEQ ID NO: 2926477 - RNA, 12 nt, Human T-lymphotropic virus 2
cuaacccuccag

SEQ ID NO: 2926478 - RNA, 22 nt, Human T-lymphotropic virus 2
cauuccccaacaaaccuccucc

SEQ ID NO: 2926479 - RNA, 21 nt, Human T-lymphotropic virus 2
guugacaaagacaucucccac

SEQ ID NO: 2926480 - RNA, 16 nt, Human T-lymphotropic virus 2
agccucuaccccuccc

SEQ ID NO: 2926481 - RNA, 18 nt, Human T-lymphotropic virus 2
accccagacacucgugcc

SEQ ID NO: 2926482 - RNA, 15 nt, Human T-lymphotropic virus 2
aagguaagucuccuc

SEQ ID NO: 2926483 - RNA, 15 nt, Human T-lymphotropic virus 2
ucuuacaccucccaa

SEQ ID NO: 2926484 - RNA, 14 nt, Human T-lymphotropic virus 2
uccccggccuuacc

SEQ ID NO: 2926485 - RNA, 20 nt, Human T-lymphotropic virus 2
uuuccaaaucccccucccca

SEQ ID NO: 2926486 - RNA, 12 nt, Human T-lymphotropic virus 2
uggcgccacacc

SEQ ID NO: 2926487 - RNA, 20 nt, Human T-lymphotropic virus 2
aacccaucaaaacccaggag

SEQ ID NO: 2926488 - RNA, 21 nt, Human T-lymphotropic virus 2
uacauaugagaguaccccuac

SEQ ID NO: 2926489 - RNA, 14 nt, Human T-lymphotropic virus 2
ucaaacuccuccaa

SEQ ID NO: 2926490 - RNA, 18 nt, Human T-lymphotropic virus 2
gaucucccuuccaccuca

SEQ ID NO: 2926491 - RNA, 15 nt, Human T-lymphotropic virus 2
ccuaacccccuccac

SEQ ID NO: 2926492 - RNA, 16 nt, Human T-lymphotropic virus 2
caagguaagucuccuc

SEQ ID NO: 2926493 - RNA, 13 nt, Human T-lymphotropic virus 2
caugcccaagacc

SEQ ID NO: 2926494 - RNA, 13 nt, Human T-lymphotropic virus 2
acacuaacagccc

SEQ ID NO: 2926495 - RNA, 14 nt, Human T-lymphotropic virus 2
ccugagcgccucca

SEQ ID NO: 2926496 - RNA, 23 nt, Human T-lymphotropic virus 2
uccccaaaacaucuacaccaccu

SEQ ID NO: 2926497 - RNA, 12 nt, Human T-lymphotropic virus 2
ucccccaccucc

SEQ ID NO: 2926498 - RNA, 16 nt, Human T-lymphotropic virus 2
caguucaaacuccucc

SEQ ID NO: 2926499 - RNA, 14 nt, Human T-lymphotropic virus 2
agacucgccucucc

SEQ ID NO: 2926500 - RNA, 13 nt, Human T-lymphotropic virus 2
acccauauaccau

SEQ ID NO: 2926501 - RNA, 21 nt, Human T-lymphotropic virus 2
aagcaagucacaaaacccauc

SEQ ID NO: 2926502 - RNA, 22 nt, Human T-lymphotropic virus 2
accauucucgcucuacuccucc

SEQ ID NO: 2926503 - RNA, 19 nt, Human T-lymphotropic virus 2
gcuagccuuauccccaagg

SEQ ID NO: 2926504 - RNA, 14 nt, Human T-lymphotropic virus 2
auaccccagacacu

SEQ ID NO: 2926505 - RNA, 17 nt, Human T-lymphotropic virus 2
uccucucagcccauuuc

SEQ ID NO: 2926506 - RNA, 19 nt, Human T-lymphotropic virus 2
ugaagccucuaccccuccc

SEQ ID NO: 2926507 - RNA, 23 nt, Human T-lymphotropic virus 2
ccccagggggcuaucaacccacc

SEQ ID NO: 2926508 - RNA, 13 nt, Human T-lymphotropic virus 2
caaacccuccagg

SEQ ID NO: 2926509 - RNA, 13 nt, Human T-lymphotropic virus 2
ccaacaucccugu

SEQ ID NO: 2926510 - RNA, 15 nt, Human T-lymphotropic virus 2
aucaagucuccccua

SEQ ID NO: 2926511 - RNA, 19 nt, Human T-lymphotropic virus 2
cuccguuaugggacaaaca

SEQ ID NO: 2926512 - RNA, 13 nt, Human T-lymphotropic virus 2
aacccuucccuug

SEQ ID NO: 2926513 - RNA, 18 nt, Human T-lymphotropic virus 2
cuauaccuauaccagcuu

SEQ ID NO: 2926514 - RNA, 14 nt, Human T-lymphotropic virus 2
uguccuaaccuucc

SEQ ID NO: 2926515 - RNA, 17 nt, Human T-lymphotropic virus 2
gucacggagacucaccu

SEQ ID NO: 2926516 - RNA, 13 nt, Human T-lymphotropic virus 2
cuuuuccccuuca

SEQ ID NO: 2926517 - RNA, 15 nt, Human T-lymphotropic virus 2
cuccacaccccccac

SEQ ID NO: 2926518 - RNA, 22 nt, Human T-lymphotropic virus 2
uuccugaggaacuccccucauc

SEQ ID NO: 2926519 - RNA, 22 nt, Human T-lymphotropic virus 2
aaagcugcaugcccaagaccag

SEQ ID NO: 2926520 - RNA, 20 nt, Human T-lymphotropic virus 2
ggcucugacgucucccccuu

SEQ ID NO: 2926521 - RNA, 17 nt, Human T-lymphotropic virus 2
auuccauaaccuuggca

SEQ ID NO: 2926522 - RNA, 20 nt, Human T-lymphotropic virus 2
uccgcccaucaaacccucca

SEQ ID NO: 2926523 - RNA, 23 nt, Human T-lymphotropic virus 2
cgccuacaucgacaugcccuccu

SEQ ID NO: 2926524 - RNA, 16 nt, Human T-lymphotropic virus 2
acuaccacccucaccu

SEQ ID NO: 2926525 - RNA, 15 nt, Human T-lymphotropic virus 2
cagacucgccucucc

SEQ ID NO: 2926526 - RNA, 21 nt, Human T-lymphotropic virus 2
gcccccuuggggagaugcucc

SEQ ID NO: 2926527 - RNA, 16 nt, Human T-lymphotropic virus 2
uccaugacuccgaccu

SEQ ID NO: 2926528 - RNA, 20 nt, Human T-lymphotropic virus 2
caggagguggcucgcucccu

SEQ ID NO: 2926529 - RNA, 17 nt, Human T-lymphotropic virus 2
uuccacuagcccagcag

SEQ ID NO: 2926530 - RNA, 16 nt, Human T-lymphotropic virus 2
guuccaacccgugagg

SEQ ID NO: 2926531 - RNA, 15 nt, Human T-lymphotropic virus 2
uacuccuccuuccau

SEQ ID NO: 2926532 - RNA, 23 nt, Human T-lymphotropic virus 2
cacuggcuuaacuuucuccaggc

SEQ ID NO: 2926533 - RNA, 17 nt, Human T-lymphotropic virus 2
cuccuccuaccacucca

SEQ ID NO: 2926534 - RNA, 21 nt, Human T-lymphotropic virus 2
acuccgaccuugaacaugucc

SEQ ID NO: 2926535 - RNA, 12 nt, Human T-lymphotropic virus 2
ccuggccaccug

SEQ ID NO: 2926536 - RNA, 15 nt, Human T-lymphotropic virus 2
acccacucagccucc

SEQ ID NO: 2926537 - RNA, 16 nt, Human T-lymphotropic virus 2
gacgaccccagccccc

SEQ ID NO: 2926538 - RNA, 16 nt, Human T-lymphotropic virus 2
cuucuauaccucccag

SEQ ID NO: 2926539 - RNA, 18 nt, Human T-lymphotropic virus 2
cuccacaccccccacccu

SEQ ID NO: 2926540 - RNA, 14 nt, Human T-lymphotropic virus 2
ccgauggcuccccu

SEQ ID NO: 2926541 - RNA, 17 nt, Human T-lymphotropic virus 2
ccuugacaacggccucc

SEQ ID NO: 2926542 - RNA, 16 nt, Human T-lymphotropic virus 2
agccuaggcccuccga

SEQ ID NO: 2926543 - RNA, 13 nt, Human T-lymphotropic virus 2
auagaccucaccc

SEQ ID NO: 2926544 - RNA, 21 nt, Human T-lymphotropic virus 2
ccccaaagcagggcagccauc

SEQ ID NO: 2926545 - RNA, 23 nt, Human T-lymphotropic virus 2
augccuuucuucccucucccggc

SEQ ID NO: 2926546 - RNA, 18 nt, Human T-lymphotropic virus 2
ccaccaauugcugccaau

SEQ ID NO: 2926547 - RNA, 15 nt, Human T-lymphotropic virus 2
gcagcaacagcaacc

SEQ ID NO: 2926548 - RNA, 22 nt, Human T-lymphotropic virus 2
uucaacaggacaucacuccccu

SEQ ID NO: 2926549 - RNA, 12 nt, Human T-lymphotropic virus 2
cugucuccccca

SEQ ID NO: 2926550 - RNA, 22 nt, Human T-lymphotropic virus 2
uuucccacaucgaccauugucc

SEQ ID NO: 2926551 - RNA, 19 nt, Human T-lymphotropic virus 2
cucuacacccccaacaucu

SEQ ID NO: 2926552 - RNA, 18 nt, Human T-lymphotropic virus 2
cugaaaaacaaggcucug

SEQ ID NO: 2926553 - RNA, 13 nt, Human T-lymphotropic virus 2
uaacuuucuccag

SEQ ID NO: 2926554 - RNA, 18 nt, Human T-lymphotropic virus 2
ccacuuauaccccauguc

SEQ ID NO: 2926555 - RNA, 13 nt, Human T-lymphotropic virus 2
cuccucucagguc

SEQ ID NO: 2926556 - RNA, 17 nt, Human T-lymphotropic virus 2
accuuaucccucgccuc

SEQ ID NO: 2926557 - RNA, 17 nt, Human T-lymphotropic virus 2
ccgcccuaggagcauug

SEQ ID NO: 2926558 - RNA, 16 nt, Human T-lymphotropic virus 2
ccccauggcagggccc

SEQ ID NO: 2926559 - RNA, 15 nt, Human T-lymphotropic virus 2
caggcaauaaccccg

SEQ ID NO: 2926560 - RNA, 19 nt, Human T-lymphotropic virus 2
uuccugaggaacuccccuc

SEQ ID NO: 2926561 - RNA, 14 nt, Human T-lymphotropic virus 2
gucccgucucaggu

SEQ ID NO: 2926562 - RNA, 15 nt, Human T-lymphotropic virus 2
cagccacgccccccu

SEQ ID NO: 2926563 - RNA, 16 nt, Human T-lymphotropic virus 2
auucgaaaccaaagcc

SEQ ID NO: 2926564 - RNA, 21 nt, Human T-lymphotropic virus 2
agguccuuaccccucccacca

SEQ ID NO: 2926565 - RNA, 16 nt, Human T-lymphotropic virus 2
ccaacauacgccgugg

SEQ ID NO: 2926566 - RNA, 20 nt, Human T-lymphotropic virus 2
augggacaaacaccucagcc

SEQ ID NO: 2926567 - RNA, 20 nt, Human T-lymphotropic virus 2
acauacuuuuagccagcccc

SEQ ID NO: 2926568 - RNA, 13 nt, Human T-lymphotropic virus 2
uaaaggcucugac

SEQ ID NO: 2926569 - RNA, 15 nt, Human T-lymphotropic virus 2
ugcaaucccuccagg

SEQ ID NO: 2926570 - RNA, 22 nt, Human T-lymphotropic virus 2
caagagcuuguaucacccucac

SEQ ID NO: 2926571 - RNA, 20 nt, Human T-lymphotropic virus 2
cuccauagacggcucccccc

SEQ ID NO: 2926572 - RNA, 21 nt, Human T-lymphotropic virus 2
ugaacauguccuaacccccuc

SEQ ID NO: 2926573 - RNA, 20 nt, Human T-lymphotropic virus 2
cucccuuaucuuagcucccc

SEQ ID NO: 2926574 - RNA, 23 nt, Human T-lymphotropic virus 2
agacaauuaggagccuuccucac

SEQ ID NO: 2926575 - RNA, 18 nt, Human T-lymphotropic virus 2
uggcauguacucuacacc

SEQ ID NO: 2926576 - RNA, 14 nt, Human T-lymphotropic virus 2
aauagaccucaccc

SEQ ID NO: 2926577 - RNA, 17 nt, Human T-lymphotropic virus 2
cugcacguggaaccucg

SEQ ID NO: 2926578 - RNA, 15 nt, Human T-lymphotropic virus 2
gccauuacuaccacc

SEQ ID NO: 2926579 - RNA, 17 nt, Human T-lymphotropic virus 2
ucccucgccuccccucc

SEQ ID NO: 2926580 - RNA, 17 nt, Human T-lymphotropic virus 2
cagccuccaccaacuuc

SEQ ID NO: 2926581 - RNA, 12 nt, Human T-lymphotropic virus 2
acggccuccccg

SEQ ID NO: 2926582 - RNA, 19 nt, Human T-lymphotropic virus 2
cauugcuaccaaccucgcc

SEQ ID NO: 2926583 - RNA, 21 nt, Human T-lymphotropic virus 2
gcaaucuccuaaaauagucua

SEQ ID NO: 2926584 - RNA, 21 nt, Human T-lymphotropic virus 2
ucgaacaccuucccccaccuc

SEQ ID NO: 2926585 - RNA, 12 nt, Human T-lymphotropic virus 2
uccccucaucca

SEQ ID NO: 2926586 - RNA, 20 nt, Human T-lymphotropic virus 2
cucaccgacccucuggucac

SEQ ID NO: 2926587 - RNA, 17 nt, Human T-lymphotropic virus 2
acccaguucaaacuccu

SEQ ID NO: 2926588 - RNA, 17 nt, Human T-lymphotropic virus 2
ccaucuuaacucuagac

SEQ ID NO: 2926589 - RNA, 16 nt, Human T-lymphotropic virus 2
uacaccaucagcagcu

SEQ ID NO: 2926590 - RNA, 22 nt, Human T-lymphotropic virus 2
ucccccuaccauugacccaucc

SEQ ID NO: 2926591 - RNA, 18 nt, Human T-lymphotropic virus 2
ccacccugccaggcaaua

SEQ ID NO: 2926592 - RNA, 18 nt, Human T-lymphotropic virus 2
uaauaaccccgcccagca

SEQ ID NO: 2926593 - RNA, 16 nt, Human T-lymphotropic virus 2
cucccguaccuccucc

SEQ ID NO: 2926594 - RNA, 18 nt, Human T-lymphotropic virus 2
acuccaauacccaaagcc

SEQ ID NO: 2926595 - RNA, 21 nt, Human T-lymphotropic virus 2
uccggcccuuaccccaaagca

SEQ ID NO: 2926596 - RNA, 20 nt, Human T-lymphotropic virus 2
accucccagacgaccccagc

SEQ ID NO: 2926597 - RNA, 15 nt, Human T-lymphotropic virus 2
aaaccaucaacucac

SEQ ID NO: 2926598 - RNA, 21 nt, Human T-lymphotropic virus 2
gaugccuuucuucccucuccc

SEQ ID NO: 2926599 - RNA, 15 nt, Human T-lymphotropic virus 2
aacugcaacaacucc

SEQ ID NO: 2926600 - RNA, 19 nt, Human T-lymphotropic virus 2
uuauacaauacuccuccuu

SEQ ID NO: 2926601 - RNA, 22 nt, Human T-lymphotropic virus 2
cucauguauccguccuccagga

SEQ ID NO: 2926602 - RNA, 22 nt, Human T-lymphotropic virus 2
ggucaccuacuggccugcacca

SEQ ID NO: 2926603 - RNA, 17 nt, Human T-lymphotropic virus 2
ugacccauccacagucc

SEQ ID NO: 2926604 - RNA, 21 nt, Human T-lymphotropic virus 2
gccccuggcuuggcuccacac

SEQ ID NO: 2926605 - RNA, 11 nt, Human T-lymphotropic virus 2
cgccgucacug

SEQ ID NO: 2926606 - RNA, 13 nt, Human T-lymphotropic virus 2
ucccggggaagac

SEQ ID NO: 2926607 - RNA, 16 nt, Human T-lymphotropic virus 2
uggcuccacacccccc

SEQ ID NO: 2926608 - RNA, 13 nt, Human T-lymphotropic virus 2
accccagccccca

SEQ ID NO: 2926609 - RNA, 22 nt, Human T-lymphotropic virus 2
cagacuauccuucaacaggaca

SEQ ID NO: 2926610 - RNA, 13 nt, Human T-lymphotropic virus 2
cugucuccucuca

SEQ ID NO: 2926611 - RNA, 15 nt, Human T-lymphotropic virus 2
cuaccucuccuuggc

SEQ ID NO: 2926612 - RNA, 22 nt, Human T-lymphotropic virus 2
acugcugaugccuuucuucccu

SEQ ID NO: 2926613 - RNA, 16 nt, Human T-lymphotropic virus 2
cagcucuccucuccaa

SEQ ID NO: 2926614 - RNA, 12 nt, Human T-lymphotropic virus 2
ccaccaaugcca

SEQ ID NO: 2926615 - RNA, 19 nt, Human T-lymphotropic virus 2
gcuccccucaaaaggcagc

SEQ ID NO: 2926616 - RNA, 22 nt, Human T-lymphotropic virus 2
cccaagagcuuguaucacccuc

SEQ ID NO: 2926617 - RNA, 21 nt, Human T-lymphotropic virus 2
caucucccaccuuacccaggc

SEQ ID NO: 2926618 - RNA, 16 nt, Human T-lymphotropic virus 2
uccgccaacagucucc

SEQ ID NO: 2926619 - RNA, 22 nt, Human T-lymphotropic virus 2
agcgccuuaacguggcccuuga

SEQ ID NO: 2926620 - RNA, 13 nt, Human T-lymphotropic virus 2
uaccacccucacc

SEQ ID NO: 2926621 - RNA, 14 nt, Human T-lymphotropic virus 2
gagguggcucgcuc

SEQ ID NO: 2926622 - RNA, 19 nt, Human T-lymphotropic virus 2
ccuccuagggaaaccacuc

SEQ ID NO: 2926623 - RNA, 20 nt, Human T-lymphotropic virus 2
acccuccaggcggccuugcc

SEQ ID NO: 2926624 - RNA, 23 nt, Human T-lymphotropic virus 2
gccuacaucgacaugcccuccug

SEQ ID NO: 2926625 - RNA, 18 nt, Human T-lymphotropic virus 2
cgggacuguacccagcca

SEQ ID NO: 2926626 - RNA, 17 nt, Human T-lymphotropic virus 2
agcagcuuaacacacua

SEQ ID NO: 2926627 - RNA, 14 nt, Human T-lymphotropic virus 2
ccuaggagcauugu

SEQ ID NO: 2926628 - RNA, 22 nt, Human T-lymphotropic virus 2
acuacugaggaaaaaaacuccu

SEQ ID NO: 2926629 - RNA, 14 nt, Human T-lymphotropic virus 2
ucuccauuccccaa

SEQ ID NO: 2926630 - RNA, 19 nt, Human T-lymphotropic virus 2
acgaggauuagaccuccua

SEQ ID NO: 2926631 - RNA, 20 nt, Human T-lymphotropic virus 2
caccaagggaagccaagucc

SEQ ID NO: 2926632 - RNA, 19 nt, Human T-lymphotropic virus 2
uagccuaccgacagccuua

SEQ ID NO: 2926633 - RNA, 14 nt, Human T-lymphotropic virus 2
caaaccaccuccca

SEQ ID NO: 2926634 - RNA, 21 nt, Human T-lymphotropic virus 2
uccauaaccuucaccuucuau

SEQ ID NO: 2926635 - RNA, 21 nt, Human T-lymphotropic virus 2
cgcucccguaccuccuccggc

SEQ ID NO: 2926636 - RNA, 13 nt, Human T-lymphotropic virus 2
agagcaccaacuc

SEQ ID NO: 2926637 - RNA, 12 nt, Human T-lymphotropic virus 2
ccgucucaggug

SEQ ID NO: 2926638 - RNA, 17 nt, Human T-lymphotropic virus 2
gcgcagcaagggcuagg

SEQ ID NO: 2926639 - RNA, 21 nt, Human T-lymphotropic virus 2
accccuccuguuggaucuccc

SEQ ID NO: 2926640 - RNA, 19 nt, Human T-lymphotropic virus 2
gcucggcuagacucugccu

SEQ ID NO: 2926641 - RNA, 19 nt, Human T-lymphotropic virus 2
cauuccugaagccucuacc

SEQ ID NO: 2926642 - RNA, 15 nt, Human T-lymphotropic virus 2
ccccucccaccacuc

SEQ ID NO: 2926643 - RNA, 20 nt, Human T-lymphotropic virus 2
auccugucuccucucagccc

SEQ ID NO: 2926644 - RNA, 13 nt, Human T-lymphotropic virus 2
cacccccccugcc

SEQ ID NO: 2926645 - RNA, 22 nt, Human T-lymphotropic virus 2
accacggcccugacgucccucc

SEQ ID NO: 2926646 - RNA, 16 nt, Human T-lymphotropic virus 2
acgccgcccucuuggc

SEQ ID NO: 2926647 - RNA, 21 nt, Human T-lymphotropic virus 2
ucaagcaggaggucagcuccu

SEQ ID NO: 2926648 - RNA, 14 nt, Human T-lymphotropic virus 2
uuccaccucaggca

SEQ ID NO: 2926649 - RNA, 16 nt, Human T-lymphotropic virus 2
caagucuccccuagcg

SEQ ID NO: 2926650 - RNA, 23 nt, Human T-lymphotropic virus 2
acccauauaccauacaaccccac

SEQ ID NO: 2926651 - RNA, 19 nt, Human T-lymphotropic virus 2
ucacauugaaccauacuca

SEQ ID NO: 2926652 - RNA, 22 nt, Human T-lymphotropic virus 2
aaggcagcguacguucucuggg

SEQ ID NO: 2926653 - RNA, 19 nt, Human T-lymphotropic virus 2
acccuuacccacuuccccu

SEQ ID NO: 2926654 - RNA, 16 nt, Human T-lymphotropic virus 2
gaaccacgacuccuca

SEQ ID NO: 2926655 - RNA, 22 nt, Human T-lymphotropic virus 2
cgugcuugacacggcccccugc

SEQ ID NO: 2926656 - RNA, 11 nt, Human T-lymphotropic virus 2
aagacaaacaa

SEQ ID NO: 2926657 - RNA, 14 nt, Human T-lymphotropic virus 2
ugaaccucuccggg

SEQ ID NO: 2926658 - RNA, 13 nt, Human T-lymphotropic virus 2
cugcccgcuccuc

SEQ ID NO: 2926659 - RNA, 15 nt, Human T-lymphotropic virus 2
ccccaacaaaccucc

SEQ ID NO: 2926660 - RNA, 23 nt, Human T-lymphotropic virus 2
aucagcuccccucccucgccuuc

SEQ ID NO: 2926661 - RNA, 21 nt, Human T-lymphotropic virus 2
uacaucccccaggagcccccu

SEQ ID NO: 2926662 - RNA, 19 nt, Human T-lymphotropic virus 2
cccucggggaucagcuccc

SEQ ID NO: 2926663 - RNA, 17 nt, Human T-lymphotropic virus 2
cacgccgcaacagacca

SEQ ID NO: 2926664 - RNA, 11 nt, Human T-lymphotropic virus 2
auccagccucu

SEQ ID NO: 2926665 - RNA, 19 nt, Human T-lymphotropic virus 2
cucccgagccagccaccca

SEQ ID NO: 2926666 - RNA, 21 nt, Human T-lymphotropic virus 2
ggggccucuugcccaaccaca

SEQ ID NO: 2926667 - RNA, 14 nt, Human T-lymphotropic virus 2
gucucccccaaggu

SEQ ID NO: 2926668 - RNA, 23 nt, Human T-lymphotropic virus 2
cucacuggaaaagggacugccca

SEQ ID NO: 2926669 - RNA, 14 nt, Human T-lymphotropic virus 2
cacccucucccccg

SEQ ID NO: 2926670 - RNA, 21 nt, Human T-lymphotropic virus 2
ccggccucggcaccuccugaa

SEQ ID NO: 2926671 - RNA, 13 nt, Human T-lymphotropic virus 2
gugagggcucccu

SEQ ID NO: 2926672 - RNA, 16 nt, Human T-lymphotropic virus 2
cucccgcugcuccucc

SEQ ID NO: 2926673 - RNA, 18 nt, Human T-lymphotropic virus 2
aggucagaccgucucaca

SEQ ID NO: 2926674 - RNA, 13 nt, Human T-lymphotropic virus 2
ccuaucucuggcu

SEQ ID NO: 2926675 - RNA, 20 nt, Human T-lymphotropic virus 2
uccccaacaaaccuccuccc

SEQ ID NO: 2926676 - RNA, 13 nt, Human T-lymphotropic virus 2
accccucccacca

SEQ ID NO: 2926677 - RNA, 13 nt, Human T-lymphotropic virus 2
agccuaggcccuc

SEQ ID NO: 2926678 - RNA, 22 nt, Human T-lymphotropic virus 2
cgaacaacaauuagcagccguc

SEQ ID NO: 2926679 - RNA, 21 nt, Human T-lymphotropic virus 2
agccuaccgacagccuuaccc

SEQ ID NO: 2926680 - RNA, 20 nt, Human T-lymphotropic virus 2
uacaccucccaacccuucuc

SEQ ID NO: 2926681 - RNA, 13 nt, Human T-lymphotropic virus 2
ugagcgccuccag

SEQ ID NO: 2926682 - RNA, 17 nt, Human T-lymphotropic virus 2
accuucccccaccuccc

SEQ ID NO: 2926683 - RNA, 15 nt, Human T-lymphotropic virus 2
cuccacccugccagg

SEQ ID NO: 2926684 - RNA, 17 nt, Human T-lymphotropic virus 2
cgucucccggccucggc

SEQ ID NO: 2926685 - RNA, 22 nt, Human T-lymphotropic virus 2
gucacugaaaacgaaaccucaa

SEQ ID NO: 2926686 - RNA, 13 nt, Human T-lymphotropic virus 2
gcgccuccaggcc

SEQ ID NO: 2926687 - RNA, 11 nt, Human T-lymphotropic virus 2
ucagucucaca

SEQ ID NO: 2926688 - RNA, 17 nt, Human T-lymphotropic virus 2
uacaacaacucucccag

SEQ ID NO: 2926689 - RNA, 14 nt, Human T-lymphotropic virus 2
uccacuagcccagc

SEQ ID NO: 2926690 - RNA, 13 nt, Human T-lymphotropic virus 2
cgcaaggacaguu

SEQ ID NO: 2926691 - RNA, 20 nt, Human T-lymphotropic virus 2
ccaccucaggcacuacugag

SEQ ID NO: 2926692 - RNA, 18 nt, Human T-lymphotropic virus 2
acaccaagggaagccaag

SEQ ID NO: 2926693 - RNA, 20 nt, Human T-lymphotropic virus 2
cuucgaaaaauucgaaacca

SEQ ID NO: 2926694 - RNA, 19 nt, Human T-lymphotropic virus 2
caagauccuucucacugga

SEQ ID NO: 2926695 - RNA, 22 nt, Human T-lymphotropic virus 2
ccaugucauauucugccacccc

SEQ ID NO: 2926696 - RNA, 12 nt, Human T-lymphotropic virus 2
aucccucgccuc

SEQ ID NO: 2926697 - RNA, 22 nt, Human T-lymphotropic virus 2
cuaacccccuccacguccugga

SEQ ID NO: 2926698 - RNA, 17 nt, Human T-lymphotropic virus 2
ccccugacgccccaagg

SEQ ID NO: 2926699 - RNA, 22 nt, Human T-lymphotropic virus 2
ccuccuguuggaucucccuucc

SEQ ID NO: 2926700 - RNA, 15 nt, Human T-lymphotropic virus 2
uacucaggaccaggc

SEQ ID NO: 2926701 - RNA, 23 nt, Human T-lymphotropic virus 2
ggcucccuguauccagacugccu

SEQ ID NO: 2926702 - RNA, 22 nt, Human T-lymphotropic virus 2
gccauuacuaccacccucaccu

SEQ ID NO: 2926703 - RNA, 21 nt, Human T-lymphotropic virus 2
ccuuagguagucgcuccccga

SEQ ID NO: 2926704 - RNA, 17 nt, Human T-lymphotropic virus 2
cgaacaccuucccccac

SEQ ID NO: 2926705 - RNA, 22 nt, Human T-lymphotropic virus 2
ucucccccaagguuccaccugc

SEQ ID NO: 2926706 - RNA, 19 nt, Human T-lymphotropic virus 2
acuguccuaaccuuccccu

SEQ ID NO: 2926707 - RNA, 13 nt, Human T-lymphotropic virus 2
gagacgccuuccg

SEQ ID NO: 2926708 - RNA, 12 nt, Human T-lymphotropic virus 2
uacccagccacg

SEQ ID NO: 2926709 - RNA, 12 nt, Human T-lymphotropic virus 2
ccaccagcucag

SEQ ID NO: 2926710 - RNA, 22 nt, Human T-lymphotropic virus 2
ucccucgcucccguaccuccuc

SEQ ID NO: 2926711 - RNA, 18 nt, Human T-lymphotropic virus 2
cuucuauaccucccagac

SEQ ID NO: 2926712 - RNA, 20 nt, Human T-lymphotropic virus 2
cagccccuguagcccaaccc

SEQ ID NO: 2926713 - RNA, 20 nt, Human T-lymphotropic virus 2
ggcaggcccgcccuaggagc

SEQ ID NO: 2926714 - RNA, 21 nt, Human T-lymphotropic virus 2
uccagccucucauccuggcau

SEQ ID NO: 2926715 - RNA, 20 nt, Human T-lymphotropic virus 2
uaccagcuuuccccacccau

SEQ ID NO: 2926716 - RNA, 16 nt, Human T-lymphotropic virus 2
ucuccaauaccuuauc

SEQ ID NO: 2926717 - RNA, 19 nt, Human T-lymphotropic virus 2
ccuagcgcccccgccgccc

SEQ ID NO: 2926718 - RNA, 16 nt, Human T-lymphotropic virus 2
uggcugcuuucuccac

SEQ ID NO: 2926719 - RNA, 20 nt, Human T-lymphotropic virus 2
cauuacuaccacccucaccu

SEQ ID NO: 2926720 - RNA, 17 nt, Human T-lymphotropic virus 2
acccccaacaucuccau

SEQ ID NO: 2926721 - RNA, 19 nt, Human T-lymphotropic virus 2
cuccucugcucuuggcagc

SEQ ID NO: 2926722 - RNA, 21 nt, Human T-lymphotropic virus 2
aucucgauacucccacucauc

SEQ ID NO: 2926723 - RNA, 22 nt, Human T-lymphotropic virus 2
gaagacucucuuacaccuccca

SEQ ID NO: 2926724 - RNA, 23 nt, Human T-lymphotropic virus 2
ugccccuacuugggcugccaagc

SEQ ID NO: 2926725 - RNA, 14 nt, Human T-lymphotropic virus 2
cauacucaggacca

SEQ ID NO: 2926726 - RNA, 14 nt, Human T-lymphotropic virus 2
accucagccuaccc

SEQ ID NO: 2926727 - RNA, 13 nt, Human T-lymphotropic virus 2
uauacccuacaac

SEQ ID NO: 2926728 - RNA, 22 nt, Human T-lymphotropic virus 2
cuacaacauuauggccagcucu

SEQ ID NO: 2926729 - RNA, 23 nt, Human T-lymphotropic virus 2
cuccuccaucccaacccuucccu

SEQ ID NO: 2926730 - RNA, 14 nt, Human T-lymphotropic virus 2
uucuccaggaacca

SEQ ID NO: 2926731 - RNA, 14 nt, Human T-lymphotropic virus 2
uccuccgccaccuc

SEQ ID NO: 2926732 - RNA, 22 nt, Human T-lymphotropic virus 2
uguccagagcaccaacucaccu

SEQ ID NO: 2926733 - RNA, 21 nt, Human T-lymphotropic virus 2
guccagagcaccaacucaccu

SEQ ID NO: 2926734 - RNA, 14 nt, Human T-lymphotropic virus 2
cucccaccuuaccc

SEQ ID NO: 2926735 - RNA, 20 nt, Human T-lymphotropic virus 2
cugaaaaacaaggcucugac

SEQ ID NO: 2926736 - RNA, 14 nt, Human T-lymphotropic virus 2
cauaaccuuggcag

SEQ ID NO: 2926737 - RNA, 19 nt, Human T-lymphotropic virus 2
auuacaaguuauccuagga

SEQ ID NO: 2926738 - RNA, 14 nt, Human T-lymphotropic virus 2
acgccccaaggccu

SEQ ID NO: 2926739 - RNA, 22 nt, Human T-lymphotropic virus 2
cuacaucgacaugcccuccugg

SEQ ID NO: 2926740 - RNA, 13 nt, Human T-lymphotropic virus 2
ccguccuccagga

SEQ ID NO: 2926741 - RNA, 19 nt, Human T-lymphotropic virus 2
cccugcccgcuccuccauc

SEQ ID NO: 2926742 - RNA, 18 nt, Human T-lymphotropic virus 2
gcucggcuagacucugcc

SEQ ID NO: 2926743 - RNA, 20 nt, Human T-lymphotropic virus 2
accagaugucagacucgccu

SEQ ID NO: 2926744 - RNA, 23 nt, Human T-lymphotropic virus 2
caucccuccuaucuacucucuca

SEQ ID NO: 2926745 - RNA, 18 nt, Human T-lymphotropic virus 2
guacaggacuucuccccu

SEQ ID NO: 2926746 - RNA, 19 nt, Human T-lymphotropic virus 2
cagaugucagacucgccuc

SEQ ID NO: 2926747 - RNA, 13 nt, Human T-lymphotropic virus 2
ugcugccaagcca

SEQ ID NO: 2926748 - RNA, 14 nt, Human T-lymphotropic virus 2
uggccaccugucca

SEQ ID NO: 2926749 - RNA, 22 nt, Human T-lymphotropic virus 2
uguuuggccccuguauccuccg

SEQ ID NO: 2926750 - RNA, 14 nt, Human T-lymphotropic virus 2
accuacauucccuc

SEQ ID NO: 2926751 - RNA, 20 nt, Human T-lymphotropic virus 2
cuuccauaaccuucaccuuc

SEQ ID NO: 2926752 - RNA, 17 nt, Human T-lymphotropic virus 2
uaccuacauucccucgc

SEQ ID NO: 2926753 - RNA, 21 nt, Human T-lymphotropic virus 2
cuucucuaagugcggcuccuc

SEQ ID NO: 2926754 - RNA, 22 nt, Human T-lymphotropic virus 2
auacuuuuagccagccccacca

SEQ ID NO: 2926755 - RNA, 23 nt, Human T-lymphotropic virus 2
aacuucuauacaaaauguuccua

SEQ ID NO: 2926756 - RNA, 14 nt, Human T-lymphotropic virus 2
aacuccccucaucc

SEQ ID NO: 2926757 - RNA, 18 nt, Human T-lymphotropic virus 2
ccaucaaaacccaggagu

SEQ ID NO: 2926758 - RNA, 16 nt, Human T-lymphotropic virus 2
auuuucacccucuccc

SEQ ID NO: 2926759 - RNA, 17 nt, Human T-lymphotropic virus 2
gguucgucccccuacca

SEQ ID NO: 2926760 - RNA, 14 nt, Human T-lymphotropic virus 2
gcccccucagcuca

SEQ ID NO: 2926761 - RNA, 19 nt, Human T-lymphotropic virus 2
ccaugucauauucugccac

SEQ ID NO: 2926762 - RNA, 18 nt, Human T-lymphotropic virus 2
cuggucuccaaggcccug

SEQ ID NO: 2926763 - RNA, 18 nt, Human T-lymphotropic virus 2
guagucgcuccccgaggg

SEQ ID NO: 2926764 - RNA, 18 nt, Human T-lymphotropic virus 2
gggcuucuauaccuccca

SEQ ID NO: 2926765 - RNA, 15 nt, Human T-lymphotropic virus 2
cagaccaccaacacc

SEQ ID NO: 2926766 - RNA, 16 nt, Human T-lymphotropic virus 2
caucuacaccaccugg

SEQ ID NO: 2926767 - RNA, 13 nt, Human T-lymphotropic virus 2
cuaccacuccagc

SEQ ID NO: 2926768 - RNA, 17 nt, Human T-lymphotropic virus 2
cagccccacccucuucg

SEQ ID NO: 2926769 - RNA, 23 nt, Human T-lymphotropic virus 2
ggcuuccaguaaaagccuucucc

SEQ ID NO: 2926770 - RNA, 16 nt, Human T-lymphotropic virus 2
cacccaggaagucagc

SEQ ID NO: 2926771 - RNA, 21 nt, Human T-lymphotropic virus 2
cacucauguauccguccucca

SEQ ID NO: 2926772 - RNA, 20 nt, Human T-lymphotropic virus 2
uccaagugucggcauccuca

SEQ ID NO: 2926773 - RNA, 15 nt, Human T-lymphotropic virus 2
acaaaaccaaggucc

SEQ ID NO: 2926774 - RNA, 22 nt, Human T-lymphotropic virus 2
ccaccacuccugucucccccaa

SEQ ID NO: 2926775 - RNA, 14 nt, Human T-lymphotropic virus 2
caacaacucuccca

SEQ ID NO: 2926776 - RNA, 17 nt, Human T-lymphotropic virus 2
cccaucaaaacccagga

SEQ ID NO: 2926777 - RNA, 19 nt, Human T-lymphotropic virus 2
accccuacuauucccauaa

SEQ ID NO: 2926778 - RNA, 22 nt, Human T-lymphotropic virus 2
cugacgucccuccccccuagga

SEQ ID NO: 2926779 - RNA, 13 nt, Human T-lymphotropic virus 2
caguaaaagccuu

SEQ ID NO: 2926780 - RNA, 11 nt, Human T-lymphotropic virus 2
accuuggcagc

SEQ ID NO: 2926781 - RNA, 20 nt, Human T-lymphotropic virus 2
ccgcauacacgggccccguc

SEQ ID NO: 2926782 - RNA, 18 nt, Human T-lymphotropic virus 2
ccuaccacuccagccccu

SEQ ID NO: 2926783 - RNA, 16 nt, Human T-lymphotropic virus 2
uacaugccauucaaca

SEQ ID NO: 2926784 - RNA, 18 nt, Human T-lymphotropic virus 2
ccauguccgcagccacac

SEQ ID NO: 2926785 - RNA, 16 nt, Human T-lymphotropic virus 2
uacaaccccaccagcu

SEQ ID NO: 2926786 - RNA, 18 nt, Human T-lymphotropic virus 2
acccauuccugaagccuc

SEQ ID NO: 2926787 - RNA, 17 nt, Human T-lymphotropic virus 2
caggauuuggacagagc

SEQ ID NO: 2926788 - RNA, 18 nt, Human T-lymphotropic virus 2
acucucuuacaccuccca

SEQ ID NO: 2926789 - RNA, 14 nt, Human T-lymphotropic virus 2
caacaaugccaggg

SEQ ID NO: 2926790 - RNA, 15 nt, Human T-lymphotropic virus 2
acacauauucuugcc

SEQ ID NO: 2926791 - RNA, 21 nt, Human T-lymphotropic virus 2
ucacgauugguaucuccuccu

SEQ ID NO: 2926792 - RNA, 22 nt, Human T-lymphotropic virus 2
acaguccuccacuaccacccau

SEQ ID NO: 2926793 - RNA, 17 nt, Human T-lymphotropic virus 2
aguccuauacacuccaa

SEQ ID NO: 2926794 - RNA, 20 nt, Human T-lymphotropic virus 2
ucgagcucggcugccccuua

SEQ ID NO: 2926795 - RNA, 13 nt, Human T-lymphotropic virus 2
cucagccuccacc

SEQ ID NO: 2926796 - RNA, 16 nt, Human T-lymphotropic virus 2
aaaacacaacaaaccc

SEQ ID NO: 2926797 - RNA, 24 nt, Human T-lymphotropic virus 2
gcuuuccccaacuccaauacccaa

SEQ ID NO: 2926798 - RNA, 12 nt, Human T-lymphotropic virus 2
aguauucccuua

SEQ ID NO: 2926799 - RNA, 12 nt, Human T-lymphotropic virus 2
cacuccacauua

SEQ ID NO: 2926800 - RNA, 20 nt, Human T-lymphotropic virus 2
uccuucucacuggaaaaggg

SEQ ID NO: 2926801 - RNA, 21 nt, Human T-lymphotropic virus 2
cuccuuccauaaccuucaccu

SEQ ID NO: 2926802 - RNA, 17 nt, Human T-lymphotropic virus 2
ucagcccauuucccagg

SEQ ID NO: 2926803 - RNA, 13 nt, Human T-lymphotropic virus 2
ugaauuccuccau

SEQ ID NO: 2926804 - RNA, 19 nt, Human T-lymphotropic virus 2
ggacacacuaacagccccc

SEQ ID NO: 2926805 - RNA, 12 nt, Human T-lymphotropic virus 2
ucucccuuccac

SEQ ID NO: 2926806 - RNA, 17 nt, Human T-lymphotropic virus 2
cuuuccccacccaugac

SEQ ID NO: 2926807 - RNA, 14 nt, Human T-lymphotropic virus 2
cuuaccccaaagca

SEQ ID NO: 2926808 - RNA, 13 nt, Human T-lymphotropic virus 2
aaucuuuccacca

SEQ ID NO: 2926809 - RNA, 18 nt, Human T-lymphotropic virus 2
cagccacgccccccuccu

SEQ ID NO: 2926810 - RNA, 17 nt, Human T-lymphotropic virus 2
gcggcuccuccaugacc

SEQ ID NO: 2926811 - RNA, 19 nt, Human T-lymphotropic virus 2
gcgccgcucccgcuccuca

SEQ ID NO: 2926812 - RNA, 19 nt, Human T-lymphotropic virus 2
uccugaacugcuccuccca

SEQ ID NO: 2926813 - RNA, 16 nt, Human T-lymphotropic virus 2
cgacuuccugaggaac

SEQ ID NO: 2926814 - RNA, 20 nt, Human T-lymphotropic virus 2
cccgauggcaaauccaccac

SEQ ID NO: 2926815 - RNA, 13 nt, Human T-lymphotropic virus 2
ucugcgccgcucc

SEQ ID NO: 2926816 - RNA, 22 nt, Human T-lymphotropic virus 2
cccucagcucauaggcccuggc

SEQ ID NO: 2926817 - RNA, 14 nt, Human T-lymphotropic virus 2
gccccaaggccucc

SEQ ID NO: 2926818 - RNA, 15 nt, Human T-lymphotropic virus 2
caucuaccuccacca

SEQ ID NO: 2926819 - RNA, 15 nt, Human T-lymphotropic virus 2
cuuauucccacauug

SEQ ID NO: 2926820 - RNA, 19 nt, Human T-lymphotropic virus 2
cuguauccuccgccaaauc

SEQ ID NO: 2926821 - RNA, 20 nt, Human T-lymphotropic virus 2
cguggauagauccagccucu

SEQ ID NO: 2926822 - RNA, 20 nt, Human T-lymphotropic virus 2
ucccccauugguccaugacu

SEQ ID NO: 2926823 - RNA, 16 nt, Human T-lymphotropic virus 2
acugcagggcaagacc

SEQ ID NO: 2926824 - RNA, 13 nt, Human T-lymphotropic virus 2
ucuccuccuacca

SEQ ID NO: 2926825 - RNA, 15 nt, Human T-lymphotropic virus 2
accuuaauucccuaa

SEQ ID NO: 2926826 - RNA, 18 nt, Human T-lymphotropic virus 2
caggaacagcucuccaga

SEQ ID NO: 2926827 - RNA, 13 nt, Human T-lymphotropic virus 2
uccuccuuccaua

SEQ ID NO: 2926828 - RNA, 15 nt, Human T-lymphotropic virus 2
cgccgcccucuuggc

SEQ ID NO: 2926829 - RNA, 16 nt, Human T-lymphotropic virus 2
caccuucccccaccuc

SEQ ID NO: 2926830 - RNA, 17 nt, Human T-lymphotropic virus 2
uacccacuuccccuagc

SEQ ID NO: 2926831 - RNA, 11 nt, Human T-lymphotropic virus 2
cagcccccuug

SEQ ID NO: 2926832 - RNA, 20 nt, Human T-lymphotropic virus 2
gucugcacguggaaccucga

SEQ ID NO: 2926833 - RNA, 14 nt, Human T-lymphotropic virus 2
gccgucacugaaaa

SEQ ID NO: 2926834 - RNA, 14 nt, Human T-lymphotropic virus 2
acugcuccucccaa

SEQ ID NO: 2926835 - RNA, 11 nt, Human T-lymphotropic virus 2
acaaagaaugc

SEQ ID NO: 2926836 - RNA, 14 nt, Human T-lymphotropic virus 2
caccuacagaccau

SEQ ID NO: 2926837 - RNA, 20 nt, Human T-lymphotropic virus 2
ccucugcucuuggcagcccc

SEQ ID NO: 2926838 - RNA, 22 nt, Human T-lymphotropic virus 2
caggucgagcucggcugccccu

SEQ ID NO: 2926839 - RNA, 15 nt, Human T-lymphotropic virus 2
cuuaucaacccagaa

SEQ ID NO: 2926840 - RNA, 18 nt, Human T-lymphotropic virus 2
uggccccuguauccuccg

SEQ ID NO: 2926841 - RNA, 16 nt, Human T-lymphotropic virus 2
accuucccccaccucc

SEQ ID NO: 2926842 - RNA, 14 nt, Human T-lymphotropic virus 2
cagcuaacccucca

SEQ ID NO: 2926843 - RNA, 19 nt, Human T-lymphotropic virus 2
ccgagccagccacccaggg

SEQ ID NO: 2926844 - RNA, 17 nt, Human T-lymphotropic virus 2
cccacuuccccuagcgc

SEQ ID NO: 2926845 - RNA, 16 nt, Human T-lymphotropic virus 2
acugccguggccgccu

SEQ ID NO: 2926846 - RNA, 13 nt, Human T-lymphotropic virus 2
acccccugcccau

SEQ ID NO: 2926847 - RNA, 17 nt, Human T-lymphotropic virus 2
gccucccgagccagcca

SEQ ID NO: 2926848 - RNA, 18 nt, Human T-lymphotropic virus 2
uccuacaaugacccuugc

SEQ ID NO: 2926849 - RNA, 15 nt, Human T-lymphotropic virus 2
uuaugggacaaacac

SEQ ID NO: 2926850 - RNA, 15 nt, Human T-lymphotropic virus 2
cuucccccaccuccc

SEQ ID NO: 2926851 - RNA, 17 nt, Human T-lymphotropic virus 2
agguccuuaccccuccc

SEQ ID NO: 2926852 - RNA, 21 nt, Human T-lymphotropic virus 2
gucacugaaaacgaaaccuca

SEQ ID NO: 2926853 - RNA, 20 nt, Human T-lymphotropic virus 2
agcucugccaaucuuuccac

SEQ ID NO: 2926854 - RNA, 13 nt, Human T-lymphotropic virus 2
cauuauccucccc

SEQ ID NO: 2926855 - RNA, 15 nt, Human T-lymphotropic virus 2
ccugucuccucucag

SEQ ID NO: 2926856 - RNA, 18 nt, Human T-lymphotropic virus 2
cccgcugcuccuccgcca

SEQ ID NO: 2926857 - RNA, 22 nt, Human T-lymphotropic virus 2
uucgaaaccaaagccuuccauc

SEQ ID NO: 2926858 - RNA, 22 nt, Human T-lymphotropic virus 2
agcaagggcuagggcuuccuga

SEQ ID NO: 2926859 - RNA, 21 nt, Human T-lymphotropic virus 2
cuacaaugacccuugcucgcu

SEQ ID NO: 2926860 - RNA, 23 nt, Human T-lymphotropic virus 2
gccaucuuuaguaguucaguccu

SEQ ID NO: 2926861 - RNA, 19 nt, Human T-lymphotropic virus 2
ucccucaccgacccucugg

SEQ ID NO: 2926862 - RNA, 14 nt, Human T-lymphotropic virus 2
uccacauuaacaca

SEQ ID NO: 2926863 - RNA, 23 nt, Human T-lymphotropic virus 2
acccucggggaucagcuccccuc

SEQ ID NO: 2926864 - RNA, 15 nt, Human T-lymphotropic virus 2
gacaucucccaccuu

SEQ ID NO: 2926865 - RNA, 18 nt, Human T-lymphotropic virus 2
cuccauuauccucccccc

SEQ ID NO: 2926866 - RNA, 17 nt, Human T-lymphotropic virus 2
ccuccuaccacuccagc

SEQ ID NO: 2926867 - RNA, 18 nt, Human T-lymphotropic virus 2
gccucucccuggucuccu

SEQ ID NO: 2926868 - RNA, 18 nt, Human T-lymphotropic virus 2
cauguauccguccuccag

SEQ ID NO: 2926869 - RNA, 22 nt, Human T-lymphotropic virus 2
aaccuuccccuagacaaugcca

SEQ ID NO: 2926870 - RNA, 18 nt, Human T-lymphotropic virus 2
uccccuaucacuccaucu

SEQ ID NO: 2926871 - RNA, 22 nt, Human T-lymphotropic virus 2
gcuccacaccccccacccuccg

SEQ ID NO: 2926872 - RNA, 23 nt, Human T-lymphotropic virus 2
uuggcuccacaccccccacccuc

SEQ ID NO: 2926873 - RNA, 12 nt, Human T-lymphotropic virus 2
cccuaucacucc

SEQ ID NO: 2926874 - RNA, 14 nt, Human T-lymphotropic virus 2
uccuuuccuccugc

SEQ ID NO: 2926875 - RNA, 14 nt, Human T-lymphotropic virus 2
caccccccacccuc

SEQ ID NO: 2926876 - RNA, 15 nt, Human T-lymphotropic virus 2
ucccguaccuccucc

SEQ ID NO: 2926877 - RNA, 19 nt, Human T-lymphotropic virus 2
ccuaccauugacccaucca

SEQ ID NO: 2926878 - RNA, 20 nt, Human T-lymphotropic virus 2
accagccauacuucgccuuc

SEQ ID NO: 2926879 - RNA, 17 nt, Human T-lymphotropic virus 2
ugccaagccauggccuu

SEQ ID NO: 2926880 - RNA, 18 nt, Human T-lymphotropic virus 2
ccucuaacccccgcucac

SEQ ID NO: 2926881 - RNA, 12 nt, Human T-lymphotropic virus 2
cccgucuccagu

SEQ ID NO: 2926882 - RNA, 12 nt, Human T-lymphotropic virus 2
cccuucuccagg

SEQ ID NO: 2926883 - RNA, 20 nt, Human T-lymphotropic virus 2
ccaagcaaaauuggccccug

SEQ ID NO: 2926884 - RNA, 19 nt, Human T-lymphotropic virus 2
accacgcauggccuuccaa

SEQ ID NO: 2926885 - RNA, 15 nt, Human T-lymphotropic virus 2
cugaaccucuccggg

SEQ ID NO: 2926886 - RNA, 18 nt, Human T-lymphotropic virus 2
acccucggggaucagcuc

SEQ ID NO: 2926887 - RNA, 20 nt, Human T-lymphotropic virus 2
uggccuuccaauuucccagg

SEQ ID NO: 2926888 - RNA, 18 nt, Human T-lymphotropic virus 2
aucccucgccuccccucc

SEQ ID NO: 2926889 - RNA, 18 nt, Human T-lymphotropic virus 2
cucgguuccucuccaggg

SEQ ID NO: 2926890 - RNA, 16 nt, Human T-lymphotropic virus 2
gguggcucgcucccuc

SEQ ID NO: 2926891 - RNA, 12 nt, Human T-lymphotropic virus 2
cucgcaccugcu

SEQ ID NO: 2926892 - RNA, 22 nt, Human T-lymphotropic virus 2
aggcccccccccacacagcccu

SEQ ID NO: 2926893 - RNA, 15 nt, Human T-lymphotropic virus 2
ccgaugcacacucac

SEQ ID NO: 2926894 - RNA, 19 nt, Human T-lymphotropic virus 2
ccccaagguuccaccugcc

SEQ ID NO: 2926895 - RNA, 19 nt, Human T-lymphotropic virus 2
uccacaccccccacccucc

SEQ ID NO: 2926896 - RNA, 19 nt, Human T-lymphotropic virus 2
cuacaacauaacugccgug

SEQ ID NO: 2926897 - RNA, 19 nt, Human T-lymphotropic virus 2
aacaccuacaaucccuaua

SEQ ID NO: 2926898 - RNA, 19 nt, Human T-lymphotropic virus 2
augguaaauggagguucau

SEQ ID NO: 2926899 - RNA, 20 nt, Human T-lymphotropic virus 2
gccguccucaaccccaugag

SEQ ID NO: 2926900 - RNA, 13 nt, Human T-lymphotropic virus 2
aguccucccuauu

SEQ ID NO: 2926901 - RNA, 17 nt, Human T-lymphotropic virus 2
aagacuuauuccuuaua

SEQ ID NO: 2926902 - RNA, 20 nt, Human T-lymphotropic virus 2
ugccauuacuaccacccuca

SEQ ID NO: 2926903 - RNA, 17 nt, Human T-lymphotropic virus 2
gccaauuuucacccucu

SEQ ID NO: 2926904 - RNA, 15 nt, Human T-lymphotropic virus 2
aacaggcucccuauc

SEQ ID NO: 2926905 - RNA, 17 nt, Human T-lymphotropic virus 2
aacccaggaguccuaua

SEQ ID NO: 2926906 - RNA, 21 nt, Human T-lymphotropic virus 2
aacccgugagggcucccugua

SEQ ID NO: 2926907 - RNA, 18 nt, Human T-lymphotropic virus 2
aaccguaguaugccuaua

SEQ ID NO: 2926908 - RNA, 22 nt, Human T-lymphotropic virus 2
aaccucgaccuuaauucccuaa

SEQ ID NO: 2926909 - RNA, 19 nt, Human T-lymphotropic virus 2
acaacaacuccaugcguua

SEQ ID NO: 2926910 - RNA, 20 nt, Human T-lymphotropic virus 2
ccacagcgguuacaaaaccg

SEQ ID NO: 2926911 - RNA, 13 nt, Human T-lymphotropic virus 2
uguaucacccuca

SEQ ID NO: 2926912 - RNA, 20 nt, Human T-lymphotropic virus 2
uaccgggacccaagagcuug

SEQ ID NO: 2926913 - RNA, 20 nt, Human T-lymphotropic virus 2
uauccagcugaccuuacaga

SEQ ID NO: 2926914 - RNA, 12 nt, Human T-lymphotropic virus 2
gccccacccucu

SEQ ID NO: 2926915 - RNA, 20 nt, Human T-lymphotropic virus 2
cugcaugguuugcguggaua

SEQ ID NO: 2926916 - RNA, 19 nt, Human T-lymphotropic virus 2
ccccuguauccuccgccaa

SEQ ID NO: 2926917 - RNA, 16 nt, Human
cucuccgaccagacac

SEQ ID NO: 2926918 - RNA, 20 nt, Human
cucuccuccuuuucacaguu

SEQ ID NO: 2926919 - RNA, 13 nt, Human
cucuccuccuuuu

SEQ ID NO: 2926920 - RNA, 13 nt, Human
cucucccuuggau

SEQ ID NO: 2926921 - RNA, 19 nt, Human
cucucuggccuucggccuc

SEQ ID NO: 2926922 - RNA, 17 nt, Human
cucucuggccuucggcc

SEQ ID NO: 2926923 - RNA, 10 nt, Human
cucuccucug

SEQ ID NO: 2926924 - RNA, 16 nt, Human
cucugcacaagcugca

SEQ ID NO: 2926925 - RNA, 23 nt, Human
cucgguguggagaagcggcuggc

SEQ ID NO: 2926926 - RNA, 11 nt, Human
cucggugccuu

SEQ ID NO: 2926927 - RNA, 24 nt, Human
cuccuuuucacaguucucuccuuc

SEQ ID NO: 2926928 - RNA, 23 nt, Human
cuccuuugugaggaagccgcugg

SEQ ID NO: 2926929 - RNA, 16 nt, Human
cuccuuuagcgcccag

SEQ ID NO: 2926930 - RNA, 17 nt, Human
cuccuuuagcgcccagu

SEQ ID NO: 2926931 - RNA, 22 nt, Human
cuccuagccugugccucuggga

SEQ ID NO: 2926932 - RNA, 22 nt, Human
cuccuuuagcgcccaguugggu

SEQ ID NO: 2926933 - RNA, 14 nt, Human
cucccaccucagcc

SEQ ID NO: 2926934 - RNA, 16 nt, Human
cucccaccucagccuc

SEQ ID NO: 2926935 - RNA, 17 nt, Human
cucccaccucagccucc

SEQ ID NO: 2926936 - RNA, 13 nt, Human
cucccaccucagc

SEQ ID NO: 2926937 - RNA, 11 nt, Human
cucccagccag

SEQ ID NO: 2926938 - RNA, 13 nt, Human
cucccagccaggc

SEQ ID NO: 2926939 - RNA, 14 nt, Human
cucccagccaggcc

SEQ ID NO: 2926940 - RNA, 16 nt, Human
cucccagccaggcccu

SEQ ID NO: 2926941 - RNA, 18 nt, Human
cuccaggugcacaagcuc

SEQ ID NO: 2926942 - RNA, 20 nt, Human
cuccaggugcacaagcucca

SEQ ID NO: 2926943 - RNA, 19 nt, Human
cuccaggugcacaagcucc

SEQ ID NO: 2926944 - RNA, 21 nt, Human
cuccagugagacagcucugca

SEQ ID NO: 2926945 - RNA, 22 nt, Human
cuccaggugcacaagcuccaag

SEQ ID NO: 2926946 - RNA, 23 nt, Human
cuccaggcuguaucccaugagcc

SEQ ID NO: 2926947 - RNA, 22 nt, Human
cuccaggcuguaucccaugagc

SEQ ID NO: 2926948 - RNA, 21 nt, Human
cuccagaauuucccaaagcag

SEQ ID NO: 2926949 - RNA, 16 nt, Human
cucagaaucucaaaua

SEQ ID NO: 2926950 - RNA, 17 nt, Human
cucagaaucucaaauaa

SEQ ID NO: 2926951 - RNA, 16 nt, Human
cuccagacacaugucc

SEQ ID NO: 2926952 - RNA, 11 nt, Human
cuccagacaca

SEQ ID NO: 2926953 - RNA, 22 nt, Human
cuccagaauuucccaaagcagu

SEQ ID NO: 2926954 - RNA, 15 nt, Human
cucccucuuucccuc

SEQ ID NO: 2926955 - RNA, 16 nt, Human
cucccucccucuuucc

SEQ ID NO: 2926956 - RNA, 19 nt, Human
cucccucuuucccucccuu

SEQ ID NO: 2926957 - RNA, 21 nt, Human
cuccgcuuucuacccagcgag

SEQ ID NO: 2926958 - RNA, 20 nt, Human
cuccgcuuucuacccagcga

SEQ ID NO: 2926959 - RNA, 14 nt, Human
cuccgucaacucau

SEQ ID NO: 2926960 - RNA, 22 nt, Human
cuccgcuuucuacccagcgagc

SEQ ID NO: 2926961 - RNA, 18 nt, Human
cucugcacaagcugcacc

SEQ ID NO: 2926962 - RNA, 17 nt, Human
cucugcacaagcugcac

SEQ ID NO: 2926963 - RNA, 23 nt, Human
cucuugagccuugaacuuugacc

SEQ ID NO: 2926964 - RNA, 16 nt, Human
cucuugagccugggag

SEQ ID NO: 2926965 - RNA, 15 nt, Human
cucuugagccuggga

SEQ ID NO: 2926966 - RNA, 22 nt, Human
cucuugauucauaaugacuuaa

SEQ ID NO: 2926967 - RNA, 14 nt, Human
cucuugagccuggg

SEQ ID NO: 2926968 - RNA, 13 nt, Human
cucuugagccugg

SEQ ID NO: 2926969 - RNA, 24 nt, Human
cucuugauucauaaugacuuaagc

SEQ ID NO: 2926970 - RNA, 13 nt, Human
cugaaagaggaau

SEQ ID NO: 2926971 - RNA, 17 nt, Human
cugaaagaggaaugaag

SEQ ID NO: 2926972 - RNA, 13 nt, Human
cugacacacagcu

SEQ ID NO: 2926973 - RNA, 15 nt, Human
cugacacacagcucu

SEQ ID NO: 2926974 - RNA, 14 nt, Human
cugaaaauguaugu

SEQ ID NO: 2926975 - RNA, 16 nt, Human
cugacacacagcucug

SEQ ID NO: 2926976 - RNA, 17 nt, Human
cugacacacagcucugu

SEQ ID NO: 2926977 - RNA, 18 nt, Human
cugacacacagcucuguc

SEQ ID NO: 2926978 - RNA, 19 nt, Human
cugacacacagcucugucc

SEQ ID NO: 2926979 - RNA, 20 nt, Human
cugacacacagcucuguccu

SEQ ID NO: 2926980 - RNA, 21 nt, Human
cugacacacagcucuguccug

SEQ ID NO: 2926981 - RNA, 22 nt, Human
cugacacacagcucuguccugg

SEQ ID NO: 2926982 - RNA, 23 nt, Human
cugacacacagcucuguccuggg

SEQ ID NO: 2926983 - RNA, 21 nt, Human
cugacacaugcugaacaucac

SEQ ID NO: 2926984 - RNA, 19 nt, Human
cugacccugcuucaaauau

SEQ ID NO: 2926985 - RNA, 22 nt, Human
cugagcugggaugauuggaggg

SEQ ID NO: 2926986 - RNA, 12 nt, Human
cugagcugggau

SEQ ID NO: 2926987 - RNA, 18 nt, Human
cugagggggccuggaugc

SEQ ID NO: 2926988 - RNA, 22 nt, Human
cugaggugggaggaucucuuga

SEQ ID NO: 2926989 - RNA, 12 nt, Human
cugaggugggag

SEQ ID NO: 2926990 - RNA, 13 nt, Human
cugaggugggagg

SEQ ID NO: 2926991 - RNA, 14 nt, Human
cugaggggccucuu

SEQ ID NO: 2926992 - RNA, 23 nt, Human
cugaggaauccagacccggcugc

SEQ ID NO: 2926993 - RNA, 14 nt, Human
cugaucucucguga

SEQ ID NO: 2926994 - RNA, 18 nt, Human
cugaucucucgugauuga

SEQ ID NO: 2926995 - RNA, 17 nt, Human
cugaucucucgugauug

SEQ ID NO: 2926996 - RNA, 14 nt, Human
cuaacuggacuggu

SEQ ID NO: 2926997 - RNA, 22 nt, Human
cuaaaguguauuuuuuuacuaa

SEQ ID NO: 2926998 - RNA, 17 nt, Human
cuaaaggcuaccuuugu

SEQ ID NO: 2926999 - RNA, 19 nt, Human
cuaaaggcuaccuuuguau

SEQ ID NO: 2927000 - RNA, 19 nt, Human
cuaaaguguauuuuuuuac

SEQ ID NO: 2927001 - RNA, 17 nt, Human
cuaaagaaguuugaaca

SEQ ID NO: 2927002 - RNA, 14 nt, Human
cuaaagcugccagc

SEQ ID NO: 2927003 - RNA, 15 nt, Human
cuaaaggcuaccuuu

SEQ ID NO: 2927004 - RNA, 16 nt, Human
cuaaaggcuaccuuug

SEQ ID NO: 2927005 - RNA, 15 nt, Human
cuaaagcugccagcc

SEQ ID NO: 2927006 - RNA, 13 nt, Human
cguuaaaauacca

SEQ ID NO: 2927007 - RNA, 13 nt, Human
cguacacauuuua

SEQ ID NO: 2927008 - RNA, 16 nt, Human
cguacacauuuuauuu

SEQ ID NO: 2927009 - RNA, 15 nt, Human
cgguuuauauaagcu

SEQ ID NO: 2927010 - RNA, 15 nt, Human
cggagacggaguccc

SEQ ID NO: 2927011 - RNA, 24 nt, Human
cggagaagagcuguucacagccag

SEQ ID NO: 2927012 - RNA, 23 nt, Human
cggagaagagcuguucacagcca

SEQ ID NO: 2927013 - RNA, 16 nt, Human
cgccuuaaggauguuc

SEQ ID NO: 2927014 - RNA, 18 nt, Human
cgcugccccuggcagccc

SEQ ID NO: 2927015 - RNA, 19 nt, Human
cgcuggaccuugaacuggg

SEQ ID NO: 2927016 - RNA, 23 nt, Human
cgcuggaccuugaacuggguacu

SEQ ID NO: 2927017 - RNA, 13 nt, Human
cgcugccccuggc

SEQ ID NO: 2927018 - RNA, 17 nt, Human
cgcugccccuggcagcc

SEQ ID NO: 2927019 - RNA, 16 nt, Human
cgcugccccuggcagc

SEQ ID NO: 2927020 - RNA, 17 nt, Human
cgcuggggccaguuggu

SEQ ID NO: 2927021 - RNA, 20 nt, Human
cgcuggggccaguugguccc

SEQ ID NO: 2927022 - RNA, 14 nt, Human
cuauguugcccagg

SEQ ID NO: 2927023 - RNA, 15 nt, Human
cuauguugcccaggc

SEQ ID NO: 2927024 - RNA, 22 nt, Human
cuauguguagggcgggaggaug

SEQ ID NO: 2927025 - RNA, 16 nt, Human
cuauguaucaaugagu

SEQ ID NO: 2927026 - RNA, 17 nt, Human
cuaugugagcacaaagg

SEQ ID NO: 2927027 - RNA, 18 nt, Human
cuaucucccccagcccca

SEQ ID NO: 2927028 - RNA, 19 nt, Human
cuauguaucaaugaguaac

SEQ ID NO: 2927029 - RNA, 20 nt, Human
cuaucucccccagccccauc

SEQ ID NO: 2927030 - RNA, 16 nt, Human
cuauguugcccaggca

SEQ ID NO: 2927031 - RNA, 17 nt, Human
cuauguugcccaggcag

SEQ ID NO: 2927032 - RNA, 17 nt, Human
cucaaaaaaagaaaaag

SEQ ID NO: 2927033 - RNA, 18 nt, Human
cucaaaaaaagaaaaaga

SEQ ID NO: 2927034 - RNA, 13 nt, Human
cucaaaacugcac

SEQ ID NO: 2927035 - RNA, 17 nt, Human
cucacaauccuugccac

SEQ ID NO: 2927036 - RNA, 12 nt, Human
cucaaauaacua

SEQ ID NO: 2927037 - RNA, 14 nt, Human
cucacaaaggaugc

SEQ ID NO: 2927038 - RNA, 21 nt, Human
cucacacaugagcaucaggcc

SEQ ID NO: 2927039 - RNA, 14 nt, Human
cucacacaugagca

SEQ ID NO: 2927040 - RNA, 13 nt, Human
cucaccucucccu

SEQ ID NO: 2927041 - RNA, 17 nt, Human
cucaccucucccuugga

SEQ ID NO: 2927042 - RNA, 16 nt, Human
cucaccucucccuugg

SEQ ID NO: 2927043 - RNA, 15 nt, Human
cucaccucucccuug

SEQ ID NO: 2927044 - RNA, 14 nt, Human
cucaccucucccuu

SEQ ID NO: 2927045 - RNA, 13 nt, Human
cucaccugccccu

SEQ ID NO: 2927046 - RNA, 18 nt, Human
cucaccugccccucaacu

SEQ ID NO: 2927047 - RNA, 16 nt, Human
cucaccugccccucaa

SEQ ID NO: 2927048 - RNA, 14 nt, Human
cucaccugccccuc

SEQ ID NO: 2927049 - RNA, 18 nt, Human
cucacuuguuuuauuuaa

SEQ ID NO: 2927050 - RNA, 19 nt, Human
cucagaaaacaaggaugaa

SEQ ID NO: 2927051 - RNA, 23 nt, Human
cucagaaaacaaggaugaauuaa

SEQ ID NO: 2927052 - RNA, 15 nt, Human
cuaguuugauuaaau

SEQ ID NO: 2927053 - RNA, 20 nt, Human
cuaguuugauuaaauucuug

SEQ ID NO: 2927054 - RNA, 17 nt, Human
cuaguuugauuaaauuc

SEQ ID NO: 2927055 - RNA, 19 nt, Human
cuaguuugauuaaauucuu

SEQ ID NO: 2927056 - RNA, 14 nt, Human
cuagggaagauaau

SEQ ID NO: 2927057 - RNA, 17 nt, Human
cuagccagaggagagag

SEQ ID NO: 2927058 - RNA, 19 nt, Human
cuagccagaggagagagga

SEQ ID NO: 2927059 - RNA, 13 nt, Human
cuaggccuggcca

SEQ ID NO: 2927060 - RNA, 13 nt, Human
cuaggccugggga

SEQ ID NO: 2927061 - RNA, 12 nt, Human
cuaggccugggg

SEQ ID NO: 2927062 - RNA, 14 nt, Human
cuaggccuggccag

SEQ ID NO: 2927063 - RNA, 15 nt, Human
cuaggccuggccaga

SEQ ID NO: 2927064 - RNA, 18 nt, Human
cuaggccuggccagaugc

SEQ ID NO: 2927065 - RNA, 19 nt, Human
cuaggccuggccagaugca

SEQ ID NO: 2927066 - RNA, 16 nt, Human
cuagcauacguacaca

SEQ ID NO: 2927067 - RNA, 18 nt, Human
cuagcauacguacacauu

SEQ ID NO: 2927068 - RNA, 19 nt, Human
cuagcauacguacacauuu

SEQ ID NO: 2927069 - RNA, 20 nt, Human
cuagcauacguacacauuuu

SEQ ID NO: 2927070 - RNA, 20 nt, Human
cuacuaaaaaugcaaaaaaa

SEQ ID NO: 2927071 - RNA, 23 nt, Human
cuaccugaggggccucuuauggg

SEQ ID NO: 2927072 - RNA, 19 nt, Human
cuaccugaggggccucuua

SEQ ID NO: 2927073 - RNA, 16 nt, Human
cuaccugaggggccuc

SEQ ID NO: 2927074 - RNA, 15 nt, Human
cuaccugaggggccu

SEQ ID NO: 2927075 - RNA, 12 nt, Human
ccuaauguguuu

SEQ ID NO: 2927076 - RNA, 21 nt, Human
ccuagcauacguacacauuuu

SEQ ID NO: 2927077 - RNA, 14 nt, Human
ccuaauaaaaaggu

SEQ ID NO: 2927078 - RNA, 20 nt, Human
ccuaauaaaaaggugaccau

SEQ ID NO: 2927079 - RNA, 16 nt, Human
ccuaauaaaaagguga

SEQ ID NO: 2927080 - RNA, 15 nt, Human
ccuaauaaaaaggug

SEQ ID NO: 2927081 - RNA, 22 nt, Human
ccuagccuuagaagucacacag

SEQ ID NO: 2927082 - RNA, 19 nt, Human
ccuagccuuagaagucaca

SEQ ID NO: 2927083 - RNA, 23 nt, Human
ccuagccugugccucugggacug

SEQ ID NO: 2927084 - RNA, 17 nt, Human
ccggccaccugcggugc

SEQ ID NO: 2927085 - RNA, 18 nt, Human
ccggccaccugcggugcu

SEQ ID NO: 2927086 - RNA, 23 nt, Human
ccgcagcccugcagagggcacag

SEQ ID NO: 2927087 - RNA, 18 nt, Human
ccgcagcccugcagaggg

SEQ ID NO: 2927088 - RNA, 14 nt, Human
ccgcagcccugcag

SEQ ID NO: 2927089 - RNA, 19 nt, Human
cccuguggaugcugcugcc

SEQ ID NO: 2927090 - RNA, 14 nt, Human
cccuccuuucacca

SEQ ID NO: 2927091 - RNA, 21 nt, Human
cccugugaguacuacaguccu

SEQ ID NO: 2927092 - RNA, 15 nt, Human
cccugugauggggcc

SEQ ID NO: 2927093 - RNA, 23 nt, Human
cccugugaguacuacaguccucc

SEQ ID NO: 2927094 - RNA, 23 nt, Human
cccuuuuuuggcugcugaaggcu

SEQ ID NO: 2927095 - RNA, 22 nt, Human
cccuuuuuuggcugcugaaggc

SEQ ID NO: 2927096 - RNA, 21 nt, Human
cccuuuuuuggcugcugaagg

SEQ ID NO: 2927097 - RNA, 19 nt, Human
cccuucucuccagccccug

SEQ ID NO: 2927098 - RNA, 14 nt, Human
cccuucucuccagc

SEQ ID NO: 2927099 - RNA, 20 nt, Human
ccuccaagaccuucuccuuc

SEQ ID NO: 2927100 - RNA, 12 nt, Human
ccucccaucacc

SEQ ID NO: 2927101 - RNA, 16 nt, Human
ccuccaagaccuucuc

SEQ ID NO: 2927102 - RNA, 19 nt, Human
ccuccaagaccuucuccuu

SEQ ID NO: 2927103 - RNA, 17 nt, Human
ccuccaagaccuucucc

SEQ ID NO: 2927104 - RNA, 17 nt, Human
ccucccaucacccgcua

SEQ ID NO: 2927105 - RNA, 23 nt, Human
ccucaagugauucuccugccuca

SEQ ID NO: 2927106 - RNA, 20 nt, Human
ccucaagugauucuccugcc

SEQ ID NO: 2927107 - RNA, 18 nt, Human
ccucaggcaggugggaug

SEQ ID NO: 2927108 - RNA, 12 nt, Human
ccucaggcaggu

SEQ ID NO: 2927109 - RNA, 10 nt, Human
ccucaggccu

SEQ ID NO: 2927110 - RNA, 18 nt, Human
ccucauuagcauuuugcu

SEQ ID NO: 2927111 - RNA, 15 nt, Human
ccucaaccuccuggg

SEQ ID NO: 2927112 - RNA, 19 nt, Human
ccucaacucuccuccagag

SEQ ID NO: 2927113 - RNA, 23 nt, Human
ccucaacucuccuccagagucag

SEQ ID NO: 2927114 - RNA, 21 nt, Human
ccucaacucuccuccagaguc

SEQ ID NO: 2927115 - RNA, 16 nt, Human
ccucaacaccucugca

SEQ ID NO: 2927116 - RNA, 13 nt, Human
ccuccgccucuug

SEQ ID NO: 2927117 - RNA, 14 nt, Human
ccuccgccucuugg

SEQ ID NO: 2927118 - RNA, 16 nt, Human
ccucccuucucuucac

SEQ ID NO: 2927119 - RNA, 23 nt, Human
ccuccuuugugaggaagccgcug

SEQ ID NO: 2927120 - RNA, 18 nt, Human
ccuccuuuucacaguucu

SEQ ID NO: 2927121 - RNA, 20 nt, Human
ccucggaccccacuccggcc

SEQ ID NO: 2927122 - RNA, 22 nt, Human
ccucggaccccacuccggcccu

SEQ ID NO: 2927123 - RNA, 14 nt, Human
ccucggagaagagc

SEQ ID NO: 2927124 - RNA, 12 nt, Human
ccucggagaaga

SEQ ID NO: 2927125 - RNA, 16 nt, Human
ccugccucagccuccc

SEQ ID NO: 2927126 - RNA, 15 nt, Human
ccugccucagccucc

SEQ ID NO: 2927127 - RNA, 21 nt, Human
ccugcccaggccccugccacc

SEQ ID NO: 2927128 - RNA, 18 nt, Human
ccugcccaggccccugcc

SEQ ID NO: 2927129 - RNA, 19 nt, Human
ccugcccaggccccugcca

SEQ ID NO: 2927130 - RNA, 19 nt, Human
ccugcccaccuggccucug

SEQ ID NO: 2927131 - RNA, 18 nt, Human
ccugcccaccuggccucu

SEQ ID NO: 2927132 - RNA, 17 nt, Human
ccugcccaccuggccuc

SEQ ID NO: 2927133 - RNA, 15 nt, Human
ccugcccaccuggcc

SEQ ID NO: 2927134 - RNA, 14 nt, Human
ccugcaggcagcca

SEQ ID NO: 2927135 - RNA, 13 nt, Human
ccugcaggcagcc

SEQ ID NO: 2927136 - RNA, 12 nt, Human
ccugcaggcagc

SEQ ID NO: 2927137 - RNA, 16 nt, Human
ccucuuucccucccuu

SEQ ID NO: 2927138 - RNA, 19 nt, Human
ccucuuucccucccuuccu

SEQ ID NO: 2927139 - RNA, 15 nt, Human
ccucuuugagugaag

SEQ ID NO: 2927140 - RNA, 15 nt, Human
ccugggcuacaagga

SEQ ID NO: 2927141 - RNA, 15 nt, Human
ccuggggagaaagua

SEQ ID NO: 2927142 - RNA, 13 nt, Human
ccugguguggaag

SEQ ID NO: 2927143 - RNA, 20 nt, Human
ccugguggcagugggagcug

SEQ ID NO: 2927144 - RNA, 15 nt, Human
ccugguggcaguggg

SEQ ID NO: 2927145 - RNA, 18 nt, Human
ccugguggcagugggagc

SEQ ID NO: 2927146 - RNA, 19 nt, Human
ccugguggcagugggagcu

SEQ ID NO: 2927147 - RNA, 22 nt, Human
ccuggccucaagugauucuccu

SEQ ID NO: 2927148 - RNA, 21 nt, Human
ccuggccccucagggucccug

SEQ ID NO: 2927149 - RNA, 20 nt, Human
ccuggccccucagggucccu

SEQ ID NO: 2927150 - RNA, 18 nt, Human
ccuggccccucagggucc

SEQ ID NO: 2927151 - RNA, 16 nt, Human
ccuggccccucagggu

SEQ ID NO: 2927152 - RNA, 19 nt, Human
ccuggaugcccccugugga

SEQ ID NO: 2927153 - RNA, 16 nt, Human
ccuggaugcccccugu

SEQ ID NO: 2927154 - RNA, 18 nt, Human
ccuggaugcccccugugg

SEQ ID NO: 2927155 - RNA, 18 nt, Human
ccuggauggggcugcacc

SEQ ID NO: 2927156 - RNA, 17 nt, Human
ccuggauggggcugcac

SEQ ID NO: 2927157 - RNA, 15 nt, Human
ccuggauggggcugc

SEQ ID NO: 2927158 - RNA, 13 nt, Human
ccuggaugccauc

SEQ ID NO: 2927159 - RNA, 14 nt, Human
ccuggaugccaucc

SEQ ID NO: 2927160 - RNA, 18 nt, Human
ccuggaugccauccaagu

SEQ ID NO: 2927161 - RNA, 14 nt, Human
ccuggaugcccccu

SEQ ID NO: 2927162 - RNA, 17 nt, Human
ccugucucuacuaaaaa

SEQ ID NO: 2927163 - RNA, 13 nt, Human
cccaagcucugcu

SEQ ID NO: 2927164 - RNA, 14 nt, Human
cccaagcucugcuc

SEQ ID NO: 2927165 - RNA, 12 nt, Human
cccaagcucugc

SEQ ID NO: 2927166 - RNA, 16 nt, Human
cccaagacucccauga

SEQ ID NO: 2927167 - RNA, 20 nt, Human
cccaagacucccaugaggga

SEQ ID NO: 2927168 - RNA, 13 nt, Human
cccaacuccagaa

SEQ ID NO: 2927169 - RNA, 20 nt, Human
cccaacucaccccagcccca

SEQ ID NO: 2927170 - RNA, 17 nt, Human
cccaacucaccccagcc

SEQ ID NO: 2927171 - RNA, 14 nt, Human
cccacuccggcccu

SEQ ID NO: 2927172 - RNA, 12 nt, Human
cccacucccugc

SEQ ID NO: 2927173 - RNA, 13 nt, Human
cccacucccugca

SEQ ID NO: 2927174 - RNA, 19 nt, Human
cccacuccggcccuccaga

SEQ ID NO: 2927175 - RNA, 21 nt, Human
cccacuccggcccuccagagc

SEQ ID NO: 2927176 - RNA, 23 nt, Human
cccacugcuuuuggucuguguga

SEQ ID NO: 2927177 - RNA, 22 nt, Human
cccacugcuuuuggucugugug

SEQ ID NO: 2927178 - RNA, 16 nt, Human
ccauucuuggcccagg

SEQ ID NO: 2927179 - RNA, 15 nt, Human
ccauuggggcuccca

SEQ ID NO: 2927180 - RNA, 16 nt, Human
ccauuggggcucccag

SEQ ID NO: 2927181 - RNA, 17 nt, Human
ccauuggggcucccagc

SEQ ID NO: 2927182 - RNA, 16 nt, Human
cccaacucaccccagc

SEQ ID NO: 2927183 - RNA, 15 nt, Human
cccaacucaccccag

SEQ ID NO: 2927184 - RNA, 23 nt, Human
ccaugagggagaugccaugagcc

SEQ ID NO: 2927185 - RNA, 18 nt, Human
ccaugagggagaugccau

SEQ ID NO: 2927186 - RNA, 19 nt, Human
ccaugagggagaugccaug

SEQ ID NO: 2927187 - RNA, 20 nt, Human
ccaugagggagaugccauga

SEQ ID NO: 2927188 - RNA, 21 nt, Human
ccaugagggagaugccaugag

SEQ ID NO: 2927189 - RNA, 18 nt, Human
ccaugaguccccuguuug

SEQ ID NO: 2927190 - RNA, 17 nt, Human
ccaugagggagaugcca

SEQ ID NO: 2927191 - RNA, 23 nt, Human
ccaugaggaacaaggcaaggcug

SEQ ID NO: 2927192 - RNA, 14 nt, Human
ccaucccucccucc

SEQ ID NO: 2927193 - RNA, 15 nt, Human
ccaucccucccucca

SEQ ID NO: 2927194 - RNA, 20 nt, Human
ccaugaggaacaaggcaagg

SEQ ID NO: 2927195 - RNA, 22 nt, Human
ccaguuggagcagaugccuccc

SEQ ID NO: 2927196 - RNA, 23 nt, Human
ccaguuggguggaugccuggugg

SEQ ID NO: 2927197 - RNA, 13 nt, Human
ccaguuggucccc

SEQ ID NO: 2927198 - RNA, 17 nt, Human
ccauaagcuacugccau

SEQ ID NO: 2927199 - RNA, 18 nt, Human
ccauaagcuacugccauc

SEQ ID NO: 2927200 - RNA, 21 nt, Human
ccauaagcuacugccauccug

SEQ ID NO: 2927201 - RNA, 16 nt, Human
ccauaagcuacugcca

SEQ ID NO: 2927202 - RNA, 20 nt, Human
ccaguuggucccccuuccau

SEQ ID NO: 2927203 - RNA, 18 nt, Human
ccaguuggucccccuucc

SEQ ID NO: 2927204 - RNA, 18 nt, Human
ccauccagguucagcuug

SEQ ID NO: 2927205 - RNA, 19 nt, Human
ccauccagguucagcuugu

SEQ ID NO: 2927206 - RNA, 20 nt, Human
ccaucccaaacccuucagug

SEQ ID NO: 2927207 - RNA, 20 nt, Human
ccaucccauaugccugggca

SEQ ID NO: 2927208 - RNA, 19 nt, Human
ccaucccauaugccugggc

SEQ ID NO: 2927209 - RNA, 13 nt, Human
ccaucccucccuc

SEQ ID NO: 2927210 - RNA, 21 nt, Human
ccaucccauaugccugggcag

SEQ ID NO: 2927211 - RNA, 22 nt, Human
ccauccccuguagagugggagc

SEQ ID NO: 2927212 - RNA, 12 nt, Human
ccaguccugccc

SEQ ID NO: 2927213 - RNA, 13 nt, Human
ccaguccugcccg

SEQ ID NO: 2927214 - RNA, 15 nt, Human
ccaguccugcccgcc

SEQ ID NO: 2927215 - RNA, 16 nt, Human
ccaguccugcccgcca

SEQ ID NO: 2927216 - RNA, 22 nt, Human
ccagucauuauguuaauauuuc

SEQ ID NO: 2927217 - RNA, 21 nt, Human
ccagucauuauguuaauauuu

SEQ ID NO: 2927218 - RNA, 21 nt, Human
ccaggggaaaaucagccugcu

SEQ ID NO: 2927219 - RNA, 12 nt, Human
ccaggcuggcgu

SEQ ID NO: 2927220 - RNA, 23 nt, Human
ccaggcaggucuugaacuccugg

SEQ ID NO: 2927221 - RNA, 12 nt, Human
ccaggcaggucu

SEQ ID NO: 2927222 - RNA, 14 nt, Human
ccaggcaggucuug

SEQ ID NO: 2927223 - RNA, 21 nt, Human
ccagcacuuugggaggcugag

SEQ ID NO: 2927224 - RNA, 23 nt, Human
ccagcacuuugggaggcugaggc

SEQ ID NO: 2927225 - RNA, 17 nt, Human
ccagccccauccucugu

SEQ ID NO: 2927226 - RNA, 15 nt, Human
ccagccccauccucu

SEQ ID NO: 2927227 - RNA, 17 nt, Human
ccagccccagugcccac

SEQ ID NO: 2927228 - RNA, 14 nt, Human
ccagcagagcaccu

SEQ ID NO: 2927229 - RNA, 13 nt, Human
ccagcagagcacc

SEQ ID NO: 2927230 - RNA, 12 nt, Human
ccagcagagcac

SEQ ID NO: 2927231 - RNA, 21 nt, Human
ccagcuacucgggaggcugag

SEQ ID NO: 2927232 - RNA, 23 nt, Human
ccagcuacucgggaggcugaggc

SEQ ID NO: 2927233 - RNA, 24 nt, Human
ccagccccuucugacccaugcugc

SEQ ID NO: 2927234 - RNA, 23 nt, Human
ccagccccuucugacccaugcug

SEQ ID NO: 2927235 - RNA, 15 nt, Human
ccccagauugcaaca

SEQ ID NO: 2927236 - RNA, 20 nt, Human
ccccagauugcaacaggcug

SEQ ID NO: 2927237 - RNA, 15 nt, Human
cccauuugcuccuuu

SEQ ID NO: 2927238 - RNA, 19 nt, Human
cccauucugccugcccagg

SEQ ID NO: 2927239 - RNA, 14 nt, Human
cccauucugccugc

SEQ ID NO: 2927240 - RNA, 15 nt, Human
cccauucugccugcc

SEQ ID NO: 2927241 - RNA, 14 nt, Human
ccccgcacugggcu

SEQ ID NO: 2927242 - RNA, 22 nt, Human
cccauccucuguacagagccca

SEQ ID NO: 2927243 - RNA, 21 nt, Human
cccauccucuguacagagccc

SEQ ID NO: 2927244 - RNA, 22 nt, Human
cccaggcuuagucacugagaca

SEQ ID NO: 2927245 - RNA, 18 nt, Human
cccaggaaaggcuccagg

SEQ ID NO: 2927246 - RNA, 17 nt, Human
cccaggaaaggcuccag

SEQ ID NO: 2927247 - RNA, 20 nt, Human
cccauauuuguacaccaaua

SEQ ID NO: 2927248 - RNA, 16 nt, Human
cccaggaaaggcucca

SEQ ID NO: 2927249 - RNA, 15 nt, Human
cccaggaaaggcucc

SEQ ID NO: 2927250 - RNA, 18 nt, Human
cccagcaauuaugaaaau

SEQ ID NO: 2927251 - RNA, 20 nt, Human
cccagcacaaagcagauccu

SEQ ID NO: 2927252 - RNA, 16 nt, Human
cccagcaauuaugaaa

SEQ ID NO: 2927253 - RNA, 23 nt, Human
cccagcaagugagagcugggugu

SEQ ID NO: 2927254 - RNA, 24 nt, Human
cccagccagcaguucagagcugcc

SEQ ID NO: 2927255 - RNA, 14 nt, Human
cccagccaggcccu

SEQ ID NO: 2927256 - RNA, 12 nt, Human
cccagccaggcc

SEQ ID NO: 2927257 - RNA, 16 nt, Human
cccggccccugcuggu

SEQ ID NO: 2927258 - RNA, 15 nt, Human
cccggccccugcugg

SEQ ID NO: 2927259 - RNA, 15 nt, Human
cccgggaagggggcu

SEQ ID NO: 2927260 - RNA, 13 nt, Human
ccccuucugaccc

SEQ ID NO: 2927261 - RNA, 14 nt, Human
ccccuucugaccca

SEQ ID NO: 2927262 - RNA, 16 nt, Human
cccgaauagcugggac

SEQ ID NO: 2927263 - RNA, 17 nt, Human
cccgaauagcugggacu

SEQ ID NO: 2927264 - RNA, 18 nt, Human
cccgaauagcugggacua

SEQ ID NO: 2927265 - RNA, 16 nt, Human
cccucaacucuccucc

SEQ ID NO: 2927266 - RNA, 16 nt, Human
cccucaacaccucugc

SEQ ID NO: 2927267 - RNA, 21 nt, Human
cccgggaagggggcugggaca

SEQ ID NO: 2927268 - RNA, 18 nt, Human
cccgggaagggggcuggg

SEQ ID NO: 2927269 - RNA, 22 nt, Human
ccccugcacagcaggcugccag

SEQ ID NO: 2927270 - RNA, 23 nt, Human
ccccugcacagcaggcugccagu

SEQ ID NO: 2927271 - RNA, 14 nt, Human
ccccugccacccug

SEQ ID NO: 2927272 - RNA, 16 nt, Human
ccccugccacccuggg

SEQ ID NO: 2927273 - RNA, 13 nt, Human
ccccugaauuuaa

SEQ ID NO: 2927274 - RNA, 15 nt, Human
ccccugacaacacuc

SEQ ID NO: 2927275 - RNA, 17 nt, Human
ccccugaauuuaaauag

SEQ ID NO: 2927276 - RNA, 15 nt, Human
ccccugcacagcagg

SEQ ID NO: 2927277 - RNA, 16 nt, Human
ccccugcacagcaggc

SEQ ID NO: 2927278 - RNA, 21 nt, Human
ccccugcacagcaggcugcca

SEQ ID NO: 2927279 - RNA, 13 nt, Human
ccccugcacucca

SEQ ID NO: 2927280 - RNA, 13 nt, Human
cccuccucugcuu

SEQ ID NO: 2927281 - RNA, 22 nt, Human
cccuccucugcuugccaucccu

SEQ ID NO: 2927282 - RNA, 15 nt, Human
cagucucaggaaauc

SEQ ID NO: 2927283 - RNA, 14 nt, Human
cagugcaguauaga

SEQ ID NO: 2927284 - RNA, 15 nt, Human
cagugccaaaaacaa

SEQ ID NO: 2927285 - RNA, 11 nt, Human
cagugggagcu

SEQ ID NO: 2927286 - RNA, 12 nt, Human
cagugcccacag

SEQ ID NO: 2927287 - RNA, 22 nt, Human
cagugcacuaauguguaagaca

SEQ ID NO: 2927288 - RNA, 19 nt, Human
cagucugauucccaagcuc

SEQ ID NO: 2927289 - RNA, 20 nt, Human
cagucugauucccaagcucu

SEQ ID NO: 2927290 - RNA, 19 nt, Human
cagugcaugcugucccuua

SEQ ID NO: 2927291 - RNA, 23 nt, Human
cagugcaugcugucccuuacgug

SEQ ID NO: 2927292 - RNA, 22 nt, Human
cagugcaugcugucccuuacgu

SEQ ID NO: 2927293 - RNA, 21 nt, Human
cagggucucacucugucgccc

SEQ ID NO: 2927294 - RNA, 17 nt, Human
cagggucucacucuguc

SEQ ID NO: 2927295 - RNA, 18 nt, Human
cagggucucacucugucg

SEQ ID NO: 2927296 - RNA, 22 nt, Human
caggugcacaagcuccaagcuc

SEQ ID NO: 2927297 - RNA, 12 nt, Human
caggguuggccc

SEQ ID NO: 2927298 - RNA, 16 nt, Human
caggugauccacccac

SEQ ID NO: 2927299 - RNA, 17 nt, Human
caggugauccacccacc

SEQ ID NO: 2927300 - RNA, 14 nt, Human
caggugcgaaagga

SEQ ID NO: 2927301 - RNA, 20 nt, Human
caggugcuaggaacacuccu

SEQ ID NO: 2927302 - RNA, 18 nt, Human
caggugcuaggaacacuc

SEQ ID NO: 2927303 - RNA, 14 nt, Human
cagguugguggggg

SEQ ID NO: 2927304 - RNA, 19 nt, Human
cagucaccccggccaccug

SEQ ID NO: 2927305 - RNA, 20 nt, Human
cagucaccccggccaccugc

SEQ ID NO: 2927306 - RNA, 22 nt, Human
cagucaccccggccaccugcgg

SEQ ID NO: 2927307 - RNA, 18 nt, Human
cagguuuaagcuguuacu

SEQ ID NO: 2927308 - RNA, 16 nt, Human
cagguuuaagcuguua

SEQ ID NO: 2927309 - RNA, 17 nt, Human
caggaggccagccuuga

SEQ ID NO: 2927310 - RNA, 18 nt, Human
caggcacccaccaucaug

SEQ ID NO: 2927311 - RNA, 22 nt, Human
caggcacccaccaucaugucug

SEQ ID NO: 2927312 - RNA, 23 nt, Human
caggcacccaccaucaugucugg

SEQ ID NO: 2927313 - RNA, 16 nt, Human
caggaggccagccuug

SEQ ID NO: 2927314 - RNA, 15 nt, Human
caggaggccagccuu

SEQ ID NO: 2927315 - RNA, 14 nt, Human
caggaggccagccu

SEQ ID NO: 2927316 - RNA, 23 nt, Human
caggccagagggagugacagagg

SEQ ID NO: 2927317 - RNA, 16 nt, Human
caggccagagggagug

SEQ ID NO: 2927318 - RNA, 16 nt, Human
caggcagcagacacau

SEQ ID NO: 2927319 - RNA, 15 nt, Human
caggcagcagacaca

SEQ ID NO: 2927320 - RNA, 17 nt, Human
caggcagcagacacaug

SEQ ID NO: 2927321 - RNA, 19 nt, Human
caggccagagggagugaca

SEQ ID NO: 2927322 - RNA, 21 nt, Human
caggccagagggagugacaga

SEQ ID NO: 2927323 - RNA, 22 nt, Human
cagggaguccgaaagggacuug

SEQ ID NO: 2927324 - RNA, 18 nt, Human
cagggaggugaccccagg

SEQ ID NO: 2927325 - RNA, 16 nt, Human
caggcugggcuucagu

SEQ ID NO: 2927326 - RNA, 15 nt, Human
caggcugggcuucag

SEQ ID NO: 2927327 - RNA, 17 nt, Human
caggcugggcuucagug

SEQ ID NO: 2927328 - RNA, 19 nt, Human
caggcugggcuucaguggc

SEQ ID NO: 2927329 - RNA, 17 nt, Human
cagggaggacgcucucu

SEQ ID NO: 2927330 - RNA, 18 nt, Human
cagggaggacgcucucug

SEQ ID NO: 2927331 - RNA, 22 nt, Human
cagaguaggcuauuccugagag

SEQ ID NO: 2927332 - RNA, 22 nt, Human
cagaguaggggucugucuuuua

SEQ ID NO: 2927333 - RNA, 23 nt, Human
cagaguaggggucugucuuuuaa

SEQ ID NO: 2927334 - RNA, 20 nt, Human
cagaguaggggucugucuuu

SEQ ID NO: 2927335 - RNA, 20 nt, Human
cagagucagaaguuucugcc

SEQ ID NO: 2927336 - RNA, 20 nt, Human
cagaggggguggccucccaa

SEQ ID NO: 2927337 - RNA, 19 nt, Human
cagaggggguggccuccca

SEQ ID NO: 2927338 - RNA, 17 nt, Human
cagaggggguggccucc

SEQ ID NO: 2927339 - RNA, 18 nt, Human
cagaggggguggccuccc

SEQ ID NO: 2927340 - RNA, 15 nt, Human
cagauaugauucaaa

SEQ ID NO: 2927341 - RNA, 16 nt, Human
cagauaugauucaaau

SEQ ID NO: 2927342 - RNA, 17 nt, Human
cagauaugauucaaaug

SEQ ID NO: 2927343 - RNA, 19 nt, Human
cagauaugauucaaauguc

SEQ ID NO: 2927344 - RNA, 22 nt, Human
cagagggccugcaagggaguga

SEQ ID NO: 2927345 - RNA, 13 nt, Human
cagagcugcccuc

SEQ ID NO: 2927346 - RNA, 15 nt, Human
cagagcugcccucuc

SEQ ID NO: 2927347 - RNA, 18 nt, Human
cagagcugccaccugccu

SEQ ID NO: 2927348 - RNA, 16 nt, Human
cagagcugccaccugc

SEQ ID NO: 2927349 - RNA, 23 nt, Human
cagaaguuugagaucagccuggg

SEQ ID NO: 2927350 - RNA, 22 nt, Human
cagaaguuugagaucagccugg

SEQ ID NO: 2927351 - RNA, 19 nt, Human
cagaaguuucugccgcagc

SEQ ID NO: 2927352 - RNA, 23 nt, Human
cagaaguuucugccgcagcccug

SEQ ID NO: 2927353 - RNA, 20 nt, Human
cagaaguuugagaucagccu

SEQ ID NO: 2927354 - RNA, 22 nt, Human
cagcacagccucuuagaugcag

SEQ ID NO: 2927355 - RNA, 22 nt, Human
cagccaggccacaagacccuug

SEQ ID NO: 2927356 - RNA, 13 nt, Human
cagccaggccaca

SEQ ID NO: 2927357 - RNA, 12 nt, Human
cagccaggccac

SEQ ID NO: 2927358 - RNA, 14 nt, Human
cagccagcaguuca

SEQ ID NO: 2927359 - RNA, 15 nt, Human
cagccagcaguucag

SEQ ID NO: 2927360 - RNA, 21 nt, Human
cagccagcaguucagagcugc

SEQ ID NO: 2927361 - RNA, 15 nt, Human
cagcagugagacugg

SEQ ID NO: 2927362 - RNA, 23 nt, Human
cagcauauucaggaagcucaggg

SEQ ID NO: 2927363 - RNA, 22 nt, Human
cagcauauucaggaagcucagg

SEQ ID NO: 2927364 - RNA, 19 nt, Human
cagcauauucaggaagcuc

SEQ ID NO: 2927365 - RNA, 17 nt, Human
cagcaguugaaaagacu

SEQ ID NO: 2927366 - RNA, 14 nt, Human
cagcagugagacug

SEQ ID NO: 2927367 - RNA, 21 nt, Human
cagcaguugaaaagacuccaa

SEQ ID NO: 2927368 - RNA, 20 nt, Human
cagcaguugaaaagacucca

SEQ ID NO: 2927369 - RNA, 15 nt, Human
cagcggggacagcuc

SEQ ID NO: 2927370 - RNA, 14 nt, Human
cagcggggacagcu

SEQ ID NO: 2927371 - RNA, 16 nt, Human
cagcggggacagcucc

SEQ ID NO: 2927372 - RNA, 17 nt, Human
cagcggggacagcuccu

SEQ ID NO: 2927373 - RNA, 18 nt, Human
cagccugagcgacaguga

SEQ ID NO: 2927374 - RNA, 19 nt, Human
cagccugagcgacagugag

SEQ ID NO: 2927375 - RNA, 15 nt, Human
cagcccuuagcaggg

SEQ ID NO: 2927376 - RNA, 16 nt, Human
cagcccuuagcaggga

SEQ ID NO: 2927377 - RNA, 21 nt, Human
cagcccuuagcagggaaacag

SEQ ID NO: 2927378 - RNA, 21 nt, Human
cagccccuggaugcagccuca

SEQ ID NO: 2927379 - RNA, 19 nt, Human
cagccccuggaugcagccu

SEQ ID NO: 2927380 - RNA, 18 nt, Human
cagccccuggaugcagcc

SEQ ID NO: 2927381 - RNA, 17 nt, Human
cagccccuggaugcagc

SEQ ID NO: 2927382 - RNA, 14 nt, Human
cagccccuggaugc

SEQ ID NO: 2927383 - RNA, 13 nt, Human
cagccccuggaug

SEQ ID NO: 2927384 - RNA, 12 nt, Human
cagccccuggau

SEQ ID NO: 2927385 - RNA, 21 nt, Human
cagccgagauagccaaggcca

SEQ ID NO: 2927386 - RNA, 20 nt, Human
cagccgagauagccaaggcc

SEQ ID NO: 2927387 - RNA, 15 nt, Human
cagcccuucuuucca

SEQ ID NO: 2927388 - RNA, 19 nt, Human
cagcccuucuuuccacaga

SEQ ID NO: 2927389 - RNA, 20 nt, Human
cagcccuucuuuccacagaa

SEQ ID NO: 2927390 - RNA, 22 nt, Human
cagcuccagcucaccagcccca

SEQ ID NO: 2927391 - RNA, 16 nt, Human
cagcuccagcucacca

SEQ ID NO: 2927392 - RNA, 17 nt, Human
cagcuccagcucaccag

SEQ ID NO: 2927393 - RNA, 18 nt, Human
cagcuccagcucaccagc

SEQ ID NO: 2927394 - RNA, 20 nt, Human
cagcuccagcucaccagccc

SEQ ID NO: 2927395 - RNA, 13 nt, Human
cagcuccagcuca

SEQ ID NO: 2927396 - RNA, 19 nt, Human
cagcuccaagaauuucuag

SEQ ID NO: 2927397 - RNA, 14 nt, Human
cagcuccagcucac

SEQ ID NO: 2927398 - RNA, 15 nt, Human
cagcuccagcucacc

SEQ ID NO: 2927399 - RNA, 16 nt, Human
cagcuccaagaauuuc

SEQ ID NO: 2927400 - RNA, 23 nt, Human
cagcugccuccccuccucugcuu

SEQ ID NO: 2927401 - RNA, 24 nt, Human
cagcugccuccccuccucugcuug

SEQ ID NO: 2927402 - RNA, 21 nt, Human
cagcugccuccccuccucugc

SEQ ID NO: 2927403 - RNA, 22 nt, Human
cagcugccuccccuccucugcu

SEQ ID NO: 2927404 - RNA, 16 nt, Human
cagcuccccucggaga

SEQ ID NO: 2927405 - RNA, 18 nt, Human
cagcuccccucggagaag

SEQ ID NO: 2927406 - RNA, 17 nt, Human
cagcuccccucggagaa

SEQ ID NO: 2927407 - RNA, 18 nt, Human
cagcugugcucuggacag

SEQ ID NO: 2927408 - RNA, 15 nt, Human
cagcuucauuuccug

SEQ ID NO: 2927409 - RNA, 18 nt, Human
cagcuucauuuccugugu

SEQ ID NO: 2927410 - RNA, 20 nt, Human
caggaaagagaacuuccaga

SEQ ID NO: 2927411 - RNA, 15 nt, Human
caggaaaggcuccag

SEQ ID NO: 2927412 - RNA, 14 nt, Human
caggaaaggcucca

SEQ ID NO: 2927413 - RNA, 23 nt, Human
caggaaaucaaauaugcaaagca

SEQ ID NO: 2927414 - RNA, 22 nt, Human
caggaaaucaaauaugcaaagc

SEQ ID NO: 2927415 - RNA, 14 nt, Human
cauccccuguagag

SEQ ID NO: 2927416 - RNA, 19 nt, Human
caucccauaugccugggca

SEQ ID NO: 2927417 - RNA, 21 nt, Human
caucugcgggggcagugcuca

SEQ ID NO: 2927418 - RNA, 19 nt, Human
caucugcgggggcagugcu

SEQ ID NO: 2927419 - RNA, 20 nt, Human
caucugcgggggcagugcuc

SEQ ID NO: 2927420 - RNA, 17 nt, Human
caucugcgggggcagug

SEQ ID NO: 2927421 - RNA, 17 nt, Human
caucccagccccaauga

SEQ ID NO: 2927422 - RNA, 19 nt, Human
caucaggccaggcccucug

SEQ ID NO: 2927423 - RNA, 16 nt, Human
caucaggccaggcccu

SEQ ID NO: 2927424 - RNA, 14 nt, Human
caucaggccaggcc

SEQ ID NO: 2927425 - RNA, 15 nt, Human
caucaggccaggccc

SEQ ID NO: 2927426 - RNA, 15 nt, Human
cauauucaggaagcu

SEQ ID NO: 2927427 - RNA, 14 nt, Human
cauauucaggaagc

SEQ ID NO: 2927428 - RNA, 20 nt, Human
cauauucaggaagcucaggg

SEQ ID NO: 2927429 - RNA, 22 nt, Human
cauauucaggaagcucagggcc

SEQ ID NO: 2927430 - RNA, 20 nt, Human
cauaugccugggcagaagga

SEQ ID NO: 2927431 - RNA, 15 nt, Human
cauaugccugggcag

SEQ ID NO: 2927432 - RNA, 22 nt, Human
cauaugccugggcagaaggaag

SEQ ID NO: 2927433 - RNA, 19 nt, Human
cauagcagagaaugaaagg

SEQ ID NO: 2927434 - RNA, 22 nt, Human
cauagcagagaaugaaagggcc

SEQ ID NO: 2927435 - RNA, 13 nt, Human
cauagcugugauu

SEQ ID NO: 2927436 - RNA, 15 nt, Human
cauagcugugauuuu

SEQ ID NO: 2927437 - RNA, 18 nt, Human
cauagcugugauuuuugg

SEQ ID NO: 2927438 - RNA, 15 nt, Human
caugcugcccuguga

SEQ ID NO: 2927439 - RNA, 14 nt, Human
caugcugcccugug

SEQ ID NO: 2927440 - RNA, 23 nt, Human
caugacacgaauauugcugaugg

SEQ ID NO: 2927441 - RNA, 21 nt, Human
caugacacgaauauugcugau

SEQ ID NO: 2927442 - RNA, 15 nt, Human
caugaaguaauaugc

SEQ ID NO: 2927443 - RNA, 19 nt, Human
caugaaguaauaugcacac

SEQ ID NO: 2927444 - RNA, 22 nt, Human
caugaaguaauaugcacacauu

SEQ ID NO: 2927445 - RNA, 23 nt, Human
caugaaguaauaugcacacauuu

SEQ ID NO: 2927446 - RNA, 16 nt, Human
caugcacgugugugca

SEQ ID NO: 2927447 - RNA, 13 nt, Human
caugcuccuggcc

SEQ ID NO: 2927448 - RNA, 13 nt, Human
caugcugcccugu

SEQ ID NO: 2927449 - RNA, 12 nt, Human
caugcugcccug

SEQ ID NO: 2927450 - RNA, 24 nt, Human
caugauuaaccacuucagcugacu

SEQ ID NO: 2927451 - RNA, 23 nt, Human
caugauuaaccacuucagcugac

SEQ ID NO: 2927452 - RNA, 22 nt, Human
caugauuaaccacuucagcuga

SEQ ID NO: 2927453 - RNA, 13 nt, Human
caugucagacaca

SEQ ID NO: 2927454 - RNA, 14 nt, Human
caugucagacacag

SEQ ID NO: 2927455 - RNA, 12 nt, Human
cauuccuguucc

SEQ ID NO: 2927456 - RNA, 12 nt, Human
cauguuggccag

SEQ ID NO: 2927457 - RNA, 13 nt, Human
cauguuggccagg

SEQ ID NO: 2927458 - RNA, 18 nt, Human
cauguccaagaagcccag

SEQ ID NO: 2927459 - RNA, 20 nt, Human
cauguccaagaagcccagga

SEQ ID NO: 2927460 - RNA, 19 nt, Human
cauguccaagaagcccagg

SEQ ID NO: 2927461 - RNA, 14 nt, Human
cauuagguugugaa

SEQ ID NO: 2927462 - RNA, 15 nt, Human
cauuagguugugaau

SEQ ID NO: 2927463 - RNA, 16 nt, Human
cauuagguugugaaug

SEQ ID NO: 2927464 - RNA, 22 nt, Human
cauuaggugugacugaauuucu

SEQ ID NO: 2927465 - RNA, 12 nt, Human
cauuaucucaaa

SEQ ID NO: 2927466 - RNA, 23 nt, Human
cauuaucuagauacuguaucaug

SEQ ID NO: 2927467 - RNA, 13 nt, Human
cauuaucucaaaa

SEQ ID NO: 2927468 - RNA, 13 nt, Human
cauuaguuuugaa

SEQ ID NO: 2927469 - RNA, 12 nt, Human
ccaagcuggucc

SEQ ID NO: 2927470 - RNA, 19 nt, Human
ccaagcuggucccacucag

SEQ ID NO: 2927471 - RNA, 14 nt, Human
ccaagaagcccagg

SEQ ID NO: 2927472 - RNA, 15 nt, Human
ccaaggccaaaggaa

SEQ ID NO: 2927473 - RNA, 22 nt, Human
ccaaauggaaaugggcagagca

SEQ ID NO: 2927474 - RNA, 15 nt, Human
ccaacgucugugcca

SEQ ID NO: 2927475 - RNA, 13 nt, Human
ccaacgucugugc

SEQ ID NO: 2927476 - RNA, 13 nt, Human
ccaagaagcccag

SEQ ID NO: 2927477 - RNA, 16 nt, Human
ccaaggccaaaggaag

SEQ ID NO: 2927478 - RNA, 19 nt, Human
cauuuuuuaaaugcaccug

SEQ ID NO: 2927479 - RNA, 15 nt, Human
cauuuuuuaaaugca

SEQ ID NO: 2927480 - RNA, 16 nt, Human
cauuuuuuaaaugcac

SEQ ID NO: 2927481 - RNA, 14 nt, Human
cauuuauucugcuc

SEQ ID NO: 2927482 - RNA, 15 nt, Human
cauuuauucugcuca

SEQ ID NO: 2927483 - RNA, 14 nt, Human
cauuugucccaagu

SEQ ID NO: 2927484 - RNA, 16 nt, Human
cauuugucccaagugc

SEQ ID NO: 2927485 - RNA, 18 nt, Human
cauuugucccaagugcca

SEQ ID NO: 2927486 - RNA, 19 nt, Human
cauuugucccaagugccaa

SEQ ID NO: 2927487 - RNA, 17 nt, Human
cauuugucacacacuuu

SEQ ID NO: 2927488 - RNA, 12 nt, Human
cauuugucccaa

SEQ ID NO: 2927489 - RNA, 13 nt, Human
cauuugucccaag

SEQ ID NO: 2927490 - RNA, 15 nt, Human
cauuuggauuggaug

SEQ ID NO: 2927491 - RNA, 18 nt, Human
ccacgcuggaccuugaac

SEQ ID NO: 2927492 - RNA, 18 nt, Human
ccaccuuggcugcaggga

SEQ ID NO: 2927493 - RNA, 19 nt, Human
ccaccuuggcugcagggag

SEQ ID NO: 2927494 - RNA, 12 nt, Human
ccaccuuggcug

SEQ ID NO: 2927495 - RNA, 14 nt, Human
ccaccuuggcugca

SEQ ID NO: 2927496 - RNA, 15 nt, Human
ccaccuuggcugcag

SEQ ID NO: 2927497 - RNA, 16 nt, Human
ccaccuuggcugcagg

SEQ ID NO: 2927498 - RNA, 19 nt, Human
ccaccgccuugcccagccu

SEQ ID NO: 2927499 - RNA, 16 nt, Human
ccaccgccuugcccag

SEQ ID NO: 2927500 - RNA, 17 nt, Human
ccaccgccuugcccagc

SEQ ID NO: 2927501 - RNA, 19 nt, Human
ccaccaucaugucuggcua

SEQ ID NO: 2927502 - RNA, 18 nt, Human
ccaccaucaccagacagg

SEQ ID NO: 2927503 - RNA, 20 nt, Human
ccaccagugccucucccugc

SEQ ID NO: 2927504 - RNA, 19 nt, Human
ccaccagugccucucccug

SEQ ID NO: 2927505 - RNA, 18 nt, Human
ccaccaucaugucuggcu

SEQ ID NO: 2927506 - RNA, 12 nt, Human
ccaccagugccu

SEQ ID NO: 2927507 - RNA, 13 nt, Human
ccaccagugccuc

SEQ ID NO: 2927508 - RNA, 14 nt, Human
ccaccagugccucu

SEQ ID NO: 2927509 - RNA, 15 nt, Human
ccaccagugccucuc

SEQ ID NO: 2927510 - RNA, 17 nt, Human
ccaccagugccucuccc

SEQ ID NO: 2927511 - RNA, 22 nt, Human
ccacagagaaaguacuucucca

SEQ ID NO: 2927512 - RNA, 18 nt, Human
ccacagaagcuccaggua

SEQ ID NO: 2927513 - RNA, 18 nt, Human
ccaccagucugacuguuu

SEQ ID NO: 2927514 - RNA, 16 nt, Human
ccacagaagcuccagg

SEQ ID NO: 2927515 - RNA, 20 nt, Human
auuucauaccuaucaucuua

SEQ ID NO: 2927516 - RNA, 14 nt, Human
auuucuaugaaaua

SEQ ID NO: 2927517 - RNA, 16 nt, Human
auuuaaugaaagacug

SEQ ID NO: 2927518 - RNA, 15 nt, Human
auuuaaugaaagacu

SEQ ID NO: 2927519 - RNA, 20 nt, Human
auuuaaugaaagacuguaca

SEQ ID NO: 2927520 - RNA, 21 nt, Human
auuuaaugaaagacuguacaa

SEQ ID NO: 2927521 - RNA, 16 nt, Human
auuuaauaaaugugcc

SEQ ID NO: 2927522 - RNA, 16 nt, Human
auuguugucugcaacu

SEQ ID NO: 2927523 - RNA, 15 nt, Human
auuguuuaaaaucau

SEQ ID NO: 2927524 - RNA, 17 nt, Human
auucuccuuguguuacu

SEQ ID NO: 2927525 - RNA, 18 nt, Human
auucuccuuguguuacua

SEQ ID NO: 2927526 - RNA, 19 nt, Human
auucuccuuguguuacuaa

SEQ ID NO: 2927527 - RNA, 21 nt, Human
auucuccuuguguuacuaagu

SEQ ID NO: 2927528 - RNA, 22 nt, Human
auucuccuuguguuacuaaguu

SEQ ID NO: 2927529 - RNA, 17 nt, Human
auucucuaguuugauua

SEQ ID NO: 2927530 - RNA, 18 nt, Human
auucucuaguuugauuaa

SEQ ID NO: 2927531 - RNA, 19 nt, Human
auucuucugcuucagccuc

SEQ ID NO: 2927532 - RNA, 20 nt, Human
auucuucugcuucagccucc

SEQ ID NO: 2927533 - RNA, 22 nt, Human
auucuucuguacgucugacagg

SEQ ID NO: 2927534 - RNA, 14 nt, Human
auucuugcaaagua

SEQ ID NO: 2927535 - RNA, 15 nt, Human
auucuugcaaaguau

SEQ ID NO: 2927536 - RNA, 16 nt, Human
auucuugcaaaguauc

SEQ ID NO: 2927537 - RNA, 14 nt, Human
auuauggaaacaga

SEQ ID NO: 2927538 - RNA, 18 nt, Human
auucaaauguauuacagu

SEQ ID NO: 2927539 - RNA, 16 nt, Human
auucaaaugucuauaa

SEQ ID NO: 2927540 - RNA, 18 nt, Human
auucaacagguuuuccug

SEQ ID NO: 2927541 - RNA, 14 nt, Human
auuaaaugacucuu

SEQ ID NO: 2927542 - RNA, 12 nt, Human
auuaaaugacuc

SEQ ID NO: 2927543 - RNA, 13 nt, Human
auuaaaugacucu

SEQ ID NO: 2927544 - RNA, 19 nt, Human
auuaaaugcccagccccuu

SEQ ID NO: 2927545 - RNA, 17 nt, Human
auuaaaugcccagcccc

SEQ ID NO: 2927546 - RNA, 22 nt, Human
auuaugaauuacauuuguauaa

SEQ ID NO: 2927547 - RNA, 19 nt, Human
auuaugaauuacauuugua

SEQ ID NO: 2927548 - RNA, 20 nt, Human
auuaugaauuacauuuguau

SEQ ID NO: 2927549 - RNA, 23 nt, Human
caaaugcuguaacuuucugaaau

SEQ ID NO: 2927550 - RNA, 21 nt, Human
caaaucugcuuuuuaaagaau

SEQ ID NO: 2927551 - RNA, 21 nt, Human
caaaucuuaacuugaaggagu

SEQ ID NO: 2927552 - RNA, 20 nt, Human
caaaguagaucaugcauaga

SEQ ID NO: 2927553 - RNA, 22 nt, Human
caaaguagaagucuuagaugua

SEQ ID NO: 2927554 - RNA, 17 nt, Human
caaaguagaucaugcau

SEQ ID NO: 2927555 - RNA, 19 nt, Human
caaaguaucccuacuguaa

SEQ ID NO: 2927556 - RNA, 21 nt, Human
caaaguaucccuacuguaauu

SEQ ID NO: 2927557 - RNA, 22 nt, Human
caaagcagugcaugcugucccu

SEQ ID NO: 2927558 - RNA, 21 nt, Human
caaagcagugcaugcuguccc

SEQ ID NO: 2927559 - RNA, 18 nt, Human
caaagcagugcaugcugu

SEQ ID NO: 2927560 - RNA, 14 nt, Human
caaagauauuuugc

SEQ ID NO: 2927561 - RNA, 16 nt, Human
caaagauauuuugcuu

SEQ ID NO: 2927562 - RNA, 18 nt, Human
caacucaccccagcccca

SEQ ID NO: 2927563 - RNA, 17 nt, Human
caacucaccccagcccc

SEQ ID NO: 2927564 - RNA, 17 nt, Human
caacucauauuuucaug

SEQ ID NO: 2927565 - RNA, 22 nt, Human
caagaauugaagcaggacuaaa

SEQ ID NO: 2927566 - RNA, 14 nt, Human
caacucuccuccag

SEQ ID NO: 2927567 - RNA, 19 nt, Human
caagacccaaaaggcagaa

SEQ ID NO: 2927568 - RNA, 17 nt, Human
caagaccacguuucuaa

SEQ ID NO: 2927569 - RNA, 18 nt, Human
caagaccacguuucuaaa

SEQ ID NO: 2927570 - RNA, 24 nt, Human
caaacccaguguuuuaggagcaug

SEQ ID NO: 2927571 - RNA, 17 nt, Human
caaacagucucccuucc

SEQ ID NO: 2927572 - RNA, 17 nt, Human
caaacagucucaggaaa

SEQ ID NO: 2927573 - RNA, 16 nt, Human
caaacagucucaggaa

SEQ ID NO: 2927574 - RNA, 15 nt, Human
caaacagucucagga

SEQ ID NO: 2927575 - RNA, 21 nt, Human
caaaaggauaaugaauacuuu

SEQ ID NO: 2927576 - RNA, 19 nt, Human
caaaagcugggcagguugg

SEQ ID NO: 2927577 - RNA, 22 nt, Human
auuuuuuuuuccuucagugccu

SEQ ID NO: 2927578 - RNA, 20 nt, Human
auuuuuuuuuccuucagugc

SEQ ID NO: 2927579 - RNA, 16 nt, Human
auuuuuuugagacaga

SEQ ID NO: 2927580 - RNA, 18 nt, Human
auuuuuuuuuccuucagu

SEQ ID NO: 2927581 - RNA, 15 nt, Human
auuuuuauauuugaa

SEQ ID NO: 2927582 - RNA, 14 nt, Human
auuuuuagacagag

SEQ ID NO: 2927583 - RNA, 16 nt, Human
auuuuuaagugcugca

SEQ ID NO: 2927584 - RNA, 18 nt, Human
auuuuuaagugcugcauu

SEQ ID NO: 2927585 - RNA, 19 nt, Human
auuuuuaagugcugcauuu

SEQ ID NO: 2927586 - RNA, 13 nt, Human
auuuugaaauugu

SEQ ID NO: 2927587 - RNA, 15 nt, Human
auuuugaaauuguuu

SEQ ID NO: 2927588 - RNA, 13 nt, Human
auuuuaugucuuu

SEQ ID NO: 2927589 - RNA, 19 nt, Human
auuuuagggguagcauuug

SEQ ID NO: 2927590 - RNA, 21 nt, Human
auuuuauaucaauuuaaaaaa

SEQ ID NO: 2927591 - RNA, 17 nt, Human
cacauuuuauuuuauua

SEQ ID NO: 2927592 - RNA, 19 nt, Human
cacauuuuauuuuauuaug

SEQ ID NO: 2927593 - RNA, 20 nt, Human
cacauuuuauuuuauuaugc

SEQ ID NO: 2927594 - RNA, 21 nt, Human
cacauuuuauuuuauuaugca

SEQ ID NO: 2927595 - RNA, 15 nt, Human
cacaucuguuuugua

SEQ ID NO: 2927596 - RNA, 14 nt, Human
caccaacgucugug

SEQ ID NO: 2927597 - RNA, 16 nt, Human
caccaacgucugugcc

SEQ ID NO: 2927598 - RNA, 22 nt, Human
cacaucuaguaguuguucugaa

SEQ ID NO: 2927599 - RNA, 23 nt, Human
cacaucuaguaguuguucugaaa

SEQ ID NO: 2927600 - RNA, 18 nt, Human
cacccaggaacuccugac

SEQ ID NO: 2927601 - RNA, 16 nt, Human
cacccaggagccccga

SEQ ID NO: 2927602 - RNA, 18 nt, Human
cacccaccucagccuccc

SEQ ID NO: 2927603 - RNA, 16 nt, Human
caccagccccagugcc

SEQ ID NO: 2927604 - RNA, 13 nt, Human
caccagccccagu

SEQ ID NO: 2927605 - RNA, 17 nt, Human
cacccaccucagccucc

SEQ ID NO: 2927606 - RNA, 15 nt, Human
cacacuuuggcccag

SEQ ID NO: 2927607 - RNA, 18 nt, Human
cacacuuuggcccagggu

SEQ ID NO: 2927608 - RNA, 19 nt, Human
cacacuuuggcccagggug

SEQ ID NO: 2927609 - RNA, 10 nt, Human
cacacauuuu

SEQ ID NO: 2927610 - RNA, 11 nt, Human
cacacauuuuu

SEQ ID NO: 2927611 - RNA, 12 nt, Human
cacacauuuuuu

SEQ ID NO: 2927612 - RNA, 16 nt, Human
cacacauuuuuuaaau

SEQ ID NO: 2927613 - RNA, 19 nt, Human
cacacauuuuuuaaaugca

SEQ ID NO: 2927614 - RNA, 20 nt, Human
cacacauuuuuuaaaugcac

SEQ ID NO: 2927615 - RNA, 17 nt, Human
cacagcucuucuccagg

SEQ ID NO: 2927616 - RNA, 14 nt, Human
cacagcucuucucc

SEQ ID NO: 2927617 - RNA, 15 nt, Human
cacagcucuucucca

SEQ ID NO: 2927618 - RNA, 15 nt, Human
cacagcucuguccug

SEQ ID NO: 2927619 - RNA, 16 nt, Human
cacagcucuguccugg

SEQ ID NO: 2927620 - RNA, 18 nt, Human
cacagcucuguccuggga

SEQ ID NO: 2927621 - RNA, 11 nt, Human
cacagcucugu

SEQ ID NO: 2927622 - RNA, 14 nt, Human
cacagcucuguccu

SEQ ID NO: 2927623 - RNA, 18 nt, Human
cacagacccugcccugug

SEQ ID NO: 2927624 - RNA, 13 nt, Human
cacagaagaugaa

SEQ ID NO: 2927625 - RNA, 14 nt, Human
cacagacccugccc

SEQ ID NO: 2927626 - RNA, 17 nt, Human
cacagacccugcccugu

SEQ ID NO: 2927627 - RNA, 16 nt, Human
cacagacccugcccug

SEQ ID NO: 2927628 - RNA, 23 nt, Human
caauugaaguaaaauguggcagg

SEQ ID NO: 2927629 - RNA, 15 nt, Human
caaugggagcucaug

SEQ ID NO: 2927630 - RNA, 19 nt, Human
cacaagagcccaggccucc

SEQ ID NO: 2927631 - RNA, 18 nt, Human
cacaagagcccaggccuc

SEQ ID NO: 2927632 - RNA, 19 nt, Human
cacaagcuccaagcuccca

SEQ ID NO: 2927633 - RNA, 18 nt, Human
cacaagcuccaagcuccc

SEQ ID NO: 2927634 - RNA, 20 nt, Human
cacaagagcccaggccuccu

SEQ ID NO: 2927635 - RNA, 17 nt, Human
cacaagagcccaggccu

SEQ ID NO: 2927636 - RNA, 13 nt, Human
caaucaugucagu

SEQ ID NO: 2927637 - RNA, 16 nt, Human
caauggcagccuuggc

SEQ ID NO: 2927638 - RNA, 12 nt, Human
caaugcuggcug

SEQ ID NO: 2927639 - RNA, 20 nt, Human
caaugcuggcuguuggcugg

SEQ ID NO: 2927640 - RNA, 21 nt, Human
caaugcuggcuguuggcuggg

SEQ ID NO: 2927641 - RNA, 13 nt, Human
caaugcuggcugu

SEQ ID NO: 2927642 - RNA, 21 nt, Human
cacaagcuccaagcucccagg

SEQ ID NO: 2927643 - RNA, 20 nt, Human
cacaagcuccaagcucccag

SEQ ID NO: 2927644 - RNA, 21 nt, Human
caaggccaaaggaagcacaug

SEQ ID NO: 2927645 - RNA, 20 nt, Human
caaggccaaaggaagcacau

SEQ ID NO: 2927646 - RNA, 19 nt, Human
caaggccaaaggaagcaca

SEQ ID NO: 2927647 - RNA, 16 nt, Human
caaggcaaggcuguca

SEQ ID NO: 2927648 - RNA, 17 nt, Human
caaggcaaggcugucaa

SEQ ID NO: 2927649 - RNA, 18 nt, Human
caaggcaaggcugucaau

SEQ ID NO: 2927650 - RNA, 21 nt, Human
caaggccuuccccuggcacug

SEQ ID NO: 2927651 - RNA, 18 nt, Human
caaggccuuccccuggca

SEQ ID NO: 2927652 - RNA, 21 nt, Human
caaggccugucagcuaaagaa

SEQ ID NO: 2927653 - RNA, 21 nt, Human
caagucagucauucagauaug

SEQ ID NO: 2927654 - RNA, 12 nt, Human
caaguuugaauu

SEQ ID NO: 2927655 - RNA, 20 nt, Human
caauaaaauccauacauuug

SEQ ID NO: 2927656 - RNA, 23 nt, Human
caauaaaauccauacauuugugu

SEQ ID NO: 2927657 - RNA, 15 nt, Human
caauaaaauggguuu

SEQ ID NO: 2927658 - RNA, 12 nt, Human
caccucagccuc

SEQ ID NO: 2927659 - RNA, 21 nt, Human
caccuuuuucauacaaggccc

SEQ ID NO: 2927660 - RNA, 19 nt, Human
caccuuuuucauacaaggc

SEQ ID NO: 2927661 - RNA, 14 nt, Human
caccuuucccaucu

SEQ ID NO: 2927662 - RNA, 18 nt, Human
caccuuggcugcagggag

SEQ ID NO: 2927663 - RNA, 15 nt, Human
caccuuggcugcagg

SEQ ID NO: 2927664 - RNA, 16 nt, Human
caccuuggcugcaggg

SEQ ID NO: 2927665 - RNA, 20 nt, Human
cacucuuauugcccacgcug

SEQ ID NO: 2927666 - RNA, 21 nt, Human
cacucuuauugcccacgcugg

SEQ ID NO: 2927667 - RNA, 22 nt, Human
cacucuuauugcccacgcugga

SEQ ID NO: 2927668 - RNA, 14 nt, Human
cacggcucacugca

SEQ ID NO: 2927669 - RNA, 17 nt, Human
cacggccaggccagagg

SEQ ID NO: 2927670 - RNA, 12 nt, Human
cacggccaggcc

SEQ ID NO: 2927671 - RNA, 13 nt, Human
cacggccaggcca

SEQ ID NO: 2927672 - RNA, 20 nt, Human
cacucugucgcccagucugg

SEQ ID NO: 2927673 - RNA, 13 nt, Human
cacuccagccugg

SEQ ID NO: 2927674 - RNA, 14 nt, Human
cacuccagccuggg

SEQ ID NO: 2927675 - RNA, 23 nt, Human
cacuccagccugagcgacaguga

SEQ ID NO: 2927676 - RNA, 16 nt, Human
cacuacauucuguuaa

SEQ ID NO: 2927677 - RNA, 17 nt, Human
cacuacauucuguuaau

SEQ ID NO: 2927678 - RNA, 21 nt, Human
cacuacauucuguuaaucauu

SEQ ID NO: 2927679 - RNA, 13 nt, Human
cacuccagccuga

SEQ ID NO: 2927680 - RNA, 12 nt, Human
cacuccagccug

SEQ ID NO: 2927681 - RNA, 16 nt, Human
cagaaauguacagcaa

SEQ ID NO: 2927682 - RNA, 16 nt, Human
cagaaguuucugccgc

SEQ ID NO: 2927683 - RNA, 14 nt, Human
cagaaguuucugcc

SEQ ID NO: 2927684 - RNA, 11 nt, Human
cagaacaguga

SEQ ID NO: 2927685 - RNA, 12 nt, Human
cagaacagugau

SEQ ID NO: 2927686 - RNA, 17 nt, Human
cagaacagugauuacca

SEQ ID NO: 2927687 - RNA, 13 nt, Human
cacuuucuagcca

SEQ ID NO: 2927688 - RNA, 17 nt, Human
cacuuucuagccagagg

SEQ ID NO: 2927689 - RNA, 16 nt, Human
cacuuucuagccagag

SEQ ID NO: 2927690 - RNA, 13 nt, Human
cacuuuaaaacac

SEQ ID NO: 2927691 - RNA, 18 nt, Human
cacuuguguuaugaagca

SEQ ID NO: 2927692 - RNA, 17 nt, Human
cacugccaugccagcuu

SEQ ID NO: 2927693 - RNA, 20 nt, Human
cacugcagccucaaccuccu

SEQ ID NO: 2927694 - RNA, 21 nt, Human
cacugcagccucaaccuccug

SEQ ID NO: 2927695 - RNA, 22 nt, Human
cacugcagccucaaccuccugg

SEQ ID NO: 2927696 - RNA, 23 nt, Human
cacugcagccucaaccuccuggg

SEQ ID NO: 2927697 - RNA, 19 nt, Human
cacugcagccucaaccucc

SEQ ID NO: 2927698 - RNA, 14 nt, Human
cacugcagccucaa

SEQ ID NO: 2927699 - RNA, 18 nt, Human
cacuggguguaaacacau

SEQ ID NO: 2927700 - RNA, 23 nt, Human
cacuguugcccaggcuggcgugc

SEQ ID NO: 2927701 - RNA, 18 nt, Human
cacuguugcccaggcugg

SEQ ID NO: 2927702 - RNA, 19 nt, Human
cacuguugcccaggcuggc

SEQ ID NO: 2927703 - RNA, 15 nt, Human
cacuuaaaaaugguu

SEQ ID NO: 2927704 - RNA, 18 nt, Human
cuggcagaguugaagaca

SEQ ID NO: 2927705 - RNA, 17 nt, Human
cuggcagaguugaagac

SEQ ID NO: 2927706 - RNA, 12 nt, Human
cuggcagccccu

SEQ ID NO: 2927707 - RNA, 11 nt, Human
cuggcagccca

SEQ ID NO: 2927708 - RNA, 11 nt, Human
cugggacacag

SEQ ID NO: 2927709 - RNA, 14 nt, Human
cuggccuagcauac

SEQ ID NO: 2927710 - RNA, 22 nt, Human
cuggccccucagggucccuggu

SEQ ID NO: 2927711 - RNA, 15 nt, Human
cugggcagaaggaag

SEQ ID NO: 2927712 - RNA, 12 nt, Human
cugggcagaagg

SEQ ID NO: 2927713 - RNA, 14 nt, Human
cuggggagaaagua

SEQ ID NO: 2927714 - RNA, 18 nt, Human
cuggguucacugcaaccu

SEQ ID NO: 2927715 - RNA, 20 nt, Human
cuggguucacugcaaccucc

SEQ ID NO: 2927716 - RNA, 15 nt, Human
cuggguucacugcaa

SEQ ID NO: 2927717 - RNA, 18 nt, Human
cuggauauagcuagguga

SEQ ID NO: 2927718 - RNA, 19 nt, Human
cuggauaguccgucucugc

SEQ ID NO: 2927719 - RNA, 18 nt, Human
cuggauaguccgucucug

SEQ ID NO: 2927720 - RNA, 19 nt, Human
cugcuuuugucuaugggac

SEQ ID NO: 2927721 - RNA, 21 nt, Human
cugcuuuugucuaugggacuc

SEQ ID NO: 2927722 - RNA, 19 nt, Human
cugcuuuuuaaagaaugcu

SEQ ID NO: 2927723 - RNA, 23 nt, Human
cuggacugagggggccuggaugc

SEQ ID NO: 2927724 - RNA, 20 nt, Human
cuggacugagggggccugga

SEQ ID NO: 2927725 - RNA, 21 nt, Human
cuggacugagggggccuggau

SEQ ID NO: 2927726 - RNA, 22 nt, Human
cuggacugagggggccuggaug

SEQ ID NO: 2927727 - RNA, 18 nt, Human
cuggacugagggggccug

SEQ ID NO: 2927728 - RNA, 14 nt, Human
cuggagaaaaugga

SEQ ID NO: 2927729 - RNA, 14 nt, Human
cugcuucaaauauu

SEQ ID NO: 2927730 - RNA, 20 nt, Human
cugcuucaaggauccugagc

SEQ ID NO: 2927731 - RNA, 20 nt, Human
cugcuuuugucuaugggacu

SEQ ID NO: 2927732 - RNA, 23 nt, Human
cugcuucaaggauccugagccag

SEQ ID NO: 2927733 - RNA, 22 nt, Human
cugcuucaaggauccugagcca

SEQ ID NO: 2927734 - RNA, 21 nt, Human
cugcuucaaggauccugagcc

SEQ ID NO: 2927735 - RNA, 13 nt, Human
cugcuucaaggau

SEQ ID NO: 2927736 - RNA, 12 nt, Human
cugcuucaagga

SEQ ID NO: 2927737 - RNA, 19 nt, Human
cugcuucaaauauuucccu

SEQ ID NO: 2927738 - RNA, 21 nt, Human
cugcugacuguuuucucuuga

SEQ ID NO: 2927739 - RNA, 18 nt, Human
cugcugacuguuuucucu

SEQ ID NO: 2927740 - RNA, 23 nt, Human
cugccuguugggccaggagccuc

SEQ ID NO: 2927741 - RNA, 22 nt, Human
cugccuguugggccaggagccu

SEQ ID NO: 2927742 - RNA, 21 nt, Human
cugccuguugggccaggagcc

SEQ ID NO: 2927743 - RNA, 21 nt, Human
cugccuccccuccucugcuug

SEQ ID NO: 2927744 - RNA, 17 nt, Human
cugccuguucagcucca

SEQ ID NO: 2927745 - RNA, 18 nt, Human
cugccuguucagcuccag

SEQ ID NO: 2927746 - RNA, 19 nt, Human
cugccuguucagcuccagc

SEQ ID NO: 2927747 - RNA, 20 nt, Human
cugccuguugggccaggagc

SEQ ID NO: 2927748 - RNA, 15 nt, Human
cugccucucccauca

SEQ ID NO: 2927749 - RNA, 22 nt, Human
cugccucucccaucacuucccu

SEQ ID NO: 2927750 - RNA, 23 nt, Human
cugccucucccaucacuucccua

SEQ ID NO: 2927751 - RNA, 17 nt, Human
cugucggagcccugucu

SEQ ID NO: 2927752 - RNA, 15 nt, Human
cugucgcccagucug

SEQ ID NO: 2927753 - RNA, 16 nt, Human
cugucgcccagucugg

SEQ ID NO: 2927754 - RNA, 21 nt, Human
cuguccugggagugagcuggu

SEQ ID NO: 2927755 - RNA, 20 nt, Human
cugucaauuacaggaaguac

SEQ ID NO: 2927756 - RNA, 19 nt, Human
cugucaauuacaggaagua

SEQ ID NO: 2927757 - RNA, 23 nt, Human
cugucaauuacaggaaguacugg

SEQ ID NO: 2927758 - RNA, 13 nt, Human
cuguagaguggga

SEQ ID NO: 2927759 - RNA, 12 nt, Human
cugugcugcccu

SEQ ID NO: 2927760 - RNA, 14 nt, Human
cugugcugcccugc

SEQ ID NO: 2927761 - RNA, 13 nt, Human
cugugcugcccug

SEQ ID NO: 2927762 - RNA, 18 nt, Human
cugugccucugggacugg

SEQ ID NO: 2927763 - RNA, 19 nt, Human
cugugucagcauagaagua

SEQ ID NO: 2927764 - RNA, 17 nt, Human
cugugucagcauagaag

SEQ ID NO: 2927765 - RNA, 19 nt, Human
cugugcugcccugcccacc

SEQ ID NO: 2927766 - RNA, 18 nt, Human
cugugcugcccugcccac

SEQ ID NO: 2927767 - RNA, 17 nt, Human
cugugcugcccugccca

SEQ ID NO: 2927768 - RNA, 15 nt, Human
cugugcugcccugcc

SEQ ID NO: 2927769 - RNA, 13 nt, Human
cuguuauaaucuu

SEQ ID NO: 2927770 - RNA, 21 nt, Human
cuuagggaaggauacaaaagc

SEQ ID NO: 2927771 - RNA, 19 nt, Human
cuuagggaaggauacaaaa

SEQ ID NO: 2927772 - RNA, 16 nt, Human
cuuaccagcagagcac

SEQ ID NO: 2927773 - RNA, 22 nt, Human
cuuagcucauucuccuuguguu

SEQ ID NO: 2927774 - RNA, 23 nt, Human
cuuagcucauucuccuuguguua

SEQ ID NO: 2927775 - RNA, 14 nt, Human
cuguuggcuggggg

SEQ ID NO: 2927776 - RNA, 19 nt, Human
cuguuggcugggggccuca

SEQ ID NO: 2927777 - RNA, 22 nt, Human
cuguuggcugggggccucagug

SEQ ID NO: 2927778 - RNA, 21 nt, Human
cuuaaaaaugguuuaaauggu

SEQ ID NO: 2927779 - RNA, 15 nt, Human
cuuaccagcagagca

SEQ ID NO: 2927780 - RNA, 14 nt, Human
cuuaaaacaacacu

SEQ ID NO: 2927781 - RNA, 22 nt, Human
cuuggauuguccccgacccuug

SEQ ID NO: 2927782 - RNA, 24 nt, Human
cuuggauuguccccgacccuugcc

SEQ ID NO: 2927783 - RNA, 23 nt, Human
cuuggauuguccccgacccuugc

SEQ ID NO: 2927784 - RNA, 12 nt, Human
cuugauucauaa

SEQ ID NO: 2927785 - RNA, 12 nt, Human
cuugcaaaguau

SEQ ID NO: 2927786 - RNA, 18 nt, Human
cuugauguguuaucucuu

SEQ ID NO: 2927787 - RNA, 17 nt, Human
cuugauauccucuuuga

SEQ ID NO: 2927788 - RNA, 22 nt, Human
cuugauauccucuuugagugaa

SEQ ID NO: 2927789 - RNA, 20 nt, Human
cuugacagggcacaccgggc

SEQ ID NO: 2927790 - RNA, 16 nt, Human
cuugacaucaacugca

SEQ ID NO: 2927791 - RNA, 14 nt, Human
cuucuucagagacu

SEQ ID NO: 2927792 - RNA, 13 nt, Human
cuucuucagagac

SEQ ID NO: 2927793 - RNA, 23 nt, Human
cuucugaacuuggcgcugccccu

SEQ ID NO: 2927794 - RNA, 13 nt, Human
cuuccuccuggug

SEQ ID NO: 2927795 - RNA, 22 nt, Human
cuuccucuuuccaucuacccuc

SEQ ID NO: 2927796 - RNA, 21 nt, Human
cuuccucuuuccaucuacccu

SEQ ID NO: 2927797 - RNA, 20 nt, Human
cuucucacauuuauauuuuu

SEQ ID NO: 2927798 - RNA, 13 nt, Human
cuucucacauuua

SEQ ID NO: 2927799 - RNA, 21 nt, Human
cuucuaaguaaaaccacagca

SEQ ID NO: 2927800 - RNA, 17 nt, Human
cuucuaaguaaaaccac

SEQ ID NO: 2927801 - RNA, 13 nt, Human
cuucuaaguaaaa

SEQ ID NO: 2927802 - RNA, 15 nt, Human
cuuucuacccagcga

SEQ ID NO: 2927803 - RNA, 16 nt, Human
cuuucuacccagcgag

SEQ ID NO: 2927804 - RNA, 17 nt, Human
cuuugacgccaucccag

SEQ ID NO: 2927805 - RNA, 16 nt, Human
cuuugacgccauccca

SEQ ID NO: 2927806 - RNA, 19 nt, Human
cuuuuauaaacuuuaccuu

SEQ ID NO: 2927807 - RNA, 22 nt, Human
cuuuguauucucuccuguaccu

SEQ ID NO: 2927808 - RNA, 20 nt, Human
cuuuuauaaacuuuaccuuu

SEQ ID NO: 2927809 - RNA, 21 nt, Human
cuuuuauaaacuuuaccuuuu

SEQ ID NO: 2927810 - RNA, 15 nt, Human
cuuugcacacuuugg

SEQ ID NO: 2927811 - RNA, 23 nt, Human
cuuugguuauuuuacuuuuugga

SEQ ID NO: 2927812 - RNA, 17 nt, Human
cuuugguuauuuuacuu

SEQ ID NO: 2927813 - RNA, 19 nt, Human
cuuugguuauuuuacuuuu

SEQ ID NO: 2927814 - RNA, 13 nt, Human
cuuugguuauuuu

SEQ ID NO: 2927815 - RNA, 22 nt, Human
cuuugcacacuuuggcccaggg

SEQ ID NO: 2927816 - RNA, 19 nt, Human
cuuugcacacuuuggccca

SEQ ID NO: 2927817 - RNA, 20 nt, Human
cuuugcacacuuuggcccag

SEQ ID NO: 2927818 - RNA, 17 nt, Human
cuuuguauucucuccug

SEQ ID NO: 2927819 - RNA, 23 nt, Human
cuuuaaugucacaggcaggucca

SEQ ID NO: 2927820 - RNA, 18 nt, Human
cuuuaccaauugaaguaa

SEQ ID NO: 2927821 - RNA, 16 nt, Human
cuuuaccaauugaagu

SEQ ID NO: 2927822 - RNA, 19 nt, Human
cuuuaccaauugaaguaaa

SEQ ID NO: 2927823 - RNA, 20 nt, Human
cuuuaccaauugaaguaaaa

SEQ ID NO: 2927824 - RNA, 20 nt, Human
cuuucacccuuuucuguuug

SEQ ID NO: 2927825 - RNA, 15 nt, Human
cuuucacccuuuucu

SEQ ID NO: 2927826 - RNA, 14 nt, Human
cuuucacccuuuuc

SEQ ID NO: 2927827 - RNA, 22 nt, Human
cuugguagaagcccuucuaccu

SEQ ID NO: 2927828 - RNA, 19 nt, Human
cuuggucugugagaugcua

SEQ ID NO: 2927829 - RNA, 16 nt, Human
cuuggucugugagaug

SEQ ID NO: 2927830 - RNA, 14 nt, Human
cuugguccugcugc

SEQ ID NO: 2927831 - RNA, 19 nt, Human
cuuggugucgggcaugaca

SEQ ID NO: 2927832 - RNA, 20 nt, Human
cuuggugucgggcaugacac

SEQ ID NO: 2927833 - RNA, 22 nt, Human
cuugugaauaaagagggugggu

SEQ ID NO: 2927834 - RNA, 18 nt, Human
cuugucuuuggacccuga

SEQ ID NO: 2927835 - RNA, 15 nt, Human
cuugucuuuggaccc

SEQ ID NO: 2927836 - RNA, 13 nt, Human
cuugucuuuggac

SEQ ID NO: 2927837 - RNA, 18 nt, Human
gaaccaccacacccagcc

SEQ ID NO: 2927838 - RNA, 20 nt, Human
gaaccaccacacccagccca

SEQ ID NO: 2927839 - RNA, 21 nt, Human
gaaccaccacacccagcccac

SEQ ID NO: 2927840 - RNA, 22 nt, Human
gaaccaccacacccagcccacu

SEQ ID NO: 2927841 - RNA, 22 nt, Human
gaacugaucauguuuaugagaa

SEQ ID NO: 2927842 - RNA, 20 nt, Human
gaacugaucauguuuaugag

SEQ ID NO: 2927843 - RNA, 17 nt, Human
gaacugauguaaguaaa

SEQ ID NO: 2927844 - RNA, 14 nt, Human
gaacuccuggccuc

SEQ ID NO: 2927845 - RNA, 13 nt, Human
gaacuccuggccu

SEQ ID NO: 2927846 - RNA, 17 nt, Human
gaacccgggaggcagag

SEQ ID NO: 2927847 - RNA, 23 nt, Human
gaaccaccacacccagcccacuu

SEQ ID NO: 2927848 - RNA, 22 nt, Human
gaaccauggucggaaaacaugc

SEQ ID NO: 2927849 - RNA, 17 nt, Human
gaacccaaguccaagca

SEQ ID NO: 2927850 - RNA, 16 nt, Human
gaacccaaguccaagc

SEQ ID NO: 2927851 - RNA, 16 nt, Human
gaagacacugaugggc

SEQ ID NO: 2927852 - RNA, 21 nt, Human
gaagacacugaugggcaaccc

SEQ ID NO: 2927853 - RNA, 13 nt, Human
gaagacagcucuu

SEQ ID NO: 2927854 - RNA, 12 nt, Human
gaagacagcucu

SEQ ID NO: 2927855 - RNA, 15 nt, Human
gaagacagagcuaca

SEQ ID NO: 2927856 - RNA, 13 nt, Human
gaagacagagcua

SEQ ID NO: 2927857 - RNA, 15 nt, Human
gaagacagcucuuau

SEQ ID NO: 2927858 - RNA, 14 nt, Human
gaagacagcucuua

SEQ ID NO: 2927859 - RNA, 20 nt, Human
gaagcacccauuaugcgcug

SEQ ID NO: 2927860 - RNA, 21 nt, Human
gaagcacaugccucucucagg

SEQ ID NO: 2927861 - RNA, 16 nt, Human
gaagcaccauaacuuu

SEQ ID NO: 2927862 - RNA, 13 nt, Human
gaagcacagcuuc

SEQ ID NO: 2927863 - RNA, 14 nt, Human
gaagcacagcuuca

SEQ ID NO: 2927864 - RNA, 22 nt, Human
gaagcacaugccucucucaggc

SEQ ID NO: 2927865 - RNA, 17 nt, Human
gaagcacagugaucaag

SEQ ID NO: 2927866 - RNA, 17 nt, Human
gaagacucauucuucug

SEQ ID NO: 2927867 - RNA, 18 nt, Human
gaagacucauucuucugu

SEQ ID NO: 2927868 - RNA, 16 nt, Human
gaagacucauucuucu

SEQ ID NO: 2927869 - RNA, 16 nt, Human
gaaaauuauucuauaa

SEQ ID NO: 2927870 - RNA, 17 nt, Human
gaaaagacuccaaagaa

SEQ ID NO: 2927871 - RNA, 16 nt, Human
gaaaagacuccaaaga

SEQ ID NO: 2927872 - RNA, 14 nt, Human
gaaaagacuccaaa

SEQ ID NO: 2927873 - RNA, 23 nt, Human
gaaaagaaaaaugagccuggcaa

SEQ ID NO: 2927874 - RNA, 21 nt, Human
gaaaacuuuaugcuaagugaa

SEQ ID NO: 2927875 - RNA, 13 nt, Human
gaaacuggauuaa

SEQ ID NO: 2927876 - RNA, 17 nt, Human
gaaacuggauuaaacuu

SEQ ID NO: 2927877 - RNA, 17 nt, Human
gaaacuggcaaagcaga

SEQ ID NO: 2927878 - RNA, 16 nt, Human
gaaacuggcaaagcag

SEQ ID NO: 2927879 - RNA, 18 nt, Human
gaaagaaaaucaggcugg

SEQ ID NO: 2927880 - RNA, 13 nt, Human
gaaaggcuccagg

SEQ ID NO: 2927881 - RNA, 15 nt, Human
gaaaggcuccaggag

SEQ ID NO: 2927882 - RNA, 14 nt, Human
gaaaggcuccagga

SEQ ID NO: 2927883 - RNA, 13 nt, Human
gaaagggcccaga

SEQ ID NO: 2927884 - RNA, 20 nt, Human
gaaagggauuuucagcccuc

SEQ ID NO: 2927885 - RNA, 12 nt, Human
gaaagggauuuu

SEQ ID NO: 2927886 - RNA, 12 nt, Human
gaaaggcuccag

SEQ ID NO: 2927887 - RNA, 18 nt, Human
gaaaucuaggaaaauuau

SEQ ID NO: 2927888 - RNA, 15 nt, Human
gaaagggcccagaga

SEQ ID NO: 2927889 - RNA, 16 nt, Human
gaaagggcccagagag

SEQ ID NO: 2927890 - RNA, 22 nt, Human
gcacuauaauguaagcucuacu

SEQ ID NO: 2927891 - RNA, 22 nt, Human
gcacuauagccuaggugacaga

SEQ ID NO: 2927892 - RNA, 15 nt, Human
gcacuauuuauuuac

SEQ ID NO: 2927893 - RNA, 21 nt, Human
gcacuauuuauuuacaaaugu

SEQ ID NO: 2927894 - RNA, 17 nt, Human
gcacuauuuauuuacaa

SEQ ID NO: 2927895 - RNA, 18 nt, Human
gcacuauuuauuuacaaa

SEQ ID NO: 2927896 - RNA, 15 nt, Human
gcacuccagccuggg

SEQ ID NO: 2927897 - RNA, 17 nt, Human
gcacuccagccugggug

SEQ ID NO: 2927898 - RNA, 12 nt, Human
gcaccuccugcc

SEQ ID NO: 2927899 - RNA, 16 nt, Human
gcaccggcuggccugg

SEQ ID NO: 2927900 - RNA, 15 nt, Human
gcaccggcuggccug

SEQ ID NO: 2927901 - RNA, 17 nt, Human
gcaccggcuggccuggc

SEQ ID NO: 2927902 - RNA, 20 nt, Human
gcacacaccagagcccaccu

SEQ ID NO: 2927903 - RNA, 11 nt, Human
gcacacauuuu

SEQ ID NO: 2927904 - RNA, 12 nt, Human
gcacacauuuuu

SEQ ID NO: 2927905 - RNA, 18 nt, Human
gcaaccuccgccucuugg

SEQ ID NO: 2927906 - RNA, 22 nt, Human
gcaacccuggugaccagcacca

SEQ ID NO: 2927907 - RNA, 17 nt, Human
gcaacccccagccugcu

SEQ ID NO: 2927908 - RNA, 16 nt, Human
gcaaaagaugcuucuc

SEQ ID NO: 2927909 - RNA, 18 nt, Human
gcaacccccagccugcua

SEQ ID NO: 2927910 - RNA, 15 nt, Human
gcaaaagaugcuucu

SEQ ID NO: 2927911 - RNA, 12 nt, Human
gcacacaccaga

SEQ ID NO: 2927912 - RNA, 14 nt, Human
gcacacaccagagc

SEQ ID NO: 2927913 - RNA, 15 nt, Human
gcacacaccagagcc

SEQ ID NO: 2927914 - RNA, 16 nt, Human
gcacacaccagagccc

SEQ ID NO: 2927915 - RNA, 17 nt, Human
gcacacaccagagccca

SEQ ID NO: 2927916 - RNA, 18 nt, Human
gcacacaccagagcccac

SEQ ID NO: 2927917 - RNA, 19 nt, Human
gcacacaccagagcccacc

SEQ ID NO: 2927918 - RNA, 23 nt, Human
gcaauaaggggagaguaacccug

SEQ ID NO: 2927919 - RNA, 18 nt, Human
gcaauagucaaauugugu

SEQ ID NO: 2927920 - RNA, 16 nt, Human
gcaauaaaauggguuu

SEQ ID NO: 2927921 - RNA, 11 nt, Human
gcaauaaagca

SEQ ID NO: 2927922 - RNA, 19 nt, Human
gauucuccugccucagccu

SEQ ID NO: 2927923 - RNA, 20 nt, Human
gauucuccugccucagccuc

SEQ ID NO: 2927924 - RNA, 21 nt, Human
gauucuccugccucagccucc

SEQ ID NO: 2927925 - RNA, 21 nt, Human
gauucuucugcuucagccucc

SEQ ID NO: 2927926 - RNA, 23 nt, Human
gauucuuauggacaaugacccag

SEQ ID NO: 2927927 - RNA, 20 nt, Human
gauuuaacagaaauguacag

SEQ ID NO: 2927928 - RNA, 23 nt, Human
gauuuaacagaaauguacagcaa

SEQ ID NO: 2927929 - RNA, 15 nt, Human
gauucuuguauuuau

SEQ ID NO: 2927930 - RNA, 21 nt, Human
gauucuuguauuuauuacaac

SEQ ID NO: 2927931 - RNA, 13 nt, Human
gcaaaaaaaauua

SEQ ID NO: 2927932 - RNA, 16 nt, Human
gcaaaaaaaauuagcc

SEQ ID NO: 2927933 - RNA, 22 nt, Human
gauuuuuuuuuccuucagugcc

SEQ ID NO: 2927934 - RNA, 23 nt, Human
gauuuuuuuuuccuucagugccu

SEQ ID NO: 2927935 - RNA, 16 nt, Human
gauuucacucuccuug

SEQ ID NO: 2927936 - RNA, 13 nt, Human
gauuucacucucc

SEQ ID NO: 2927937 - RNA, 18 nt, Human
gauuucacucuccuuggu

SEQ ID NO: 2927938 - RNA, 17 nt, Human
gauuucacucuccuugg

SEQ ID NO: 2927939 - RNA, 20 nt, Human
gaucuggguucacugcaacc

SEQ ID NO: 2927940 - RNA, 18 nt, Human
gaucuggguucacugcaa

SEQ ID NO: 2927941 - RNA, 21 nt, Human
gaugaugaaaugaggucagag

SEQ ID NO: 2927942 - RNA, 21 nt, Human
gaugcugucuucguacuggga

SEQ ID NO: 2927943 - RNA, 19 nt, Human
gauggaggacuccaggcag

SEQ ID NO: 2927944 - RNA, 14 nt, Human
gaugcuuguacaua

SEQ ID NO: 2927945 - RNA, 16 nt, Human
gaugcuuguacauaau

SEQ ID NO: 2927946 - RNA, 17 nt, Human
gcauccuggcacccggc

SEQ ID NO: 2927947 - RNA, 21 nt, Human
gcauccuggcacccggccccu

SEQ ID NO: 2927948 - RNA, 14 nt, Human
gcauccuggcaccc

SEQ ID NO: 2927949 - RNA, 22 nt, Human
gcauccuggcacccggccccug

SEQ ID NO: 2927950 - RNA, 23 nt, Human
gcauccuggcacccggccccugc

SEQ ID NO: 2927951 - RNA, 19 nt, Human
gcaugggaaugaaugucag

SEQ ID NO: 2927952 - RNA, 16 nt, Human
gcaugggaaugaaugu

SEQ ID NO: 2927953 - RNA, 13 nt, Human
gcaugggaaugaa

SEQ ID NO: 2927954 - RNA, 18 nt, Human
gcauguauuuuugucaau

SEQ ID NO: 2927955 - RNA, 17 nt, Human
gcaugugaugagaggaa

SEQ ID NO: 2927956 - RNA, 16 nt, Human
gcauuguaaaugugcu

SEQ ID NO: 2927957 - RNA, 12 nt, Human
gcauuuaaaaga

SEQ ID NO: 2927958 - RNA, 15 nt, Human
gcauuuaaaagauac

SEQ ID NO: 2927959 - RNA, 14 nt, Human
gcauuugaaaauuu

SEQ ID NO: 2927960 - RNA, 16 nt, Human
gcauuugaaaauuuug

SEQ ID NO: 2927961 - RNA, 18 nt, Human
gccaagaauucuuaaaua

SEQ ID NO: 2927962 - RNA, 14 nt, Human
gccaagaauucuua

SEQ ID NO: 2927963 - RNA, 11 nt, Human
gccaaggccaa

SEQ ID NO: 2927964 - RNA, 17 nt, Human
gccaaggccaaaggaag

SEQ ID NO: 2927965 - RNA, 18 nt, Human
gcacuuugggaggcugag

SEQ ID NO: 2927966 - RNA, 16 nt, Human
gcacuuuguucuggcu

SEQ ID NO: 2927967 - RNA, 22 nt, Human
gcagcugcgguccacccaggag

SEQ ID NO: 2927968 - RNA, 23 nt, Human
gcagcugcgguccacccaggagc

SEQ ID NO: 2927969 - RNA, 13 nt, Human
gcagcugcuuuug

SEQ ID NO: 2927970 - RNA, 20 nt, Human
gcagcugcuuuugucuaugg

SEQ ID NO: 2927971 - RNA, 16 nt, Human
gcagcuugaggguugg

SEQ ID NO: 2927972 - RNA, 15 nt, Human
gcagcuuauucacaa

SEQ ID NO: 2927973 - RNA, 13 nt, Human
gcagggaaacagc

SEQ ID NO: 2927974 - RNA, 22 nt, Human
gcagggaaacagcuaaugggac

SEQ ID NO: 2927975 - RNA, 17 nt, Human
gcaggcucucaggccag

SEQ ID NO: 2927976 - RNA, 14 nt, Human
gcaggcuggaguua

SEQ ID NO: 2927977 - RNA, 18 nt, Human
gcaggcugccagugccug

SEQ ID NO: 2927978 - RNA, 17 nt, Human
gcaggcugccagugccu

SEQ ID NO: 2927979 - RNA, 19 nt, Human
gcagcuugaggguugggcu

SEQ ID NO: 2927980 - RNA, 21 nt, Human
gcagcuugaggguugggcugg

SEQ ID NO: 2927981 - RNA, 12 nt, Human
gcaggcucucag

SEQ ID NO: 2927982 - RNA, 22 nt, Human
gcaggcucgggcuccccagccc

SEQ ID NO: 2927983 - RNA, 16 nt, Human
gcaggcucucaggcca

SEQ ID NO: 2927984 - RNA, 15 nt, Human
gcaggcucucaggcc

SEQ ID NO: 2927985 - RNA, 14 nt, Human
gcaggcucucaggc

SEQ ID NO: 2927986 - RNA, 13 nt, Human
gcaggcucucagg

SEQ ID NO: 2927987 - RNA, 16 nt, Human
gcauaccacuuuuguu

SEQ ID NO: 2927988 - RNA, 15 nt, Human
gcauaccacuuuugu

SEQ ID NO: 2927989 - RNA, 15 nt, Human
gcauaaaaauuagcc

SEQ ID NO: 2927990 - RNA, 23 nt, Human
gcaguugccagucaccccggcca

SEQ ID NO: 2927991 - RNA, 14 nt, Human
gcaguugccaguca

SEQ ID NO: 2927992 - RNA, 22 nt, Human
gcaguugaaaagacuccaaaga

SEQ ID NO: 2927993 - RNA, 20 nt, Human
gaggccagagacacaagccu

SEQ ID NO: 2927994 - RNA, 17 nt, Human
gaggcucugcccuuggu

SEQ ID NO: 2927995 - RNA, 15 nt, Human
gaggcucugcccuug

SEQ ID NO: 2927996 - RNA, 14 nt, Human
gaggcucugcccuu

SEQ ID NO: 2927997 - RNA, 13 nt, Human
gaggcucugcccu

SEQ ID NO: 2927998 - RNA, 12 nt, Human
gaggcucugccc

SEQ ID NO: 2927999 - RNA, 12 nt, Human
gaggggaacaga

SEQ ID NO: 2928000 - RNA, 15 nt, Human
gagggcuccagacac

SEQ ID NO: 2928001 - RNA, 14 nt, Human
gagggcuccagaca

SEQ ID NO: 2928002 - RNA, 13 nt, Human
gagggcuccagac

SEQ ID NO: 2928003 - RNA, 12 nt, Human
gagggcuccaga

SEQ ID NO: 2928004 - RNA, 13 nt, Human
gaggugggauccu

SEQ ID NO: 2928005 - RNA, 16 nt, Human
gaggugggauccucca

SEQ ID NO: 2928006 - RNA, 15 nt, Human
gaggugggauccucc

SEQ ID NO: 2928007 - RNA, 17 nt, Human
gaggugggauccuccag

SEQ ID NO: 2928008 - RNA, 21 nt, Human
gagucacuggaacacuaauga

SEQ ID NO: 2928009 - RNA, 14 nt, Human
gagucacuggaaca

SEQ ID NO: 2928010 - RNA, 19 nt, Human
gaguugauacuacaguuug

SEQ ID NO: 2928011 - RNA, 21 nt, Human
gaguugauagcacagacccug

SEQ ID NO: 2928012 - RNA, 22 nt, Human
gaguugauacuacaguuuguua

SEQ ID NO: 2928013 - RNA, 13 nt, Human
gagugcagugagc

SEQ ID NO: 2928014 - RNA, 18 nt, Human
gagugcagugagccgaga

SEQ ID NO: 2928015 - RNA, 14 nt, Human
gagugagacucugu

SEQ ID NO: 2928016 - RNA, 18 nt, Human
gagugagacucugucuca

SEQ ID NO: 2928017 - RNA, 18 nt, Human
gagucagaaguuucugcc

SEQ ID NO: 2928018 - RNA, 22 nt, Human
gagcaucaggccaggcccucug

SEQ ID NO: 2928019 - RNA, 20 nt, Human
gagcaucaggccaggcccuc

SEQ ID NO: 2928020 - RNA, 15 nt, Human
gagcugccuguucag

SEQ ID NO: 2928021 - RNA, 17 nt, Human
gagcggagaaaggaagg

SEQ ID NO: 2928022 - RNA, 16 nt, Human
gagcugccuguucagc

SEQ ID NO: 2928023 - RNA, 19 nt, Human
gagcugccuguucagcucc

SEQ ID NO: 2928024 - RNA, 17 nt, Human
gagcaucaggccaggcc

SEQ ID NO: 2928025 - RNA, 13 nt, Human
gagcgacagugag

SEQ ID NO: 2928026 - RNA, 15 nt, Human
gagcgacagugagac

SEQ ID NO: 2928027 - RNA, 13 nt, Human
gagccuuccaggg

SEQ ID NO: 2928028 - RNA, 12 nt, Human
gagccuuccagg

SEQ ID NO: 2928029 - RNA, 17 nt, Human
gagaagcggcuggcagc

SEQ ID NO: 2928030 - RNA, 22 nt, Human
gacuguacaaaguagaagucuu

SEQ ID NO: 2928031 - RNA, 17 nt, Human
gacucaaugcacugaca

SEQ ID NO: 2928032 - RNA, 14 nt, Human
gacucaaugcacug

SEQ ID NO: 2928033 - RNA, 21 nt, Human
gacuuuucuguccgagcuuug

SEQ ID NO: 2928034 - RNA, 22 nt, Human
gacuuuguuaguuucuccaagc

SEQ ID NO: 2928035 - RNA, 22 nt, Human
gacuuugguuauuuuacuuuuu

SEQ ID NO: 2928036 - RNA, 14 nt, Human
gacuuuggaaagag

SEQ ID NO: 2928037 - RNA, 14 nt, Human
gacuuuggaaagac

SEQ ID NO: 2928038 - RNA, 18 nt, Human
gacuguuuucucuugaga

SEQ ID NO: 2928039 - RNA, 16 nt, Human
gacuguuuucucuuga

SEQ ID NO: 2928040 - RNA, 16 nt, Human
gacuauucaaacaguc

SEQ ID NO: 2928041 - RNA, 15 nt, Human
gacuauucaaacagu

SEQ ID NO: 2928042 - RNA, 13 nt, Human
gacgcugugcugc

SEQ ID NO: 2928043 - RNA, 12 nt, Human
gacgcugugcug

SEQ ID NO: 2928044 - RNA, 21 nt, Human
gacccucucaaacuaacaggc

SEQ ID NO: 2928045 - RNA, 15 nt, Human
gaccaucccugaagg

SEQ ID NO: 2928046 - RNA, 14 nt, Human
gaccaucccugaag

SEQ ID NO: 2928047 - RNA, 16 nt, Human
gaccauucuccaccug

SEQ ID NO: 2928048 - RNA, 17 nt, Human
gaccaucccugaaggcc

SEQ ID NO: 2928049 - RNA, 16 nt, Human
gaccaucccugaaggc

SEQ ID NO: 2928050 - RNA, 12 nt, Human
gacccggcugcg

SEQ ID NO: 2928051 - RNA, 13 nt, Human
gacccggcugcgu

SEQ ID NO: 2928052 - RNA, 16 nt, Human
gacccuauugcugcuu

SEQ ID NO: 2928053 - RNA, 14 nt, Human
gacccgucuccagc

SEQ ID NO: 2928054 - RNA, 15 nt, Human
gacccgucuccagcu

SEQ ID NO: 2928055 - RNA, 18 nt, Human
gacccgucuccagcugcu

SEQ ID NO: 2928056 - RNA, 14 nt, Human
gacagaaagcagaa

SEQ ID NO: 2928057 - RNA, 21 nt, Human
gacagcccuucuuuccacaga

SEQ ID NO: 2928058 - RNA, 20 nt, Human
gacagaaagcagaacaguga

SEQ ID NO: 2928059 - RNA, 13 nt, Human
gacagcuccuucu

SEQ ID NO: 2928060 - RNA, 14 nt, Human
gacagcuccuucug

SEQ ID NO: 2928061 - RNA, 15 nt, Human
gacagcuccuucugu

SEQ ID NO: 2928062 - RNA, 20 nt, Human
ggcaguggugguuuucuguu

SEQ ID NO: 2928063 - RNA, 21 nt, Human
ggcaguggugguuuucuguuc

SEQ ID NO: 2928064 - RNA, 22 nt, Human
ggcagccccuguucuggcagag

SEQ ID NO: 2928065 - RNA, 16 nt, Human
ggagagaagagaaugc

SEQ ID NO: 2928066 - RNA, 19 nt, Human
ggcacagaaaauggaagac

SEQ ID NO: 2928067 - RNA, 21 nt, Human
ggcacagaaaauggaagacag

SEQ ID NO: 2928068 - RNA, 20 nt, Human
ggcacagaaaauggaagaca

SEQ ID NO: 2928069 - RNA, 23 nt, Human
ggcacucagaagacacugauggg

SEQ ID NO: 2928070 - RNA, 20 nt, Human
ggcacucagaagacacugau

SEQ ID NO: 2928071 - RNA, 13 nt, Human
ggcacaucagcac

SEQ ID NO: 2928072 - RNA, 21 nt, Human
ggcacaguuuucugagaaaga

SEQ ID NO: 2928073 - RNA, 23 nt, Human
ggcacagaaaauggaagacagcu

SEQ ID NO: 2928074 - RNA, 23 nt, Human
ggcagccccauucugccugccca

SEQ ID NO: 2928075 - RNA, 11 nt, Human
ggcagccccug

SEQ ID NO: 2928076 - RNA, 20 nt, Human
ggcacugguuuguucccugu

SEQ ID NO: 2928077 - RNA, 16 nt, Human
ggcacuuuaaaacacu

SEQ ID NO: 2928078 - RNA, 18 nt, Human
ggcacuuuaaaacacucu

SEQ ID NO: 2928079 - RNA, 23 nt, Human
ggccccugcugguucaggguugg

SEQ ID NO: 2928080 - RNA, 13 nt, Human
ggcccggcuccag

SEQ ID NO: 2928081 - RNA, 13 nt, Human
ggccccugcuggu

SEQ ID NO: 2928082 - RNA, 14 nt, Human
ggccccugcugguu

SEQ ID NO: 2928083 - RNA, 15 nt, Human
ggcccggcuccaggc

SEQ ID NO: 2928084 - RNA, 21 nt, Human
ggcccuucucuccagccccug

SEQ ID NO: 2928085 - RNA, 20 nt, Human
ggcccuucucuccagccccu

SEQ ID NO: 2928086 - RNA, 19 nt, Human
ggcccuucucuccagcccc

SEQ ID NO: 2928087 - RNA, 14 nt, Human
ggccuccauccuga

SEQ ID NO: 2928088 - RNA, 15 nt, Human
ggccuccauccugag

SEQ ID NO: 2928089 - RNA, 13 nt, Human
ggccuccauccug

SEQ ID NO: 2928090 - RNA, 17 nt, Human
ggcccuugucggcccca

SEQ ID NO: 2928091 - RNA, 19 nt, Human
ggcccuuuuucaauaacug

SEQ ID NO: 2928092 - RNA, 23 nt, Human
ggcccuucucuccagccccugga

SEQ ID NO: 2928093 - RNA, 22 nt, Human
ggcccuucucuccagccccugg

SEQ ID NO: 2928094 - RNA, 23 nt, Human
ggccucaagugauucuccugccu

SEQ ID NO: 2928095 - RNA, 17 nt, Human
ggccaguuggucccccu

SEQ ID NO: 2928096 - RNA, 14 nt, Human
ggccaguugguccc

SEQ ID NO: 2928097 - RNA, 20 nt, Human
ggccagugugacaaggauug

SEQ ID NO: 2928098 - RNA, 21 nt, Human
ggcugcucccaccuggcucug

SEQ ID NO: 2928099 - RNA, 22 nt, Human
ggcugcucccaccuggcucugu

SEQ ID NO: 2928100 - RNA, 13 nt, Human
ggcugcucccacc

SEQ ID NO: 2928101 - RNA, 15 nt, Human
ggcugcucccaccug

SEQ ID NO: 2928102 - RNA, 18 nt, Human
ggcugcucccaccuggcu

SEQ ID NO: 2928103 - RNA, 19 nt, Human
ggcugcucccaccuggcuc

SEQ ID NO: 2928104 - RNA, 11 nt, Human
ggcugcuccca

SEQ ID NO: 2928105 - RNA, 12 nt, Human
ggcugcucccac

SEQ ID NO: 2928106 - RNA, 16 nt, Human
ggcugggagagccuuc

SEQ ID NO: 2928107 - RNA, 15 nt, Human
ggcugggagagccuu

SEQ ID NO: 2928108 - RNA, 14 nt, Human
ggcugggagagccu

SEQ ID NO: 2928109 - RNA, 13 nt, Human
ggcugggagagcc

SEQ ID NO: 2928110 - RNA, 11 nt, Human
ggcucucaggc

SEQ ID NO: 2928111 - RNA, 13 nt, Human
ggcucucaggcca

SEQ ID NO: 2928112 - RNA, 12 nt, Human
ggcucuuccagg

SEQ ID NO: 2928113 - RNA, 22 nt, Human
ggcugcggaaugaaccacaucu

SEQ ID NO: 2928114 - RNA, 21 nt, Human
ggcugccaaugggagcucaug

SEQ ID NO: 2928115 - RNA, 18 nt, Human
ggcugaacuuuguggucg

SEQ ID NO: 2928116 - RNA, 22 nt, Human
ggcugcaugcgggcuuccuccu

SEQ ID NO: 2928117 - RNA, 20 nt, Human
ggcugccaaugggagcucau

SEQ ID NO: 2928118 - RNA, 19 nt, Human
ggcugccaaugggagcuca

SEQ ID NO: 2928119 - RNA, 14 nt, Human
ggcuccacuugguc

SEQ ID NO: 2928120 - RNA, 20 nt, Human
ggcucagguggggucacucu

SEQ ID NO: 2928121 - RNA, 19 nt, Human
ggcucagguggggucacuc

SEQ ID NO: 2928122 - RNA, 19 nt, Human
ggcucagcggggacagcuc

SEQ ID NO: 2928123 - RNA, 20 nt, Human
ggcucagcggggacagcucc

SEQ ID NO: 2928124 - RNA, 18 nt, Human
ggcucagcggggacagcu

SEQ ID NO: 2928125 - RNA, 13 nt, Human
aaaacaugcuaca

SEQ ID NO: 2928126 - RNA, 14 nt, Human
aaaacaugcuacac

SEQ ID NO: 2928127 - RNA, 12 nt, Human
aaaacccaagug

SEQ ID NO: 2928128 - RNA, 14 nt, Human
aaaaccacagcagu

SEQ ID NO: 2928129 - RNA, 20 nt, Human
gggaccagagcugccaccug

SEQ ID NO: 2928130 - RNA, 14 nt, Human
gggaccagagcugc

SEQ ID NO: 2928131 - RNA, 19 nt, Human
aaaaaugguagcauuuuaa

SEQ ID NO: 2928132 - RNA, 20 nt, Human
aaaaaugguagcauuuuaaa

SEQ ID NO: 2928133 - RNA, 17 nt, Human
aaaaaugguuuaaaugg

SEQ ID NO: 2928134 - RNA, 18 nt, Human
aaaacucuccucugcugc

SEQ ID NO: 2928135 - RNA, 13 nt, Human
aaaacugagcaua

SEQ ID NO: 2928136 - RNA, 15 nt, Human
aaaacuucagacaua

SEQ ID NO: 2928137 - RNA, 12 nt, Human
aaaagcauuuuu

SEQ ID NO: 2928138 - RNA, 20 nt, Human
aaaaggaagcuuacaugccu

SEQ ID NO: 2928139 - RNA, 21 nt, Human
aaaaggaagcuuacaugccua

SEQ ID NO: 2928140 - RNA, 21 nt, Human
gggagaaccaaaaagaggcua

SEQ ID NO: 2928141 - RNA, 15 nt, Human
gggacuuggaagcuc

SEQ ID NO: 2928142 - RNA, 17 nt, Human
gggacuuggaagcuccg

SEQ ID NO: 2928143 - RNA, 18 nt, Human
gggacuuggaagcuccgc

SEQ ID NO: 2928144 - RNA, 23 nt, Human
gggacuuggaagcuccgcuuucu

SEQ ID NO: 2928145 - RNA, 23 nt, Human
gggagcaggcucgggcuccccag

SEQ ID NO: 2928146 - RNA, 19 nt, Human
gggagagccuuccaggggu

SEQ ID NO: 2928147 - RNA, 15 nt, Human
gggagagccuuccag

SEQ ID NO: 2928148 - RNA, 16 nt, Human
gggagggagggcucca

SEQ ID NO: 2928149 - RNA, 18 nt, Human
gggaggcugaggcaggag

SEQ ID NO: 2928150 - RNA, 15 nt, Human
gggagggagggcucc

SEQ ID NO: 2928151 - RNA, 18 nt, Human
gggaggucaaggcugcag

SEQ ID NO: 2928152 - RNA, 22 nt, Human
ggcuucauccuccucagaucuu

SEQ ID NO: 2928153 - RNA, 18 nt, Human
ggcuucauccuccucaga

SEQ ID NO: 2928154 - RNA, 16 nt, Human
ggcuuccucauaguau

SEQ ID NO: 2928155 - RNA, 18 nt, Human
ggcuucaguggcagcugc

SEQ ID NO: 2928156 - RNA, 17 nt, Human
ggcuucaguggcagcug

SEQ ID NO: 2928157 - RNA, 19 nt, Human
ggcuucaguggcagcugcu

SEQ ID NO: 2928158 - RNA, 20 nt, Human
ggcuucaguggcagcugcuu

SEQ ID NO: 2928159 - RNA, 18 nt, Human
ggcuguaucccaugagcc

SEQ ID NO: 2928160 - RNA, 19 nt, Human
ggcuggguggcaccagcag

SEQ ID NO: 2928161 - RNA, 21 nt, Human
ggcuggguucuacccaggugc

SEQ ID NO: 2928162 - RNA, 19 nt, Human
ggcuggguucuacccaggu

SEQ ID NO: 2928163 - RNA, 15 nt, Human
ggcugggggccucag

SEQ ID NO: 2928164 - RNA, 16 nt, Human
ggcugggggccucagu

SEQ ID NO: 2928165 - RNA, 17 nt, Human
ggcugggggccucagug

SEQ ID NO: 2928166 - RNA, 19 nt, Human
ggcugggggccucagugcc

SEQ ID NO: 2928167 - RNA, 14 nt, Human
aaaaauaacaauga

SEQ ID NO: 2928168 - RNA, 21 nt, Human
ggcuuccuccugguguggaag

SEQ ID NO: 2928169 - RNA, 18 nt, Human
gggaagaagcucucuccu

SEQ ID NO: 2928170 - RNA, 20 nt, Human
gggaacccaaguccaagcau

SEQ ID NO: 2928171 - RNA, 12 nt, Human
gggacagcuccu

SEQ ID NO: 2928172 - RNA, 13 nt, Human
gggacagcuccuu

SEQ ID NO: 2928173 - RNA, 13 nt, Human
gggaagagacuug

SEQ ID NO: 2928174 - RNA, 15 nt, Human
gggacagcuccuucu

SEQ ID NO: 2928175 - RNA, 22 nt, Human
gggacagucaccucauggaauu

SEQ ID NO: 2928176 - RNA, 20 nt, Human
gggacagucaccucauggaa

SEQ ID NO: 2928177 - RNA, 21 nt, Human
gggacagucaccucauggaau

SEQ ID NO: 2928178 - RNA, 16 nt, Human
guaccacuuuugcaaa

SEQ ID NO: 2928179 - RNA, 12 nt, Human
guacccacugcu

SEQ ID NO: 2928180 - RNA, 19 nt, Human
guacauggaauaacaugua

SEQ ID NO: 2928181 - RNA, 17 nt, Human
guacaugaaaacacauu

SEQ ID NO: 2928182 - RNA, 18 nt, Human
guacaugaaaacacauuu

SEQ ID NO: 2928183 - RNA, 19 nt, Human
guacaugaaaacacauuuu

SEQ ID NO: 2928184 - RNA, 20 nt, Human
guacaugaaaacacauuuuu

SEQ ID NO: 2928185 - RNA, 14 nt, Human
guacaugaaaacac

SEQ ID NO: 2928186 - RNA, 15 nt, Human
guacaugaaaacaca

SEQ ID NO: 2928187 - RNA, 16 nt, Human
guacaugaaaacacau

SEQ ID NO: 2928188 - RNA, 15 nt, Human
aaauccauacauuug

SEQ ID NO: 2928189 - RNA, 19 nt, Human
aaauauuaagaaagacuau

SEQ ID NO: 2928190 - RNA, 17 nt, Human
aaauauuauguuaaaac

SEQ ID NO: 2928191 - RNA, 14 nt, Human
aaaucagguuuucu

SEQ ID NO: 2928192 - RNA, 16 nt, Human
aaaucagguuuucuuu

SEQ ID NO: 2928193 - RNA, 18 nt, Human
aaaucagguuuucuuuua

SEQ ID NO: 2928194 - RNA, 19 nt, Human
aaaucagguuuucuuuuaa

SEQ ID NO: 2928195 - RNA, 22 nt, Human
aaaucagguuuucuuuuaagaa

SEQ ID NO: 2928196 - RNA, 12 nt, Human
aaaucauuucug

SEQ ID NO: 2928197 - RNA, 16 nt, Human
aaaucagcugcuacua

SEQ ID NO: 2928198 - RNA, 18 nt, Human
aaaucagccugcuccagc

SEQ ID NO: 2928199 - RNA, 12 nt, Human
aaaucagccugc

SEQ ID NO: 2928200 - RNA, 19 nt, Human
aaaucagccguguaaccau

SEQ ID NO: 2928201 - RNA, 11 nt, Human
aaaucauuucu

SEQ ID NO: 2928202 - RNA, 23 nt, Human
aaaucauuucugcaucagcugcu

SEQ ID NO: 2928203 - RNA, 22 nt, Human
aaaucauuucugcaucagcugc

SEQ ID NO: 2928204 - RNA, 21 nt, Human
aaaucauuucugcaucagcug

SEQ ID NO: 2928205 - RNA, 19 nt, Human
aaaucauuucugcaucagc

SEQ ID NO: 2928206 - RNA, 22 nt, Human
guagaaguucuaguguuuucaa

SEQ ID NO: 2928207 - RNA, 18 nt, Human
guagaaguucuaguguuu

SEQ ID NO: 2928208 - RNA, 19 nt, Human
guagaaguucuaguguuuu

SEQ ID NO: 2928209 - RNA, 14 nt, Human
guagaauguuuuca

SEQ ID NO: 2928210 - RNA, 18 nt, Human
guagaagcccuucuaccu

SEQ ID NO: 2928211 - RNA, 21 nt, Human
guagaagucuuagauguauau

SEQ ID NO: 2928212 - RNA, 20 nt, Human
guagaaauaucugaaaaugu

SEQ ID NO: 2928213 - RNA, 21 nt, Human
guagaaauaucugaaaaugua

SEQ ID NO: 2928214 - RNA, 23 nt, Human
guagaaauaucugaaaauguaug

SEQ ID NO: 2928215 - RNA, 15 nt, Human
guagagccagggucu

SEQ ID NO: 2928216 - RNA, 13 nt, Human
guagagacagggu

SEQ ID NO: 2928217 - RNA, 10 nt, Human
guagagccag

SEQ ID NO: 2928218 - RNA, 11 nt, Human
guagagccagg

SEQ ID NO: 2928219 - RNA, 16 nt, Human
guagacaguuggguuu

SEQ ID NO: 2928220 - RNA, 11 nt, Human
guagagacagg

SEQ ID NO: 2928221 - RNA, 12 nt, Human
guagagacaggg

SEQ ID NO: 2928222 - RNA, 23 nt, Human
guagacgugcacgcacacugucu

SEQ ID NO: 2928223 - RNA, 20 nt, Human
guagacgugcacgcacacug

SEQ ID NO: 2928224 - RNA, 21 nt, Human
guacucugccacuuuauuucu

SEQ ID NO: 2928225 - RNA, 15 nt, Human
guacuauguaucaau

SEQ ID NO: 2928226 - RNA, 17 nt, Human
guacuauguaucaauga

SEQ ID NO: 2928227 - RNA, 17 nt, Human
guacuacaguccuccca

SEQ ID NO: 2928228 - RNA, 21 nt, Human
guacuaucugugcguagaagu

SEQ ID NO: 2928229 - RNA, 13 nt, Human
guacuauguauca

SEQ ID NO: 2928230 - RNA, 13 nt, Human
guacccacugcuc

SEQ ID NO: 2928231 - RNA, 14 nt, Human
guacccacugcucu

SEQ ID NO: 2928232 - RNA, 19 nt, Human
guacuacaguccucccauc

SEQ ID NO: 2928233 - RNA, 18 nt, Human
guacuacaguccucccau

SEQ ID NO: 2928234 - RNA, 16 nt, Human
guacuggagaaaaugg

SEQ ID NO: 2928235 - RNA, 15 nt, Human
guacuucaugcuguc

SEQ ID NO: 2928236 - RNA, 21 nt, Human
guacuucaaauccuugaagau

SEQ ID NO: 2928237 - RNA, 22 nt, Human
guacuucaaauccuugaagauu

SEQ ID NO: 2928238 - RNA, 14 nt, Human
guaacucuguaauu

SEQ ID NO: 2928239 - RNA, 20 nt, Human
guaauaggcguaacuaauuu

SEQ ID NO: 2928240 - RNA, 22 nt, Human
guaauuugugauacaaugcugu

SEQ ID NO: 2928241 - RNA, 14 nt, Human
guaauaugcacaca

SEQ ID NO: 2928242 - RNA, 16 nt, Human
guaauaugcacacauu

SEQ ID NO: 2928243 - RNA, 17 nt, Human
guaauaugcacacauuu

SEQ ID NO: 2928244 - RNA, 18 nt, Human
guaauaugcacacauuuu

SEQ ID NO: 2928245 - RNA, 14 nt, Human
aaauauaauugaca

SEQ ID NO: 2928246 - RNA, 22 nt, Human
aaauacgugggcauucaaaugu

SEQ ID NO: 2928247 - RNA, 18 nt, Human
aaauaccagccaguaaau

SEQ ID NO: 2928248 - RNA, 19 nt, Human
aaauacacacucaaaucaa

SEQ ID NO: 2928249 - RNA, 17 nt, Human
aaauacagauagauaua

SEQ ID NO: 2928250 - RNA, 22 nt, Human
aaauaauuuuuauauuugaaau

SEQ ID NO: 2928251 - RNA, 23 nt, Human
aaauaauuuuuauauuugaaaua

SEQ ID NO: 2928252 - RNA, 15 nt, Human
aaauacacacucaaa

SEQ ID NO: 2928253 - RNA, 14 nt, Human
guacacauaagcca

SEQ ID NO: 2928254 - RNA, 23 nt, Human
guacacugccuucucaacuccaa

SEQ ID NO: 2928255 - RNA, 21 nt, Human
aaauaauuuuuauauuugaaa

SEQ ID NO: 2928256 - RNA, 16 nt, Human
aaagguacuuugcagg

SEQ ID NO: 2928257 - RNA, 20 nt, Human
aaagguauuuuaaucaccaa

SEQ ID NO: 2928258 - RNA, 20 nt, Human
aaaguacacuguuucaaacu

SEQ ID NO: 2928259 - RNA, 19 nt, Human
aaaguacuucuccacccug

SEQ ID NO: 2928260 - RNA, 23 nt, Human
aaaguacuucuccacccugcucu

SEQ ID NO: 2928261 - RNA, 20 nt, Human
aaaguacuucuccacccugc

SEQ ID NO: 2928262 - RNA, 21 nt, Human
aaaguacuucuccacccugcu

SEQ ID NO: 2928263 - RNA, 18 nt, Human
aaaguauguuagugcaaa

SEQ ID NO: 2928264 - RNA, 18 nt, Human
aaaguaucccuacuguaa

SEQ ID NO: 2928265 - RNA, 23 nt, Human
aaaguucugcagauaaacaguag

SEQ ID NO: 2928266 - RNA, 17 nt, Human
aaaguauguuagugcaa

SEQ ID NO: 2928267 - RNA, 20 nt, Human
aaauaaguguauuuugaaau

SEQ ID NO: 2928268 - RNA, 13 nt, Human
aaauaaucucuga

SEQ ID NO: 2928269 - RNA, 14 nt, Human
aaauaaguguauuu

SEQ ID NO: 2928270 - RNA, 19 nt, Human
aaauaaguguauuuugaaa

SEQ ID NO: 2928271 - RNA, 16 nt, Human
aaauaacagaagaaaa

SEQ ID NO: 2928272 - RNA, 17 nt, Human
aaauaacagaagaaaau

SEQ ID NO: 2928273 - RNA, 11 nt, Human
gguccugcugc

SEQ ID NO: 2928274 - RNA, 12 nt, Human
gguccugcugca

SEQ ID NO: 2928275 - RNA, 23 nt, Human
aaagacugaguacguugugcauu

SEQ ID NO: 2928276 - RNA, 13 nt, Human
aaagacuguacaa

SEQ ID NO: 2928277 - RNA, 14 nt, Human
aaagacuguacaaa

SEQ ID NO: 2928278 - RNA, 19 nt, Human
aaagaugcuucucacugcc

SEQ ID NO: 2928279 - RNA, 14 nt, Human
aaagaugcuucuca

SEQ ID NO: 2928280 - RNA, 17 nt, Human
aaagaugcuucucacug

SEQ ID NO: 2928281 - RNA, 15 nt, Human
aaagaggaaugaagu

SEQ ID NO: 2928282 - RNA, 15 nt, Human
aaagaggcagcuuga

SEQ ID NO: 2928283 - RNA, 14 nt, Human
ggguggggcagugc

SEQ ID NO: 2928284 - RNA, 14 nt, Human
ggguggccucccaa

SEQ ID NO: 2928285 - RNA, 23 nt, Human
aaacuucagcgguuuauauaagc

SEQ ID NO: 2928286 - RNA, 19 nt, Human
aaacuucagacauagaauu

SEQ ID NO: 2928287 - RNA, 13 nt, Human
aaagacagugaaa

SEQ ID NO: 2928288 - RNA, 17 nt, Human
aaagacuauucaaacag

SEQ ID NO: 2928289 - RNA, 19 nt, Human
aaagacuauucaaacaguc

SEQ ID NO: 2928290 - RNA, 18 nt, Human
aaagacuauucaaacagu

SEQ ID NO: 2928291 - RNA, 14 nt, Human
aaagacuccaaaga

SEQ ID NO: 2928292 - RNA, 21 nt, Human
aaagacuccaaagaaauguaa

SEQ ID NO: 2928293 - RNA, 15 nt, Human
aaagacuccaaagaa

SEQ ID NO: 2928294 - RNA, 21 nt, Human
aaagacuauucaaacagucuc

SEQ ID NO: 2928295 - RNA, 13 nt, Human
gguggaugccugg

SEQ ID NO: 2928296 - RNA, 12 nt, Human
ggugcaaugacc

SEQ ID NO: 2928297 - RNA, 16 nt, Human
ggugcaaugaccuuuc

SEQ ID NO: 2928298 - RNA, 13 nt, Human
ggugcaaugaccu

SEQ ID NO: 2928299 - RNA, 18 nt, Human
ggugauccacccaccuca

SEQ ID NO: 2928300 - RNA, 23 nt, Human
ggugauccacccaccucagccuc

SEQ ID NO: 2928301 - RNA, 24 nt, Human
ggugauccacccaccucagccucc

SEQ ID NO: 2928302 - RNA, 13 nt, Human
ggugaacagaaca

SEQ ID NO: 2928303 - RNA, 13 nt, Human
ggucgaggcagga

SEQ ID NO: 2928304 - RNA, 13 nt, Human
aaagcugcugaca

SEQ ID NO: 2928305 - RNA, 15 nt, Human
aaagcuuguuaagau

SEQ ID NO: 2928306 - RNA, 13 nt, Human
aaagcuuuugcau

SEQ ID NO: 2928307 - RNA, 15 nt, Human
aaagcucacuuuacu

SEQ ID NO: 2928308 - RNA, 21 nt, Human
aaagcacugacuucuaaguaa

SEQ ID NO: 2928309 - RNA, 17 nt, Human
aaagcacugacuucuaa

SEQ ID NO: 2928310 - RNA, 17 nt, Human
aaaggagauuggaagga

SEQ ID NO: 2928311 - RNA, 17 nt, Human
aaaggagagcuagcagc

SEQ ID NO: 2928312 - RNA, 21 nt, Human
aaaggagagcuagcagcaggg

SEQ ID NO: 2928313 - RNA, 14 nt, Human
aaagcuuuugcaua

SEQ ID NO: 2928314 - RNA, 17 nt, Human
aaagcuuuugcauauug

SEQ ID NO: 2928315 - RNA, 22 nt, Human
aaaggaaagagggagguaagga

SEQ ID NO: 2928316 - RNA, 22 nt, Human
aaagggacuuggaagcuccgcu

SEQ ID NO: 2928317 - RNA, 14 nt, Human
aaagguacuucaaa

SEQ ID NO: 2928318 - RNA, 15 nt, Human
aaacucguuaauuug

SEQ ID NO: 2928319 - RNA, 13 nt, Human
aaacgucuuaaau

SEQ ID NO: 2928320 - RNA, 14 nt, Human
aaacgucuuaaaua

SEQ ID NO: 2928321 - RNA, 13 nt, Human
aaacucuccucug

SEQ ID NO: 2928322 - RNA, 19 nt, Human
ggguggcaccagcagccug

SEQ ID NO: 2928323 - RNA, 17 nt, Human
aaacuuaaucuaaaugg

SEQ ID NO: 2928324 - RNA, 18 nt, Human
aaacuuaaucuaaaugga

SEQ ID NO: 2928325 - RNA, 16 nt, Human
aaacuuaaucuaaaug

SEQ ID NO: 2928326 - RNA, 14 nt, Human
aaacuuaaucuaaa

SEQ ID NO: 2928327 - RNA, 15 nt, Human
gggggccuggaugcc

SEQ ID NO: 2928328 - RNA, 15 nt, Human
aaacgggcucagcaa

SEQ ID NO: 2928329 - RNA, 23 nt, Human
aaaccaagucaagugaaaaagga

SEQ ID NO: 2928330 - RNA, 12 nt, Human
aaaccacagcag

SEQ ID NO: 2928331 - RNA, 11 nt, Human
aaacacagcaa

SEQ ID NO: 2928332 - RNA, 19 nt, Human
aaacacaaacgggcucagc

SEQ ID NO: 2928333 - RNA, 21 nt, Human
aaacacauuaaagguacuuug

SEQ ID NO: 2928334 - RNA, 11 nt, Human
aaacacauuaa

SEQ ID NO: 2928335 - RNA, 15 nt, Human
aaacacauuaaaggu

SEQ ID NO: 2928336 - RNA, 11 nt, Human
aaacacauuuu

SEQ ID NO: 2928337 - RNA, 18 nt, Human
aaacacaucuaguaguug

SEQ ID NO: 2928338 - RNA, 14 nt, Human
aaacacagcaaggg

SEQ ID NO: 2928339 - RNA, 12 nt, Human
aaacacagcaag

SEQ ID NO: 2928340 - RNA, 20 nt, Human
aaaauuuugauguuuuaagg

SEQ ID NO: 2928341 - RNA, 19 nt, Human
aaaauuuagaaauauaauu

SEQ ID NO: 2928342 - RNA, 13 nt, Human
gggaugagaaagg

SEQ ID NO: 2928343 - RNA, 15 nt, Human
ggggccucagugcca

SEQ ID NO: 2928344 - RNA, 12 nt, Human
gggggccucagu

SEQ ID NO: 2928345 - RNA, 15 nt, Human
gggggccucagugcc

SEQ ID NO: 2928346 - RNA, 17 nt, Human
gggggccucagugccac

SEQ ID NO: 2928347 - RNA, 18 nt, Human
gggggccucagugccacu

SEQ ID NO: 2928348 - RNA, 11 nt, Human
ggggagaaagu

SEQ ID NO: 2928349 - RNA, 18 nt, Human
ggggaauguuugccucug

SEQ ID NO: 2928350 - RNA, 22 nt, Human
ggggaauguuugccucugccuc

SEQ ID NO: 2928351 - RNA, 15 nt, Human
ggggaccagagcugc

SEQ ID NO: 2928352 - RNA, 16 nt, Human
ggggaccagagcugcc

SEQ ID NO: 2928353 - RNA, 19 nt, Human
ggggaauugaggacacuga

SEQ ID NO: 2928354 - RNA, 17 nt, Human
aaacauggccuuugcuu

SEQ ID NO: 2928355 - RNA, 14 nt, Human
aaacaguagugaua

SEQ ID NO: 2928356 - RNA, 15 nt, Human
aaacagucucaggaa

SEQ ID NO: 2928357 - RNA, 16 nt, Human
aaacauggccuuugcu

SEQ ID NO: 2928358 - RNA, 18 nt, Human
gcuucaaggauccugagc

SEQ ID NO: 2928359 - RNA, 19 nt, Human
gcuucaaggauccugagcc

SEQ ID NO: 2928360 - RNA, 21 nt, Human
gcuucaaggauccugagccag

SEQ ID NO: 2928361 - RNA, 20 nt, Human
gcuucaaggauccugagcca

SEQ ID NO: 2928362 - RNA, 15 nt, Human
gcuucacggaagagc

SEQ ID NO: 2928363 - RNA, 17 nt, Human
gcuucacggaagagccu

SEQ ID NO: 2928364 - RNA, 12 nt, Human
gcuucagccucc

SEQ ID NO: 2928365 - RNA, 18 nt, Human
gcuucacggaagagccuu

SEQ ID NO: 2928366 - RNA, 22 nt, Human
gcuuccucauaguaugguggcu

SEQ ID NO: 2928367 - RNA, 20 nt, Human
gcuuguaaauagcucaggug

SEQ ID NO: 2928368 - RNA, 14 nt, Human
gcuugagcucagga

SEQ ID NO: 2928369 - RNA, 16 nt, Human
gcuuguacacucauuc

SEQ ID NO: 2928370 - RNA, 12 nt, Human
gcuuguacauaa

SEQ ID NO: 2928371 - RNA, 13 nt, Human
gcugcuggcuggu

SEQ ID NO: 2928372 - RNA, 13 nt, Human
gcucugcccuugg

SEQ ID NO: 2928373 - RNA, 16 nt, Human
gcucugguccauagag

SEQ ID NO: 2928374 - RNA, 15 nt, Human
gcucugguccauaga

SEQ ID NO: 2928375 - RNA, 15 nt, Human
gcugcugaaggcucg

SEQ ID NO: 2928376 - RNA, 14 nt, Human
gcugcugaaggcuc

SEQ ID NO: 2928377 - RNA, 13 nt, Human
gcugcugaaggcu

SEQ ID NO: 2928378 - RNA, 20 nt, Human
gcuggcgugcaguggugcga

SEQ ID NO: 2928379 - RNA, 18 nt, Human
gcuggagugcagugagcc

SEQ ID NO: 2928380 - RNA, 17 nt, Human
gcuggagugcagugagc

SEQ ID NO: 2928381 - RNA, 22 nt, Human
gcuggagugcagugagccgaga

SEQ ID NO: 2928382 - RNA, 20 nt, Human
gcuggccuggccccucaggg

SEQ ID NO: 2928383 - RNA, 23 nt, Human
gcuggguggcaccagcagccugg

SEQ ID NO: 2928384 - RNA, 22 nt, Human
gcuggguggcaccagcagccug

SEQ ID NO: 2928385 - RNA, 21 nt, Human
gcuggguggcaccagcagccu

SEQ ID NO: 2928386 - RNA, 15 nt, Human
gcuggcuguuggcug

SEQ ID NO: 2928387 - RNA, 16 nt, Human
gcuggcuguuggcugg

SEQ ID NO: 2928388 - RNA, 12 nt, Human
ggacccccugaa

SEQ ID NO: 2928389 - RNA, 11 nt, Human
ggacccugagg

SEQ ID NO: 2928390 - RNA, 13 nt, Human
ggacccugaggcc

SEQ ID NO: 2928391 - RNA, 12 nt, Human
ggacccugaggc

SEQ ID NO: 2928392 - RNA, 13 nt, Human
ggaccucaggccu

SEQ ID NO: 2928393 - RNA, 20 nt, Human
ggacguguuaugacuccaga

SEQ ID NO: 2928394 - RNA, 15 nt, Human
ggaccucaggccugg

SEQ ID NO: 2928395 - RNA, 14 nt, Human
ggaccucaggccug

SEQ ID NO: 2928396 - RNA, 14 nt, Human
ggacuuggaagcuc

SEQ ID NO: 2928397 - RNA, 23 nt, Human
ggacuuugcacacuuuggcccag

SEQ ID NO: 2928398 - RNA, 14 nt, Human
ggacuuugcacacu

SEQ ID NO: 2928399 - RNA, 13 nt, Human
ggagaaacuggaa

SEQ ID NO: 2928400 - RNA, 16 nt, Human
ggagaaaggaagggcu

SEQ ID NO: 2928401 - RNA, 20 nt, Human
ggacuaacuugucuuuggac

SEQ ID NO: 2928402 - RNA, 15 nt, Human
ggacucaaugcacug

SEQ ID NO: 2928403 - RNA, 14 nt, Human
ggacuacaggugug

SEQ ID NO: 2928404 - RNA, 24 nt, Human
ggacuaacuugucuuuggacccug

SEQ ID NO: 2928405 - RNA, 16 nt, Human
ggacucaaugcacuga

SEQ ID NO: 2928406 - RNA, 18 nt, Human
ggacucaaugcacugaca

SEQ ID NO: 2928407 - RNA, 21 nt, Human
ggacuccaggcagcagacaca

SEQ ID NO: 2928408 - RNA, 22 nt, Human
ggacuccaggcagcagacacau

SEQ ID NO: 2928409 - RNA, 22 nt, Human
ggacucauuuuaaaaaauggaa

SEQ ID NO: 2928410 - RNA, 15 nt, Human
ggaagagaaaaaaua

SEQ ID NO: 2928411 - RNA, 18 nt, Human
ggaagacuuuggaaagag

SEQ ID NO: 2928412 - RNA, 13 nt, Human
ggaagagaaaaaa

SEQ ID NO: 2928413 - RNA, 22 nt, Human
ggaagacaaugugaaaagaaaa

SEQ ID NO: 2928414 - RNA, 14 nt, Human
ggaagacagcucuu

SEQ ID NO: 2928415 - RNA, 13 nt, Human
ggaagacagcucu

SEQ ID NO: 2928416 - RNA, 12 nt, Human
ggaagacuuugg

SEQ ID NO: 2928417 - RNA, 17 nt, Human
ggaagacuuuggaaaga

SEQ ID NO: 2928418 - RNA, 13 nt, Human
ggaagacuuugga

SEQ ID NO: 2928419 - RNA, 14 nt, Human
ggaacacucugaga

SEQ ID NO: 2928420 - RNA, 12 nt, Human
ggaacacucuga

SEQ ID NO: 2928421 - RNA, 23 nt, Human
ggaacagaagaggaaagagagac

SEQ ID NO: 2928422 - RNA, 16 nt, Human
ggaacacucugagacu

SEQ ID NO: 2928423 - RNA, 15 nt, Human
ggaacacucugagac

SEQ ID NO: 2928424 - RNA, 15 nt, Human
ggaagccgcuggggc

SEQ ID NO: 2928425 - RNA, 20 nt, Human
ggaaggaaacccagcucugg

SEQ ID NO: 2928426 - RNA, 19 nt, Human
ggaaggaaacccagcucug

SEQ ID NO: 2928427 - RNA, 22 nt, Human
ggaagcucagggccuggcucag

SEQ ID NO: 2928428 - RNA, 11 nt, Human
ggaagcuccgc

SEQ ID NO: 2928429 - RNA, 23 nt, Human
ggaagcucagggccuggcucagg

SEQ ID NO: 2928430 - RNA, 15 nt, Human
ggaagcucagggccu

SEQ ID NO: 2928431 - RNA, 16 nt, Human
ggaaggaaacccagcu

SEQ ID NO: 2928432 - RNA, 17 nt, Human
ggacacuaaccacgcug

SEQ ID NO: 2928433 - RNA, 22 nt, Human
ggacacuaaccacgcuggaccu

SEQ ID NO: 2928434 - RNA, 19 nt, Human
ggacagcuccuucuguccu

SEQ ID NO: 2928435 - RNA, 20 nt, Human
ggacagcuccuucuguccua

SEQ ID NO: 2928436 - RNA, 17 nt, Human
ggacagcuccuucuguc

SEQ ID NO: 2928437 - RNA, 14 nt, Human
ggacacagcucuuc

SEQ ID NO: 2928438 - RNA, 21 nt, Human
ggacacagcucuucuccaggc

SEQ ID NO: 2928439 - RNA, 15 nt, Human
ggacacagcucuucu

SEQ ID NO: 2928440 - RNA, 18 nt, Human
ggacacagcucuucucca

SEQ ID NO: 2928441 - RNA, 19 nt, Human
ggaaugaagauacugaaau

SEQ ID NO: 2928442 - RNA, 13 nt, Human
ggacaagagcagg

SEQ ID NO: 2928443 - RNA, 23 nt, Human
ggacaaggaugaucuaggaagac

SEQ ID NO: 2928444 - RNA, 22 nt, Human
ggacaaggaugaucuaggaaga

SEQ ID NO: 2928445 - RNA, 16 nt, Human
ggaauccagacccggc

SEQ ID NO: 2928446 - RNA, 17 nt, Human
ggaauaagacagagacc

SEQ ID NO: 2928447 - RNA, 13 nt, Human
ggaauaagacaga

SEQ ID NO: 2928448 - RNA, 18 nt, Human
ggaauaacauguaauuaa

SEQ ID NO: 2928449 - RNA, 23 nt, Human
gcucugaucauccacugugccau

SEQ ID NO: 2928450 - RNA, 17 nt, Human
gcucugaucauccacug

SEQ ID NO: 2928451 - RNA, 23 nt, Human
gcucugcaagaauugaagcagga

SEQ ID NO: 2928452 - RNA, 11 nt, Human
gcucugcccuu

SEQ ID NO: 2928453 - RNA, 19 nt, Human
gcuccaccuugcagcucuc

SEQ ID NO: 2928454 - RNA, 15 nt, Human
gcuccacuuggucug

SEQ ID NO: 2928455 - RNA, 18 nt, Human
gcucccaccuggcucugu

SEQ ID NO: 2928456 - RNA, 14 nt, Human
gcucccaccuggcu

SEQ ID NO: 2928457 - RNA, 16 nt, Human
gcucccaccuggcucu

SEQ ID NO: 2928458 - RNA, 18 nt, Human
gcucccagccaggcccuu

SEQ ID NO: 2928459 - RNA, 16 nt, Human
gcucccagccaggccc

SEQ ID NO: 2928460 - RNA, 17 nt, Human
gcucccagccaggcccu

SEQ ID NO: 2928461 - RNA, 14 nt, Human
gcucccagccaggc

SEQ ID NO: 2928462 - RNA, 15 nt, Human
gcucccagccaggcc

SEQ ID NO: 2928463 - RNA, 17 nt, Human
gcucccaggcauucccc

SEQ ID NO: 2928464 - RNA, 20 nt, Human
gcuccagcucaccagcccca

SEQ ID NO: 2928465 - RNA, 21 nt, Human
gcuccagcucaccagccccag

SEQ ID NO: 2928466 - RNA, 17 nt, Human
gcuccagcucaccagcc

SEQ ID NO: 2928467 - RNA, 18 nt, Human
gcuccagcucaccagccc

SEQ ID NO: 2928468 - RNA, 18 nt, Human
gcuccacuuggucuguga

SEQ ID NO: 2928469 - RNA, 19 nt, Human
gcuccacuuggucugugag

SEQ ID NO: 2928470 - RNA, 15 nt, Human
gcuccuggcccacug

SEQ ID NO: 2928471 - RNA, 14 nt, Human
gcuccuggcccacu

SEQ ID NO: 2928472 - RNA, 20 nt, Human
gcuccuggcccacugcaucg

SEQ ID NO: 2928473 - RNA, 19 nt, Human
gcuccuggcccacugcauc

SEQ ID NO: 2928474 - RNA, 18 nt, Human
gcuccuggcccacugcau

SEQ ID NO: 2928475 - RNA, 18 nt, Human
gcuccccucggagaagag

SEQ ID NO: 2928476 - RNA, 21 nt, Human
gcuccccucggagaagagcug

SEQ ID NO: 2928477 - RNA, 17 nt, Human
gcuaggccuggccagau

SEQ ID NO: 2928478 - RNA, 23 nt, Human
gcuaggccuggccagaugcacca

SEQ ID NO: 2928479 - RNA, 16 nt, Human
gcuaggccuggccaga

SEQ ID NO: 2928480 - RNA, 19 nt, Human
gcuauucaguaauaacucu

SEQ ID NO: 2928481 - RNA, 13 nt, Human
gcuaugcauuuga

SEQ ID NO: 2928482 - RNA, 12 nt, Human
gcuaugcauuug

SEQ ID NO: 2928483 - RNA, 22 nt, Human
gcuagugugguguuuccuggca

SEQ ID NO: 2928484 - RNA, 21 nt, Human
gcuagugugguguuuccuggc

SEQ ID NO: 2928485 - RNA, 13 nt, Human
gcucagagagggu

SEQ ID NO: 2928486 - RNA, 14 nt, Human
gcucagagagggug

SEQ ID NO: 2928487 - RNA, 16 nt, Human
gcucaggugucccugc

SEQ ID NO: 2928488 - RNA, 14 nt, Human
gcucaggugucccu

SEQ ID NO: 2928489 - RNA, 23 nt, Human
gcucagguggggucacucuggca

SEQ ID NO: 2928490 - RNA, 17 nt, Human
gcucacugcagccucaa

SEQ ID NO: 2928491 - RNA, 15 nt, Human
gcucacugcagccuc

SEQ ID NO: 2928492 - RNA, 16 nt, Human
gcucacugcagccuca

SEQ ID NO: 2928493 - RNA, 11 nt, Human
gcucacugcag

SEQ ID NO: 2928494 - RNA, 12 nt, Human
gcucacugcagc

SEQ ID NO: 2928495 - RNA, 13 nt, Human
gcucacugcagcc

SEQ ID NO: 2928496 - RNA, 14 nt, Human
gcucacugcagccu

SEQ ID NO: 2928497 - RNA, 18 nt, Human
gcuauucaguaauaacuc

SEQ ID NO: 2928498 - RNA, 20 nt, Human
gcuauucaguaauaacucua

SEQ ID NO: 2928499 - RNA, 11 nt, Human
gcuacugccau

SEQ ID NO: 2928500 - RNA, 13 nt, Human
gcuacugccaucc

SEQ ID NO: 2928501 - RNA, 16 nt, Human
gcuagaacucccuuuc

SEQ ID NO: 2928502 - RNA, 23 nt, Human
gcuacucgggaggcugaggcagg

SEQ ID NO: 2928503 - RNA, 17 nt, Human
gcuacucgggaggcuga

SEQ ID NO: 2928504 - RNA, 18 nt, Human
gcuacucgggaggcugag

SEQ ID NO: 2928505 - RNA, 12 nt, Human
gcuagaacuccc

SEQ ID NO: 2928506 - RNA, 13 nt, Human
gcuagaacucccu

SEQ ID NO: 2928507 - RNA, 14 nt, Human
gcuagaacucccuu

SEQ ID NO: 2928508 - RNA, 15 nt, Human
gcuagaacucccuuu

SEQ ID NO: 2928509 - RNA, 20 nt, Human
gcgugcacacaccagagccc

SEQ ID NO: 2928510 - RNA, 21 nt, Human
gcgggaggauguucugggaca

SEQ ID NO: 2928511 - RNA, 22 nt, Human
gcgggaggauguucugggacac

SEQ ID NO: 2928512 - RNA, 20 nt, Human
gcgggaggauguucugggac

SEQ ID NO: 2928513 - RNA, 19 nt, Human
gcgugcacacaccagagcc

SEQ ID NO: 2928514 - RNA, 23 nt, Human
gcgugcacacaccagagcccacc

SEQ ID NO: 2928515 - RNA, 18 nt, Human
gcguuucuaugacacaug

SEQ ID NO: 2928516 - RNA, 23 nt, Human
gcuaagugauccucccaccucag

SEQ ID NO: 2928517 - RNA, 13 nt, Human
gcuaaugggacac

SEQ ID NO: 2928518 - RNA, 15 nt, Human
gcuaaugggacacua

SEQ ID NO: 2928519 - RNA, 22 nt, Human
gccugcccaggccccugccacc

SEQ ID NO: 2928520 - RNA, 15 nt, Human
gccugcccaggcccc

SEQ ID NO: 2928521 - RNA, 20 nt, Human
gccugcccaggccccugcca

SEQ ID NO: 2928522 - RNA, 17 nt, Human
gccucgaacuggcugca

SEQ ID NO: 2928523 - RNA, 19 nt, Human
gccuccugugugugcgccu

SEQ ID NO: 2928524 - RNA, 23 nt, Human
gccuccugugugugcgccuacag

SEQ ID NO: 2928525 - RNA, 16 nt, Human
gccucccaaagugcug

SEQ ID NO: 2928526 - RNA, 13 nt, Human
gccuccugugugu

SEQ ID NO: 2928527 - RNA, 17 nt, Human
gccucccaaagugcugg

SEQ ID NO: 2928528 - RNA, 13 nt, Human
gccugcccaggcc

SEQ ID NO: 2928529 - RNA, 14 nt, Human
gccugcccaggccc

SEQ ID NO: 2928530 - RNA, 14 nt, Human
gccucuuggguuca

SEQ ID NO: 2928531 - RNA, 21 nt, Human
gccucuuaugggcuggguucu

SEQ ID NO: 2928532 - RNA, 20 nt, Human
gccucgaacuggcugcaaag

SEQ ID NO: 2928533 - RNA, 22 nt, Human
gccucgaacuggcugcaaaggg

SEQ ID NO: 2928534 - RNA, 15 nt, Human
gccucuuagaugcag

SEQ ID NO: 2928535 - RNA, 16 nt, Human
gccucuuaugggcugg

SEQ ID NO: 2928536 - RNA, 18 nt, Human
gccucuuaugggcugggu

SEQ ID NO: 2928537 - RNA, 17 nt, Human
gccucuuaugggcuggg

SEQ ID NO: 2928538 - RNA, 20 nt, Human
gccuggccugagcugggaug

SEQ ID NO: 2928539 - RNA, 18 nt, Human
gccuggccugagcuggga

SEQ ID NO: 2928540 - RNA, 14 nt, Human
gccuggccugagcu

SEQ ID NO: 2928541 - RNA, 13 nt, Human
gccuggccugagc

SEQ ID NO: 2928542 - RNA, 18 nt, Human
gccugugccucugggacu

SEQ ID NO: 2928543 - RNA, 13 nt, Human
gccuggcucaggu

SEQ ID NO: 2928544 - RNA, 16 nt, Human
gccugugccucuggga

SEQ ID NO: 2928545 - RNA, 17 nt, Human
gccugugccucugggac

SEQ ID NO: 2928546 - RNA, 14 nt, Human
gccuguugggccag

SEQ ID NO: 2928547 - RNA, 20 nt, Human
gccuguugggccaggagccu

SEQ ID NO: 2928548 - RNA, 18 nt, Human
gccuguugggccaggagc

SEQ ID NO: 2928549 - RNA, 16 nt, Human
gccuguugggccagga

SEQ ID NO: 2928550 - RNA, 15 nt, Human
gccuguugggccagg

SEQ ID NO: 2928551 - RNA, 22 nt, Human
gcgaucuggguucacugcaacc

SEQ ID NO: 2928552 - RNA, 18 nt, Human
gccuugcccagccuggau

SEQ ID NO: 2928553 - RNA, 19 nt, Human
gccuugcccagccuggaug

SEQ ID NO: 2928554 - RNA, 14 nt, Human
gccuugcccagccu

SEQ ID NO: 2928555 - RNA, 15 nt, Human
gccuugcccagccug

SEQ ID NO: 2928556 - RNA, 17 nt, Human
gccuugcccagccugga

SEQ ID NO: 2928557 - RNA, 13 nt, Human
gccuugcccagcc

SEQ ID NO: 2928558 - RNA, 17 nt, Human
gcgagcccugguggcag

SEQ ID NO: 2928559 - RNA, 15 nt, Human
gcgagcccugguggc

SEQ ID NO: 2928560 - RNA, 20 nt, Human
gccuugaccauucuccaccu

SEQ ID NO: 2928561 - RNA, 19 nt, Human
gccuugaccauucuccacc

SEQ ID NO: 2928562 - RNA, 17 nt, Human
gccuugaccauucucca

SEQ ID NO: 2928563 - RNA, 21 nt, Human
gccuucggccuccauccugag

SEQ ID NO: 2928564 - RNA, 20 nt, Human
gccuucggccuccauccuga

SEQ ID NO: 2928565 - RNA, 12 nt, Human
gcccccacuggu

SEQ ID NO: 2928566 - RNA, 17 nt, Human
gccccugccacccuggg

SEQ ID NO: 2928567 - RNA, 16 nt, Human
gccccugccacccugg

SEQ ID NO: 2928568 - RNA, 16 nt, Human
gcccucaauugugaaa

SEQ ID NO: 2928569 - RNA, 23 nt, Human
gcccgggcucugccucccaucac

SEQ ID NO: 2928570 - RNA, 16 nt, Human
gcccugcagagggcac

SEQ ID NO: 2928571 - RNA, 18 nt, Human
gcccugcagagggcacag

SEQ ID NO: 2928572 - RNA, 11 nt, Human
gcccugccucc

SEQ ID NO: 2928573 - RNA, 22 nt, Human
gcccugcccaccuggccucugc

SEQ ID NO: 2928574 - RNA, 21 nt, Human
gcccugcccaccuggccucug

SEQ ID NO: 2928575 - RNA, 20 nt, Human
gcccugcccaccuggccucu

SEQ ID NO: 2928576 - RNA, 17 nt, Human
gcccugcccaccuggcc

SEQ ID NO: 2928577 - RNA, 23 nt, Human
gccgcccaaggccuuccccuggc

SEQ ID NO: 2928578 - RNA, 14 nt, Human
gccgcccaaggccu

SEQ ID NO: 2928579 - RNA, 19 nt, Human
gccgcagcccugcagaggg

SEQ ID NO: 2928580 - RNA, 20 nt, Human
gccgcagcccugcagagggc

SEQ ID NO: 2928581 - RNA, 22 nt, Human
gcccuuagcagggaaacagcua

SEQ ID NO: 2928582 - RNA, 13 nt, Human
gcccugccuccuu

SEQ ID NO: 2928583 - RNA, 12 nt, Human
gcccugccuccu

SEQ ID NO: 2928584 - RNA, 19 nt, Human
gcccuuagcagggaaacag

SEQ ID NO: 2928585 - RNA, 20 nt, Human
gcccuuagcagggaaacagc

SEQ ID NO: 2928586 - RNA, 20 nt, Human
gccuaggugacagagugaga

SEQ ID NO: 2928587 - RNA, 23 nt, Human
gccuagcauacguacacauuuua

SEQ ID NO: 2928588 - RNA, 21 nt, Human
gccuagcauacguacacauuu

SEQ ID NO: 2928589 - RNA, 22 nt, Human
gccuagcauacguacacauuuu

SEQ ID NO: 2928590 - RNA, 20 nt, Human
gccuagcauacguacacauu

SEQ ID NO: 2928591 - RNA, 13 nt, Human
gccuaggugacag

SEQ ID NO: 2928592 - RNA, 14 nt, Human
gccuaggugacaga

SEQ ID NO: 2928593 - RNA, 15 nt, Human
gccuaggugacagag

SEQ ID NO: 2928594 - RNA, 13 nt, Human
uaacaagccaccc

SEQ ID NO: 2928595 - RNA, 13 nt, Human
uaacaaugcugua

SEQ ID NO: 2928596 - RNA, 15 nt, Human
uaacaaugcuguauu

SEQ ID NO: 2928597 - RNA, 17 nt, Human
uaacaaugcuguauuuu

SEQ ID NO: 2928598 - RNA, 22 nt, Human
uaaauuaacuuuuauaaacuuu

SEQ ID NO: 2928599 - RNA, 16 nt, Human
uaaaugacucuucccu

SEQ ID NO: 2928600 - RNA, 20 nt, Human
uaaaucuccaaaauaaaacu

SEQ ID NO: 2928601 - RNA, 21 nt, Human
uaaaucuccaaaauaaaacuu

SEQ ID NO: 2928602 - RNA, 15 nt, Human
uaaauguugacaugg

SEQ ID NO: 2928603 - RNA, 17 nt, Human
uaaaugauuucauucaa

SEQ ID NO: 2928604 - RNA, 12 nt, Human
uaaauagcuuuu

SEQ ID NO: 2928605 - RNA, 19 nt, Human
uaaaucuccaaaauaaaac

SEQ ID NO: 2928606 - RNA, 16 nt, Human
aauacaccacuacauu

SEQ ID NO: 2928607 - RNA, 18 nt, Human
aauacaccacuacauucu

SEQ ID NO: 2928608 - RNA, 20 nt, Human
aauacaccacuacauucugu

SEQ ID NO: 2928609 - RNA, 14 nt, Human
aauacacacucaaa

SEQ ID NO: 2928610 - RNA, 15 nt, Human
aauacaccacuacau

SEQ ID NO: 2928611 - RNA, 15 nt, Human
aauaacuaaaaggua

SEQ ID NO: 2928612 - RNA, 12 nt, Human
aauaagucugau

SEQ ID NO: 2928613 - RNA, 15 nt, Human
aauaagucugauuua

SEQ ID NO: 2928614 - RNA, 19 nt, Human
aauaauguuucaaacauau

SEQ ID NO: 2928615 - RNA, 12 nt, Human
aauaaauuauuu

SEQ ID NO: 2928616 - RNA, 21 nt, Human
aauaaaugugccuucauuuuu

SEQ ID NO: 2928617 - RNA, 12 nt, Human
aauaaaugugcc

SEQ ID NO: 2928618 - RNA, 15 nt, Human
aauaacaauaaaaga

SEQ ID NO: 2928619 - RNA, 22 nt, Human
aauaacagaagaaaauagaauu

SEQ ID NO: 2928620 - RNA, 12 nt, Human
aauaacauguaa

SEQ ID NO: 2928621 - RNA, 15 nt, Human
aauaacgauaaaaga

SEQ ID NO: 2928622 - RNA, 19 nt, Human
aauaacauguaauuaagua

SEQ ID NO: 2928623 - RNA, 13 nt, Human
uaaagucaggggu

SEQ ID NO: 2928624 - RNA, 14 nt, Human
uaaaguguauuuuu

SEQ ID NO: 2928625 - RNA, 15 nt, Human
uaaaguguauuuuuu

SEQ ID NO: 2928626 - RNA, 19 nt, Human
uaaaguguauuuuuuuacu

SEQ ID NO: 2928627 - RNA, 14 nt, Human
aauaaaguaauuau

SEQ ID NO: 2928628 - RNA, 22 nt, Human
aauaaaauccauacauuugugu

SEQ ID NO: 2928629 - RNA, 12 nt, Human
aauaaaaauaau

SEQ ID NO: 2928630 - RNA, 19 nt, Human
uaaaauuauggaaacagau

SEQ ID NO: 2928631 - RNA, 16 nt, Human
uaaaauuauggaaaca

SEQ ID NO: 2928632 - RNA, 18 nt, Human
uaaacaaaauagaaaguu

SEQ ID NO: 2928633 - RNA, 22 nt, Human
uaaacaaaauagaaaguugcaa

SEQ ID NO: 2928634 - RNA, 15 nt, Human
uaaacaaaauagaaa

SEQ ID NO: 2928635 - RNA, 16 nt, Human
uaaacaaaauagaaag

SEQ ID NO: 2928636 - RNA, 17 nt, Human
uaaacaaaauagaaagu

SEQ ID NO: 2928637 - RNA, 19 nt, Human
uaaaccaaggcuagaacca

SEQ ID NO: 2928638 - RNA, 13 nt, Human
aaguuuugagaaa

SEQ ID NO: 2928639 - RNA, 12 nt, Human
aaguuaaauaaa

SEQ ID NO: 2928640 - RNA, 14 nt, Human
aaguuaaauaaauc

SEQ ID NO: 2928641 - RNA, 14 nt, Human
aaguucuaguguuu

SEQ ID NO: 2928642 - RNA, 21 nt, Human
aaguucuaguguuuucaauuu

SEQ ID NO: 2928643 - RNA, 22 nt, Human
aaguucuaguguuuucaauuuu

SEQ ID NO: 2928644 - RNA, 13 nt, Human
uaaacgucuuaaa

SEQ ID NO: 2928645 - RNA, 17 nt, Human
uaaacgucuuaaauauu

SEQ ID NO: 2928646 - RNA, 22 nt, Human
uaaacuacauuagguugugaau

SEQ ID NO: 2928647 - RNA, 18 nt, Human
uaaaccgccaaggcuggg

SEQ ID NO: 2928648 - RNA, 16 nt, Human
uaaaccgccaaggcug

SEQ ID NO: 2928649 - RNA, 17 nt, Human
uaaacucauuucuagca

SEQ ID NO: 2928650 - RNA, 12 nt, Human
uaaacucauuuc

SEQ ID NO: 2928651 - RNA, 20 nt, Human
uaaacucugagugcaaacuu

SEQ ID NO: 2928652 - RNA, 13 nt, Human
uaaagaaguuuga

SEQ ID NO: 2928653 - RNA, 14 nt, Human
uaaagaaguuugaa

SEQ ID NO: 2928654 - RNA, 18 nt, Human
uaaagaaguuugaacauu

SEQ ID NO: 2928655 - RNA, 19 nt, Human
uaaaggcuaccuuuguauu

SEQ ID NO: 2928656 - RNA, 21 nt, Human
uaaaggcuaccuuuguauucu

SEQ ID NO: 2928657 - RNA, 12 nt, Human
guucucugcccu

SEQ ID NO: 2928658 - RNA, 14 nt, Human
guucucugaggaca

SEQ ID NO: 2928659 - RNA, 20 nt, Human
guucuccagucauuauguua

SEQ ID NO: 2928660 - RNA, 18 nt, Human
guucuccagucauuaugu

SEQ ID NO: 2928661 - RNA, 16 nt, Human
guucucugaggacacu

SEQ ID NO: 2928662 - RNA, 11 nt, Human
guucucugccc

SEQ ID NO: 2928663 - RNA, 22 nt, Human
guugauagcacagacccugccc

SEQ ID NO: 2928664 - RNA, 23 nt, Human
guugauagcacagacccugcccu

SEQ ID NO: 2928665 - RNA, 13 nt, Human
guugaauuuuaca

SEQ ID NO: 2928666 - RNA, 13 nt, Human
guguuuauuguca

SEQ ID NO: 2928667 - RNA, 11 nt, Human
aagcucccagg

SEQ ID NO: 2928668 - RNA, 23 nt, Human
aagcucccaggcauuccccagga

SEQ ID NO: 2928669 - RNA, 22 nt, Human
aagcucccaggcauuccccagg

SEQ ID NO: 2928670 - RNA, 12 nt, Human
aagcucccaggc

SEQ ID NO: 2928671 - RNA, 13 nt, Human
aagcucugcuccu

SEQ ID NO: 2928672 - RNA, 18 nt, Human
aagcuguuacugucuuca

SEQ ID NO: 2928673 - RNA, 19 nt, Human
aaggaaaaaauaacaauga

SEQ ID NO: 2928674 - RNA, 16 nt, Human
aaggaaaaaauaacaa

SEQ ID NO: 2928675 - RNA, 20 nt, Human
aaggccugucagcuaaagaa

SEQ ID NO: 2928676 - RNA, 13 nt, Human
aaggcuaccuuug

SEQ ID NO: 2928677 - RNA, 14 nt, Human
guugcccaggcugg

SEQ ID NO: 2928678 - RNA, 15 nt, Human
aaggcuaccuuugua

SEQ ID NO: 2928679 - RNA, 19 nt, Human
aaggccccgcccaggcuua

SEQ ID NO: 2928680 - RNA, 16 nt, Human
aaggccccgcccaggc

SEQ ID NO: 2928681 - RNA, 14 nt, Human
aaggccccgcccag

SEQ ID NO: 2928682 - RNA, 24 nt, Human
aaggaugcacagaguuguuacauu

SEQ ID NO: 2928683 - RNA, 22 nt, Human
aaggaugcacagaguuguuaca

SEQ ID NO: 2928684 - RNA, 14 nt, Human
aaggaugcccaaag

SEQ ID NO: 2928685 - RNA, 19 nt, Human
aaggaugcccaaagaugca

SEQ ID NO: 2928686 - RNA, 23 nt, Human
guuggcugggggccucagugcca

SEQ ID NO: 2928687 - RNA, 15 nt, Human
guugcccaggcuggc

SEQ ID NO: 2928688 - RNA, 23 nt, Human
guugcuaacagcaacacaaagcu

SEQ ID NO: 2928689 - RNA, 16 nt, Human
guugcccaggcuggcg

SEQ ID NO: 2928690 - RNA, 15 nt, Human
guugggcugguguca

SEQ ID NO: 2928691 - RNA, 17 nt, Human
guugggcuggugucacc

SEQ ID NO: 2928692 - RNA, 15 nt, Human
aaggaaacccagcuc

SEQ ID NO: 2928693 - RNA, 18 nt, Human
aaggagauuuacaacugg

SEQ ID NO: 2928694 - RNA, 17 nt, Human
aaggagauuuacaacug

SEQ ID NO: 2928695 - RNA, 12 nt, Human
aaggauccugag

SEQ ID NO: 2928696 - RNA, 11 nt, Human
aaggauccuga

SEQ ID NO: 2928697 - RNA, 22 nt, Human
aaggauccugagccagauuuca

SEQ ID NO: 2928698 - RNA, 20 nt, Human
aaggauccugagccagauuu

SEQ ID NO: 2928699 - RNA, 20 nt, Human
aaggaggaagagaaaaaaua

SEQ ID NO: 2928700 - RNA, 18 nt, Human
guuuuucuaggccugggg

SEQ ID NO: 2928701 - RNA, 18 nt, Human
aagucuuagauguauaua

SEQ ID NO: 2928702 - RNA, 19 nt, Human
aagucuuagauguauauau

SEQ ID NO: 2928703 - RNA, 17 nt, Human
aagucuuagauguauau

SEQ ID NO: 2928704 - RNA, 16 nt, Human
guuuuugucuuaaaaa

SEQ ID NO: 2928705 - RNA, 23 nt, Human
guuuuuuaagggcccuuuuucaa

SEQ ID NO: 2928706 - RNA, 23 nt, Human
guuuuuuuuuaaaaaagaaacau

SEQ ID NO: 2928707 - RNA, 20 nt, Human
aagucacauuccugaacagg

SEQ ID NO: 2928708 - RNA, 13 nt, Human
aagucacacagug

SEQ ID NO: 2928709 - RNA, 18 nt, Human
aaguauucuuauuuaaug

SEQ ID NO: 2928710 - RNA, 19 nt, Human
aaguauucuuauuuaauga

SEQ ID NO: 2928711 - RNA, 24 nt, Human
aagucacacaguauuacuucugcu

SEQ ID NO: 2928712 - RNA, 22 nt, Human
aagucaaggcuuagacccucau

SEQ ID NO: 2928713 - RNA, 13 nt, Human
aagucaaggcuua

SEQ ID NO: 2928714 - RNA, 21 nt, Human
aagucaagugaaaaaggagga

SEQ ID NO: 2928715 - RNA, 21 nt, Human
aaguacuucuccacccugcuc

SEQ ID NO: 2928716 - RNA, 15 nt, Human
aaguacuggagaaaa

SEQ ID NO: 2928717 - RNA, 16 nt, Human
aaguacuauguaucaa

SEQ ID NO: 2928718 - RNA, 22 nt, Human
guuuucugagaaagacuauuca

SEQ ID NO: 2928719 - RNA, 15 nt, Human
aaguacuauguauca

SEQ ID NO: 2928720 - RNA, 17 nt, Human
guuuucugagaaagacu

SEQ ID NO: 2928721 - RNA, 16 nt, Human
guuuucugagaaagac

SEQ ID NO: 2928722 - RNA, 22 nt, Human
aaguacuucuccacccugcucu

SEQ ID NO: 2928723 - RNA, 23 nt, Human
aaguacuucuccacccugcucuc

SEQ ID NO: 2928724 - RNA, 23 nt, Human
aaguauguuagugcaaauuguca

SEQ ID NO: 2928725 - RNA, 21 nt, Human
aaguauguuagugcaaauugu

SEQ ID NO: 2928726 - RNA, 18 nt, Human
aaguaaaaccacagcagu

SEQ ID NO: 2928727 - RNA, 17 nt, Human
aaguaaaaccacagcag

SEQ ID NO: 2928728 - RNA, 21 nt, Human
guuucuagcaugaagacagag

SEQ ID NO: 2928729 - RNA, 14 nt, Human
aaguaaaaccacag

SEQ ID NO: 2928730 - RNA, 16 nt, Human
aaguaaaaccacagca

SEQ ID NO: 2928731 - RNA, 15 nt, Human
aaguaaaaccacagc

SEQ ID NO: 2928732 - RNA, 21 nt, Human
aagggugaugggaaagcauug

SEQ ID NO: 2928733 - RNA, 15 nt, Human
aagggcccagagagg

SEQ ID NO: 2928734 - RNA, 13 nt, Human
aagggcccagaga

SEQ ID NO: 2928735 - RNA, 22 nt, Human
aagggcccuuuuucaauaacug

SEQ ID NO: 2928736 - RNA, 16 nt, Human
aagggcccuuuuucaa

SEQ ID NO: 2928737 - RNA, 17 nt, Human
aaggguaucaggugcug

SEQ ID NO: 2928738 - RNA, 14 nt, Human
aaggggcaguggug

SEQ ID NO: 2928739 - RNA, 19 nt, Human
aaggguaucaggugcugcc

SEQ ID NO: 2928740 - RNA, 16 nt, Human
aaggguaucuggugac

SEQ ID NO: 2928741 - RNA, 22 nt, Human
guuucugccgcagcccugcaga

SEQ ID NO: 2928742 - RNA, 18 nt, Human
guuucugccgcagcccug

SEQ ID NO: 2928743 - RNA, 17 nt, Human
guuugccucugccucug

SEQ ID NO: 2928744 - RNA, 13 nt, Human
guuugcuaaguga

SEQ ID NO: 2928745 - RNA, 14 nt, Human
guuuuaagaggcag

SEQ ID NO: 2928746 - RNA, 16 nt, Human
guuuuaagaggcaggg

SEQ ID NO: 2928747 - RNA, 11 nt, Human
guuuggccaga

SEQ ID NO: 2928748 - RNA, 23 nt, Human
guuuggccagaagucaaggcuua

SEQ ID NO: 2928749 - RNA, 18 nt, Human
guuuggccagaagucaag

SEQ ID NO: 2928750 - RNA, 12 nt, Human
guuuggccagaa

SEQ ID NO: 2928751 - RNA, 15 nt, Human
guuuuacugcagcuu

SEQ ID NO: 2928752 - RNA, 18 nt, Human
guuuuacugcagcuuugu

SEQ ID NO: 2928753 - RNA, 16 nt, Human
guuuuacugcagcuuu

SEQ ID NO: 2928754 - RNA, 15 nt, Human
guuuuauaauuuugu

SEQ ID NO: 2928755 - RNA, 22 nt, Human
guuuuauaauuuugugaagcaa

SEQ ID NO: 2928756 - RNA, 15 nt, Human
guuuucugagaaaga

SEQ ID NO: 2928757 - RNA, 23 nt, Human
gugguggcaggcaccuguagucc

SEQ ID NO: 2928758 - RNA, 14 nt, Human
gugguggcaggcac

SEQ ID NO: 2928759 - RNA, 16 nt, Human
gugguguuuccuggca

SEQ ID NO: 2928760 - RNA, 15 nt, Human
gugguguuuccuggc

SEQ ID NO: 2928761 - RNA, 14 nt, Human
guggguagacacac

SEQ ID NO: 2928762 - RNA, 12 nt, Human
gugggagcugag

SEQ ID NO: 2928763 - RNA, 18 nt, Human
gugggauccuccaggugc

SEQ ID NO: 2928764 - RNA, 15 nt, Human
gugggauccuccagg

SEQ ID NO: 2928765 - RNA, 14 nt, Human
guggccucccaacu

SEQ ID NO: 2928766 - RNA, 13 nt, Human
guggccucccaac

SEQ ID NO: 2928767 - RNA, 15 nt, Human
guggccucccaacuc

SEQ ID NO: 2928768 - RNA, 16 nt, Human
aagagcccaggccucc

SEQ ID NO: 2928769 - RNA, 14 nt, Human
aagagcccaggccu

SEQ ID NO: 2928770 - RNA, 12 nt, Human
aagagcccaggc

SEQ ID NO: 2928771 - RNA, 19 nt, Human
aagagauugugguuucauu

SEQ ID NO: 2928772 - RNA, 16 nt, Human
aagagauugugguuuc

SEQ ID NO: 2928773 - RNA, 18 nt, Human
aagagcuguucacagcca

SEQ ID NO: 2928774 - RNA, 17 nt, Human
aagacugcauuauauuu

SEQ ID NO: 2928775 - RNA, 22 nt, Human
aagacucccaugagggagaugc

SEQ ID NO: 2928776 - RNA, 17 nt, Human
aagacucauucuucugu

SEQ ID NO: 2928777 - RNA, 14 nt, Human
aagacuccaaagaa

SEQ ID NO: 2928778 - RNA, 17 nt, Human
aagacuccaaagaaaug

SEQ ID NO: 2928779 - RNA, 16 nt, Human
aagacuccaaagaaau

SEQ ID NO: 2928780 - RNA, 22 nt, Human
aagacgcugugcugcccugccc

SEQ ID NO: 2928781 - RNA, 21 nt, Human
aagacgcugugcugcccugcc

SEQ ID NO: 2928782 - RNA, 14 nt, Human
aagacuauucaaac

SEQ ID NO: 2928783 - RNA, 13 nt, Human
aagacuauucaaa

SEQ ID NO: 2928784 - RNA, 20 nt, Human
aagacgcugugcugcccugc

SEQ ID NO: 2928785 - RNA, 23 nt, Human
aagacgcugugcugcccugccca

SEQ ID NO: 2928786 - RNA, 23 nt, Human
guguguggucaacauuucucaug

SEQ ID NO: 2928787 - RNA, 19 nt, Human
gugugguguuuccuggcac

SEQ ID NO: 2928788 - RNA, 21 nt, Human
gugucuugcaauggcagccuu

SEQ ID NO: 2928789 - RNA, 13 nt, Human
gugugagucacca

SEQ ID NO: 2928790 - RNA, 18 nt, Human
gugugagucaccaagccc

SEQ ID NO: 2928791 - RNA, 15 nt, Human
gugugguguuuccug

SEQ ID NO: 2928792 - RNA, 19 nt, Human
gugucuugcaauggcagcc

SEQ ID NO: 2928793 - RNA, 20 nt, Human
gugucccaaaaagaaaggag

SEQ ID NO: 2928794 - RNA, 16 nt, Human
aagcaaguauuagaau

SEQ ID NO: 2928795 - RNA, 22 nt, Human
aagauauuuugcuuugugauuu

SEQ ID NO: 2928796 - RNA, 17 nt, Human
aagauauuuugcuuugu

SEQ ID NO: 2928797 - RNA, 20 nt, Human
aagauauuuugcuuugugau

SEQ ID NO: 2928798 - RNA, 20 nt, Human
gugguuauaacuuaaugaaa

SEQ ID NO: 2928799 - RNA, 17 nt, Human
gugguuauaacuuaaug

SEQ ID NO: 2928800 - RNA, 19 nt, Human
gugguguuuccuggcacug

SEQ ID NO: 2928801 - RNA, 18 nt, Human
gugguuauggagagggug

SEQ ID NO: 2928802 - RNA, 15 nt, Human
aagauauuuugcuuu

SEQ ID NO: 2928803 - RNA, 19 nt, Human
aagaguaggaagacuuugg

SEQ ID NO: 2928804 - RNA, 18 nt, Human
aagaguaggaagacuuug

SEQ ID NO: 2928805 - RNA, 16 nt, Human
aagaguaggaagacuu

SEQ ID NO: 2928806 - RNA, 19 nt, Human
aagcaaaauuuuuucucua

SEQ ID NO: 2928807 - RNA, 19 nt, Human
aagauguagaggagaaacu

SEQ ID NO: 2928808 - RNA, 13 nt, Human
aagcaaaauguga

SEQ ID NO: 2928809 - RNA, 22 nt, Human
aagauguagaggagaaacugga

SEQ ID NO: 2928810 - RNA, 12 nt, Human
gugcacacacca

SEQ ID NO: 2928811 - RNA, 14 nt, Human
gugcacacaccaga

SEQ ID NO: 2928812 - RNA, 18 nt, Human
gugcacguacacacacau

SEQ ID NO: 2928813 - RNA, 23 nt, Human
gugcacaagcuccaagcucccag

SEQ ID NO: 2928814 - RNA, 17 nt, Human
gugcacacaccagagcc

SEQ ID NO: 2928815 - RNA, 14 nt, Human
gugccaagcagagg

SEQ ID NO: 2928816 - RNA, 15 nt, Human
gugcauuuggugguu

SEQ ID NO: 2928817 - RNA, 20 nt, Human
gugcacuaauguguaagaca

SEQ ID NO: 2928818 - RNA, 20 nt, Human
gugcauuugaggucuguucu

SEQ ID NO: 2928819 - RNA, 21 nt, Human
gugcauuugaggucuguucuu

SEQ ID NO: 2928820 - RNA, 22 nt, Human
gugcauuugaggucuguucuuu

SEQ ID NO: 2928821 - RNA, 14 nt, Human
gugccucugggacu

SEQ ID NO: 2928822 - RNA, 15 nt, Human
gugccucugggacug

SEQ ID NO: 2928823 - RNA, 21 nt, Human
gugccuggguggaugggccac

SEQ ID NO: 2928824 - RNA, 14 nt, Human
aacuuggcgcugcc

SEQ ID NO: 2928825 - RNA, 22 nt, Human
aacuugucuuuggacccugagg

SEQ ID NO: 2928826 - RNA, 23 nt, Human
aacuugguucccauuugcuccuu

SEQ ID NO: 2928827 - RNA, 18 nt, Human
aagaaaaguuuauaaaag

SEQ ID NO: 2928828 - RNA, 22 nt, Human
aagaaaaaggaugcacagaguu

SEQ ID NO: 2928829 - RNA, 19 nt, Human
aagaaaaaggaugcacaga

SEQ ID NO: 2928830 - RNA, 20 nt, Human
aagaaaaaggaugcacagag

SEQ ID NO: 2928831 - RNA, 15 nt, Human
aagaagcucucuccu

SEQ ID NO: 2928832 - RNA, 14 nt, Human
aagaagcucucucc

SEQ ID NO: 2928833 - RNA, 22 nt, Human
aagaagcaccaaucaugaauua

SEQ ID NO: 2928834 - RNA, 17 nt, Human
aagaagcccaggaaagg

SEQ ID NO: 2928835 - RNA, 16 nt, Human
aagaagcccaggaaag

SEQ ID NO: 2928836 - RNA, 13 nt, Human
aagaaaauaucac

SEQ ID NO: 2928837 - RNA, 14 nt, Human
guggacacagcucu

SEQ ID NO: 2928838 - RNA, 15 nt, Human
guggacacagcucuu

SEQ ID NO: 2928839 - RNA, 24 nt, Human
guggacacagcucuucuccaggcu

SEQ ID NO: 2928840 - RNA, 18 nt, Human
gugcugcccugcccaccu

SEQ ID NO: 2928841 - RNA, 20 nt, Human
gugcugcccugcccaccugg

SEQ ID NO: 2928842 - RNA, 19 nt, Human
gugcugcccugcccaccug

SEQ ID NO: 2928843 - RNA, 21 nt, Human
gugcugcccugcccaccuggc

SEQ ID NO: 2928844 - RNA, 21 nt, Human
guggauuuaacagaaauguac

SEQ ID NO: 2928845 - RNA, 20 nt, Human
guggauuuaacagaaaugua

SEQ ID NO: 2928846 - RNA, 23 nt, Human
guggauuuaacagaaauguacag

SEQ ID NO: 2928847 - RNA, 14 nt, Human
guggcaccagcagc

SEQ ID NO: 2928848 - RNA, 13 nt, Human
guggcaccagcag

SEQ ID NO: 2928849 - RNA, 14 nt, Human
guggcagcugcggu

SEQ ID NO: 2928850 - RNA, 22 nt, Human
guggcagcucaccucucccuug

SEQ ID NO: 2928851 - RNA, 24 nt, Human
aagaauuucuaggacugaauuaug

SEQ ID NO: 2928852 - RNA, 13 nt, Human
aagacccaaaagg

SEQ ID NO: 2928853 - RNA, 17 nt, Human
guggcagcugcggucca

SEQ ID NO: 2928854 - RNA, 13 nt, Human
aagaauauuuuaa

SEQ ID NO: 2928855 - RNA, 17 nt, Human
aacagucucaggaaauc

SEQ ID NO: 2928856 - RNA, 19 nt, Human
aacagucucaggaaaucaa

SEQ ID NO: 2928857 - RNA, 13 nt, Human
guccuacccaccc

SEQ ID NO: 2928858 - RNA, 20 nt, Human
aacagacuggaagcacagcu

SEQ ID NO: 2928859 - RNA, 19 nt, Human
aacagauuauuaccuuaca

SEQ ID NO: 2928860 - RNA, 20 nt, Human
aacauacucccaucugugaa

SEQ ID NO: 2928861 - RNA, 16 nt, Human
aacauacucccaucug

SEQ ID NO: 2928862 - RNA, 18 nt, Human
aacauacucccaucugug

SEQ ID NO: 2928863 - RNA, 23 nt, Human
aacagugagagacuccauaguuu

SEQ ID NO: 2928864 - RNA, 19 nt, Human
aacauauccaaguuugaau

SEQ ID NO: 2928865 - RNA, 20 nt, Human
aacauauccaaguuugaauu

SEQ ID NO: 2928866 - RNA, 14 nt, Human
aacaucaacaucuu

SEQ ID NO: 2928867 - RNA, 16 nt, Human
aacauauauaacaaug

SEQ ID NO: 2928868 - RNA, 14 nt, Human
aacauauccaaguu

SEQ ID NO: 2928869 - RNA, 22 nt, Human
aacauguuuuucuucucccuca

SEQ ID NO: 2928870 - RNA, 23 nt, Human
guccccuguuuguuucugaaagg

SEQ ID NO: 2928871 - RNA, 16 nt, Human
guccccgcacugggcu

SEQ ID NO: 2928872 - RNA, 15 nt, Human
guccccgcacugggc

SEQ ID NO: 2928873 - RNA, 13 nt, Human
gucccccugacaa

SEQ ID NO: 2928874 - RNA, 22 nt, Human
guccgaaagggacuuggaagcu

SEQ ID NO: 2928875 - RNA, 21 nt, Human
guccgaaagggacuuggaagc

SEQ ID NO: 2928876 - RNA, 13 nt, Human
gucccuuuuccuu

SEQ ID NO: 2928877 - RNA, 19 nt, Human
gucccaccuuggcugcagg

SEQ ID NO: 2928878 - RNA, 17 nt, Human
gucccaccuuggcugca

SEQ ID NO: 2928879 - RNA, 18 nt, Human
gucccaccuuggcugcag

SEQ ID NO: 2928880 - RNA, 23 nt, Human
guccaugaagauguagaggagaa

SEQ ID NO: 2928881 - RNA, 22 nt, Human
guagcucuaggagggcuggcaa

SEQ ID NO: 2928882 - RNA, 16 nt, Human
guccugcugcaguugc

SEQ ID NO: 2928883 - RNA, 13 nt, Human
guccugcugcagu

SEQ ID NO: 2928884 - RNA, 20 nt, Human
gucuaccugaggggccucuu

SEQ ID NO: 2928885 - RNA, 23 nt, Human
gucgcccagucuggaaugcagug

SEQ ID NO: 2928886 - RNA, 14 nt, Human
gucgaggacaggga

SEQ ID NO: 2928887 - RNA, 13 nt, Human
gucgcccagucug

SEQ ID NO: 2928888 - RNA, 14 nt, Human
gucgcccagucugg

SEQ ID NO: 2928889 - RNA, 23 nt, Human
aaccaucauugaaaucuuuuugc

SEQ ID NO: 2928890 - RNA, 13 nt, Human
aaccacaucuugc

SEQ ID NO: 2928891 - RNA, 14 nt, Human
gucuccagcugcug

SEQ ID NO: 2928892 - RNA, 13 nt, Human
gucuccauguuug

SEQ ID NO: 2928893 - RNA, 13 nt, Human
gucuccagcugcu

SEQ ID NO: 2928894 - RNA, 19 nt, Human
gucucaaaaaaagaaaaag

SEQ ID NO: 2928895 - RNA, 22 nt, Human
gucucaaacucuugaccucagg

SEQ ID NO: 2928896 - RNA, 14 nt, Human
gucuaugggacuca

SEQ ID NO: 2928897 - RNA, 23 nt, Human
gucucaguccaugaagauguaga

SEQ ID NO: 2928898 - RNA, 23 nt, Human
aacguggcugcuucaaggauccu

SEQ ID NO: 2928899 - RNA, 22 nt, Human
aacuaacaggcuuagugaugua

SEQ ID NO: 2928900 - RNA, 18 nt, Human
aacuaacaggcuuaguga

SEQ ID NO: 2928901 - RNA, 18 nt, Human
aaccugauugugucucuu

SEQ ID NO: 2928902 - RNA, 19 nt, Human
aaccugauugugucucuug

SEQ ID NO: 2928903 - RNA, 16 nt, Human
gucuucaguaagccgu

SEQ ID NO: 2928904 - RNA, 16 nt, Human
gucuuuguacagacaa

SEQ ID NO: 2928905 - RNA, 15 nt, Human
gucuuuguacagaca

SEQ ID NO: 2928906 - RNA, 18 nt, Human
gucucuuuaaugucacag

SEQ ID NO: 2928907 - RNA, 19 nt, Human
gucucuuuaaugucacagg

SEQ ID NO: 2928908 - RNA, 20 nt, Human
gucucuuuaaugucacaggc

SEQ ID NO: 2928909 - RNA, 14 nt, Human
gucugaaggcuggg

SEQ ID NO: 2928910 - RNA, 19 nt, Human
gucugaaggcuggguucug

SEQ ID NO: 2928911 - RNA, 22 nt, Human
gucucuuuaaugucacaggcag

SEQ ID NO: 2928912 - RNA, 17 nt, Human
gucucuugguccugcug

SEQ ID NO: 2928913 - RNA, 19 nt, Human
gucucuugguccugcugca

SEQ ID NO: 2928914 - RNA, 18 nt, Human
gucucuugguccugcugc

SEQ ID NO: 2928915 - RNA, 20 nt, Human
gucucuugguccugcugcag

SEQ ID NO: 2928916 - RNA, 13 nt, Human
gucucuugguccu

SEQ ID NO: 2928917 - RNA, 18 nt, Human
gucuggaaugcaguggua

SEQ ID NO: 2928918 - RNA, 21 nt, Human
gucugacaggcaaugcuggcu

SEQ ID NO: 2928919 - RNA, 22 nt, Human
gucugacaggcaaugcuggcug

SEQ ID NO: 2928920 - RNA, 23 nt, Human
gucugacaggcaaugcuggcugu

SEQ ID NO: 2928921 - RNA, 13 nt, Human
gucuucacaacag

SEQ ID NO: 2928922 - RNA, 14 nt, Human
gugaagugaagaca

SEQ ID NO: 2928923 - RNA, 23 nt, Human
gugaagacaaugacuuacuguac

SEQ ID NO: 2928924 - RNA, 13 nt, Human
aacuauauuguuu

SEQ ID NO: 2928925 - RNA, 20 nt, Human
aacuaucucauuuccaagca

SEQ ID NO: 2928926 - RNA, 16 nt, Human
gugacagaggcagccc

SEQ ID NO: 2928927 - RNA, 18 nt, Human
gugacagaggcagcccca

SEQ ID NO: 2928928 - RNA, 19 nt, Human
gugacagaggcagccccau

SEQ ID NO: 2928929 - RNA, 14 nt, Human
gugacaugucuuuu

SEQ ID NO: 2928930 - RNA, 18 nt, Human
gugaccauguuuuguuua

SEQ ID NO: 2928931 - RNA, 21 nt, Human
gugaccagcaccaucucuccu

SEQ ID NO: 2928932 - RNA, 18 nt, Human
gugaccagcaccaucucu

SEQ ID NO: 2928933 - RNA, 17 nt, Human
gugaccaaugaugguca

SEQ ID NO: 2928934 - RNA, 12 nt, Human
gugagagcuggg

SEQ ID NO: 2928935 - RNA, 12 nt, Human
gugaccccaggu

SEQ ID NO: 2928936 - RNA, 17 nt, Human
gugaguacuacaguccu

SEQ ID NO: 2928937 - RNA, 21 nt, Human
gugagcacuaaggugugcucu

SEQ ID NO: 2928938 - RNA, 15 nt, Human
gugagcaauccugca

SEQ ID NO: 2928939 - RNA, 13 nt, Human
gugagagcugggu

SEQ ID NO: 2928940 - RNA, 16 nt, Human
gugagaggggaacaga

SEQ ID NO: 2928941 - RNA, 20 nt, Human
gugaguccuggcaugggaau

SEQ ID NO: 2928942 - RNA, 17 nt, Human
gugaguccuggcauggg

SEQ ID NO: 2928943 - RNA, 19 nt, Human
gugaguacuacaguccucc

SEQ ID NO: 2928944 - RNA, 13 nt, Human
aacucuguaauuc

SEQ ID NO: 2928945 - RNA, 13 nt, Human
aacugaaaucaua

SEQ ID NO: 2928946 - RNA, 20 nt, Human
aacugaaaucauacuucuua

SEQ ID NO: 2928947 - RNA, 23 nt, Human
aaucuucugaacuuggcgcugcc

SEQ ID NO: 2928948 - RNA, 19 nt, Human
aaucuuuuaugauugccuu

SEQ ID NO: 2928949 - RNA, 15 nt, Human
aaugaaugaaugaau

SEQ ID NO: 2928950 - RNA, 14 nt, Human
aaugaaugaaacau

SEQ ID NO: 2928951 - RNA, 14 nt, Human
aaugaaugucagug

SEQ ID NO: 2928952 - RNA, 15 nt, Human
aaugaaugucagugu

SEQ ID NO: 2928953 - RNA, 16 nt, Human
uaauguaagcucuacu

SEQ ID NO: 2928954 - RNA, 17 nt, Human
uaauguaagcucuacug

SEQ ID NO: 2928955 - RNA, 16 nt, Human
uaaugucacaggcagg

SEQ ID NO: 2928956 - RNA, 17 nt, Human
uaaugucacaggcaggu

SEQ ID NO: 2928957 - RNA, 15 nt, Human
uaaugucacaggcag

SEQ ID NO: 2928958 - RNA, 12 nt, Human
uaaugugaaacu

SEQ ID NO: 2928959 - RNA, 20 nt, Human
uaaugugaaacuggauuaaa

SEQ ID NO: 2928960 - RNA, 22 nt, Human
uaaugugaaacuggauuaaacu

SEQ ID NO: 2928961 - RNA, 23 nt, Human
uaaugugaaacuggauuaaacuu

SEQ ID NO: 2928962 - RNA, 21 nt, Human
uaauauugauaugcuuauaca

SEQ ID NO: 2928963 - RNA, 20 nt, Human
aauacaguaucucagggccu

SEQ ID NO: 2928964 - RNA, 23 nt, Human
uaauacaccacuacauucuguua

SEQ ID NO: 2928965 - RNA, 22 nt, Human
uaauacaccacuacauucuguu

SEQ ID NO: 2928966 - RNA, 21 nt, Human
uaauacaccacuacauucugu

SEQ ID NO: 2928967 - RNA, 22 nt, Human
uaauuuccauuuacuuaagacu

SEQ ID NO: 2928968 - RNA, 18 nt, Human
uaauuuaccugaagucuu

SEQ ID NO: 2928969 - RNA, 17 nt, Human
uaauuuaccugaagucu

SEQ ID NO: 2928970 - RNA, 20 nt, Human
uaauuugaagguagaauguu

SEQ ID NO: 2928971 - RNA, 21 nt, Human
uacaagcgugagccacugcac

SEQ ID NO: 2928972 - RNA, 16 nt, Human
uacaagcgugagccac

SEQ ID NO: 2928973 - RNA, 18 nt, Human
uacaagcgugagccacug

SEQ ID NO: 2928974 - RNA, 19 nt, Human
uacaagcgugagccacugc

SEQ ID NO: 2928975 - RNA, 20 nt, Human
uacaagcgugagccacugca

SEQ ID NO: 2928976 - RNA, 16 nt, Human
uacaaaaacacagcaa

SEQ ID NO: 2928977 - RNA, 16 nt, Human
uacaaaaacauggccu

SEQ ID NO: 2928978 - RNA, 18 nt, Human
uacaaaaacacagcaagg

SEQ ID NO: 2928979 - RNA, 17 nt, Human
uacaaaaacacagcaag

SEQ ID NO: 2928980 - RNA, 21 nt, Human
aaugcaaagaugaaggucugu

SEQ ID NO: 2928981 - RNA, 14 nt, Human
aaugcaaagaugaa

SEQ ID NO: 2928982 - RNA, 18 nt, Human
aaugcaaagaugaagguc

SEQ ID NO: 2928983 - RNA, 12 nt, Human
aaugcaaagaug

SEQ ID NO: 2928984 - RNA, 23 nt, Human
aaugcaaaccaucauugaaaucu

SEQ ID NO: 2928985 - RNA, 22 nt, Human
aaugcaaaccaucauugaaauc

SEQ ID NO: 2928986 - RNA, 18 nt, Human
aaugcacaaacagaggcc

SEQ ID NO: 2928987 - RNA, 21 nt, Human
aaugaaugucagugugacuga

SEQ ID NO: 2928988 - RNA, 20 nt, Human
aaugaaugucagugugacug

SEQ ID NO: 2928989 - RNA, 16 nt, Human
aaugcaaaccaucauu

SEQ ID NO: 2928990 - RNA, 14 nt, Human
aaugcaaaccauca

SEQ ID NO: 2928991 - RNA, 14 nt, Human
aaugaccuuucaau

SEQ ID NO: 2928992 - RNA, 13 nt, Human
aaugaccuuucaa

SEQ ID NO: 2928993 - RNA, 23 nt, Human
uaauuaguuccucauuagcauuu

SEQ ID NO: 2928994 - RNA, 20 nt, Human
aaugcacuuuguucuggcuc

SEQ ID NO: 2928995 - RNA, 19 nt, Human
aaugcacuuuguucuggcu

SEQ ID NO: 2928996 - RNA, 16 nt, Human
aaugcacuuuguucug

SEQ ID NO: 2928997 - RNA, 13 nt, Human
aaugcacuuuguu

SEQ ID NO: 2928998 - RNA, 20 nt, Human
aaugcacaaacagaggccgc

SEQ ID NO: 2928999 - RNA, 19 nt, Human
aaugcacaaacagaggccg

SEQ ID NO: 2929000 - RNA, 21 nt, Human
uaauuaugguuaguagaggua

SEQ ID NO: 2929001 - RNA, 14 nt, Human
uacauacuuuuugg

SEQ ID NO: 2929002 - RNA, 15 nt, Human
uacauacuuuuuggg

SEQ ID NO: 2929003 - RNA, 12 nt, Human
uacauacuuuuu

SEQ ID NO: 2929004 - RNA, 14 nt, Human
aauguaggcuggcu

SEQ ID NO: 2929005 - RNA, 13 nt, Human
aaugucacaggca

SEQ ID NO: 2929006 - RNA, 14 nt, Human
aaugucacaggcag

SEQ ID NO: 2929007 - RNA, 22 nt, Human
aaugugaaacuggauuaaacuu

SEQ ID NO: 2929008 - RNA, 20 nt, Human
uacaguggggaaugaagaua

SEQ ID NO: 2929009 - RNA, 18 nt, Human
uacaguccucccaucuca

SEQ ID NO: 2929010 - RNA, 17 nt, Human
uacaguccucccaucuc

SEQ ID NO: 2929011 - RNA, 15 nt, Human
uacaguccucccauc

SEQ ID NO: 2929012 - RNA, 12 nt, Human
uacaguccuccc

SEQ ID NO: 2929013 - RNA, 18 nt, Human
uacaguaucucagggccu

SEQ ID NO: 2929014 - RNA, 21 nt, Human
aauguacagcaaggagauuua

SEQ ID NO: 2929015 - RNA, 23 nt, Human
aauguacagcaaggagauuuaca

SEQ ID NO: 2929016 - RNA, 22 nt, Human
uacagcaaggagauuuacaacu

SEQ ID NO: 2929017 - RNA, 22 nt, Human
aaugguuuucuuguguguuuau

SEQ ID NO: 2929018 - RNA, 18 nt, Human
aaugguuuucuugugugu

SEQ ID NO: 2929019 - RNA, 17 nt, Human
aaugguuuucuugugug

SEQ ID NO: 2929020 - RNA, 13 nt, Human
aauguaagcucua

SEQ ID NO: 2929021 - RNA, 15 nt, Human
aauguaagcucuacu

SEQ ID NO: 2929022 - RNA, 16 nt, Human
aaugguuuaaaugguc

SEQ ID NO: 2929023 - RNA, 20 nt, Human
uacccgggaagggggcuggg

SEQ ID NO: 2929024 - RNA, 15 nt, Human
uacccucauguucuu

SEQ ID NO: 2929025 - RNA, 16 nt, Human
uacccucauguucuua

SEQ ID NO: 2929026 - RNA, 20 nt, Human
uacccuggcacuauaaugua

SEQ ID NO: 2929027 - RNA, 22 nt, Human
uacccuggcacuauaauguaag

SEQ ID NO: 2929028 - RNA, 17 nt, Human
uaccacuuuugcaaaua

SEQ ID NO: 2929029 - RNA, 15 nt, Human
uaccacuuuugcaaa

SEQ ID NO: 2929030 - RNA, 17 nt, Human
uaccacuuuuguucuug

SEQ ID NO: 2929031 - RNA, 17 nt, Human
uaccauccccuguagag

SEQ ID NO: 2929032 - RNA, 16 nt, Human
uacauuagguugugaa

SEQ ID NO: 2929033 - RNA, 23 nt, Human
uacauggcuggagcuagaauuug

SEQ ID NO: 2929034 - RNA, 13 nt, Human
aauuaaguacuau

SEQ ID NO: 2929035 - RNA, 18 nt, Human
aauguugacaugggacau

SEQ ID NO: 2929036 - RNA, 18 nt, Human
aauuaacuuuuauaaacu

SEQ ID NO: 2929037 - RNA, 20 nt, Human
aauuaacuuuuauaaacuuu

SEQ ID NO: 2929038 - RNA, 15 nt, Human
aauuaagagagucua

SEQ ID NO: 2929039 - RNA, 22 nt, Human
aauuaacuuuuauaaacuuuac

SEQ ID NO: 2929040 - RNA, 13 nt, Human
aauugacccacaa

SEQ ID NO: 2929041 - RNA, 16 nt, Human
aauugacccacaagaa

SEQ ID NO: 2929042 - RNA, 19 nt, Human
aauugacccacaagaaaug

SEQ ID NO: 2929043 - RNA, 15 nt, Human
uacguacacauuuua

SEQ ID NO: 2929044 - RNA, 14 nt, Human
uacguacacauuuu

SEQ ID NO: 2929045 - RNA, 14 nt, Human
aauucuuucauuuu

SEQ ID NO: 2929046 - RNA, 13 nt, Human
aauucuuaaauau

SEQ ID NO: 2929047 - RNA, 22 nt, Human
aauucuucuccacuuucuagcc

SEQ ID NO: 2929048 - RNA, 21 nt, Human
aauucuugccaaauauaaaua

SEQ ID NO: 2929049 - RNA, 14 nt, Human
aauucuugcaaagu

SEQ ID NO: 2929050 - RNA, 20 nt, Human
aauucuugcaaaguaucccu

SEQ ID NO: 2929051 - RNA, 21 nt, Human
uacucugugucagguggggca

SEQ ID NO: 2929052 - RNA, 20 nt, Human
uacucuuauaucuauauuuu

SEQ ID NO: 2929053 - RNA, 22 nt, Human
uacucuuauaucuauauuuuac

SEQ ID NO: 2929054 - RNA, 18 nt, Human
uacuauuaaacaugcugu

SEQ ID NO: 2929055 - RNA, 14 nt, Human
uacuauuaaacaug

SEQ ID NO: 2929056 - RNA, 15 nt, Human
uacuauuaaacaugc

SEQ ID NO: 2929057 - RNA, 16 nt, Human
uacuauuaaacaugcu

SEQ ID NO: 2929058 - RNA, 16 nt, Human
uacuauaauuuaccug

SEQ ID NO: 2929059 - RNA, 13 nt, Human
uacuauuaaacau

SEQ ID NO: 2929060 - RNA, 16 nt, Human
uacuauguaucaauga

SEQ ID NO: 2929061 - RNA, 13 nt, Human
uacguugugcauu

SEQ ID NO: 2929062 - RNA, 14 nt, Human
uacguugugcauuu

SEQ ID NO: 2929063 - RNA, 14 nt, Human
uacgucugacaggc

SEQ ID NO: 2929064 - RNA, 19 nt, Human
aauuuacauacucugcuua

SEQ ID NO: 2929065 - RNA, 16 nt, Human
aauuuaaauagcuuuu

SEQ ID NO: 2929066 - RNA, 15 nt, Human
aauuuaaauagcuuu

SEQ ID NO: 2929067 - RNA, 13 nt, Human
aauuuaaaagucu

SEQ ID NO: 2929068 - RNA, 21 nt, Human
aauuguuugacggcaagguuu

SEQ ID NO: 2929069 - RNA, 22 nt, Human
aauuguuuggggaugagaaagg

SEQ ID NO: 2929070 - RNA, 23 nt, Human
aauugugugaaagguacuucaaa

SEQ ID NO: 2929071 - RNA, 16 nt, Human
aauuugauaugugaac

SEQ ID NO: 2929072 - RNA, 18 nt, Human
aauuugauaugugaacag

SEQ ID NO: 2929073 - RNA, 15 nt, Human
aauuugauaugugaa

SEQ ID NO: 2929074 - RNA, 19 nt, Human
aauuugauaugugaacagu

SEQ ID NO: 2929075 - RNA, 14 nt, Human
uacuucaaauccuu

SEQ ID NO: 2929076 - RNA, 19 nt, Human
uacuucaaauccuugaaga

SEQ ID NO: 2929077 - RNA, 17 nt, Human
aauuuagaaauauaauu

SEQ ID NO: 2929078 - RNA, 13 nt, Human
aauuucuaaaucu

SEQ ID NO: 2929079 - RNA, 21 nt, Human
aauuucuaaaucuccaaaaua

SEQ ID NO: 2929080 - RNA, 19 nt, Human
aauuucucccagucauuua

SEQ ID NO: 2929081 - RNA, 20 nt, Human
aauuucucccagucauuuaa

SEQ ID NO: 2929082 - RNA, 19 nt, Human
aauuuuuucucuaggaaau

SEQ ID NO: 2929083 - RNA, 17 nt, Human
aauuuuuuugagacaga

SEQ ID NO: 2929084 - RNA, 16 nt, Human
acaaaaacacagcaag

SEQ ID NO: 2929085 - RNA, 13 nt, Human
acaaaaacauggc

SEQ ID NO: 2929086 - RNA, 14 nt, Human
uagacagucccugc

SEQ ID NO: 2929087 - RNA, 12 nt, Human
uagacagucccu

SEQ ID NO: 2929088 - RNA, 17 nt, Human
aauuuuuauuaaauuau

SEQ ID NO: 2929089 - RNA, 18 nt, Human
aauuuuuauuaaauuaug

SEQ ID NO: 2929090 - RNA, 13 nt, Human
aauuuuaaacaua

SEQ ID NO: 2929091 - RNA, 14 nt, Human
aauuuuaaacauau

SEQ ID NO: 2929092 - RNA, 19 nt, Human
aauuuuuauauuugaaaua

SEQ ID NO: 2929093 - RNA, 21 nt, Human
uagacagagucucacuguugc

SEQ ID NO: 2929094 - RNA, 16 nt, Human
uagacaauuuauuaug

SEQ ID NO: 2929095 - RNA, 16 nt, Human
uagaagucacacagua

SEQ ID NO: 2929096 - RNA, 23 nt, Human
uagaagucacauuccugaacagg

SEQ ID NO: 2929097 - RNA, 16 nt, Human
uagaagucuuagaugu

SEQ ID NO: 2929098 - RNA, 17 nt, Human
uagaagucuuagaugua

SEQ ID NO: 2929099 - RNA, 18 nt, Human
uagaagucuuagauguau

SEQ ID NO: 2929100 - RNA, 19 nt, Human
uagaagucuuagauguaua

SEQ ID NO: 2929101 - RNA, 19 nt, Human
uagaauugacauugaaauc

SEQ ID NO: 2929102 - RNA, 21 nt, Human
uagaauugacauugaaaucua

SEQ ID NO: 2929103 - RNA, 21 nt, Human
uacuucaaauccuugaagauu

SEQ ID NO: 2929104 - RNA, 15 nt, Human
uagaacucccuuuca

SEQ ID NO: 2929105 - RNA, 15 nt, Human
uagaagucacacagu

SEQ ID NO: 2929106 - RNA, 18 nt, Human
uagaacucccuuucaaca

SEQ ID NO: 2929107 - RNA, 14 nt, Human
acaaauguuuugcu

SEQ ID NO: 2929108 - RNA, 23 nt, Human
acaaauguuuugcucaauagauu

SEQ ID NO: 2929109 - RNA, 13 nt, Human
acaaauguuuugc

SEQ ID NO: 2929110 - RNA, 19 nt, Human
uagcauuuguguugaagag

SEQ ID NO: 2929111 - RNA, 12 nt, Human
acaacacucaca

SEQ ID NO: 2929112 - RNA, 15 nt, Human
acaacaacaaaauga

SEQ ID NO: 2929113 - RNA, 22 nt, Human
acaagaaaugaaagcagggacu

SEQ ID NO: 2929114 - RNA, 18 nt, Human
acaagcgugagccacugc

SEQ ID NO: 2929115 - RNA, 13 nt, Human
acaagcugcaccc

SEQ ID NO: 2929116 - RNA, 20 nt, Human
acaagcgugagccacugcac

SEQ ID NO: 2929117 - RNA, 21 nt, Human
acaagcgugagccacugcacc

SEQ ID NO: 2929118 - RNA, 12 nt, Human
acaagccacccc

SEQ ID NO: 2929119 - RNA, 17 nt, Human
acaagagcccaggccuc

SEQ ID NO: 2929120 - RNA, 18 nt, Human
acaagcacuaaacaaaga

SEQ ID NO: 2929121 - RNA, 16 nt, Human
uagaugcaguucugaa

SEQ ID NO: 2929122 - RNA, 17 nt, Human
uagaugcaguucugaag

SEQ ID NO: 2929123 - RNA, 19 nt, Human
uagaugcaguucugaagaa

SEQ ID NO: 2929124 - RNA, 22 nt, Human
uagauuuuagacccuauugcug

SEQ ID NO: 2929125 - RNA, 19 nt, Human
uagcacagacccugcccug

SEQ ID NO: 2929126 - RNA, 18 nt, Human
uagcacagacccugcccu

SEQ ID NO: 2929127 - RNA, 17 nt, Human
uagcacagacccugccc

SEQ ID NO: 2929128 - RNA, 16 nt, Human
uagcacagacccugcc

SEQ ID NO: 2929129 - RNA, 24 nt, Human
uagcacagacccugcccugugggc

SEQ ID NO: 2929130 - RNA, 18 nt, Human
uagcaugucgucaaagcu

SEQ ID NO: 2929131 - RNA, 21 nt, Human
uagcaugucgucaaagcugaa

SEQ ID NO: 2929132 - RNA, 13 nt, Human
uauuuauuuaaau

SEQ ID NO: 2929133 - RNA, 16 nt, Human
uauuuauuuacaaaug

SEQ ID NO: 2929134 - RNA, 15 nt, Human
uauuuauuuacaaau

SEQ ID NO: 2929135 - RNA, 14 nt, Human
uauuuauuuaaauu

SEQ ID NO: 2929136 - RNA, 14 nt, Human
uauuuauuuauuua

SEQ ID NO: 2929137 - RNA, 13 nt, Human
uauuuauuuguga

SEQ ID NO: 2929138 - RNA, 18 nt, Human
uauuuauuuuaauaaugu

SEQ ID NO: 2929139 - RNA, 14 nt, Human
uauuuauuuuaaua

SEQ ID NO: 2929140 - RNA, 16 nt, Human
uauuuauuuuaauaau

SEQ ID NO: 2929141 - RNA, 23 nt, Human
uauuuaauuuuuuugagacagag

SEQ ID NO: 2929142 - RNA, 14 nt, Human
uauuuacaaauguu

SEQ ID NO: 2929143 - RNA, 21 nt, Human
uauuuacaaauguuuugcuca

SEQ ID NO: 2929144 - RNA, 13 nt, Human
uauuuaauuugaa

SEQ ID NO: 2929145 - RNA, 23 nt, Human
uauuuaauuugaagguagaaugu

SEQ ID NO: 2929146 - RNA, 16 nt, Human
uauuuaauuugaaggu

SEQ ID NO: 2929147 - RNA, 18 nt, Human
uauuuacuucuuauacau

SEQ ID NO: 2929148 - RNA, 17 nt, Human
uauuguagcauccugga

SEQ ID NO: 2929149 - RNA, 18 nt, Human
uauuguagcauccuggaa

SEQ ID NO: 2929150 - RNA, 20 nt, Human
uauuguagcauccuggaaua

SEQ ID NO: 2929151 - RNA, 21 nt, Human
uauuguagcauccuggaauau

SEQ ID NO: 2929152 - RNA, 17 nt, Human
uauugucaaagugguga

SEQ ID NO: 2929153 - RNA, 13 nt, Human
uauugucaaagug

SEQ ID NO: 2929154 - RNA, 15 nt, Human
uauuuaaugaaagac

SEQ ID NO: 2929155 - RNA, 21 nt, Human
uauuuaaugaaagacuguaca

SEQ ID NO: 2929156 - RNA, 14 nt, Human
uauuuaauagguuu

SEQ ID NO: 2929157 - RNA, 13 nt, Human
uauuuaaucuuuu

SEQ ID NO: 2929158 - RNA, 15 nt, Human
uauuuaaucuuuuau

SEQ ID NO: 2929159 - RNA, 17 nt, Human
uauuuaaccucuaaauu

SEQ ID NO: 2929160 - RNA, 18 nt, Human
uauuuaaccucuaaauuc

SEQ ID NO: 2929161 - RNA, 17 nt, Human
uauugucuagugaaacu

SEQ ID NO: 2929162 - RNA, 16 nt, Human
uauugaaaugauuuca

SEQ ID NO: 2929163 - RNA, 14 nt, Human
uauugaagcagagu

SEQ ID NO: 2929164 - RNA, 16 nt, Human
uauugaagcagagugg

SEQ ID NO: 2929165 - RNA, 20 nt, Human
uauugaagcagaguggcagu

SEQ ID NO: 2929166 - RNA, 15 nt, Human
uauucugagaugacu

SEQ ID NO: 2929167 - RNA, 15 nt, Human
uauucuuauuuaaug

SEQ ID NO: 2929168 - RNA, 16 nt, Human
uauucuguuggccagu

SEQ ID NO: 2929169 - RNA, 17 nt, Human
acaguucucuccuucuu

SEQ ID NO: 2929170 - RNA, 18 nt, Human
uauucucuccuguaccuc

SEQ ID NO: 2929171 - RNA, 20 nt, Human
uauucucuccuguaccucuu

SEQ ID NO: 2929172 - RNA, 24 nt, Human
uauucucuccuguaccucuugagc

SEQ ID NO: 2929173 - RNA, 13 nt, Human
acaguuacucaga

SEQ ID NO: 2929174 - RNA, 20 nt, Human
acaguuacucagaauucucu

SEQ ID NO: 2929175 - RNA, 20 nt, Human
acaguucaauucucauuugu

SEQ ID NO: 2929176 - RNA, 23 nt, Human
acaguucggugagcuacaaaugc

SEQ ID NO: 2929177 - RNA, 16 nt, Human
acaguucucuccuucu

SEQ ID NO: 2929178 - RNA, 22 nt, Human
acaguucggugagcuacaaaug

SEQ ID NO: 2929179 - RNA, 19 nt, Human
acaguucggugagcuacaa

SEQ ID NO: 2929180 - RNA, 12 nt, Human
uauuagagaaga

SEQ ID NO: 2929181 - RNA, 16 nt, Human
uauuaccacagacaua

SEQ ID NO: 2929182 - RNA, 15 nt, Human
uauuagaauaccaca

SEQ ID NO: 2929183 - RNA, 16 nt, Human
uauucaggaagcucag

SEQ ID NO: 2929184 - RNA, 22 nt, Human
uauucaggaagcucagggccug

SEQ ID NO: 2929185 - RNA, 18 nt, Human
uauucaggaagcucaggg

SEQ ID NO: 2929186 - RNA, 23 nt, Human
uauucauagcagcuuauucacaa

SEQ ID NO: 2929187 - RNA, 23 nt, Human
uauuacaguggggaaugaagaua

SEQ ID NO: 2929188 - RNA, 23 nt, Human
uauuaaaaaucucaaauuucuaa

SEQ ID NO: 2929189 - RNA, 12 nt, Human
uauuaaaacuca

SEQ ID NO: 2929190 - RNA, 17 nt, Human
uauuaaacaugcuguac

SEQ ID NO: 2929191 - RNA, 15 nt, Human
uauuaaacaugcugu

SEQ ID NO: 2929192 - RNA, 19 nt, Human
uauuaaacaugcuguacau

SEQ ID NO: 2929193 - RNA, 15 nt, Human
uauguuuuauauagc

SEQ ID NO: 2929194 - RNA, 17 nt, Human
uauguuuuaagaggcag

SEQ ID NO: 2929195 - RNA, 19 nt, Human
uauguuuuaagaggcaggg

SEQ ID NO: 2929196 - RNA, 16 nt, Human
uauuaaaaaucucaaa

SEQ ID NO: 2929197 - RNA, 18 nt, Human
uauuaaaaaucucaaauu

SEQ ID NO: 2929198 - RNA, 20 nt, Human
uauuaaaaaucucaaauuuc

SEQ ID NO: 2929199 - RNA, 22 nt, Human
uauuaaaaaucucaaauuucua

SEQ ID NO: 2929200 - RNA, 17 nt, Human
acagucucaggaaauca

SEQ ID NO: 2929201 - RNA, 20 nt, Human
acagugaaagaaaauaacaa

SEQ ID NO: 2929202 - RNA, 22 nt, Human
acaguccuuaccagcagagcac

SEQ ID NO: 2929203 - RNA, 21 nt, Human
acaguccuuaccagcagagca

SEQ ID NO: 2929204 - RNA, 16 nt, Human
acagucucaggaaauc

SEQ ID NO: 2929205 - RNA, 15 nt, Human
acagucucaggaaau

SEQ ID NO: 2929206 - RNA, 14 nt, Human
acagucucaggaaa

SEQ ID NO: 2929207 - RNA, 13 nt, Human
acagucucaggaa

SEQ ID NO: 2929208 - RNA, 22 nt, Human
acaguguguggucaacauuucu

SEQ ID NO: 2929209 - RNA, 12 nt, Human
acagugagagac

SEQ ID NO: 2929210 - RNA, 23 nt, Human
acagugagagacuccauaguuug

SEQ ID NO: 2929211 - RNA, 14 nt, Human
acagugagacucug

SEQ ID NO: 2929212 - RNA, 18 nt, Human
acagugagacucugucuc

SEQ ID NO: 2929213 - RNA, 21 nt, Human
acaguuaccucugccucagaa

SEQ ID NO: 2929214 - RNA, 15 nt, Human
acaguuaagagaaau

SEQ ID NO: 2929215 - RNA, 13 nt, Human
acagucccugcca

SEQ ID NO: 2929216 - RNA, 12 nt, Human
acagucccugcc

SEQ ID NO: 2929217 - RNA, 15 nt, Human
acaguauuacuucug

SEQ ID NO: 2929218 - RNA, 16 nt, Human
acaguauuacuucugc

SEQ ID NO: 2929219 - RNA, 17 nt, Human
acaguauuacuucugcu

SEQ ID NO: 2929220 - RNA, 19 nt, Human
acaguauuacuucugcuac

SEQ ID NO: 2929221 - RNA, 17 nt, Human
acaguccucccaucuca

SEQ ID NO: 2929222 - RNA, 20 nt, Human
acaguccuuaccagcagagc

SEQ ID NO: 2929223 - RNA, 18 nt, Human
acaguccuuaccagcaga

SEQ ID NO: 2929224 - RNA, 15 nt, Human
acaguccucccaucu

SEQ ID NO: 2929225 - RNA, 14 nt, Human
acaguccucccauc

SEQ ID NO: 2929226 - RNA, 13 nt, Human
acaguccucccau

SEQ ID NO: 2929227 - RNA, 15 nt, Human
acagucccugccaau

SEQ ID NO: 2929228 - RNA, 22 nt, Human
acagggcacaccgggcacucag

SEQ ID NO: 2929229 - RNA, 22 nt, Human
acagguuuuccugaagaauuga

SEQ ID NO: 2929230 - RNA, 21 nt, Human
acaggcugggcuucaguggca

SEQ ID NO: 2929231 - RNA, 14 nt, Human
acaggcugggcuuc

SEQ ID NO: 2929232 - RNA, 17 nt, Human
acaggcugggcuucagu

SEQ ID NO: 2929233 - RNA, 21 nt, Human
acaguaacauagcugugauuu

SEQ ID NO: 2929234 - RNA, 21 nt, Human
acaguauggcagcuuuccuca

SEQ ID NO: 2929235 - RNA, 20 nt, Human
uaucacuuccaugacauaag

SEQ ID NO: 2929236 - RNA, 18 nt, Human
uaucacccagaagaaaau

SEQ ID NO: 2929237 - RNA, 15 nt, Human
uauauuuacaaaugg

SEQ ID NO: 2929238 - RNA, 21 nt, Human
uaucaaguauuauaccuuuuu

SEQ ID NO: 2929239 - RNA, 18 nt, Human
uaucaaguauuauaccuu

SEQ ID NO: 2929240 - RNA, 14 nt, Human
uauauuuacaaaug

SEQ ID NO: 2929241 - RNA, 16 nt, Human
acagacccugcccugu

SEQ ID NO: 2929242 - RNA, 17 nt, Human
acagacccugcccugug

SEQ ID NO: 2929243 - RNA, 23 nt, Human
acagacacaggcccggcuccagg

SEQ ID NO: 2929244 - RNA, 11 nt, Human
acacuccuuca

SEQ ID NO: 2929245 - RNA, 19 nt, Human
uauauucucagcagagugc

SEQ ID NO: 2929246 - RNA, 17 nt, Human
uauauucucagcagagu

SEQ ID NO: 2929247 - RNA, 14 nt, Human
acagacuggaagca

SEQ ID NO: 2929248 - RNA, 20 nt, Human
acagacccugcccugugggc

SEQ ID NO: 2929249 - RNA, 18 nt, Human
acagacccugcccugugg

SEQ ID NO: 2929250 - RNA, 15 nt, Human
uaucuagauacugua

SEQ ID NO: 2929251 - RNA, 16 nt, Human
uaucuagauacuguau

SEQ ID NO: 2929252 - RNA, 14 nt, Human
uaucagaacuaugu

SEQ ID NO: 2929253 - RNA, 20 nt, Human
uaucagaacuauguuuuugu

SEQ ID NO: 2929254 - RNA, 17 nt, Human
uaucucccccagcccca

SEQ ID NO: 2929255 - RNA, 18 nt, Human
uaucucccccagccccau

SEQ ID NO: 2929256 - RNA, 16 nt, Human
uaucucccccagcccc

SEQ ID NO: 2929257 - RNA, 19 nt, Human
uaucuagauacuguaucau

SEQ ID NO: 2929258 - RNA, 22 nt, Human
acagagaccugcccucaagagc

SEQ ID NO: 2929259 - RNA, 22 nt, Human
acagacuggaagcacagcuuca

SEQ ID NO: 2929260 - RNA, 21 nt, Human
acagaguggaauaagacagag

SEQ ID NO: 2929261 - RNA, 22 nt, Human
acagaguggaauaagacagaga

SEQ ID NO: 2929262 - RNA, 23 nt, Human
acagaguggaauaagacagagac

SEQ ID NO: 2929263 - RNA, 18 nt, Human
acagagcuacacagggga

SEQ ID NO: 2929264 - RNA, 21 nt, Human
acagagugagacucugucuca

SEQ ID NO: 2929265 - RNA, 20 nt, Human
acagagcccacgcccccacu

SEQ ID NO: 2929266 - RNA, 16 nt, Human
acagagcuacacaggg

SEQ ID NO: 2929267 - RNA, 13 nt, Human
uaugggagcuguc

SEQ ID NO: 2929268 - RNA, 10 nt, Human
uaugggagag

SEQ ID NO: 2929269 - RNA, 16 nt, Human
uauggcuuuugugcau

SEQ ID NO: 2929270 - RNA, 17 nt, Human
uauggcuauaggugcua

SEQ ID NO: 2929271 - RNA, 15 nt, Human
acagcuccaagaauu

SEQ ID NO: 2929272 - RNA, 17 nt, Human
acagcuaacauggaagu

SEQ ID NO: 2929273 - RNA, 15 nt, Human
acagcuaacauggaa

SEQ ID NO: 2929274 - RNA, 14 nt, Human
acagcuaacaugga

SEQ ID NO: 2929275 - RNA, 18 nt, Human
uaugcucugcauguuaca

SEQ ID NO: 2929276 - RNA, 14 nt, Human
uaugcucugcaugu

SEQ ID NO: 2929277 - RNA, 14 nt, Human
uaugaugacuguuu

SEQ ID NO: 2929278 - RNA, 15 nt, Human
uaugaugacuguuuu

SEQ ID NO: 2929279 - RNA, 19 nt, Human
uaugcucugcauguuacau

SEQ ID NO: 2929280 - RNA, 22 nt, Human
uauggcccuggccuagcauacg

SEQ ID NO: 2929281 - RNA, 16 nt, Human
uauggcuauaggugcu

SEQ ID NO: 2929282 - RNA, 14 nt, Human
uaucuugaagacuu

SEQ ID NO: 2929283 - RNA, 20 nt, Human
acagaguuuucacucuuauu

SEQ ID NO: 2929284 - RNA, 18 nt, Human
acagaguuuucacucuua

SEQ ID NO: 2929285 - RNA, 14 nt, Human
acagcaggcugcca

SEQ ID NO: 2929286 - RNA, 23 nt, Human
uaugaggcauuuguuugaacuga

SEQ ID NO: 2929287 - RNA, 13 nt, Human
uaugaggcauuug

SEQ ID NO: 2929288 - RNA, 15 nt, Human
uaucuugaagacuuu

SEQ ID NO: 2929289 - RNA, 14 nt, Human
uaugaucacggcuc

SEQ ID NO: 2929290 - RNA, 21 nt, Human
uaugaucacggcucacugcag

SEQ ID NO: 2929291 - RNA, 23 nt, Human
uaugaucacggcucacugcagcc

SEQ ID NO: 2929292 - RNA, 18 nt, Human
uauaacaaugcuguauuu

SEQ ID NO: 2929293 - RNA, 20 nt, Human
uauaaccaguguuguggauu

SEQ ID NO: 2929294 - RNA, 21 nt, Human
uauaauuuaccugaagucuuu

SEQ ID NO: 2929295 - RNA, 15 nt, Human
uauaauuuccauuua

SEQ ID NO: 2929296 - RNA, 20 nt, Human
uauaauuuccauuuacuuaa

SEQ ID NO: 2929297 - RNA, 21 nt, Human
uauaauuuccauuuacuuaag

SEQ ID NO: 2929298 - RNA, 22 nt, Human
uauaauuuccauuuacuuaaga

SEQ ID NO: 2929299 - RNA, 14 nt, Human
uauaauuuugugaa

SEQ ID NO: 2929300 - RNA, 13 nt, Human
uauacauaaacaa

SEQ ID NO: 2929301 - RNA, 14 nt, Human
uauacauaaacaag

SEQ ID NO: 2929302 - RNA, 14 nt, Human
uauacauuugauaa

SEQ ID NO: 2929303 - RNA, 23 nt, Human
uauauauuuuuuucugaaauuuc

SEQ ID NO: 2929304 - RNA, 20 nt, Human
uauauauuuuuuucugaaau

SEQ ID NO: 2929305 - RNA, 21 nt, Human
uauauauuuuuuucugaaauu

SEQ ID NO: 2929306 - RNA, 22 nt, Human
uauauauuuuuuucugaaauuu

SEQ ID NO: 2929307 - RNA, 19 nt, Human
acacucauugaccugaggc

SEQ ID NO: 2929308 - RNA, 23 nt, Human
acacucauugaccugaggcccuu

SEQ ID NO: 2929309 - RNA, 21 nt, Human
acacucauugaccugaggccc

SEQ ID NO: 2929310 - RNA, 23 nt, Human
uauaggugcuacaaaaacacagc

SEQ ID NO: 2929311 - RNA, 20 nt, Human
uauaggugcuacaaaaacac

SEQ ID NO: 2929312 - RNA, 21 nt, Human
uauaggugcuacaaaaacaca

SEQ ID NO: 2929313 - RNA, 22 nt, Human
uauagcuaggugacauauacau

SEQ ID NO: 2929314 - RNA, 19 nt, Human
uauagcuaggugacauaua

SEQ ID NO: 2929315 - RNA, 13 nt, Human
uauagcaagacau

SEQ ID NO: 2929316 - RNA, 20 nt, Human
uauagccuaggugacagagu

SEQ ID NO: 2929317 - RNA, 14 nt, Human
uauaggaauugacc

SEQ ID NO: 2929318 - RNA, 13 nt, Human
uauaggaauugac

SEQ ID NO: 2929319 - RNA, 12 nt, Human
uauaggaauuga

SEQ ID NO: 2929320 - RNA, 20 nt, Human
uaguuccucauuagcauuuu

SEQ ID NO: 2929321 - RNA, 15 nt, Human
uaguuuuauaugcuu

SEQ ID NO: 2929322 - RNA, 16 nt, Human
uaguuuuauaugcuuc

SEQ ID NO: 2929323 - RNA, 21 nt, Human
uagucaggugccucaagagaa

SEQ ID NO: 2929324 - RNA, 23 nt, Human
acaagcugcacccucaggcaggu

SEQ ID NO: 2929325 - RNA, 22 nt, Human
acaagcugcacccucaggcagg

SEQ ID NO: 2929326 - RNA, 21 nt, Human
acaagcugcacccucaggcag

SEQ ID NO: 2929327 - RNA, 19 nt, Human
acaagcugcacccucaggc

SEQ ID NO: 2929328 - RNA, 15 nt, Human
uagucauucuucccu

SEQ ID NO: 2929329 - RNA, 14 nt, Human
uagucauucuuccc

SEQ ID NO: 2929330 - RNA, 22 nt, Human
uagugagcagucaggaaagaga

SEQ ID NO: 2929331 - RNA, 18 nt, Human
acacaugcaaggucauuu

SEQ ID NO: 2929332 - RNA, 19 nt, Human
acacaugcaaggucauuuu

SEQ ID NO: 2929333 - RNA, 20 nt, Human
acacaugcaaggucauuuuu

SEQ ID NO: 2929334 - RNA, 22 nt, Human
acacaucagcuugcccuguuaa

SEQ ID NO: 2929335 - RNA, 21 nt, Human
uauaaaauaauuuuuauauuu

SEQ ID NO: 2929336 - RNA, 22 nt, Human
uauaaaauaauuuuuauauuug

SEQ ID NO: 2929337 - RNA, 19 nt, Human
acaccauaagcuacugcca

SEQ ID NO: 2929338 - RNA, 20 nt, Human
acaccauaagcuacugccau

SEQ ID NO: 2929339 - RNA, 11 nt, Human
acacccuguga

SEQ ID NO: 2929340 - RNA, 18 nt, Human
acacccugugauggggcc

SEQ ID NO: 2929341 - RNA, 12 nt, Human
acacccugugau

SEQ ID NO: 2929342 - RNA, 19 nt, Human
acacccagcccacuucugc

SEQ ID NO: 2929343 - RNA, 20 nt, Human
acacccagcccacuucugcc

SEQ ID NO: 2929344 - RNA, 21 nt, Human
acacccagcccacuucugcca

SEQ ID NO: 2929345 - RNA, 21 nt, Human
acacaugcaaggucauuuuuu

SEQ ID NO: 2929346 - RNA, 19 nt, Human
acucuccucugcugcuggc

SEQ ID NO: 2929347 - RNA, 18 nt, Human
acucuccucugcugcugg

SEQ ID NO: 2929348 - RNA, 16 nt, Human
acucugccacuuuauu

SEQ ID NO: 2929349 - RNA, 23 nt, Human
acucuuauaucuauauuuuacau

SEQ ID NO: 2929350 - RNA, 22 nt, Human
acucuuauaucuauauuuuaca

SEQ ID NO: 2929351 - RNA, 17 nt, Human
acucgcgacaaugcaaa

SEQ ID NO: 2929352 - RNA, 23 nt, Human
acucgcgacaaugcaaaccauca

SEQ ID NO: 2929353 - RNA, 20 nt, Human
acucgcgacaaugcaaacca

SEQ ID NO: 2929354 - RNA, 19 nt, Human
uccuaggcauuugcugaau

SEQ ID NO: 2929355 - RNA, 18 nt, Human
acucgcgacaaugcaaac

SEQ ID NO: 2929356 - RNA, 21 nt, Human
acucgggaggcugaggcagga

SEQ ID NO: 2929357 - RNA, 17 nt, Human
acucuccucugcugcug

SEQ ID NO: 2929358 - RNA, 22 nt, Human
uccucauacccacccccaccca

SEQ ID NO: 2929359 - RNA, 18 nt, Human
uccucauacccaccccca

SEQ ID NO: 2929360 - RNA, 14 nt, Human
uccucauacccacc

SEQ ID NO: 2929361 - RNA, 12 nt, Human
uccucuccccag

SEQ ID NO: 2929362 - RNA, 19 nt, Human
uccucccucccucuuuccc

SEQ ID NO: 2929363 - RNA, 17 nt, Human
uccucccucccucuuuc

SEQ ID NO: 2929364 - RNA, 15 nt, Human
uccucccucccucuu

SEQ ID NO: 2929365 - RNA, 20 nt, Human
uccucagaucuucugugggu

SEQ ID NO: 2929366 - RNA, 16 nt, Human
acucuuauugcccacg

SEQ ID NO: 2929367 - RNA, 19 nt, Human
acucuuauugcccacgcug

SEQ ID NO: 2929368 - RNA, 20 nt, Human
uccucaaaacuucagacaua

SEQ ID NO: 2929369 - RNA, 21 nt, Human
ucccucagucuggcccuuccu

SEQ ID NO: 2929370 - RNA, 22 nt, Human
ucccucauccucauacccaccc

SEQ ID NO: 2929371 - RNA, 17 nt, Human
acuccaggcagcagaca

SEQ ID NO: 2929372 - RNA, 20 nt, Human
acuccaggcagcagacacau

SEQ ID NO: 2929373 - RNA, 22 nt, Human
acuccaggcagcagacacaugc

SEQ ID NO: 2929374 - RNA, 15 nt, Human
ucccuuucccuuggu

SEQ ID NO: 2929375 - RNA, 22 nt, Human
ucccuuuccaaaugcccagcuu

SEQ ID NO: 2929376 - RNA, 22 nt, Human
ucccuuacgugaguccuggcau

SEQ ID NO: 2929377 - RNA, 18 nt, Human
ucccuuacgugaguccug

SEQ ID NO: 2929378 - RNA, 23 nt, Human
ucccugguggcagcucaccucuc

SEQ ID NO: 2929379 - RNA, 17 nt, Human
uccuaaaauuauggaaa

SEQ ID NO: 2929380 - RNA, 22 nt, Human
uccuaaaauuauggaaacagau

SEQ ID NO: 2929381 - RNA, 16 nt, Human
uccuaaaacaacagau

SEQ ID NO: 2929382 - RNA, 20 nt, Human
uccuaaaacaacagauguac

SEQ ID NO: 2929383 - RNA, 13 nt, Human
uccuaaaacaaca

SEQ ID NO: 2929384 - RNA, 12 nt, Human
uccuaaaacaac

SEQ ID NO: 2929385 - RNA, 14 nt, Human
uccuaggcauuugc

SEQ ID NO: 2929386 - RNA, 21 nt, Human
ucccuuugacgccaucccagc

SEQ ID NO: 2929387 - RNA, 23 nt, Human
ucccuuugacgccaucccagccc

SEQ ID NO: 2929388 - RNA, 22 nt, Human
ucccuuugacgccaucccagcc

SEQ ID NO: 2929389 - RNA, 17 nt, Human
acuauagccuaggugac

SEQ ID NO: 2929390 - RNA, 21 nt, Human
acuauaauguaagcucuacug

SEQ ID NO: 2929391 - RNA, 23 nt, Human
acuauaauuuaccugaagucuuu

SEQ ID NO: 2929392 - RNA, 24 nt, Human
uccccaccgcagacaggaccaggg

SEQ ID NO: 2929393 - RNA, 23 nt, Human
uccccaggaggccagccuugacc

SEQ ID NO: 2929394 - RNA, 20 nt, Human
acuaucugugcguagaaguu

SEQ ID NO: 2929395 - RNA, 22 nt, Human
acuaucugugcguagaaguucu

SEQ ID NO: 2929396 - RNA, 17 nt, Human
acuauguugcccaggca

SEQ ID NO: 2929397 - RNA, 18 nt, Human
acuauguugcccaggcag

SEQ ID NO: 2929398 - RNA, 21 nt, Human
acuauuaaacaugcuguacau

SEQ ID NO: 2929399 - RNA, 19 nt, Human
acuauguugcccaggcagg

SEQ ID NO: 2929400 - RNA, 20 nt, Human
acuauguugcccaggcaggu

SEQ ID NO: 2929401 - RNA, 20 nt, Human
acuauguuuuuguucaguuu

SEQ ID NO: 2929402 - RNA, 23 nt, Human
acuauguugcccaggcaggucuu

SEQ ID NO: 2929403 - RNA, 18 nt, Human
ucccuauuagagaagaga

SEQ ID NO: 2929404 - RNA, 20 nt, Human
ucccgaguagcugggacuac

SEQ ID NO: 2929405 - RNA, 18 nt, Human
ucccgaauagcugggacu

SEQ ID NO: 2929406 - RNA, 15 nt, Human
ucccgaauagcuggg

SEQ ID NO: 2929407 - RNA, 16 nt, Human
ucccgaauagcuggga

SEQ ID NO: 2929408 - RNA, 12 nt, Human
uccccuccucug

SEQ ID NO: 2929409 - RNA, 15 nt, Human
ucccauaugccuggg

SEQ ID NO: 2929410 - RNA, 13 nt, Human
ucccaucucacac

SEQ ID NO: 2929411 - RNA, 19 nt, Human
ucccaucucacacaugagc

SEQ ID NO: 2929412 - RNA, 14 nt, Human
ucccaucucacaca

SEQ ID NO: 2929413 - RNA, 18 nt, Human
acuacauuagguugugaa

SEQ ID NO: 2929414 - RNA, 19 nt, Human
acuacauuagguugugaau

SEQ ID NO: 2929415 - RNA, 20 nt, Human
acuacauuagguugugaaug

SEQ ID NO: 2929416 - RNA, 16 nt, Human
acuacaguccucccau

SEQ ID NO: 2929417 - RNA, 22 nt, Human
ucccagugccgagaaggaagcc

SEQ ID NO: 2929418 - RNA, 19 nt, Human
ucccagugccgagaaggaa

SEQ ID NO: 2929419 - RNA, 15 nt, Human
acuacaguccuccca

SEQ ID NO: 2929420 - RNA, 23 nt, Human
acuacaggugugagucaccaagc

SEQ ID NO: 2929421 - RNA, 17 nt, Human
acuaaccagcagaaaug

SEQ ID NO: 2929422 - RNA, 13 nt, Human
acuaaccacgcug

SEQ ID NO: 2929423 - RNA, 16 nt, Human
acuaaccagcagaaau

SEQ ID NO: 2929424 - RNA, 14 nt, Human
acuaaaauguucua

SEQ ID NO: 2929425 - RNA, 13 nt, Human
uccagccugggug

SEQ ID NO: 2929426 - RNA, 24 nt, Human
uccagccugggugacagagcaagu

SEQ ID NO: 2929427 - RNA, 14 nt, Human
uccagcucaccagc

SEQ ID NO: 2929428 - RNA, 12 nt, Human
acguuucuaaag

SEQ ID NO: 2929429 - RNA, 14 nt, Human
acguuucuaaaggc

SEQ ID NO: 2929430 - RNA, 15 nt, Human
acuaaaaaugcaaaa

SEQ ID NO: 2929431 - RNA, 13 nt, Human
acuaaaaauacaa

SEQ ID NO: 2929432 - RNA, 12 nt, Human
uccuucagugcc

SEQ ID NO: 2929433 - RNA, 13 nt, Human
uccuucagccuga

SEQ ID NO: 2929434 - RNA, 11 nt, Human
uccuucagugc

SEQ ID NO: 2929435 - RNA, 22 nt, Human
uccuucagugccuuauggaaca

SEQ ID NO: 2929436 - RNA, 20 nt, Human
uccuucagugccuuauggaa

SEQ ID NO: 2929437 - RNA, 13 nt, Human
uccuucagugccu

SEQ ID NO: 2929438 - RNA, 15 nt, Human
acuggcaaagcagaa

SEQ ID NO: 2929439 - RNA, 13 nt, Human
acuggcaaagcag

SEQ ID NO: 2929440 - RNA, 22 nt, Human
acuggcacaguuuucugagaaa

SEQ ID NO: 2929441 - RNA, 21 nt, Human
acuggcacaguuuucugagaa

SEQ ID NO: 2929442 - RNA, 21 nt, Human
acuggcgugaacccaggaggc

SEQ ID NO: 2929443 - RNA, 15 nt, Human
acuggcucacccagu

SEQ ID NO: 2929444 - RNA, 12 nt, Human
acuggcucaccc

SEQ ID NO: 2929445 - RNA, 18 nt, Human
acuggcucacccaguccu

SEQ ID NO: 2929446 - RNA, 22 nt, Human
acuggcugcaaaggguaucagg

SEQ ID NO: 2929447 - RNA, 20 nt, Human
acugccuucucaacuccaaa

SEQ ID NO: 2929448 - RNA, 22 nt, Human
acugccuucucaacuccaaacu

SEQ ID NO: 2929449 - RNA, 23 nt, Human
acugcuuccagugaggcucugcc

SEQ ID NO: 2929450 - RNA, 22 nt, Human
acugcuuccagugaggcucugc

SEQ ID NO: 2929451 - RNA, 21 nt, Human
acugcuuccagugaggcucug

SEQ ID NO: 2929452 - RNA, 18 nt, Human
acugcuuccagugaggcu

SEQ ID NO: 2929453 - RNA, 22 nt, Human
acuggauuaaacuuaaucuaaa

SEQ ID NO: 2929454 - RNA, 21 nt, Human
acuggcaaacagggccucugc

SEQ ID NO: 2929455 - RNA, 17 nt, Human
acuggcaaacagggccu

SEQ ID NO: 2929456 - RNA, 19 nt, Human
acuggcaaacagggccucu

SEQ ID NO: 2929457 - RNA, 20 nt, Human
acuggcaaacagggccucug

SEQ ID NO: 2929458 - RNA, 14 nt, Human
ucgaggacagggag

SEQ ID NO: 2929459 - RNA, 17 nt, Human
ucgaggacagggaggug

SEQ ID NO: 2929460 - RNA, 14 nt, Human
ucgcgacaaugcaa

SEQ ID NO: 2929461 - RNA, 13 nt, Human
ucgcgacaaugca

SEQ ID NO: 2929462 - RNA, 13 nt, Human
ucgaggacaggga

SEQ ID NO: 2929463 - RNA, 14 nt, Human
ucgagcaugccugg

SEQ ID NO: 2929464 - RNA, 15 nt, Human
uccuuucaccacaug

SEQ ID NO: 2929465 - RNA, 15 nt, Human
ucgaacuggcugcaa

SEQ ID NO: 2929466 - RNA, 14 nt, Human
ucgaacuggcugca

SEQ ID NO: 2929467 - RNA, 13 nt, Human
ucgaacuggcugc

SEQ ID NO: 2929468 - RNA, 20 nt, Human
acuggguacuuguggacaca

SEQ ID NO: 2929469 - RNA, 23 nt, Human
acuggguacuuguggacacagcu

SEQ ID NO: 2929470 - RNA, 19 nt, Human
acuggguacuuguggacac

SEQ ID NO: 2929471 - RNA, 12 nt, Human
ucgcuccugugu

SEQ ID NO: 2929472 - RNA, 13 nt, Human
ucgcuccuguguc

SEQ ID NO: 2929473 - RNA, 22 nt, Human
acugggcuuggggaccagagcu

SEQ ID NO: 2929474 - RNA, 23 nt, Human
acuguacaugaaaacacauuuuu

SEQ ID NO: 2929475 - RNA, 13 nt, Human
acuguacaugaaa

SEQ ID NO: 2929476 - RNA, 14 nt, Human
acuguacaugaaaa

SEQ ID NO: 2929477 - RNA, 19 nt, Human
acuguaauuugugauacaa

SEQ ID NO: 2929478 - RNA, 13 nt, Human
acuguacaaagua

SEQ ID NO: 2929479 - RNA, 14 nt, Human
acuguacaaaguag

SEQ ID NO: 2929480 - RNA, 15 nt, Human
acuguacaaaguaga

SEQ ID NO: 2929481 - RNA, 18 nt, Human
uccugugugugcgccuac

SEQ ID NO: 2929482 - RNA, 13 nt, Human
uccugugugugcg

SEQ ID NO: 2929483 - RNA, 14 nt, Human
uccugugugugcgc

SEQ ID NO: 2929484 - RNA, 23 nt, Human
uccugugucuugcaauggcagcc

SEQ ID NO: 2929485 - RNA, 24 nt, Human
uccugugucuugcaauggcagccu

SEQ ID NO: 2929486 - RNA, 19 nt, Human
uccuguucccaugagauga

SEQ ID NO: 2929487 - RNA, 15 nt, Human
uccuguuuuuauuau

SEQ ID NO: 2929488 - RNA, 21 nt, Human
uccuguuuuuauuauuaacaa

SEQ ID NO: 2929489 - RNA, 16 nt, Human
uccuguuuuuauuauu

SEQ ID NO: 2929490 - RNA, 20 nt, Human
uccuguuuuuauuauuaaca

SEQ ID NO: 2929491 - RNA, 19 nt, Human
acugcagccucaaccuccu

SEQ ID NO: 2929492 - RNA, 21 nt, Human
acugcagccucaaccuccugg

SEQ ID NO: 2929493 - RNA, 22 nt, Human
acugcagccucaaccuccuggg

SEQ ID NO: 2929494 - RNA, 13 nt, Human
acugcacuguuuu

SEQ ID NO: 2929495 - RNA, 23 nt, Human
acugcagccucaaccuccugggc

SEQ ID NO: 2929496 - RNA, 18 nt, Human
uccugggcagcugccucc

SEQ ID NO: 2929497 - RNA, 19 nt, Human
uccugggcagcugccuccc

SEQ ID NO: 2929498 - RNA, 22 nt, Human
uccugggcagcugccuccccuc

SEQ ID NO: 2929499 - RNA, 23 nt, Human
uccugggcagcugccuccccucc

SEQ ID NO: 2929500 - RNA, 14 nt, Human
uccugggcagcugc

SEQ ID NO: 2929501 - RNA, 15 nt, Human
uccugggcagcugcc

SEQ ID NO: 2929502 - RNA, 16 nt, Human
uccugggcagcugccu

SEQ ID NO: 2929503 - RNA, 17 nt, Human
uccugggcagcugccuc

SEQ ID NO: 2929504 - RNA, 13 nt, Human
uccugcugcaguu

SEQ ID NO: 2929505 - RNA, 20 nt, Human
uccugcugagccucacagca

SEQ ID NO: 2929506 - RNA, 20 nt, Human
uccugccucgaacuggcugc

SEQ ID NO: 2929507 - RNA, 22 nt, Human
uccugcaggcagccaggccaca

SEQ ID NO: 2929508 - RNA, 19 nt, Human
uccugccucagccucccaa

SEQ ID NO: 2929509 - RNA, 20 nt, Human
uccugcaggcagccaggcca

SEQ ID NO: 2929510 - RNA, 19 nt, Human
uccugcaggcagccaggcc

SEQ ID NO: 2929511 - RNA, 17 nt, Human
uccugcaggcagccagg

SEQ ID NO: 2929512 - RNA, 16 nt, Human
uccugcaggcagccag

SEQ ID NO: 2929513 - RNA, 15 nt, Human
uccugcaggcagcca

SEQ ID NO: 2929514 - RNA, 19 nt, Human
acugagggggccuggaugc

SEQ ID NO: 2929515 - RNA, 22 nt, Human
acugaguacguugugcauuugg

SEQ ID NO: 2929516 - RNA, 23 nt, Human
acugaguacguugugcauuuggu

SEQ ID NO: 2929517 - RNA, 16 nt, Human
acugagggggccugga

SEQ ID NO: 2929518 - RNA, 17 nt, Human
acugagggggccuggau

SEQ ID NO: 2929519 - RNA, 18 nt, Human
acugagggggccuggaug

SEQ ID NO: 2929520 - RNA, 18 nt, Human
acugaguacguugugcau

SEQ ID NO: 2929521 - RNA, 19 nt, Human
acugaguacguugugcauu

SEQ ID NO: 2929522 - RNA, 21 nt, Human
acugaguacguugugcauuug

SEQ ID NO: 2929523 - RNA, 13 nt, Human
acugcaaccuccg

SEQ ID NO: 2929524 - RNA, 14 nt, Human
acugcaaccuccgc

SEQ ID NO: 2929525 - RNA, 16 nt, Human
acugcaaccuccgccu

SEQ ID NO: 2929526 - RNA, 22 nt, Human
acugcaaccuccgccucuuggg

SEQ ID NO: 2929527 - RNA, 15 nt, Human
uccucuccccagcaa

SEQ ID NO: 2929528 - RNA, 17 nt, Human
acugaggggaggggagc

SEQ ID NO: 2929529 - RNA, 22 nt, Human
acugaggggaggggagcauggg

SEQ ID NO: 2929530 - RNA, 23 nt, Human
accuuuguauucucuccuguacc

SEQ ID NO: 2929531 - RNA, 15 nt, Human
accuuuguauucucu

SEQ ID NO: 2929532 - RNA, 19 nt, Human
accuuuguauucucuccug

SEQ ID NO: 2929533 - RNA, 22 nt, Human
uccagaaguuugagaucagccu

SEQ ID NO: 2929534 - RNA, 14 nt, Human
uccagccccuggau

SEQ ID NO: 2929535 - RNA, 15 nt, Human
uccagccccuggaug

SEQ ID NO: 2929536 - RNA, 21 nt, Human
uccagccccuggaugcagccu

SEQ ID NO: 2929537 - RNA, 19 nt, Human
uccagccccuggaugcagc

SEQ ID NO: 2929538 - RNA, 17 nt, Human
uccagccccuggaugca

SEQ ID NO: 2929539 - RNA, 16 nt, Human
uccagccccuggaugc

SEQ ID NO: 2929540 - RNA, 11 nt, Human
uccagccuggg

SEQ ID NO: 2929541 - RNA, 21 nt, Human
uccagccugagcgacagugag

SEQ ID NO: 2929542 - RNA, 22 nt, Human
uccagccccuggaugcagccuc

SEQ ID NO: 2929543 - RNA, 20 nt, Human
uccagccugagcgacaguga

SEQ ID NO: 2929544 - RNA, 15 nt, Human
accuugacagggcac

SEQ ID NO: 2929545 - RNA, 14 nt, Human
accuugacagggca

SEQ ID NO: 2929546 - RNA, 15 nt, Human
accuugaaugaugcc

SEQ ID NO: 2929547 - RNA, 13 nt, Human
accuucuccuuca

SEQ ID NO: 2929548 - RNA, 12 nt, Human
accuucuccuuc

SEQ ID NO: 2929549 - RNA, 15 nt, Human
uccaccaucaagcca

SEQ ID NO: 2929550 - RNA, 17 nt, Human
accuuagacagucccug

SEQ ID NO: 2929551 - RNA, 18 nt, Human
accugcggugcuaucucc

SEQ ID NO: 2929552 - RNA, 22 nt, Human
accugaagucuuuguacagaca

SEQ ID NO: 2929553 - RNA, 15 nt, Human
accugaagucuuugu

SEQ ID NO: 2929554 - RNA, 23 nt, Human
accugcggugcuaucucccccag

SEQ ID NO: 2929555 - RNA, 22 nt, Human
accugcggugcuaucuccccca

SEQ ID NO: 2929556 - RNA, 19 nt, Human
accugcggugcuaucuccc

SEQ ID NO: 2929557 - RNA, 19 nt, Human
ucauuugagcagggcucag

SEQ ID NO: 2929558 - RNA, 14 nt, Human
accuggaauauaua

SEQ ID NO: 2929559 - RNA, 17 nt, Human
accuggaauauauaacc

SEQ ID NO: 2929560 - RNA, 20 nt, Human
ucauuuuagggguagcauuu

SEQ ID NO: 2929561 - RNA, 21 nt, Human
ucauuugagcagggcucagcg

SEQ ID NO: 2929562 - RNA, 13 nt, Human
ucauuuuuuuuaa

SEQ ID NO: 2929563 - RNA, 21 nt, Human
uccacauuuguuuugccaauu

SEQ ID NO: 2929564 - RNA, 17 nt, Human
uccaauaaaaugccuca

SEQ ID NO: 2929565 - RNA, 11 nt, Human
uccaagcuggu

SEQ ID NO: 2929566 - RNA, 16 nt, Human
uccaagcucccaggca

SEQ ID NO: 2929567 - RNA, 15 nt, Human
uccaagcucccaggc

SEQ ID NO: 2929568 - RNA, 14 nt, Human
uccaagcucccagg

SEQ ID NO: 2929569 - RNA, 13 nt, Human
uccaagcucccag

SEQ ID NO: 2929570 - RNA, 12 nt, Human
uccaagcuccca

SEQ ID NO: 2929571 - RNA, 13 nt, Human
accuagccuuaga

SEQ ID NO: 2929572 - RNA, 14 nt, Human
accuccuaaaacaa

SEQ ID NO: 2929573 - RNA, 18 nt, Human
ucauccacugugccaugu

SEQ ID NO: 2929574 - RNA, 20 nt, Human
accuccgccucuuggguuca

SEQ ID NO: 2929575 - RNA, 10 nt, Human
acccuuuucu

SEQ ID NO: 2929576 - RNA, 20 nt, Human
ucauauuuacuucuuauaca

SEQ ID NO: 2929577 - RNA, 21 nt, Human
ucauauuuacuucuuauacau

SEQ ID NO: 2929578 - RNA, 22 nt, Human
ucauauuuacuucuuauacauu

SEQ ID NO: 2929579 - RNA, 16 nt, Human
ucauauuuacuucuua

SEQ ID NO: 2929580 - RNA, 21 nt, Human
accgaacugauguaaguaaac

SEQ ID NO: 2929581 - RNA, 17 nt, Human
accgcagacaggaccag

SEQ ID NO: 2929582 - RNA, 17 nt, Human
accgccaaggcuggggg

SEQ ID NO: 2929583 - RNA, 20 nt, Human
accgcagacaggaccaggga

SEQ ID NO: 2929584 - RNA, 12 nt, Human
accucugcacaa

SEQ ID NO: 2929585 - RNA, 19 nt, Human
accucucucacuccuugaa

SEQ ID NO: 2929586 - RNA, 14 nt, Human
accucucucacucc

SEQ ID NO: 2929587 - RNA, 23 nt, Human
accucucccuuggauuguccccg

SEQ ID NO: 2929588 - RNA, 21 nt, Human
accucuaaauucuuucauuuu

SEQ ID NO: 2929589 - RNA, 15 nt, Human
accucucccuuggau

SEQ ID NO: 2929590 - RNA, 14 nt, Human
accucucccuugga

SEQ ID NO: 2929591 - RNA, 13 nt, Human
accucucccuugg

SEQ ID NO: 2929592 - RNA, 18 nt, Human
accucuaaauucuuucau

SEQ ID NO: 2929593 - RNA, 17 nt, Human
accucggugccuuccuc

SEQ ID NO: 2929594 - RNA, 19 nt, Human
ucauugaccugaggcccuu

SEQ ID NO: 2929595 - RNA, 21 nt, Human
ucauucuccuuguguuacuaa

SEQ ID NO: 2929596 - RNA, 22 nt, Human
ucauugaccugaggcccuucuc

SEQ ID NO: 2929597 - RNA, 11 nt, Human
ucauguucuua

SEQ ID NO: 2929598 - RNA, 17 nt, Human
ucauguucuuaauucuu

SEQ ID NO: 2929599 - RNA, 13 nt, Human
ucaugucuggcua

SEQ ID NO: 2929600 - RNA, 21 nt, Human
ucaugaauuaguuuuauaugc

SEQ ID NO: 2929601 - RNA, 19 nt, Human
ucaugacaaagacugagua

SEQ ID NO: 2929602 - RNA, 19 nt, Human
ucauccacugugccaugug

SEQ ID NO: 2929603 - RNA, 21 nt, Human
ucauccacugugccaugugcc

SEQ ID NO: 2929604 - RNA, 23 nt, Human
ucauccacugugccaugugccag

SEQ ID NO: 2929605 - RNA, 22 nt, Human
ucaugaauuaguuuuauaugcu

SEQ ID NO: 2929606 - RNA, 15 nt, Human
acccccagccugcua

SEQ ID NO: 2929607 - RNA, 14 nt, Human
acccccagccugcu

SEQ ID NO: 2929608 - RNA, 12 nt, Human
ucagccugggca

SEQ ID NO: 2929609 - RNA, 10 nt, Human
ucagccuggg

SEQ ID NO: 2929610 - RNA, 16 nt, Human
acccaguccugcccgc

SEQ ID NO: 2929611 - RNA, 15 nt, Human
acccagcucuggucc

SEQ ID NO: 2929612 - RNA, 13 nt, Human
acccagcucuggu

SEQ ID NO: 2929613 - RNA, 19 nt, Human
ucagaacuauguuuuuguu

SEQ ID NO: 2929614 - RNA, 16 nt, Human
ucagaacuauguuuuu

SEQ ID NO: 2929615 - RNA, 13 nt, Human
ucagaucuucugu

SEQ ID NO: 2929616 - RNA, 13 nt, Human
ucagaagacacug

SEQ ID NO: 2929617 - RNA, 18 nt, Human
ucagaugcacaugagcug

SEQ ID NO: 2929618 - RNA, 14 nt, Human
acccucuuagaaaa

SEQ ID NO: 2929619 - RNA, 14 nt, Human
acccugcccugugg

SEQ ID NO: 2929620 - RNA, 13 nt, Human
acccugcccugug

SEQ ID NO: 2929621 - RNA, 12 nt, Human
acccugcccugu

SEQ ID NO: 2929622 - RNA, 11 nt, Human
acccugcccug

SEQ ID NO: 2929623 - RNA, 15 nt, Human
acccuugugguccca

SEQ ID NO: 2929624 - RNA, 19 nt, Human
acccuuguggucccacccc

SEQ ID NO: 2929625 - RNA, 17 nt, Human
acccuuguggucccacc

SEQ ID NO: 2929626 - RNA, 16 nt, Human
acccuuguggucccac

SEQ ID NO: 2929627 - RNA, 23 nt, Human
ucaggguuggccccugcccggcu

SEQ ID NO: 2929628 - RNA, 20 nt, Human
accccuucgcuccugugucu

SEQ ID NO: 2929629 - RNA, 13 nt, Human
ucagggucccugg

SEQ ID NO: 2929630 - RNA, 18 nt, Human
ucagggucccugguggca

SEQ ID NO: 2929631 - RNA, 14 nt, Human
ucagggucccuggu

SEQ ID NO: 2929632 - RNA, 13 nt, Human
ucagguaacaggc

SEQ ID NO: 2929633 - RNA, 15 nt, Human
ucagguaacaggcag

SEQ ID NO: 2929634 - RNA, 16 nt, Human
ucagguaacaggcaga

SEQ ID NO: 2929635 - RNA, 19 nt, Human
accccuucgcuccuguguc

SEQ ID NO: 2929636 - RNA, 14 nt, Human
ucaggccagcugcu

SEQ ID NO: 2929637 - RNA, 11 nt, Human
ucaggccaggc

SEQ ID NO: 2929638 - RNA, 20 nt, Human
ucaggccagcugcuugggcu

SEQ ID NO: 2929639 - RNA, 15 nt, Human
ucaggccagcugcuu

SEQ ID NO: 2929640 - RNA, 15 nt, Human
ucagcggggacagcu

SEQ ID NO: 2929641 - RNA, 16 nt, Human
ucagcggggacagcuc

SEQ ID NO: 2929642 - RNA, 17 nt, Human
ucagcggggacagcucc

SEQ ID NO: 2929643 - RNA, 20 nt, Human
ucaggaagcucagggccugg

SEQ ID NO: 2929644 - RNA, 19 nt, Human
ucaggaagcucagggccug

SEQ ID NO: 2929645 - RNA, 17 nt, Human
ucaggaagcucagggcc

SEQ ID NO: 2929646 - RNA, 16 nt, Human
ucaggaagcucagggc

SEQ ID NO: 2929647 - RNA, 23 nt, Human
ucaggccaaacucaccugccccu

SEQ ID NO: 2929648 - RNA, 20 nt, Human
ucaggccaaacucaccugcc

SEQ ID NO: 2929649 - RNA, 12 nt, Human
ucacugcagccu

SEQ ID NO: 2929650 - RNA, 16 nt, Human
ucacuguugcccaggc

SEQ ID NO: 2929651 - RNA, 13 nt, Human
ucacugagacagc

SEQ ID NO: 2929652 - RNA, 15 nt, Human
ucacugagacagccc

SEQ ID NO: 2929653 - RNA, 14 nt, Human
ucacugagacagcc

SEQ ID NO: 2929654 - RNA, 16 nt, Human
ucaccuccuaaaacaa

SEQ ID NO: 2929655 - RNA, 16 nt, Human
ucaccugccccucaac

SEQ ID NO: 2929656 - RNA, 17 nt, Human
ucacuguugcccaggcu

SEQ ID NO: 2929657 - RNA, 18 nt, Human
ucacuguugcccaggcug

SEQ ID NO: 2929658 - RNA, 13 nt, Human
accagugccucuc

SEQ ID NO: 2929659 - RNA, 10 nt, Human
accagugccu

SEQ ID NO: 2929660 - RNA, 18 nt, Human
accagugccucucccugc

SEQ ID NO: 2929661 - RNA, 21 nt, Human
accagugccucucccugcugc

SEQ ID NO: 2929662 - RNA, 22 nt, Human
accagugccucucccugcugcu

SEQ ID NO: 2929663 - RNA, 23 nt, Human
accagugccucucccugcugcuc

SEQ ID NO: 2929664 - RNA, 21 nt, Human
accaguguuguggauuuaaca

SEQ ID NO: 2929665 - RNA, 16 nt, Human
acccagcccacuucug

SEQ ID NO: 2929666 - RNA, 17 nt, Human
acccagcccacuucugc

SEQ ID NO: 2929667 - RNA, 18 nt, Human
acccagcccacuucugcc

SEQ ID NO: 2929668 - RNA, 16 nt, Human
ucagaacagagccuuu

SEQ ID NO: 2929669 - RNA, 16 nt, Human
acccagaagaaaauag

SEQ ID NO: 2929670 - RNA, 18 nt, Human
acccaaaaggcagaagca

SEQ ID NO: 2929671 - RNA, 21 nt, Human
acccaaauguucaucaaugaa

SEQ ID NO: 2929672 - RNA, 23 nt, Human
accaugauuaaccacuucagcug

SEQ ID NO: 2929673 - RNA, 22 nt, Human
accaugauuaaccacuucagcu

SEQ ID NO: 2929674 - RNA, 18 nt, Human
accauucuccaccugcca

SEQ ID NO: 2929675 - RNA, 16 nt, Human
accauucuccaccugc

SEQ ID NO: 2929676 - RNA, 13 nt, Human
accauucuccacc

SEQ ID NO: 2929677 - RNA, 22 nt, Human
accauuuugggguacccacugc

SEQ ID NO: 2929678 - RNA, 23 nt, Human
accauuuugggguacccacugcu

SEQ ID NO: 2929679 - RNA, 13 nt, Human
acccaaaaggcag

SEQ ID NO: 2929680 - RNA, 15 nt, Human
acccaaaaggcagaa

SEQ ID NO: 2929681 - RNA, 19 nt, Human
accagagcccaccuuggcu

SEQ ID NO: 2929682 - RNA, 22 nt, Human
accagagcccaccuuggcucaa

SEQ ID NO: 2929683 - RNA, 17 nt, Human
accagagcccaccuugg

SEQ ID NO: 2929684 - RNA, 22 nt, Human
accagacaccuugacagggcac

SEQ ID NO: 2929685 - RNA, 23 nt, Human
accagacaccuugacagggcaca

SEQ ID NO: 2929686 - RNA, 17 nt, Human
accagacaccuugacag

SEQ ID NO: 2929687 - RNA, 12 nt, Human
accacuuuuguu

SEQ ID NO: 2929688 - RNA, 19 nt, Human
accacuuguguuuugcaag

SEQ ID NO: 2929689 - RNA, 23 nt, Human
accacuuguguuuugcaagccag

SEQ ID NO: 2929690 - RNA, 23 nt, Human
ucaccugaagacucauucuucug

SEQ ID NO: 2929691 - RNA, 16 nt, Human
ucaccugaagacucau

SEQ ID NO: 2929692 - RNA, 19 nt, Human
ucaccugaagacucauucu

SEQ ID NO: 2929693 - RNA, 11 nt, Human
ucaccuccuaa

SEQ ID NO: 2929694 - RNA, 20 nt, Human
accacucuaucaaguauuau

SEQ ID NO: 2929695 - RNA, 20 nt, Human
accacaucuugcucugcuga

SEQ ID NO: 2929696 - RNA, 21 nt, Human
accacaucuugcucugcugac

SEQ ID NO: 2929697 - RNA, 24 nt, Human
accacaucuugcucugcugacaga

SEQ ID NO: 2929698 - RNA, 15 nt, Human
accacuucagcugac

SEQ ID NO: 2929699 - RNA, 14 nt, Human
accacuucagcuga

SEQ ID NO: 2929700 - RNA, 13 nt, Human
accacuucagcug

SEQ ID NO: 2929701 - RNA, 13 nt, Human
accacugcagaag

SEQ ID NO: 2929702 - RNA, 14 nt, Human
accacugcagaaga

SEQ ID NO: 2929703 - RNA, 19 nt, Human
accacugcagaagacagua

SEQ ID NO: 2929704 - RNA, 21 nt, Human
accacagacauacuaaccagc

SEQ ID NO: 2929705 - RNA, 22 nt, Human
accacagacauacuaaccagca

SEQ ID NO: 2929706 - RNA, 14 nt, Human
accacaucuugcuc

SEQ ID NO: 2929707 - RNA, 11 nt, Human
accacagcagu

SEQ ID NO: 2929708 - RNA, 12 nt, Human
uauuucauuucu

SEQ ID NO: 2929709 - RNA, 15 nt, Human
agcacagugaucaag

SEQ ID NO: 2929710 - RNA, 16 nt, Human
agcacagcuucauuuc

SEQ ID NO: 2929711 - RNA, 22 nt, Human
agcacagccucuuagaugcagu

SEQ ID NO: 2929712 - RNA, 22 nt, Human
agcaccaaaagcuuaccaaggg

SEQ ID NO: 2929713 - RNA, 14 nt, Human
agcacaugccucuc

SEQ ID NO: 2929714 - RNA, 13 nt, Human
agcacaugccucu

SEQ ID NO: 2929715 - RNA, 16 nt, Human
agcaccaaucaugaau

SEQ ID NO: 2929716 - RNA, 22 nt, Human
agcaagugagagcuggguguca

SEQ ID NO: 2929717 - RNA, 18 nt, Human
agcaagugagagcugggu

SEQ ID NO: 2929718 - RNA, 14 nt, Human
agcaagugagagcu

SEQ ID NO: 2929719 - RNA, 20 nt, Human
agcaagugagacccugucuc

SEQ ID NO: 2929720 - RNA, 13 nt, Human
agcaagugagagc

SEQ ID NO: 2929721 - RNA, 22 nt, Human
ugagccagauuucacucuccuu

SEQ ID NO: 2929722 - RNA, 17 nt, Human
ugagccagauuucacuc

SEQ ID NO: 2929723 - RNA, 21 nt, Human
ugagcaucaggccaggcccuc

SEQ ID NO: 2929724 - RNA, 23 nt, Human
ugagcaucgcuuaggagaagucu

SEQ ID NO: 2929725 - RNA, 24 nt, Human
ugagcaucaggccaggcccucugc

SEQ ID NO: 2929726 - RNA, 22 nt, Human
ugagcaucaggccaggcccucu

SEQ ID NO: 2929727 - RNA, 21 nt, Human
ugagccacugcaccgggccac

SEQ ID NO: 2929728 - RNA, 18 nt, Human
ugagccacugcaccgggc

SEQ ID NO: 2929729 - RNA, 23 nt, Human
ugagccacugcaccgggccacag

SEQ ID NO: 2929730 - RNA, 13 nt, Human
ugagccagauuuc

SEQ ID NO: 2929731 - RNA, 16 nt, Human
ugagccagauuucacu

SEQ ID NO: 2929732 - RNA, 14 nt, Human
ugagccagauuuca

SEQ ID NO: 2929733 - RNA, 20 nt, Human
ugagcacuaaggugugcucu

SEQ ID NO: 2929734 - RNA, 21 nt, Human
ugagcacuaaggugugcucug

SEQ ID NO: 2929735 - RNA, 22 nt, Human
ugagcacuaaggugugcucuga

SEQ ID NO: 2929736 - RNA, 23 nt, Human
ugagcacuaaggugugcucugau

SEQ ID NO: 2929737 - RNA, 15 nt, Human
ugagcaauccugcaa

SEQ ID NO: 2929738 - RNA, 14 nt, Human
agcaacgcaggccc

SEQ ID NO: 2929739 - RNA, 10 nt, Human
ugagccuggc

SEQ ID NO: 2929740 - RNA, 16 nt, Human
agcagagaccaucccu

SEQ ID NO: 2929741 - RNA, 15 nt, Human
agcagagaccauccc

SEQ ID NO: 2929742 - RNA, 22 nt, Human
agcagagaaugaaagggcccag

SEQ ID NO: 2929743 - RNA, 23 nt, Human
agcagagaaugaaagggcccaga

SEQ ID NO: 2929744 - RNA, 14 nt, Human
agcagagaauucuc

SEQ ID NO: 2929745 - RNA, 21 nt, Human
agcagagaauucucuuaucca

SEQ ID NO: 2929746 - RNA, 13 nt, Human
agcagaaugugau

SEQ ID NO: 2929747 - RNA, 16 nt, Human
agcagacacaugccag

SEQ ID NO: 2929748 - RNA, 11 nt, Human
agcagacacau

SEQ ID NO: 2929749 - RNA, 12 nt, Human
agcagacacaug

SEQ ID NO: 2929750 - RNA, 22 nt, Human
agcagaccauuggggcucccag

SEQ ID NO: 2929751 - RNA, 23 nt, Human
agcagaccauuggggcucccagc

SEQ ID NO: 2929752 - RNA, 21 nt, Human
agcagagaaugaaagggccca

SEQ ID NO: 2929753 - RNA, 14 nt, Human
ugagccugggaggu

SEQ ID NO: 2929754 - RNA, 16 nt, Human
ugagccuggcaagaau

SEQ ID NO: 2929755 - RNA, 11 nt, Human
ugagccuggca

SEQ ID NO: 2929756 - RNA, 14 nt, Human
ugagccuugaacuu

SEQ ID NO: 2929757 - RNA, 22 nt, Human
ugagccugggaggucaaggcug

SEQ ID NO: 2929758 - RNA, 19 nt, Human
ugagccugggaggucaagg

SEQ ID NO: 2929759 - RNA, 13 nt, Human
ugagcgacaguga

SEQ ID NO: 2929760 - RNA, 14 nt, Human
ugagcgacagugag

SEQ ID NO: 2929761 - RNA, 16 nt, Human
ugagcgacagugagac

SEQ ID NO: 2929762 - RNA, 20 nt, Human
ugagcgacagugagacucug

SEQ ID NO: 2929763 - RNA, 15 nt, Human
ugagccuugaacuuu

SEQ ID NO: 2929764 - RNA, 17 nt, Human
ugagccuugaacuuuga

SEQ ID NO: 2929765 - RNA, 18 nt, Human
ugagccuugaacuuugac

SEQ ID NO: 2929766 - RNA, 19 nt, Human
ugagccuugaacuuugacc

SEQ ID NO: 2929767 - RNA, 22 nt, Human
agcaccuuagacagucccugcc

SEQ ID NO: 2929768 - RNA, 21 nt, Human
agcaccuuagacagucccugc

SEQ ID NO: 2929769 - RNA, 20 nt, Human
agcaccuuagacagucccug

SEQ ID NO: 2929770 - RNA, 19 nt, Human
agcaccuuagacagucccu

SEQ ID NO: 2929771 - RNA, 13 nt, Human
agcacgauuucug

SEQ ID NO: 2929772 - RNA, 23 nt, Human
agcaccuuagacagucccugcca

SEQ ID NO: 2929773 - RNA, 16 nt, Human
agcacgauuucuguuu

SEQ ID NO: 2929774 - RNA, 14 nt, Human
agcacgauuucugu

SEQ ID NO: 2929775 - RNA, 15 nt, Human
agcacgauuucuguu

SEQ ID NO: 2929776 - RNA, 22 nt, Human
agcacuuugggaggccaaggug

SEQ ID NO: 2929777 - RNA, 19 nt, Human
agcacuuugggaggcugag

SEQ ID NO: 2929778 - RNA, 23 nt, Human
agcacuuugggaggccaaggugg

SEQ ID NO: 2929779 - RNA, 14 nt, Human
agcagaacagugau

SEQ ID NO: 2929780 - RNA, 12 nt, Human
agcagaaaugcc

SEQ ID NO: 2929781 - RNA, 13 nt, Human
agcagaaaugccu

SEQ ID NO: 2929782 - RNA, 19 nt, Human
agcagaaaugccuuacccu

SEQ ID NO: 2929783 - RNA, 21 nt, Human
ugaggaagccgcuggggccag

SEQ ID NO: 2929784 - RNA, 19 nt, Human
ugaggaagccgcuggggcc

SEQ ID NO: 2929785 - RNA, 18 nt, Human
ugaggaagccgcuggggc

SEQ ID NO: 2929786 - RNA, 17 nt, Human
ugaggaagccgcugggg

SEQ ID NO: 2929787 - RNA, 14 nt, Human
ugaggaagccgcug

SEQ ID NO: 2929788 - RNA, 22 nt, Human
ugaggaagcaaaagcaucuaug

SEQ ID NO: 2929789 - RNA, 15 nt, Human
ugaggaagcaaaagc

SEQ ID NO: 2929790 - RNA, 16 nt, Human
ugagcuacaaaugcau

SEQ ID NO: 2929791 - RNA, 14 nt, Human
ugagcuacaaaugc

SEQ ID NO: 2929792 - RNA, 13 nt, Human
ugagcuacaaaug

SEQ ID NO: 2929793 - RNA, 13 nt, Human
ugaggcccagagg

SEQ ID NO: 2929794 - RNA, 12 nt, Human
ugaggcccagag

SEQ ID NO: 2929795 - RNA, 16 nt, Human
ugaggccagagacaca

SEQ ID NO: 2929796 - RNA, 14 nt, Human
ugaggccagagaca

SEQ ID NO: 2929797 - RNA, 20 nt, Human
ugaggccagagacacaagcc

SEQ ID NO: 2929798 - RNA, 20 nt, Human
ugaggcccagagggccugca

SEQ ID NO: 2929799 - RNA, 18 nt, Human
ugaggcccagagggccug

SEQ ID NO: 2929800 - RNA, 17 nt, Human
ugaggcccagagggccu

SEQ ID NO: 2929801 - RNA, 15 nt, Human
ugaggcccagagggc

SEQ ID NO: 2929802 - RNA, 22 nt, Human
ugaggcccagagggccugcaag

SEQ ID NO: 2929803 - RNA, 21 nt, Human
ugaggcccagagggccugcaa

SEQ ID NO: 2929804 - RNA, 23 nt, Human
ugaggcccagagggccugcaagg

SEQ ID NO: 2929805 - RNA, 21 nt, Human
ugaggaauccagacccggcug

SEQ ID NO: 2929806 - RNA, 22 nt, Human
ugaggaauccagacccggcugc

SEQ ID NO: 2929807 - RNA, 12 nt, Human
ugaggccagaga

SEQ ID NO: 2929808 - RNA, 23 nt, Human
ugaggcauuuguuugaacugaua

SEQ ID NO: 2929809 - RNA, 21 nt, Human
ugaggacacuaaccacgcugg

SEQ ID NO: 2929810 - RNA, 15 nt, Human
ugaggacacugauau

SEQ ID NO: 2929811 - RNA, 19 nt, Human
ugagggauacccaucccau

SEQ ID NO: 2929812 - RNA, 16 nt, Human
ugaggcccuucucucc

SEQ ID NO: 2929813 - RNA, 19 nt, Human
ugaggcccuucucuccagc

SEQ ID NO: 2929814 - RNA, 18 nt, Human
ugaggcccuucucuccag

SEQ ID NO: 2929815 - RNA, 24 nt, Human
ugaggcccuucucuccagccccug

SEQ ID NO: 2929816 - RNA, 23 nt, Human
ugaggcccuucucuccagccccu

SEQ ID NO: 2929817 - RNA, 22 nt, Human
ugaggcccuucucuccagcccc

SEQ ID NO: 2929818 - RNA, 20 nt, Human
ugaggcccuucucuccagcc

SEQ ID NO: 2929819 - RNA, 12 nt, Human
ugaggggccucu

SEQ ID NO: 2929820 - RNA, 13 nt, Human
ugaggggccucuu

SEQ ID NO: 2929821 - RNA, 10 nt, Human
agcagagugc

SEQ ID NO: 2929822 - RNA, 13 nt, Human
agcagagugcuuu

SEQ ID NO: 2929823 - RNA, 17 nt, Human
agcagaggaaggagagg

SEQ ID NO: 2929824 - RNA, 19 nt, Human
agcagauggagaccccuug

SEQ ID NO: 2929825 - RNA, 20 nt, Human
agcagagaccaucccugaag

SEQ ID NO: 2929826 - RNA, 20 nt, Human
agcagagcaccuuagacagu

SEQ ID NO: 2929827 - RNA, 17 nt, Human
ugaggucagagccugca

SEQ ID NO: 2929828 - RNA, 17 nt, Human
agcagagaccaucccug

SEQ ID NO: 2929829 - RNA, 19 nt, Human
agcagagaccaucccugaa

SEQ ID NO: 2929830 - RNA, 18 nt, Human
agcagagaccaucccuga

SEQ ID NO: 2929831 - RNA, 20 nt, Human
ugaggguugggcugguguca

SEQ ID NO: 2929832 - RNA, 17 nt, Human
ugagguacugagaguga

SEQ ID NO: 2929833 - RNA, 14 nt, Human
ugaggucagagccu

SEQ ID NO: 2929834 - RNA, 16 nt, Human
ugaggucagagccugc

SEQ ID NO: 2929835 - RNA, 13 nt, Human
ugaggucagagcc

SEQ ID NO: 2929836 - RNA, 22 nt, Human
ugagguacugagagugaacaaa

SEQ ID NO: 2929837 - RNA, 19 nt, Human
ugaauggacuuugcacacu

SEQ ID NO: 2929838 - RNA, 20 nt, Human
ugaaugcccagugagacugu

SEQ ID NO: 2929839 - RNA, 16 nt, Human
ugaaugucacuucugg

SEQ ID NO: 2929840 - RNA, 14 nt, Human
ugaaugucagugug

SEQ ID NO: 2929841 - RNA, 18 nt, Human
ugaaugucagugugacug

SEQ ID NO: 2929842 - RNA, 15 nt, Human
ugaaugucaguguga

SEQ ID NO: 2929843 - RNA, 20 nt, Human
agagucucacuguugcccag

SEQ ID NO: 2929844 - RNA, 22 nt, Human
agagucucacuguugcccaggc

SEQ ID NO: 2929845 - RNA, 14 nt, Human
agagugaacaaauu

SEQ ID NO: 2929846 - RNA, 15 nt, Human
agagugagacucugu

SEQ ID NO: 2929847 - RNA, 16 nt, Human
agagugagacucuguc

SEQ ID NO: 2929848 - RNA, 18 nt, Human
agagucuauuuacggaac

SEQ ID NO: 2929849 - RNA, 22 nt, Human
agagugaacaaauuuacagaga

SEQ ID NO: 2929850 - RNA, 17 nt, Human
agauaaggguaucuggu

SEQ ID NO: 2929851 - RNA, 19 nt, Human
agauaaggguaucugguga

SEQ ID NO: 2929852 - RNA, 19 nt, Human
agagugagacucugucuca

SEQ ID NO: 2929853 - RNA, 22 nt, Human
agauauuuugcuuugugauuuu

SEQ ID NO: 2929854 - RNA, 19 nt, Human
agauacaggaaaagcugcu

SEQ ID NO: 2929855 - RNA, 14 nt, Human
agaucaaccccuuc

SEQ ID NO: 2929856 - RNA, 19 nt, Human
agaucaaccccuucgcucc

SEQ ID NO: 2929857 - RNA, 21 nt, Human
agaucaaccccuucgcuccug

SEQ ID NO: 2929858 - RNA, 19 nt, Human
agagcugggugucaagagg

SEQ ID NO: 2929859 - RNA, 19 nt, Human
agaggaaagcaaaggagau

SEQ ID NO: 2929860 - RNA, 18 nt, Human
agaggaaagcaaaggaga

SEQ ID NO: 2929861 - RNA, 16 nt, Human
agaggaaagcaaagga

SEQ ID NO: 2929862 - RNA, 12 nt, Human
agaggaaagcaa

SEQ ID NO: 2929863 - RNA, 12 nt, Human
agaggaaaucac

SEQ ID NO: 2929864 - RNA, 11 nt, Human
agaggaaauca

SEQ ID NO: 2929865 - RNA, 21 nt, Human
agaggaaaucaccgaaaacgu

SEQ ID NO: 2929866 - RNA, 18 nt, Human
agaggcaacugcauuggc

SEQ ID NO: 2929867 - RNA, 21 nt, Human
ucuuuggucuacacugugcug

SEQ ID NO: 2929868 - RNA, 14 nt, Human
ucuuuggucuacac

SEQ ID NO: 2929869 - RNA, 11 nt, Human
ugaacuuugac

SEQ ID NO: 2929870 - RNA, 16 nt, Human
ugaacuuugaccucug

SEQ ID NO: 2929871 - RNA, 14 nt, Human
ugaagaagauggua

SEQ ID NO: 2929872 - RNA, 20 nt, Human
ugaagaagcaccaaucauga

SEQ ID NO: 2929873 - RNA, 13 nt, Human
ugaagacaaugac

SEQ ID NO: 2929874 - RNA, 17 nt, Human
ugaagacaaugacuuac

SEQ ID NO: 2929875 - RNA, 11 nt, Human
ugaagacaaug

SEQ ID NO: 2929876 - RNA, 20 nt, Human
agagggagggagggcuccag

SEQ ID NO: 2929877 - RNA, 21 nt, Human
agagggagggagggcuccaga

SEQ ID NO: 2929878 - RNA, 22 nt, Human
agagggagggagggcuccagac

SEQ ID NO: 2929879 - RNA, 17 nt, Human
ugaagauguagaggaga

SEQ ID NO: 2929880 - RNA, 17 nt, Human
ugaagcagaguggcagu

SEQ ID NO: 2929881 - RNA, 21 nt, Human
ugaagauucuauguuaauauu

SEQ ID NO: 2929882 - RNA, 18 nt, Human
ugaagauguagaggagaa

SEQ ID NO: 2929883 - RNA, 12 nt, Human
ugaccugaggcc

SEQ ID NO: 2929884 - RNA, 14 nt, Human
ugaccucugccuga

SEQ ID NO: 2929885 - RNA, 13 nt, Human
ugaccucugccug

SEQ ID NO: 2929886 - RNA, 16 nt, Human
agaugcuucucacugc

SEQ ID NO: 2929887 - RNA, 18 nt, Human
agaugcuucucacugcca

SEQ ID NO: 2929888 - RNA, 23 nt, Human
agaugcuagaacucccuuucaac

SEQ ID NO: 2929889 - RNA, 22 nt, Human
agaugcuagaacucccuuucaa

SEQ ID NO: 2929890 - RNA, 14 nt, Human
ugacauugcaccug

SEQ ID NO: 2929891 - RNA, 17 nt, Human
ugacauugcaccuggau

SEQ ID NO: 2929892 - RNA, 13 nt, Human
ugacauugaaauc

SEQ ID NO: 2929893 - RNA, 20 nt, Human
ugacauugaaaucuaggaaa

SEQ ID NO: 2929894 - RNA, 21 nt, Human
ugacauugaaaucuaggaaaa

SEQ ID NO: 2929895 - RNA, 14 nt, Human
ugacauugacuauu

SEQ ID NO: 2929896 - RNA, 16 nt, Human
ugacauugacuauuuu

SEQ ID NO: 2929897 - RNA, 14 nt, Human
agauccuggaaauc

SEQ ID NO: 2929898 - RNA, 19 nt, Human
agaugaugaugaucuuuaa

SEQ ID NO: 2929899 - RNA, 14 nt, Human
agauuucacucucc

SEQ ID NO: 2929900 - RNA, 13 nt, Human
agauuucacucuc

SEQ ID NO: 2929901 - RNA, 16 nt, Human
agauuuaccacuugug

SEQ ID NO: 2929902 - RNA, 16 nt, Human
agauugugccccugca

SEQ ID NO: 2929903 - RNA, 15 nt, Human
agcaacacaaagcuu

SEQ ID NO: 2929904 - RNA, 21 nt, Human
agcaacacaaagcuuuugcau

SEQ ID NO: 2929905 - RNA, 16 nt, Human
agcaacacaaagcuuu

SEQ ID NO: 2929906 - RNA, 18 nt, Human
agcaacacaaagcuuuug

SEQ ID NO: 2929907 - RNA, 24 nt, Human
ugacuucuaaguaaaaccacagca

SEQ ID NO: 2929908 - RNA, 23 nt, Human
agauuauauauauuuuuuucuga

SEQ ID NO: 2929909 - RNA, 22 nt, Human
agauucaaugccccugaauuua

SEQ ID NO: 2929910 - RNA, 21 nt, Human
agauucaaugccccugaauuu

SEQ ID NO: 2929911 - RNA, 17 nt, Human
ugaccugaggcccuucu

SEQ ID NO: 2929912 - RNA, 15 nt, Human
ugaccugaggcccuu

SEQ ID NO: 2929913 - RNA, 14 nt, Human
ugaccugaggcccu

SEQ ID NO: 2929914 - RNA, 19 nt, Human
ugacuccagaauuucccaa

SEQ ID NO: 2929915 - RNA, 17 nt, Human
ugacuccagaauuuccc

SEQ ID NO: 2929916 - RNA, 23 nt, Human
ugacuccagaauuucccaaagca

SEQ ID NO: 2929917 - RNA, 20 nt, Human
ugacuccagaauuucccaaa

SEQ ID NO: 2929918 - RNA, 15 nt, Human
ugacuguuuccauca

SEQ ID NO: 2929919 - RNA, 17 nt, Human
ucucuccuguaccucuu

SEQ ID NO: 2929920 - RNA, 15 nt, Human
ucucuccagccccug

SEQ ID NO: 2929921 - RNA, 20 nt, Human
ucucuccuguaccucuugag

SEQ ID NO: 2929922 - RNA, 22 nt, Human
ucucuccuguaccucuugagcc

SEQ ID NO: 2929923 - RNA, 18 nt, Human
ucuccuucaccuuugucc

SEQ ID NO: 2929924 - RNA, 20 nt, Human
ucuccuucaccuuugucccc

SEQ ID NO: 2929925 - RNA, 14 nt, Human
ucucuccagccccu

SEQ ID NO: 2929926 - RNA, 13 nt, Human
ucucuccagcccc

SEQ ID NO: 2929927 - RNA, 12 nt, Human
ucucuucuuuaa

SEQ ID NO: 2929928 - RNA, 13 nt, Human
ucucuucuuuaaa

SEQ ID NO: 2929929 - RNA, 14 nt, Human
ucucuugagagggu

SEQ ID NO: 2929930 - RNA, 13 nt, Human
ucucuggccuucg

SEQ ID NO: 2929931 - RNA, 16 nt, Human
ucucuggccuucggcc

SEQ ID NO: 2929932 - RNA, 17 nt, Human
ucucuggccuucggccu

SEQ ID NO: 2929933 - RNA, 15 nt, Human
ucucuugagccuggg

SEQ ID NO: 2929934 - RNA, 14 nt, Human
ucucuugagccugg

SEQ ID NO: 2929935 - RNA, 13 nt, Human
ucucuugagccug

SEQ ID NO: 2929936 - RNA, 22 nt, Human
ucucuuuaaugucacaggcagg

SEQ ID NO: 2929937 - RNA, 18 nt, Human
agaaaaaggaugcacaga

SEQ ID NO: 2929938 - RNA, 17 nt, Human
agaaaaaugagccuggc

SEQ ID NO: 2929939 - RNA, 16 nt, Human
agaaaacaaggaugaa

SEQ ID NO: 2929940 - RNA, 19 nt, Human
agaaaacaaggaugaauua

SEQ ID NO: 2929941 - RNA, 15 nt, Human
agaaacauuugguaa

SEQ ID NO: 2929942 - RNA, 14 nt, Human
agaaagaaaaucag

SEQ ID NO: 2929943 - RNA, 13 nt, Human
agaaacuggaacu

SEQ ID NO: 2929944 - RNA, 22 nt, Human
acuuuuuauggcacuaguauuu

SEQ ID NO: 2929945 - RNA, 14 nt, Human
acuuuuggaaggua

SEQ ID NO: 2929946 - RNA, 23 nt, Human
acuuugaccucugcagcaauaaa

SEQ ID NO: 2929947 - RNA, 19 nt, Human
acuuugaccucugcagcaa

SEQ ID NO: 2929948 - RNA, 19 nt, Human
acuuuaccuuuuuuauaca

SEQ ID NO: 2929949 - RNA, 22 nt, Human
acuuuaccuuuuuuauacauaa

SEQ ID NO: 2929950 - RNA, 18 nt, Human
acuuuaccuuuuuuauac

SEQ ID NO: 2929951 - RNA, 12 nt, Human
acuuuggaaaga

SEQ ID NO: 2929952 - RNA, 14 nt, Human
acuuuggaaagacu

SEQ ID NO: 2929953 - RNA, 13 nt, Human
acuuuggaaagac

SEQ ID NO: 2929954 - RNA, 17 nt, Human
acuuuggaaagacuuuu

SEQ ID NO: 2929955 - RNA, 15 nt, Human
ucucccagucauuua

SEQ ID NO: 2929956 - RNA, 18 nt, Human
ucucccuuggauuguccc

SEQ ID NO: 2929957 - RNA, 11 nt, Human
ucucccuugga

SEQ ID NO: 2929958 - RNA, 20 nt, Human
acuuguugaggguauguuuu

SEQ ID NO: 2929959 - RNA, 14 nt, Human
ucuccucugcugcu

SEQ ID NO: 2929960 - RNA, 13 nt, Human
ucuccucugcugc

SEQ ID NO: 2929961 - RNA, 15 nt, Human
ucuccucucucugua

SEQ ID NO: 2929962 - RNA, 12 nt, Human
ucuccucugcug

SEQ ID NO: 2929963 - RNA, 19 nt, Human
ucucccuuggauugucccc

SEQ ID NO: 2929964 - RNA, 20 nt, Human
agaacaaaggggcuuaauua

SEQ ID NO: 2929965 - RNA, 11 nt, Human
agaaauguguu

SEQ ID NO: 2929966 - RNA, 17 nt, Human
agaaauguacagcaagg

SEQ ID NO: 2929967 - RNA, 16 nt, Human
agaaauguacagcaag

SEQ ID NO: 2929968 - RNA, 17 nt, Human
agaacuaaaauguucua

SEQ ID NO: 2929969 - RNA, 19 nt, Human
agaagaaaauagaauugac

SEQ ID NO: 2929970 - RNA, 14 nt, Human
agaacucccuuuca

SEQ ID NO: 2929971 - RNA, 19 nt, Human
ucugacccugcuucaaaua

SEQ ID NO: 2929972 - RNA, 23 nt, Human
agaaagacuauucaaacagucuc

SEQ ID NO: 2929973 - RNA, 20 nt, Human
agaaagacuauucaaacagu

SEQ ID NO: 2929974 - RNA, 18 nt, Human
agaaagacuauucaaaca

SEQ ID NO: 2929975 - RNA, 19 nt, Human
agaaagacuauucaaacag

SEQ ID NO: 2929976 - RNA, 21 nt, Human
ucugacuguuuccaucaaggg

SEQ ID NO: 2929977 - RNA, 20 nt, Human
ucugagaaagacuauucaaa

SEQ ID NO: 2929978 - RNA, 19 nt, Human
ucugagaaagacuauucaa

SEQ ID NO: 2929979 - RNA, 15 nt, Human
ucugagaaagacuau

SEQ ID NO: 2929980 - RNA, 14 nt, Human
ucugagaaagacua

SEQ ID NO: 2929981 - RNA, 18 nt, Human
ucugauucccaagcucug

SEQ ID NO: 2929982 - RNA, 16 nt, Human
ucugauacagaaaagu

SEQ ID NO: 2929983 - RNA, 17 nt, Human
ucugauacagaaaaguu

SEQ ID NO: 2929984 - RNA, 19 nt, Human
ucugauucccaagcucugc

SEQ ID NO: 2929985 - RNA, 20 nt, Human
ucugauucccaagcucugcu

SEQ ID NO: 2929986 - RNA, 21 nt, Human
ucugauucccaagcucugcuc

SEQ ID NO: 2929987 - RNA, 22 nt, Human
ucugcacuccccugcugggugu

SEQ ID NO: 2929988 - RNA, 23 nt, Human
ucugagaaagacuauucaaacag

SEQ ID NO: 2929989 - RNA, 22 nt, Human
ucugagaaagacuauucaaaca

SEQ ID NO: 2929990 - RNA, 21 nt, Human
ucugagaaagacuauucaaac

SEQ ID NO: 2929991 - RNA, 23 nt, Human
ucugccgcagcccugcagagggc

SEQ ID NO: 2929992 - RNA, 14 nt, Human
ucugcccuccaaga

SEQ ID NO: 2929993 - RNA, 21 nt, Human
agaagaacugaaaucauacuu

SEQ ID NO: 2929994 - RNA, 16 nt, Human
ucugcucacauaucug

SEQ ID NO: 2929995 - RNA, 12 nt, Human
ucugcuuagaaa

SEQ ID NO: 2929996 - RNA, 14 nt, Human
ucugcuuagaaaua

SEQ ID NO: 2929997 - RNA, 16 nt, Human
ucugcuuagaaauaac

SEQ ID NO: 2929998 - RNA, 17 nt, Human
ucugcuuagaaauaaca

SEQ ID NO: 2929999 - RNA, 22 nt, Human
ucugcuuagaaauaacagaaga

SEQ ID NO: 2930000 - RNA, 11 nt, Human
ucugcuugcca

SEQ ID NO: 2930001 - RNA, 16 nt, Human
agaagcggcuggcagc

SEQ ID NO: 2930002 - RNA, 15 nt, Human
agaagcggcuggcag

SEQ ID NO: 2930003 - RNA, 15 nt, Human
ucuggcagcucagag

SEQ ID NO: 2930004 - RNA, 14 nt, Human
ucuggcagcucaga

SEQ ID NO: 2930005 - RNA, 15 nt, Human
ucuggauucauauuu

SEQ ID NO: 2930006 - RNA, 18 nt, Human
ucuggagguacgaaaaga

SEQ ID NO: 2930007 - RNA, 23 nt, Human
ucugcuuuuuaaagaaugcucuu

SEQ ID NO: 2930008 - RNA, 12 nt, Human
ucugcuugccau

SEQ ID NO: 2930009 - RNA, 19 nt, Human
agacccucaugcugccaau

SEQ ID NO: 2930010 - RNA, 18 nt, Human
agacccucaugcugccaa

SEQ ID NO: 2930011 - RNA, 21 nt, Human
agacccucaugcugccaauau

SEQ ID NO: 2930012 - RNA, 20 nt, Human
agacccucaugcugccaaua

SEQ ID NO: 2930013 - RNA, 24 nt, Human
agacccucaugcugccaauauccu

SEQ ID NO: 2930014 - RNA, 16 nt, Human
agacccucucaaacua

SEQ ID NO: 2930015 - RNA, 12 nt, Human
agacccugcccu

SEQ ID NO: 2930016 - RNA, 14 nt, Human
agacccugcccugu

SEQ ID NO: 2930017 - RNA, 13 nt, Human
agacccugcccug

SEQ ID NO: 2930018 - RNA, 15 nt, Human
agacccuuguggucc

SEQ ID NO: 2930019 - RNA, 13 nt, Human
agacccuuguggu

SEQ ID NO: 2930020 - RNA, 23 nt, Human
agacccugcccugugggccccca

SEQ ID NO: 2930021 - RNA, 21 nt, Human
agacccugcccugugggcccc

SEQ ID NO: 2930022 - RNA, 19 nt, Human
agacccugcccugugggcc

SEQ ID NO: 2930023 - RNA, 16 nt, Human
agacccugcccugugg

SEQ ID NO: 2930024 - RNA, 23 nt, Human
agacccuuguggucccaccccac

SEQ ID NO: 2930025 - RNA, 22 nt, Human
agacccuuguggucccacccca

SEQ ID NO: 2930026 - RNA, 20 nt, Human
agacccuuguggucccaccc

SEQ ID NO: 2930027 - RNA, 19 nt, Human
agacccuuguggucccacc

SEQ ID NO: 2930028 - RNA, 17 nt, Human
ucuugcaauggcagccu

SEQ ID NO: 2930029 - RNA, 13 nt, Human
ucuugcaauggca

SEQ ID NO: 2930030 - RNA, 16 nt, Human
ucuugcaauggcagcc

SEQ ID NO: 2930031 - RNA, 19 nt, Human
agacuccaaagaaauguaa

SEQ ID NO: 2930032 - RNA, 16 nt, Human
agacuccaaagaaaug

SEQ ID NO: 2930033 - RNA, 15 nt, Human
agacuaucuaaaugu

SEQ ID NO: 2930034 - RNA, 16 nt, Human
agacuauucaaacagu

SEQ ID NO: 2930035 - RNA, 19 nt, Human
agacuaucuaaauguugaa

SEQ ID NO: 2930036 - RNA, 17 nt, Human
agacuaucuaaauguug

SEQ ID NO: 2930037 - RNA, 18 nt, Human
agacuaucuaaauguuga

SEQ ID NO: 2930038 - RNA, 18 nt, Human
agacucauucuucuguac

SEQ ID NO: 2930039 - RNA, 12 nt, Human
agacuccaaaga

SEQ ID NO: 2930040 - RNA, 14 nt, Human
agacuccaaagaaa

SEQ ID NO: 2930041 - RNA, 13 nt, Human
agacuccaaagaa

SEQ ID NO: 2930042 - RNA, 17 nt, Human
agacucauucuucugua

SEQ ID NO: 2930043 - RNA, 21 nt, Human
agacuauucaaacagucucag

SEQ ID NO: 2930044 - RNA, 20 nt, Human
agacuauucaaacagucuca

SEQ ID NO: 2930045 - RNA, 18 nt, Human
agacuauucaaacagucu

SEQ ID NO: 2930046 - RNA, 17 nt, Human
agacuucaucccucugg

SEQ ID NO: 2930047 - RNA, 14 nt, Human
agacuucaucccuc

SEQ ID NO: 2930048 - RNA, 21 nt, Human
agacuggauaguccgucucug

SEQ ID NO: 2930049 - RNA, 15 nt, Human
agacuggcacaguuu

SEQ ID NO: 2930050 - RNA, 14 nt, Human
agacuggcacaguu

SEQ ID NO: 2930051 - RNA, 18 nt, Human
agagaaugaaagggccca

SEQ ID NO: 2930052 - RNA, 14 nt, Human
agacuuuggaaaga

SEQ ID NO: 2930053 - RNA, 12 nt, Human
agacuuuggaaa

SEQ ID NO: 2930054 - RNA, 17 nt, Human
agagacacacugaagaa

SEQ ID NO: 2930055 - RNA, 15 nt, Human
agagaaugagagaca

SEQ ID NO: 2930056 - RNA, 15 nt, Human
agagaccaucccuga

SEQ ID NO: 2930057 - RNA, 18 nt, Human
agagacacacugaagaag

SEQ ID NO: 2930058 - RNA, 20 nt, Human
agagacacacugaagaagca

SEQ ID NO: 2930059 - RNA, 14 nt, Human
agagaccaucccug

SEQ ID NO: 2930060 - RNA, 13 nt, Human
agagaccaucccu

SEQ ID NO: 2930061 - RNA, 19 nt, Human
agacucuacagaggccaug

SEQ ID NO: 2930062 - RNA, 20 nt, Human
agacuggauaguccgucucu

SEQ ID NO: 2930063 - RNA, 17 nt, Human
agacucuacagaggcca

SEQ ID NO: 2930064 - RNA, 21 nt, Human
agacucgcgacaaugcaaacc

SEQ ID NO: 2930065 - RNA, 23 nt, Human
agacuccugcaggcagccaggcc

SEQ ID NO: 2930066 - RNA, 20 nt, Human
agacuccugcaggcagccag

SEQ ID NO: 2930067 - RNA, 19 nt, Human
agacuccugcaggcagcca

SEQ ID NO: 2930068 - RNA, 18 nt, Human
agacuccugcaggcagcc

SEQ ID NO: 2930069 - RNA, 17 nt, Human
agacuccugcaggcagc

SEQ ID NO: 2930070 - RNA, 16 nt, Human
agacuccugcaggcag

SEQ ID NO: 2930071 - RNA, 15 nt, Human
agacuccugcaggca

SEQ ID NO: 2930072 - RNA, 14 nt, Human
agacuccugcaggc

SEQ ID NO: 2930073 - RNA, 15 nt, Human
ucuuuccugaggcug

SEQ ID NO: 2930074 - RNA, 14 nt, Human
ucuuuccugaggcu

SEQ ID NO: 2930075 - RNA, 13 nt, Human
ucuuuccugaggc

SEQ ID NO: 2930076 - RNA, 15 nt, Human
ucuuuacuucaugga

SEQ ID NO: 2930077 - RNA, 17 nt, Human
ucuuuaaaauacacacu

SEQ ID NO: 2930078 - RNA, 21 nt, Human
ucuuuaaagggauggcaagau

SEQ ID NO: 2930079 - RNA, 16 nt, Human
ucuucccucaaaugug

SEQ ID NO: 2930080 - RNA, 22 nt, Human
ucuuccaggcugggagagccuu

SEQ ID NO: 2930081 - RNA, 14 nt, Human
ucuuauugcccacg

SEQ ID NO: 2930082 - RNA, 18 nt, Human
ucuuauugcccacgcugg

SEQ ID NO: 2930083 - RNA, 22 nt, Human
ucuuauugcccacgcuggagug

SEQ ID NO: 2930084 - RNA, 14 nt, Human
ucuuaugggcuggg

SEQ ID NO: 2930085 - RNA, 16 nt, Human
ucuuaugggcuggguu

SEQ ID NO: 2930086 - RNA, 15 nt, Human
ucuuaugggcugggu

SEQ ID NO: 2930087 - RNA, 14 nt, Human
ucuuaauuaaaaga

SEQ ID NO: 2930088 - RNA, 21 nt, Human
ucuuaauuaaaagaauauuuu

SEQ ID NO: 2930089 - RNA, 18 nt, Human
ucuuaauuaaaagaauau

SEQ ID NO: 2930090 - RNA, 14 nt, Human
agacagucccugcc

SEQ ID NO: 2930091 - RNA, 15 nt, Human
agacagucccugcca

SEQ ID NO: 2930092 - RNA, 17 nt, Human
agacagucccugccaau

SEQ ID NO: 2930093 - RNA, 16 nt, Human
agacagucccugccaa

SEQ ID NO: 2930094 - RNA, 23 nt, Human
agacaggcaagcaccuccugccu

SEQ ID NO: 2930095 - RNA, 22 nt, Human
agacaggcaagcaccuccugcc

SEQ ID NO: 2930096 - RNA, 15 nt, Human
agacaggaccaggga

SEQ ID NO: 2930097 - RNA, 21 nt, Human
agacaggguuuugccauguug

SEQ ID NO: 2930098 - RNA, 20 nt, Human
agaauuugauaugugaacag

SEQ ID NO: 2930099 - RNA, 18 nt, Human
agaauuugauaugugaac

SEQ ID NO: 2930100 - RNA, 19 nt, Human
agaauuugauaugugaaca

SEQ ID NO: 2930101 - RNA, 17 nt, Human
agaauuugauaugugaa

SEQ ID NO: 2930102 - RNA, 18 nt, Human
ucuguuggccagugugac

SEQ ID NO: 2930103 - RNA, 19 nt, Human
ucuguuggccagugugaca

SEQ ID NO: 2930104 - RNA, 20 nt, Human
ucuguuggccagugugacaa

SEQ ID NO: 2930105 - RNA, 18 nt, Human
ucugucuuuuaaacucug

SEQ ID NO: 2930106 - RNA, 16 nt, Human
ucugugcguagaaguu

SEQ ID NO: 2930107 - RNA, 12 nt, Human
ucugucuuuuaa

SEQ ID NO: 2930108 - RNA, 16 nt, Human
ucugucuuuuaaacuc

SEQ ID NO: 2930109 - RNA, 21 nt, Human
ucugugaaaggaaagagggag

SEQ ID NO: 2930110 - RNA, 15 nt, Human
ucugugaaaggaaag

SEQ ID NO: 2930111 - RNA, 18 nt, Human
agaauuucccaaagcagu

SEQ ID NO: 2930112 - RNA, 17 nt, Human
agaauuucccaaagcag

SEQ ID NO: 2930113 - RNA, 13 nt, Human
agaauuucuagga

SEQ ID NO: 2930114 - RNA, 21 nt, Human
agaauuucuaggacugaauua

SEQ ID NO: 2930115 - RNA, 23 nt, Human
agaauuucccaaagcagugcaug

SEQ ID NO: 2930116 - RNA, 18 nt, Human
ucuguuuuauaauuuugu

SEQ ID NO: 2930117 - RNA, 11 nt, Human
ucuggggcugu

SEQ ID NO: 2930118 - RNA, 14 nt, Human
ucuggguucacugc

SEQ ID NO: 2930119 - RNA, 16 nt, Human
ucuggguucacugcaa

SEQ ID NO: 2930120 - RNA, 18 nt, Human
ucugguccauagagagca

SEQ ID NO: 2930121 - RNA, 20 nt, Human
ucugucauuugagcagggcu

SEQ ID NO: 2930122 - RNA, 23 nt, Human
ucugucauuugagcagggcucag

SEQ ID NO: 2930123 - RNA, 15 nt, Human
ucugucauuugagca

SEQ ID NO: 2930124 - RNA, 14 nt, Human
ugcagugagccgag

SEQ ID NO: 2930125 - RNA, 18 nt, Human
ugcagccucaaccuccug

SEQ ID NO: 2930126 - RNA, 19 nt, Human
ugcagccucaaccuccugg

SEQ ID NO: 2930127 - RNA, 17 nt, Human
agccucaaccuccuggg

SEQ ID NO: 2930128 - RNA, 18 nt, Human
agccucaaccuccugggc

SEQ ID NO: 2930129 - RNA, 13 nt, Human
agccucagcaucc

SEQ ID NO: 2930130 - RNA, 14 nt, Human
agccucagcauccu

SEQ ID NO: 2930131 - RNA, 15 nt, Human
agccucagcauccug

SEQ ID NO: 2930132 - RNA, 18 nt, Human
agccugagcgacagugag

SEQ ID NO: 2930133 - RNA, 17 nt, Human
ugcauacuauuaaacau

SEQ ID NO: 2930134 - RNA, 18 nt, Human
ugcauacuauuaaacaug

SEQ ID NO: 2930135 - RNA, 20 nt, Human
ugcauacuauuaaacaugcu

SEQ ID NO: 2930136 - RNA, 22 nt, Human
ugcauaccacuuuuguucuugg

SEQ ID NO: 2930137 - RNA, 12 nt, Human
ugcauacuauua

SEQ ID NO: 2930138 - RNA, 15 nt, Human
ugcauacuauuaaac

SEQ ID NO: 2930139 - RNA, 16 nt, Human
ugcauacuauuaaaca

SEQ ID NO: 2930140 - RNA, 21 nt, Human
ugcauaccacuuuuguucuug

SEQ ID NO: 2930141 - RNA, 13 nt, Human
ugcaugcuguccc

SEQ ID NO: 2930142 - RNA, 15 nt, Human
ugcaugcugucccuu

SEQ ID NO: 2930143 - RNA, 14 nt, Human
ugcaugcugucccu

SEQ ID NO: 2930144 - RNA, 21 nt, Human
ugcaugaggcuaguguggugu

SEQ ID NO: 2930145 - RNA, 22 nt, Human
ugcaugaaguaauaugcacaca

SEQ ID NO: 2930146 - RNA, 20 nt, Human
ugcaugaaguaauaugcaca

SEQ ID NO: 2930147 - RNA, 23 nt, Human
agccugcaguuauuaacacuaac

SEQ ID NO: 2930148 - RNA, 19 nt, Human
agccugccucuucucuacu

SEQ ID NO: 2930149 - RNA, 16 nt, Human
agccugccucuucucu

SEQ ID NO: 2930150 - RNA, 16 nt, Human
ugcaugcugucccuua

SEQ ID NO: 2930151 - RNA, 15 nt, Human
ugcacacacauauau

SEQ ID NO: 2930152 - RNA, 18 nt, Human
ugcacacacauauauuau

SEQ ID NO: 2930153 - RNA, 13 nt, Human
ugcacacacauau

SEQ ID NO: 2930154 - RNA, 17 nt, Human
ugcacaucuguuuugua

SEQ ID NO: 2930155 - RNA, 15 nt, Human
ugcacacaccagagc

SEQ ID NO: 2930156 - RNA, 16 nt, Human
ugcacaagcuccaagc

SEQ ID NO: 2930157 - RNA, 15 nt, Human
ugcacaagcuccaag

SEQ ID NO: 2930158 - RNA, 23 nt, Human
ugcacaagcuccaagcucccagg

SEQ ID NO: 2930159 - RNA, 22 nt, Human
ugcacaagcuccaagcucccag

SEQ ID NO: 2930160 - RNA, 20 nt, Human
ugcacaagcuccaagcuccc

SEQ ID NO: 2930161 - RNA, 18 nt, Human
ugcacaagcuccaagcuc

SEQ ID NO: 2930162 - RNA, 14 nt, Human
ugcaccacugcacu

SEQ ID NO: 2930163 - RNA, 19 nt, Human
ugcacguacacacacauac

SEQ ID NO: 2930164 - RNA, 13 nt, Human
ugcacuccccugc

SEQ ID NO: 2930165 - RNA, 12 nt, Human
ugcacuccccug

SEQ ID NO: 2930166 - RNA, 19 nt, Human
ugcagacucuacagaggcc

SEQ ID NO: 2930167 - RNA, 20 nt, Human
ugcagacucuacagaggcca

SEQ ID NO: 2930168 - RNA, 18 nt, Human
ugcagacucuacagaggc

SEQ ID NO: 2930169 - RNA, 15 nt, Human
ugcacuccccugcug

SEQ ID NO: 2930170 - RNA, 22 nt, Human
ugcagacucuacagaggccaug

SEQ ID NO: 2930171 - RNA, 17 nt, Human
agcccuucuuuccacag

SEQ ID NO: 2930172 - RNA, 15 nt, Human
agccucaaccuccug

SEQ ID NO: 2930173 - RNA, 15 nt, Human
agccuaggugacaga

SEQ ID NO: 2930174 - RNA, 17 nt, Human
agccuaggugacagagu

SEQ ID NO: 2930175 - RNA, 18 nt, Human
agcccuucuuuccacaga

SEQ ID NO: 2930176 - RNA, 19 nt, Human
agcccuucuuuccacagaa

SEQ ID NO: 2930177 - RNA, 12 nt, Human
agcuacugccau

SEQ ID NO: 2930178 - RNA, 13 nt, Human
agcuacugccauc

SEQ ID NO: 2930179 - RNA, 14 nt, Human
agcuacugccaucc

SEQ ID NO: 2930180 - RNA, 16 nt, Human
agcuacugccauccug

SEQ ID NO: 2930181 - RNA, 18 nt, Human
agcuacugccauccuggc

SEQ ID NO: 2930182 - RNA, 19 nt, Human
agcuacucgggaggcugag

SEQ ID NO: 2930183 - RNA, 15 nt, Human
agcuacucgggaggc

SEQ ID NO: 2930184 - RNA, 22 nt, Human
agcuacugccauccuggcccag

SEQ ID NO: 2930185 - RNA, 21 nt, Human
ugccauguuggccaggcuggu

SEQ ID NO: 2930186 - RNA, 20 nt, Human
ugccauguuggccaggcugg

SEQ ID NO: 2930187 - RNA, 17 nt, Human
ugccauguuggccaggc

SEQ ID NO: 2930188 - RNA, 17 nt, Human
agcucagggccuggcuc

SEQ ID NO: 2930189 - RNA, 18 nt, Human
ugccauguuggccaggcu

SEQ ID NO: 2930190 - RNA, 19 nt, Human
ugccauguuggccaggcug

SEQ ID NO: 2930191 - RNA, 16 nt, Human
agcucagggccuggcu

SEQ ID NO: 2930192 - RNA, 15 nt, Human
agcucagggccuggc

SEQ ID NO: 2930193 - RNA, 14 nt, Human
agcucagggccugg

SEQ ID NO: 2930194 - RNA, 12 nt, Human
ugcccaggcccc

SEQ ID NO: 2930195 - RNA, 20 nt, Human
ugcccaggccccugccaccc

SEQ ID NO: 2930196 - RNA, 22 nt, Human
ugcccaggccccugccacccug

SEQ ID NO: 2930197 - RNA, 14 nt, Human
ugcccacaggauca

SEQ ID NO: 2930198 - RNA, 15 nt, Human
ugcccaggcaggucu

SEQ ID NO: 2930199 - RNA, 16 nt, Human
ugcccaggcaggucuu

SEQ ID NO: 2930200 - RNA, 17 nt, Human
ugcccaggcaggucuug

SEQ ID NO: 2930201 - RNA, 20 nt, Human
ugcccaggcaggucuugaac

SEQ ID NO: 2930202 - RNA, 11 nt, Human
ugcccaggccc

SEQ ID NO: 2930203 - RNA, 13 nt, Human
ugcccccugugga

SEQ ID NO: 2930204 - RNA, 19 nt, Human
ugcccccuguggaugcugc

SEQ ID NO: 2930205 - RNA, 21 nt, Human
ugcccccuguggaugcugcug

SEQ ID NO: 2930206 - RNA, 19 nt, Human
ugcccucaagagcaaagua

SEQ ID NO: 2930207 - RNA, 14 nt, Human
agcgcccaguuggg

SEQ ID NO: 2930208 - RNA, 22 nt, Human
agcgcccaguuggguggaugcc

SEQ ID NO: 2930209 - RNA, 19 nt, Human
ugcauuugaaaauuuugau

SEQ ID NO: 2930210 - RNA, 23 nt, Human
ugcauuugaaaauuuugauguuu

SEQ ID NO: 2930211 - RNA, 23 nt, Human
ugccaauauccuaauaaaaaggu

SEQ ID NO: 2930212 - RNA, 21 nt, Human
ugccaauauccuaauaaaaag

SEQ ID NO: 2930213 - RNA, 19 nt, Human
ugccaauauccuaauaaaa

SEQ ID NO: 2930214 - RNA, 18 nt, Human
ugccaauauccuaauaaa

SEQ ID NO: 2930215 - RNA, 17 nt, Human
ugccaauauccuaauaa

SEQ ID NO: 2930216 - RNA, 16 nt, Human
ugccaauauccuaaua

SEQ ID NO: 2930217 - RNA, 15 nt, Human
ugccaauauccuaau

SEQ ID NO: 2930218 - RNA, 23 nt, Human
ugccagucaccccggccaccugc

SEQ ID NO: 2930219 - RNA, 22 nt, Human
ugccagucaccccggccaccug

SEQ ID NO: 2930220 - RNA, 16 nt, Human
ugccauauucuguugg

SEQ ID NO: 2930221 - RNA, 17 nt, Human
ugccauauucuguuggc

SEQ ID NO: 2930222 - RNA, 15 nt, Human
ugccauauucuguug

SEQ ID NO: 2930223 - RNA, 20 nt, Human
ugccagucaccccggccacc

SEQ ID NO: 2930224 - RNA, 18 nt, Human
ugccagucaccccggcca

SEQ ID NO: 2930225 - RNA, 16 nt, Human
ugccagucaccccggc

SEQ ID NO: 2930226 - RNA, 15 nt, Human
ugccagucaccccgg

SEQ ID NO: 2930227 - RNA, 13 nt, Human
agcgugagccacu

SEQ ID NO: 2930228 - RNA, 15 nt, Human
agcgugagccacugc

SEQ ID NO: 2930229 - RNA, 16 nt, Human
agcggggacagcuccu

SEQ ID NO: 2930230 - RNA, 17 nt, Human
agcggggacagcuccuu

SEQ ID NO: 2930231 - RNA, 15 nt, Human
agcggggacagcucc

SEQ ID NO: 2930232 - RNA, 20 nt, Human
ugccauauucuguuggccag

SEQ ID NO: 2930233 - RNA, 21 nt, Human
ugccauauucuguuggccagu

SEQ ID NO: 2930234 - RNA, 16 nt, Human
agcgugagccacugca

SEQ ID NO: 2930235 - RNA, 17 nt, Human
agcgugagccacugcac

SEQ ID NO: 2930236 - RNA, 20 nt, Human
agcgugguggacaugcacag

SEQ ID NO: 2930237 - RNA, 23 nt, Human
agcgugguggacaugcacagcua

SEQ ID NO: 2930238 - RNA, 19 nt, Human
agcuacuaauuuuaaaaug

SEQ ID NO: 2930239 - RNA, 19 nt, Human
ugcgaaaggaugaaaguga

SEQ ID NO: 2930240 - RNA, 18 nt, Human
ugcggacagccacggcca

SEQ ID NO: 2930241 - RNA, 17 nt, Human
ugcggacagccacggcc

SEQ ID NO: 2930242 - RNA, 13 nt, Human
ugcgaaaggauga

SEQ ID NO: 2930243 - RNA, 15 nt, Human
ugccuguucagcucc

SEQ ID NO: 2930244 - RNA, 16 nt, Human
ugccuguucagcucca

SEQ ID NO: 2930245 - RNA, 23 nt, Human
agcugggaugauuggagggggga

SEQ ID NO: 2930246 - RNA, 17 nt, Human
agcugggacuacaggug

SEQ ID NO: 2930247 - RNA, 19 nt, Human
agcugggacuacaggugug

SEQ ID NO: 2930248 - RNA, 14 nt, Human
agcugggcagguug

SEQ ID NO: 2930249 - RNA, 22 nt, Human
ugccucugacacacagcucugu

SEQ ID NO: 2930250 - RNA, 17 nt, Human
agcugccuccccuccuc

SEQ ID NO: 2930251 - RNA, 18 nt, Human
agcugccuccccuccucu

SEQ ID NO: 2930252 - RNA, 19 nt, Human
agcugccuccccuccucug

SEQ ID NO: 2930253 - RNA, 20 nt, Human
agcugccuccccuccucugc

SEQ ID NO: 2930254 - RNA, 21 nt, Human
agcugccuccccuccucugcu

SEQ ID NO: 2930255 - RNA, 22 nt, Human
agcugccuccccuccucugcuu

SEQ ID NO: 2930256 - RNA, 23 nt, Human
agcugccuccccuccucugcuug

SEQ ID NO: 2930257 - RNA, 13 nt, Human
agcuggaaaagua

SEQ ID NO: 2930258 - RNA, 19 nt, Human
agcugccugggaucccuca

SEQ ID NO: 2930259 - RNA, 13 nt, Human
agcugccugggau

SEQ ID NO: 2930260 - RNA, 21 nt, Human
agcugccugggaucccucauc

SEQ ID NO: 2930261 - RNA, 20 nt, Human
ugccucugacacacagcucu

SEQ ID NO: 2930262 - RNA, 21 nt, Human
ugccucugacacacagcucug

SEQ ID NO: 2930263 - RNA, 15 nt, Human
ugccucucucaggcc

SEQ ID NO: 2930264 - RNA, 14 nt, Human
ugccucucucaggc

SEQ ID NO: 2930265 - RNA, 13 nt, Human
ugccucucucagg

SEQ ID NO: 2930266 - RNA, 19 nt, Human
ugccucccaucacccgcua

SEQ ID NO: 2930267 - RNA, 14 nt, Human
ugccucccaucacc

SEQ ID NO: 2930268 - RNA, 13 nt, Human
ugccucccaucac

SEQ ID NO: 2930269 - RNA, 18 nt, Human
agcugcauacaguuugca

SEQ ID NO: 2930270 - RNA, 13 nt, Human
agcugccaccugc

SEQ ID NO: 2930271 - RNA, 17 nt, Human
agcugcacccucaggca

SEQ ID NO: 2930272 - RNA, 13 nt, Human
agcugcacccuca

SEQ ID NO: 2930273 - RNA, 22 nt, Human
agcugcacccucaggcaggugg

SEQ ID NO: 2930274 - RNA, 20 nt, Human
agcugcacccucaggcaggu

SEQ ID NO: 2930275 - RNA, 19 nt, Human
agcugcacccucaggcagg

SEQ ID NO: 2930276 - RNA, 18 nt, Human
agcugcacccucaggcag

SEQ ID NO: 2930277 - RNA, 20 nt, Human
agcugaucgcuucuccccca

SEQ ID NO: 2930278 - RNA, 18 nt, Human
agcucuucuccaggcugu

SEQ ID NO: 2930279 - RNA, 17 nt, Human
agcucuucuccaggcug

SEQ ID NO: 2930280 - RNA, 12 nt, Human
agcucuguccug

SEQ ID NO: 2930281 - RNA, 12 nt, Human
agcucugcuccu

SEQ ID NO: 2930282 - RNA, 22 nt, Human
agcucugcuccucuccccagca

SEQ ID NO: 2930283 - RNA, 20 nt, Human
agcucugguccauagagagc

SEQ ID NO: 2930284 - RNA, 16 nt, Human
agcucucuccucccuu

SEQ ID NO: 2930285 - RNA, 22 nt, Human
ugcccuccaagaccuucuccuu

SEQ ID NO: 2930286 - RNA, 20 nt, Human
ugcccuccaagaccuucucc

SEQ ID NO: 2930287 - RNA, 19 nt, Human
ugcccuccaagaccuucuc

SEQ ID NO: 2930288 - RNA, 15 nt, Human
agcuuaucucagggg

SEQ ID NO: 2930289 - RNA, 14 nt, Human
agcuuaucucaggg

SEQ ID NO: 2930290 - RNA, 12 nt, Human
agcuuaucucag

SEQ ID NO: 2930291 - RNA, 20 nt, Human
ugcggacagccacggccagg

SEQ ID NO: 2930292 - RNA, 21 nt, Human
ugcggacagccacggccaggc

SEQ ID NO: 2930293 - RNA, 18 nt, Human
agcuuguaaauagcucag

SEQ ID NO: 2930294 - RNA, 19 nt, Human
agcuuguaaauagcucagg

SEQ ID NO: 2930295 - RNA, 20 nt, Human
agcuuguaaauagcucaggu

SEQ ID NO: 2930296 - RNA, 21 nt, Human
agcuuguaaauagcucaggug

SEQ ID NO: 2930297 - RNA, 21 nt, Human
agcuuauugucuagugaaacu

SEQ ID NO: 2930298 - RNA, 15 nt, Human
agcuuauuaaaacuc

SEQ ID NO: 2930299 - RNA, 20 nt, Human
agcuuauuaaaacucauuuu

SEQ ID NO: 2930300 - RNA, 21 nt, Human
aggaaacccagcucuggucca

SEQ ID NO: 2930301 - RNA, 20 nt, Human
aggaaacccagcucuggucc

SEQ ID NO: 2930302 - RNA, 18 nt, Human
aggaaacccagcucuggu

SEQ ID NO: 2930303 - RNA, 15 nt, Human
aggaaacccagcucu

SEQ ID NO: 2930304 - RNA, 17 nt, Human
aggaaacccagcucugg

SEQ ID NO: 2930305 - RNA, 16 nt, Human
aggaaacccagcucug

SEQ ID NO: 2930306 - RNA, 19 nt, Human
agcuuugaaaauucagugg

SEQ ID NO: 2930307 - RNA, 18 nt, Human
agcuuugaaaauucagug

SEQ ID NO: 2930308 - RNA, 16 nt, Human
agcuuugaaaauucag

SEQ ID NO: 2930309 - RNA, 12 nt, Human
agcuuugaaaau

SEQ ID NO: 2930310 - RNA, 13 nt, Human
aggaaagagaacu

SEQ ID NO: 2930311 - RNA, 19 nt, Human
aggaaagagaacuuccaga

SEQ ID NO: 2930312 - RNA, 13 nt, Human
aggaaagaggcuc

SEQ ID NO: 2930313 - RNA, 12 nt, Human
aggaaagaggcu

SEQ ID NO: 2930314 - RNA, 14 nt, Human
ugcuaguaauugga

SEQ ID NO: 2930315 - RNA, 17 nt, Human
aggaaagcaaaggagau

SEQ ID NO: 2930316 - RNA, 16 nt, Human
aggaaagaggcucugg

SEQ ID NO: 2930317 - RNA, 16 nt, Human
ugcuaguaauuggaaa

SEQ ID NO: 2930318 - RNA, 19 nt, Human
ugcucugaucauccacugu

SEQ ID NO: 2930319 - RNA, 22 nt, Human
ugcucugaucauccacugugcc

SEQ ID NO: 2930320 - RNA, 17 nt, Human
ugcugacuguuuucucu

SEQ ID NO: 2930321 - RNA, 17 nt, Human
ugcucuggacaggcaug

SEQ ID NO: 2930322 - RNA, 15 nt, Human
ugcucugcauguuac

SEQ ID NO: 2930323 - RNA, 18 nt, Human
ugcucugcauguuacaua

SEQ ID NO: 2930324 - RNA, 23 nt, Human
aggaaagcaaaucaguuugguug

SEQ ID NO: 2930325 - RNA, 19 nt, Human
aggaaagcaaaggagauug

SEQ ID NO: 2930326 - RNA, 16 nt, Human
ugcugacuguuuucuc

SEQ ID NO: 2930327 - RNA, 24 nt, Human
ugcugacuguuuucucuugagagg

SEQ ID NO: 2930328 - RNA, 21 nt, Human
ugcugacuguuuucucuugag

SEQ ID NO: 2930329 - RNA, 20 nt, Human
aggaaaggcuccaggagcag

SEQ ID NO: 2930330 - RNA, 18 nt, Human
aggaaaggcuccaggagc

SEQ ID NO: 2930331 - RNA, 14 nt, Human
aggaaauauuuauu

SEQ ID NO: 2930332 - RNA, 18 nt, Human
aggaaauauuuauuuuaa

SEQ ID NO: 2930333 - RNA, 13 nt, Human
aggaaauauuuau

SEQ ID NO: 2930334 - RNA, 22 nt, Human
aggaaaggcuccaggagcagcc

SEQ ID NO: 2930335 - RNA, 21 nt, Human
ugcugccauccagguucagcu

SEQ ID NO: 2930336 - RNA, 22 nt, Human
ugcugccauccagguucagcuu

SEQ ID NO: 2930337 - RNA, 12 nt, Human
ugcugccaucca

SEQ ID NO: 2930338 - RNA, 13 nt, Human
ugcugccauccag

SEQ ID NO: 2930339 - RNA, 14 nt, Human
ugcugccauccagg

SEQ ID NO: 2930340 - RNA, 15 nt, Human
ugcugccauccaggu

SEQ ID NO: 2930341 - RNA, 11 nt, Human
ugcugccaucc

SEQ ID NO: 2930342 - RNA, 23 nt, Human
ugcugccaauauccuaauaaaaa

SEQ ID NO: 2930343 - RNA, 15 nt, Human
aggaaugcaaagaug

SEQ ID NO: 2930344 - RNA, 17 nt, Human
aggaagcucagggccug

SEQ ID NO: 2930345 - RNA, 22 nt, Human
aggaagcucagggccuggcuca

SEQ ID NO: 2930346 - RNA, 18 nt, Human
aggaagcucagggccugg

SEQ ID NO: 2930347 - RNA, 14 nt, Human
aggaagagaaaaaa

SEQ ID NO: 2930348 - RNA, 15 nt, Human
aggaagacuuuggaa

SEQ ID NO: 2930349 - RNA, 23 nt, Human
aggaauccagacccggcugcgug

SEQ ID NO: 2930350 - RNA, 19 nt, Human
aggaauugacccacaagaa

SEQ ID NO: 2930351 - RNA, 21 nt, Human
uggagcucgugggacagucac

SEQ ID NO: 2930352 - RNA, 15 nt, Human
aggcaaugcuggcug

SEQ ID NO: 2930353 - RNA, 16 nt, Human
aggcaaugcuggcugu

SEQ ID NO: 2930354 - RNA, 22 nt, Human
uggacuuuguuaguuucuccaa

SEQ ID NO: 2930355 - RNA, 11 nt, Human
uggacuuuguu

SEQ ID NO: 2930356 - RNA, 16 nt, Human
uggagaagaacugaaa

SEQ ID NO: 2930357 - RNA, 14 nt, Human
uggagaagaacuga

SEQ ID NO: 2930358 - RNA, 24 nt, Human
uggacuuuguuaguuucuccaagc

SEQ ID NO: 2930359 - RNA, 22 nt, Human
aggcagccccauucugccugcc

SEQ ID NO: 2930360 - RNA, 19 nt, Human
aggcagccccauucugccu

SEQ ID NO: 2930361 - RNA, 20 nt, Human
aggcagccccauucugccug

SEQ ID NO: 2930362 - RNA, 21 nt, Human
aggcagccccauucugccugc

SEQ ID NO: 2930363 - RNA, 15 nt, Human
aggcaggagacuggc

SEQ ID NO: 2930364 - RNA, 18 nt, Human
aggcaggagacuggcgug

SEQ ID NO: 2930365 - RNA, 12 nt, Human
aggcaggauggc

SEQ ID NO: 2930366 - RNA, 21 nt, Human
aggcaggucuugaacuccugg

SEQ ID NO: 2930367 - RNA, 22 nt, Human
aggcagggucucacucugucgc

SEQ ID NO: 2930368 - RNA, 14 nt, Human
aggcagguccaggg

SEQ ID NO: 2930369 - RNA, 19 nt, Human
aggcagggucucacucugu

SEQ ID NO: 2930370 - RNA, 18 nt, Human
aggcagggucucacucug

SEQ ID NO: 2930371 - RNA, 20 nt, Human
aggcagggucucacucuguc

SEQ ID NO: 2930372 - RNA, 21 nt, Human
aggcagggucucacucugucg

SEQ ID NO: 2930373 - RNA, 18 nt, Human
uggaaguacuauaauuua

SEQ ID NO: 2930374 - RNA, 20 nt, Human
uggaaguacuauaauuuacc

SEQ ID NO: 2930375 - RNA, 13 nt, Human
uggaagcuccgcu

SEQ ID NO: 2930376 - RNA, 14 nt, Human
uggaacacucugag

SEQ ID NO: 2930377 - RNA, 12 nt, Human
uggaacacucug

SEQ ID NO: 2930378 - RNA, 19 nt, Human
uggaacacucuauaacaaa

SEQ ID NO: 2930379 - RNA, 12 nt, Human
ugcugcccugcc

SEQ ID NO: 2930380 - RNA, 22 nt, Human
ugcugccccugcacagcaggcu

SEQ ID NO: 2930381 - RNA, 10 nt, Human
ugcugcccug

SEQ ID NO: 2930382 - RNA, 21 nt, Human
ugcugccccugcacagcaggc

SEQ ID NO: 2930383 - RNA, 20 nt, Human
ugcugccccugcacagcagg

SEQ ID NO: 2930384 - RNA, 15 nt, Human
aggaggccagccuug

SEQ ID NO: 2930385 - RNA, 21 nt, Human
aggaguuugagaccaaccugg

SEQ ID NO: 2930386 - RNA, 13 nt, Human
aggaguuuggcca

SEQ ID NO: 2930387 - RNA, 12 nt, Human
aggaguuuggcc

SEQ ID NO: 2930388 - RNA, 22 nt, Human
aggauugcuacuguccuaccca

SEQ ID NO: 2930389 - RNA, 18 nt, Human
aggaugcuuguacauaau

SEQ ID NO: 2930390 - RNA, 12 nt, Human
aggaucagucug

SEQ ID NO: 2930391 - RNA, 21 nt, Human
aggauccugagccagauuuca

SEQ ID NO: 2930392 - RNA, 15 nt, Human
aggaugcuuguacau

SEQ ID NO: 2930393 - RNA, 16 nt, Human
aggaugcuuguacaua

SEQ ID NO: 2930394 - RNA, 14 nt, Human
uggacaaaauggaa

SEQ ID NO: 2930395 - RNA, 17 nt, Human
uggacaaaauggaauac

SEQ ID NO: 2930396 - RNA, 15 nt, Human
uggacaccggaaaca

SEQ ID NO: 2930397 - RNA, 14 nt, Human
aggcaagcaccucc

SEQ ID NO: 2930398 - RNA, 19 nt, Human
aggcaacugcauuggcuuu

SEQ ID NO: 2930399 - RNA, 16 nt, Human
aggcccagagggccug

SEQ ID NO: 2930400 - RNA, 15 nt, Human
aggcccagagggccu

SEQ ID NO: 2930401 - RNA, 18 nt, Human
aggccaugggccuccugu

SEQ ID NO: 2930402 - RNA, 23 nt, Human
aggccagagacacaagccuucgg

SEQ ID NO: 2930403 - RNA, 15 nt, Human
uggcagcucagagag

SEQ ID NO: 2930404 - RNA, 14 nt, Human
uggcagcucagaga

SEQ ID NO: 2930405 - RNA, 18 nt, Human
aggccagagacacaagcc

SEQ ID NO: 2930406 - RNA, 13 nt, Human
aggccagagacac

SEQ ID NO: 2930407 - RNA, 16 nt, Human
uggcagcucagagagg

SEQ ID NO: 2930408 - RNA, 17 nt, Human
uggcaccagcagccugg

SEQ ID NO: 2930409 - RNA, 16 nt, Human
uggcaccagcagccug

SEQ ID NO: 2930410 - RNA, 13 nt, Human
aggccuggccaga

SEQ ID NO: 2930411 - RNA, 12 nt, Human
aggccuggccag

SEQ ID NO: 2930412 - RNA, 14 nt, Human
aggcccggcuccag

SEQ ID NO: 2930413 - RNA, 15 nt, Human
aggcccggcuccagg

SEQ ID NO: 2930414 - RNA, 16 nt, Human
aggcccggcuccaggc

SEQ ID NO: 2930415 - RNA, 13 nt, Human
aggccccugccac

SEQ ID NO: 2930416 - RNA, 15 nt, Human
aggccccugccaccc

SEQ ID NO: 2930417 - RNA, 20 nt, Human
aggcccagagggccugcaag

SEQ ID NO: 2930418 - RNA, 19 nt, Human
aggcccagagggccugcaa

SEQ ID NO: 2930419 - RNA, 17 nt, Human
aggccccugccacccug

SEQ ID NO: 2930420 - RNA, 18 nt, Human
aggccccugccacccugg

SEQ ID NO: 2930421 - RNA, 12 nt, Human
aggccccugcca

SEQ ID NO: 2930422 - RNA, 21 nt, Human
aggccccugccacccugggga

SEQ ID NO: 2930423 - RNA, 18 nt, Human
uggccugagcugggauga

SEQ ID NO: 2930424 - RNA, 20 nt, Human
uggccucugcacuccccugc

SEQ ID NO: 2930425 - RNA, 18 nt, Human
uggccucugcacuccccu

SEQ ID NO: 2930426 - RNA, 19 nt, Human
uggccucugcacuccccug

SEQ ID NO: 2930427 - RNA, 22 nt, Human
uggcaugggaaugaaugucagu

SEQ ID NO: 2930428 - RNA, 19 nt, Human
uggcccacgcacuucggga

SEQ ID NO: 2930429 - RNA, 14 nt, Human
uggcccacugcauc

SEQ ID NO: 2930430 - RNA, 13 nt, Human
uggcccacugcau

SEQ ID NO: 2930431 - RNA, 11 nt, Human
uggcccaggag

SEQ ID NO: 2930432 - RNA, 12 nt, Human
uggcccaggagu

SEQ ID NO: 2930433 - RNA, 15 nt, Human
aggcuauuccugaga

SEQ ID NO: 2930434 - RNA, 20 nt, Human
aggcuauuccugagagcugc

SEQ ID NO: 2930435 - RNA, 22 nt, Human
aggcuauuccugagagcugcau

SEQ ID NO: 2930436 - RNA, 17 nt, Human
aggccuucucugaagga

SEQ ID NO: 2930437 - RNA, 18 nt, Human
aggccuucucugaaggac

SEQ ID NO: 2930438 - RNA, 13 nt, Human
aggcuccaggagc

SEQ ID NO: 2930439 - RNA, 16 nt, Human
aggcuccaggagcagc

SEQ ID NO: 2930440 - RNA, 14 nt, Human
aggcuccaggagca

SEQ ID NO: 2930441 - RNA, 11 nt, Human
aggcuccacuu

SEQ ID NO: 2930442 - RNA, 17 nt, Human
aggcuccacuuggucug

SEQ ID NO: 2930443 - RNA, 21 nt, Human
aggcuccacuuggucugugag

SEQ ID NO: 2930444 - RNA, 22 nt, Human
aggcuccacuuggucugugaga

SEQ ID NO: 2930445 - RNA, 12 nt, Human
agggcccagaga

SEQ ID NO: 2930446 - RNA, 13 nt, Human
agggcccagagag

SEQ ID NO: 2930447 - RNA, 23 nt, Human
agggaguccgaaagggacuugga

SEQ ID NO: 2930448 - RNA, 20 nt, Human
agggagugacagaggcagcc

SEQ ID NO: 2930449 - RNA, 20 nt, Human
agggagugaguugauagcac

SEQ ID NO: 2930450 - RNA, 20 nt, Human
agggaguccgaaagggacuu

SEQ ID NO: 2930451 - RNA, 22 nt, Human
agggagggcuccagacacaugu

SEQ ID NO: 2930452 - RNA, 17 nt, Human
agggagggagggcucca

SEQ ID NO: 2930453 - RNA, 12 nt, Human
agggagggcucc

SEQ ID NO: 2930454 - RNA, 19 nt, Human
agggagggcuccagacaca

SEQ ID NO: 2930455 - RNA, 17 nt, Human
agggagggcuccagaca

SEQ ID NO: 2930456 - RNA, 14 nt, Human
agggcccagagagg

SEQ ID NO: 2930457 - RNA, 20 nt, Human
agggcuccagacacaugucc

SEQ ID NO: 2930458 - RNA, 21 nt, Human
ugggcucccuucccaccucuc

SEQ ID NO: 2930459 - RNA, 15 nt, Human
ugggcucccuuccca

SEQ ID NO: 2930460 - RNA, 14 nt, Human
ugggcucccuuccc

SEQ ID NO: 2930461 - RNA, 22 nt, Human
agggcuguuauaaucuuucaca

SEQ ID NO: 2930462 - RNA, 18 nt, Human
agggacuuggaagcuccg

SEQ ID NO: 2930463 - RNA, 19 nt, Human
agggacuuggaagcuccgc

SEQ ID NO: 2930464 - RNA, 15 nt, Human
agggacuuggaagcu

SEQ ID NO: 2930465 - RNA, 23 nt, Human
agggacuucugucuucacaacag

SEQ ID NO: 2930466 - RNA, 20 nt, Human
agggacuuggaagcuccgcu

SEQ ID NO: 2930467 - RNA, 14 nt, Human
agggagagaagaua

SEQ ID NO: 2930468 - RNA, 13 nt, Human
agggagagaagau

SEQ ID NO: 2930469 - RNA, 18 nt, Human
ugggacuacaggcaccca

SEQ ID NO: 2930470 - RNA, 16 nt, Human
ugggacuacaggugug

SEQ ID NO: 2930471 - RNA, 18 nt, Human
ugggacucaaugcacuga

SEQ ID NO: 2930472 - RNA, 14 nt, Human
ugggcaacagagca

SEQ ID NO: 2930473 - RNA, 19 nt, Human
ugggcaacagagcaagacu

SEQ ID NO: 2930474 - RNA, 15 nt, Human
ugggcaacagagcaa

SEQ ID NO: 2930475 - RNA, 21 nt, Human
ugggcaacccccagccugcua

SEQ ID NO: 2930476 - RNA, 13 nt, Human
ugggcagaaggaa

SEQ ID NO: 2930477 - RNA, 20 nt, Human
ugggcagaaggaagacuuca

SEQ ID NO: 2930478 - RNA, 16 nt, Human
ugggcagaaggaagac

SEQ ID NO: 2930479 - RNA, 14 nt, Human
ugggcauucaaaug

SEQ ID NO: 2930480 - RNA, 13 nt, Human
ugggcauucaaau

SEQ ID NO: 2930481 - RNA, 23 nt, Human
ugggcagaaggaagacuucaucc

SEQ ID NO: 2930482 - RNA, 19 nt, Human
ugggaggcugagaugggag

SEQ ID NO: 2930483 - RNA, 21 nt, Human
ugggagaaccaaaaagaggcu

SEQ ID NO: 2930484 - RNA, 21 nt, Human
ugggaggauugcuugagcuca

SEQ ID NO: 2930485 - RNA, 18 nt, Human
ugggaggauugcuugagc

SEQ ID NO: 2930486 - RNA, 22 nt, Human
ugggaggauugcuugagcucag

SEQ ID NO: 2930487 - RNA, 17 nt, Human
aggcugggggaagaagc

SEQ ID NO: 2930488 - RNA, 22 nt, Human
aggcugggcuucaguggcagcu

SEQ ID NO: 2930489 - RNA, 23 nt, Human
aggcugggcuucaguggcagcug

SEQ ID NO: 2930490 - RNA, 18 nt, Human
aggcugggcuucaguggc

SEQ ID NO: 2930491 - RNA, 19 nt, Human
aggcugggcuucaguggca

SEQ ID NO: 2930492 - RNA, 20 nt, Human
aggcugggcuucaguggcag

SEQ ID NO: 2930493 - RNA, 21 nt, Human
aggcugggcuucaguggcagc

SEQ ID NO: 2930494 - RNA, 17 nt, Human
aggcuggguucugaucc

SEQ ID NO: 2930495 - RNA, 14 nt, Human
aggcuggguucuga

SEQ ID NO: 2930496 - RNA, 22 nt, Human
aggcugggggaagaagcucucu

SEQ ID NO: 2930497 - RNA, 13 nt, Human
aggcugggcuccc

SEQ ID NO: 2930498 - RNA, 18 nt, Human
aggcugggcucccuuccc

SEQ ID NO: 2930499 - RNA, 14 nt, Human
aggcugggcucccu

SEQ ID NO: 2930500 - RNA, 14 nt, Human
aggcugggcuucag

SEQ ID NO: 2930501 - RNA, 23 nt, Human
aggcugggcucccuucccaccuc

SEQ ID NO: 2930502 - RNA, 21 nt, Human
aggcugggcucccuucccacc

SEQ ID NO: 2930503 - RNA, 22 nt, Human
aggcugggagagccuuccaggg

SEQ ID NO: 2930504 - RNA, 21 nt, Human
aggcugggagagccuuccagg

SEQ ID NO: 2930505 - RNA, 20 nt, Human
aggcugggagagccuuccag

SEQ ID NO: 2930506 - RNA, 20 nt, Human
ugggaacccaaguccaagca

SEQ ID NO: 2930507 - RNA, 16 nt, Human
aggcugggagagccuu

SEQ ID NO: 2930508 - RNA, 19 nt, Human
aggcugggagagccuucca

SEQ ID NO: 2930509 - RNA, 22 nt, Human
aggcuuagucacugagacagcc

SEQ ID NO: 2930510 - RNA, 21 nt, Human
aggcuuagucacugagacagc

SEQ ID NO: 2930511 - RNA, 23 nt, Human
aggcuuagucacugagacagccc

SEQ ID NO: 2930512 - RNA, 19 nt, Human
aggcuuagugauguaauua

SEQ ID NO: 2930513 - RNA, 17 nt, Human
aggcuuagugauguaau

SEQ ID NO: 2930514 - RNA, 18 nt, Human
aggcuuagugauguaauu

SEQ ID NO: 2930515 - RNA, 15 nt, Human
agggaaacugccagc

SEQ ID NO: 2930516 - RNA, 14 nt, Human
agggaaacugccag

SEQ ID NO: 2930517 - RNA, 23 nt, Human
agggaaacugccagcaacgcagg

SEQ ID NO: 2930518 - RNA, 21 nt, Human
agggaaacugccagcaacgca

SEQ ID NO: 2930519 - RNA, 19 nt, Human
agggaaacugccagcaacg

SEQ ID NO: 2930520 - RNA, 16 nt, Human
agggaaacugccagca

SEQ ID NO: 2930521 - RNA, 23 nt, Human
uggcuguuggcugggggccucag

SEQ ID NO: 2930522 - RNA, 14 nt, Human
uggcuucacggaag

SEQ ID NO: 2930523 - RNA, 16 nt, Human
uggcuguuggcugggg

SEQ ID NO: 2930524 - RNA, 18 nt, Human
uggcuguuggcugggggc

SEQ ID NO: 2930525 - RNA, 14 nt, Human
uggcugugaacuga

SEQ ID NO: 2930526 - RNA, 23 nt, Human
uggcugcaaaggguaucaggugc

SEQ ID NO: 2930527 - RNA, 16 nt, Human
ugggaaagcauuguaa

SEQ ID NO: 2930528 - RNA, 14 nt, Human
ugggaaagcauugu

SEQ ID NO: 2930529 - RNA, 18 nt, Human
ugggaaagcauuguaaau

SEQ ID NO: 2930530 - RNA, 17 nt, Human
ugggaaagcauuguaaa

SEQ ID NO: 2930531 - RNA, 21 nt, Human
uggcuuuugugcauuaucuag

SEQ ID NO: 2930532 - RNA, 18 nt, Human
ugggaaacaaaaggauaa

SEQ ID NO: 2930533 - RNA, 15 nt, Human
uggcuuuugugcauu

SEQ ID NO: 2930534 - RNA, 16 nt, Human
uggcuuuugugcauua

SEQ ID NO: 2930535 - RNA, 20 nt, Human
uggcuucacggaagagccuu

SEQ ID NO: 2930536 - RNA, 17 nt, Human
uggcuucacggaagagc

SEQ ID NO: 2930537 - RNA, 13 nt, Human
uggcucacccagu

SEQ ID NO: 2930538 - RNA, 16 nt, Human
uggcucacccaguccu

SEQ ID NO: 2930539 - RNA, 13 nt, Human
uggcucacgccug

SEQ ID NO: 2930540 - RNA, 23 nt, Human
uggcuauaggugcuacaaaaaca

SEQ ID NO: 2930541 - RNA, 14 nt, Human
uggcuaaauucaug

SEQ ID NO: 2930542 - RNA, 18 nt, Human
uggcuaagcaaaauguga

SEQ ID NO: 2930543 - RNA, 23 nt, Human
aggcuccaggagcagccacauuc

SEQ ID NO: 2930544 - RNA, 19 nt, Human
aggcuccaggagcagccac

SEQ ID NO: 2930545 - RNA, 18 nt, Human
aggcuccaggagcagcca

SEQ ID NO: 2930546 - RNA, 17 nt, Human
aggcuccaggagcagcc

SEQ ID NO: 2930547 - RNA, 16 nt, Human
uggcuaacuuggguua

SEQ ID NO: 2930548 - RNA, 17 nt, Human
uggcuaauguacugcau

SEQ ID NO: 2930549 - RNA, 19 nt, Human
uggcuaauguacugcauau

SEQ ID NO: 2930550 - RNA, 19 nt, Human
uggcuauaggugcuacaaa

SEQ ID NO: 2930551 - RNA, 15 nt, Human
uggcuauaggugcua

SEQ ID NO: 2930552 - RNA, 14 nt, Human
agucaggaaagaga

SEQ ID NO: 2930553 - RNA, 20 nt, Human
ugucggccccaccagugccu

SEQ ID NO: 2930554 - RNA, 21 nt, Human
ugucggccccaccagugccuc

SEQ ID NO: 2930555 - RNA, 22 nt, Human
ugucggccccaccagugccucu

SEQ ID NO: 2930556 - RNA, 23 nt, Human
ugucggccccaccagugccucuc

SEQ ID NO: 2930557 - RNA, 23 nt, Human
ugucccuuacgugaguccuggca

SEQ ID NO: 2930558 - RNA, 19 nt, Human
ugucccuuacgugaguccu

SEQ ID NO: 2930559 - RNA, 19 nt, Human
agucccagcuacucgggag

SEQ ID NO: 2930560 - RNA, 18 nt, Human
agucccaccuuggcugca

SEQ ID NO: 2930561 - RNA, 19 nt, Human
agucccaccuuggcugcag

SEQ ID NO: 2930562 - RNA, 15 nt, Human
agucccaccuuggcu

SEQ ID NO: 2930563 - RNA, 16 nt, Human
agucccaccuuggcug

SEQ ID NO: 2930564 - RNA, 23 nt, Human
agucucacuguugcccaggcugg

SEQ ID NO: 2930565 - RNA, 15 nt, Human
agucuauuuacggaa

SEQ ID NO: 2930566 - RNA, 20 nt, Human
agucuauuuacggaacucaa

SEQ ID NO: 2930567 - RNA, 20 nt, Human
agucuagguugguagaguuu

SEQ ID NO: 2930568 - RNA, 22 nt, Human
ugucucaguccaugaagaugua

SEQ ID NO: 2930569 - RNA, 21 nt, Human
agucucacuguugcccaggcu

SEQ ID NO: 2930570 - RNA, 13 nt, Human
agucucaggaaau

SEQ ID NO: 2930571 - RNA, 16 nt, Human
aguccccucuccucca

SEQ ID NO: 2930572 - RNA, 16 nt, Human
aguccucccaucucac

SEQ ID NO: 2930573 - RNA, 14 nt, Human
aguccucccaucuc

SEQ ID NO: 2930574 - RNA, 15 nt, Human
uguccaagaagccca

SEQ ID NO: 2930575 - RNA, 14 nt, Human
uguccaagaagccc

SEQ ID NO: 2930576 - RNA, 17 nt, Human
ugucagguggggcagcu

SEQ ID NO: 2930577 - RNA, 18 nt, Human
ugucagguggggcagcuu

SEQ ID NO: 2930578 - RNA, 20 nt, Human
ugucagguggggcagcuuga

SEQ ID NO: 2930579 - RNA, 20 nt, Human
ugucauuugagcagggcuca

SEQ ID NO: 2930580 - RNA, 21 nt, Human
ugucauuugagcagggcucag

SEQ ID NO: 2930581 - RNA, 22 nt, Human
ugucauuugagcagggcucagc

SEQ ID NO: 2930582 - RNA, 20 nt, Human
ugucccugcacuugcagacu

SEQ ID NO: 2930583 - RNA, 22 nt, Human
ugucccugcacuugcagacucu

SEQ ID NO: 2930584 - RNA, 23 nt, Human
ugucccugcacuugcagacucua

SEQ ID NO: 2930585 - RNA, 20 nt, Human
uguccagccccguagacgug

SEQ ID NO: 2930586 - RNA, 22 nt, Human
uguccaagaagcccaggaaagg

SEQ ID NO: 2930587 - RNA, 18 nt, Human
uguccaagaagcccagga

SEQ ID NO: 2930588 - RNA, 17 nt, Human
uguccaagaagcccagg

SEQ ID NO: 2930589 - RNA, 16 nt, Human
uguccaagaagcccag

SEQ ID NO: 2930590 - RNA, 15 nt, Human
agucaccaagcccag

SEQ ID NO: 2930591 - RNA, 17 nt, Human
agucaccccggccaccu

SEQ ID NO: 2930592 - RNA, 19 nt, Human
aguauucuuauuuaaugaa

SEQ ID NO: 2930593 - RNA, 12 nt, Human
aguauagaauag

SEQ ID NO: 2930594 - RNA, 15 nt, Human
aguauagaaaaucuu

SEQ ID NO: 2930595 - RNA, 16 nt, Human
aguauagaaaaucuuc

SEQ ID NO: 2930596 - RNA, 14 nt, Human
agguugaagcacca

SEQ ID NO: 2930597 - RNA, 14 nt, Human
agguugcagugagc

SEQ ID NO: 2930598 - RNA, 16 nt, Human
aggugucccugcacuu

SEQ ID NO: 2930599 - RNA, 21 nt, Human
aggugugagucaccaagccca

SEQ ID NO: 2930600 - RNA, 22 nt, Human
aggugugagucaccaagcccag

SEQ ID NO: 2930601 - RNA, 22 nt, Human
aggugggauaucacuuccauga

SEQ ID NO: 2930602 - RNA, 12 nt, Human
aggugggaggau

SEQ ID NO: 2930603 - RNA, 16 nt, Human
aggugcuacaaaaaca

SEQ ID NO: 2930604 - RNA, 20 nt, Human
uguacauacuuuuuggguuu

SEQ ID NO: 2930605 - RNA, 15 nt, Human
uguacauacuuuuug

SEQ ID NO: 2930606 - RNA, 16 nt, Human
uguacaugaaaacaca

SEQ ID NO: 2930607 - RNA, 14 nt, Human
uguacaugaaaaca

SEQ ID NO: 2930608 - RNA, 20 nt, Human
uguaauuuuuuuaucgucac

SEQ ID NO: 2930609 - RNA, 19 nt, Human
uguacauaaugcgugcaua

SEQ ID NO: 2930610 - RNA, 20 nt, Human
uguacauaaugcgugcauac

SEQ ID NO: 2930611 - RNA, 20 nt, Human
agguuggcaaaaaggcagga

SEQ ID NO: 2930612 - RNA, 18 nt, Human
uguaagggaaacugccag

SEQ ID NO: 2930613 - RNA, 13 nt, Human
uguaagggaaacu

SEQ ID NO: 2930614 - RNA, 19 nt, Human
uguaagggaaacugccagc

SEQ ID NO: 2930615 - RNA, 18 nt, Human
uguaauuaaguacuaugu

SEQ ID NO: 2930616 - RNA, 19 nt, Human
uguaauuaaguacuaugua

SEQ ID NO: 2930617 - RNA, 21 nt, Human
uguaauuaaguacuauguauc

SEQ ID NO: 2930618 - RNA, 23 nt, Human
aguacacuguuucaaacuuuacu

SEQ ID NO: 2930619 - RNA, 21 nt, Human
aguacacuguuucaaacuuua

SEQ ID NO: 2930620 - RNA, 17 nt, Human
aguaaugagcuuaagaa

SEQ ID NO: 2930621 - RNA, 12 nt, Human
aguaauuggaaa

SEQ ID NO: 2930622 - RNA, 13 nt, Human
aguaauuggaaag

SEQ ID NO: 2930623 - RNA, 16 nt, Human
agguuuuuuuuucuca

SEQ ID NO: 2930624 - RNA, 20 nt, Human
aguaaaaaaugguguuuuau

SEQ ID NO: 2930625 - RNA, 21 nt, Human
uguacauggaauaacauguaa

SEQ ID NO: 2930626 - RNA, 16 nt, Human
aguaauaaaugaaugu

SEQ ID NO: 2930627 - RNA, 19 nt, Human
aguaauaaaugaaugucac

SEQ ID NO: 2930628 - RNA, 19 nt, Human
aguaaaaccacagcaguug

SEQ ID NO: 2930629 - RNA, 17 nt, Human
aguaaaaccacagcagu

SEQ ID NO: 2930630 - RNA, 16 nt, Human
aguaaaaccacagcag

SEQ ID NO: 2930631 - RNA, 16 nt, Human
uguaggguuauaauaa

SEQ ID NO: 2930632 - RNA, 17 nt, Human
uguaggguuauaauaau

SEQ ID NO: 2930633 - RNA, 15 nt, Human
uguagugagccgaga

SEQ ID NO: 2930634 - RNA, 16 nt, Human
uguaguguuggagaag

SEQ ID NO: 2930635 - RNA, 16 nt, Human
uguauauguagaugua

SEQ ID NO: 2930636 - RNA, 21 nt, Human
uguauauguagauguaugcac

SEQ ID NO: 2930637 - RNA, 22 nt, Human
uguauauauuuccuauauuguu

SEQ ID NO: 2930638 - RNA, 18 nt, Human
uguauauauuuccuauau

SEQ ID NO: 2930639 - RNA, 17 nt, Human
uguaguguuggagaaga

SEQ ID NO: 2930640 - RNA, 18 nt, Human
uguaguguuggagaagaa

SEQ ID NO: 2930641 - RNA, 19 nt, Human
uguuccacaaguuaaauaa

SEQ ID NO: 2930642 - RNA, 22 nt, Human
agugugguguuuccuggcacug

SEQ ID NO: 2930643 - RNA, 13 nt, Human
uguuaugacucca

SEQ ID NO: 2930644 - RNA, 17 nt, Human
uguuaugacuccagaau

SEQ ID NO: 2930645 - RNA, 20 nt, Human
agugugacugaucucucgug

SEQ ID NO: 2930646 - RNA, 20 nt, Human
agugugccugaagucccaga

SEQ ID NO: 2930647 - RNA, 21 nt, Human
agugugccugaagucccagau

SEQ ID NO: 2930648 - RNA, 20 nt, Human
agugugguguuuccuggcac

SEQ ID NO: 2930649 - RNA, 19 nt, Human
aguguguggucaacauuuc

SEQ ID NO: 2930650 - RNA, 23 nt, Human
uguugcccaggcuggcgugcagu

SEQ ID NO: 2930651 - RNA, 20 nt, Human
uguugcccaggcuggcgugc

SEQ ID NO: 2930652 - RNA, 22 nt, Human
uguugcccacagcuguaugauu

SEQ ID NO: 2930653 - RNA, 22 nt, Human
uguucuaaauaucccuuggaca

SEQ ID NO: 2930654 - RNA, 15 nt, Human
uguucuaagaaguga

SEQ ID NO: 2930655 - RNA, 13 nt, Human
aguuacucagaau

SEQ ID NO: 2930656 - RNA, 19 nt, Human
aguguuguggauuuaacag

SEQ ID NO: 2930657 - RNA, 20 nt, Human
aguguuguggauuuaacaga

SEQ ID NO: 2930658 - RNA, 23 nt, Human
aguguuggagaagaacugaaauc

SEQ ID NO: 2930659 - RNA, 16 nt, Human
aguguuguggauuuaa

SEQ ID NO: 2930660 - RNA, 18 nt, Human
agugggggaucacagccu

SEQ ID NO: 2930661 - RNA, 22 nt, Human
agugggcccaaugcacuuuguu

SEQ ID NO: 2930662 - RNA, 16 nt, Human
aguggggaaugaagau

SEQ ID NO: 2930663 - RNA, 13 nt, Human
uguuaauauuuua

SEQ ID NO: 2930664 - RNA, 19 nt, Human
uguuacauaagauaaaugu

SEQ ID NO: 2930665 - RNA, 22 nt, Human
uguguuaucacccagaagaaaa

SEQ ID NO: 2930666 - RNA, 20 nt, Human
ugugucagguggggcagcuu

SEQ ID NO: 2930667 - RNA, 13 nt, Human
ugugucauuucaa

SEQ ID NO: 2930668 - RNA, 14 nt, Human
ugugucauuucaaa

SEQ ID NO: 2930669 - RNA, 22 nt, Human
uguggucaacauuucucauguu

SEQ ID NO: 2930670 - RNA, 11 nt, Human
uguguguuuau

SEQ ID NO: 2930671 - RNA, 22 nt, Human
ugugucucuugguccugcugca

SEQ ID NO: 2930672 - RNA, 21 nt, Human
ugugcugcccugcccaccugg

SEQ ID NO: 2930673 - RNA, 20 nt, Human
ugugcugcccugcccaccug

SEQ ID NO: 2930674 - RNA, 19 nt, Human
ugugcugcccugcccaccu

SEQ ID NO: 2930675 - RNA, 18 nt, Human
ugugcugcccugcccacc

SEQ ID NO: 2930676 - RNA, 14 nt, Human
uguggaugauaaaa

SEQ ID NO: 2930677 - RNA, 23 nt, Human
agugagcugguuuuuagcggaga

SEQ ID NO: 2930678 - RNA, 22 nt, Human
uguggauuuaacagaaauguac

SEQ ID NO: 2930679 - RNA, 19 nt, Human
uguggauuuaacagaaaug

SEQ ID NO: 2930680 - RNA, 20 nt, Human
uguggauuuaacagaaaugu

SEQ ID NO: 2930681 - RNA, 15 nt, Human
ugugccuaauguguu

SEQ ID NO: 2930682 - RNA, 14 nt, Human
ugugccuaaugugu

SEQ ID NO: 2930683 - RNA, 18 nt, Human
ugugccuaauguguuuga

SEQ ID NO: 2930684 - RNA, 17 nt, Human
ugugccuaauguguuug

SEQ ID NO: 2930685 - RNA, 19 nt, Human
ugugcugagucugaaggcu

SEQ ID NO: 2930686 - RNA, 18 nt, Human
ugugcugagucugaaggc

SEQ ID NO: 2930687 - RNA, 17 nt, Human
agugcagugagccgaga

SEQ ID NO: 2930688 - RNA, 14 nt, Human
agugcacuaaugug

SEQ ID NO: 2930689 - RNA, 17 nt, Human
agugcacuaauguguaa

SEQ ID NO: 2930690 - RNA, 21 nt, Human
agugcacuaauguguaagaca

SEQ ID NO: 2930691 - RNA, 16 nt, Human
agugcaugcugucccu

SEQ ID NO: 2930692 - RNA, 14 nt, Human
agugcaugcugucc

SEQ ID NO: 2930693 - RNA, 14 nt, Human
agugccaaaaacaa

SEQ ID NO: 2930694 - RNA, 16 nt, Human
agugaggaugaaaaaa

SEQ ID NO: 2930695 - RNA, 12 nt, Human
agugaggcucug

SEQ ID NO: 2930696 - RNA, 13 nt, Human
agugaggcucugc

SEQ ID NO: 2930697 - RNA, 22 nt, Human
agugcaaauugucacaggacag

SEQ ID NO: 2930698 - RNA, 18 nt, Human
agugcaaacuucagaguu

SEQ ID NO: 2930699 - RNA, 15 nt, Human
agucucccuuccuau

SEQ ID NO: 2930700 - RNA, 11 nt, Human
ugugaggaagc

SEQ ID NO: 2930701 - RNA, 16 nt, Human
ugugacugaucucucg

SEQ ID NO: 2930702 - RNA, 17 nt, Human
agucucuugauucauaa

SEQ ID NO: 2930703 - RNA, 16 nt, Human
agucucuugauucaua

SEQ ID NO: 2930704 - RNA, 14 nt, Human
agucuuagauguau

SEQ ID NO: 2930705 - RNA, 16 nt, Human
agucuuagauguauau

SEQ ID NO: 2930706 - RNA, 13 nt, Human
agucuuagaugua

SEQ ID NO: 2930707 - RNA, 18 nt, Human
ugugaugagaggaaauca

SEQ ID NO: 2930708 - RNA, 19 nt, Human
ugugaugagaggaaaucac

SEQ ID NO: 2930709 - RNA, 22 nt, Human
ugugaugaugaaaugaggucag

SEQ ID NO: 2930710 - RNA, 12 nt, Human
agugagcugguu

SEQ ID NO: 2930711 - RNA, 14 nt, Human
agugagcacuaagg

SEQ ID NO: 2930712 - RNA, 22 nt, Human
agugagcacuaaggugugcucu

SEQ ID NO: 2930713 - RNA, 21 nt, Human
agugacugauggcuaauguac

SEQ ID NO: 2930714 - RNA, 16 nt, Human
agugaacuugggccac

SEQ ID NO: 2930715 - RNA, 22 nt, Human
agugaacaaauuuacagagaca

SEQ ID NO: 2930716 - RNA, 23 nt, Human
agugaacaaauuuacagagacag

SEQ ID NO: 2930717 - RNA, 16 nt, Human
agucuuucacauuuaa

SEQ ID NO: 2930718 - RNA, 21 nt, Human
agugaacaaauuuacagagac

SEQ ID NO: 2930719 - RNA, 20 nt, Human
auacauacuuacaugugugu

SEQ ID NO: 2930720 - RNA, 18 nt, Human
auacauacuuacaugugu

SEQ ID NO: 2930721 - RNA, 20 nt, Human
auacauaaacaagaccacgu

SEQ ID NO: 2930722 - RNA, 20 nt, Human
auacaguuacucagaauucu

SEQ ID NO: 2930723 - RNA, 18 nt, Human
auacaguuacucagaauu

SEQ ID NO: 2930724 - RNA, 23 nt, Human
auacagauagauauaugcucugc

SEQ ID NO: 2930725 - RNA, 22 nt, Human
auacaggaaaagcugcugacag

SEQ ID NO: 2930726 - RNA, 23 nt, Human
auacaggaaaagcugcugacagu

SEQ ID NO: 2930727 - RNA, 17 nt, Human
auacagaggcaacugca

SEQ ID NO: 2930728 - RNA, 16 nt, Human
auacagaggcaacugc

SEQ ID NO: 2930729 - RNA, 17 nt, Human
uuauaaacuuuaccuuu

SEQ ID NO: 2930730 - RNA, 18 nt, Human
uuauaaacuuuaccuuuu

SEQ ID NO: 2930731 - RNA, 13 nt, Human
auacguacacauu

SEQ ID NO: 2930732 - RNA, 14 nt, Human
auacguacacauuu

SEQ ID NO: 2930733 - RNA, 15 nt, Human
auacguacacauuuu

SEQ ID NO: 2930734 - RNA, 18 nt, Human
auacgugggcauucaaau

SEQ ID NO: 2930735 - RNA, 19 nt, Human
auacgugggcauucaaaug

SEQ ID NO: 2930736 - RNA, 16 nt, Human
auacguacacauuuua

SEQ ID NO: 2930737 - RNA, 14 nt, Human
auaccuuuuuuaga

SEQ ID NO: 2930738 - RNA, 22 nt, Human
auaccacaggaaccacaagacu

SEQ ID NO: 2930739 - RNA, 17 nt, Human
auaccacuuuuguucuu

SEQ ID NO: 2930740 - RNA, 18 nt, Human
auaccacuuuuguucuug

SEQ ID NO: 2930741 - RNA, 20 nt, Human
auacuauuaaacaugcugua

SEQ ID NO: 2930742 - RNA, 15 nt, Human
uuauauuugaaauau

SEQ ID NO: 2930743 - RNA, 18 nt, Human
auacuauuaaacaugcug

SEQ ID NO: 2930744 - RNA, 19 nt, Human
auacuauuaaacaugcugu

SEQ ID NO: 2930745 - RNA, 19 nt, Human
uuauauuugaaauauugac

SEQ ID NO: 2930746 - RNA, 17 nt, Human
auacuauggaauuucuc

SEQ ID NO: 2930747 - RNA, 17 nt, Human
auacuauuaaacaugcu

SEQ ID NO: 2930748 - RNA, 13 nt, Human
auacuaaccagca

SEQ ID NO: 2930749 - RNA, 19 nt, Human
auacuaaccagcagaaaug

SEQ ID NO: 2930750 - RNA, 20 nt, Human
auacuaaccagcagaaaugc

SEQ ID NO: 2930751 - RNA, 22 nt, Human
uuaugggcuggguucuacccag

SEQ ID NO: 2930752 - RNA, 24 nt, Human
uuaugggagcugucaagcauguau

SEQ ID NO: 2930753 - RNA, 13 nt, Human
uuaugggcugggu

SEQ ID NO: 2930754 - RNA, 19 nt, Human
uuauggcuuuugugcauua

SEQ ID NO: 2930755 - RNA, 18 nt, Human
uuauggcuuuugugcauu

SEQ ID NO: 2930756 - RNA, 19 nt, Human
uuaugauuaaguaaugaua

SEQ ID NO: 2930757 - RNA, 17 nt, Human
uuaucacccagaagaaa

SEQ ID NO: 2930758 - RNA, 18 nt, Human
uuaucacccagaagaaaa

SEQ ID NO: 2930759 - RNA, 19 nt, Human
uuaucacccagaagaaaau

SEQ ID NO: 2930760 - RNA, 21 nt, Human
uuaucacccagaagaaaauag

SEQ ID NO: 2930761 - RNA, 19 nt, Human
uuaugaaacuuuuggaagg

SEQ ID NO: 2930762 - RNA, 13 nt, Human
uuaugaaaauaau

SEQ ID NO: 2930763 - RNA, 14 nt, Human
uuaugaaacuuuug

SEQ ID NO: 2930764 - RNA, 17 nt, Human
uuaugaaacuuuuggaa

SEQ ID NO: 2930765 - RNA, 18 nt, Human
uuaugaaacuuuuggaag

SEQ ID NO: 2930766 - RNA, 21 nt, Human
uuaugagaaacuggcaaagca

SEQ ID NO: 2930767 - RNA, 23 nt, Human
uuaugagaaacuggcaaagcaga

SEQ ID NO: 2930768 - RNA, 11 nt, Human
uuaugacucca

SEQ ID NO: 2930769 - RNA, 21 nt, Human
uuaugaauuacauuuguauaa

SEQ ID NO: 2930770 - RNA, 14 nt, Human
uuaugaauuacauu

SEQ ID NO: 2930771 - RNA, 16 nt, Human
uuaugaauuacauuug

SEQ ID NO: 2930772 - RNA, 17 nt, Human
uuaugaauuacauuugu

SEQ ID NO: 2930773 - RNA, 13 nt, Human
auagaaguaaaaa

SEQ ID NO: 2930774 - RNA, 23 nt, Human
auagacaauuuauuauggcacau

SEQ ID NO: 2930775 - RNA, 13 nt, Human
auagaauugacau

SEQ ID NO: 2930776 - RNA, 18 nt, Human
auagaauugacauugaaa

SEQ ID NO: 2930777 - RNA, 22 nt, Human
auagaauugacauugaaaucua

SEQ ID NO: 2930778 - RNA, 16 nt, Human
auagacaauuuauuau

SEQ ID NO: 2930779 - RNA, 22 nt, Human
auagacaauuuauuauggcaca

SEQ ID NO: 2930780 - RNA, 18 nt, Human
auagaauaggcacuuuaa

SEQ ID NO: 2930781 - RNA, 20 nt, Human
auagaauaggcacuuuaaaa

SEQ ID NO: 2930782 - RNA, 22 nt, Human
auagaauaggcacuuuaaaaca

SEQ ID NO: 2930783 - RNA, 17 nt, Human
auagaauuaacacauga

SEQ ID NO: 2930784 - RNA, 20 nt, Human
auagauguugcuaacagcaa

SEQ ID NO: 2930785 - RNA, 14 nt, Human
auagauguugcuaa

SEQ ID NO: 2930786 - RNA, 17 nt, Human
auagauugcucaaauca

SEQ ID NO: 2930787 - RNA, 14 nt, Human
auagagagagacca

SEQ ID NO: 2930788 - RNA, 16 nt, Human
auagagugugauguau

SEQ ID NO: 2930789 - RNA, 22 nt, Human
auagagugugauguauguguaa

SEQ ID NO: 2930790 - RNA, 18 nt, Human
auagauaggucagugcaa

SEQ ID NO: 2930791 - RNA, 11 nt, Human
auacucccauc

SEQ ID NO: 2930792 - RNA, 16 nt, Human
auacucauuaggaugg

SEQ ID NO: 2930793 - RNA, 22 nt, Human
uuauuccaagggaauauugcca

SEQ ID NO: 2930794 - RNA, 14 nt, Human
auacucccaucugu

SEQ ID NO: 2930795 - RNA, 17 nt, Human
auacuccuccaagguua

SEQ ID NO: 2930796 - RNA, 14 nt, Human
auacucuuauaucu

SEQ ID NO: 2930797 - RNA, 18 nt, Human
auacucuuauaucuauau

SEQ ID NO: 2930798 - RNA, 16 nt, Human
auacucugcuuagaau

SEQ ID NO: 2930799 - RNA, 20 nt, Human
auacugccuuguuuaauggu

SEQ ID NO: 2930800 - RNA, 18 nt, Human
auacugccuuguuuaaug

SEQ ID NO: 2930801 - RNA, 13 nt, Human
uuauuauuaacaa

SEQ ID NO: 2930802 - RNA, 14 nt, Human
uuauuauuaacaaa

SEQ ID NO: 2930803 - RNA, 13 nt, Human
uuauuaugcauga

SEQ ID NO: 2930804 - RNA, 21 nt, Human
uuauucauuaguuuugaagau

SEQ ID NO: 2930805 - RNA, 18 nt, Human
uuauucauuaguuuugaa

SEQ ID NO: 2930806 - RNA, 15 nt, Human
uuauuauauuuacaa

SEQ ID NO: 2930807 - RNA, 12 nt, Human
uuauuaugcaug

SEQ ID NO: 2930808 - RNA, 14 nt, Human
uuauuauauuuaca

SEQ ID NO: 2930809 - RNA, 13 nt, Human
uuauguuaauauu

SEQ ID NO: 2930810 - RNA, 19 nt, Human
uuauguuaaaacugggaca

SEQ ID NO: 2930811 - RNA, 16 nt, Human
aguuuuauaugcuucu

SEQ ID NO: 2930812 - RNA, 19 nt, Human
aguuuuuuuccuucaagaa

SEQ ID NO: 2930813 - RNA, 23 nt, Human
uuaacuuuuauaaacuuuaccuu

SEQ ID NO: 2930814 - RNA, 22 nt, Human
uuaacuuuuauaaacuuuaccu

SEQ ID NO: 2930815 - RNA, 18 nt, Human
uuaacuuuuauaaacuuu

SEQ ID NO: 2930816 - RNA, 16 nt, Human
uuaagacuuaaugaga

SEQ ID NO: 2930817 - RNA, 19 nt, Human
uuaagacuuugguuauuuu

SEQ ID NO: 2930818 - RNA, 23 nt, Human
uuaagacuuaaugagacuuuaaa

SEQ ID NO: 2930819 - RNA, 22 nt, Human
uuaagagagucuauuuacggaa

SEQ ID NO: 2930820 - RNA, 15 nt, Human
uuaaucuaaauggaa

SEQ ID NO: 2930821 - RNA, 16 nt, Human
uuaauuuauccucugu

SEQ ID NO: 2930822 - RNA, 16 nt, Human
uuaauuugguuuucac

SEQ ID NO: 2930823 - RNA, 15 nt, Human
aguuuaucuguucau

SEQ ID NO: 2930824 - RNA, 12 nt, Human
uuaacagaaaug

SEQ ID NO: 2930825 - RNA, 13 nt, Human
uuaacagaaaugu

SEQ ID NO: 2930826 - RNA, 14 nt, Human
uuaacagaaaugua

SEQ ID NO: 2930827 - RNA, 14 nt, Human
aguuucucuuuuca

SEQ ID NO: 2930828 - RNA, 15 nt, Human
aguuucugccgcagc

SEQ ID NO: 2930829 - RNA, 15 nt, Human
aguuuuacaguguuu

SEQ ID NO: 2930830 - RNA, 22 nt, Human
aguuuguuaguaugaggcauuu

SEQ ID NO: 2930831 - RNA, 19 nt, Human
aguuucugccgcagcccug

SEQ ID NO: 2930832 - RNA, 14 nt, Human
uuaaaaucauuucu

SEQ ID NO: 2930833 - RNA, 22 nt, Human
uuaaaaucauuucugcaucagc

SEQ ID NO: 2930834 - RNA, 17 nt, Human
uuaaaaaucucaaauuu

SEQ ID NO: 2930835 - RNA, 20 nt, Human
uuaaaaaucucaaauuucua

SEQ ID NO: 2930836 - RNA, 16 nt, Human
uuaaaaaauggaacau

SEQ ID NO: 2930837 - RNA, 19 nt, Human
uuaaaaaucucaaauuucu

SEQ ID NO: 2930838 - RNA, 18 nt, Human
aguuuagcccugaacauu

SEQ ID NO: 2930839 - RNA, 22 nt, Human
aguuuagcccugaacauuucau

SEQ ID NO: 2930840 - RNA, 19 nt, Human
uuaaaaaagaaacauuugg

SEQ ID NO: 2930841 - RNA, 15 nt, Human
aguuuagcuggaaaa

SEQ ID NO: 2930842 - RNA, 20 nt, Human
aguuuaaauuguaauaggcg

SEQ ID NO: 2930843 - RNA, 17 nt, Human
aguuuaaauuguaauag

SEQ ID NO: 2930844 - RNA, 13 nt, Human
uuauaaacuuuac

SEQ ID NO: 2930845 - RNA, 15 nt, Human
uuauaaaagugaaua

SEQ ID NO: 2930846 - RNA, 14 nt, Human
uuaguagagacagg

SEQ ID NO: 2930847 - RNA, 13 nt, Human
uuaguagagacag

SEQ ID NO: 2930848 - RNA, 16 nt, Human
uuagguugaaacauau

SEQ ID NO: 2930849 - RNA, 14 nt, Human
uuagguugaaacau

SEQ ID NO: 2930850 - RNA, 19 nt, Human
uuaggugugggggaagcac

SEQ ID NO: 2930851 - RNA, 15 nt, Human
uuagggagagaagau

SEQ ID NO: 2930852 - RNA, 14 nt, Human
uuagggagagaaga

SEQ ID NO: 2930853 - RNA, 14 nt, Human
uuaggguuaugauu

SEQ ID NO: 2930854 - RNA, 16 nt, Human
uuaggguuaugauuaa

SEQ ID NO: 2930855 - RNA, 19 nt, Human
auaagccaaaacugagcau

SEQ ID NO: 2930856 - RNA, 22 nt, Human
auaagccaaaaaaugcuugcuu

SEQ ID NO: 2930857 - RNA, 21 nt, Human
auaagauucauauuuacuucu

SEQ ID NO: 2930858 - RNA, 18 nt, Human
auaauuuaccugaagucu

SEQ ID NO: 2930859 - RNA, 22 nt, Human
auaauuuccauuuacuuaagac

SEQ ID NO: 2930860 - RNA, 23 nt, Human
auaauuuccauuuacuuaagacu

SEQ ID NO: 2930861 - RNA, 14 nt, Human
auaaucuuucacag

SEQ ID NO: 2930862 - RNA, 16 nt, Human
uuagaagucacacagu

SEQ ID NO: 2930863 - RNA, 14 nt, Human
auaagauucauauu

SEQ ID NO: 2930864 - RNA, 22 nt, Human
auaacuuuuuauauucucagca

SEQ ID NO: 2930865 - RNA, 15 nt, Human
uuacugcagcuuugu

SEQ ID NO: 2930866 - RNA, 12 nt, Human
uuacuguacaug

SEQ ID NO: 2930867 - RNA, 13 nt, Human
uuacuguacauga

SEQ ID NO: 2930868 - RNA, 14 nt, Human
uuacuguacaugaa

SEQ ID NO: 2930869 - RNA, 22 nt, Human
uuacuguacaugaaaacacauu

SEQ ID NO: 2930870 - RNA, 23 nt, Human
uuacuguacaugaaaacacauuu

SEQ ID NO: 2930871 - RNA, 14 nt, Human
uuacaggugugaac

SEQ ID NO: 2930872 - RNA, 19 nt, Human
uuaccagcagagcaccuua

SEQ ID NO: 2930873 - RNA, 17 nt, Human
uuacaguggggaaugaa

SEQ ID NO: 2930874 - RNA, 11 nt, Human
uuacaaauguu

SEQ ID NO: 2930875 - RNA, 13 nt, Human
aucuugcucugcu

SEQ ID NO: 2930876 - RNA, 20 nt, Human
aucuuggucagauuugaacu

SEQ ID NO: 2930877 - RNA, 18 nt, Human
aucugugaaaggaaagag

SEQ ID NO: 2930878 - RNA, 17 nt, Human
aucugugaaaggaaaga

SEQ ID NO: 2930879 - RNA, 10 nt, Human
aucuggugac

SEQ ID NO: 2930880 - RNA, 17 nt, Human
aucuggugacuuuccuc

SEQ ID NO: 2930881 - RNA, 16 nt, Human
aucuggugacuuuccu

SEQ ID NO: 2930882 - RNA, 18 nt, Human
aucugcgggggcagugcu

SEQ ID NO: 2930883 - RNA, 19 nt, Human
aucugcgggggcagugcuc

SEQ ID NO: 2930884 - RNA, 20 nt, Human
aucugcgggggcagugcuca

SEQ ID NO: 2930885 - RNA, 21 nt, Human
aucugcgggggcagugcucac

SEQ ID NO: 2930886 - RNA, 23 nt, Human
aucugcgggggcagugcucaccc

SEQ ID NO: 2930887 - RNA, 15 nt, Human
augaaagggcccaga

SEQ ID NO: 2930888 - RNA, 18 nt, Human
augaaagggcccagagag

SEQ ID NO: 2930889 - RNA, 17 nt, Human
aucuuugcagacaggca

SEQ ID NO: 2930890 - RNA, 22 nt, Human
aucuuuucauuuaggugaggaa

SEQ ID NO: 2930891 - RNA, 23 nt, Human
uuggcuauuagagaucaaccccu

SEQ ID NO: 2930892 - RNA, 18 nt, Human
uuggccccugcccggcug

SEQ ID NO: 2930893 - RNA, 16 nt, Human
uuggagggugucccaa

SEQ ID NO: 2930894 - RNA, 14 nt, Human
uugcuugaaagaaa

SEQ ID NO: 2930895 - RNA, 14 nt, Human
augaaaugagguca

SEQ ID NO: 2930896 - RNA, 19 nt, Human
augaaagggcccagagagg

SEQ ID NO: 2930897 - RNA, 16 nt, Human
augaauuacauuugua

SEQ ID NO: 2930898 - RNA, 18 nt, Human
uuggggaccagagcugcc

SEQ ID NO: 2930899 - RNA, 15 nt, Human
augaauuaaguuuuu

SEQ ID NO: 2930900 - RNA, 15 nt, Human
augaauuacauuugu

SEQ ID NO: 2930901 - RNA, 23 nt, Human
augaauggcuaagcaaaauguga

SEQ ID NO: 2930902 - RNA, 21 nt, Human
uugaaggaugcugucuucgua

SEQ ID NO: 2930903 - RNA, 17 nt, Human
uugaagggaaauuucag

SEQ ID NO: 2930904 - RNA, 18 nt, Human
auccuccugggauuggcu

SEQ ID NO: 2930905 - RNA, 17 nt, Human
auccucuguacagagcc

SEQ ID NO: 2930906 - RNA, 16 nt, Human
auccucuguacagagc

SEQ ID NO: 2930907 - RNA, 17 nt, Human
aucuaaauggaaccacu

SEQ ID NO: 2930908 - RNA, 18 nt, Human
aucuaaauggaaccacuc

SEQ ID NO: 2930909 - RNA, 13 nt, Human
aucuaaauggaac

SEQ ID NO: 2930910 - RNA, 15 nt, Human
uugagaucagccugg

SEQ ID NO: 2930911 - RNA, 16 nt, Human
uugagaucagccuggg

SEQ ID NO: 2930912 - RNA, 12 nt, Human
uugagacagagu

SEQ ID NO: 2930913 - RNA, 20 nt, Human
uugaguugauucagcucugc

SEQ ID NO: 2930914 - RNA, 20 nt, Human
uugagugaagcugggagaac

SEQ ID NO: 2930915 - RNA, 18 nt, Human
aucuaauauguaacaagc

SEQ ID NO: 2930916 - RNA, 18 nt, Human
aucuacacuccagugaga

SEQ ID NO: 2930917 - RNA, 19 nt, Human
aucuacacuccagugagac

SEQ ID NO: 2930918 - RNA, 15 nt, Human
aucucuugagccugg

SEQ ID NO: 2930919 - RNA, 14 nt, Human
aucugaaaauguau

SEQ ID NO: 2930920 - RNA, 18 nt, Human
aucucuugagccugggag

SEQ ID NO: 2930921 - RNA, 16 nt, Human
aucugaaaauguaugu

SEQ ID NO: 2930922 - RNA, 19 nt, Human
aucugaaaauguaugugua

SEQ ID NO: 2930923 - RNA, 20 nt, Human
aucugaaaauguauguguaa

SEQ ID NO: 2930924 - RNA, 22 nt, Human
aucugaaaauguauguguaagu

SEQ ID NO: 2930925 - RNA, 15 nt, Human
aucucccccagcccc

SEQ ID NO: 2930926 - RNA, 14 nt, Human
aucucccccagccc

SEQ ID NO: 2930927 - RNA, 17 nt, Human
aucucccccagccccau

SEQ ID NO: 2930928 - RNA, 16 nt, Human
aucucccccagcccca

SEQ ID NO: 2930929 - RNA, 16 nt, Human
aucucagggccugguc

SEQ ID NO: 2930930 - RNA, 14 nt, Human
aucucagggccugg

SEQ ID NO: 2930931 - RNA, 14 nt, Human
aucuccaaaauaaa

SEQ ID NO: 2930932 - RNA, 17 nt, Human
aucuccaaaauaaaacu

SEQ ID NO: 2930933 - RNA, 20 nt, Human
aucuccaaaauaaaacuuuu

SEQ ID NO: 2930934 - RNA, 21 nt, Human
aucuccaaaauaaaacuuuuu

SEQ ID NO: 2930935 - RNA, 13 nt, Human
aucuccaaaauaa

SEQ ID NO: 2930936 - RNA, 16 nt, Human
uugcaauggcagccuu

SEQ ID NO: 2930937 - RNA, 17 nt, Human
uugcaauggcagccuug

SEQ ID NO: 2930938 - RNA, 19 nt, Human
uugcaauggcagccuuggc

SEQ ID NO: 2930939 - RNA, 18 nt, Human
uugcaccacugcacucca

SEQ ID NO: 2930940 - RNA, 16 nt, Human
uugcaccacugcacuc

SEQ ID NO: 2930941 - RNA, 15 nt, Human
uugcaccacugcacu

SEQ ID NO: 2930942 - RNA, 14 nt, Human
uugcaccacugcac

SEQ ID NO: 2930943 - RNA, 17 nt, Human
uugcauauugcauacua

SEQ ID NO: 2930944 - RNA, 13 nt, Human
uugcaucaauuuu

SEQ ID NO: 2930945 - RNA, 23 nt, Human
aucugaaaauguauguguaagua

SEQ ID NO: 2930946 - RNA, 12 nt, Human
aucugaaaaugu

SEQ ID NO: 2930947 - RNA, 17 nt, Human
aucugaaauaaggaaug

SEQ ID NO: 2930948 - RNA, 13 nt, Human
uugauuaaauucu

SEQ ID NO: 2930949 - RNA, 23 nt, Human
uugauguuuuaaggaugcuugua

SEQ ID NO: 2930950 - RNA, 14 nt, Human
uugauuaaauucuu

SEQ ID NO: 2930951 - RNA, 22 nt, Human
uugcaagccagauuuuccugaa

SEQ ID NO: 2930952 - RNA, 16 nt, Human
uugcaaggcaaauguu

SEQ ID NO: 2930953 - RNA, 18 nt, Human
uugaacccgggaggcaga

SEQ ID NO: 2930954 - RNA, 17 nt, Human
uugaaauuguauuacaa

SEQ ID NO: 2930955 - RNA, 19 nt, Human
uugaacccgggaggcagag

SEQ ID NO: 2930956 - RNA, 16 nt, Human
auccuccucagaucuu

SEQ ID NO: 2930957 - RNA, 16 nt, Human
auccuaggcauuugcu

SEQ ID NO: 2930958 - RNA, 12 nt, Human
auccuaagcuau

SEQ ID NO: 2930959 - RNA, 20 nt, Human
uucuucugcuucagccuccc

SEQ ID NO: 2930960 - RNA, 13 nt, Human
uucuucugcuuca

SEQ ID NO: 2930961 - RNA, 15 nt, Human
uucuucugcuucagc

SEQ ID NO: 2930962 - RNA, 14 nt, Human
uucuucucccucag

SEQ ID NO: 2930963 - RNA, 11 nt, Human
uucuucucccu

SEQ ID NO: 2930964 - RNA, 13 nt, Human
uucuucucccuca

SEQ ID NO: 2930965 - RNA, 24 nt, Human
aucccauaugccugggcagaagga

SEQ ID NO: 2930966 - RNA, 14 nt, Human
aucccucauccuca

SEQ ID NO: 2930967 - RNA, 13 nt, Human
aucccucauccuc

SEQ ID NO: 2930968 - RNA, 23 nt, Human
aucccucauccucauacccaccc

SEQ ID NO: 2930969 - RNA, 21 nt, Human
aucccucauccucauacccac

SEQ ID NO: 2930970 - RNA, 18 nt, Human
auccaagcuggucccacu

SEQ ID NO: 2930971 - RNA, 21 nt, Human
auccaagcuggucccacucag

SEQ ID NO: 2930972 - RNA, 13 nt, Human
auccacccaccuc

SEQ ID NO: 2930973 - RNA, 15 nt, Human
auccacccaccucag

SEQ ID NO: 2930974 - RNA, 16 nt, Human
auccaguaucuugaag

SEQ ID NO: 2930975 - RNA, 15 nt, Human
auccaguaucuugaa

SEQ ID NO: 2930976 - RNA, 18 nt, Human
aucccauaugccugggca

SEQ ID NO: 2930977 - RNA, 12 nt, Human
aucccagcccca

SEQ ID NO: 2930978 - RNA, 20 nt, Human
aucccaaacccuucagugcc

SEQ ID NO: 2930979 - RNA, 19 nt, Human
aucccaaacccuucagugc

SEQ ID NO: 2930980 - RNA, 21 nt, Human
auccaguaucuugaagacuuu

SEQ ID NO: 2930981 - RNA, 17 nt, Human
uucuggcucuuccaggc

SEQ ID NO: 2930982 - RNA, 16 nt, Human
uucuggcucuuccagg

SEQ ID NO: 2930983 - RNA, 21 nt, Human
uucugccugcccaggccccug

SEQ ID NO: 2930984 - RNA, 15 nt, Human
uucuggcucuuccag

SEQ ID NO: 2930985 - RNA, 17 nt, Human
uucugccugcccaggcc

SEQ ID NO: 2930986 - RNA, 18 nt, Human
uucugccugcccaggccc

SEQ ID NO: 2930987 - RNA, 15 nt, Human
uucugccauauucug

SEQ ID NO: 2930988 - RNA, 23 nt, Human
uucugaacuuggcgcugccccug

SEQ ID NO: 2930989 - RNA, 22 nt, Human
uucugaacuuggcgcugccccu

SEQ ID NO: 2930990 - RNA, 19 nt, Human
uucugaacuuggcgcugcc

SEQ ID NO: 2930991 - RNA, 20 nt, Human
aucagguuuucuuuuaagaa

SEQ ID NO: 2930992 - RNA, 21 nt, Human
uucuccuuguguuacuaaguu

SEQ ID NO: 2930993 - RNA, 12 nt, Human
uucucuaggaaa

SEQ ID NO: 2930994 - RNA, 15 nt, Human
uucucuaguuugauu

SEQ ID NO: 2930995 - RNA, 17 nt, Human
uucucuaguuugauuaa

SEQ ID NO: 2930996 - RNA, 14 nt, Human
uucggccuccaucc

SEQ ID NO: 2930997 - RNA, 15 nt, Human
uucgcuccugugucu

SEQ ID NO: 2930998 - RNA, 19 nt, Human
uucgcuccugugucuugca

SEQ ID NO: 2930999 - RNA, 21 nt, Human
uucuaaaucuccaaaauaaaa

SEQ ID NO: 2931000 - RNA, 15 nt, Human
uucggccuccauccu

SEQ ID NO: 2931001 - RNA, 19 nt, Human
uucuaaaggcuaccuuugu

SEQ ID NO: 2931002 - RNA, 20 nt, Human
uucuaaaggcuaccuuugua

SEQ ID NO: 2931003 - RNA, 21 nt, Human
uucuaaaggcuaccuuuguau

SEQ ID NO: 2931004 - RNA, 16 nt, Human
uucuagcauggcugcc

SEQ ID NO: 2931005 - RNA, 19 nt, Human
uucuagcaugaagacagag

SEQ ID NO: 2931006 - RNA, 23 nt, Human
uucuaagaagugaaaaucuacac

SEQ ID NO: 2931007 - RNA, 13 nt, Human
uucuaagaaguga

SEQ ID NO: 2931008 - RNA, 15 nt, Human
uucuaaguaaaacca

SEQ ID NO: 2931009 - RNA, 16 nt, Human
uucuaaguaaaaccac

SEQ ID NO: 2931010 - RNA, 12 nt, Human
aucagaauucuc

SEQ ID NO: 2931011 - RNA, 18 nt, Human
aucaggccaggcccucug

SEQ ID NO: 2931012 - RNA, 16 nt, Human
aucaggccaggcccuc

SEQ ID NO: 2931013 - RNA, 15 nt, Human
aucaggccaggcccu

SEQ ID NO: 2931014 - RNA, 13 nt, Human
aucagcacgauuu

SEQ ID NO: 2931015 - RNA, 14 nt, Human
aucaggccaggccc

SEQ ID NO: 2931016 - RNA, 17 nt, Human
aucaggguuaguauugu

SEQ ID NO: 2931017 - RNA, 13 nt, Human
uucuaggacugaa

SEQ ID NO: 2931018 - RNA, 14 nt, Human
uucuaggacugaau

SEQ ID NO: 2931019 - RNA, 20 nt, Human
uucucacagcuccaagaauu

SEQ ID NO: 2931020 - RNA, 16 nt, Human
uucuaggacugaauua

SEQ ID NO: 2931021 - RNA, 11 nt, Human
aucagaauucu

SEQ ID NO: 2931022 - RNA, 22 nt, Human
aucacuugucaauaaaauccau

SEQ ID NO: 2931023 - RNA, 18 nt, Human
aucacggcucacugcagc

SEQ ID NO: 2931024 - RNA, 19 nt, Human
aucacggcucacugcagcc

SEQ ID NO: 2931025 - RNA, 13 nt, Human
aucacgccacugc

SEQ ID NO: 2931026 - RNA, 15 nt, Human
aucacggcucacugc

SEQ ID NO: 2931027 - RNA, 20 nt, Human
aucaaucaugucagucugcu

SEQ ID NO: 2931028 - RNA, 14 nt, Human
aucaaugaguaaca

SEQ ID NO: 2931029 - RNA, 11 nt, Human
uuccugugucu

SEQ ID NO: 2931030 - RNA, 17 nt, Human
aucaacagugagagacu

SEQ ID NO: 2931031 - RNA, 21 nt, Human
aucaagaugugacauguuuua

SEQ ID NO: 2931032 - RNA, 14 nt, Human
aucaacagauaaau

SEQ ID NO: 2931033 - RNA, 18 nt, Human
auauuuuuuguuaaauga

SEQ ID NO: 2931034 - RNA, 20 nt, Human
auauuuuuuguuaaaugauu

SEQ ID NO: 2931035 - RNA, 13 nt, Human
uuccuaaaauuau

SEQ ID NO: 2931036 - RNA, 17 nt, Human
uuccuaauccucuagga

SEQ ID NO: 2931037 - RNA, 15 nt, Human
uuccugaacaggaua

SEQ ID NO: 2931038 - RNA, 18 nt, Human
uuccugaagaauugaaaa

SEQ ID NO: 2931039 - RNA, 14 nt, Human
uuccugaacaggau

SEQ ID NO: 2931040 - RNA, 14 nt, Human
uuccugaaccgaug

SEQ ID NO: 2931041 - RNA, 17 nt, Human
uuccucuuuccaucuac

SEQ ID NO: 2931042 - RNA, 22 nt, Human
uuccucuuuccaucuacccucc

SEQ ID NO: 2931043 - RNA, 13 nt, Human
uuccucuuuccau

SEQ ID NO: 2931044 - RNA, 15 nt, Human
uucccuauuagagaa

SEQ ID NO: 2931045 - RNA, 20 nt, Human
uucccucaccuuucccaucu

SEQ ID NO: 2931046 - RNA, 15 nt, Human
uucccucaaaugugu

SEQ ID NO: 2931047 - RNA, 14 nt, Human
uuccguuaaaauac

SEQ ID NO: 2931048 - RNA, 16 nt, Human
uuccguuaaaauacca

SEQ ID NO: 2931049 - RNA, 19 nt, Human
uuccguagguuauuuucag

SEQ ID NO: 2931050 - RNA, 17 nt, Human
uuugugaagcaaaauuu

SEQ ID NO: 2931051 - RNA, 17 nt, Human
uuuguaguguuggagaa

SEQ ID NO: 2931052 - RNA, 19 nt, Human
uuuguaguguuggagaaga

SEQ ID NO: 2931053 - RNA, 21 nt, Human
uuuguaguguuggagaagaac

SEQ ID NO: 2931054 - RNA, 19 nt, Human
augugaugagaggaaauca

SEQ ID NO: 2931055 - RNA, 17 nt, Human
augugaugagaggaaau

SEQ ID NO: 2931056 - RNA, 15 nt, Human
augugaugagaggaa

SEQ ID NO: 2931057 - RNA, 16 nt, Human
augugaugagaggaaa

SEQ ID NO: 2931058 - RNA, 19 nt, Human
augugcacaucuguuuugu

SEQ ID NO: 2931059 - RNA, 23 nt, Human
augugcacaugcacgugugugca

SEQ ID NO: 2931060 - RNA, 13 nt, Human
augucaguauuuc

SEQ ID NO: 2931061 - RNA, 16 nt, Human
augucaguauuucaac

SEQ ID NO: 2931062 - RNA, 22 nt, Human
auguauuacaguggggaaugaa

SEQ ID NO: 2931063 - RNA, 16 nt, Human
auguauguguaaguau

SEQ ID NO: 2931064 - RNA, 17 nt, Human
auguauguguaauaaau

SEQ ID NO: 2931065 - RNA, 15 nt, Human
auguauguguaagua

SEQ ID NO: 2931066 - RNA, 15 nt, Human
auguaugcacacaca

SEQ ID NO: 2931067 - RNA, 16 nt, Human
auguaugcacacacau

SEQ ID NO: 2931068 - RNA, 17 nt, Human
auguaugcacacacaua

SEQ ID NO: 2931069 - RNA, 18 nt, Human
augucagucugcuuagaa

SEQ ID NO: 2931070 - RNA, 19 nt, Human
augucagucugcuuagaaa

SEQ ID NO: 2931071 - RNA, 20 nt, Human
augucagucugcuuagaaau

SEQ ID NO: 2931072 - RNA, 21 nt, Human
augucagucugcuuagaaaua

SEQ ID NO: 2931073 - RNA, 22 nt, Human
augucagucugcuuagaaauaa

SEQ ID NO: 2931074 - RNA, 16 nt, Human
auguccacugguucuu

SEQ ID NO: 2931075 - RNA, 17 nt, Human
auguccacugguucuuc

SEQ ID NO: 2931076 - RNA, 13 nt, Human
augucagugugac

SEQ ID NO: 2931077 - RNA, 12 nt, Human
augucaguguga

SEQ ID NO: 2931078 - RNA, 17 nt, Human
auguagauguaugcaca

SEQ ID NO: 2931079 - RNA, 18 nt, Human
auguagauguaugcacac

SEQ ID NO: 2931080 - RNA, 17 nt, Human
auguagaggagaaacug

SEQ ID NO: 2931081 - RNA, 19 nt, Human
auguagaggagaaacugga

SEQ ID NO: 2931082 - RNA, 20 nt, Human
auguagacaguuggguuuuu

SEQ ID NO: 2931083 - RNA, 18 nt, Human
auguagacaguuggguuu

SEQ ID NO: 2931084 - RNA, 12 nt, Human
auguagaggaga

SEQ ID NO: 2931085 - RNA, 13 nt, Human
auguagaggagaa

SEQ ID NO: 2931086 - RNA, 17 nt, Human
auguacgacuugcauac

SEQ ID NO: 2931087 - RNA, 16 nt, Human
auguacuucaugcugu

SEQ ID NO: 2931088 - RNA, 19 nt, Human
auguagauguaugcacaca

SEQ ID NO: 2931089 - RNA, 22 nt, Human
auguagauguaugcacacacau

SEQ ID NO: 2931090 - RNA, 22 nt, Human
auguaggcuggcuuucagagua

SEQ ID NO: 2931091 - RNA, 12 nt, Human
uuugaccucugc

SEQ ID NO: 2931092 - RNA, 22 nt, Human
uuugauguucuuucacccuuuu

SEQ ID NO: 2931093 - RNA, 13 nt, Human
uuugauuaaauuc

SEQ ID NO: 2931094 - RNA, 18 nt, Human
uuugauuaaauucuugca

SEQ ID NO: 2931095 - RNA, 21 nt, Human
uuugauuaaauucuugcaaag

SEQ ID NO: 2931096 - RNA, 21 nt, Human
uuugauucagacagcugccug

SEQ ID NO: 2931097 - RNA, 23 nt, Human
uuugauuaaauucuugcaaagua

SEQ ID NO: 2931098 - RNA, 20 nt, Human
uuugacgccaucccagcccc

SEQ ID NO: 2931099 - RNA, 19 nt, Human
uuugacgccaucccagccc

SEQ ID NO: 2931100 - RNA, 16 nt, Human
uuugacgccaucccag

SEQ ID NO: 2931101 - RNA, 14 nt, Human
uuugacgccauccc

SEQ ID NO: 2931102 - RNA, 13 nt, Human
uuugacgccaucc

SEQ ID NO: 2931103 - RNA, 13 nt, Human
uuugcaaauaagu

SEQ ID NO: 2931104 - RNA, 22 nt, Human
uuugauucagacagcugccugg

SEQ ID NO: 2931105 - RNA, 14 nt, Human
uuugcaagccagau

SEQ ID NO: 2931106 - RNA, 15 nt, Human
uuugccguuauuaaa

SEQ ID NO: 2931107 - RNA, 13 nt, Human
uuugccucugccu

SEQ ID NO: 2931108 - RNA, 13 nt, Human
uuugcucauggaa

SEQ ID NO: 2931109 - RNA, 14 nt, Human
augguuuucuugug

SEQ ID NO: 2931110 - RNA, 16 nt, Human
augguuuucaaaauaa

SEQ ID NO: 2931111 - RNA, 15 nt, Human
augguuuggagcuga

SEQ ID NO: 2931112 - RNA, 14 nt, Human
augguuuggagcug

SEQ ID NO: 2931113 - RNA, 14 nt, Human
augguuuucaaaau

SEQ ID NO: 2931114 - RNA, 15 nt, Human
augguuuucaaaaua

SEQ ID NO: 2931115 - RNA, 21 nt, Human
augguucccuugaugaagaag

SEQ ID NO: 2931116 - RNA, 12 nt, Human
augguggcuggg

SEQ ID NO: 2931117 - RNA, 13 nt, Human
augguggcugggu

SEQ ID NO: 2931118 - RNA, 15 nt, Human
augguggcuggguug

SEQ ID NO: 2931119 - RNA, 17 nt, Human
augguggcuggguugga

SEQ ID NO: 2931120 - RNA, 20 nt, Human
auggugagggauacccaucc

SEQ ID NO: 2931121 - RNA, 15 nt, Human
augggugcuuggagg

SEQ ID NO: 2931122 - RNA, 15 nt, Human
auggugcaaugaccu

SEQ ID NO: 2931123 - RNA, 13 nt, Human
auggugcaaugac

SEQ ID NO: 2931124 - RNA, 12 nt, Human
auggugcaauga

SEQ ID NO: 2931125 - RNA, 17 nt, Human
auggugcaaugaccuuu

SEQ ID NO: 2931126 - RNA, 16 nt, Human
auggugcaaugaccuu

SEQ ID NO: 2931127 - RNA, 19 nt, Human
auggugcaaugaccuuuca

SEQ ID NO: 2931128 - RNA, 21 nt, Human
uuucugcagccacuauuguua

SEQ ID NO: 2931129 - RNA, 19 nt, Human
uuucugcagccacuauugu

SEQ ID NO: 2931130 - RNA, 15 nt, Human
uuucuggcuaugcau

SEQ ID NO: 2931131 - RNA, 16 nt, Human
uuucuggcuaugcauu

SEQ ID NO: 2931132 - RNA, 18 nt, Human
uuucuggcuaugcauuug

SEQ ID NO: 2931133 - RNA, 19 nt, Human
uuucuggcuaugcauuuga

SEQ ID NO: 2931134 - RNA, 15 nt, Human
augggauccuggagu

SEQ ID NO: 2931135 - RNA, 18 nt, Human
uuucucccagucauuuaa

SEQ ID NO: 2931136 - RNA, 17 nt, Human
uuucucccagucauuua

SEQ ID NO: 2931137 - RNA, 15 nt, Human
augggggugcauuug

SEQ ID NO: 2931138 - RNA, 14 nt, Human
augggggugcauuu

SEQ ID NO: 2931139 - RNA, 24 nt, Human
auggggcugcaccggcuggccugg

SEQ ID NO: 2931140 - RNA, 12 nt, Human
auggggcugcac

SEQ ID NO: 2931141 - RNA, 20 nt, Human
augggcuggguucuacccag

SEQ ID NO: 2931142 - RNA, 18 nt, Human
augggccuccugugugug

SEQ ID NO: 2931143 - RNA, 15 nt, Human
uuugaaauauugacu

SEQ ID NO: 2931144 - RNA, 15 nt, Human
uuuaaauagaugaca

SEQ ID NO: 2931145 - RNA, 18 nt, Human
uuuaaauauaugcuaagu

SEQ ID NO: 2931146 - RNA, 12 nt, Human
uuuacaaauguu

SEQ ID NO: 2931147 - RNA, 22 nt, Human
uuuaauuugaagguagaauguu

SEQ ID NO: 2931148 - RNA, 19 nt, Human
uuuaauuuuuuugagacag

SEQ ID NO: 2931149 - RNA, 18 nt, Human
augcagccucacaguccu

SEQ ID NO: 2931150 - RNA, 14 nt, Human
augcccagccccuu

SEQ ID NO: 2931151 - RNA, 13 nt, Human
augcccagccccu

SEQ ID NO: 2931152 - RNA, 12 nt, Human
augcccagcccc

SEQ ID NO: 2931153 - RNA, 11 nt, Human
augcccagccc

SEQ ID NO: 2931154 - RNA, 21 nt, Human
augccauuuaaagcuuauuaa

SEQ ID NO: 2931155 - RNA, 17 nt, Human
augccauuuaaagcuua

SEQ ID NO: 2931156 - RNA, 23 nt, Human
augcagugguaugaucacggcuc

SEQ ID NO: 2931157 - RNA, 13 nt, Human
augcagugcuucc

SEQ ID NO: 2931158 - RNA, 13 nt, Human
augcaguucugaa

SEQ ID NO: 2931159 - RNA, 21 nt, Human
uuguuccacaaguuaaauaaa

SEQ ID NO: 2931160 - RNA, 16 nt, Human
uuggugcgggguacac

SEQ ID NO: 2931161 - RNA, 13 nt, Human
uuguguuacuaag

SEQ ID NO: 2931162 - RNA, 15 nt, Human
uuguguuacuaaguu

SEQ ID NO: 2931163 - RNA, 20 nt, Human
uuguguuacuaaguuuuuau

SEQ ID NO: 2931164 - RNA, 20 nt, Human
uuguucuugguuuguaaauu

SEQ ID NO: 2931165 - RNA, 19 nt, Human
uuguugaggguauguuuua

SEQ ID NO: 2931166 - RNA, 15 nt, Human
augauaacuggaaac

SEQ ID NO: 2931167 - RNA, 16 nt, Human
augauauaagguuuuu

SEQ ID NO: 2931168 - RNA, 15 nt, Human
augaucuaggaagac

SEQ ID NO: 2931169 - RNA, 20 nt, Human
augaucuaggaagacuuugg

SEQ ID NO: 2931170 - RNA, 17 nt, Human
augaucuaggaagacuu

SEQ ID NO: 2931171 - RNA, 18 nt, Human
augauuaaguaaugauaa

SEQ ID NO: 2931172 - RNA, 14 nt, Human
augauuaaguaaug

SEQ ID NO: 2931173 - RNA, 18 nt, Human
uuguuuugccaauuugca

SEQ ID NO: 2931174 - RNA, 23 nt, Human
uuuaaaaauacagauagauauau

SEQ ID NO: 2931175 - RNA, 17 nt, Human
uuuaaagauguagacag

SEQ ID NO: 2931176 - RNA, 13 nt, Human
uuuaaagaaugcu

SEQ ID NO: 2931177 - RNA, 22 nt, Human
augcaccagcccuuagcaggga

SEQ ID NO: 2931178 - RNA, 13 nt, Human
augcaccuggaau

SEQ ID NO: 2931179 - RNA, 16 nt, Human
augcacuuuguucugg

SEQ ID NO: 2931180 - RNA, 17 nt, Human
augcacuuuguucuggc

SEQ ID NO: 2931181 - RNA, 20 nt, Human
augcacuuuguucuggcucu

SEQ ID NO: 2931182 - RNA, 19 nt, Human
augcacuuuguucuggcuc

SEQ ID NO: 2931183 - RNA, 19 nt, Human
augauugccuuuuuauaac

SEQ ID NO: 2931184 - RNA, 14 nt, Human
auggcacuaguauu

SEQ ID NO: 2931185 - RNA, 16 nt, Human
auggcacuaguauuuc

SEQ ID NO: 2931186 - RNA, 15 nt, Human
augggagagaagaga

SEQ ID NO: 2931187 - RNA, 21 nt, Human
augggagcugucaagcaugua

SEQ ID NO: 2931188 - RNA, 19 nt, Human
augggagagaagagaaugc

SEQ ID NO: 2931189 - RNA, 22 nt, Human
augggagcugucaagcauguau

SEQ ID NO: 2931190 - RNA, 23 nt, Human
auggcuauaggugcuacaaaaac

SEQ ID NO: 2931191 - RNA, 18 nt, Human
auggcuaauguacugcau

SEQ ID NO: 2931192 - RNA, 19 nt, Human
auggcuaagcaaaauguga

SEQ ID NO: 2931193 - RNA, 19 nt, Human
auggacuaacuugucuuug

SEQ ID NO: 2931194 - RNA, 22 nt, Human
auggacuuugcacacuuuggcc

SEQ ID NO: 2931195 - RNA, 12 nt, Human
auggacuuuguu

SEQ ID NO: 2931196 - RNA, 11 nt, Human
auggacuuugu

SEQ ID NO: 2931197 - RNA, 14 nt, Human
auggacuucuggau

SEQ ID NO: 2931198 - RNA, 14 nt, Human
uuucaaauguucuc

SEQ ID NO: 2931199 - RNA, 18 nt, Human
uuuccaugaguccccugu

SEQ ID NO: 2931200 - RNA, 17 nt, Human
uuuccaugaguccccug

SEQ ID NO: 2931201 - RNA, 15 nt, Human
uuucaaacuuuacua

SEQ ID NO: 2931202 - RNA, 22 nt, Human
uuucaaacuuuacuauggcccu

SEQ ID NO: 2931203 - RNA, 16 nt, Human
uuucaaacuuuacuau

SEQ ID NO: 2931204 - RNA, 16 nt, Human
uuucaaacauauauaa

SEQ ID NO: 2931205 - RNA, 13 nt, Human
augcugcugcccc

SEQ ID NO: 2931206 - RNA, 15 nt, Human
augcugcugccccug

SEQ ID NO: 2931207 - RNA, 21 nt, Human
augcugcugccccugcacagc

SEQ ID NO: 2931208 - RNA, 22 nt, Human
augcugcugccccugcacagca

SEQ ID NO: 2931209 - RNA, 23 nt, Human
augcugcugccccugcacagcag

SEQ ID NO: 2931210 - RNA, 17 nt, Human
augcuguucaugaaaga

SEQ ID NO: 2931211 - RNA, 22 nt, Human
augcugugcccuaaaguguauu

SEQ ID NO: 2931212 - RNA, 19 nt, Human
augcuguucaugaaagauu

SEQ ID NO: 2931213 - RNA, 13 nt, Human
augcuucucacug

SEQ ID NO: 2931214 - RNA, 19 nt, Human
augcuagaacucccuuuca

SEQ ID NO: 2931215 - RNA, 22 nt, Human
augcuagaacucccuuucaaca

SEQ ID NO: 2931216 - RNA, 20 nt, Human
augcuagaacucccuuucaa

SEQ ID NO: 2931217 - RNA, 21 nt, Human
augcuagaacucccuuucaac

SEQ ID NO: 2931218 - RNA, 17 nt, Human
auuuaaaagauacaguu

SEQ ID NO: 2931219 - RNA, 14 nt, Human
auuuaaaagauaca

SEQ ID NO: 2931220 - RNA, 16 nt, Human
auuuaaaagauacagu

SEQ ID NO: 2931221 - RNA, 13 nt, Human
auuuaaaagauac

SEQ ID NO: 2931222 - RNA, 21 nt, Human
auuguuuggggaugagaaagg

SEQ ID NO: 2931223 - RNA, 16 nt, Human
auugucaaagugguga

SEQ ID NO: 2931224 - RNA, 23 nt, Human
auugucaaaguggugagaggcau

SEQ ID NO: 2931225 - RNA, 13 nt, Human
auugugggaaggg

SEQ ID NO: 2931226 - RNA, 14 nt, Human
auugugggaagggg

SEQ ID NO: 2931227 - RNA, 13 nt, Human
auugucuagugaa

SEQ ID NO: 2931228 - RNA, 21 nt, Human
auugauuuccguuaaaauacc

SEQ ID NO: 2931229 - RNA, 19 nt, Human
auugauugggcacaucauu

SEQ ID NO: 2931230 - RNA, 23 nt, Human
auugauugggcacaucauuucaa

SEQ ID NO: 2931231 - RNA, 13 nt, Human
auugacuuuuuau

SEQ ID NO: 2931232 - RNA, 20 nt, Human
auugauuauuacuggcaaaa

SEQ ID NO: 2931233 - RNA, 19 nt, Human
auuggagcucgugggacag

SEQ ID NO: 2931234 - RNA, 19 nt, Human
auuggacaguaaaauccac

SEQ ID NO: 2931235 - RNA, 19 nt, Human
auuucccaaagcagugcau

SEQ ID NO: 2931236 - RNA, 16 nt, Human
auuuauuuauuuauuc

SEQ ID NO: 2931237 - RNA, 12 nt, Human
auuuauuuaaau

SEQ ID NO: 2931238 - RNA, 14 nt, Human
auuuauuuaaauuu

SEQ ID NO: 2931239 - RNA, 14 nt, Human
auuuauuuuaauaa

SEQ ID NO: 2931240 - RNA, 20 nt, Human
auuucuaggacugaauuaug

SEQ ID NO: 2931241 - RNA, 23 nt, Human
auuucuaggacugaauuaugaaa

SEQ ID NO: 2931242 - RNA, 23 nt, Human
auuucuuccacaagagcccaggc

SEQ ID NO: 2931243 - RNA, 20 nt, Human
auuucuuccacaagagccca

SEQ ID NO: 2931244 - RNA, 17 nt, Human
auuucuaggacugaauu

SEQ ID NO: 2931245 - RNA, 18 nt, Human
auuucuaggacugaauua

SEQ ID NO: 2931246 - RNA, 14 nt, Human
auuugaaacacugg

SEQ ID NO: 2931247 - RNA, 17 nt, Human
auuugaaacacugguuu

SEQ ID NO: 2931248 - RNA, 16 nt, Human
auuugaaaauuuugau

SEQ ID NO: 2931249 - RNA, 15 nt, Human
auuugaaaauuuuga

SEQ ID NO: 2931250 - RNA, 16 nt, Human
auuuuaaaagaaugau

SEQ ID NO: 2931251 - RNA, 22 nt, Human
auuuuaaaaauacagauagaua

SEQ ID NO: 2931252 - RNA, 18 nt, Human
auuugucccaagugccaa

SEQ ID NO: 2931253 - RNA, 13 nt, Human
auuugucccaagu

SEQ ID NO: 2931254 - RNA, 14 nt, Human
auuugucccaagug

SEQ ID NO: 2931255 - RNA, 23 nt, Human
auuuuaaaagaaugauuaugaau

SEQ ID NO: 2931256 - RNA, 19 nt, Human
auuuguaguguuggagaag

SEQ ID NO: 2931257 - RNA, 22 nt, Human
auuuguaguguuggagaagaac

SEQ ID NO: 2931258 - RNA, 14 nt, Human
auuuguauaaaaua

SEQ ID NO: 2931259 - RNA, 19 nt, Human
auuuuuuacauuuuacaca

SEQ ID NO: 2931260 - RNA, 20 nt, Human
auuuuuucucuaggaaauau

SEQ ID NO: 2931261 - RNA, 23 nt, Human
auuuuuucucuaggaaauauuua

SEQ ID NO: 2931262 - RNA, 18 nt, Human
auuuuuuguuaaaugauu

SEQ ID NO: 2931263 - RNA, 23 nt, Human
auuuuuuaaccuccuaaguauca

SEQ ID NO: 2931264 - RNA, 13 nt, Human
auuuuuuaaaugc

SEQ ID NO: 2931265 - RNA, 14 nt, Human
auuuuuuaaaugca

SEQ ID NO: 2931266 - RNA, 14 nt, Human
auuuuuuaaaauaa

SEQ ID NO: 2931267 - RNA, 21 nt, Human
auuuuuguuuucauuaucuca

SEQ ID NO: 2931268 - RNA, 21 nt, Human
auuuuuguuuuuauuaaaagg

SEQ ID NO: 2931269 - RNA, 19 nt, Human
auuuuuguuuuuauuaaaa

SEQ ID NO: 2931270 - RNA, 19 nt, Human
auuuuuguagagccagggu

SEQ ID NO: 2931271 - RNA, 12 nt, Human
auuuuuguaauu

SEQ ID NO: 2931272 - RNA, 22 nt, Human
auuuuugugauuuugugauuga

SEQ ID NO: 2931273 - RNA, 21 nt, Human
auuuuucuuagggaaggauac

SEQ ID NO: 2931274 - RNA, 21 nt, Human
auuuuguuuuugucuuaaaaa

SEQ ID NO: 2931275 - RNA, 19 nt, Human
auuuuugguauuugaaaca

SEQ ID NO: 2931276 - RNA, 15 nt, Human
auuuuucuuauuuca

SEQ ID NO: 2931277 - RNA, 22 nt, Human
auuuuucuuagggaaggauaca

SEQ ID NO: 2931278 - RNA, 20 nt, Human
auuuuucuuauuucauuucu

SEQ ID NO: 2931279 - RNA, 19 nt, Human
auuuuucuuauuucauuuc

SEQ ID NO: 2931280 - RNA, 20 nt, Human
auuuuggaaaauaaauuauu

SEQ ID NO: 2931281 - RNA, 14 nt, Human
auuuuggaaaauaa

SEQ ID NO: 2931282 - RNA, 19 nt, Human
auuuuggaaaauaaauuau

SEQ ID NO: 2931283 - RNA, 18 nt, Human
auuuugcuuugugauuuu

SEQ ID NO: 2931284 - RNA, 20 nt, Human
auuuugcuuugugauuuuug

SEQ ID NO: 2931285 - RNA, 12 nt, Human
auuuugcuuugu

SEQ ID NO: 2931286 - RNA, 19 nt, Human
auuuugugcccccauguaa

SEQ ID NO: 2931287 - RNA, 23 nt, Human
auuuugucauauaagauucauau

SEQ ID NO: 2931288 - RNA, 16 nt, Human
auuuuguuucagugca

SEQ ID NO: 2931289 - RNA, 20 nt, Human
auuuugcuaaaugugaauga

SEQ ID NO: 2931290 - RNA, 21 nt, Human
auuuugcugucccuuuuccuu

SEQ ID NO: 2931291 - RNA, 18 nt, Human
auuuugauccaagcuggu

SEQ ID NO: 2931292 - RNA, 19 nt, Human
auuuugauccaagcugguc

SEQ ID NO: 2931293 - RNA, 15 nt, Human
auuuugauguuuuaa

SEQ ID NO: 2931294 - RNA, 17 nt, Human
auuuugauguuuuaagg

SEQ ID NO: 2931295 - RNA, 16 nt, Human
auuuuccugccaggca

SEQ ID NO: 2931296 - RNA, 14 nt, Human
auuuuccugaaaac

SEQ ID NO: 2931297 - RNA, 19 nt, Human
auuuucccuauuagagaag

SEQ ID NO: 2931298 - RNA, 15 nt, Human
auuuucuauaauuua

SEQ ID NO: 2931299 - RNA, 14 nt, Human
auuuucuauaauuu

SEQ ID NO: 2931300 - RNA, 14 nt, Human
auucuuaaauaugu

SEQ ID NO: 2931301 - RNA, 12 nt, Human
auugaaaucuuu

SEQ ID NO: 2931302 - RNA, 20 nt, Human
auugaaaucuuuuugcuuug

SEQ ID NO: 2931303 - RNA, 18 nt, Human
auugaaaucuuuuugcuu

SEQ ID NO: 2931304 - RNA, 17 nt, Human
auugaaaucuuuuugcu

SEQ ID NO: 2931305 - RNA, 19 nt, Human
auugacacuuaaaaauggu

SEQ ID NO: 2931306 - RNA, 17 nt, Human
auugaccugaggcccuu

SEQ ID NO: 2931307 - RNA, 18 nt, Human
auugaagcagaguggcag

SEQ ID NO: 2931308 - RNA, 14 nt, Human
auugaagcagagug

SEQ ID NO: 2931309 - RNA, 15 nt, Human
auugaagcagagugg

SEQ ID NO: 2931310 - RNA, 13 nt, Human
auugaagcagagu

SEQ ID NO: 2931311 - RNA, 15 nt, Human
auugacacuuaaaaa

SEQ ID NO: 2931312 - RNA, 17 nt, Human
auugacacuuaaaaaug

SEQ ID NO: 2931313 - RNA, 17 nt, Human
auucucauuugucacac

SEQ ID NO: 2931314 - RNA, 11 nt, Human
auucugccugc

SEQ ID NO: 2931315 - RNA, 13 nt, Human
auucugccugccc

SEQ ID NO: 2931316 - RNA, 14 nt, Human
auucugccugccca

SEQ ID NO: 2931317 - RNA, 15 nt, Human
auucugccugcccag

SEQ ID NO: 2931318 - RNA, 16 nt, Human
auucugccugcccagg

SEQ ID NO: 2931319 - RNA, 17 nt, Human
auucugccugcccaggc

SEQ ID NO: 2931320 - RNA, 18 nt, Human
auucugccugcccaggcc

SEQ ID NO: 2931321 - RNA, 19 nt, Human
auucugccugcccaggccc

SEQ ID NO: 2931322 - RNA, 18 nt, Human
auucugcucacauaucug

SEQ ID NO: 2931323 - RNA, 20 nt, Human
auucugccugcccaggcccc

SEQ ID NO: 2931324 - RNA, 21 nt, Human
auucugccugcccaggccccu

SEQ ID NO: 2931325 - RNA, 19 nt, Human
auucugcucacauaucugu

SEQ ID NO: 2931326 - RNA, 20 nt, Human
auucugcucacauaucuguc

SEQ ID NO: 2931327 - RNA, 21 nt, Human
auucugcucacauaucuguca

SEQ ID NO: 2931328 - RNA, 22 nt, Human
auucugcucacauaucugucau

SEQ ID NO: 2931329 - RNA, 19 nt, Human
auucuguuggccaguguga

SEQ ID NO: 2931330 - RNA, 21 nt, Human
auucuguuggccagugugaca

SEQ ID NO: 2931331 - RNA, 14 nt, Human
auucuguuggccag

SEQ ID NO: 2931332 - RNA, 17 nt, Human
uuuguggaaaauaacuc

SEQ ID NO: 2931333 - RNA, 21 nt, Human
auuaguuuugaagauucuaug

SEQ ID NO: 2931334 - RNA, 16 nt, Human
auuauauucauucuuu

SEQ ID NO: 2931335 - RNA, 19 nt, Human
auucagacagcugccuggg

SEQ ID NO: 2931336 - RNA, 11 nt, Human
auucagacagc

SEQ ID NO: 2931337 - RNA, 13 nt, Human
auucagacagcug

SEQ ID NO: 2931338 - RNA, 12 nt, Human
auucagacagcu

SEQ ID NO: 2931339 - RNA, 12 nt, Human
auucaggaagcu

SEQ ID NO: 2931340 - RNA, 18 nt, Human
auucagacagcugccugg

SEQ ID NO: 2931341 - RNA, 17 nt, Human
auucagacagcugccug

SEQ ID NO: 2931342 - RNA, 16 nt, Human
auucagacagcugccu

SEQ ID NO: 2931343 - RNA, 15 nt, Human
auucagacagcugcc

SEQ ID NO: 2931344 - RNA, 14 nt, Human
auucagacagcugc

SEQ ID NO: 2931345 - RNA, 13 nt, Human
auucaggaagcuc

SEQ ID NO: 2931346 - RNA, 15 nt, Human
auuauauuuauuacu

SEQ ID NO: 2931347 - RNA, 18 nt, Human
auuauauuuauuacugua

SEQ ID NO: 2931348 - RNA, 21 nt, Human
auuauguuaaaacugggacag

SEQ ID NO: 2931349 - RNA, 14 nt, Human
auuaucuagauacu

SEQ ID NO: 2931350 - RNA, 18 nt, Human
auuaucuagauacuguau

SEQ ID NO: 2931351 - RNA, 17 nt, Human
auuauguuaauauuucu

SEQ ID NO: 2931352 - RNA, 20 nt, Human
auuauuaccuuacagaaguu

SEQ ID NO: 2931353 - RNA, 13 nt, Human
auuauguuaauau

SEQ ID NO: 2931354 - RNA, 16 nt, Human
auuauguuaauauuuc

SEQ ID NO: 2931355 - RNA, 14 nt, Human
auuauguuaauauu

SEQ ID NO: 2931356 - RNA, 18 nt, Human
auucaaacagucucagga

SEQ ID NO: 2931357 - RNA, 16 nt, Human
auucaaacagucucag

SEQ ID NO: 2931358 - RNA, 20 nt, Human
auucaaacagucucaggaaa

SEQ ID NO: 2931359 - RNA, 19 nt, Human
auucaaacagucucaggaa

SEQ ID NO: 2931360 - RNA, 15 nt, Human
aaaaaauauuuuccu

SEQ ID NO: 2931361 - RNA, 12 nt, Human
aaaaacacagca

SEQ ID NO: 2931362 - RNA, 18 nt, Human
aaaaacacagcaagggug

SEQ ID NO: 2931363 - RNA, 13 nt, Human
aaaaacacagcaa

SEQ ID NO: 2931364 - RNA, 14 nt, Human
acucaaaucaagaa

SEQ ID NO: 2931365 - RNA, 13 nt, Human
acucaaaagcugg

SEQ ID NO: 2931366 - RNA, 16 nt, Human
acuauuuauuuacaaa

SEQ ID NO: 2931367 - RNA, 17 nt, Human
acuauuuauuuacaaau

SEQ ID NO: 2931368 - RNA, 18 nt, Human
acuauuuauuuacaaaug

SEQ ID NO: 2931369 - RNA, 20 nt, Human
acuauuuuuguuuuuauuaa

SEQ ID NO: 2931370 - RNA, 19 nt, Human
acuauucugagaugacuau

SEQ ID NO: 2931371 - RNA, 18 nt, Human
acuauucugagaugacua

SEQ ID NO: 2931372 - RNA, 21 nt, Human
acuauucaaacagucucagga

SEQ ID NO: 2931373 - RNA, 20 nt, Human
acuaguauuucuaugaaaua

SEQ ID NO: 2931374 - RNA, 21 nt, Human
acuauuuuuguuuuuauuaaa

SEQ ID NO: 2931375 - RNA, 22 nt, Human
acuauuuuuguuuuuauuaaaa

SEQ ID NO: 2931376 - RNA, 19 nt, Human
acucaguccauagcagaga

SEQ ID NO: 2931377 - RNA, 19 nt, Human
acuauuuauuuacaaaugu

SEQ ID NO: 2931378 - RNA, 15 nt, Human
acucauauuuucaug

SEQ ID NO: 2931379 - RNA, 19 nt, Human
acucugucgcccagucugg

SEQ ID NO: 2931380 - RNA, 21 nt, Human
acucuaucaaguauuauaccu

SEQ ID NO: 2931381 - RNA, 17 nt, Human
acucuauguucuaagaa

SEQ ID NO: 2931382 - RNA, 23 nt, Human
acucuaucaaguauuauaccuuu

SEQ ID NO: 2931383 - RNA, 17 nt, Human
acucuagggaaaaacca

SEQ ID NO: 2931384 - RNA, 15 nt, Human
acucuagggaaaaac

SEQ ID NO: 2931385 - RNA, 11 nt, Human
acgugaguccu

SEQ ID NO: 2931386 - RNA, 13 nt, Human
acuaagagagaau

SEQ ID NO: 2931387 - RNA, 13 nt, Human
acgucugacaggc

SEQ ID NO: 2931388 - RNA, 14 nt, Human
acggaacucaaaua

SEQ ID NO: 2931389 - RNA, 14 nt, Human
acgucugacaggca

SEQ ID NO: 2931390 - RNA, 11 nt, Human
acgcugugcug

SEQ ID NO: 2931391 - RNA, 14 nt, Human
acgcugugcugccc

SEQ ID NO: 2931392 - RNA, 12 nt, Human
acgcugugcugc

SEQ ID NO: 2931393 - RNA, 22 nt, Human
acgcaggcccccaggugccagu

SEQ ID NO: 2931394 - RNA, 19 nt, Human
acgcaggcccccaggugcc

SEQ ID NO: 2931395 - RNA, 18 nt, Human
accuuggcugcagggagu

SEQ ID NO: 2931396 - RNA, 17 nt, Human
accuuggcugcagggag

SEQ ID NO: 2931397 - RNA, 13 nt, Human
accuuucccaucu

SEQ ID NO: 2931398 - RNA, 18 nt, Human
accuuucccaucuuccaa

SEQ ID NO: 2931399 - RNA, 15 nt, Human
accuuuaagagaaau

SEQ ID NO: 2931400 - RNA, 16 nt, Human
accugucccccugaca

SEQ ID NO: 2931401 - RNA, 15 nt, Human
accugucccccugac

SEQ ID NO: 2931402 - RNA, 12 nt, Human
accugucccccu

SEQ ID NO: 2931403 - RNA, 21 nt, Human
accucugcagcaauaaagcag

SEQ ID NO: 2931404 - RNA, 18 nt, Human
accucugcagcaauaaag

SEQ ID NO: 2931405 - RNA, 20 nt, Human
accucugcagcaauaaagca

SEQ ID NO: 2931406 - RNA, 15 nt, Human
accucugcagcaaua

SEQ ID NO: 2931407 - RNA, 17 nt, Human
acugguuuguucccugu

SEQ ID NO: 2931408 - RNA, 18 nt, Human
acugguuccauggccucu

SEQ ID NO: 2931409 - RNA, 14 nt, Human
acugguuuuaaaua

SEQ ID NO: 2931410 - RNA, 22 nt, Human
acuguaagaaaauaucacuugu

SEQ ID NO: 2931411 - RNA, 19 nt, Human
acuguaagaaaauaucacu

SEQ ID NO: 2931412 - RNA, 13 nt, Human
acuguaagaaaau

SEQ ID NO: 2931413 - RNA, 16 nt, Human
acuggaagcacagcuu

SEQ ID NO: 2931414 - RNA, 19 nt, Human
acuggaagcacagcuucau

SEQ ID NO: 2931415 - RNA, 17 nt, Human
acuggaagcacagcuuc

SEQ ID NO: 2931416 - RNA, 15 nt, Human
acuggagaaaaugga

SEQ ID NO: 2931417 - RNA, 13 nt, Human
acugccagcaacg

SEQ ID NO: 2931418 - RNA, 20 nt, Human
acucugucucaguccaugaa

SEQ ID NO: 2931419 - RNA, 18 nt, Human
acucugucucaguccaug

SEQ ID NO: 2931420 - RNA, 16 nt, Human
acuucacgcccuuggc

SEQ ID NO: 2931421 - RNA, 23 nt, Human
acuucacauauugauuuccguua

SEQ ID NO: 2931422 - RNA, 21 nt, Human
acuucugucuucacaacagau

SEQ ID NO: 2931423 - RNA, 12 nt, Human
acuucagacaua

SEQ ID NO: 2931424 - RNA, 21 nt, Human
acuuggucugugagaugcuag

SEQ ID NO: 2931425 - RNA, 16 nt, Human
acuugguuuuuaaaaa

SEQ ID NO: 2931426 - RNA, 15 nt, Human
acuugggccacugug

SEQ ID NO: 2931427 - RNA, 14 nt, Human
acuugggccacugu

SEQ ID NO: 2931428 - RNA, 22 nt, Human
acuucugucuucacaacagauu

SEQ ID NO: 2931429 - RNA, 20 nt, Human
acugugcuccagccugggca

SEQ ID NO: 2931430 - RNA, 22 nt, Human
acugugcugagucugaaggcug

SEQ ID NO: 2931431 - RNA, 18 nt, Human
acugugcuccagccuggg

SEQ ID NO: 2931432 - RNA, 20 nt, Human
acugugcugagucugaaggc

SEQ ID NO: 2931433 - RNA, 23 nt, Human
agaaaaucuucauggaauucaca

SEQ ID NO: 2931434 - RNA, 22 nt, Human
agaaaguacuucuccacccugc

SEQ ID NO: 2931435 - RNA, 23 nt, Human
agaaaguacuucuccacccugcu

SEQ ID NO: 2931436 - RNA, 22 nt, Human
agaaauaacagaagaaaauaga

SEQ ID NO: 2931437 - RNA, 13 nt, Human
agaaauaacagaa

SEQ ID NO: 2931438 - RNA, 21 nt, Human
agaaauaacagaagaaaauag

SEQ ID NO: 2931439 - RNA, 22 nt, Human
agaaaguugcaaggcaaauguu

SEQ ID NO: 2931440 - RNA, 12 nt, Human
acuuuuaagacu

SEQ ID NO: 2931441 - RNA, 13 nt, Human
acuuuuaagacuu

SEQ ID NO: 2931442 - RNA, 19 nt, Human
acuuuguucuggcucuucc

SEQ ID NO: 2931443 - RNA, 20 nt, Human
acuuuguucuggcucuucca

SEQ ID NO: 2931444 - RNA, 13 nt, Human
acuuuuauaaacu

SEQ ID NO: 2931445 - RNA, 16 nt, Human
acuuuauuucucucau

SEQ ID NO: 2931446 - RNA, 22 nt, Human
acuuuauuuucuauaauuuaaa

SEQ ID NO: 2931447 - RNA, 17 nt, Human
acuuuguucuggcucuu

SEQ ID NO: 2931448 - RNA, 16 nt, Human
acuuuguucuggcucu

SEQ ID NO: 2931449 - RNA, 20 nt, Human
acuuuucauaaccuagccuu

SEQ ID NO: 2931450 - RNA, 16 nt, Human
acuuuucuuucagcca

SEQ ID NO: 2931451 - RNA, 15 nt, Human
acuuuugcaaauaag

SEQ ID NO: 2931452 - RNA, 14 nt, Human
acuuuugcaaauaa

SEQ ID NO: 2931453 - RNA, 14 nt, Human
acuuuucuuugugg

SEQ ID NO: 2931454 - RNA, 14 nt, Human
agaaaauaacaaua

SEQ ID NO: 2931455 - RNA, 16 nt, Human
agaaaaucaggcuggc

SEQ ID NO: 2931456 - RNA, 19 nt, Human
agaaaauaguggugugauu

SEQ ID NO: 2931457 - RNA, 15 nt, Human
agaaaauaccaagga

SEQ ID NO: 2931458 - RNA, 19 nt, Human
accagagcugccaccugcc

SEQ ID NO: 2931459 - RNA, 13 nt, Human
accagcagaaaug

SEQ ID NO: 2931460 - RNA, 17 nt, Human
accagccaguaaauggg

SEQ ID NO: 2931461 - RNA, 15 nt, Human
acauuuauucugcuc

SEQ ID NO: 2931462 - RNA, 12 nt, Human
accaagcccagu

SEQ ID NO: 2931463 - RNA, 14 nt, Human
acauuuauucugcu

SEQ ID NO: 2931464 - RNA, 16 nt, Human
acaugugcacaugcac

SEQ ID NO: 2931465 - RNA, 18 nt, Human
acaugugcacaugcacgu

SEQ ID NO: 2931466 - RNA, 19 nt, Human
acaugaucuucuuuauaau

SEQ ID NO: 2931467 - RNA, 18 nt, Human
acaucagcacgauuucug

SEQ ID NO: 2931468 - RNA, 15 nt, Human
acaucagcacgauuu

SEQ ID NO: 2931469 - RNA, 17 nt, Human
acaucagcacgauuucu

SEQ ID NO: 2931470 - RNA, 23 nt, Human
acauaaugcgugcauaccacuuu

SEQ ID NO: 2931471 - RNA, 22 nt, Human
acauaaugcgugcauaccacuu

SEQ ID NO: 2931472 - RNA, 21 nt, Human
acauaaugcgugcauaccacu

SEQ ID NO: 2931473 - RNA, 19 nt, Human
acaggguuuugccauguug

SEQ ID NO: 2931474 - RNA, 19 nt, Human
acaggcaaugcuggcuguu

SEQ ID NO: 2931475 - RNA, 23 nt, Human
acaggcaaugcuggcuguuggcu

SEQ ID NO: 2931476 - RNA, 16 nt, Human
accccuccaugugggc

SEQ ID NO: 2931477 - RNA, 19 nt, Human
accccuccaugugggcuag

SEQ ID NO: 2931478 - RNA, 14 nt, Human
accauauuaccaca

SEQ ID NO: 2931479 - RNA, 16 nt, Human
accauauuaccacaga

SEQ ID NO: 2931480 - RNA, 11 nt, Human
acccccugaau

SEQ ID NO: 2931481 - RNA, 16 nt, Human
acccaccucagccucc

SEQ ID NO: 2931482 - RNA, 19 nt, Human
acccaguguuuuaggagca

SEQ ID NO: 2931483 - RNA, 22 nt, Human
acccaguguuuuaggagcauga

SEQ ID NO: 2931484 - RNA, 20 nt, Human
accauccuggcuaacacggu

SEQ ID NO: 2931485 - RNA, 20 nt, Human
accauauuaccacagacaua

SEQ ID NO: 2931486 - RNA, 18 nt, Human
acccaagggccuggccug

SEQ ID NO: 2931487 - RNA, 22 nt, Human
acccaagggccuggccugagcu

SEQ ID NO: 2931488 - RNA, 19 nt, Human
acccaagggccuggccuga

SEQ ID NO: 2931489 - RNA, 13 nt, Human
acccaccucagcc

SEQ ID NO: 2931490 - RNA, 14 nt, Human
acccaccucagccu

SEQ ID NO: 2931491 - RNA, 15 nt, Human
acccaccucagccuc

SEQ ID NO: 2931492 - RNA, 21 nt, Human
acccacaagaaaugaaagcag

SEQ ID NO: 2931493 - RNA, 17 nt, Human
acccacaagaaaugaaa

SEQ ID NO: 2931494 - RNA, 23 nt, Human
acccaagggccuggccugagcug

SEQ ID NO: 2931495 - RNA, 20 nt, Human
acacagcucuguccugggag

SEQ ID NO: 2931496 - RNA, 14 nt, Human
acacagcucugucc

SEQ ID NO: 2931497 - RNA, 19 nt, Human
acacagaggcugccucucc

SEQ ID NO: 2931498 - RNA, 21 nt, Human
acacauuuuauuuuauuaugc

SEQ ID NO: 2931499 - RNA, 22 nt, Human
acacauuuuauuuuauuaugca

SEQ ID NO: 2931500 - RNA, 11 nt, Human
acacagcucuu

SEQ ID NO: 2931501 - RNA, 13 nt, Human
acacagcucuucu

SEQ ID NO: 2931502 - RNA, 20 nt, Human
acacauuuuuuaaaugcacc

SEQ ID NO: 2931503 - RNA, 22 nt, Human
acacauuuuuuaaaugcaccug

SEQ ID NO: 2931504 - RNA, 12 nt, Human
acacauuuuucu

SEQ ID NO: 2931505 - RNA, 19 nt, Human
acacgagcaggcuacuguc

SEQ ID NO: 2931506 - RNA, 14 nt, Human
acacgagcaggcua

SEQ ID NO: 2931507 - RNA, 15 nt, Human
acacgcgugcacaca

SEQ ID NO: 2931508 - RNA, 17 nt, Human
acacgcgugcacacacc

SEQ ID NO: 2931509 - RNA, 21 nt, Human
acacgagcaggcuacugucag

SEQ ID NO: 2931510 - RNA, 20 nt, Human
acaaggcaaggcugucaauu

SEQ ID NO: 2931511 - RNA, 17 nt, Human
acaaggauugcuacugu

SEQ ID NO: 2931512 - RNA, 14 nt, Human
acaaggcaaggcug

SEQ ID NO: 2931513 - RNA, 12 nt, Human
acaaggcaaggc

SEQ ID NO: 2931514 - RNA, 22 nt, Human
acaaaauguaggguuauaauaa

SEQ ID NO: 2931515 - RNA, 18 nt, Human
acagccacggccaggcca

SEQ ID NO: 2931516 - RNA, 15 nt, Human
acagccacggccagg

SEQ ID NO: 2931517 - RNA, 16 nt, Human
acagccacggccaggc

SEQ ID NO: 2931518 - RNA, 17 nt, Human
acagccacggccaggcc

SEQ ID NO: 2931519 - RNA, 16 nt, Human
acagcucuucuccagg

SEQ ID NO: 2931520 - RNA, 17 nt, Human
acagcucuucuccaggc

SEQ ID NO: 2931521 - RNA, 15 nt, Human
acaggaucagucuga

SEQ ID NO: 2931522 - RNA, 14 nt, Human
acaggauuauugga

SEQ ID NO: 2931523 - RNA, 18 nt, Human
acaggcaaugcuggcugu

SEQ ID NO: 2931524 - RNA, 12 nt, Human
acaggcaagcac

SEQ ID NO: 2931525 - RNA, 21 nt, Human
acacuggcucacccaguccug

SEQ ID NO: 2931526 - RNA, 20 nt, Human
acacuggcucacccaguccu

SEQ ID NO: 2931527 - RNA, 14 nt, Human
acacugcauguuug

SEQ ID NO: 2931528 - RNA, 15 nt, Human
acacugcauguuugu

SEQ ID NO: 2931529 - RNA, 19 nt, Human
acagaggcagccccauucu

SEQ ID NO: 2931530 - RNA, 23 nt, Human
acagaggccaugggccuccugug

SEQ ID NO: 2931531 - RNA, 13 nt, Human
acagacacaggcc

SEQ ID NO: 2931532 - RNA, 14 nt, Human
acagacacaggccc

SEQ ID NO: 2931533 - RNA, 14 nt, Human
acagaggcagcccc

SEQ ID NO: 2931534 - RNA, 15 nt, Human
acagaggcagcccca

SEQ ID NO: 2931535 - RNA, 15 nt, Human
acacuguacugcaau

SEQ ID NO: 2931536 - RNA, 11 nt, Human
acagacacagg

SEQ ID NO: 2931537 - RNA, 23 nt, Human
acagagucucacuguugcccagg

SEQ ID NO: 2931538 - RNA, 15 nt, Human
acagagugagacucu

SEQ ID NO: 2931539 - RNA, 14 nt, Human
acagaggggguggc

SEQ ID NO: 2931540 - RNA, 19 nt, Human
acagagugagacucugucu

SEQ ID NO: 2931541 - RNA, 21 nt, Human
acagcaguugaaaagacucca

SEQ ID NO: 2931542 - RNA, 23 nt, Human
acagcaguugaaaagacuccaaa

SEQ ID NO: 2931543 - RNA, 22 nt, Human
acagcaguugaaaagacuccaa

SEQ ID NO: 2931544 - RNA, 16 nt, Human
aaagccuccuccagcc

SEQ ID NO: 2931545 - RNA, 16 nt, Human
aaaggcuccaggagca

SEQ ID NO: 2931546 - RNA, 15 nt, Human
aaaggcuccaggagc

SEQ ID NO: 2931547 - RNA, 14 nt, Human
aaaggcagaagcaa

SEQ ID NO: 2931548 - RNA, 20 nt, Human
aaaggcuccaggagcagcca

SEQ ID NO: 2931549 - RNA, 19 nt, Human
aaaggcuccaggagcagcc

SEQ ID NO: 2931550 - RNA, 13 nt, Human
aaaguggaaaaau

SEQ ID NO: 2931551 - RNA, 13 nt, Human
aaauaaaacuuuu

SEQ ID NO: 2931552 - RNA, 16 nt, Human
aaauaaaacuuuuuaa

SEQ ID NO: 2931553 - RNA, 19 nt, Human
aaauaaaacuuuuuaaaau

SEQ ID NO: 2931554 - RNA, 19 nt, Human
aaauaguggugugauuugg

SEQ ID NO: 2931555 - RNA, 20 nt, Human
aaauagcuuuuuucucugau

SEQ ID NO: 2931556 - RNA, 17 nt, Human
aaauagcuuuuuucucu

SEQ ID NO: 2931557 - RNA, 24 nt, Human
aaauagcucaggugucccugcacu

SEQ ID NO: 2931558 - RNA, 18 nt, Human
aaaucugcuuuuuaaaga

SEQ ID NO: 2931559 - RNA, 20 nt, Human
aaauauuuauuuuaauaaug

SEQ ID NO: 2931560 - RNA, 13 nt, Human
aaauauuuauuuu

SEQ ID NO: 2931561 - RNA, 15 nt, Human
aaauauuuauuuuaa

SEQ ID NO: 2931562 - RNA, 14 nt, Human
aaaucaaauaugca

SEQ ID NO: 2931563 - RNA, 12 nt, Human
aaaucaaauaug

SEQ ID NO: 2931564 - RNA, 15 nt, Human
aaaucaaauaugcaa

SEQ ID NO: 2931565 - RNA, 15 nt, Human
aaagaaauguaaggg

SEQ ID NO: 2931566 - RNA, 13 nt, Human
aaagaagcagacc

SEQ ID NO: 2931567 - RNA, 16 nt, Human
aaagaagcagaccauu

SEQ ID NO: 2931568 - RNA, 23 nt, Human
aaagaaggcauggacuucuggau

SEQ ID NO: 2931569 - RNA, 14 nt, Human
aaagaguaggaaga

SEQ ID NO: 2931570 - RNA, 11 nt, Human
aaacugagcau

SEQ ID NO: 2931571 - RNA, 15 nt, Human
aaacucugagugcaa

SEQ ID NO: 2931572 - RNA, 13 nt, Human
aaacucugagugc

SEQ ID NO: 2931573 - RNA, 23 nt, Human
aaacugagaugugaacacaucag

SEQ ID NO: 2931574 - RNA, 21 nt, Human
aaacugagaugugaacacauc

SEQ ID NO: 2931575 - RNA, 12 nt, Human
aaagauauuuug

SEQ ID NO: 2931576 - RNA, 16 nt, Human
aaagauauuuugcuuu

SEQ ID NO: 2931577 - RNA, 17 nt, Human
aaagauauuuugcuuug

SEQ ID NO: 2931578 - RNA, 18 nt, Human
aaacucuccucugcugcu

SEQ ID NO: 2931579 - RNA, 20 nt, Human
aaacccgucucuacuaaaaa

SEQ ID NO: 2931580 - RNA, 21 nt, Human
aaacccgucucuacuaaaaau

SEQ ID NO: 2931581 - RNA, 18 nt, Human
aaaccaucauugaaaucu

SEQ ID NO: 2931582 - RNA, 22 nt, Human
aaaaucccuuaccucggugccu

SEQ ID NO: 2931583 - RNA, 21 nt, Human
aaaaucuacacuccagugaga

SEQ ID NO: 2931584 - RNA, 18 nt, Human
aaaaguucugcagauaaa

SEQ ID NO: 2931585 - RNA, 13 nt, Human
aaaaguugaauuu

SEQ ID NO: 2931586 - RNA, 17 nt, Human
aaaauaaaacuuuuuaa

SEQ ID NO: 2931587 - RNA, 15 nt, Human
aaaaagaaaggaggg

SEQ ID NO: 2931588 - RNA, 16 nt, Human
aaaaagaaacauuugg

SEQ ID NO: 2931589 - RNA, 19 nt, Human
aaacacugguuuuaaauau

SEQ ID NO: 2931590 - RNA, 16 nt, Human
aaacacuguucucugc

SEQ ID NO: 2931591 - RNA, 16 nt, Human
aaaaucucaauauuuc

SEQ ID NO: 2931592 - RNA, 19 nt, Human
aaaaucucaaauuucuaaa

SEQ ID NO: 2931593 - RNA, 22 nt, Human
aaaaucucaaauuucuaaaucu

SEQ ID NO: 2931594 - RNA, 14 nt, Human
aacugaucauguuu

SEQ ID NO: 2931595 - RNA, 14 nt, Human
aacugauaaagaug

SEQ ID NO: 2931596 - RNA, 19 nt, Human
aacuuaaauaaugugaaac

SEQ ID NO: 2931597 - RNA, 15 nt, Human
aacugacucuuaaga

SEQ ID NO: 2931598 - RNA, 18 nt, Human
aacugacucuuaagaaga

SEQ ID NO: 2931599 - RNA, 20 nt, Human
aacugagaugugaacacauc

SEQ ID NO: 2931600 - RNA, 19 nt, Human
aacugacucuuaagaagac

SEQ ID NO: 2931601 - RNA, 20 nt, Human
aacugacucuuaagaagacu

SEQ ID NO: 2931602 - RNA, 13 nt, Human
aacuuaaugaaaa

SEQ ID NO: 2931603 - RNA, 18 nt, Human
aacuuaaucuaaauggaa

SEQ ID NO: 2931604 - RNA, 15 nt, Human
aacuuaaucuaaaug

SEQ ID NO: 2931605 - RNA, 16 nt, Human
aacuuaaucuaaaugg

SEQ ID NO: 2931606 - RNA, 21 nt, Human
aacuuuaugcuaagugaaaua

SEQ ID NO: 2931607 - RNA, 20 nt, Human
aacuuuaugcuaagugaaau

SEQ ID NO: 2931608 - RNA, 21 nt, Human
aacacaucuaguaguuguucu

SEQ ID NO: 2931609 - RNA, 20 nt, Human
aacacauuaaagguacuuug

SEQ ID NO: 2931610 - RNA, 15 nt, Human
aacacauuaaaggua

SEQ ID NO: 2931611 - RNA, 16 nt, Human
aacacaucagcuugcc

SEQ ID NO: 2931612 - RNA, 18 nt, Human
aacaaauuuacagagaca

SEQ ID NO: 2931613 - RNA, 19 nt, Human
aaauugacacuuaaaaaug

SEQ ID NO: 2931614 - RNA, 13 nt, Human
aaauucuuucauu

SEQ ID NO: 2931615 - RNA, 21 nt, Human
aaauucuugcaaaguaucccu

SEQ ID NO: 2931616 - RNA, 18 nt, Human
aaauucuugcaaaguauc

SEQ ID NO: 2931617 - RNA, 23 nt, Human
aaaugccuuacccucauguucuu

SEQ ID NO: 2931618 - RNA, 17 nt, Human
aaaucuuauaauuuaaa

SEQ ID NO: 2931619 - RNA, 22 nt, Human
aaauguuguucucuucuuuaaa

SEQ ID NO: 2931620 - RNA, 22 nt, Human
aaauguuuauuuaaaagagcag

SEQ ID NO: 2931621 - RNA, 15 nt, Human
aaauguuuauuuaaa

SEQ ID NO: 2931622 - RNA, 17 nt, Human
aaauguuuauuuaaaag

SEQ ID NO: 2931623 - RNA, 18 nt, Human
aaauguuuauuuaaaaga

SEQ ID NO: 2931624 - RNA, 14 nt, Human
aaauguuuauuuaa

SEQ ID NO: 2931625 - RNA, 22 nt, Human
aacagcaacacaaagcuuuugc

SEQ ID NO: 2931626 - RNA, 13 nt, Human
aaccacgcuggac

SEQ ID NO: 2931627 - RNA, 15 nt, Human
aaccacuucagcuga

SEQ ID NO: 2931628 - RNA, 22 nt, Human
aaccacuggaaaguuuaugguu

SEQ ID NO: 2931629 - RNA, 21 nt, Human
aaccgaacugauguaaguaaa

SEQ ID NO: 2931630 - RNA, 16 nt, Human
aacccgggaggcagag

SEQ ID NO: 2931631 - RNA, 17 nt, Human
aaccuagggugauauua

SEQ ID NO: 2931632 - RNA, 12 nt, Human
aaguugaauuuu

SEQ ID NO: 2931633 - RNA, 21 nt, Human
aaguggaaaaauagccugccu

SEQ ID NO: 2931634 - RNA, 19 nt, Human
aaguggaaaaauagccugc

SEQ ID NO: 2931635 - RNA, 20 nt, Human
aagucuagguugguagaguu

SEQ ID NO: 2931636 - RNA, 22 nt, Human
aaguccucuuuucugagaggac

SEQ ID NO: 2931637 - RNA, 18 nt, Human
aaguccucuuuucugaga

SEQ ID NO: 2931638 - RNA, 18 nt, Human
aaguccaagcauuuagau

SEQ ID NO: 2931639 - RNA, 17 nt, Human
aaguccaagcauaccaa

SEQ ID NO: 2931640 - RNA, 12 nt, Human
aaggugcaucug

SEQ ID NO: 2931641 - RNA, 19 nt, Human
aaguagaagucuuagaugu

SEQ ID NO: 2931642 - RNA, 20 nt, Human
aaguagaagucuuagaugua

SEQ ID NO: 2931643 - RNA, 17 nt, Human
aaguaucccuacuguaa

SEQ ID NO: 2931644 - RNA, 18 nt, Human
aaguaucccuacuguaau

SEQ ID NO: 2931645 - RNA, 23 nt, Human
aaguaucccuacuguaauuugug

SEQ ID NO: 2931646 - RNA, 21 nt, Human
aaguagaagucuuagauguau

SEQ ID NO: 2931647 - RNA, 21 nt, Human
aaguagggacuucugucuuca

SEQ ID NO: 2931648 - RNA, 18 nt, Human
aaggucauuuuuuuuaag

SEQ ID NO: 2931649 - RNA, 19 nt, Human
aaggucauuuuuuuuaaga

SEQ ID NO: 2931650 - RNA, 23 nt, Human
aagggaaacugccagcaacgcag

SEQ ID NO: 2931651 - RNA, 17 nt, Human
aagggaaacugccagca

SEQ ID NO: 2931652 - RNA, 16 nt, Human
aagggaaacugccagc

SEQ ID NO: 2931653 - RNA, 22 nt, Human
aagcuacugccauccuggccca

SEQ ID NO: 2931654 - RNA, 17 nt, Human
aagcuacugccauccug

SEQ ID NO: 2931655 - RNA, 15 nt, Human
aagcugggcagguug

SEQ ID NO: 2931656 - RNA, 18 nt, Human
aagcuggucccacucagu

SEQ ID NO: 2931657 - RNA, 21 nt, Human
aagcuggucccacucagucca

SEQ ID NO: 2931658 - RNA, 13 nt, Human
aaggacacuagaa

SEQ ID NO: 2931659 - RNA, 15 nt, Human
aaggauguucuagca

SEQ ID NO: 2931660 - RNA, 15 nt, Human
aaggauugcuacugu

SEQ ID NO: 2931661 - RNA, 20 nt, Human
aaggcagcucuaaaugucaa

SEQ ID NO: 2931662 - RNA, 21 nt, Human
aagcgauucuucugcuucagc

SEQ ID NO: 2931663 - RNA, 17 nt, Human
aagcgauucuucugcuu

SEQ ID NO: 2931664 - RNA, 23 nt, Human
aagccagcaggcucucaggccag

SEQ ID NO: 2931665 - RNA, 20 nt, Human
aagccagcaggcucucaggc

SEQ ID NO: 2931666 - RNA, 19 nt, Human
aagauucuauguuaauauu

SEQ ID NO: 2931667 - RNA, 11 nt, Human
aagauucuaug

SEQ ID NO: 2931668 - RNA, 17 nt, Human
aagcagcguuucuauga

SEQ ID NO: 2931669 - RNA, 20 nt, Human
aagcagcguuucuaugacac

SEQ ID NO: 2931670 - RNA, 14 nt, Human
aagcagcguuucua

SEQ ID NO: 2931671 - RNA, 21 nt, Human
aagcagcguuucuaugacaca

SEQ ID NO: 2931672 - RNA, 22 nt, Human
aagcagcguuucuaugacacau

SEQ ID NO: 2931673 - RNA, 19 nt, Human
aagccagcaggcucucagg

SEQ ID NO: 2931674 - RNA, 12 nt, Human
aagauaaaugug

SEQ ID NO: 2931675 - RNA, 23 nt, Human
aagauacaguuacucagaauucu

SEQ ID NO: 2931676 - RNA, 13 nt, Human
aagauaaaugugc

SEQ ID NO: 2931677 - RNA, 13 nt, Human
aagauacugaaau

SEQ ID NO: 2931678 - RNA, 13 nt, Human
aauacucuuauau

SEQ ID NO: 2931679 - RNA, 22 nt, Human
aauacucuacccucuuagaaaa

SEQ ID NO: 2931680 - RNA, 20 nt, Human
aauacucuacccucuuagaa

SEQ ID NO: 2931681 - RNA, 13 nt, Human
aauagacaauuua

SEQ ID NO: 2931682 - RNA, 15 nt, Human
aauagaauugacauu

SEQ ID NO: 2931683 - RNA, 21 nt, Human
aauagaauugacauugaaauc

SEQ ID NO: 2931684 - RNA, 22 nt, Human
aauagaauugacauugaaaucu

SEQ ID NO: 2931685 - RNA, 13 nt, Human
aauauguuucaca

SEQ ID NO: 2931686 - RNA, 15 nt, Human
aauauguuucacaca

SEQ ID NO: 2931687 - RNA, 14 nt, Human
aaucaccgaaaacg

SEQ ID NO: 2931688 - RNA, 15 nt, Human
aaucaccgaaaacgu

SEQ ID NO: 2931689 - RNA, 19 nt, Human
aauccagacccggcugcgu

SEQ ID NO: 2931690 - RNA, 17 nt, Human
aauccagacccggcugc

SEQ ID NO: 2931691 - RNA, 16 nt, Human
aaucucaaauuucuaa

SEQ ID NO: 2931692 - RNA, 15 nt, Human
aaucucaaauuucua

SEQ ID NO: 2931693 - RNA, 21 nt, Human
aaucucugauucccugauuua

SEQ ID NO: 2931694 - RNA, 17 nt, Human
aaucucaaauuucuaaa

SEQ ID NO: 2931695 - RNA, 18 nt, Human
aaucucaaauuucuaaau

SEQ ID NO: 2931696 - RNA, 15 nt, Human
aaugauuaugaauua

SEQ ID NO: 2931697 - RNA, 21 nt, Human
aaugauuaugaauuacauuug

SEQ ID NO: 2931698 - RNA, 16 nt, Human
aaugauuaauuaaaac

SEQ ID NO: 2931699 - RNA, 15 nt, Human
aaugugaaaagaaaa

SEQ ID NO: 2931700 - RNA, 15 nt, Human
aauguuugccucugc

SEQ ID NO: 2931701 - RNA, 16 nt, Human
aauguuugccucugcc

SEQ ID NO: 2931702 - RNA, 23 nt, Human
aauguuucaaacauauauaacaa

SEQ ID NO: 2931703 - RNA, 19 nt, Human
aaugcgugcauaccacuuu

SEQ ID NO: 2931704 - RNA, 18 nt, Human
aaugcgugcauaccacuu

SEQ ID NO: 2931705 - RNA, 23 nt, Human
aaugccuuacccucauguucuua

SEQ ID NO: 2931706 - RNA, 15 nt, Human
agcaugaagacagag

SEQ ID NO: 2931707 - RNA, 19 nt, Human
agcaucgcuuaggagaagu

SEQ ID NO: 2931708 - RNA, 18 nt, Human
agcauccuggcacccggc

SEQ ID NO: 2931709 - RNA, 22 nt, Human
agcauccuggcacccggccccu

SEQ ID NO: 2931710 - RNA, 23 nt, Human
agcauccuggcacccggccccug

SEQ ID NO: 2931711 - RNA, 23 nt, Human
agcaugccuggauggggcugcac

SEQ ID NO: 2931712 - RNA, 20 nt, Human
agcaugccuggauggggcug

SEQ ID NO: 2931713 - RNA, 23 nt, Human
agccaagugugguagagugugcc

SEQ ID NO: 2931714 - RNA, 16 nt, Human
agcaguugaaaagacu

SEQ ID NO: 2931715 - RNA, 13 nt, Human
agcaguugaaaag

SEQ ID NO: 2931716 - RNA, 23 nt, Human
agcaguucagagcugcccucucc

SEQ ID NO: 2931717 - RNA, 20 nt, Human
agcaguucagagcugcccuc

SEQ ID NO: 2931718 - RNA, 13 nt, Human
agcagcguuucua

SEQ ID NO: 2931719 - RNA, 20 nt, Human
agcagugcaugcugucccuu

SEQ ID NO: 2931720 - RNA, 19 nt, Human
agcagugcaugcugucccu

SEQ ID NO: 2931721 - RNA, 18 nt, Human
agcagugcaugcuguccc

SEQ ID NO: 2931722 - RNA, 12 nt, Human
agcacacuggcu

SEQ ID NO: 2931723 - RNA, 19 nt, Human
agcacacuggcucacccag

SEQ ID NO: 2931724 - RNA, 23 nt, Human
agcacacuugacaucaacugcau

SEQ ID NO: 2931725 - RNA, 20 nt, Human
agcacacuggcucacccagu

SEQ ID NO: 2931726 - RNA, 17 nt, Human
agcacagacccugcccu

SEQ ID NO: 2931727 - RNA, 20 nt, Human
agcacagacccugcccugug

SEQ ID NO: 2931728 - RNA, 19 nt, Human
agcacagacccugcccugu

SEQ ID NO: 2931729 - RNA, 18 nt, Human
agcacagacccugcccug

SEQ ID NO: 2931730 - RNA, 16 nt, Human
agcacugacuucuaag

SEQ ID NO: 2931731 - RNA, 13 nt, Human
agccccagugccc

SEQ ID NO: 2931732 - RNA, 14 nt, Human
agccccagugccca

SEQ ID NO: 2931733 - RNA, 15 nt, Human
agccccagugcccac

SEQ ID NO: 2931734 - RNA, 17 nt, Human
agcccucaauugugaaa

SEQ ID NO: 2931735 - RNA, 16 nt, Human
agcccucaauugugaa

SEQ ID NO: 2931736 - RNA, 13 nt, Human
agccccauucugc

SEQ ID NO: 2931737 - RNA, 16 nt, Human
agccccauucugccug

SEQ ID NO: 2931738 - RNA, 20 nt, Human
agccagcaggcucucaggcc

SEQ ID NO: 2931739 - RNA, 17 nt, Human
agccagcaggcucucag

SEQ ID NO: 2931740 - RNA, 19 nt, Human
agccagcaggcucucaggc

SEQ ID NO: 2931741 - RNA, 18 nt, Human
agccagcaggcucucagg

SEQ ID NO: 2931742 - RNA, 22 nt, Human
agccgggcgugguggcaggcac

SEQ ID NO: 2931743 - RNA, 22 nt, Human
agccucccacgacugcccggca

SEQ ID NO: 2931744 - RNA, 21 nt, Human
agccucccaaagugcugggau

SEQ ID NO: 2931745 - RNA, 14 nt, Human
agccuccuccagcc

SEQ ID NO: 2931746 - RNA, 20 nt, Human
agccucccgaguagcuggga

SEQ ID NO: 2931747 - RNA, 18 nt, Human
agccucccgaguagcugg

SEQ ID NO: 2931748 - RNA, 19 nt, Human
agccucccgaguagcuggg

SEQ ID NO: 2931749 - RNA, 21 nt, Human
agccgccaugcuccuggccca

SEQ ID NO: 2931750 - RNA, 13 nt, Human
agccgcuggggcc

SEQ ID NO: 2931751 - RNA, 12 nt, Human
agccgcccaagg

SEQ ID NO: 2931752 - RNA, 13 nt, Human
agccgcccaaggc

SEQ ID NO: 2931753 - RNA, 15 nt, Human
agccgcccaaggccu

SEQ ID NO: 2931754 - RNA, 16 nt, Human
agccgcccaaggccuu

SEQ ID NO: 2931755 - RNA, 23 nt, Human
agacagagucucacuguugccca

SEQ ID NO: 2931756 - RNA, 21 nt, Human
agacagauacuccuccaaggu

SEQ ID NO: 2931757 - RNA, 15 nt, Human
agacagauacuccuc

SEQ ID NO: 2931758 - RNA, 15 nt, Human
agacagcccgggcuc

SEQ ID NO: 2931759 - RNA, 14 nt, Human
agacagcccgggcu

SEQ ID NO: 2931760 - RNA, 12 nt, Human
agacagcugccu

SEQ ID NO: 2931761 - RNA, 12 nt, Human
agacagcucuua

SEQ ID NO: 2931762 - RNA, 11 nt, Human
agacagcucuu

SEQ ID NO: 2931763 - RNA, 21 nt, Human
agacgcugugcugcccugccc

SEQ ID NO: 2931764 - RNA, 18 nt, Human
agacggagucccaccuug

SEQ ID NO: 2931765 - RNA, 22 nt, Human
agacgcugugcugcccugccca

SEQ ID NO: 2931766 - RNA, 22 nt, Human
agacgugcacgcacacugucug

SEQ ID NO: 2931767 - RNA, 21 nt, Human
agacgugcacgcacacugucu

SEQ ID NO: 2931768 - RNA, 19 nt, Human
agagcccaccuuggcucaa

SEQ ID NO: 2931769 - RNA, 13 nt, Human
agagcccacgccc

SEQ ID NO: 2931770 - RNA, 16 nt, Human
agagcccacgccccca

SEQ ID NO: 2931771 - RNA, 22 nt, Human
agagaggguggugaccucugcc

SEQ ID NO: 2931772 - RNA, 20 nt, Human
agagaggguggugaccucug

SEQ ID NO: 2931773 - RNA, 21 nt, Human
agagaggguggugaccucugc

SEQ ID NO: 2931774 - RNA, 17 nt, Human
agagaacuuccagaucc

SEQ ID NO: 2931775 - RNA, 19 nt, Human
agacuggaagcacagcuuc

SEQ ID NO: 2931776 - RNA, 17 nt, Human
agacuggaagcacagcu

SEQ ID NO: 2931777 - RNA, 16 nt, Human
agacuggaagcacagc

SEQ ID NO: 2931778 - RNA, 21 nt, Human
agacugcauuauauuuauuac

SEQ ID NO: 2931779 - RNA, 19 nt, Human
agauauaugcucugcaugu

SEQ ID NO: 2931780 - RNA, 14 nt, Human
agaucuucuguggg

SEQ ID NO: 2931781 - RNA, 16 nt, Human
agaggaaggagaggag

SEQ ID NO: 2931782 - RNA, 23 nt, Human
agaggacuuuucuuuguggcuuc

SEQ ID NO: 2931783 - RNA, 16 nt, Human
agaggagagaggaccc

SEQ ID NO: 2931784 - RNA, 15 nt, Human
agaggagagaggacc

SEQ ID NO: 2931785 - RNA, 19 nt, Human
agaggguggugaccucugc

SEQ ID NO: 2931786 - RNA, 20 nt, Human
agaggguggugaccucugcc

SEQ ID NO: 2931787 - RNA, 22 nt, Human
agaggguggugaccucugccug

SEQ ID NO: 2931788 - RNA, 12 nt, Human
agagggcacaga

SEQ ID NO: 2931789 - RNA, 11 nt, Human
agagugggagc

SEQ ID NO: 2931790 - RNA, 19 nt, Human
agaguggggauaugauuua

SEQ ID NO: 2931791 - RNA, 20 nt, Human
agagugugauguauguguaa

SEQ ID NO: 2931792 - RNA, 14 nt, Human
agagugugccugaa

SEQ ID NO: 2931793 - RNA, 14 nt, Human
agagcccaggccuc

SEQ ID NO: 2931794 - RNA, 13 nt, Human
agagcccaggccu

SEQ ID NO: 2931795 - RNA, 15 nt, Human
agagcccaggccucc

SEQ ID NO: 2931796 - RNA, 23 nt, Human
agcugcgguccacccaggagccc

SEQ ID NO: 2931797 - RNA, 23 nt, Human
agcuccgcuuucuacccagcgag

SEQ ID NO: 2931798 - RNA, 20 nt, Human
agcuccgcuuucuacccagc

SEQ ID NO: 2931799 - RNA, 21 nt, Human
agcuccgcuuucuacccagcg

SEQ ID NO: 2931800 - RNA, 12 nt, Human
agcuccuucugu

SEQ ID NO: 2931801 - RNA, 13 nt, Human
agcuccuucuguc

SEQ ID NO: 2931802 - RNA, 21 nt, Human
agcugcgguccacccaggagc

SEQ ID NO: 2931803 - RNA, 22 nt, Human
agcuccccucggagaagagcug

SEQ ID NO: 2931804 - RNA, 12 nt, Human
agcuuuugcaua

SEQ ID NO: 2931805 - RNA, 20 nt, Human
aggaauccagacccggcugc

SEQ ID NO: 2931806 - RNA, 17 nt, Human
aggaauccagacccggc

SEQ ID NO: 2931807 - RNA, 21 nt, Human
aggaaucaugugccaagcaga

SEQ ID NO: 2931808 - RNA, 22 nt, Human
aggagaagucuucuauuuauuu

SEQ ID NO: 2931809 - RNA, 23 nt, Human
aggagaagucuucuauuuauuua

SEQ ID NO: 2931810 - RNA, 13 nt, Human
aggaccucaggug

SEQ ID NO: 2931811 - RNA, 21 nt, Human
aggaugcuuguacauaaugcg

SEQ ID NO: 2931812 - RNA, 23 nt, Human
aggaugcuuguacauaaugcgug

SEQ ID NO: 2931813 - RNA, 14 nt, Human
aggauuauuggaaa

SEQ ID NO: 2931814 - RNA, 17 nt, Human
aggauguugaaaaaguu

SEQ ID NO: 2931815 - RNA, 15 nt, Human
aggauguucugggac

SEQ ID NO: 2931816 - RNA, 16 nt, Human
aggauguucugggaca

SEQ ID NO: 2931817 - RNA, 22 nt, Human
aggauguucuagcauggcugcc

SEQ ID NO: 2931818 - RNA, 23 nt, Human
aggaugguucccuugaugaagaa

SEQ ID NO: 2931819 - RNA, 20 nt, Human
agguaaaagcaucacaugaa

SEQ ID NO: 2931820 - RNA, 20 nt, Human
agguaaugaccaugaaagac

SEQ ID NO: 2931821 - RNA, 21 nt, Human
agguaaugaccaugaaagacu

SEQ ID NO: 2931822 - RNA, 19 nt, Human
agguaaugaccaugaaaga

SEQ ID NO: 2931823 - RNA, 14 nt, Human
agguacacuuguga

SEQ ID NO: 2931824 - RNA, 18 nt, Human
aggucuguucuuuccaaa

SEQ ID NO: 2931825 - RNA, 22 nt, Human
aggucuguuuuguguacuuuua

SEQ ID NO: 2931826 - RNA, 18 nt, Human
aggugcuacaaaaacaca

SEQ ID NO: 2931827 - RNA, 22 nt, Human
aggucuguucuuuccaaaguac

SEQ ID NO: 2931828 - RNA, 23 nt, Human
aggucuguucuuuccaaaguaca

SEQ ID NO: 2931829 - RNA, 22 nt, Human
aggugcuacaaaaacacagcaa

SEQ ID NO: 2931830 - RNA, 21 nt, Human
aggugcuacaaaaacacagca

SEQ ID NO: 2931831 - RNA, 20 nt, Human
aggugcuacaaaaacacagc

SEQ ID NO: 2931832 - RNA, 19 nt, Human
aggugcuacaaaaacacag

SEQ ID NO: 2931833 - RNA, 16 nt, Human
agguuaaaaagaaaag

SEQ ID NO: 2931834 - RNA, 23 nt, Human
aggugcuaggaacacuccuucac

SEQ ID NO: 2931835 - RNA, 24 nt, Human
aggugcuacaaaaacacagcaagg

SEQ ID NO: 2931836 - RNA, 23 nt, Human
aggugcuacaaaaacacagcaag

SEQ ID NO: 2931837 - RNA, 22 nt, Human
aggugcuaggaacacuccuuca

SEQ ID NO: 2931838 - RNA, 19 nt, Human
aggugcuaggaacacuccu

SEQ ID NO: 2931839 - RNA, 23 nt, Human
agguucccuuugacgccauccca

SEQ ID NO: 2931840 - RNA, 14 nt, Human
agguucaaagauau

SEQ ID NO: 2931841 - RNA, 13 nt, Human
agguucccuuuga

SEQ ID NO: 2931842 - RNA, 22 nt, Human
agguucccuuugacgccauccc

SEQ ID NO: 2931843 - RNA, 11 nt, Human
agggucccugg

SEQ ID NO: 2931844 - RNA, 19 nt, Human
aggguaucaggugcugcca

SEQ ID NO: 2931845 - RNA, 18 nt, Human
aggguaucaggugcugcc

SEQ ID NO: 2931846 - RNA, 21 nt, Human
aggguaucaggugcugccauc

SEQ ID NO: 2931847 - RNA, 15 nt, Human
aggguaucuggugac

SEQ ID NO: 2931848 - RNA, 21 nt, Human
aggggccucuuaugggcuggg

SEQ ID NO: 2931849 - RNA, 20 nt, Human
aggggccucuuaugggcugg

SEQ ID NO: 2931850 - RNA, 19 nt, Human
aggggccucuuaugggcug

SEQ ID NO: 2931851 - RNA, 23 nt, Human
agggacagaggggguggccuccc

SEQ ID NO: 2931852 - RNA, 21 nt, Human
aggcugucaauuacaggaagu

SEQ ID NO: 2931853 - RNA, 22 nt, Human
agggacagaggggguggccucc

SEQ ID NO: 2931854 - RNA, 13 nt, Human
aggcuguauccca

SEQ ID NO: 2931855 - RNA, 18 nt, Human
aggcuguaucccaugagc

SEQ ID NO: 2931856 - RNA, 19 nt, Human
aggcugucaauuacaggaa

SEQ ID NO: 2931857 - RNA, 20 nt, Human
aggcugucaauuacaggaag

SEQ ID NO: 2931858 - RNA, 17 nt, Human
aggcuagauguauguac

SEQ ID NO: 2931859 - RNA, 15 nt, Human
aggcuagauguaugu

SEQ ID NO: 2931860 - RNA, 16 nt, Human
aggcuagauguaugua

SEQ ID NO: 2931861 - RNA, 22 nt, Human
aggcccuugucggccccaccag

SEQ ID NO: 2931862 - RNA, 23 nt, Human
aggcccuucucuccagccccugg

SEQ ID NO: 2931863 - RNA, 22 nt, Human
aggcccuucucuccagccccug

SEQ ID NO: 2931864 - RNA, 21 nt, Human
aggcccuucucuccagccccu

SEQ ID NO: 2931865 - RNA, 20 nt, Human
aggcccuucucuccagcccc

SEQ ID NO: 2931866 - RNA, 21 nt, Human
aggcuagaaccaccugccuau

SEQ ID NO: 2931867 - RNA, 17 nt, Human
aggcuacugucagcucc

SEQ ID NO: 2931868 - RNA, 16 nt, Human
auauuauguuaaaacu

SEQ ID NO: 2931869 - RNA, 22 nt, Human
auauuauuugcagugcaguaua

SEQ ID NO: 2931870 - RNA, 22 nt, Human
auauuuauuacuguaagaaaau

SEQ ID NO: 2931871 - RNA, 19 nt, Human
auauuuacuucuuauacau

SEQ ID NO: 2931872 - RNA, 13 nt, Human
auauuuauuuuaa

SEQ ID NO: 2931873 - RNA, 16 nt, Human
auauccaaguuugaau

SEQ ID NO: 2931874 - RNA, 20 nt, Human
auaucccuuggacauuuuau

SEQ ID NO: 2931875 - RNA, 14 nt, Human
auauccuaauaaaa

SEQ ID NO: 2931876 - RNA, 13 nt, Human
auauccuaauaaa

SEQ ID NO: 2931877 - RNA, 12 nt, Human
auauccuaauaa

SEQ ID NO: 2931878 - RNA, 23 nt, Human
auaucccuuggacauuuuauguc

SEQ ID NO: 2931879 - RNA, 22 nt, Human
auaucccuuggacauuuuaugu

SEQ ID NO: 2931880 - RNA, 20 nt, Human
auauccuaauaaaaagguga

SEQ ID NO: 2931881 - RNA, 18 nt, Human
auauccuaauaaaaaggu

SEQ ID NO: 2931882 - RNA, 16 nt, Human
auauccuaauaaaaag

SEQ ID NO: 2931883 - RNA, 19 nt, Human
auauuaccacagacauacu

SEQ ID NO: 2931884 - RNA, 22 nt, Human
auauuaccacagacauacuaac

SEQ ID NO: 2931885 - RNA, 20 nt, Human
auaugcuucuguuuuauaau

SEQ ID NO: 2931886 - RNA, 22 nt, Human
auaugcuucuguuuuauaauuu

SEQ ID NO: 2931887 - RNA, 21 nt, Human
auaugcuuauacacuuacacu

SEQ ID NO: 2931888 - RNA, 19 nt, Human
auauauuuuuuucugaaau

SEQ ID NO: 2931889 - RNA, 21 nt, Human
auagccaaggccaaaggaagc

SEQ ID NO: 2931890 - RNA, 15 nt, Human
auagccaaggccaaa

SEQ ID NO: 2931891 - RNA, 18 nt, Human
auagcagcuuauucacaa

SEQ ID NO: 2931892 - RNA, 21 nt, Human
auagcaguaaaaaaugguguu

SEQ ID NO: 2931893 - RNA, 15 nt, Human
auagcaguaaaaaau

SEQ ID NO: 2931894 - RNA, 23 nt, Human
auaggugcuacaaaaacacagca

SEQ ID NO: 2931895 - RNA, 21 nt, Human
auaggugcuacaaaaacacag

SEQ ID NO: 2931896 - RNA, 15 nt, Human
auaggugcuacaaaa

SEQ ID NO: 2931897 - RNA, 14 nt, Human
auaggugcuacaaa

SEQ ID NO: 2931898 - RNA, 17 nt, Human
auaguaugguggcuggg

SEQ ID NO: 2931899 - RNA, 18 nt, Human
auaguaugguggcugggu

SEQ ID NO: 2931900 - RNA, 14 nt, Human
auagguuuggacaa

SEQ ID NO: 2931901 - RNA, 15 nt, Human
auagguuuaauaauu

SEQ ID NO: 2931902 - RNA, 14 nt, Human
auagucaaauugug

SEQ ID NO: 2931903 - RNA, 17 nt, Human
auaccugucccccugac

SEQ ID NO: 2931904 - RNA, 18 nt, Human
auaccugucccccugaca

SEQ ID NO: 2931905 - RNA, 11 nt, Human
auacccacccc

SEQ ID NO: 2931906 - RNA, 12 nt, Human
auacccaccccc

SEQ ID NO: 2931907 - RNA, 14 nt, Human
auaauguaagcucu

SEQ ID NO: 2931908 - RNA, 21 nt, Human
auaaugcgugcauaccacuuu

SEQ ID NO: 2931909 - RNA, 20 nt, Human
auaaugcgugcauaccacuu

SEQ ID NO: 2931910 - RNA, 15 nt, Human
auaauguaagcucua

SEQ ID NO: 2931911 - RNA, 23 nt, Human
auaauguuucaaacauauauaac

SEQ ID NO: 2931912 - RNA, 15 nt, Human
auaaugucccuucac

SEQ ID NO: 2931913 - RNA, 21 nt, Human
auacaccacuacauucuguua

SEQ ID NO: 2931914 - RNA, 19 nt, Human
auacaccacuacauucugu

SEQ ID NO: 2931915 - RNA, 20 nt, Human
auacaccacuacauucuguu

SEQ ID NO: 2931916 - RNA, 18 nt, Human
auacacacucaaaucaag

SEQ ID NO: 2931917 - RNA, 17 nt, Human
auacacacucaaaucaa

SEQ ID NO: 2931918 - RNA, 18 nt, Human
auacaccacuacauucug

SEQ ID NO: 2931919 - RNA, 17 nt, Human
auaaaacuuuuuaaaau

SEQ ID NO: 2931920 - RNA, 21 nt, Human
auaaacuuuaccuuuuuuaua

SEQ ID NO: 2931921 - RNA, 16 nt, Human
auaaacuuuaccuuuu

SEQ ID NO: 2931922 - RNA, 24 nt, Human
auaaacuuuaccuuuuuuauacau

SEQ ID NO: 2931923 - RNA, 15 nt, Human
auaaaacuuuuuaaa

SEQ ID NO: 2931924 - RNA, 11 nt, Human
auaaaacuuuu

SEQ ID NO: 2931925 - RNA, 13 nt, Human
auaaagcagcguu

SEQ ID NO: 2931926 - RNA, 14 nt, Human
auaaagcagcguuu

SEQ ID NO: 2931927 - RNA, 18 nt, Human
auaaagcagcguuucuau

SEQ ID NO: 2931928 - RNA, 19 nt, Human
auaaagcagcguuucuaug

SEQ ID NO: 2931929 - RNA, 20 nt, Human
auaaagcagcguuucuauga

SEQ ID NO: 2931930 - RNA, 21 nt, Human
auaacaaaggauacuuauuua

SEQ ID NO: 2931931 - RNA, 20 nt, Human
auaacaaaggauacuuauuu

SEQ ID NO: 2931932 - RNA, 18 nt, Human
auaaaggauuaaugucaa

SEQ ID NO: 2931933 - RNA, 23 nt, Human
aguggcuuaaaacaacacucaca

SEQ ID NO: 2931934 - RNA, 15 nt, Human
agugggagcugccug

SEQ ID NO: 2931935 - RNA, 14 nt, Human
agugggagcugccu

SEQ ID NO: 2931936 - RNA, 16 nt, Human
aguguauuuugaaauu

SEQ ID NO: 2931937 - RNA, 17 nt, Human
aguguauuuuuuuacua

SEQ ID NO: 2931938 - RNA, 18 nt, Human
aguguauuuuuuuacuaa

SEQ ID NO: 2931939 - RNA, 15 nt, Human
agugucuuaauuaaa

SEQ ID NO: 2931940 - RNA, 18 nt, Human
agugucuuaauuaaaaga

SEQ ID NO: 2931941 - RNA, 17 nt, Human
agugucuuaauuaaaag

SEQ ID NO: 2931942 - RNA, 22 nt, Human
aguugaaaagacuccaaagaaa

SEQ ID NO: 2931943 - RNA, 23 nt, Human
aguugaaaaucuuauaauuuaaa

SEQ ID NO: 2931944 - RNA, 21 nt, Human
aguugugugaauaccccaaga

SEQ ID NO: 2931945 - RNA, 16 nt, Human
aguuguguuugaagca

SEQ ID NO: 2931946 - RNA, 14 nt, Human
aguugaagacagag

SEQ ID NO: 2931947 - RNA, 13 nt, Human
aguuguucugaaa

SEQ ID NO: 2931948 - RNA, 17 nt, Human
aguuguucugaaauguc

SEQ ID NO: 2931949 - RNA, 20 nt, Human
aguuguuugauucagacagc

SEQ ID NO: 2931950 - RNA, 12 nt, Human
aguuaaauaaau

SEQ ID NO: 2931951 - RNA, 18 nt, Human
aguuacacuaaaagguga

SEQ ID NO: 2931952 - RNA, 16 nt, Human
aguuacagacaaagcg

SEQ ID NO: 2931953 - RNA, 14 nt, Human
aguuacagacaaag

SEQ ID NO: 2931954 - RNA, 20 nt, Human
aguucagguaacaggcagau

SEQ ID NO: 2931955 - RNA, 19 nt, Human
aguucagguaacaggcaga

SEQ ID NO: 2931956 - RNA, 22 nt, Human
aguucaucuugaauuguaagga

SEQ ID NO: 2931957 - RNA, 21 nt, Human
aguugaaaagacuccaaagaa

SEQ ID NO: 2931958 - RNA, 22 nt, Human
aguugaaaaucuuauaauuuaa

SEQ ID NO: 2931959 - RNA, 14 nt, Human
agugaagacaauga

SEQ ID NO: 2931960 - RNA, 16 nt, Human
agugaagacaaugacu

SEQ ID NO: 2931961 - RNA, 16 nt, Human
agucugauucccaagc

SEQ ID NO: 2931962 - RNA, 18 nt, Human
agucugauucccaagcuc

SEQ ID NO: 2931963 - RNA, 17 nt, Human
agucuggaaugcagugg

SEQ ID NO: 2931964 - RNA, 20 nt, Human
agugaacuugggccacugug

SEQ ID NO: 2931965 - RNA, 17 nt, Human
agucugcuuagaaauaa

SEQ ID NO: 2931966 - RNA, 22 nt, Human
aguccuggcaugggaaugaaug

SEQ ID NO: 2931967 - RNA, 21 nt, Human
aguccuggcaugggaaugaau

SEQ ID NO: 2931968 - RNA, 20 nt, Human
aguccuggcaugggaaugaa

SEQ ID NO: 2931969 - RNA, 12 nt, Human
aguccuguaaug

SEQ ID NO: 2931970 - RNA, 15 nt, Human
agucugaaggcuggg

SEQ ID NO: 2931971 - RNA, 13 nt, Human
agucugaaggcug

SEQ ID NO: 2931972 - RNA, 16 nt, Human
agucugaaggcugggu

SEQ ID NO: 2931973 - RNA, 12 nt, Human
agucugaaggcu

SEQ ID NO: 2931974 - RNA, 15 nt, Human
aguaugaggcauuug

SEQ ID NO: 2931975 - RNA, 16 nt, Human
aguaugaggcauuugu

SEQ ID NO: 2931976 - RNA, 15 nt, Human
aguaucucagggccu

SEQ ID NO: 2931977 - RNA, 15 nt, Human
aguaucuugaagacu

SEQ ID NO: 2931978 - RNA, 12 nt, Human
aguaucuugaag

SEQ ID NO: 2931979 - RNA, 11 nt, Human
aguaucuugaa

SEQ ID NO: 2931980 - RNA, 23 nt, Human
agucaaauugugugaaagguacu

SEQ ID NO: 2931981 - RNA, 19 nt, Human
agucaaauugugugaaagg

SEQ ID NO: 2931982 - RNA, 18 nt, Human
auguuuucaaauguucuc

SEQ ID NO: 2931983 - RNA, 17 nt, Human
auguuuuauauagcaag

SEQ ID NO: 2931984 - RNA, 15 nt, Human
auguuuucaaauguu

SEQ ID NO: 2931985 - RNA, 12 nt, Human
auguuuucaaau

SEQ ID NO: 2931986 - RNA, 19 nt, Human
auguuugccucugccucug

SEQ ID NO: 2931987 - RNA, 22 nt, Human
auguuugccucugccucugaca

SEQ ID NO: 2931988 - RNA, 18 nt, Human
auguuugccucugccucu

SEQ ID NO: 2931989 - RNA, 13 nt, Human
auguucugggaca

SEQ ID NO: 2931990 - RNA, 17 nt, Human
auguuucacacaaacaa

SEQ ID NO: 2931991 - RNA, 16 nt, Human
auguuucacacaaaca

SEQ ID NO: 2931992 - RNA, 21 nt, Human
auguuucaaacauauauaaca

SEQ ID NO: 2931993 - RNA, 20 nt, Human
auguucuccagucauuaugu

SEQ ID NO: 2931994 - RNA, 11 nt, Human
auguucuggga

SEQ ID NO: 2931995 - RNA, 12 nt, Human
auguucugggac

SEQ ID NO: 2931996 - RNA, 18 nt, Human
augugggcagugauguca

SEQ ID NO: 2931997 - RNA, 17 nt, Human
auguucuaagaagugaa

SEQ ID NO: 2931998 - RNA, 14 nt, Human
augucuuuucuugc

SEQ ID NO: 2931999 - RNA, 23 nt, Human
augugaacaguuguguuugaagc

SEQ ID NO: 2932000 - RNA, 11 nt, Human
augugaacagu

SEQ ID NO: 2932001 - RNA, 21 nt, Human
augugaacaguuguguuugaa

SEQ ID NO: 2932002 - RNA, 22 nt, Human
augugaaacuggauuaaacuua

SEQ ID NO: 2932003 - RNA, 19 nt, Human
auggucaccaaaucagcug

SEQ ID NO: 2932004 - RNA, 17 nt, Human
auguauuuuugucaauu

SEQ ID NO: 2932005 - RNA, 16 nt, Human
auguaagggaaacugc

SEQ ID NO: 2932006 - RNA, 14 nt, Human
auguaagggaaacu

SEQ ID NO: 2932007 - RNA, 19 nt, Human
auguaagggaaacugccag

SEQ ID NO: 2932008 - RNA, 15 nt, Human
auguaauuaaguacu

SEQ ID NO: 2932009 - RNA, 17 nt, Human
auguaauuaaguacuau

SEQ ID NO: 2932010 - RNA, 15 nt, Human
augcacaaacagagg

SEQ ID NO: 2932011 - RNA, 24 nt, Human
augauguuuuccaugaguccccug

SEQ ID NO: 2932012 - RNA, 17 nt, Human
augaugccaugaggaac

SEQ ID NO: 2932013 - RNA, 16 nt, Human
augaugccaugaggaa

SEQ ID NO: 2932014 - RNA, 19 nt, Human
augccucucucaggccaaa

SEQ ID NO: 2932015 - RNA, 16 nt, Human
augcaugaaguaauau

SEQ ID NO: 2932016 - RNA, 17 nt, Human
augccucucucaggcca

SEQ ID NO: 2932017 - RNA, 23 nt, Human
augcacacauuuuuuaaaugcac

SEQ ID NO: 2932018 - RNA, 16 nt, Human
augcacagaguuguua

SEQ ID NO: 2932019 - RNA, 17 nt, Human
augcacaaacagaggcc

SEQ ID NO: 2932020 - RNA, 16 nt, Human
augcacaaacagaggc

SEQ ID NO: 2932021 - RNA, 17 nt, Human
augcacagaguuguuac

SEQ ID NO: 2932022 - RNA, 18 nt, Human
augcacagaguuguuaca

SEQ ID NO: 2932023 - RNA, 13 nt, Human
augcuuguacaua

SEQ ID NO: 2932024 - RNA, 14 nt, Human
augcuuguacauaa

SEQ ID NO: 2932025 - RNA, 12 nt, Human
augcuuguacau

SEQ ID NO: 2932026 - RNA, 17 nt, Human
auggaggacuccaggca

SEQ ID NO: 2932027 - RNA, 18 nt, Human
auggaggacuccaggcag

SEQ ID NO: 2932028 - RNA, 19 nt, Human
auggaggacuccaggcagc

SEQ ID NO: 2932029 - RNA, 21 nt, Human
auggaggacuccaggcagcag

SEQ ID NO: 2932030 - RNA, 15 nt, Human
auggauuuccagcca

SEQ ID NO: 2932031 - RNA, 16 nt, Human
augcucuuuacuucau

SEQ ID NO: 2932032 - RNA, 11 nt, Human
augcugcccug

SEQ ID NO: 2932033 - RNA, 23 nt, Human
augcugccaauauccuaauaaaa

SEQ ID NO: 2932034 - RNA, 22 nt, Human
augcugccaauauccuaauaaa

SEQ ID NO: 2932035 - RNA, 21 nt, Human
augcugccaauauccuaauaa

SEQ ID NO: 2932036 - RNA, 20 nt, Human
augcugccaauauccuaaua

SEQ ID NO: 2932037 - RNA, 13 nt, Human
augcugccaauau

SEQ ID NO: 2932038 - RNA, 19 nt, Human
augcugccaauauccuaau

SEQ ID NO: 2932039 - RNA, 18 nt, Human
augcugccaauauccuaa

SEQ ID NO: 2932040 - RNA, 17 nt, Human
augcugccaauauccua

SEQ ID NO: 2932041 - RNA, 14 nt, Human
augcugccaauauc

SEQ ID NO: 2932042 - RNA, 23 nt, Human
aucagcugcugaaacaacaaaua

SEQ ID NO: 2932043 - RNA, 22 nt, Human
aucagcugcugaaacaacaaau

SEQ ID NO: 2932044 - RNA, 23 nt, Human
aucagcacgauuucuguuuagau

SEQ ID NO: 2932045 - RNA, 19 nt, Human
aucagcacgauuucuguuu

SEQ ID NO: 2932046 - RNA, 20 nt, Human
aucagcacgauuucuguuua

SEQ ID NO: 2932047 - RNA, 14 nt, Human
aucaccgaaaacgu

SEQ ID NO: 2932048 - RNA, 21 nt, Human
aucaccgaaaacguggcugcu

SEQ ID NO: 2932049 - RNA, 19 nt, Human
aucaccgaaaacguggcug

SEQ ID NO: 2932050 - RNA, 21 nt, Human
aucagcugcugaaacaacaaa

SEQ ID NO: 2932051 - RNA, 18 nt, Human
aucagccugcuccagcug

SEQ ID NO: 2932052 - RNA, 17 nt, Human
aucagccugcuccagcu

SEQ ID NO: 2932053 - RNA, 19 nt, Human
aucagccugcuccagcugu

SEQ ID NO: 2932054 - RNA, 21 nt, Human
aucacagccucugaaaaccaa

SEQ ID NO: 2932055 - RNA, 18 nt, Human
aucaccaacgucugugcc

SEQ ID NO: 2932056 - RNA, 23 nt, Human
aucacccgcuaagagggagggag

SEQ ID NO: 2932057 - RNA, 19 nt, Human
aucaccaacgucugugcca

SEQ ID NO: 2932058 - RNA, 17 nt, Human
auauuuauuuuaauaau

SEQ ID NO: 2932059 - RNA, 14 nt, Human
auauuuauuuuaau

SEQ ID NO: 2932060 - RNA, 15 nt, Human
auauuuauuuuaaua

SEQ ID NO: 2932061 - RNA, 20 nt, Human
auccucccaccucagccucc

SEQ ID NO: 2932062 - RNA, 18 nt, Human
auccucccaccucagccu

SEQ ID NO: 2932063 - RNA, 19 nt, Human
auccucccaccucagccuc

SEQ ID NO: 2932064 - RNA, 15 nt, Human
aucccauuuaaaaaa

SEQ ID NO: 2932065 - RNA, 14 nt, Human
aucccauuuaaaaa

SEQ ID NO: 2932066 - RNA, 15 nt, Human
auccagacccggcug

SEQ ID NO: 2932067 - RNA, 15 nt, Human
auccccuguagagug

SEQ ID NO: 2932068 - RNA, 15 nt, Human
auccucccaccucag

SEQ ID NO: 2932069 - RNA, 23 nt, Human
auccuccaggugcacaagcucca

SEQ ID NO: 2932070 - RNA, 23 nt, Human
auccucauacccacccccaccca

SEQ ID NO: 2932071 - RNA, 11 nt, Human
auccuccaggu

SEQ ID NO: 2932072 - RNA, 23 nt, Human
augaccuuucaauaggaaaaacu

SEQ ID NO: 2932073 - RNA, 22 nt, Human
augaccuuucaauaggaaaaac

SEQ ID NO: 2932074 - RNA, 21 nt, Human
augaccuuucaauaggaaaaa

SEQ ID NO: 2932075 - RNA, 13 nt, Human
augaaagacugua

SEQ ID NO: 2932076 - RNA, 16 nt, Human
augaaagacuguacaa

SEQ ID NO: 2932077 - RNA, 17 nt, Human
augaaagacuguacaaa

SEQ ID NO: 2932078 - RNA, 19 nt, Human
augaaagacuguacaaagu

SEQ ID NO: 2932079 - RNA, 17 nt, Human
aucuugaauuguaagga

SEQ ID NO: 2932080 - RNA, 14 nt, Human
aucuucuuuauaau

SEQ ID NO: 2932081 - RNA, 18 nt, Human
aucuugaagacuuuucuu

SEQ ID NO: 2932082 - RNA, 22 nt, Human
aucuucugaacuuggcgcugcc

SEQ ID NO: 2932083 - RNA, 22 nt, Human
aucugcuuuuuaaagaaugcuc

SEQ ID NO: 2932084 - RNA, 21 nt, Human
aucucccccagccccauccuc

SEQ ID NO: 2932085 - RNA, 14 nt, Human
aucuauauuuuaca

SEQ ID NO: 2932086 - RNA, 17 nt, Human
aucuauauuuuacauaa

SEQ ID NO: 2932087 - RNA, 21 nt, Human
aucuauauuuuacauaaauuu

SEQ ID NO: 2932088 - RNA, 21 nt, Human
caaauguucaucaaugaauga

SEQ ID NO: 2932089 - RNA, 20 nt, Human
caaauguucaucaaugaaug

SEQ ID NO: 2932090 - RNA, 22 nt, Human
caaauucugcuugcuugcuuuu

SEQ ID NO: 2932091 - RNA, 16 nt, Human
caaaucagcugcuacu

SEQ ID NO: 2932092 - RNA, 13 nt, Human
caaaucagcugcu

SEQ ID NO: 2932093 - RNA, 18 nt, Human
caaauaugcaaagcacug

SEQ ID NO: 2932094 - RNA, 17 nt, Human
caaauaugcaaagcacu

SEQ ID NO: 2932095 - RNA, 16 nt, Human
caaauaugcaaagcac

SEQ ID NO: 2932096 - RNA, 16 nt, Human
caaauaaguguauuuu

SEQ ID NO: 2932097 - RNA, 17 nt, Human
caaauaaguguauuuug

SEQ ID NO: 2932098 - RNA, 18 nt, Human
caaauaaguguauuuuga

SEQ ID NO: 2932099 - RNA, 13 nt, Human
caaauaaguguau

SEQ ID NO: 2932100 - RNA, 21 nt, Human
caaaggaugcccaaagaugca

SEQ ID NO: 2932101 - RNA, 21 nt, Human
caaaggauacuuauuuaaaua

SEQ ID NO: 2932102 - RNA, 16 nt, Human
caaaggauacuuauuu

SEQ ID NO: 2932103 - RNA, 19 nt, Human
caaauaaguguauuuugaa

SEQ ID NO: 2932104 - RNA, 20 nt, Human
caaauaaguguauuuugaaa

SEQ ID NO: 2932105 - RNA, 21 nt, Human
caaauaaguguauuuugaaau

SEQ ID NO: 2932106 - RNA, 14 nt, Human
caaauaugcaaagc

SEQ ID NO: 2932107 - RNA, 18 nt, Human
auuuuuuuacuaauagac

SEQ ID NO: 2932108 - RNA, 23 nt, Human
caaacuuuauugauucaccuccu

SEQ ID NO: 2932109 - RNA, 16 nt, Human
caaagcuuguuaagau

SEQ ID NO: 2932110 - RNA, 17 nt, Human
caaagcuuuugcauauu

SEQ ID NO: 2932111 - RNA, 18 nt, Human
caaagcuaggccuggcca

SEQ ID NO: 2932112 - RNA, 16 nt, Human
caaagcuaggccuggc

SEQ ID NO: 2932113 - RNA, 17 nt, Human
caaagcuaggccuggcc

SEQ ID NO: 2932114 - RNA, 20 nt, Human
caaagccaaagcuaggccug

SEQ ID NO: 2932115 - RNA, 21 nt, Human
caaagccaaagcuaggccugg

SEQ ID NO: 2932116 - RNA, 15 nt, Human
caaagcuaggccugg

SEQ ID NO: 2932117 - RNA, 23 nt, Human
caacaugccagccacugugauag

SEQ ID NO: 2932118 - RNA, 22 nt, Human
caacauuucucauguugaaacu

SEQ ID NO: 2932119 - RNA, 21 nt, Human
caaccccuucgcuccuguguc

SEQ ID NO: 2932120 - RNA, 18 nt, Human
caaccccuucgcuccugu

SEQ ID NO: 2932121 - RNA, 19 nt, Human
caaccccuucgcuccugug

SEQ ID NO: 2932122 - RNA, 16 nt, Human
caacagugagagacuc

SEQ ID NO: 2932123 - RNA, 22 nt, Human
caacaucuuggucagauuugaa

SEQ ID NO: 2932124 - RNA, 15 nt, Human
caacagguuuuccug

SEQ ID NO: 2932125 - RNA, 18 nt, Human
caacaggguuuuuuucca

SEQ ID NO: 2932126 - RNA, 19 nt, Human
caacagguuuuccugaaga

SEQ ID NO: 2932127 - RNA, 24 nt, Human
caacaggcugggcuucaguggcag

SEQ ID NO: 2932128 - RNA, 23 nt, Human
caacaggcugggcuucaguggca

SEQ ID NO: 2932129 - RNA, 15 nt, Human
caaauuuacagagac

SEQ ID NO: 2932130 - RNA, 14 nt, Human
caaauuuacagaga

SEQ ID NO: 2932131 - RNA, 15 nt, Human
caaauugugugaaag

SEQ ID NO: 2932132 - RNA, 19 nt, Human
caacucuccuccagaguca

SEQ ID NO: 2932133 - RNA, 16 nt, Human
caaccugauugugucu

SEQ ID NO: 2932134 - RNA, 15 nt, Human
caacccucaucacca

SEQ ID NO: 2932135 - RNA, 12 nt, Human
caacccucauca

SEQ ID NO: 2932136 - RNA, 16 nt, Human
caacugcauuggcuuu

SEQ ID NO: 2932137 - RNA, 21 nt, Human
caacucugaaggguaauuaua

SEQ ID NO: 2932138 - RNA, 20 nt, Human
caacucuccuccagagucag

SEQ ID NO: 2932139 - RNA, 15 nt, Human
caaggauugcuacug

SEQ ID NO: 2932140 - RNA, 16 nt, Human
caagggccuggccuga

SEQ ID NO: 2932141 - RNA, 19 nt, Human
caagggccuggccugagcu

SEQ ID NO: 2932142 - RNA, 12 nt, Human
caaggugggagg

SEQ ID NO: 2932143 - RNA, 23 nt, Human
caaggugggaggauugcuugagc

SEQ ID NO: 2932144 - RNA, 22 nt, Human
caagugugguagagugugccug

SEQ ID NO: 2932145 - RNA, 22 nt, Human
caagugauucuccugccucagc

SEQ ID NO: 2932146 - RNA, 21 nt, Human
caagugauucuccugccucag

SEQ ID NO: 2932147 - RNA, 19 nt, Human
caagugaaaaaggaggaag

SEQ ID NO: 2932148 - RNA, 16 nt, Human
caagugauucuccugc

SEQ ID NO: 2932149 - RNA, 17 nt, Human
caagugauucuccugcc

SEQ ID NO: 2932150 - RNA, 17 nt, Human
caagcgugagccacugc

SEQ ID NO: 2932151 - RNA, 18 nt, Human
caagcgugagccacugca

SEQ ID NO: 2932152 - RNA, 22 nt, Human
caaggacccagccugagauggu

SEQ ID NO: 2932153 - RNA, 22 nt, Human
caaggauccugagccagauuuc

SEQ ID NO: 2932154 - RNA, 21 nt, Human
caaggaugaucuaggaagacu

SEQ ID NO: 2932155 - RNA, 13 nt, Human
caaggauccugag

SEQ ID NO: 2932156 - RNA, 16 nt, Human
caagcgugagccacug

SEQ ID NO: 2932157 - RNA, 21 nt, Human
caagccaccaacauacuccca

SEQ ID NO: 2932158 - RNA, 18 nt, Human
caagcaccuccugccucg

SEQ ID NO: 2932159 - RNA, 17 nt, Human
caagcacuaaacaaaga

SEQ ID NO: 2932160 - RNA, 17 nt, Human
cacaugugcacaugcac

SEQ ID NO: 2932161 - RNA, 14 nt, Human
cacaugugcacaug

SEQ ID NO: 2932162 - RNA, 15 nt, Human
cacaugugcacaugc

SEQ ID NO: 2932163 - RNA, 17 nt, Human
cacauuaaagguacuuu

SEQ ID NO: 2932164 - RNA, 13 nt, Human
cacauuaaaugac

SEQ ID NO: 2932165 - RNA, 15 nt, Human
cacauuaaaugacuc

SEQ ID NO: 2932166 - RNA, 16 nt, Human
cacauuccugaacagg

SEQ ID NO: 2932167 - RNA, 16 nt, Human
cacauuccugaugcuu

SEQ ID NO: 2932168 - RNA, 12 nt, Human
cacauaucuguc

SEQ ID NO: 2932169 - RNA, 18 nt, Human
cacaucagcacgauuucu

SEQ ID NO: 2932170 - RNA, 18 nt, Human
cacaugccucucucaggc

SEQ ID NO: 2932171 - RNA, 17 nt, Human
cacaugccucucucagg

SEQ ID NO: 2932172 - RNA, 13 nt, Human
cacaugccucucu

SEQ ID NO: 2932173 - RNA, 19 nt, Human
cacaucagcacgauuucug

SEQ ID NO: 2932174 - RNA, 23 nt, Human
cacauguccaagaagcccaggaa

SEQ ID NO: 2932175 - RNA, 19 nt, Human
cacaugccucucucaggcc

SEQ ID NO: 2932176 - RNA, 19 nt, Human
caccacaugugcacaugca

SEQ ID NO: 2932177 - RNA, 15 nt, Human
caccacaugugcaca

SEQ ID NO: 2932178 - RNA, 18 nt, Human
caccacaugugcacaugc

SEQ ID NO: 2932179 - RNA, 19 nt, Human
caccacuacauucuguuaa

SEQ ID NO: 2932180 - RNA, 20 nt, Human
caccacuacauucuguuaau

SEQ ID NO: 2932181 - RNA, 14 nt, Human
caccaccucuuugg

SEQ ID NO: 2932182 - RNA, 16 nt, Human
caccacuacauucugu

SEQ ID NO: 2932183 - RNA, 17 nt, Human
caccacuacauucuguu

SEQ ID NO: 2932184 - RNA, 18 nt, Human
caccacuacauucuguua

SEQ ID NO: 2932185 - RNA, 17 nt, Human
caccacacccagcccac

SEQ ID NO: 2932186 - RNA, 13 nt, Human
caccacacccagc

SEQ ID NO: 2932187 - RNA, 15 nt, Human
caccacacccagccc

SEQ ID NO: 2932188 - RNA, 17 nt, Human
cacauuggaaacaaguc

SEQ ID NO: 2932189 - RNA, 15 nt, Human
caccaagcccaguua

SEQ ID NO: 2932190 - RNA, 19 nt, Human
cacagugagucgaggacag

SEQ ID NO: 2932191 - RNA, 20 nt, Human
cacagugagucgaggacagg

SEQ ID NO: 2932192 - RNA, 18 nt, Human
cacagugagucgaggaca

SEQ ID NO: 2932193 - RNA, 20 nt, Human
cacaggcccggcuccaggcu

SEQ ID NO: 2932194 - RNA, 23 nt, Human
cacaggcccggcuccaggcuccu

SEQ ID NO: 2932195 - RNA, 17 nt, Human
cacauacacacacacgc

SEQ ID NO: 2932196 - RNA, 22 nt, Human
cacauaagccaaaacugagcau

SEQ ID NO: 2932197 - RNA, 19 nt, Human
cacauaagccaaaacugag

SEQ ID NO: 2932198 - RNA, 21 nt, Human
cacauaagccaaaacugagca

SEQ ID NO: 2932199 - RNA, 14 nt, Human
cacaguuuucugag

SEQ ID NO: 2932200 - RNA, 16 nt, Human
cacaggcccggcucca

SEQ ID NO: 2932201 - RNA, 17 nt, Human
cacaggcccggcuccag

SEQ ID NO: 2932202 - RNA, 18 nt, Human
cacaggcccggcuccagg

SEQ ID NO: 2932203 - RNA, 19 nt, Human
cacaggcccggcuccaggc

SEQ ID NO: 2932204 - RNA, 10 nt, Human
cacaggcagg

SEQ ID NO: 2932205 - RNA, 12 nt, Human
cacaggaucagu

SEQ ID NO: 2932206 - RNA, 15 nt, Human
cacaggaucagucug

SEQ ID NO: 2932207 - RNA, 16 nt, Human
cacaggaucagucuga

SEQ ID NO: 2932208 - RNA, 19 nt, Human
cacaggaaccacaagacug

SEQ ID NO: 2932209 - RNA, 15 nt, Human
cacaggaaguagagg

SEQ ID NO: 2932210 - RNA, 20 nt, Human
cacaggaaccacaagacugc

SEQ ID NO: 2932211 - RNA, 20 nt, Human
cacagaguuguuacauuuuu

SEQ ID NO: 2932212 - RNA, 18 nt, Human
cacagaugggugcuugga

SEQ ID NO: 2932213 - RNA, 14 nt, Human
cacagaugggugcu

SEQ ID NO: 2932214 - RNA, 20 nt, Human
cacagaugggugcuuggagg

SEQ ID NO: 2932215 - RNA, 22 nt, Human
cacagcaguugaaaagacucca

SEQ ID NO: 2932216 - RNA, 15 nt, Human
cacaccagagcccac

SEQ ID NO: 2932217 - RNA, 12 nt, Human
cacaccagagcc

SEQ ID NO: 2932218 - RNA, 13 nt, Human
cacaccagagccc

SEQ ID NO: 2932219 - RNA, 15 nt, Human
cacaccauaagcuac

SEQ ID NO: 2932220 - RNA, 21 nt, Human
cacaccauaagcuacugccau

SEQ ID NO: 2932221 - RNA, 23 nt, Human
cacaccauaagcuacugccaucc

SEQ ID NO: 2932222 - RNA, 12 nt, Human
cacacagcucug

SEQ ID NO: 2932223 - RNA, 19 nt, Human
cacacagaggcugccucuc

SEQ ID NO: 2932224 - RNA, 14 nt, Human
cacacaccagagcc

SEQ ID NO: 2932225 - RNA, 13 nt, Human
cacaacuauauug

SEQ ID NO: 2932226 - RNA, 21 nt, Human
cacacuugacaucaacugcau

SEQ ID NO: 2932227 - RNA, 22 nt, Human
cacagacccugcccugugggcc

SEQ ID NO: 2932228 - RNA, 21 nt, Human
cacagagaaaguacuucucca

SEQ ID NO: 2932229 - RNA, 16 nt, Human
cacagaguuguuacau

SEQ ID NO: 2932230 - RNA, 17 nt, Human
cacagaguuguuacauu

SEQ ID NO: 2932231 - RNA, 15 nt, Human
cacacuggcucaccc

SEQ ID NO: 2932232 - RNA, 16 nt, Human
cacacuggcucaccca

SEQ ID NO: 2932233 - RNA, 19 nt, Human
cacacuggcucacccaguc

SEQ ID NO: 2932234 - RNA, 12 nt, Human
cacacuggcuca

SEQ ID NO: 2932235 - RNA, 14 nt, Human
cacacugaagaagc

SEQ ID NO: 2932236 - RNA, 19 nt, Human
cacacucaaaucaagaaac

SEQ ID NO: 2932237 - RNA, 13 nt, Human
caauuuuaaacau

SEQ ID NO: 2932238 - RNA, 15 nt, Human
caauuuuaaacauau

SEQ ID NO: 2932239 - RNA, 23 nt, Human
cacaaagaaccaccaggaaagca

SEQ ID NO: 2932240 - RNA, 15 nt, Human
cacaaagcagauccu

SEQ ID NO: 2932241 - RNA, 16 nt, Human
cacaaaaguuucucuu

SEQ ID NO: 2932242 - RNA, 18 nt, Human
cacaaaaguuucucuuuu

SEQ ID NO: 2932243 - RNA, 11 nt, Human
cacaacagauu

SEQ ID NO: 2932244 - RNA, 20 nt, Human
caauaggaaaaacugauuuu

SEQ ID NO: 2932245 - RNA, 21 nt, Human
caauaggaaaaacugauuuuu

SEQ ID NO: 2932246 - RNA, 22 nt, Human
caauaggugcugaguguacaga

SEQ ID NO: 2932247 - RNA, 21 nt, Human
caauaucuuuuuuuuaauaaa

SEQ ID NO: 2932248 - RNA, 18 nt, Human
caaugcaaaccaucauug

SEQ ID NO: 2932249 - RNA, 17 nt, Human
caaugcaaaccaucauu

SEQ ID NO: 2932250 - RNA, 23 nt, Human
caaugcacuuuguucuggcucuu

SEQ ID NO: 2932251 - RNA, 19 nt, Human
caaugcaaaccaucauuga

SEQ ID NO: 2932252 - RNA, 22 nt, Human
caaugaaugaaugaauggcuaa

SEQ ID NO: 2932253 - RNA, 13 nt, Human
caccccagcccca

SEQ ID NO: 2932254 - RNA, 12 nt, Human
caccccagcccc

SEQ ID NO: 2932255 - RNA, 12 nt, Human
cacccaccucag

SEQ ID NO: 2932256 - RNA, 13 nt, Human
cacccaccucagc

SEQ ID NO: 2932257 - RNA, 14 nt, Human
cacccaccucagcc

SEQ ID NO: 2932258 - RNA, 16 nt, Human
cacccaccucagccuc

SEQ ID NO: 2932259 - RNA, 20 nt, Human
cacccaccaucaugucuggc

SEQ ID NO: 2932260 - RNA, 22 nt, Human
cacccaccaucaugucuggcua

SEQ ID NO: 2932261 - RNA, 15 nt, Human
cacccacaccauaag

SEQ ID NO: 2932262 - RNA, 23 nt, Human
cacccaagggccuggccugagcu

SEQ ID NO: 2932263 - RNA, 21 nt, Human
cacccaagggccuggccugag

SEQ ID NO: 2932264 - RNA, 20 nt, Human
cacccaagggccuggccuga

SEQ ID NO: 2932265 - RNA, 19 nt, Human
cacccaagggccuggccug

SEQ ID NO: 2932266 - RNA, 18 nt, Human
cacccaagggccuggccu

SEQ ID NO: 2932267 - RNA, 17 nt, Human
cacccaagggccuggcc

SEQ ID NO: 2932268 - RNA, 16 nt, Human
cacccaagggccuggc

SEQ ID NO: 2932269 - RNA, 17 nt, Human
caccccggccaccugcg

SEQ ID NO: 2932270 - RNA, 16 nt, Human
caccccggccaccugc

SEQ ID NO: 2932271 - RNA, 15 nt, Human
caccccggccaccug

SEQ ID NO: 2932272 - RNA, 14 nt, Human
caccccggccaccu

SEQ ID NO: 2932273 - RNA, 22 nt, Human
cacccccacccaagggccuggc

SEQ ID NO: 2932274 - RNA, 15 nt, Human
ccacugugaagagaa

SEQ ID NO: 2932275 - RNA, 14 nt, Human
ccacugugaagaga

SEQ ID NO: 2932276 - RNA, 19 nt, Human
ccacuggguguaaacacau

SEQ ID NO: 2932277 - RNA, 15 nt, Human
ccacugguucuucuu

SEQ ID NO: 2932278 - RNA, 23 nt, Human
ccacuggugacaugucuuuucuu

SEQ ID NO: 2932279 - RNA, 22 nt, Human
ccacugcuuuuggucuguguga

SEQ ID NO: 2932280 - RNA, 20 nt, Human
ccacugcuuuuggucugugu

SEQ ID NO: 2932281 - RNA, 11 nt, Human
ccacugcucug

SEQ ID NO: 2932282 - RNA, 12 nt, Human
ccacugcucugg

SEQ ID NO: 2932283 - RNA, 13 nt, Human
ccacugcucuggu

SEQ ID NO: 2932284 - RNA, 15 nt, Human
ccacugcucugguua

SEQ ID NO: 2932285 - RNA, 23 nt, Human
ccacugcaucguuucaucuucca

SEQ ID NO: 2932286 - RNA, 21 nt, Human
ccacugcaucguuucaucuuc

SEQ ID NO: 2932287 - RNA, 20 nt, Human
ccacugugcuccagccuggg

SEQ ID NO: 2932288 - RNA, 19 nt, Human
ccacugugccaugugccag

SEQ ID NO: 2932289 - RNA, 15 nt, Human
ccacugugccaugug

SEQ ID NO: 2932290 - RNA, 16 nt, Human
ccacugugccaugugc

SEQ ID NO: 2932291 - RNA, 22 nt, Human
ccagaagaaaauagugguguga

SEQ ID NO: 2932292 - RNA, 14 nt, Human
ccagacccggcugc

SEQ ID NO: 2932293 - RNA, 15 nt, Human
ccagacccggcugcg

SEQ ID NO: 2932294 - RNA, 22 nt, Human
ccagacacauguccaagaagcc

SEQ ID NO: 2932295 - RNA, 20 nt, Human
ccagacacauguccaagaag

SEQ ID NO: 2932296 - RNA, 17 nt, Human
ccagacacauguccaag

SEQ ID NO: 2932297 - RNA, 14 nt, Human
ccagacaucaacag

SEQ ID NO: 2932298 - RNA, 14 nt, Human
ccacccuccuuuca

SEQ ID NO: 2932299 - RNA, 19 nt, Human
ccaccccucaacaccucug

SEQ ID NO: 2932300 - RNA, 12 nt, Human
ccacccccuagg

SEQ ID NO: 2932301 - RNA, 19 nt, Human
ccacccccacccaagggcc

SEQ ID NO: 2932302 - RNA, 15 nt, Human
ccaccugccagggac

SEQ ID NO: 2932303 - RNA, 12 nt, Human
ccaccugccagg

SEQ ID NO: 2932304 - RNA, 14 nt, Human
ccaccugccaggga

SEQ ID NO: 2932305 - RNA, 13 nt, Human
ccaccugccaggg

SEQ ID NO: 2932306 - RNA, 14 nt, Human
ccaccuggcucugu

SEQ ID NO: 2932307 - RNA, 16 nt, Human
ccaccuggcucugugg

SEQ ID NO: 2932308 - RNA, 13 nt, Human
ccaccuggcucug

SEQ ID NO: 2932309 - RNA, 12 nt, Human
ccaccuggcucu

SEQ ID NO: 2932310 - RNA, 20 nt, Human
ccaccuggccucugcacucc

SEQ ID NO: 2932311 - RNA, 18 nt, Human
ccaccuggccucugcacu

SEQ ID NO: 2932312 - RNA, 13 nt, Human
ccaccuggccucu

SEQ ID NO: 2932313 - RNA, 20 nt, Human
ccaccucucucacuccuuga

SEQ ID NO: 2932314 - RNA, 19 nt, Human
ccaccucucucacuccuug

SEQ ID NO: 2932315 - RNA, 16 nt, Human
ccaccucucucacucc

SEQ ID NO: 2932316 - RNA, 14 nt, Human
ccaccucucucacu

SEQ ID NO: 2932317 - RNA, 11 nt, Human
ccacccugcuc

SEQ ID NO: 2932318 - RNA, 12 nt, Human
ccacccugcucu

SEQ ID NO: 2932319 - RNA, 15 nt, Human
ccaccucccugcaau

SEQ ID NO: 2932320 - RNA, 14 nt, Human
ccaccucccugcaa

SEQ ID NO: 2932321 - RNA, 19 nt, Human
ccaccucccugcaauaaaa

SEQ ID NO: 2932322 - RNA, 21 nt, Human
ccaccucccugcaauaaaaug

SEQ ID NO: 2932323 - RNA, 18 nt, Human
ccagcaccaucucuccuc

SEQ ID NO: 2932324 - RNA, 17 nt, Human
ccagcaccaucucuccu

SEQ ID NO: 2932325 - RNA, 16 nt, Human
ccagcaggcucucagg

SEQ ID NO: 2932326 - RNA, 18 nt, Human
ccagcaggcucucaggcc

SEQ ID NO: 2932327 - RNA, 17 nt, Human
ccagcaggcucucaggc

SEQ ID NO: 2932328 - RNA, 14 nt, Human
ccagcacaaagcag

SEQ ID NO: 2932329 - RNA, 17 nt, Human
ccagcaagugagagcug

SEQ ID NO: 2932330 - RNA, 18 nt, Human
ccagcaagugagagcugg

SEQ ID NO: 2932331 - RNA, 19 nt, Human
ccagcaagugagagcuggg

SEQ ID NO: 2932332 - RNA, 17 nt, Human
ccagagccccacagccc

SEQ ID NO: 2932333 - RNA, 23 nt, Human
ccagagccccacagccccaucug

SEQ ID NO: 2932334 - RNA, 14 nt, Human
ccagauugcaacag

SEQ ID NO: 2932335 - RNA, 16 nt, Human
ccagauugcaacaggc

SEQ ID NO: 2932336 - RNA, 14 nt, Human
ccagagcccaccuu

SEQ ID NO: 2932337 - RNA, 16 nt, Human
ccagagccccacagcc

SEQ ID NO: 2932338 - RNA, 13 nt, Human
ccagagccccaca

SEQ ID NO: 2932339 - RNA, 23 nt, Human
ccagauugcaacaggcugggcuu

SEQ ID NO: 2932340 - RNA, 22 nt, Human
ccagauugcaacaggcugggcu

SEQ ID NO: 2932341 - RNA, 15 nt, Human
ccagauuucacucuc

SEQ ID NO: 2932342 - RNA, 19 nt, Human
ccagauuucacucuccuug

SEQ ID NO: 2932343 - RNA, 18 nt, Human
ccagauuucacucuccuu

SEQ ID NO: 2932344 - RNA, 16 nt, Human
ccagcccacuucugcc

SEQ ID NO: 2932345 - RNA, 17 nt, Human
ccagcccacuucugcca

SEQ ID NO: 2932346 - RNA, 23 nt, Human
ccagcaggcucucaggccagcug

SEQ ID NO: 2932347 - RNA, 21 nt, Human
ccagcaggcucucaggccagc

SEQ ID NO: 2932348 - RNA, 20 nt, Human
ccagcaggcucucaggccag

SEQ ID NO: 2932349 - RNA, 19 nt, Human
ccagcaggcucucaggcca

SEQ ID NO: 2932350 - RNA, 19 nt, Human
ccagccccaaaacucuccu

SEQ ID NO: 2932351 - RNA, 17 nt, Human
ccagccgagauagccaa

SEQ ID NO: 2932352 - RNA, 22 nt, Human
ccagccgagauagccaaggcca

SEQ ID NO: 2932353 - RNA, 20 nt, Human
ccagccgagauagccaaggc

SEQ ID NO: 2932354 - RNA, 13 nt, Human
ccagccuggguga

SEQ ID NO: 2932355 - RNA, 23 nt, Human
ccagccuugaccauucuccaccu

SEQ ID NO: 2932356 - RNA, 13 nt, Human
ccagcgagcccug

SEQ ID NO: 2932357 - RNA, 19 nt, Human
ccagccugagcgacaguga

SEQ ID NO: 2932358 - RNA, 15 nt, Human
ccauucugccugccc

SEQ ID NO: 2932359 - RNA, 13 nt, Human
ccauuugcuccuu

SEQ ID NO: 2932360 - RNA, 16 nt, Human
ccaucuuaaaaacaac

SEQ ID NO: 2932361 - RNA, 18 nt, Human
ccauguuuuguuuacggu

SEQ ID NO: 2932362 - RNA, 14 nt, Human
cccaagggccuggc

SEQ ID NO: 2932363 - RNA, 12 nt, Human
cccaagggccug

SEQ ID NO: 2932364 - RNA, 21 nt, Human
ccauuuuguauuuuacuaaua

SEQ ID NO: 2932365 - RNA, 20 nt, Human
ccauuuugcugucccuuuuc

SEQ ID NO: 2932366 - RNA, 13 nt, Human
cccaagugccaaa

SEQ ID NO: 2932367 - RNA, 15 nt, Human
cccaagugccaaaga

SEQ ID NO: 2932368 - RNA, 16 nt, Human
cccaagggccuggccu

SEQ ID NO: 2932369 - RNA, 16 nt, Human
cccacagccccaucug

SEQ ID NO: 2932370 - RNA, 17 nt, Human
cccacaggaucagucug

SEQ ID NO: 2932371 - RNA, 13 nt, Human
cccacaggaucag

SEQ ID NO: 2932372 - RNA, 12 nt, Human
cccaccucagcc

SEQ ID NO: 2932373 - RNA, 14 nt, Human
cccaccucagccuc

SEQ ID NO: 2932374 - RNA, 15 nt, Human
cccaccucagccucc

SEQ ID NO: 2932375 - RNA, 19 nt, Human
cccaccucucucacuccuu

SEQ ID NO: 2932376 - RNA, 12 nt, Human
cccaccuuggcu

SEQ ID NO: 2932377 - RNA, 21 nt, Human
cccaccucagccucccaaagu

SEQ ID NO: 2932378 - RNA, 13 nt, Human
cccaccucucuca

SEQ ID NO: 2932379 - RNA, 17 nt, Human
cccaccucucucacucc

SEQ ID NO: 2932380 - RNA, 14 nt, Human
cccaccucucucac

SEQ ID NO: 2932381 - RNA, 19 nt, Human
cccacgcccccacugguga

SEQ ID NO: 2932382 - RNA, 17 nt, Human
cccacgcccccacuggu

SEQ ID NO: 2932383 - RNA, 15 nt, Human
cccaccuuggcucaa

SEQ ID NO: 2932384 - RNA, 22 nt, Human
cccaccuuggcucaaguccucu

SEQ ID NO: 2932385 - RNA, 14 nt, Human
cccaccuuggcugc

SEQ ID NO: 2932386 - RNA, 15 nt, Human
cccaccuuggcugca

SEQ ID NO: 2932387 - RNA, 13 nt, Human
ccagugagacugu

SEQ ID NO: 2932388 - RNA, 18 nt, Human
ccagugacagucagggaa

SEQ ID NO: 2932389 - RNA, 16 nt, Human
ccagguuucuaugugu

SEQ ID NO: 2932390 - RNA, 13 nt, Human
ccagguuuaagcu

SEQ ID NO: 2932391 - RNA, 20 nt, Human
ccaguaaaugggggugcauu

SEQ ID NO: 2932392 - RNA, 21 nt, Human
ccaguaaaugggggugcauuu

SEQ ID NO: 2932393 - RNA, 22 nt, Human
ccaguaaaugggggugcauuug

SEQ ID NO: 2932394 - RNA, 21 nt, Human
ccaggugcuaggaacacuccu

SEQ ID NO: 2932395 - RNA, 12 nt, Human
ccaggugccagu

SEQ ID NO: 2932396 - RNA, 12 nt, Human
ccaucaugucug

SEQ ID NO: 2932397 - RNA, 13 nt, Human
ccaucaugucugg

SEQ ID NO: 2932398 - RNA, 12 nt, Human
ccaucauugaaa

SEQ ID NO: 2932399 - RNA, 14 nt, Human
ccaucaagccacca

SEQ ID NO: 2932400 - RNA, 13 nt, Human
ccaucaagccacc

SEQ ID NO: 2932401 - RNA, 16 nt, Human
ccaucaagccaccaac

SEQ ID NO: 2932402 - RNA, 15 nt, Human
ccauaugccugggca

SEQ ID NO: 2932403 - RNA, 12 nt, Human
ccaucaagccac

SEQ ID NO: 2932404 - RNA, 13 nt, Human
ccauaugccuggg

SEQ ID NO: 2932405 - RNA, 14 nt, Human
ccagugugacaagg

SEQ ID NO: 2932406 - RNA, 23 nt, Human
ccagugugacaaggauugcuacu

SEQ ID NO: 2932407 - RNA, 15 nt, Human
ccaucucuccuccuu

SEQ ID NO: 2932408 - RNA, 21 nt, Human
ccaucucacacaugagcauca

SEQ ID NO: 2932409 - RNA, 20 nt, Human
ccaucucacacaugagcauc

SEQ ID NO: 2932410 - RNA, 18 nt, Human
ccaucucacacaugagca

SEQ ID NO: 2932411 - RNA, 17 nt, Human
ccaucucacacaugagc

SEQ ID NO: 2932412 - RNA, 15 nt, Human
ccaucucacacauga

SEQ ID NO: 2932413 - RNA, 14 nt, Human
ccaucucacacaug

SEQ ID NO: 2932414 - RNA, 17 nt, Human
ccauccuggcccagggc

SEQ ID NO: 2932415 - RNA, 20 nt, Human
ccauccugaggcuccacuug

SEQ ID NO: 2932416 - RNA, 18 nt, Human
ccauccugaggcuccacu

SEQ ID NO: 2932417 - RNA, 17 nt, Human
ccaucauugaaaucuuu

SEQ ID NO: 2932418 - RNA, 16 nt, Human
ccaucauugaaaucuu

SEQ ID NO: 2932419 - RNA, 14 nt, Human
ccaucauugaaauc

SEQ ID NO: 2932420 - RNA, 14 nt, Human
ccaggcccucugcc

SEQ ID NO: 2932421 - RNA, 13 nt, Human
ccaggcccucugc

SEQ ID NO: 2932422 - RNA, 12 nt, Human
ccaggccagagg

SEQ ID NO: 2932423 - RNA, 14 nt, Human
ccaggccccugcca

SEQ ID NO: 2932424 - RNA, 15 nt, Human
ccaggccccugccac

SEQ ID NO: 2932425 - RNA, 16 nt, Human
ccaggccccugccacc

SEQ ID NO: 2932426 - RNA, 14 nt, Human
ccaggaggccagcc

SEQ ID NO: 2932427 - RNA, 18 nt, Human
ccaggaggccagccuuga

SEQ ID NO: 2932428 - RNA, 15 nt, Human
ccaggaggccagccu

SEQ ID NO: 2932429 - RNA, 20 nt, Human
ccaggaggccagccuugacc

SEQ ID NO: 2932430 - RNA, 21 nt, Human
ccaggccacaagacccuugug

SEQ ID NO: 2932431 - RNA, 22 nt, Human
ccaggaggcggaccuuguagug

SEQ ID NO: 2932432 - RNA, 21 nt, Human
ccaggcuuagucacugagaca

SEQ ID NO: 2932433 - RNA, 23 nt, Human
ccaggcuuagucacugagacagc

SEQ ID NO: 2932434 - RNA, 22 nt, Human
ccaggcuuagucacugagacag

SEQ ID NO: 2932435 - RNA, 23 nt, Human
ccaggcugggagagccuuccagg

SEQ ID NO: 2932436 - RNA, 15 nt, Human
ccaggcccucugccc

SEQ ID NO: 2932437 - RNA, 18 nt, Human
ccaggguggccacaccuc

SEQ ID NO: 2932438 - RNA, 24 nt, Human
ccaggguggccacaccucuauccc

SEQ ID NO: 2932439 - RNA, 20 nt, Human
ccagguagaggguguguaag

SEQ ID NO: 2932440 - RNA, 14 nt, Human
cccaugagccucag

SEQ ID NO: 2932441 - RNA, 20 nt, Human
cccaugagggagaugccaug

SEQ ID NO: 2932442 - RNA, 21 nt, Human
cccaugagggagaugccauga

SEQ ID NO: 2932443 - RNA, 22 nt, Human
cccaugagccucagcauccugg

SEQ ID NO: 2932444 - RNA, 22 nt, Human
cccaucugcgggggcagugcuc

SEQ ID NO: 2932445 - RNA, 21 nt, Human
cccaucugcgggggcagugcu

SEQ ID NO: 2932446 - RNA, 17 nt, Human
cccaucugcagggcccc

SEQ ID NO: 2932447 - RNA, 19 nt, Human
cccaucucuacaaaaagca

SEQ ID NO: 2932448 - RNA, 14 nt, Human
cccaguugggugga

SEQ ID NO: 2932449 - RNA, 16 nt, Human
ccccacuccggcccuc

SEQ ID NO: 2932450 - RNA, 20 nt, Human
ccccacuccggcccuccaga

SEQ ID NO: 2932451 - RNA, 14 nt, Human
ccccacuggugaca

SEQ ID NO: 2932452 - RNA, 19 nt, Human
ccccaccgcagacaggacc

SEQ ID NO: 2932453 - RNA, 15 nt, Human
ccccaccgcagacag

SEQ ID NO: 2932454 - RNA, 21 nt, Human
ccccacccaagggccuggccu

SEQ ID NO: 2932455 - RNA, 19 nt, Human
ccccuguggaugcugcugc

SEQ ID NO: 2932456 - RNA, 20 nt, Human
ccccuguggaugcugcugcc

SEQ ID NO: 2932457 - RNA, 22 nt, Human
ccccuguggaugcugcugcccc

SEQ ID NO: 2932458 - RNA, 22 nt, Human
cccgaauagcugggacuacagg

SEQ ID NO: 2932459 - RNA, 20 nt, Human
ccccuuccauggacuuuguu

SEQ ID NO: 2932460 - RNA, 13 nt, Human
ccccuuccaugga

SEQ ID NO: 2932461 - RNA, 23 nt, Human
cccgcuaagagggagggagggcu

SEQ ID NO: 2932462 - RNA, 22 nt, Human
cccgcccaggcuuagucacuga

SEQ ID NO: 2932463 - RNA, 20 nt, Human
cccgcccaggcuuagucacu

SEQ ID NO: 2932464 - RNA, 17 nt, Human
ccccugcccggcugcgg

SEQ ID NO: 2932465 - RNA, 19 nt, Human
ccccugcccggcugcggaa

SEQ ID NO: 2932466 - RNA, 15 nt, Human
ccccuggaugcagcc

SEQ ID NO: 2932467 - RNA, 14 nt, Human
ccccuggcacuggc

SEQ ID NO: 2932468 - RNA, 16 nt, Human
ccccuggcacuggcaa

SEQ ID NO: 2932469 - RNA, 19 nt, Human
ccccuggaugcagccucac

SEQ ID NO: 2932470 - RNA, 18 nt, Human
ccccuggaugcagccuca

SEQ ID NO: 2932471 - RNA, 17 nt, Human
ccccugcuggguguggc

SEQ ID NO: 2932472 - RNA, 14 nt, Human
ccccugcugggugu

SEQ ID NO: 2932473 - RNA, 11 nt, Human
ccccugcuggu

SEQ ID NO: 2932474 - RNA, 13 nt, Human
ccccugcugguuc

SEQ ID NO: 2932475 - RNA, 15 nt, Human
ccccugcugguucag

SEQ ID NO: 2932476 - RNA, 20 nt, Human
ccccugcugguucaggguug

SEQ ID NO: 2932477 - RNA, 24 nt, Human
cccccacccaagggccuggccuga

SEQ ID NO: 2932478 - RNA, 13 nt, Human
cccccacccaagg

SEQ ID NO: 2932479 - RNA, 14 nt, Human
ccccauccucugua

SEQ ID NO: 2932480 - RNA, 13 nt, Human
cccccacugguga

SEQ ID NO: 2932481 - RNA, 11 nt, Human
cccccacuggu

SEQ ID NO: 2932482 - RNA, 15 nt, Human
cccccacuggugaca

SEQ ID NO: 2932483 - RNA, 14 nt, Human
ccccagugcccaca

SEQ ID NO: 2932484 - RNA, 15 nt, Human
ccccagugcccacag

SEQ ID NO: 2932485 - RNA, 16 nt, Human
ccccagugcccacagg

SEQ ID NO: 2932486 - RNA, 20 nt, Human
ccccagugcccacaggauca

SEQ ID NO: 2932487 - RNA, 17 nt, Human
cccccugacaacacuca

SEQ ID NO: 2932488 - RNA, 19 nt, Human
cccccugacaacacucauu

SEQ ID NO: 2932489 - RNA, 12 nt, Human
cccccagccugc

SEQ ID NO: 2932490 - RNA, 23 nt, Human
ccccucaacucuccuccagaguc

SEQ ID NO: 2932491 - RNA, 16 nt, Human
ccccucaacaccucug

SEQ ID NO: 2932492 - RNA, 15 nt, Human
ccccucaacaccucu

SEQ ID NO: 2932493 - RNA, 12 nt, Human
ccccuccaugug

SEQ ID NO: 2932494 - RNA, 22 nt, Human
ccccucagggucccugguggca

SEQ ID NO: 2932495 - RNA, 16 nt, Human
ccccucagggucccug

SEQ ID NO: 2932496 - RNA, 13 nt, Human
ccccuccucugcu

SEQ ID NO: 2932497 - RNA, 14 nt, Human
ccccuccucugcuu

SEQ ID NO: 2932498 - RNA, 17 nt, Human
ccccuccucugcuugcc

SEQ ID NO: 2932499 - RNA, 15 nt, Human
ccccucggagaagag

SEQ ID NO: 2932500 - RNA, 19 nt, Human
ccgagcuuugaaaauucag

SEQ ID NO: 2932501 - RNA, 14 nt, Human
ccgaguagcuggga

SEQ ID NO: 2932502 - RNA, 16 nt, Human
ccgaguagcugggacu

SEQ ID NO: 2932503 - RNA, 23 nt, Human
ccgcacugggcuuggggaccaga

SEQ ID NO: 2932504 - RNA, 21 nt, Human
ccgagauugcaccacugcacu

SEQ ID NO: 2932505 - RNA, 19 nt, Human
ccgagauugcaccacugca

SEQ ID NO: 2932506 - RNA, 15 nt, Human
ccgagauugcaccac

SEQ ID NO: 2932507 - RNA, 18 nt, Human
ccgugaggccagagacac

SEQ ID NO: 2932508 - RNA, 15 nt, Human
ccgggcucugccucc

SEQ ID NO: 2932509 - RNA, 14 nt, Human
ccgggcucugccuc

SEQ ID NO: 2932510 - RNA, 13 nt, Human
ccgggcucugccu

SEQ ID NO: 2932511 - RNA, 18 nt, Human
ccgggcucugccucccau

SEQ ID NO: 2932512 - RNA, 16 nt, Human
ccggcuccaggcuccu

SEQ ID NO: 2932513 - RNA, 21 nt, Human
ccggcuccaggcuccuuuagc

SEQ ID NO: 2932514 - RNA, 20 nt, Human
ccgggcacucagaagacacu

SEQ ID NO: 2932515 - RNA, 22 nt, Human
ccgggcacucagaagacacuga

SEQ ID NO: 2932516 - RNA, 13 nt, Human
ccgggccacagag

SEQ ID NO: 2932517 - RNA, 11 nt, Human
ccgcuggggcc

SEQ ID NO: 2932518 - RNA, 14 nt, Human
ccgcuggggccagu

SEQ ID NO: 2932519 - RNA, 21 nt, Human
ccuacaguugaaaaacagcug

SEQ ID NO: 2932520 - RNA, 23 nt, Human
ccuaggcauuugcugaauacaga

SEQ ID NO: 2932521 - RNA, 18 nt, Human
ccuaggugacagagugag

SEQ ID NO: 2932522 - RNA, 18 nt, Human
ccuacaggagugagcacu

SEQ ID NO: 2932523 - RNA, 20 nt, Human
cccugcagagggcacagaaa

SEQ ID NO: 2932524 - RNA, 12 nt, Human
cccugaggccca

SEQ ID NO: 2932525 - RNA, 11 nt, Human
cccugccuccu

SEQ ID NO: 2932526 - RNA, 12 nt, Human
cccugcugcucc

SEQ ID NO: 2932527 - RNA, 14 nt, Human
cccugcugcuccua

SEQ ID NO: 2932528 - RNA, 22 nt, Human
cccugcucuccgaccagacacc

SEQ ID NO: 2932529 - RNA, 21 nt, Human
cccugcucuccgaccagacac

SEQ ID NO: 2932530 - RNA, 14 nt, Human
cccugguggcagug

SEQ ID NO: 2932531 - RNA, 21 nt, Human
cccuguagagugggagcugag

SEQ ID NO: 2932532 - RNA, 13 nt, Human
cccugguggcagu

SEQ ID NO: 2932533 - RNA, 21 nt, Human
cccugguggcagcucaccucu

SEQ ID NO: 2932534 - RNA, 21 nt, Human
cccuggugaccagcaccaucu

SEQ ID NO: 2932535 - RNA, 14 nt, Human
cccuguucuggcag

SEQ ID NO: 2932536 - RNA, 13 nt, Human
cccuguucuggca

SEQ ID NO: 2932537 - RNA, 16 nt, Human
cccuguuuguuucuga

SEQ ID NO: 2932538 - RNA, 19 nt, Human
cccuguuuguuucugaaag

SEQ ID NO: 2932539 - RNA, 17 nt, Human
cccuuaccugccaggaa

SEQ ID NO: 2932540 - RNA, 23 nt, Human
cccuuaccugccaggaagccagc

SEQ ID NO: 2932541 - RNA, 20 nt, Human
cccuuaccugccaggaagcc

SEQ ID NO: 2932542 - RNA, 23 nt, Human
cccuuagcagggaaacagcuaau

SEQ ID NO: 2932543 - RNA, 14 nt, Human
cccuuagcagggaa

SEQ ID NO: 2932544 - RNA, 17 nt, Human
cccuuacgugaguccug

SEQ ID NO: 2932545 - RNA, 15 nt, Human
cccuuacgugagucc

SEQ ID NO: 2932546 - RNA, 12 nt, Human
cccuuccaugga

SEQ ID NO: 2932547 - RNA, 23 nt, Human
cccucccucuuucccucccuucc

SEQ ID NO: 2932548 - RNA, 12 nt, Human
cccucuuucccu

SEQ ID NO: 2932549 - RNA, 17 nt, Human
cccucuuucccucccuu

SEQ ID NO: 2932550 - RNA, 20 nt, Human
cccucuuucccucccuuccu

SEQ ID NO: 2932551 - RNA, 20 nt, Human
cccucuccugggcagcugcc

SEQ ID NO: 2932552 - RNA, 15 nt, Human
cccucuccugggcag

SEQ ID NO: 2932553 - RNA, 21 nt, Human
cccucuccugggcagcugccu

SEQ ID NO: 2932554 - RNA, 22 nt, Human
cccucuccugggcagcugccuc

SEQ ID NO: 2932555 - RNA, 19 nt, Human
cccucugcccacucccugc

SEQ ID NO: 2932556 - RNA, 23 nt, Human
cccucuccugggcagcugccucc

SEQ ID NO: 2932557 - RNA, 11 nt, Human
cccucugccca

SEQ ID NO: 2932558 - RNA, 18 nt, Human
cccucugcccacucccug

SEQ ID NO: 2932559 - RNA, 15 nt, Human
cccucugcccacucc

SEQ ID NO: 2932560 - RNA, 22 nt, Human
cucaggaaaucaaauaugcaaa

SEQ ID NO: 2932561 - RNA, 18 nt, Human
cucagggucccugguggc

SEQ ID NO: 2932562 - RNA, 24 nt, Human
cucagggucccugguggcagcuca

SEQ ID NO: 2932563 - RNA, 22 nt, Human
cucagggucccugguggcagcu

SEQ ID NO: 2932564 - RNA, 21 nt, Human
cucagggucccugguggcagc

SEQ ID NO: 2932565 - RNA, 20 nt, Human
cucagggucccugguggcag

SEQ ID NO: 2932566 - RNA, 14 nt, Human
cucagggccugguc

SEQ ID NO: 2932567 - RNA, 21 nt, Human
cucagguggggucacucuggc

SEQ ID NO: 2932568 - RNA, 20 nt, Human
cucagguggggucacucugg

SEQ ID NO: 2932569 - RNA, 19 nt, Human
cucagguggggucacucug

SEQ ID NO: 2932570 - RNA, 22 nt, Human
cucaggugauccacccaccuca

SEQ ID NO: 2932571 - RNA, 23 nt, Human
cucaggugauccacccaccucag

SEQ ID NO: 2932572 - RNA, 15 nt, Human
cucaggcagguggga

SEQ ID NO: 2932573 - RNA, 18 nt, Human
cucaggcaggugggaugg

SEQ ID NO: 2932574 - RNA, 18 nt, Human
cucagggccuggcucagg

SEQ ID NO: 2932575 - RNA, 20 nt, Human
cucagggccuggcucaggug

SEQ ID NO: 2932576 - RNA, 19 nt, Human
cucagggccuggcucaggu

SEQ ID NO: 2932577 - RNA, 13 nt, Human
cucagcauccugg

SEQ ID NO: 2932578 - RNA, 21 nt, Human
cucagcauccuggcacccggc

SEQ ID NO: 2932579 - RNA, 22 nt, Human
cucagcauccuggcacccggcc

SEQ ID NO: 2932580 - RNA, 16 nt, Human
cucagcaggggagggu

SEQ ID NO: 2932581 - RNA, 20 nt, Human
cucagcaaaagaugcuucuc

SEQ ID NO: 2932582 - RNA, 19 nt, Human
cucagcaaaagaugcuucu

SEQ ID NO: 2932583 - RNA, 13 nt, Human
cucagcggggaca

SEQ ID NO: 2932584 - RNA, 23 nt, Human
cucagcggggacagcuccuucug

SEQ ID NO: 2932585 - RNA, 14 nt, Human
cucagcggggacag

SEQ ID NO: 2932586 - RNA, 15 nt, Human
cucagcggggacagc

SEQ ID NO: 2932587 - RNA, 16 nt, Human
cucagcggggacagcu

SEQ ID NO: 2932588 - RNA, 18 nt, Human
cucagcggggacagcucc

SEQ ID NO: 2932589 - RNA, 19 nt, Human
cucagcggggacagcuccu

SEQ ID NO: 2932590 - RNA, 20 nt, Human
cucagcggggacagcuccuu

SEQ ID NO: 2932591 - RNA, 21 nt, Human
cucagcggggacagcuccuuc

SEQ ID NO: 2932592 - RNA, 14 nt, Human
cucacagcagugag

SEQ ID NO: 2932593 - RNA, 15 nt, Human
cucacugcagccuca

SEQ ID NO: 2932594 - RNA, 16 nt, Human
cucacugcagccucaa

SEQ ID NO: 2932595 - RNA, 14 nt, Human
cucacugcagccuc

SEQ ID NO: 2932596 - RNA, 18 nt, Human
cucacagcagugagacug

SEQ ID NO: 2932597 - RNA, 14 nt, Human
cucacuguugccca

SEQ ID NO: 2932598 - RNA, 15 nt, Human
cucacuguugcccag

SEQ ID NO: 2932599 - RNA, 18 nt, Human
cucagagagggugggagu

SEQ ID NO: 2932600 - RNA, 19 nt, Human
cucagagagggugggagug

SEQ ID NO: 2932601 - RNA, 19 nt, Human
cucacagcagugagacugg

SEQ ID NO: 2932602 - RNA, 23 nt, Human
cucagagagggugggagugggcc

SEQ ID NO: 2932603 - RNA, 16 nt, Human
cucacuguugcccagg

SEQ ID NO: 2932604 - RNA, 17 nt, Human
cucacuguugcccaggc

SEQ ID NO: 2932605 - RNA, 18 nt, Human
cucacuguugcccaggcu

SEQ ID NO: 2932606 - RNA, 19 nt, Human
cucacuguugcccaggcug

SEQ ID NO: 2932607 - RNA, 21 nt, Human
cucagaugcacaugagcuggc

SEQ ID NO: 2932608 - RNA, 16 nt, Human
cucagaucuucugugg

SEQ ID NO: 2932609 - RNA, 24 nt, Human
cucccaugagggagaugccaugag

SEQ ID NO: 2932610 - RNA, 14 nt, Human
cucccaucacccgc

SEQ ID NO: 2932611 - RNA, 16 nt, Human
cucccaucacuucccu

SEQ ID NO: 2932612 - RNA, 15 nt, Human
cucccacaaaggaga

SEQ ID NO: 2932613 - RNA, 15 nt, Human
cucccaacucacccc

SEQ ID NO: 2932614 - RNA, 14 nt, Human
cucccaacucaccc

SEQ ID NO: 2932615 - RNA, 16 nt, Human
cucccaaagugcuggg

SEQ ID NO: 2932616 - RNA, 23 nt, Human
cucccaaagugcugggauuacag

SEQ ID NO: 2932617 - RNA, 21 nt, Human
cuccagcugcugagauccugg

SEQ ID NO: 2932618 - RNA, 23 nt, Human
cuccagcugcugagauccuggac

SEQ ID NO: 2932619 - RNA, 20 nt, Human
cuccagcugcugagauccug

SEQ ID NO: 2932620 - RNA, 14 nt, Human
cuccagcugcugag

SEQ ID NO: 2932621 - RNA, 20 nt, Human
cucccgaauagcugggacua

SEQ ID NO: 2932622 - RNA, 23 nt, Human
cucccgaauagcugggacuacag

SEQ ID NO: 2932623 - RNA, 19 nt, Human
cucccgaauagcugggacu

SEQ ID NO: 2932624 - RNA, 14 nt, Human
cucccugcugcucc

SEQ ID NO: 2932625 - RNA, 16 nt, Human
cucccugcugcuccua

SEQ ID NO: 2932626 - RNA, 17 nt, Human
cucccugcugcuccuag

SEQ ID NO: 2932627 - RNA, 15 nt, Human
cucccuucauccuuc

SEQ ID NO: 2932628 - RNA, 23 nt, Human
cuccccugcuggguguggcgcag

SEQ ID NO: 2932629 - RNA, 21 nt, Human
cuccccugcuggguguggcgc

SEQ ID NO: 2932630 - RNA, 14 nt, Human
cuccccugcugggu

SEQ ID NO: 2932631 - RNA, 14 nt, Human
cuccccucggagaa

SEQ ID NO: 2932632 - RNA, 14 nt, Human
cuccagcucaccag

SEQ ID NO: 2932633 - RNA, 15 nt, Human
cuccagcucaccagc

SEQ ID NO: 2932634 - RNA, 16 nt, Human
cuccagcucaccagcc

SEQ ID NO: 2932635 - RNA, 18 nt, Human
cuccagcucaccagcccc

SEQ ID NO: 2932636 - RNA, 11 nt, Human
cuccagccccu

SEQ ID NO: 2932637 - RNA, 14 nt, Human
cuccagccccugga

SEQ ID NO: 2932638 - RNA, 13 nt, Human
cuccagccccugg

SEQ ID NO: 2932639 - RNA, 16 nt, Human
cuccagagccccacag

SEQ ID NO: 2932640 - RNA, 16 nt, Human
cuccagagucagaagu

SEQ ID NO: 2932641 - RNA, 18 nt, Human
cuccagagccccacagcc

SEQ ID NO: 2932642 - RNA, 21 nt, Human
cuccagagccccacagcccca

SEQ ID NO: 2932643 - RNA, 21 nt, Human
cucauugaccugaggcccuuc

SEQ ID NO: 2932644 - RNA, 19 nt, Human
cucauugaccugaggcccu

SEQ ID NO: 2932645 - RNA, 18 nt, Human
cucauucuccuuguguua

SEQ ID NO: 2932646 - RNA, 22 nt, Human
cucauucuccuuguguuacuaa

SEQ ID NO: 2932647 - RNA, 17 nt, Human
cucauugaccugaggcc

SEQ ID NO: 2932648 - RNA, 18 nt, Human
cuccaaaauaaaacuuuu

SEQ ID NO: 2932649 - RNA, 23 nt, Human
cucauuuuuauaaugucccuuca

SEQ ID NO: 2932650 - RNA, 17 nt, Human
cuccaagcucccaggca

SEQ ID NO: 2932651 - RNA, 21 nt, Human
cucauuugucacacacuuugg

SEQ ID NO: 2932652 - RNA, 18 nt, Human
cucauuugucacacacuu

SEQ ID NO: 2932653 - RNA, 17 nt, Human
cucauuuccaagcaagu

SEQ ID NO: 2932654 - RNA, 13 nt, Human
cucauuuccaagc

SEQ ID NO: 2932655 - RNA, 14 nt, Human
cucauuuccaagca

SEQ ID NO: 2932656 - RNA, 12 nt, Human
cucauuuccaag

SEQ ID NO: 2932657 - RNA, 21 nt, Human
cuaugcauuugaaaauuuuga

SEQ ID NO: 2932658 - RNA, 20 nt, Human
cuauauaauuccuguuuuua

SEQ ID NO: 2932659 - RNA, 18 nt, Human
cuauauaauuccuguuuu

SEQ ID NO: 2932660 - RNA, 18 nt, Human
cuaugaaauauuauguua

SEQ ID NO: 2932661 - RNA, 19 nt, Human
cuaugaaauauuauguuaa

SEQ ID NO: 2932662 - RNA, 19 nt, Human
cuauagccuaggugacaga

SEQ ID NO: 2932663 - RNA, 18 nt, Human
cuauagccuaggugacag

SEQ ID NO: 2932664 - RNA, 20 nt, Human
cuauagccuaggugacagag

SEQ ID NO: 2932665 - RNA, 21 nt, Human
cuauagccuaggugacagagu

SEQ ID NO: 2932666 - RNA, 12 nt, Human
cuauaauuuaaa

SEQ ID NO: 2932667 - RNA, 17 nt, Human
cuaggaagacuuuggaa

SEQ ID NO: 2932668 - RNA, 15 nt, Human
cuaggaagacuuugg

SEQ ID NO: 2932669 - RNA, 20 nt, Human
cuaggaacacuccuucacag

SEQ ID NO: 2932670 - RNA, 15 nt, Human
cuaggaaaauuauuc

SEQ ID NO: 2932671 - RNA, 13 nt, Human
cuauguaucaaug

SEQ ID NO: 2932672 - RNA, 23 nt, Human
cuauucagcacaaggaaauaaaa

SEQ ID NO: 2932673 - RNA, 17 nt, Human
cuauucaguaauaacuc

SEQ ID NO: 2932674 - RNA, 18 nt, Human
cuauucugagaugacuau

SEQ ID NO: 2932675 - RNA, 15 nt, Human
cuauucugagaugac

SEQ ID NO: 2932676 - RNA, 16 nt, Human
cuauucugagaugacu

SEQ ID NO: 2932677 - RNA, 23 nt, Human
cuauucaguaauaacucuacccu

SEQ ID NO: 2932678 - RNA, 23 nt, Human
cucacacggacacucaaaagcug

SEQ ID NO: 2932679 - RNA, 15 nt, Human
cucacagaagaugaa

SEQ ID NO: 2932680 - RNA, 18 nt, Human
cucaacucuccuccagag

SEQ ID NO: 2932681 - RNA, 16 nt, Human
cucaacucuccuccag

SEQ ID NO: 2932682 - RNA, 13 nt, Human
cucaaauuucuaa

SEQ ID NO: 2932683 - RNA, 15 nt, Human
cucaaauuucuaaau

SEQ ID NO: 2932684 - RNA, 17 nt, Human
cucaaauuucuaaaucu

SEQ ID NO: 2932685 - RNA, 14 nt, Human
cucaacucuccucc

SEQ ID NO: 2932686 - RNA, 14 nt, Human
cucaaauuucuaaa

SEQ ID NO: 2932687 - RNA, 15 nt, Human
cuauuuauuuacaaa

SEQ ID NO: 2932688 - RNA, 16 nt, Human
cuauuuauuuacaaau

SEQ ID NO: 2932689 - RNA, 19 nt, Human
cuauuuauuuauuuauuca

SEQ ID NO: 2932690 - RNA, 12 nt, Human
cuauuuauuuau

SEQ ID NO: 2932691 - RNA, 16 nt, Human
cuauugcugcuugagg

SEQ ID NO: 2932692 - RNA, 14 nt, Human
cuauuuauuuacaa

SEQ ID NO: 2932693 - RNA, 18 nt, Human
cuauuguuagucucuuga

SEQ ID NO: 2932694 - RNA, 14 nt, Human
cuaggaaauauuua

SEQ ID NO: 2932695 - RNA, 15 nt, Human
cuaggaaauauuuau

SEQ ID NO: 2932696 - RNA, 19 nt, Human
cuaggaaauauuuauuuua

SEQ ID NO: 2932697 - RNA, 20 nt, Human
cuaggaaauauuuauuuuaa

SEQ ID NO: 2932698 - RNA, 22 nt, Human
cuagccuuagaagucacacagu

SEQ ID NO: 2932699 - RNA, 23 nt, Human
cuagccuuagaagucacacagua

SEQ ID NO: 2932700 - RNA, 24 nt, Human
cuagauacuguaucaugacaaaga

SEQ ID NO: 2932701 - RNA, 13 nt, Human
cuagauacuguau

SEQ ID NO: 2932702 - RNA, 16 nt, Human
cuagauacuguaucau

SEQ ID NO: 2932703 - RNA, 21 nt, Human
cuagccuuagaagucacacag

SEQ ID NO: 2932704 - RNA, 22 nt, Human
cuagccugugccucugggacug

SEQ ID NO: 2932705 - RNA, 21 nt, Human
cuagccugugccucugggacu

SEQ ID NO: 2932706 - RNA, 19 nt, Human
cuagccugugccucuggga

SEQ ID NO: 2932707 - RNA, 14 nt, Human
cuacugccauccug

SEQ ID NO: 2932708 - RNA, 15 nt, Human
cuacugccauccugg

SEQ ID NO: 2932709 - RNA, 16 nt, Human
cuacugccauccuggc

SEQ ID NO: 2932710 - RNA, 17 nt, Human
cuacugccauccuggcc

SEQ ID NO: 2932711 - RNA, 18 nt, Human
cuacugccauccuggccc

SEQ ID NO: 2932712 - RNA, 19 nt, Human
cuacugccauccuggccca

SEQ ID NO: 2932713 - RNA, 20 nt, Human
cuacugccauccuggcccag

SEQ ID NO: 2932714 - RNA, 22 nt, Human
cuacugccauccuggcccaggg

SEQ ID NO: 2932715 - RNA, 23 nt, Human
cuacugccauccuggcccagggc

SEQ ID NO: 2932716 - RNA, 19 nt, Human
cuacuguccuacccacccu

SEQ ID NO: 2932717 - RNA, 21 nt, Human
cuacuguaauuugugauacaa

SEQ ID NO: 2932718 - RNA, 17 nt, Human
cuacucgggaggcugag

SEQ ID NO: 2932719 - RNA, 12 nt, Human
cuacucuguguc

SEQ ID NO: 2932720 - RNA, 15 nt, Human
cuacucgaguuacag

SEQ ID NO: 2932721 - RNA, 19 nt, Human
cuacucgaguuacagacaa

SEQ ID NO: 2932722 - RNA, 16 nt, Human
cuacucgaguuacaga

SEQ ID NO: 2932723 - RNA, 20 nt, Human
cuacuguccuacccacccuc

SEQ ID NO: 2932724 - RNA, 17 nt, Human
cuagagguucaaagaua

SEQ ID NO: 2932725 - RNA, 18 nt, Human
cuagagguucaaagauau

SEQ ID NO: 2932726 - RNA, 21 nt, Human
cuagagguucaaagauauuuu

SEQ ID NO: 2932727 - RNA, 19 nt, Human
cuagaguuuagcuggaaaa

SEQ ID NO: 2932728 - RNA, 18 nt, Human
cuagaguuuagcuggaaa

SEQ ID NO: 2932729 - RNA, 15 nt, Human
cuagagguucaaaga

SEQ ID NO: 2932730 - RNA, 19 nt, Human
cuaaauucuuucauuuuag

SEQ ID NO: 2932731 - RNA, 19 nt, Human
cuaaauugacacuuaaaaa

SEQ ID NO: 2932732 - RNA, 16 nt, Human
cuaaauucaugcugcu

SEQ ID NO: 2932733 - RNA, 12 nt, Human
cuaaccacgcug

SEQ ID NO: 2932734 - RNA, 14 nt, Human
cuaaccacgcugga

SEQ ID NO: 2932735 - RNA, 20 nt, Human
cuaacagcaacacaaagcuu

SEQ ID NO: 2932736 - RNA, 23 nt, Human
cuaagagggagggagggcuccag

SEQ ID NO: 2932737 - RNA, 13 nt, Human
cuaagagggaggg

SEQ ID NO: 2932738 - RNA, 22 nt, Human
cuaagagggagggagggcucca

SEQ ID NO: 2932739 - RNA, 15 nt, Human
cuaagagggagggag

SEQ ID NO: 2932740 - RNA, 14 nt, Human
cuaagagagaauga

SEQ ID NO: 2932741 - RNA, 15 nt, Human
cuaagagagaaugag

SEQ ID NO: 2932742 - RNA, 22 nt, Human
cuaaaugaaaaucgugacaaca

SEQ ID NO: 2932743 - RNA, 21 nt, Human
cuaaaucuccaaaauaaaacu

SEQ ID NO: 2932744 - RNA, 23 nt, Human
cgggaggauguucugggacacag

SEQ ID NO: 2932745 - RNA, 21 nt, Human
cgggaggauguucugggacac

SEQ ID NO: 2932746 - RNA, 20 nt, Human
cgggaggcagagguugcagu

SEQ ID NO: 2932747 - RNA, 19 nt, Human
cuaauaugaugacuguuuu

SEQ ID NO: 2932748 - RNA, 21 nt, Human
cuaauaugaugacuguuuuua

SEQ ID NO: 2932749 - RNA, 12 nt, Human
cuaaugggacac

SEQ ID NO: 2932750 - RNA, 13 nt, Human
cuaaugggacacu

SEQ ID NO: 2932751 - RNA, 21 nt, Human
cuacacacugcauguuuguga

SEQ ID NO: 2932752 - RNA, 21 nt, Human
cuacacaggggaaaagaggag

SEQ ID NO: 2932753 - RNA, 14 nt, Human
cuacacuaagagag

SEQ ID NO: 2932754 - RNA, 23 nt, Human
cuacacgagauacagaauuuuau

SEQ ID NO: 2932755 - RNA, 22 nt, Human
cuaagcuauucaguaauaacuc

SEQ ID NO: 2932756 - RNA, 21 nt, Human
cuaagcuucacuguaaaauaa

SEQ ID NO: 2932757 - RNA, 17 nt, Human
cuaauagacaauuuauu

SEQ ID NO: 2932758 - RNA, 19 nt, Human
cuaauagacaauuuauuau

SEQ ID NO: 2932759 - RNA, 23 nt, Human
cuaauagacaauuuauuauggca

SEQ ID NO: 2932760 - RNA, 19 nt, Human
cuaaguaaaaccacagcag

SEQ ID NO: 2932761 - RNA, 18 nt, Human
cuaaguaaaaccacagca

SEQ ID NO: 2932762 - RNA, 14 nt, Human
cuaaguaaaaccac

SEQ ID NO: 2932763 - RNA, 13 nt, Human
cuacaguaauaaa

SEQ ID NO: 2932764 - RNA, 16 nt, Human
cuacaggugugaguca

SEQ ID NO: 2932765 - RNA, 14 nt, Human
cuacaggugugagu

SEQ ID NO: 2932766 - RNA, 13 nt, Human
cuacaguccuccc

SEQ ID NO: 2932767 - RNA, 18 nt, Human
cuacauggaguauauguc

SEQ ID NO: 2932768 - RNA, 20 nt, Human
cuacauggaguauaugucaa

SEQ ID NO: 2932769 - RNA, 15 nt, Human
cuacaggcacccacc

SEQ ID NO: 2932770 - RNA, 17 nt, Human
cuacaggcacccaccau

SEQ ID NO: 2932771 - RNA, 14 nt, Human
cuacaggagugagc

SEQ ID NO: 2932772 - RNA, 15 nt, Human
cuacaggagugagca

SEQ ID NO: 2932773 - RNA, 16 nt, Human
cuacaggagugagcac

SEQ ID NO: 2932774 - RNA, 23 nt, Human
cuacagcuugaccgugaggccag

SEQ ID NO: 2932775 - RNA, 22 nt, Human
cuacagcuugaccgugaggcca

SEQ ID NO: 2932776 - RNA, 19 nt, Human
cuacagcuugaccgugagg

SEQ ID NO: 2932777 - RNA, 22 nt, Human
cuacagaggccaugggccuccu

SEQ ID NO: 2932778 - RNA, 18 nt, Human
cuacagaggccaugggcc

SEQ ID NO: 2932779 - RNA, 20 nt, Human
cuacagaggccaugggccuc

SEQ ID NO: 2932780 - RNA, 17 nt, Human
cuacagaggccaugggc

SEQ ID NO: 2932781 - RNA, 17 nt, Human
cuacacugugcugaguc

SEQ ID NO: 2932782 - RNA, 14 nt, Human
cuacacugugcuga

SEQ ID NO: 2932783 - RNA, 13 nt, Human
cuacacugugcug

SEQ ID NO: 2932784 - RNA, 17 nt, Human
cuacccucuuagaaaaa

SEQ ID NO: 2932785 - RNA, 18 nt, Human
cuacccagcgagcccugg

SEQ ID NO: 2932786 - RNA, 13 nt, Human
cuacccaggugcu

SEQ ID NO: 2932787 - RNA, 12 nt, Human
cuacccaggugc

SEQ ID NO: 2932788 - RNA, 15 nt, Human
cuacccagcgagccc

SEQ ID NO: 2932789 - RNA, 17 nt, Human
cuacccagcgagcccug

SEQ ID NO: 2932790 - RNA, 17 nt, Human
cuacauugacagauuga

SEQ ID NO: 2932791 - RNA, 13 nt, Human
cuacauucuguua

SEQ ID NO: 2932792 - RNA, 14 nt, Human
cuacauucuguuaa

SEQ ID NO: 2932793 - RNA, 22 nt, Human
cuacauuauaaaugucucuuua

SEQ ID NO: 2932794 - RNA, 18 nt, Human
cuacauuagguugugaau

SEQ ID NO: 2932795 - RNA, 17 nt, Human
cuacauuagguugugaa

SEQ ID NO: 2932796 - RNA, 21 nt, Human
cuaccaauauuuaaucuuuua

SEQ ID NO: 2932797 - RNA, 15 nt, Human
cuaccaauauuuaau

SEQ ID NO: 2932798 - RNA, 13 nt, Human
cuaccaauauuua

SEQ ID NO: 2932799 - RNA, 18 nt, Human
cuaccauccccuguagag

SEQ ID NO: 2932800 - RNA, 20 nt, Human
ccugugccucugggacugga

SEQ ID NO: 2932801 - RNA, 20 nt, Human
ccugugggcccccaaaugga

SEQ ID NO: 2932802 - RNA, 17 nt, Human
ccuguggaugcugcugc

SEQ ID NO: 2932803 - RNA, 19 nt, Human
ccuguggaugcugcugccc

SEQ ID NO: 2932804 - RNA, 20 nt, Human
ccuguggaugauaaaacaca

SEQ ID NO: 2932805 - RNA, 16 nt, Human
ccuucucuccagcccc

SEQ ID NO: 2932806 - RNA, 15 nt, Human
ccuucucuccagccc

SEQ ID NO: 2932807 - RNA, 13 nt, Human
ccuucucuccagc

SEQ ID NO: 2932808 - RNA, 12 nt, Human
ccuucucuccag

SEQ ID NO: 2932809 - RNA, 13 nt, Human
ccuuccaggggug

SEQ ID NO: 2932810 - RNA, 17 nt, Human
ccuuccauggacuuugu

SEQ ID NO: 2932811 - RNA, 16 nt, Human
ccuucggccuccaucc

SEQ ID NO: 2932812 - RNA, 17 nt, Human
ccuucggccuccauccu

SEQ ID NO: 2932813 - RNA, 18 nt, Human
ccuucggccuccauccug

SEQ ID NO: 2932814 - RNA, 20 nt, Human
ccuuggugucgggcaugaca

SEQ ID NO: 2932815 - RNA, 19 nt, Human
ccuuggugucgggcaugac

SEQ ID NO: 2932816 - RNA, 14 nt, Human
ccuuggcugcaggg

SEQ ID NO: 2932817 - RNA, 16 nt, Human
ccuuggcugcagggag

SEQ ID NO: 2932818 - RNA, 14 nt, Human
ccuuggggagcagg

SEQ ID NO: 2932819 - RNA, 18 nt, Human
ccuugacagggcacaccg

SEQ ID NO: 2932820 - RNA, 21 nt, Human
ccuugacagggcacaccgggc

SEQ ID NO: 2932821 - RNA, 18 nt, Human
ccuucucuccagccccug

SEQ ID NO: 2932822 - RNA, 17 nt, Human
ccuucucuccagccccu

SEQ ID NO: 2932823 - RNA, 22 nt, Human
ccuuggcucaaguccucuuuuc

SEQ ID NO: 2932824 - RNA, 15 nt, Human
ccuuggacucauuuu

SEQ ID NO: 2932825 - RNA, 15 nt, Human
ccuuggauugucccc

SEQ ID NO: 2932826 - RNA, 19 nt, Human
ccuucucuccagccccugg

SEQ ID NO: 2932827 - RNA, 23 nt, Human
cgaaagggacuuggaagcuccgc

SEQ ID NO: 2932828 - RNA, 22 nt, Human
ccuuuuuuggcugcugaaggcu

SEQ ID NO: 2932829 - RNA, 20 nt, Human
ccuuuuuuggcugcugaagg

SEQ ID NO: 2932830 - RNA, 18 nt, Human
ccuuuuuuggcugcugaa

SEQ ID NO: 2932831 - RNA, 17 nt, Human
ccuuuuuuggcugcuga

SEQ ID NO: 2932832 - RNA, 21 nt, Human
cgaacauguuuuucuucuccc

SEQ ID NO: 2932833 - RNA, 23 nt, Human
cgaacauguuuuucuucucccuc

SEQ ID NO: 2932834 - RNA, 17 nt, Human
cgaauauugcugauggu

SEQ ID NO: 2932835 - RNA, 15 nt, Human
cgaauauugcugaug

SEQ ID NO: 2932836 - RNA, 15 nt, Human
cgaauagcugggacu

SEQ ID NO: 2932837 - RNA, 16 nt, Human
cgaauagcugggacua

SEQ ID NO: 2932838 - RNA, 11 nt, Human
cgaauauugcu

SEQ ID NO: 2932839 - RNA, 14 nt, Human
cgaauauugcugau

SEQ ID NO: 2932840 - RNA, 12 nt, Human
cgaauauugcug

SEQ ID NO: 2932841 - RNA, 19 nt, Human
ccuuuuuuauacauaaaca

SEQ ID NO: 2932842 - RNA, 15 nt, Human
ccuuuuuuggcugcu

SEQ ID NO: 2932843 - RNA, 14 nt, Human
ccuuugugaggaag

SEQ ID NO: 2932844 - RNA, 23 nt, Human
ccuuuguccccaccgcagacagg

SEQ ID NO: 2932845 - RNA, 22 nt, Human
ccuuuguccccaccgcagacag

SEQ ID NO: 2932846 - RNA, 23 nt, Human
ccuuugugaggaagccgcugggg

SEQ ID NO: 2932847 - RNA, 17 nt, Human
ccuuugugaggaagccg

SEQ ID NO: 2932848 - RNA, 16 nt, Human
ccuuugugaggaagcc

SEQ ID NO: 2932849 - RNA, 15 nt, Human
ccuuugugaggaagc

SEQ ID NO: 2932850 - RNA, 24 nt, Human
ccuuuguauucucuccuguaccuc

SEQ ID NO: 2932851 - RNA, 22 nt, Human
ccuuuguauucucuccuguacc

SEQ ID NO: 2932852 - RNA, 23 nt, Human
ccuuuguauucucuccuguaccu

SEQ ID NO: 2932853 - RNA, 14 nt, Human
ccuuuguccccacc

SEQ ID NO: 2932854 - RNA, 18 nt, Human
ccuuuguccccaccgcag

SEQ ID NO: 2932855 - RNA, 16 nt, Human
ccuuuguccccaccgc

SEQ ID NO: 2932856 - RNA, 23 nt, Human
ccuugucggccccaccagugccu

SEQ ID NO: 2932857 - RNA, 16 nt, Human
cgaggacagggaggug

SEQ ID NO: 2932858 - RNA, 18 nt, Human
cgagcccugguggcagug

SEQ ID NO: 2932859 - RNA, 14 nt, Human
cgaggacagggagg

SEQ ID NO: 2932860 - RNA, 19 nt, Human
cgagcccugguggcagugg

SEQ ID NO: 2932861 - RNA, 23 nt, Human
cgauggaggacuccaggcagcag

SEQ ID NO: 2932862 - RNA, 13 nt, Human
cgcacugggcuug

SEQ ID NO: 2932863 - RNA, 17 nt, Human
cgcacugggcuugggga

SEQ ID NO: 2932864 - RNA, 17 nt, Human
cgcagcccugcagaggg

SEQ ID NO: 2932865 - RNA, 15 nt, Human
cgcagcccugcagag

SEQ ID NO: 2932866 - RNA, 20 nt, Human
cgcagcauauucaggaagcu

SEQ ID NO: 2932867 - RNA, 19 nt, Human
cgcagcauauucaggaagc

SEQ ID NO: 2932868 - RNA, 13 nt, Human
cggcccuccagag

SEQ ID NO: 2932869 - RNA, 12 nt, Human
cggccaggccag

SEQ ID NO: 2932870 - RNA, 20 nt, Human
cggccaggccagagggagug

SEQ ID NO: 2932871 - RNA, 11 nt, Human
cggccaggcca

SEQ ID NO: 2932872 - RNA, 16 nt, Human
cggcccuccagagccc

SEQ ID NO: 2932873 - RNA, 20 nt, Human
cggcccuccagagccccaca

SEQ ID NO: 2932874 - RNA, 14 nt, Human
cggcuggcagccca

SEQ ID NO: 2932875 - RNA, 13 nt, Human
cggcuggccuggc

SEQ ID NO: 2932876 - RNA, 23 nt, Human
cggcuggcagcccaccccucaac

SEQ ID NO: 2932877 - RNA, 16 nt, Human
cgggaagggggcuggg

SEQ ID NO: 2932878 - RNA, 20 nt, Human
cgggaagggggcugggacau

SEQ ID NO: 2932879 - RNA, 19 nt, Human
cgggaagggggcugggaca

SEQ ID NO: 2932880 - RNA, 14 nt, Human
cgcuuucuacccag

SEQ ID NO: 2932881 - RNA, 16 nt, Human
cgcuuucuacccagcg

SEQ ID NO: 2932882 - RNA, 20 nt, Human
cggacagccacggccaggcc

SEQ ID NO: 2932883 - RNA, 14 nt, Human
cggaauaguuggcu

SEQ ID NO: 2932884 - RNA, 16 nt, Human
cggaauaguuggcuag

SEQ ID NO: 2932885 - RNA, 17 nt, Human
cggaauaguuggcuagg

SEQ ID NO: 2932886 - RNA, 15 nt, Human
cggagaaaggaaggg

SEQ ID NO: 2932887 - RNA, 17 nt, Human
cggagaaaggaagggcu

SEQ ID NO: 2932888 - RNA, 21 nt, Human
cggacagccacggccaggcca

SEQ ID NO: 2932889 - RNA, 22 nt, Human
cggacagccacggccaggccag

SEQ ID NO: 2932890 - RNA, 19 nt, Human
cgcugugcugcccugccca

SEQ ID NO: 2932891 - RNA, 23 nt, Human
cgcugugcugcccugcccaccug

SEQ ID NO: 2932892 - RNA, 21 nt, Human
cgcugugcugcccugcccacc

SEQ ID NO: 2932893 - RNA, 11 nt, Human
cgcugugcugc

SEQ ID NO: 2932894 - RNA, 14 nt, Human
cgcugugcugcccu

SEQ ID NO: 2932895 - RNA, 13 nt, Human
cgcugugcugccc

SEQ ID NO: 2932896 - RNA, 19 nt, Human
cgcagcccugcagagggca

SEQ ID NO: 2932897 - RNA, 18 nt, Human
cgcagcccugcagagggc

SEQ ID NO: 2932898 - RNA, 12 nt, Human
cgcccaaggccu

SEQ ID NO: 2932899 - RNA, 13 nt, Human
cgcccagucugga

SEQ ID NO: 2932900 - RNA, 19 nt, Human
cgcccagucuggaaugcag

SEQ ID NO: 2932901 - RNA, 21 nt, Human
cgcccagucuggaaugcagug

SEQ ID NO: 2932902 - RNA, 17 nt, Human
cgcccaaggccuucccc

SEQ ID NO: 2932903 - RNA, 12 nt, Human
cgcccagucugg

SEQ ID NO: 2932904 - RNA, 15 nt, Human
cgccuugcccagccu

SEQ ID NO: 2932905 - RNA, 16 nt, Human
cgccuugcccagccug

SEQ ID NO: 2932906 - RNA, 19 nt, Human
cgccuugcccagccuggau

SEQ ID NO: 2932907 - RNA, 14 nt, Human
cgcgacaaugcaaa

SEQ ID NO: 2932908 - RNA, 19 nt, Human
cgcgguggcucacgccugu

SEQ ID NO: 2932909 - RNA, 24 nt, Human
cgcuacccgggaagggggcuggga

SEQ ID NO: 2932910 - RNA, 21 nt, Human
cgcuacccgggaagggggcug

SEQ ID NO: 2932911 - RNA, 18 nt, Human
cgcuacccgggaaggggg

SEQ ID NO: 2932912 - RNA, 17 nt, Human
cgcuacccgggaagggg

SEQ ID NO: 2932913 - RNA, 17 nt, Human
ccugcuaauuccccaga

SEQ ID NO: 2932914 - RNA, 21 nt, Human
ccugcuaauuccccagauugc

SEQ ID NO: 2932915 - RNA, 20 nt, Human
ccugccuguugggccaggag

SEQ ID NO: 2932916 - RNA, 19 nt, Human
ccugccuguugggccagga

SEQ ID NO: 2932917 - RNA, 18 nt, Human
ccugccuguugggccagg

SEQ ID NO: 2932918 - RNA, 19 nt, Human
ccuggcacccggccccugc

SEQ ID NO: 2932919 - RNA, 20 nt, Human
ccuggcacccggccccugcu

SEQ ID NO: 2932920 - RNA, 21 nt, Human
ccuggcacccggccccugcug

SEQ ID NO: 2932921 - RNA, 18 nt, Human
ccuggcacccggccccug

SEQ ID NO: 2932922 - RNA, 22 nt, Human
ccuggcacuauaauguaagcuc

SEQ ID NO: 2932923 - RNA, 12 nt, Human
ccuggcacugcu

SEQ ID NO: 2932924 - RNA, 14 nt, Human
ccuggcccacugca

SEQ ID NO: 2932925 - RNA, 13 nt, Human
ccuggcccacugc

SEQ ID NO: 2932926 - RNA, 21 nt, Human
ccuggccagaugcaccagccc

SEQ ID NO: 2932927 - RNA, 23 nt, Human
ccuggccagaugcaccagcccuu

SEQ ID NO: 2932928 - RNA, 20 nt, Human
ccuggccagaugcaccagcc

SEQ ID NO: 2932929 - RNA, 23 nt, Human
ccuggcaugggaaugaaugucag

SEQ ID NO: 2932930 - RNA, 13 nt, Human
ccuggcaugggaa

SEQ ID NO: 2932931 - RNA, 16 nt, Human
ccuggcacugcuucca

SEQ ID NO: 2932932 - RNA, 13 nt, Human
ccuggcacugcuu

SEQ ID NO: 2932933 - RNA, 16 nt, Human
ccuggcccagggcauc

SEQ ID NO: 2932934 - RNA, 21 nt, Human
ccuggcccagggcaucuggga

SEQ ID NO: 2932935 - RNA, 13 nt, Human
ccuggcccagggc

SEQ ID NO: 2932936 - RNA, 14 nt, Human
ccuggcccagggca

SEQ ID NO: 2932937 - RNA, 15 nt, Human
ccuggcccagggcau

SEQ ID NO: 2932938 - RNA, 12 nt, Human
ccuggcccaggg

SEQ ID NO: 2932939 - RNA, 16 nt, Human
ccuggcccacugcauc

SEQ ID NO: 2932940 - RNA, 16 nt, Human
ccugggagugagcugg

SEQ ID NO: 2932941 - RNA, 22 nt, Human
ccugggaggucaaggcugcagu

SEQ ID NO: 2932942 - RNA, 16 nt, Human
ccugggcagaaggaag

SEQ ID NO: 2932943 - RNA, 18 nt, Human
ccugggagugagcugguu

SEQ ID NO: 2932944 - RNA, 15 nt, Human
ccugggcagaaggaa

SEQ ID NO: 2932945 - RNA, 18 nt, Human
ccugggggcugggcagag

SEQ ID NO: 2932946 - RNA, 13 nt, Human
ccugggcagcugc

SEQ ID NO: 2932947 - RNA, 14 nt, Human
ccugggcagcugcc

SEQ ID NO: 2932948 - RNA, 19 nt, Human
ccugggggcugggcagagg

SEQ ID NO: 2932949 - RNA, 21 nt, Human
ccugggggcugggcagaggaa

SEQ ID NO: 2932950 - RNA, 20 nt, Human
ccugggggcugggcagagga

SEQ ID NO: 2932951 - RNA, 10 nt, Human
ccuguaccuc

SEQ ID NO: 2932952 - RNA, 13 nt, Human
ccugguggcagug

SEQ ID NO: 2932953 - RNA, 14 nt, Human
ccugguggcagugg

SEQ ID NO: 2932954 - RNA, 16 nt, Human
ccuguagagugggagc

SEQ ID NO: 2932955 - RNA, 15 nt, Human
ccuguagagugggag

SEQ ID NO: 2932956 - RNA, 13 nt, Human
ccuguagcccuaa

SEQ ID NO: 2932957 - RNA, 12 nt, Human
ccugucccccug

SEQ ID NO: 2932958 - RNA, 15 nt, Human
ccugucccccugaca

SEQ ID NO: 2932959 - RNA, 14 nt, Human
ccugucccccugac

SEQ ID NO: 2932960 - RNA, 13 nt, Human
ccugucccccuga

SEQ ID NO: 2932961 - RNA, 14 nt, Human
ccugguggcagcug

SEQ ID NO: 2932962 - RNA, 22 nt, Human
ccugguggcagcucaccucucc

SEQ ID NO: 2932963 - RNA, 21 nt, Human
ccugguggcagcucaccucuc

SEQ ID NO: 2932964 - RNA, 19 nt, Human
ccugguggcagcucaccuc

SEQ ID NO: 2932965 - RNA, 15 nt, Human
ccugguggcagcugc

SEQ ID NO: 2932966 - RNA, 16 nt, Human
ccugguggcagcugcg

SEQ ID NO: 2932967 - RNA, 17 nt, Human
ccugguggcagcugcgg

SEQ ID NO: 2932968 - RNA, 18 nt, Human
ccugguggcagcugcggu

SEQ ID NO: 2932969 - RNA, 22 nt, Human
ccugaagucuuuguacagacaa

SEQ ID NO: 2932970 - RNA, 20 nt, Human
ccugaagucacacagugagu

SEQ ID NO: 2932971 - RNA, 19 nt, Human
ccugaagucacacagugag

SEQ ID NO: 2932972 - RNA, 18 nt, Human
ccugagccagauuucacu

SEQ ID NO: 2932973 - RNA, 16 nt, Human
ccugagccagauuuca

SEQ ID NO: 2932974 - RNA, 12 nt, Human
ccugagccagau

SEQ ID NO: 2932975 - RNA, 15 nt, Human
ccugagccagauuuc

SEQ ID NO: 2932976 - RNA, 15 nt, Human
ccugaggcugggcuc

SEQ ID NO: 2932977 - RNA, 14 nt, Human
ccugaggcugggcu

SEQ ID NO: 2932978 - RNA, 13 nt, Human
ccugaggcugggc

SEQ ID NO: 2932979 - RNA, 13 nt, Human
ccugaggcuccac

SEQ ID NO: 2932980 - RNA, 14 nt, Human
ccugaggcuccacu

SEQ ID NO: 2932981 - RNA, 12 nt, Human
ccugagcuggga

SEQ ID NO: 2932982 - RNA, 18 nt, Human
ccugaggcccagagggcc

SEQ ID NO: 2932983 - RNA, 17 nt, Human
ccugaggcccagagggc

SEQ ID NO: 2932984 - RNA, 16 nt, Human
ccugaggcccagaggg

SEQ ID NO: 2932985 - RNA, 15 nt, Human
ccugaggcccagagg

SEQ ID NO: 2932986 - RNA, 23 nt, Human
ccugcacagcaggcugccagugc

SEQ ID NO: 2932987 - RNA, 14 nt, Human
ccugcacagcaggc

SEQ ID NO: 2932988 - RNA, 17 nt, Human
ccugcacagcaggcugc

SEQ ID NO: 2932989 - RNA, 19 nt, Human
ccugcacagcaggcugcca

SEQ ID NO: 2932990 - RNA, 20 nt, Human
ccugcacagcaggcugccag

SEQ ID NO: 2932991 - RNA, 21 nt, Human
ccugcacagcaggcugccagu

SEQ ID NO: 2932992 - RNA, 19 nt, Human
ccugccaauggacuaacuu

SEQ ID NO: 2932993 - RNA, 16 nt, Human
ccugccacccugggga

SEQ ID NO: 2932994 - RNA, 22 nt, Human
ccugccacccuggggagaaagu

SEQ ID NO: 2932995 - RNA, 14 nt, Human
ccugccacccuggg

SEQ ID NO: 2932996 - RNA, 12 nt, Human
ccugccacccug

SEQ ID NO: 2932997 - RNA, 13 nt, Human
ccugccacccugg

SEQ ID NO: 2932998 - RNA, 14 nt, Human
ccugaaagcccuga

SEQ ID NO: 2932999 - RNA, 13 nt, Human
ccugaaagcccug

SEQ ID NO: 2933000 - RNA, 18 nt, Human
ccugaaagcccugagcuu

SEQ ID NO: 2933001 - RNA, 21 nt, Human
ccugaagacucauucuucugu

SEQ ID NO: 2933002 - RNA, 14 nt, Human
ccugaaggccccgc

SEQ ID NO: 2933003 - RNA, 19 nt, Human
ccugaaggccccgcccagg

SEQ ID NO: 2933004 - RNA, 18 nt, Human
ccugaaggccccgcccag

SEQ ID NO: 2933005 - RNA, 21 nt, Human
ccugaaggccccgcccaggcu

SEQ ID NO: 2933006 - RNA, 20 nt, Human
ccugaaggccccgcccaggc

SEQ ID NO: 2933007 - RNA, 22 nt, Human
ccugaaggccccgcccaggcuu

SEQ ID NO: 2933008 - RNA, 15 nt, Human
ccugagcugggauga

SEQ ID NO: 2933009 - RNA, 11 nt, Human
ccugcccugug

SEQ ID NO: 2933010 - RNA, 14 nt, Human
ccugcccugugggc

SEQ ID NO: 2933011 - RNA, 12 nt, Human
ccugcccugugg

SEQ ID NO: 2933012 - RNA, 13 nt, Human
ccugccucagccu

SEQ ID NO: 2933013 - RNA, 14 nt, Human
ccugccucagccuc

SEQ ID NO: 2933014 - RNA, 12 nt, Human
ccugccucagcc

SEQ ID NO: 2933015 - RNA, 11 nt, Human
ccugccucagc

SEQ ID NO: 2933016 - RNA, 14 nt, Human
ccugccuguugggc

SEQ ID NO: 2933017 - RNA, 22 nt, Human
ccugcccuuaccugccaggaag

SEQ ID NO: 2933018 - RNA, 21 nt, Human
ccugcccuuaccugccaggaa

SEQ ID NO: 2933019 - RNA, 19 nt, Human
ccugcccuuaccugccagg

SEQ ID NO: 2933020 - RNA, 15 nt, Human
ccugcccugugggcc

SEQ ID NO: 2933021 - RNA, 22 nt, Human
ccugccagggacagagggggug

SEQ ID NO: 2933022 - RNA, 12 nt, Human
ccugccaggcau

SEQ ID NO: 2933023 - RNA, 14 nt, Human
ccugcccggcugcg

SEQ ID NO: 2933024 - RNA, 16 nt, Human
ccugcccggcugcgga

SEQ ID NO: 2933025 - RNA, 17 nt, Human
ccugccccugagcccau

SEQ ID NO: 2933026 - RNA, 22 nt, Human
ccugccuguugggccaggagcc

SEQ ID NO: 2933027 - RNA, 17 nt, Human
gaaagcccugagcuuuc

SEQ ID NO: 2933028 - RNA, 22 nt, Human
gaaagcccugagcuuucugcua

SEQ ID NO: 2933029 - RNA, 21 nt, Human
gaaagcccugagcuuucugcu

SEQ ID NO: 2933030 - RNA, 14 nt, Human
gaaagcagggacuu

SEQ ID NO: 2933031 - RNA, 22 nt, Human
gaaagcagaacagugauuacca

SEQ ID NO: 2933032 - RNA, 14 nt, Human
gaaagcagaacagu

SEQ ID NO: 2933033 - RNA, 17 nt, Human
gaaagcagaacagugau

SEQ ID NO: 2933034 - RNA, 16 nt, Human
gaaagaguaggaagac

SEQ ID NO: 2933035 - RNA, 15 nt, Human
gaaagaguaggaaga

SEQ ID NO: 2933036 - RNA, 21 nt, Human
gaaagaggaaugaaguacuca

SEQ ID NO: 2933037 - RNA, 20 nt, Human
gaaagaggcagcuugaaacu

SEQ ID NO: 2933038 - RNA, 22 nt, Human
gaaagacuucucuacccaucuu

SEQ ID NO: 2933039 - RNA, 17 nt, Human
gaaagacuguacaaagu

SEQ ID NO: 2933040 - RNA, 17 nt, Human
gaaagagaacuuccaga

SEQ ID NO: 2933041 - RNA, 19 nt, Human
gaaagacuuuuccaacccu

SEQ ID NO: 2933042 - RNA, 22 nt, Human
gaaacccgucucuacuaaaaau

SEQ ID NO: 2933043 - RNA, 23 nt, Human
gaaacccagcucugguccauaga

SEQ ID NO: 2933044 - RNA, 14 nt, Human
gaaacccugucucu

SEQ ID NO: 2933045 - RNA, 23 nt, Human
gaaacucguuaauuuguaguguu

SEQ ID NO: 2933046 - RNA, 14 nt, Human
gaaacccagcucug

SEQ ID NO: 2933047 - RNA, 13 nt, Human
gaaacccagcucu

SEQ ID NO: 2933048 - RNA, 19 nt, Human
gaaacccagcucuggucca

SEQ ID NO: 2933049 - RNA, 18 nt, Human
gaaacccagcucuggucc

SEQ ID NO: 2933050 - RNA, 16 nt, Human
gaaacccagcucuggu

SEQ ID NO: 2933051 - RNA, 15 nt, Human
gaaacccagcucugg

SEQ ID NO: 2933052 - RNA, 21 nt, Human
gaaacaagucagucauucaga

SEQ ID NO: 2933053 - RNA, 11 nt, Human
gaaacauuugg

SEQ ID NO: 2933054 - RNA, 16 nt, Human
gaaacacaacuauauu

SEQ ID NO: 2933055 - RNA, 16 nt, Human
cuuuuuuggcugcuga

SEQ ID NO: 2933056 - RNA, 15 nt, Human
gaaaaaggaggaaga

SEQ ID NO: 2933057 - RNA, 12 nt, Human
gaaaaaggagga

SEQ ID NO: 2933058 - RNA, 14 nt, Human
gaaaacacauuuuu

SEQ ID NO: 2933059 - RNA, 18 nt, Human
gaaaacacauuuuucuua

SEQ ID NO: 2933060 - RNA, 19 nt, Human
gaaaacacauuuuucuuag

SEQ ID NO: 2933061 - RNA, 17 nt, Human
cuuuuuuggcugcugaa

SEQ ID NO: 2933062 - RNA, 22 nt, Human
cuuuuuuggcugcugaaggcuc

SEQ ID NO: 2933063 - RNA, 20 nt, Human
cuuuuuuggcugcugaaggc

SEQ ID NO: 2933064 - RNA, 21 nt, Human
cuuuuuggguuuauuuggaaa

SEQ ID NO: 2933065 - RNA, 11 nt, Human
cuuuuguucuu

SEQ ID NO: 2933066 - RNA, 12 nt, Human
cuuuuguucuug

SEQ ID NO: 2933067 - RNA, 18 nt, Human
cuuuguuaguuucuccaa

SEQ ID NO: 2933068 - RNA, 24 nt, Human
gaaaacacuguucucugcccucca

SEQ ID NO: 2933069 - RNA, 22 nt, Human
gaaaacacuguucucugcccuc

SEQ ID NO: 2933070 - RNA, 19 nt, Human
gaaaagcugcugacagugu

SEQ ID NO: 2933071 - RNA, 19 nt, Human
gaaaacguggcugcuucaa

SEQ ID NO: 2933072 - RNA, 22 nt, Human
gaaaacguggcugcuucaagga

SEQ ID NO: 2933073 - RNA, 20 nt, Human
gaaaacguggcugcuucaag

SEQ ID NO: 2933074 - RNA, 17 nt, Human
gaaaaggccuucuuccc

SEQ ID NO: 2933075 - RNA, 14 nt, Human
gaaaaguugaauuu

SEQ ID NO: 2933076 - RNA, 15 nt, Human
gaaaaguugaauuuu

SEQ ID NO: 2933077 - RNA, 13 nt, Human
gaaaaguuuauaa

SEQ ID NO: 2933078 - RNA, 14 nt, Human
gaaaaguuuauaaa

SEQ ID NO: 2933079 - RNA, 18 nt, Human
gaaaauauuuguaucaca

SEQ ID NO: 2933080 - RNA, 18 nt, Human
gaaaaucuuauaauuuaa

SEQ ID NO: 2933081 - RNA, 22 nt, Human
gaaaaucuacacuccagugaga

SEQ ID NO: 2933082 - RNA, 22 nt, Human
gaaaaucagccugcuccagcug

SEQ ID NO: 2933083 - RNA, 20 nt, Human
gaaaaucagccugcuccagc

SEQ ID NO: 2933084 - RNA, 23 nt, Human
cuugugguuauaacuuaaugaaa

SEQ ID NO: 2933085 - RNA, 23 nt, Human
cuugucaauaaaauccauacauu

SEQ ID NO: 2933086 - RNA, 17 nt, Human
cuuguaaauagcucagg

SEQ ID NO: 2933087 - RNA, 18 nt, Human
cuuguaaauagcucaggu

SEQ ID NO: 2933088 - RNA, 15 nt, Human
cuuguacauaaugcg

SEQ ID NO: 2933089 - RNA, 12 nt, Human
cuuguacauaau

SEQ ID NO: 2933090 - RNA, 22 nt, Human
cuuguacauaaugcgugcauac

SEQ ID NO: 2933091 - RNA, 19 nt, Human
cuuguacauaaugcgugca

SEQ ID NO: 2933092 - RNA, 21 nt, Human
cuuguacauaaugcgugcaua

SEQ ID NO: 2933093 - RNA, 16 nt, Human
cuuguaaauagcucag

SEQ ID NO: 2933094 - RNA, 22 nt, Human
cuuggggggcugaggugggagg

SEQ ID NO: 2933095 - RNA, 19 nt, Human
cuugaguuuaaauuguaau

SEQ ID NO: 2933096 - RNA, 23 nt, Human
cuuggggggcugaggugggagga

SEQ ID NO: 2933097 - RNA, 15 nt, Human
cuuuaaaagcauuuu

SEQ ID NO: 2933098 - RNA, 22 nt, Human
cuuuaaaagcauuuuuuaaccu

SEQ ID NO: 2933099 - RNA, 13 nt, Human
cuuuacuauggcc

SEQ ID NO: 2933100 - RNA, 22 nt, Human
cuuuaccuuuuuuauacauaaa

SEQ ID NO: 2933101 - RNA, 14 nt, Human
cuuuagcgcccagu

SEQ ID NO: 2933102 - RNA, 15 nt, Human
cuuuagcgcccaguu

SEQ ID NO: 2933103 - RNA, 13 nt, Human
cuuuauaauucua

SEQ ID NO: 2933104 - RNA, 19 nt, Human
cuuuauaauucuacuuuga

SEQ ID NO: 2933105 - RNA, 15 nt, Human
cuuuaugcacaaaau

SEQ ID NO: 2933106 - RNA, 14 nt, Human
cuuugaccucugca

SEQ ID NO: 2933107 - RNA, 15 nt, Human
cuuugaccucugcag

SEQ ID NO: 2933108 - RNA, 17 nt, Human
cuuugaccucugcagca

SEQ ID NO: 2933109 - RNA, 18 nt, Human
cuuugaccucugcagcaa

SEQ ID NO: 2933110 - RNA, 20 nt, Human
cuuugaccucugcagcaaua

SEQ ID NO: 2933111 - RNA, 24 nt, Human
cuuugaccucugcagcaauaaagc

SEQ ID NO: 2933112 - RNA, 16 nt, Human
cuuugcagacaggcaa

SEQ ID NO: 2933113 - RNA, 13 nt, Human
cuuugaccucugc

SEQ ID NO: 2933114 - RNA, 14 nt, Human
cuuugcaggaaauc

SEQ ID NO: 2933115 - RNA, 20 nt, Human
cuuugcagacaggcaagcac

SEQ ID NO: 2933116 - RNA, 14 nt, Human
cuuuguccccaccg

SEQ ID NO: 2933117 - RNA, 13 nt, Human
cuuuggcccaggg

SEQ ID NO: 2933118 - RNA, 16 nt, Human
cuuuggcccagggugg

SEQ ID NO: 2933119 - RNA, 14 nt, Human
cuuuggcccagggu

SEQ ID NO: 2933120 - RNA, 15 nt, Human
cuuuggcccagggug

SEQ ID NO: 2933121 - RNA, 19 nt, Human
cuuuggcuauuagagauca

SEQ ID NO: 2933122 - RNA, 15 nt, Human
cuuuguccccaccgc

SEQ ID NO: 2933123 - RNA, 15 nt, Human
cuuugugaggaagcc

SEQ ID NO: 2933124 - RNA, 15 nt, Human
cuuuccaggaaggcu

SEQ ID NO: 2933125 - RNA, 15 nt, Human
cuuuccaucuacccu

SEQ ID NO: 2933126 - RNA, 16 nt, Human
cuuuccucuuuggucu

SEQ ID NO: 2933127 - RNA, 12 nt, Human
cuuuccugaggc

SEQ ID NO: 2933128 - RNA, 11 nt, Human
cuuucccuccc

SEQ ID NO: 2933129 - RNA, 13 nt, Human
cuuucccucccuu

SEQ ID NO: 2933130 - RNA, 14 nt, Human
cuuucccucccuuc

SEQ ID NO: 2933131 - RNA, 16 nt, Human
cuuucccucccuuccu

SEQ ID NO: 2933132 - RNA, 17 nt, Human
cuuucuggcuaugcauu

SEQ ID NO: 2933133 - RNA, 18 nt, Human
cuuucuggcuaugcauuu

SEQ ID NO: 2933134 - RNA, 19 nt, Human
cuuucuggcuaugcauuug

SEQ ID NO: 2933135 - RNA, 20 nt, Human
cuuucuggcuaugcauuuga

SEQ ID NO: 2933136 - RNA, 15 nt, Human
cuuuccugaggcugg

SEQ ID NO: 2933137 - RNA, 13 nt, Human
cuuuccugaggcu

SEQ ID NO: 2933138 - RNA, 23 nt, Human
cuucacagaugggugcuuggagg

SEQ ID NO: 2933139 - RNA, 10 nt, Human
cuucaaggau

SEQ ID NO: 2933140 - RNA, 16 nt, Human
cuucaaggauccugag

SEQ ID NO: 2933141 - RNA, 15 nt, Human
cuucaaggauccuga

SEQ ID NO: 2933142 - RNA, 13 nt, Human
cuucaaggauccu

SEQ ID NO: 2933143 - RNA, 15 nt, Human
cuuauuucauuucuu

SEQ ID NO: 2933144 - RNA, 15 nt, Human
cuuauuuccucauuu

SEQ ID NO: 2933145 - RNA, 17 nt, Human
cuuauuuaaugaaagac

SEQ ID NO: 2933146 - RNA, 18 nt, Human
cuuauuuaaugaaagacu

SEQ ID NO: 2933147 - RNA, 14 nt, Human
cuuauuucauuucu

SEQ ID NO: 2933148 - RNA, 16 nt, Human
cuuagucacugagaca

SEQ ID NO: 2933149 - RNA, 22 nt, Human
cuuagaugcaguucugaagaag

SEQ ID NO: 2933150 - RNA, 13 nt, Human
cuuagauguauau

SEQ ID NO: 2933151 - RNA, 16 nt, Human
cuguucuggcagaguu

SEQ ID NO: 2933152 - RNA, 20 nt, Human
cuuagaugcaguucugaaga

SEQ ID NO: 2933153 - RNA, 14 nt, Human
cuuagucacugaga

SEQ ID NO: 2933154 - RNA, 19 nt, Human
cuuagucacugagacagcc

SEQ ID NO: 2933155 - RNA, 18 nt, Human
cuuagucacugagacagc

SEQ ID NO: 2933156 - RNA, 15 nt, Human
cuuagugauguaauu

SEQ ID NO: 2933157 - RNA, 16 nt, Human
cuuagugauguaauua

SEQ ID NO: 2933158 - RNA, 19 nt, Human
cuuauaucuauauuuuaca

SEQ ID NO: 2933159 - RNA, 15 nt, Human
cuuauacauuugaua

SEQ ID NO: 2933160 - RNA, 17 nt, Human
cuucccuacaguugaaa

SEQ ID NO: 2933161 - RNA, 17 nt, Human
cuuccccuggcacuggc

SEQ ID NO: 2933162 - RNA, 21 nt, Human
cuuccaggggugggacacccu

SEQ ID NO: 2933163 - RNA, 17 nt, Human
cuuccaggggugggaca

SEQ ID NO: 2933164 - RNA, 15 nt, Human
cuuccagggguggga

SEQ ID NO: 2933165 - RNA, 14 nt, Human
cuuccagggguggg

SEQ ID NO: 2933166 - RNA, 19 nt, Human
cuuccaggcugggagagcc

SEQ ID NO: 2933167 - RNA, 16 nt, Human
cuuccaggcugggaga

SEQ ID NO: 2933168 - RNA, 15 nt, Human
cuuccaggcugggag

SEQ ID NO: 2933169 - RNA, 14 nt, Human
cuuccaggcuggga

SEQ ID NO: 2933170 - RNA, 12 nt, Human
cuuccaggcugg

SEQ ID NO: 2933171 - RNA, 16 nt, Human
cuuccacaagagccca

SEQ ID NO: 2933172 - RNA, 17 nt, Human
cuuccacaagagcccag

SEQ ID NO: 2933173 - RNA, 21 nt, Human
cuuccacaagagcccaggccu

SEQ ID NO: 2933174 - RNA, 19 nt, Human
cuuccacaagagcccaggc

SEQ ID NO: 2933175 - RNA, 17 nt, Human
cuucaguggcagcugcu

SEQ ID NO: 2933176 - RNA, 20 nt, Human
cuucauucaacccaccugcg

SEQ ID NO: 2933177 - RNA, 15 nt, Human
cuucaguaagccgug

SEQ ID NO: 2933178 - RNA, 22 nt, Human
cuucagugccuuauggaacacu

SEQ ID NO: 2933179 - RNA, 18 nt, Human
cuucagugccuuauggaa

SEQ ID NO: 2933180 - RNA, 13 nt, Human
cuucaguggcagc

SEQ ID NO: 2933181 - RNA, 14 nt, Human
cuucaguggcagcu

SEQ ID NO: 2933182 - RNA, 15 nt, Human
cuucaguggcagcug

SEQ ID NO: 2933183 - RNA, 16 nt, Human
cuucaguggcagcugc

SEQ ID NO: 2933184 - RNA, 23 nt, Human
cuucaguaagccgugauuuucau

SEQ ID NO: 2933185 - RNA, 16 nt, Human
cuucaguaagccguga

SEQ ID NO: 2933186 - RNA, 17 nt, Human
cuugaacuuugaccucu

SEQ ID NO: 2933187 - RNA, 21 nt, Human
cuugaacuuugaccucugcag

SEQ ID NO: 2933188 - RNA, 13 nt, Human
cuugaacuccugg

SEQ ID NO: 2933189 - RNA, 13 nt, Human
cuugaccucaggu

SEQ ID NO: 2933190 - RNA, 21 nt, Human
cuugaccgugaggccagagac

SEQ ID NO: 2933191 - RNA, 20 nt, Human
cuugaccgugaggccagaga

SEQ ID NO: 2933192 - RNA, 18 nt, Human
cuugaccgugaggccaga

SEQ ID NO: 2933193 - RNA, 23 nt, Human
cuugaccauucuccaccugccag

SEQ ID NO: 2933194 - RNA, 22 nt, Human
cuugaccauucuccaccugcca

SEQ ID NO: 2933195 - RNA, 17 nt, Human
cuugaccgugaggccag

SEQ ID NO: 2933196 - RNA, 16 nt, Human
cuugagccugggaggu

SEQ ID NO: 2933197 - RNA, 15 nt, Human
cuugagccuugaacu

SEQ ID NO: 2933198 - RNA, 17 nt, Human
cuugagccuugaacuuu

SEQ ID NO: 2933199 - RNA, 18 nt, Human
cuugagccuugaacuuug

SEQ ID NO: 2933200 - RNA, 13 nt, Human
cuugagcucagga

SEQ ID NO: 2933201 - RNA, 21 nt, Human
cuugaggguugggcugguguc

SEQ ID NO: 2933202 - RNA, 21 nt, Human
cuugaguugauucagcucugc

SEQ ID NO: 2933203 - RNA, 19 nt, Human
cuugaggguugggcuggug

SEQ ID NO: 2933204 - RNA, 20 nt, Human
cuugaggguugggcuggugu

SEQ ID NO: 2933205 - RNA, 23 nt, Human
cuugaaaacacuguucucugccc

SEQ ID NO: 2933206 - RNA, 14 nt, Human
cuugaaaacacugu

SEQ ID NO: 2933207 - RNA, 13 nt, Human
cuucuguggguuu

SEQ ID NO: 2933208 - RNA, 21 nt, Human
cuucuguggguuucuaaagcu

SEQ ID NO: 2933209 - RNA, 14 nt, Human
cuucuguggguuuc

SEQ ID NO: 2933210 - RNA, 12 nt, Human
cuucuccaggcu

SEQ ID NO: 2933211 - RNA, 13 nt, Human
cuucuccaggcug

SEQ ID NO: 2933212 - RNA, 20 nt, Human
cuucuccacuuucuagccag

SEQ ID NO: 2933213 - RNA, 11 nt, Human
cuucuccacuu

SEQ ID NO: 2933214 - RNA, 12 nt, Human
cuucucuccagc

SEQ ID NO: 2933215 - RNA, 19 nt, Human
cuucuccuucaccuuuguc

SEQ ID NO: 2933216 - RNA, 19 nt, Human
cuucucuccagccccugga

SEQ ID NO: 2933217 - RNA, 17 nt, Human
cuucucuccagccccug

SEQ ID NO: 2933218 - RNA, 15 nt, Human
cuucucuccagcccc

SEQ ID NO: 2933219 - RNA, 13 nt, Human
cuucucuccagcc

SEQ ID NO: 2933220 - RNA, 13 nt, Human
cuucucugaagga

SEQ ID NO: 2933221 - RNA, 20 nt, Human
cuucugccauuucugagauc

SEQ ID NO: 2933222 - RNA, 13 nt, Human
cuucugcuucagc

SEQ ID NO: 2933223 - RNA, 21 nt, Human
cuucuguacgucugacaggca

SEQ ID NO: 2933224 - RNA, 14 nt, Human
cuucuguacgucug

SEQ ID NO: 2933225 - RNA, 15 nt, Human
cuucuguacgucuga

SEQ ID NO: 2933226 - RNA, 18 nt, Human
cuucuguacgucugacag

SEQ ID NO: 2933227 - RNA, 20 nt, Human
cuucuguacgucugacaggc

SEQ ID NO: 2933228 - RNA, 16 nt, Human
cuucuguccuacucug

SEQ ID NO: 2933229 - RNA, 17 nt, Human
cuucuguccuacucugu

SEQ ID NO: 2933230 - RNA, 18 nt, Human
cuucuguccuacucugug

SEQ ID NO: 2933231 - RNA, 19 nt, Human
cuucuguccuacucugugu

SEQ ID NO: 2933232 - RNA, 21 nt, Human
cuucuguccuacucuguguca

SEQ ID NO: 2933233 - RNA, 18 nt, Human
cuucugucuucacaacag

SEQ ID NO: 2933234 - RNA, 22 nt, Human
cuucugucuucacaacagauua

SEQ ID NO: 2933235 - RNA, 21 nt, Human
cuucugucuucacaacagauu

SEQ ID NO: 2933236 - RNA, 14 nt, Human
cuggccagaugcac

SEQ ID NO: 2933237 - RNA, 15 nt, Human
cuggcccacugcauc

SEQ ID NO: 2933238 - RNA, 22 nt, Human
cuggcacugguuuguucccugu

SEQ ID NO: 2933239 - RNA, 22 nt, Human
cuggcacuggcaaacagggccu

SEQ ID NO: 2933240 - RNA, 18 nt, Human
cuggcacugcuuccagug

SEQ ID NO: 2933241 - RNA, 23 nt, Human
cuggcacugcuuccagugaggcu

SEQ ID NO: 2933242 - RNA, 20 nt, Human
cuggcacugcuuccagugag

SEQ ID NO: 2933243 - RNA, 19 nt, Human
cuggcacugcuuccaguga

SEQ ID NO: 2933244 - RNA, 20 nt, Human
cuggcacccggccccugcug

SEQ ID NO: 2933245 - RNA, 21 nt, Human
cuggcacccggccccugcugg

SEQ ID NO: 2933246 - RNA, 19 nt, Human
cuggcacccggccccugcu

SEQ ID NO: 2933247 - RNA, 20 nt, Human
cuggagugcagugagccgag

SEQ ID NO: 2933248 - RNA, 20 nt, Human
cuggcacaguuuucugagaa

SEQ ID NO: 2933249 - RNA, 22 nt, Human
cuggcacaguuuucugagaaag

SEQ ID NO: 2933250 - RNA, 21 nt, Human
cuggcacaguuuucugagaaa

SEQ ID NO: 2933251 - RNA, 24 nt, Human
cuggcucuuccaggcugggagagc

SEQ ID NO: 2933252 - RNA, 16 nt, Human
cuggcuaacacgguga

SEQ ID NO: 2933253 - RNA, 22 nt, Human
cuggcgugaacccaggaggcgg

SEQ ID NO: 2933254 - RNA, 22 nt, Human
cuggcucuuccaggcugggaga

SEQ ID NO: 2933255 - RNA, 21 nt, Human
cuggcucuuccaggcugggag

SEQ ID NO: 2933256 - RNA, 14 nt, Human
cuggcgugcagugg

SEQ ID NO: 2933257 - RNA, 15 nt, Human
cuggcgugcaguggu

SEQ ID NO: 2933258 - RNA, 23 nt, Human
cuggccuucggccuccauccuga

SEQ ID NO: 2933259 - RNA, 16 nt, Human
cuggccucugcacucc

SEQ ID NO: 2933260 - RNA, 21 nt, Human
cuggccucugcacuccccugc

SEQ ID NO: 2933261 - RNA, 20 nt, Human
cuggccucugcacuccccug

SEQ ID NO: 2933262 - RNA, 18 nt, Human
cuggccucugcacucccc

SEQ ID NO: 2933263 - RNA, 19 nt, Human
cuggccuggccccucaggg

SEQ ID NO: 2933264 - RNA, 24 nt, Human
cuggccuggccccucagggucccu

SEQ ID NO: 2933265 - RNA, 22 nt, Human
cuggccuucggccuccauccug

SEQ ID NO: 2933266 - RNA, 16 nt, Human
cuggaccuugaacugg

SEQ ID NO: 2933267 - RNA, 15 nt, Human
cuggacccuguggau

SEQ ID NO: 2933268 - RNA, 21 nt, Human
cuggaccuugaacuggguacu

SEQ ID NO: 2933269 - RNA, 17 nt, Human
cuggaccuugaacuggg

SEQ ID NO: 2933270 - RNA, 20 nt, Human
cuggaccuugaacuggguac

SEQ ID NO: 2933271 - RNA, 23 nt, Human
cuggacaggcauguucucugagg

SEQ ID NO: 2933272 - RNA, 14 nt, Human
cuggacaggcaugu

SEQ ID NO: 2933273 - RNA, 17 nt, Human
cuggacaggcauguucu

SEQ ID NO: 2933274 - RNA, 22 nt, Human
cuggagguacgaaaagagggga

SEQ ID NO: 2933275 - RNA, 17 nt, Human
cuggagguacgaaaaga

SEQ ID NO: 2933276 - RNA, 14 nt, Human
cuggagugcaguga

SEQ ID NO: 2933277 - RNA, 15 nt, Human
cuggagugcagugag

SEQ ID NO: 2933278 - RNA, 16 nt, Human
cuggagugcagugagc

SEQ ID NO: 2933279 - RNA, 17 nt, Human
cuggagugcagugagcc

SEQ ID NO: 2933280 - RNA, 12 nt, Human
cuggagcucugc

SEQ ID NO: 2933281 - RNA, 13 nt, Human
cuggagcucugcc

SEQ ID NO: 2933282 - RNA, 16 nt, Human
cuggagcucugcccau

SEQ ID NO: 2933283 - RNA, 15 nt, Human
cugcugcuccuagga

SEQ ID NO: 2933284 - RNA, 18 nt, Human
cugcugcuccuaggaccc

SEQ ID NO: 2933285 - RNA, 15 nt, Human
cugcugcuggcuggu

SEQ ID NO: 2933286 - RNA, 14 nt, Human
cugcugcuggcugg

SEQ ID NO: 2933287 - RNA, 15 nt, Human
cugcuuccagugagg

SEQ ID NO: 2933288 - RNA, 18 nt, Human
cugcuuccagugaggcuc

SEQ ID NO: 2933289 - RNA, 16 nt, Human
cugcuuccagugaggc

SEQ ID NO: 2933290 - RNA, 23 nt, Human
cugcuuccagugaggcucugccc

SEQ ID NO: 2933291 - RNA, 21 nt, Human
cugcuuccagugaggcucugc

SEQ ID NO: 2933292 - RNA, 20 nt, Human
cugcuuccagugaggcucug

SEQ ID NO: 2933293 - RNA, 19 nt, Human
cugcuuccagugaggcucu

SEQ ID NO: 2933294 - RNA, 13 nt, Human
cugcugguucagg

SEQ ID NO: 2933295 - RNA, 15 nt, Human
cugcugguucagggu

SEQ ID NO: 2933296 - RNA, 23 nt, Human
cugcugguucaggguuggccccu

SEQ ID NO: 2933297 - RNA, 19 nt, Human
cugcgaccacaagaaggau

SEQ ID NO: 2933298 - RNA, 20 nt, Human
cugcuccagcuguucagcug

SEQ ID NO: 2933299 - RNA, 19 nt, Human
cugcuccagcuguucagcu

SEQ ID NO: 2933300 - RNA, 15 nt, Human
cugcucccaccuggc

SEQ ID NO: 2933301 - RNA, 10 nt, Human
cugcucccac

SEQ ID NO: 2933302 - RNA, 19 nt, Human
cugcucuccgaccagacac

SEQ ID NO: 2933303 - RNA, 16 nt, Human
cugcugccccugcaca

SEQ ID NO: 2933304 - RNA, 14 nt, Human
cugcugccccugca

SEQ ID NO: 2933305 - RNA, 22 nt, Human
cugcugccccugcacagcaggc

SEQ ID NO: 2933306 - RNA, 23 nt, Human
cugcugccccugcacagcaggcu

SEQ ID NO: 2933307 - RNA, 16 nt, Human
cugcucccaccuggcu

SEQ ID NO: 2933308 - RNA, 18 nt, Human
cugcugaaacaacaaaua

SEQ ID NO: 2933309 - RNA, 11 nt, Human
cugcugaaggc

SEQ ID NO: 2933310 - RNA, 20 nt, Human
cugccugcccaggccccugc

SEQ ID NO: 2933311 - RNA, 21 nt, Human
cugccugggaucccucauccu

SEQ ID NO: 2933312 - RNA, 15 nt, Human
cugccugaagucaca

SEQ ID NO: 2933313 - RNA, 15 nt, Human
cugccugcccaggcc

SEQ ID NO: 2933314 - RNA, 16 nt, Human
cugccugcccaggccc

SEQ ID NO: 2933315 - RNA, 17 nt, Human
cugccugcccaggcccc

SEQ ID NO: 2933316 - RNA, 14 nt, Human
cugccucuucucua

SEQ ID NO: 2933317 - RNA, 15 nt, Human
cugccucuucucuac

SEQ ID NO: 2933318 - RNA, 11 nt, Human
cugccucccau

SEQ ID NO: 2933319 - RNA, 19 nt, Human
cugccucccaucacccgcu

SEQ ID NO: 2933320 - RNA, 16 nt, Human
cugccucccaucaccc

SEQ ID NO: 2933321 - RNA, 14 nt, Human
cugccucccaucac

SEQ ID NO: 2933322 - RNA, 12 nt, Human
cugccucccauc

SEQ ID NO: 2933323 - RNA, 22 nt, Human
cugccucugacacacagcucug

SEQ ID NO: 2933324 - RNA, 23 nt, Human
cugccucugacacacagcucugu

SEQ ID NO: 2933325 - RNA, 13 nt, Human
cugccuccccucc

SEQ ID NO: 2933326 - RNA, 15 nt, Human
cugccgcagcccugc

SEQ ID NO: 2933327 - RNA, 14 nt, Human
cugccgcagcccug

SEQ ID NO: 2933328 - RNA, 18 nt, Human
cugccgcagcccugcaga

SEQ ID NO: 2933329 - RNA, 17 nt, Human
cugccgcagcccugcag

SEQ ID NO: 2933330 - RNA, 16 nt, Human
cugcccucaagagcaa

SEQ ID NO: 2933331 - RNA, 12 nt, Human
cugcccuccaag

SEQ ID NO: 2933332 - RNA, 17 nt, Human
cucccuucccaccucuc

SEQ ID NO: 2933333 - RNA, 16 nt, Human
cucccuucccaccucu

SEQ ID NO: 2933334 - RNA, 15 nt, Human
cucccuucccaccuc

SEQ ID NO: 2933335 - RNA, 14 nt, Human
cucccuucccaccu

SEQ ID NO: 2933336 - RNA, 16 nt, Human
cugcccucuccugggc

SEQ ID NO: 2933337 - RNA, 18 nt, Human
cugcccucuccugggcag

SEQ ID NO: 2933338 - RNA, 19 nt, Human
cugcccucuccugggcagc

SEQ ID NO: 2933339 - RNA, 20 nt, Human
cugcccucuccugggcagcu

SEQ ID NO: 2933340 - RNA, 21 nt, Human
cugcccucuccugggcagcug

SEQ ID NO: 2933341 - RNA, 23 nt, Human
cuguaucccaugagccucagcau

SEQ ID NO: 2933342 - RNA, 22 nt, Human
cuguauuuuaaaagaaugauua

SEQ ID NO: 2933343 - RNA, 20 nt, Human
cuguauuuuaaaagaaugau

SEQ ID NO: 2933344 - RNA, 19 nt, Human
cuguauuuuaaaagaauga

SEQ ID NO: 2933345 - RNA, 22 nt, Human
cuguagucccagcuacucggga

SEQ ID NO: 2933346 - RNA, 13 nt, Human
cuguacagagccc

SEQ ID NO: 2933347 - RNA, 20 nt, Human
cugucccuuacgugaguccu

SEQ ID NO: 2933348 - RNA, 14 nt, Human
cuguccgagcuuug

SEQ ID NO: 2933349 - RNA, 22 nt, Human
cuguccccgcacugggcuuggg

SEQ ID NO: 2933350 - RNA, 19 nt, Human
cuguccccgcacugggcuu

SEQ ID NO: 2933351 - RNA, 18 nt, Human
cuguccccgcacugggcu

SEQ ID NO: 2933352 - RNA, 17 nt, Human
cuguccccgcacugggc

SEQ ID NO: 2933353 - RNA, 23 nt, Human
cugucucaaaaaaacacaaaagu

SEQ ID NO: 2933354 - RNA, 16 nt, Human
cugucucaaaaaaaga

SEQ ID NO: 2933355 - RNA, 18 nt, Human
cugucucaaaaaaagaaa

SEQ ID NO: 2933356 - RNA, 14 nt, Human
cuguccuacccacc

SEQ ID NO: 2933357 - RNA, 15 nt, Human
cuguccgagcuuuga

SEQ ID NO: 2933358 - RNA, 20 nt, Human
cugucuacacuaagagagaa

SEQ ID NO: 2933359 - RNA, 17 nt, Human
cuggguucuacccaggu

SEQ ID NO: 2933360 - RNA, 16 nt, Human
cuggguucuacccagg

SEQ ID NO: 2933361 - RNA, 15 nt, Human
cuggguucuacccag

SEQ ID NO: 2933362 - RNA, 14 nt, Human
cuggguucuaccca

SEQ ID NO: 2933363 - RNA, 20 nt, Human
cuggguaacuagggaagaua

SEQ ID NO: 2933364 - RNA, 22 nt, Human
cuggguaacuagggaagauaau

SEQ ID NO: 2933365 - RNA, 13 nt, Human
cugggggaagaag

SEQ ID NO: 2933366 - RNA, 24 nt, Human
cugggcuucaguggcagcugcuuu

SEQ ID NO: 2933367 - RNA, 15 nt, Human
cugggggaagaagcu

SEQ ID NO: 2933368 - RNA, 22 nt, Human
cugggggggauuguaaaauggu

SEQ ID NO: 2933369 - RNA, 19 nt, Human
cugggggcugggcagagga

SEQ ID NO: 2933370 - RNA, 21 nt, Human
cugguacucugccacuuuauu

SEQ ID NO: 2933371 - RNA, 23 nt, Human
cugguggcagcucaccucucccu

SEQ ID NO: 2933372 - RNA, 21 nt, Human
cugguggcagcucaccucucc

SEQ ID NO: 2933373 - RNA, 13 nt, Human
cugguggcagcug

SEQ ID NO: 2933374 - RNA, 14 nt, Human
cugguggcagcugc

SEQ ID NO: 2933375 - RNA, 20 nt, Human
cuguaauccuagcacuuugg

SEQ ID NO: 2933376 - RNA, 15 nt, Human
cuguacaaaguagaa

SEQ ID NO: 2933377 - RNA, 13 nt, Human
cuguacaaaguag

SEQ ID NO: 2933378 - RNA, 16 nt, Human
cugguuccauggccuc

SEQ ID NO: 2933379 - RNA, 22 nt, Human
cuguaauaaacucauuucuagc

SEQ ID NO: 2933380 - RNA, 23 nt, Human
cuguaaucacagcuacuugggag

SEQ ID NO: 2933381 - RNA, 13 nt, Human
cuguucucugccc

SEQ ID NO: 2933382 - RNA, 20 nt, Human
cuguucucugcccuccaaga

SEQ ID NO: 2933383 - RNA, 19 nt, Human
cuguucucugcccuccaag

SEQ ID NO: 2933384 - RNA, 18 nt, Human
cuguucucugcccuccaa

SEQ ID NO: 2933385 - RNA, 17 nt, Human
cuguucucugcccucca

SEQ ID NO: 2933386 - RNA, 16 nt, Human
cuguucucugcccucc

SEQ ID NO: 2933387 - RNA, 15 nt, Human
cuguucucugcccuc

SEQ ID NO: 2933388 - RNA, 14 nt, Human
cuguucucugcccu

SEQ ID NO: 2933389 - RNA, 21 nt, Human
cuguucagcugguugagguuu

SEQ ID NO: 2933390 - RNA, 19 nt, Human
cuguucagcugguugaggu

SEQ ID NO: 2933391 - RNA, 18 nt, Human
cuguucagcugguugagg

SEQ ID NO: 2933392 - RNA, 18 nt, Human
cuguucaugaaagauuca

SEQ ID NO: 2933393 - RNA, 23 nt, Human
cuguucaugaaagauucaaugcc

SEQ ID NO: 2933394 - RNA, 17 nt, Human
cuguucaugaaagauuc

SEQ ID NO: 2933395 - RNA, 21 nt, Human
cugugucuugcaauggcagcc

SEQ ID NO: 2933396 - RNA, 20 nt, Human
cugugucuugcaauggcagc

SEQ ID NO: 2933397 - RNA, 22 nt, Human
cugugucuugcaauggcagccu

SEQ ID NO: 2933398 - RNA, 23 nt, Human
cugugucuugcaauggcagccuu

SEQ ID NO: 2933399 - RNA, 18 nt, Human
cugugugugcgccuacag

SEQ ID NO: 2933400 - RNA, 20 nt, Human
cugugugugcgccuacagga

SEQ ID NO: 2933401 - RNA, 23 nt, Human
cuguuaaaagaugaaaauauuug

SEQ ID NO: 2933402 - RNA, 21 nt, Human
cuguuaaaagaugaaaauauu

SEQ ID NO: 2933403 - RNA, 20 nt, Human
cuguuaaaagaugaaaauau

SEQ ID NO: 2933404 - RNA, 17 nt, Human
cuguggaugauaaaaca

SEQ ID NO: 2933405 - RNA, 14 nt, Human
cuguggaugcugcu

SEQ ID NO: 2933406 - RNA, 22 nt, Human
cuguggaugcugcugccccugc

SEQ ID NO: 2933407 - RNA, 23 nt, Human
cuguggaugcugcugccccugca

SEQ ID NO: 2933408 - RNA, 16 nt, Human
cuguggaugcugcugc

SEQ ID NO: 2933409 - RNA, 18 nt, Human
cuguggaugcugcugccc

SEQ ID NO: 2933410 - RNA, 19 nt, Human
cuguggaugcugcugcccc

SEQ ID NO: 2933411 - RNA, 21 nt, Human
cuguggaugcugcugccccug

SEQ ID NO: 2933412 - RNA, 22 nt, Human
cuguggcgagccauuuguccca

SEQ ID NO: 2933413 - RNA, 23 nt, Human
cuguggcgagccauuugucccaa

SEQ ID NO: 2933414 - RNA, 14 nt, Human
cugugggcccccaa

SEQ ID NO: 2933415 - RNA, 22 nt, Human
cugugcugcccugcccaccugg

SEQ ID NO: 2933416 - RNA, 17 nt, Human
cugugccucugggacug

SEQ ID NO: 2933417 - RNA, 21 nt, Human
cugugcugcccugcccaccug

SEQ ID NO: 2933418 - RNA, 14 nt, Human
cugugccucuggga

SEQ ID NO: 2933419 - RNA, 16 nt, Human
cugugccucugggacu

SEQ ID NO: 2933420 - RNA, 21 nt, Human
cugugcaucuagccucaagcu

SEQ ID NO: 2933421 - RNA, 20 nt, Human
cugugauggggcccugccuc

SEQ ID NO: 2933422 - RNA, 19 nt, Human
cugugauggggcccugccu

SEQ ID NO: 2933423 - RNA, 14 nt, Human
cugugccauuuugu

SEQ ID NO: 2933424 - RNA, 16 nt, Human
cugugccaugugccag

SEQ ID NO: 2933425 - RNA, 18 nt, Human
cugugccaugugccaggu

SEQ ID NO: 2933426 - RNA, 19 nt, Human
cugugaugacauucccugc

SEQ ID NO: 2933427 - RNA, 17 nt, Human
cugugauggggcccugc

SEQ ID NO: 2933428 - RNA, 18 nt, Human
cugugauggggcccugcc

SEQ ID NO: 2933429 - RNA, 23 nt, Human
cugugaguacuacaguccuccca

SEQ ID NO: 2933430 - RNA, 21 nt, Human
cugugaguacuacaguccucc

SEQ ID NO: 2933431 - RNA, 20 nt, Human
cugugaguacuacaguccuc

SEQ ID NO: 2933432 - RNA, 18 nt, Human
cugucuccauguuugaug

SEQ ID NO: 2933433 - RNA, 14 nt, Human
gaauugaagcagga

SEQ ID NO: 2933434 - RNA, 16 nt, Human
gaauugacccacaaga

SEQ ID NO: 2933435 - RNA, 21 nt, Human
gaauugacccacaagaaauga

SEQ ID NO: 2933436 - RNA, 16 nt, Human
gaauugacauugaaau

SEQ ID NO: 2933437 - RNA, 16 nt, Human
gaauuggagcucgugg

SEQ ID NO: 2933438 - RNA, 13 nt, Human
gaaugucagugug

SEQ ID NO: 2933439 - RNA, 22 nt, Human
gaaugucaguuguuauuuauug

SEQ ID NO: 2933440 - RNA, 15 nt, Human
gaaugucacuucugg

SEQ ID NO: 2933441 - RNA, 22 nt, Human
gaauguaggcuggcuuucagag

SEQ ID NO: 2933442 - RNA, 13 nt, Human
gaauguaggcugg

SEQ ID NO: 2933443 - RNA, 18 nt, Human
gaauccagacccggcugc

SEQ ID NO: 2933444 - RNA, 20 nt, Human
gaauccagacccggcugcgu

SEQ ID NO: 2933445 - RNA, 20 nt, Human
gaaugcacaaacagaggccg

SEQ ID NO: 2933446 - RNA, 21 nt, Human
gaaugaaagggcccagagagg

SEQ ID NO: 2933447 - RNA, 21 nt, Human
gaaugcacaaacagaggccgc

SEQ ID NO: 2933448 - RNA, 15 nt, Human
gacaagcucacagac

SEQ ID NO: 2933449 - RNA, 23 nt, Human
gacaacacucauugaccugaggc

SEQ ID NO: 2933450 - RNA, 22 nt, Human
gacaacacucauugaccugagg

SEQ ID NO: 2933451 - RNA, 15 nt, Human
gaauuguaaggaaug

SEQ ID NO: 2933452 - RNA, 19 nt, Human
gaauuucuaggacugaauu

SEQ ID NO: 2933453 - RNA, 20 nt, Human
gaauuucuaggacugaauua

SEQ ID NO: 2933454 - RNA, 20 nt, Human
gaauuugauaugugaacagu

SEQ ID NO: 2933455 - RNA, 22 nt, Human
gaauuucuuuugccguuauuaa

SEQ ID NO: 2933456 - RNA, 20 nt, Human
gacaaugugaaaagaaaaau

SEQ ID NO: 2933457 - RNA, 19 nt, Human
gacaaugugaaaagaaaaa

SEQ ID NO: 2933458 - RNA, 22 nt, Human
gacaaugcaaaccaucauugaa

SEQ ID NO: 2933459 - RNA, 18 nt, Human
gacaaugugaaaagaaaa

SEQ ID NO: 2933460 - RNA, 12 nt, Human
gacaaugugaaa

SEQ ID NO: 2933461 - RNA, 18 nt, Human
gacaaggauugcuacugu

SEQ ID NO: 2933462 - RNA, 21 nt, Human
gacaaggaugaucuaggaaga

SEQ ID NO: 2933463 - RNA, 19 nt, Human
gacaaggauugcuacuguc

SEQ ID NO: 2933464 - RNA, 16 nt, Human
gacaaggaaaaaauaa

SEQ ID NO: 2933465 - RNA, 17 nt, Human
gacacaugccagggcca

SEQ ID NO: 2933466 - RNA, 23 nt, Human
gacacauguccaagaagcccagg

SEQ ID NO: 2933467 - RNA, 20 nt, Human
gacacauguccaagaagccc

SEQ ID NO: 2933468 - RNA, 15 nt, Human
gacacauguccaaga

SEQ ID NO: 2933469 - RNA, 19 nt, Human
gacacaugcaaggucauuu

SEQ ID NO: 2933470 - RNA, 14 nt, Human
gacacaugcaaggu

SEQ ID NO: 2933471 - RNA, 20 nt, Human
gacacaggcccggcuccagg

SEQ ID NO: 2933472 - RNA, 21 nt, Human
gacacaggcccggcuccaggc

SEQ ID NO: 2933473 - RNA, 19 nt, Human
gacacaggcccggcuccag

SEQ ID NO: 2933474 - RNA, 16 nt, Human
gacacaagccuucggc

SEQ ID NO: 2933475 - RNA, 23 nt, Human
gacagggcacaccgggcacucag

SEQ ID NO: 2933476 - RNA, 16 nt, Human
gacagggaggugaccc

SEQ ID NO: 2933477 - RNA, 18 nt, Human
gacagggaggacgcucuc

SEQ ID NO: 2933478 - RNA, 14 nt, Human
gacaguuaagagaa

SEQ ID NO: 2933479 - RNA, 24 nt, Human
gacagggcacaccgggcacucaga

SEQ ID NO: 2933480 - RNA, 17 nt, Human
gacagggaggacgcucu

SEQ ID NO: 2933481 - RNA, 14 nt, Human
gacaggaccaggga

SEQ ID NO: 2933482 - RNA, 23 nt, Human
gacaggaccagggauuuccauga

SEQ ID NO: 2933483 - RNA, 15 nt, Human
gacaggaccagggau

SEQ ID NO: 2933484 - RNA, 14 nt, Human
gacaugggaaaggg

SEQ ID NO: 2933485 - RNA, 14 nt, Human
gacaugaucuucuu

SEQ ID NO: 2933486 - RNA, 22 nt, Human
gacaguuaagagaaaugagcuu

SEQ ID NO: 2933487 - RNA, 20 nt, Human
gacauagaauuaacacauga

SEQ ID NO: 2933488 - RNA, 13 nt, Human
gacagagggggug

SEQ ID NO: 2933489 - RNA, 20 nt, Human
gacagagugagacucugucu

SEQ ID NO: 2933490 - RNA, 22 nt, Human
gacagagugagacucugucuca

SEQ ID NO: 2933491 - RNA, 14 nt, Human
gacagccacggcca

SEQ ID NO: 2933492 - RNA, 17 nt, Human
gacagccacggccaggc

SEQ ID NO: 2933493 - RNA, 18 nt, Human
gacagccacggccaggcc

SEQ ID NO: 2933494 - RNA, 19 nt, Human
gacagccacggccaggcca

SEQ ID NO: 2933495 - RNA, 21 nt, Human
gacagcugccugggaucccuc

SEQ ID NO: 2933496 - RNA, 18 nt, Human
gacagcugccugggaucc

SEQ ID NO: 2933497 - RNA, 20 nt, Human
gacagccacggccaggccag

SEQ ID NO: 2933498 - RNA, 21 nt, Human
gacagccacggccaggccaga

SEQ ID NO: 2933499 - RNA, 17 nt, Human
gacagcugccugggauc

SEQ ID NO: 2933500 - RNA, 16 nt, Human
gacagcugccugggau

SEQ ID NO: 2933501 - RNA, 17 nt, Human
gacagaggcagccccau

SEQ ID NO: 2933502 - RNA, 15 nt, Human
gacagaggggguggc

SEQ ID NO: 2933503 - RNA, 19 nt, Human
gacagaggggguggccucc

SEQ ID NO: 2933504 - RNA, 18 nt, Human
gacagaggggguggccuc

SEQ ID NO: 2933505 - RNA, 23 nt, Human
gacagaggggguggccucccaac

SEQ ID NO: 2933506 - RNA, 22 nt, Human
gacagaggggguggccucccaa

SEQ ID NO: 2933507 - RNA, 21 nt, Human
gacagaggggguggccuccca

SEQ ID NO: 2933508 - RNA, 21 nt, Human
gacagagcaagugagacccug

SEQ ID NO: 2933509 - RNA, 14 nt, Human
gacagaggcagccc

SEQ ID NO: 2933510 - RNA, 16 nt, Human
gacagaggcagcccca

SEQ ID NO: 2933511 - RNA, 12 nt, Human
gacagaggcagc

SEQ ID NO: 2933512 - RNA, 19 nt, Human
gacagagccccacccucag

SEQ ID NO: 2933513 - RNA, 20 nt, Human
gaccauucuccaccugccag

SEQ ID NO: 2933514 - RNA, 19 nt, Human
gaccauucuccaccugcca

SEQ ID NO: 2933515 - RNA, 17 nt, Human
gaccauucuccaccugc

SEQ ID NO: 2933516 - RNA, 17 nt, Human
gaccauuggggcuccca

SEQ ID NO: 2933517 - RNA, 19 nt, Human
gaccauuggggcucccagc

SEQ ID NO: 2933518 - RNA, 20 nt, Human
gaccauuggggcucccagcc

SEQ ID NO: 2933519 - RNA, 21 nt, Human
gaccauuggggcucccagcca

SEQ ID NO: 2933520 - RNA, 22 nt, Human
gaccauucuccaccugccaggg

SEQ ID NO: 2933521 - RNA, 21 nt, Human
gaccauucuccaccugccagg

SEQ ID NO: 2933522 - RNA, 19 nt, Human
gaccagagcugccaccugc

SEQ ID NO: 2933523 - RNA, 18 nt, Human
gaccagagcugccaccug

SEQ ID NO: 2933524 - RNA, 17 nt, Human
gaccagagcugccaccu

SEQ ID NO: 2933525 - RNA, 15 nt, Human
gaccagagcugccac

SEQ ID NO: 2933526 - RNA, 14 nt, Human
gaccagagcugcca

SEQ ID NO: 2933527 - RNA, 13 nt, Human
gaccagagcugcc

SEQ ID NO: 2933528 - RNA, 16 nt, Human
gacaugggacauuugc

SEQ ID NO: 2933529 - RNA, 18 nt, Human
gacaugggaaaggggaag

SEQ ID NO: 2933530 - RNA, 24 nt, Human
gaccagacaccuugacagggcaca

SEQ ID NO: 2933531 - RNA, 11 nt, Human
gaccagagcug

SEQ ID NO: 2933532 - RNA, 21 nt, Human
gaccacugcagaagacaguau

SEQ ID NO: 2933533 - RNA, 14 nt, Human
gaccacguuucuaa

SEQ ID NO: 2933534 - RNA, 12 nt, Human
gacccugucuca

SEQ ID NO: 2933535 - RNA, 20 nt, Human
gacccuuguggucccacccc

SEQ ID NO: 2933536 - RNA, 19 nt, Human
gacccuuguggucccaccc

SEQ ID NO: 2933537 - RNA, 21 nt, Human
gacccuuguggucccacccca

SEQ ID NO: 2933538 - RNA, 15 nt, Human
gacccuugugguccc

SEQ ID NO: 2933539 - RNA, 17 nt, Human
gaccgugaggccagaga

SEQ ID NO: 2933540 - RNA, 16 nt, Human
gaccgugaggccagag

SEQ ID NO: 2933541 - RNA, 18 nt, Human
gaccgugaggccagagac

SEQ ID NO: 2933542 - RNA, 23 nt, Human
gacccugaggcccagagggccug

SEQ ID NO: 2933543 - RNA, 14 nt, Human
gaccccuccaugug

SEQ ID NO: 2933544 - RNA, 18 nt, Human
gaccccuccaugugggcu

SEQ ID NO: 2933545 - RNA, 21 nt, Human
gaccccuccaugugggcuagu

SEQ ID NO: 2933546 - RNA, 22 nt, Human
gacccugaggcccagagggccu

SEQ ID NO: 2933547 - RNA, 20 nt, Human
gacccaaaaggcagaagcaa

SEQ ID NO: 2933548 - RNA, 16 nt, Human
gacccaaaaggcagaa

SEQ ID NO: 2933549 - RNA, 15 nt, Human
gacccacaagaaaug

SEQ ID NO: 2933550 - RNA, 22 nt, Human
gagaacuuccagauccuggaaa

SEQ ID NO: 2933551 - RNA, 23 nt, Human
gagaacuuccagauccuggaaau

SEQ ID NO: 2933552 - RNA, 14 nt, Human
gagaagagaaugca

SEQ ID NO: 2933553 - RNA, 16 nt, Human
gagaagcagaggaagg

SEQ ID NO: 2933554 - RNA, 16 nt, Human
gagaagagaaugcaca

SEQ ID NO: 2933555 - RNA, 17 nt, Human
gagaaugagagacacac

SEQ ID NO: 2933556 - RNA, 21 nt, Human
gagaaccuagggugauauuaa

SEQ ID NO: 2933557 - RNA, 22 nt, Human
gagaaccuagggugauauuaac

SEQ ID NO: 2933558 - RNA, 14 nt, Human
gagaaaugagcuug

SEQ ID NO: 2933559 - RNA, 16 nt, Human
gagaaagguugaagca

SEQ ID NO: 2933560 - RNA, 19 nt, Human
gacuugcauaccugcuuuu

SEQ ID NO: 2933561 - RNA, 19 nt, Human
gacuuaagcacacuugaca

SEQ ID NO: 2933562 - RNA, 16 nt, Human
gacuucuaaguaaaac

SEQ ID NO: 2933563 - RNA, 18 nt, Human
gacuucuaaguaaaacca

SEQ ID NO: 2933564 - RNA, 17 nt, Human
gacuucuaaguaaaacc

SEQ ID NO: 2933565 - RNA, 23 nt, Human
gacuucugucuucacaacagauu

SEQ ID NO: 2933566 - RNA, 20 nt, Human
gacuucugucuucacaacag

SEQ ID NO: 2933567 - RNA, 24 nt, Human
gacuucuaaguaaaaccacagcag

SEQ ID NO: 2933568 - RNA, 23 nt, Human
gacuucuaaguaaaaccacagca

SEQ ID NO: 2933569 - RNA, 19 nt, Human
gacuucuaaguaaaaccac

SEQ ID NO: 2933570 - RNA, 13 nt, Human
gacuacaggugug

SEQ ID NO: 2933571 - RNA, 18 nt, Human
gacuacaggugugaguca

SEQ ID NO: 2933572 - RNA, 21 nt, Human
gacuacaggugugagucacca

SEQ ID NO: 2933573 - RNA, 14 nt, Human
gacucauucuucug

SEQ ID NO: 2933574 - RNA, 15 nt, Human
gacucauucuucugu

SEQ ID NO: 2933575 - RNA, 13 nt, Human
gacucgcgacaau

SEQ ID NO: 2933576 - RNA, 13 nt, Human
gacuccugcaggc

SEQ ID NO: 2933577 - RNA, 12 nt, Human
gacuccugcagg

SEQ ID NO: 2933578 - RNA, 16 nt, Human
gacuccaaagaaaugu

SEQ ID NO: 2933579 - RNA, 15 nt, Human
gacuccaaagaaaug

SEQ ID NO: 2933580 - RNA, 12 nt, Human
gacuccaaagaa

SEQ ID NO: 2933581 - RNA, 11 nt, Human
gacuccaaaga

SEQ ID NO: 2933582 - RNA, 21 nt, Human
gacucauuuuaaaaaauggaa

SEQ ID NO: 2933583 - RNA, 20 nt, Human
gacugcugggagguuaaaaa

SEQ ID NO: 2933584 - RNA, 14 nt, Human
gacuggaagcacag

SEQ ID NO: 2933585 - RNA, 15 nt, Human
gacuggaagcacagc

SEQ ID NO: 2933586 - RNA, 16 nt, Human
gacuggaagcacagcu

SEQ ID NO: 2933587 - RNA, 19 nt, Human
gacuggggccacuacauuu

SEQ ID NO: 2933588 - RNA, 18 nt, Human
gacuggaagcacagcuuc

SEQ ID NO: 2933589 - RNA, 16 nt, Human
gacuggauaguccguc

SEQ ID NO: 2933590 - RNA, 17 nt, Human
gacucgcgacaaugcaa

SEQ ID NO: 2933591 - RNA, 21 nt, Human
gacugaguacguugugcauuu

SEQ ID NO: 2933592 - RNA, 22 nt, Human
gacugaguacguugugcauuug

SEQ ID NO: 2933593 - RNA, 13 nt, Human
gacugcccggcag

SEQ ID NO: 2933594 - RNA, 15 nt, Human
gacugcccggcaggg

SEQ ID NO: 2933595 - RNA, 23 nt, Human
gacugaguacguugugcauuugg

SEQ ID NO: 2933596 - RNA, 14 nt, Human
gacugcauuauauu

SEQ ID NO: 2933597 - RNA, 16 nt, Human
gacugcauuauauuua

SEQ ID NO: 2933598 - RNA, 17 nt, Human
gagcaaaguagaucaug

SEQ ID NO: 2933599 - RNA, 19 nt, Human
gagaucacgccacugcacu

SEQ ID NO: 2933600 - RNA, 18 nt, Human
gagaucacgccacugcac

SEQ ID NO: 2933601 - RNA, 14 nt, Human
gagauagccaaggc

SEQ ID NO: 2933602 - RNA, 23 nt, Human
gagaucaaccccuucgcuccugu

SEQ ID NO: 2933603 - RNA, 16 nt, Human
gagauagccaaggcca

SEQ ID NO: 2933604 - RNA, 20 nt, Human
gagcaccuuagacagucccu

SEQ ID NO: 2933605 - RNA, 21 nt, Human
gagcacuaaggugugcucuga

SEQ ID NO: 2933606 - RNA, 15 nt, Human
gagcacuaaggugug

SEQ ID NO: 2933607 - RNA, 22 nt, Human
gagcaccuuagacagucccugc

SEQ ID NO: 2933608 - RNA, 21 nt, Human
gagcaccuuagacagucccug

SEQ ID NO: 2933609 - RNA, 18 nt, Human
gagcccugguggcagugg

SEQ ID NO: 2933610 - RNA, 19 nt, Human
gagccagggucucacuaug

SEQ ID NO: 2933611 - RNA, 14 nt, Human
gagccagggucuca

SEQ ID NO: 2933612 - RNA, 23 nt, Human
gagccagauuucacucuccuugg

SEQ ID NO: 2933613 - RNA, 16 nt, Human
gagcagagaauucucu

SEQ ID NO: 2933614 - RNA, 12 nt, Human
gagcagagacca

SEQ ID NO: 2933615 - RNA, 19 nt, Human
gagccaauuuaaagaaaac

SEQ ID NO: 2933616 - RNA, 20 nt, Human
gagccagauuucacucuccu

SEQ ID NO: 2933617 - RNA, 19 nt, Human
gagaggggaacagacugga

SEQ ID NO: 2933618 - RNA, 13 nt, Human
gagaggggcacag

SEQ ID NO: 2933619 - RNA, 16 nt, Human
gagagggugggagugg

SEQ ID NO: 2933620 - RNA, 14 nt, Human
gagagggugggagu

SEQ ID NO: 2933621 - RNA, 19 nt, Human
gagagacacacugaagaag

SEQ ID NO: 2933622 - RNA, 22 nt, Human
gagacuggcgugaacccaggag

SEQ ID NO: 2933623 - RNA, 19 nt, Human
gagacuggcgugaacccag

SEQ ID NO: 2933624 - RNA, 18 nt, Human
gagacuccugcaggcagc

SEQ ID NO: 2933625 - RNA, 19 nt, Human
gagacuccugcaggcagcc

SEQ ID NO: 2933626 - RNA, 21 nt, Human
gagacuccugcaggcagccag

SEQ ID NO: 2933627 - RNA, 20 nt, Human
gagacuccugcaggcagcca

SEQ ID NO: 2933628 - RNA, 13 nt, Human
gagacucugucuc

SEQ ID NO: 2933629 - RNA, 21 nt, Human
gagacucgcgacaaugcaaac

SEQ ID NO: 2933630 - RNA, 20 nt, Human
gagacucgcgacaaugcaaa

SEQ ID NO: 2933631 - RNA, 22 nt, Human
gagacaggguuuugccauguug

SEQ ID NO: 2933632 - RNA, 12 nt, Human
gagaccaucccu

SEQ ID NO: 2933633 - RNA, 14 nt, Human
gagaccaucccuga

SEQ ID NO: 2933634 - RNA, 21 nt, Human
gagaccaucccugaaggcccc

SEQ ID NO: 2933635 - RNA, 18 nt, Human
gagaccaucccugaaggc

SEQ ID NO: 2933636 - RNA, 23 nt, Human
gagaaugcacaaacagaggccgc

SEQ ID NO: 2933637 - RNA, 20 nt, Human
gagaaugagagacacacuga

SEQ ID NO: 2933638 - RNA, 20 nt, Human
gagacagcucugcauacuca

SEQ ID NO: 2933639 - RNA, 22 nt, Human
gauaaauggcuuccuggcaaua

SEQ ID NO: 2933640 - RNA, 21 nt, Human
gaguugaagacagagcuacac

SEQ ID NO: 2933641 - RNA, 17 nt, Human
gaguugaagacagagcu

SEQ ID NO: 2933642 - RNA, 15 nt, Human
gaguugaagacagag

SEQ ID NO: 2933643 - RNA, 20 nt, Human
gaguucauacccuguuacca

SEQ ID NO: 2933644 - RNA, 14 nt, Human
gaguucaucuugaa

SEQ ID NO: 2933645 - RNA, 20 nt, Human
gaguucaucuugaauuguaa

SEQ ID NO: 2933646 - RNA, 19 nt, Human
gaguucaucuugaauugua

SEQ ID NO: 2933647 - RNA, 15 nt, Human
gaguuacagacaaag

SEQ ID NO: 2933648 - RNA, 13 nt, Human
gaguuacagacaa

SEQ ID NO: 2933649 - RNA, 13 nt, Human
gagugggugaaua

SEQ ID NO: 2933650 - RNA, 17 nt, Human
gagugacagaggcagcc

SEQ ID NO: 2933651 - RNA, 15 nt, Human
gaguguacagagugg

SEQ ID NO: 2933652 - RNA, 16 nt, Human
gaguggucagaacaga

SEQ ID NO: 2933653 - RNA, 20 nt, Human
gagugugccugaagucccag

SEQ ID NO: 2933654 - RNA, 12 nt, Human
gaguuacagaca

SEQ ID NO: 2933655 - RNA, 15 nt, Human
gauagcacagacccu

SEQ ID NO: 2933656 - RNA, 14 nt, Human
gauagccaaggcca

SEQ ID NO: 2933657 - RNA, 22 nt, Human
gauagccaaggccaaaggaagc

SEQ ID NO: 2933658 - RNA, 20 nt, Human
gauacaggaaaagcugcuga

SEQ ID NO: 2933659 - RNA, 22 nt, Human
gauaagaaccuuuugagugccu

SEQ ID NO: 2933660 - RNA, 19 nt, Human
gauacaggaaaagcugcug

SEQ ID NO: 2933661 - RNA, 21 nt, Human
gauacaggaaaagcugcugac

SEQ ID NO: 2933662 - RNA, 23 nt, Human
gauacaggaaaagcugcugacag

SEQ ID NO: 2933663 - RNA, 18 nt, Human
gaucacggcucacugcag

SEQ ID NO: 2933664 - RNA, 15 nt, Human
gaucacggcucacug

SEQ ID NO: 2933665 - RNA, 16 nt, Human
gaucacggcucacugc

SEQ ID NO: 2933666 - RNA, 24 nt, Human
gauaugauucaaaugucuauaaac

SEQ ID NO: 2933667 - RNA, 14 nt, Human
gauaugauucaaau

SEQ ID NO: 2933668 - RNA, 22 nt, Human
gauaugauucaaaugucuauaa

SEQ ID NO: 2933669 - RNA, 17 nt, Human
gaggucagagccugcag

SEQ ID NO: 2933670 - RNA, 20 nt, Human
gaggucagagccugcaguua

SEQ ID NO: 2933671 - RNA, 17 nt, Human
gagguugggaggccauu

SEQ ID NO: 2933672 - RNA, 15 nt, Human
gagguugggaggcca

SEQ ID NO: 2933673 - RNA, 16 nt, Human
gagguuucaaaccucc

SEQ ID NO: 2933674 - RNA, 19 nt, Human
gaguagcugggacuacagg

SEQ ID NO: 2933675 - RNA, 22 nt, Human
gaguagcugggacuacaggcac

SEQ ID NO: 2933676 - RNA, 12 nt, Human
gaguaggaagac

SEQ ID NO: 2933677 - RNA, 17 nt, Human
gaguaggaagacuuugg

SEQ ID NO: 2933678 - RNA, 13 nt, Human
gaguaggaagacu

SEQ ID NO: 2933679 - RNA, 20 nt, Human
gaguacuacaguccucccau

SEQ ID NO: 2933680 - RNA, 23 nt, Human
gaguacuacaguccucccaucuc

SEQ ID NO: 2933681 - RNA, 21 nt, Human
gaguacuacaguccucccauc

SEQ ID NO: 2933682 - RNA, 19 nt, Human
gaguaggaagacuuuggaa

SEQ ID NO: 2933683 - RNA, 18 nt, Human
gaguaggaagacuuugga

SEQ ID NO: 2933684 - RNA, 11 nt, Human
gaguauauguc

SEQ ID NO: 2933685 - RNA, 15 nt, Human
gagucgaggacaggg

SEQ ID NO: 2933686 - RNA, 16 nt, Human
gagucgaggacaggga

SEQ ID NO: 2933687 - RNA, 19 nt, Human
gaguccgaaagggacuugg

SEQ ID NO: 2933688 - RNA, 14 nt, Human
gagucgaggacagg

SEQ ID NO: 2933689 - RNA, 14 nt, Human
gagucugaaggcug

SEQ ID NO: 2933690 - RNA, 15 nt, Human
gagucugaaggcugg

SEQ ID NO: 2933691 - RNA, 21 nt, Human
gagucuauuuacggaacucaa

SEQ ID NO: 2933692 - RNA, 13 nt, Human
gagucugaaggcu

SEQ ID NO: 2933693 - RNA, 12 nt, Human
gagucugaaggc

SEQ ID NO: 2933694 - RNA, 14 nt, Human
gagugacagaggca

SEQ ID NO: 2933695 - RNA, 15 nt, Human
gagugacagaggcag

SEQ ID NO: 2933696 - RNA, 16 nt, Human
gagugacagaggcagc

SEQ ID NO: 2933697 - RNA, 23 nt, Human
gagugaacaaauuuacagagaca

SEQ ID NO: 2933698 - RNA, 17 nt, Human
gagugaagcugggagaa

SEQ ID NO: 2933699 - RNA, 15 nt, Human
gagggggcugcuccc

SEQ ID NO: 2933700 - RNA, 15 nt, Human
gagggggccuggaug

SEQ ID NO: 2933701 - RNA, 17 nt, Human
gaggggguggccuccca

SEQ ID NO: 2933702 - RNA, 13 nt, Human
gaggguaaggcug

SEQ ID NO: 2933703 - RNA, 21 nt, Human
gagggagugacagaggcagcc

SEQ ID NO: 2933704 - RNA, 22 nt, Human
gagggagugacagaggcagccc

SEQ ID NO: 2933705 - RNA, 18 nt, Human
gagggagugacagaggca

SEQ ID NO: 2933706 - RNA, 16 nt, Human
gagggagugacagagg

SEQ ID NO: 2933707 - RNA, 16 nt, Human
gagggagggcuccaga

SEQ ID NO: 2933708 - RNA, 20 nt, Human
gagggagggcuccagacaca

SEQ ID NO: 2933709 - RNA, 20 nt, Human
gaggcugggcucccuuccca

SEQ ID NO: 2933710 - RNA, 19 nt, Human
gagggagggcuccagacac

SEQ ID NO: 2933711 - RNA, 13 nt, Human
gagggucugagga

SEQ ID NO: 2933712 - RNA, 14 nt, Human
gagggucugaggaa

SEQ ID NO: 2933713 - RNA, 12 nt, Human
gaggguggaaua

SEQ ID NO: 2933714 - RNA, 21 nt, Human
gagggugaagugaagacaaug

SEQ ID NO: 2933715 - RNA, 14 nt, Human
gaggguggugaccu

SEQ ID NO: 2933716 - RNA, 15 nt, Human
gagggugggaguggg

SEQ ID NO: 2933717 - RNA, 21 nt, Human
gaggguggugaccucugccug

SEQ ID NO: 2933718 - RNA, 22 nt, Human
gagggugucccaaaaagaaagg

SEQ ID NO: 2933719 - RNA, 12 nt, Human
gaggucagagcc

SEQ ID NO: 2933720 - RNA, 13 nt, Human
gaggucagagccu

SEQ ID NO: 2933721 - RNA, 17 nt, Human
gaggucaaggcugcagu

SEQ ID NO: 2933722 - RNA, 18 nt, Human
gagguacacuugugaaua

SEQ ID NO: 2933723 - RNA, 24 nt, Human
gagguaaggaauaccugucccccu

SEQ ID NO: 2933724 - RNA, 21 nt, Human
gagguaaggaauaccuguccc

SEQ ID NO: 2933725 - RNA, 15 nt, Human
gaggguugggcuggu

SEQ ID NO: 2933726 - RNA, 14 nt, Human
gaggguugggcugg

SEQ ID NO: 2933727 - RNA, 20 nt, Human
gaggcccuucucuccagccc

SEQ ID NO: 2933728 - RNA, 15 nt, Human
gaggcccuucucucc

SEQ ID NO: 2933729 - RNA, 21 nt, Human
gaggcccuucucuccagcccc

SEQ ID NO: 2933730 - RNA, 16 nt, Human
gaggcccagagggccu

SEQ ID NO: 2933731 - RNA, 15 nt, Human
gaggcccagagggcc

SEQ ID NO: 2933732 - RNA, 19 nt, Human
gaggcccagagggccugca

SEQ ID NO: 2933733 - RNA, 14 nt, Human
gaggcccagagggc

SEQ ID NO: 2933734 - RNA, 13 nt, Human
gaggcccagaggg

SEQ ID NO: 2933735 - RNA, 11 nt, Human
gaggcccagag

SEQ ID NO: 2933736 - RNA, 16 nt, Human
gaggcugggcucccuu

SEQ ID NO: 2933737 - RNA, 20 nt, Human
gaggcggaccuuguagugag

SEQ ID NO: 2933738 - RNA, 14 nt, Human
gaggcugccucucc

SEQ ID NO: 2933739 - RNA, 16 nt, Human
gaggccuucucugaag

SEQ ID NO: 2933740 - RNA, 18 nt, Human
gaggccuucucugaagga

SEQ ID NO: 2933741 - RNA, 19 nt, Human
gaggccuucucugaaggac

SEQ ID NO: 2933742 - RNA, 20 nt, Human
gaggcagccccauucugccu

SEQ ID NO: 2933743 - RNA, 9 nt, Human
gaggcaggg

SEQ ID NO: 2933744 - RNA, 19 nt, Human
gaggcagccccauucugcc

SEQ ID NO: 2933745 - RNA, 18 nt, Human
gaggcagccccauucugc

SEQ ID NO: 2933746 - RNA, 14 nt, Human
gaggccaugggccu

SEQ ID NO: 2933747 - RNA, 17 nt, Human
gaggccaugggccuccu

SEQ ID NO: 2933748 - RNA, 18 nt, Human
gaggccaugggccuccug

SEQ ID NO: 2933749 - RNA, 20 nt, Human
gaggccaugggccuccugug

SEQ ID NO: 2933750 - RNA, 21 nt, Human
gaggccaugggccuccugugu

SEQ ID NO: 2933751 - RNA, 23 nt, Human
gaggccaugggccuccugugugu

SEQ ID NO: 2933752 - RNA, 20 nt, Human
gaggauugcuugagcucagg

SEQ ID NO: 2933753 - RNA, 22 nt, Human
gaggaucucuugagccugggag

SEQ ID NO: 2933754 - RNA, 19 nt, Human
gaggaucucuugagccugg

SEQ ID NO: 2933755 - RNA, 16 nt, Human
gaggaucucuugagcc

SEQ ID NO: 2933756 - RNA, 13 nt, Human
gaggaucucuuga

SEQ ID NO: 2933757 - RNA, 12 nt, Human
gagcccugucuc

SEQ ID NO: 2933758 - RNA, 12 nt, Human
gcaccauaacuu

SEQ ID NO: 2933759 - RNA, 19 nt, Human
gcaccuuagacagucccug

SEQ ID NO: 2933760 - RNA, 13 nt, Human
gcacgauuucugu

SEQ ID NO: 2933761 - RNA, 15 nt, Human
gcacgauuucuguuu

SEQ ID NO: 2933762 - RNA, 21 nt, Human
gcaccuuagacagucccugcc

SEQ ID NO: 2933763 - RNA, 20 nt, Human
gcaccuuagacagucccugc

SEQ ID NO: 2933764 - RNA, 16 nt, Human
gcacauuaaaugacuc

SEQ ID NO: 2933765 - RNA, 21 nt, Human
gcacauuaaaugacucuuccc

SEQ ID NO: 2933766 - RNA, 12 nt, Human
gcacauuaaaug

SEQ ID NO: 2933767 - RNA, 14 nt, Human
gcacauuaaaugac

SEQ ID NO: 2933768 - RNA, 22 nt, Human
gcacagaguuguuacauuuuua

SEQ ID NO: 2933769 - RNA, 16 nt, Human
gcacagaguuguuaca

SEQ ID NO: 2933770 - RNA, 18 nt, Human
gcacagaguuguuacauu

SEQ ID NO: 2933771 - RNA, 19 nt, Human
gcacagaguuguuacauuu

SEQ ID NO: 2933772 - RNA, 21 nt, Human
gcacagaguuguuacauuuuu

SEQ ID NO: 2933773 - RNA, 18 nt, Human
gcagaaggaagacuucau

SEQ ID NO: 2933774 - RNA, 13 nt, Human
gcagacaggcaag

SEQ ID NO: 2933775 - RNA, 14 nt, Human
gcagacaggcaagc

SEQ ID NO: 2933776 - RNA, 12 nt, Human
gcagacaggcaa

SEQ ID NO: 2933777 - RNA, 18 nt, Human
gcagacaggaccagggau

SEQ ID NO: 2933778 - RNA, 19 nt, Human
gcacuggcaaacagggccu

SEQ ID NO: 2933779 - RNA, 20 nt, Human
gcacuggcaaacagggccuc

SEQ ID NO: 2933780 - RNA, 22 nt, Human
gcacuggcaaacagggccucug

SEQ ID NO: 2933781 - RNA, 23 nt, Human
gcacuggcaaacagggccucugc

SEQ ID NO: 2933782 - RNA, 17 nt, Human
gcacuggcaaacagggc

SEQ ID NO: 2933783 - RNA, 22 nt, Human
gcacugcuuccagugaggcucu

SEQ ID NO: 2933784 - RNA, 23 nt, Human
gcacugcuuccagugaggcucug

SEQ ID NO: 2933785 - RNA, 18 nt, Human
gcacugacuucuaaguaa

SEQ ID NO: 2933786 - RNA, 15 nt, Human
gcacugacuucuaag

SEQ ID NO: 2933787 - RNA, 16 nt, Human
gcacgauuucuguuua

SEQ ID NO: 2933788 - RNA, 15 nt, Human
gcaauggcagccuug

SEQ ID NO: 2933789 - RNA, 13 nt, Human
gcaacucugaagg

SEQ ID NO: 2933790 - RNA, 14 nt, Human
gcaacucaucuuag

SEQ ID NO: 2933791 - RNA, 19 nt, Human
gcaauuaugaaaauaaucu

SEQ ID NO: 2933792 - RNA, 14 nt, Human
gcaauuaugaaaau

SEQ ID NO: 2933793 - RNA, 16 nt, Human
gcaauuaugaaaauaa

SEQ ID NO: 2933794 - RNA, 12 nt, Human
gcaauuaugaaa

SEQ ID NO: 2933795 - RNA, 14 nt, Human
gcaaugugauaaaa

SEQ ID NO: 2933796 - RNA, 16 nt, Human
gcacaaacagaggccg

SEQ ID NO: 2933797 - RNA, 15 nt, Human
gcacaaacagaggcc

SEQ ID NO: 2933798 - RNA, 14 nt, Human
gcacaaacagaggc

SEQ ID NO: 2933799 - RNA, 23 nt, Human
gcacagaaaauggaagacagcuc

SEQ ID NO: 2933800 - RNA, 22 nt, Human
gcacagaaaauggaagacagcu

SEQ ID NO: 2933801 - RNA, 21 nt, Human
gcacagaaaauggaagacagc

SEQ ID NO: 2933802 - RNA, 17 nt, Human
gcacagacccugcccug

SEQ ID NO: 2933803 - RNA, 16 nt, Human
gcacagacccugcccu

SEQ ID NO: 2933804 - RNA, 15 nt, Human
gcacagacccugccc

SEQ ID NO: 2933805 - RNA, 14 nt, Human
gcacagacccugcc

SEQ ID NO: 2933806 - RNA, 22 nt, Human
gcacagacccugcccugugggc

SEQ ID NO: 2933807 - RNA, 15 nt, Human
gcacagaguuguuac

SEQ ID NO: 2933808 - RNA, 21 nt, Human
gcacagacccugcccuguggg

SEQ ID NO: 2933809 - RNA, 20 nt, Human
gcacagacccugcccugugg

SEQ ID NO: 2933810 - RNA, 19 nt, Human
gcacagacccugcccugug

SEQ ID NO: 2933811 - RNA, 18 nt, Human
gcacagacccugcccugu

SEQ ID NO: 2933812 - RNA, 17 nt, Human
gcacaagcuccaagcuc

SEQ ID NO: 2933813 - RNA, 15 nt, Human
gcacaagcuccaagc

SEQ ID NO: 2933814 - RNA, 18 nt, Human
gcacaagcuccaagcucc

SEQ ID NO: 2933815 - RNA, 13 nt, Human
gcacacuggcuca

SEQ ID NO: 2933816 - RNA, 20 nt, Human
gcacaccgggcacucagaag

SEQ ID NO: 2933817 - RNA, 18 nt, Human
gcacacuuuggcccaggg

SEQ ID NO: 2933818 - RNA, 16 nt, Human
gcacacuuuggcccag

SEQ ID NO: 2933819 - RNA, 20 nt, Human
gcacagaaaauggaagacag

SEQ ID NO: 2933820 - RNA, 22 nt, Human
gcacacuggcucacccaguccu

SEQ ID NO: 2933821 - RNA, 19 nt, Human
gcacacuggcucacccagu

SEQ ID NO: 2933822 - RNA, 13 nt, Human
gcacacugucugc

SEQ ID NO: 2933823 - RNA, 19 nt, Human
gaugcccaaagaugcagcc

SEQ ID NO: 2933824 - RNA, 22 nt, Human
gaugccaugagccgcccaaggc

SEQ ID NO: 2933825 - RNA, 20 nt, Human
gaugcccaaagaugcagccg

SEQ ID NO: 2933826 - RNA, 18 nt, Human
gaugcuagaacucccuuu

SEQ ID NO: 2933827 - RNA, 20 nt, Human
gaugcuagaacucccuuuca

SEQ ID NO: 2933828 - RNA, 19 nt, Human
gaugggugcuuggaggaag

SEQ ID NO: 2933829 - RNA, 13 nt, Human
gauggggcugcac

SEQ ID NO: 2933830 - RNA, 15 nt, Human
gauggggcugcaccg

SEQ ID NO: 2933831 - RNA, 22 nt, Human
gauggccgggcgcgguggcuca

SEQ ID NO: 2933832 - RNA, 20 nt, Human
gaugggcaacccccagccug

SEQ ID NO: 2933833 - RNA, 21 nt, Human
gaugggcaacccccagccugc

SEQ ID NO: 2933834 - RNA, 24 nt, Human
gauggggcccugccuccuuuguga

SEQ ID NO: 2933835 - RNA, 14 nt, Human
gauggugcaaugac

SEQ ID NO: 2933836 - RNA, 12 nt, Human
gauggugcaaug

SEQ ID NO: 2933837 - RNA, 16 nt, Human
gauggugcaaugaccu

SEQ ID NO: 2933838 - RNA, 15 nt, Human
gauggugcaaugacc

SEQ ID NO: 2933839 - RNA, 17 nt, Human
gauggugcaaugaccuu

SEQ ID NO: 2933840 - RNA, 22 nt, Human
gauuacaagcgugagccacugc

SEQ ID NO: 2933841 - RNA, 15 nt, Human
gauuaaacuuaaucu

SEQ ID NO: 2933842 - RNA, 23 nt, Human
gauuacaagcgugagccacugca

SEQ ID NO: 2933843 - RNA, 16 nt, Human
gauguugcuaacagca

SEQ ID NO: 2933844 - RNA, 19 nt, Human
gauguugaaaaaguucugc

SEQ ID NO: 2933845 - RNA, 19 nt, Human
gauuuugauccaagcuggu

SEQ ID NO: 2933846 - RNA, 21 nt, Human
gauuuugaaauuuuuauuaaa

SEQ ID NO: 2933847 - RNA, 12 nt, Human
gcaaaccaucau

SEQ ID NO: 2933848 - RNA, 18 nt, Human
gcaaagaugaaggucugu

SEQ ID NO: 2933849 - RNA, 14 nt, Human
gcaaagaugaaggu

SEQ ID NO: 2933850 - RNA, 15 nt, Human
gcaaaccaucauuga

SEQ ID NO: 2933851 - RNA, 19 nt, Human
gcaaauguuuauuuaaaag

SEQ ID NO: 2933852 - RNA, 20 nt, Human
gcaaauguuuauuuaaaaga

SEQ ID NO: 2933853 - RNA, 17 nt, Human
gcaaauguuuauuuaaa

SEQ ID NO: 2933854 - RNA, 16 nt, Human
gcaaauugucacagga

SEQ ID NO: 2933855 - RNA, 12 nt, Human
gauuuaaaucag

SEQ ID NO: 2933856 - RNA, 13 nt, Human
gauuuaacagaaa

SEQ ID NO: 2933857 - RNA, 14 nt, Human
gauuuaacagaaau

SEQ ID NO: 2933858 - RNA, 15 nt, Human
gauuuaacagaaaug

SEQ ID NO: 2933859 - RNA, 22 nt, Human
gauuuccguuaaaauaccagcc

SEQ ID NO: 2933860 - RNA, 15 nt, Human
gauugccuuuuuaua

SEQ ID NO: 2933861 - RNA, 21 nt, Human
gauugccuuuuuauaacuuuu

SEQ ID NO: 2933862 - RNA, 22 nt, Human
gauugccuuuuuauaacuuuuu

SEQ ID NO: 2933863 - RNA, 14 nt, Human
gauucuccugccuc

SEQ ID NO: 2933864 - RNA, 21 nt, Human
gauucaaugccccugaauuua

SEQ ID NO: 2933865 - RNA, 19 nt, Human
gauucaaugccccugaauu

SEQ ID NO: 2933866 - RNA, 20 nt, Human
gauucaaugccccugaauuu

SEQ ID NO: 2933867 - RNA, 16 nt, Human
ggauucuuauggacaa

SEQ ID NO: 2933868 - RNA, 23 nt, Human
ggauuacaagcgugagccacugc

SEQ ID NO: 2933869 - RNA, 17 nt, Human
ggauugcuacuguccua

SEQ ID NO: 2933870 - RNA, 16 nt, Human
ggcaacccccagccug

SEQ ID NO: 2933871 - RNA, 17 nt, Human
ggcaacccccagccugc

SEQ ID NO: 2933872 - RNA, 15 nt, Human
ggauuguaaaauggu

SEQ ID NO: 2933873 - RNA, 14 nt, Human
ggcaaugcuggcug

SEQ ID NO: 2933874 - RNA, 15 nt, Human
ggcaaugcuggcugu

SEQ ID NO: 2933875 - RNA, 23 nt, Human
ggcaaugcuggcuguuggcuggg

SEQ ID NO: 2933876 - RNA, 18 nt, Human
ggcaacccccagccugcu

SEQ ID NO: 2933877 - RNA, 20 nt, Human
ggcacccaccaucaugucug

SEQ ID NO: 2933878 - RNA, 23 nt, Human
ggcacccaccaucaugucuggcu

SEQ ID NO: 2933879 - RNA, 22 nt, Human
ggcacccggccccugcugguuc

SEQ ID NO: 2933880 - RNA, 17 nt, Human
ggaucccucauccucau

SEQ ID NO: 2933881 - RNA, 13 nt, Human
ggaucccucaucc

SEQ ID NO: 2933882 - RNA, 22 nt, Human
ggaucccucauccucauaccca

SEQ ID NO: 2933883 - RNA, 14 nt, Human
ggagugcagugagc

SEQ ID NO: 2933884 - RNA, 12 nt, Human
ggagugcaguga

SEQ ID NO: 2933885 - RNA, 21 nt, Human
ggagaugccaugagccgccca

SEQ ID NO: 2933886 - RNA, 23 nt, Human
ggagugaguugauagcacagacc

SEQ ID NO: 2933887 - RNA, 18 nt, Human
ggauacaaaagcauguga

SEQ ID NO: 2933888 - RNA, 13 nt, Human
ggauacuuauuua

SEQ ID NO: 2933889 - RNA, 19 nt, Human
ggaugcagccucacagucc

SEQ ID NO: 2933890 - RNA, 17 nt, Human
ggaugcugcugccccug

SEQ ID NO: 2933891 - RNA, 15 nt, Human
ggaugcuuguacaua

SEQ ID NO: 2933892 - RNA, 19 nt, Human
ggauuacaagcgugagcca

SEQ ID NO: 2933893 - RNA, 17 nt, Human
ggaugcagccucacagu

SEQ ID NO: 2933894 - RNA, 16 nt, Human
ggaugcagccucacag

SEQ ID NO: 2933895 - RNA, 21 nt, Human
ggaugauuggaggggggaggu

SEQ ID NO: 2933896 - RNA, 23 nt, Human
ggaugcacagaguuguuacauuu

SEQ ID NO: 2933897 - RNA, 13 nt, Human
ggauccuccaggu

SEQ ID NO: 2933898 - RNA, 12 nt, Human
ggauccuccagg

SEQ ID NO: 2933899 - RNA, 15 nt, Human
ggcauggacuucugg

SEQ ID NO: 2933900 - RNA, 14 nt, Human
ggcauggacuucug

SEQ ID NO: 2933901 - RNA, 15 nt, Human
ggcaugaagacagau

SEQ ID NO: 2933902 - RNA, 18 nt, Human
ggcaugacacgaauauug

SEQ ID NO: 2933903 - RNA, 19 nt, Human
ggcagggucucacucuguc

SEQ ID NO: 2933904 - RNA, 20 nt, Human
ggcagggucucacucugucg

SEQ ID NO: 2933905 - RNA, 13 nt, Human
ggcagugggagcu

SEQ ID NO: 2933906 - RNA, 14 nt, Human
ggcagugggagcug

SEQ ID NO: 2933907 - RNA, 16 nt, Human
ggcagugggagcugcc

SEQ ID NO: 2933908 - RNA, 21 nt, Human
ggcagcucagagaggguggga

SEQ ID NO: 2933909 - RNA, 13 nt, Human
ggcagcucagaga

SEQ ID NO: 2933910 - RNA, 22 nt, Human
ggcagcugcuuuugucuauggg

SEQ ID NO: 2933911 - RNA, 17 nt, Human
ggcagcuugaggguugg

SEQ ID NO: 2933912 - RNA, 20 nt, Human
ggcaccuguagucccagcua

SEQ ID NO: 2933913 - RNA, 15 nt, Human
ggcacuauuuauuua

SEQ ID NO: 2933914 - RNA, 14 nt, Human
ggcagcucaccucu

SEQ ID NO: 2933915 - RNA, 12 nt, Human
ggcagcucaccu

SEQ ID NO: 2933916 - RNA, 20 nt, Human
ggccagccuugaccauucuc

SEQ ID NO: 2933917 - RNA, 17 nt, Human
ggccagcugcuugggcu

SEQ ID NO: 2933918 - RNA, 22 nt, Human
ggccagccuugaccauucucca

SEQ ID NO: 2933919 - RNA, 18 nt, Human
ggccaggcccucugccca

SEQ ID NO: 2933920 - RNA, 23 nt, Human
ggccagcugcuugggcuucaucc

SEQ ID NO: 2933921 - RNA, 16 nt, Human
ggccaugucagacaca

SEQ ID NO: 2933922 - RNA, 17 nt, Human
ggccaugucagacacag

SEQ ID NO: 2933923 - RNA, 16 nt, Human
ggccaugggccuccug

SEQ ID NO: 2933924 - RNA, 18 nt, Human
ggccaccgccuugcccag

SEQ ID NO: 2933925 - RNA, 16 nt, Human
ggccaccgccuugccc

SEQ ID NO: 2933926 - RNA, 16 nt, Human
ggcauuccccaggagg

SEQ ID NO: 2933927 - RNA, 19 nt, Human
ggcauuccccaggaggcca

SEQ ID NO: 2933928 - RNA, 18 nt, Human
ggcauuccccaggaggcc

SEQ ID NO: 2933929 - RNA, 14 nt, Human
ggcauggcugggaa

SEQ ID NO: 2933930 - RNA, 18 nt, Human
ggcaugggaaugaauguc

SEQ ID NO: 2933931 - RNA, 17 nt, Human
ggcauuccccaggaggc

SEQ ID NO: 2933932 - RNA, 22 nt, Human
ggcaugggaaugaaugucagug

SEQ ID NO: 2933933 - RNA, 23 nt, Human
ggccuagcauacguacacauuuu

SEQ ID NO: 2933934 - RNA, 17 nt, Human
ggccucuuaugggcugg

SEQ ID NO: 2933935 - RNA, 18 nt, Human
ggccucuuaugggcuggg

SEQ ID NO: 2933936 - RNA, 16 nt, Human
ggccucugcacucccc

SEQ ID NO: 2933937 - RNA, 15 nt, Human
ggccucugcacuccc

SEQ ID NO: 2933938 - RNA, 14 nt, Human
ggccucugcacucc

SEQ ID NO: 2933939 - RNA, 13 nt, Human
ggccucugcacuc

SEQ ID NO: 2933940 - RNA, 11 nt, Human
ggcccagagag

SEQ ID NO: 2933941 - RNA, 17 nt, Human
ggcccucugcccacucc

SEQ ID NO: 2933942 - RNA, 16 nt, Human
ggcccucugcccacuc

SEQ ID NO: 2933943 - RNA, 15 nt, Human
ggcccucugcccacu

SEQ ID NO: 2933944 - RNA, 13 nt, Human
ggcccucugccca

SEQ ID NO: 2933945 - RNA, 20 nt, Human
ggcccucugcccacucccug

SEQ ID NO: 2933946 - RNA, 19 nt, Human
ggcccucugcccacucccu

SEQ ID NO: 2933947 - RNA, 21 nt, Human
ggcccucugcccacucccugc

SEQ ID NO: 2933948 - RNA, 15 nt, Human
ggcccugccuccuuu

SEQ ID NO: 2933949 - RNA, 14 nt, Human
ggcccugccuccuu

SEQ ID NO: 2933950 - RNA, 13 nt, Human
ggcccugccuccu

SEQ ID NO: 2933951 - RNA, 15 nt, Human
ggcuaugcauuugaa

SEQ ID NO: 2933952 - RNA, 14 nt, Human
ggcuaugcauuuga

SEQ ID NO: 2933953 - RNA, 16 nt, Human
ggcuaguugggcuucc

SEQ ID NO: 2933954 - RNA, 15 nt, Human
ggcuaguugggcuuc

SEQ ID NO: 2933955 - RNA, 23 nt, Human
ggcuagugugguguuuccuggca

SEQ ID NO: 2933956 - RNA, 22 nt, Human
ggcuaggaccccuccauguggg

SEQ ID NO: 2933957 - RNA, 16 nt, Human
ggcuaggaccccucca

SEQ ID NO: 2933958 - RNA, 22 nt, Human
ggcuagagguucaaagauauuu

SEQ ID NO: 2933959 - RNA, 17 nt, Human
ggcuagagguucaaaga

SEQ ID NO: 2933960 - RNA, 16 nt, Human
ggcuagagguucaaag

SEQ ID NO: 2933961 - RNA, 15 nt, Human
ggcucaaguccucuu

SEQ ID NO: 2933962 - RNA, 21 nt, Human
ggcucaaguccucuuuucuga

SEQ ID NO: 2933963 - RNA, 12 nt, Human
ggcuccaggagc

SEQ ID NO: 2933964 - RNA, 19 nt, Human
ggcuccaggagcagccaca

SEQ ID NO: 2933965 - RNA, 13 nt, Human
ggcuccaggagca

SEQ ID NO: 2933966 - RNA, 15 nt, Human
ggcuccaggcuccuu

SEQ ID NO: 2933967 - RNA, 11 nt, Human
ggcuccaggcu

SEQ ID NO: 2933968 - RNA, 18 nt, Human
ggcuccaggagcagccac

SEQ ID NO: 2933969 - RNA, 16 nt, Human
ggcuccaggcuccuuu

SEQ ID NO: 2933970 - RNA, 20 nt, Human
ggcggaccuuguagugagcc

SEQ ID NO: 2933971 - RNA, 21 nt, Human
ggcggaccuuguagugagccg

SEQ ID NO: 2933972 - RNA, 23 nt, Human
ggcgcugccccuggcagccccug

SEQ ID NO: 2933973 - RNA, 21 nt, Human
ggcgcugccccuggcagcccc

SEQ ID NO: 2933974 - RNA, 19 nt, Human
ggcgcugccccuggcagcc

SEQ ID NO: 2933975 - RNA, 18 nt, Human
ggcgcugccccuggcagc

SEQ ID NO: 2933976 - RNA, 19 nt, Human
ggccuggccugagcuggga

SEQ ID NO: 2933977 - RNA, 20 nt, Human
ggccugucagcuaaagaagu

SEQ ID NO: 2933978 - RNA, 14 nt, Human
ggccugggggcugg

SEQ ID NO: 2933979 - RNA, 22 nt, Human
ggccugggggcugggcagagga

SEQ ID NO: 2933980 - RNA, 20 nt, Human
ggccugggggcugggcagag

SEQ ID NO: 2933981 - RNA, 15 nt, Human
ggagaaucacuugaa

SEQ ID NO: 2933982 - RNA, 19 nt, Human
ggagaaucacuugaacccg

SEQ ID NO: 2933983 - RNA, 18 nt, Human
ggagaagcggcuggcagc

SEQ ID NO: 2933984 - RNA, 17 nt, Human
ggagaagcggcuggcag

SEQ ID NO: 2933985 - RNA, 13 nt, Human
ggacgcucucugg

SEQ ID NO: 2933986 - RNA, 14 nt, Human
ggacgcucucuggc

SEQ ID NO: 2933987 - RNA, 13 nt, Human
ggaccagagcugc

SEQ ID NO: 2933988 - RNA, 23 nt, Human
ggaccucaggugagaagcagagg

SEQ ID NO: 2933989 - RNA, 20 nt, Human
ggaccucaggccugggggcu

SEQ ID NO: 2933990 - RNA, 19 nt, Human
ggaccucaggugagaagca

SEQ ID NO: 2933991 - RNA, 15 nt, Human
ggaccuugaacuggg

SEQ ID NO: 2933992 - RNA, 17 nt, Human
ggaccuugaacugggua

SEQ ID NO: 2933993 - RNA, 17 nt, Human
ggacgcuacccgggaag

SEQ ID NO: 2933994 - RNA, 20 nt, Human
ggacgcuacccgggaagggg

SEQ ID NO: 2933995 - RNA, 19 nt, Human
ggacgcuacccgggaaggg

SEQ ID NO: 2933996 - RNA, 17 nt, Human
ggacacucaaaagcugg

SEQ ID NO: 2933997 - RNA, 15 nt, Human
ggacagccacggcca

SEQ ID NO: 2933998 - RNA, 19 nt, Human
ggacagccacggccaggcc

SEQ ID NO: 2933999 - RNA, 20 nt, Human
ggacagccacggccaggcca

SEQ ID NO: 2934000 - RNA, 21 nt, Human
ggacagccacggccaggccag

SEQ ID NO: 2934001 - RNA, 14 nt, Human
ggacauggacaagg

SEQ ID NO: 2934002 - RNA, 20 nt, Human
ggacauugcggacagccacg

SEQ ID NO: 2934003 - RNA, 23 nt, Human
ggaaggggagauaaggguaucug

SEQ ID NO: 2934004 - RNA, 18 nt, Human
ggaaguacuggagaaaau

SEQ ID NO: 2934005 - RNA, 16 nt, Human
ggaaguacuggagaaa

SEQ ID NO: 2934006 - RNA, 12 nt, Human
ggaaguacugga

SEQ ID NO: 2934007 - RNA, 14 nt, Human
ggaaugauuaauua

SEQ ID NO: 2934008 - RNA, 20 nt, Human
ggaagugacgguuuaauggg

SEQ ID NO: 2934009 - RNA, 13 nt, Human
ggaaugcaaagau

SEQ ID NO: 2934010 - RNA, 12 nt, Human
ggaaugcagugg

SEQ ID NO: 2934011 - RNA, 24 nt, Human
ggaaugauuaauuaaaacacaaca

SEQ ID NO: 2934012 - RNA, 19 nt, Human
ggaauguuugccucugccu

SEQ ID NO: 2934013 - RNA, 16 nt, Human
ggacaaaauggaauac

SEQ ID NO: 2934014 - RNA, 17 nt, Human
ggacaaaauggaauacu

SEQ ID NO: 2934015 - RNA, 16 nt, Human
ggaauuggagcucgug

SEQ ID NO: 2934016 - RNA, 22 nt, Human
ggaauuggagcucgugggacag

SEQ ID NO: 2934017 - RNA, 23 nt, Human
ggaauuucucccagucauuuaau

SEQ ID NO: 2934018 - RNA, 23 nt, Human
ggaaagggauuuucagcccucag

SEQ ID NO: 2934019 - RNA, 22 nt, Human
ggaaaggcuccaggagcagcca

SEQ ID NO: 2934020 - RNA, 21 nt, Human
ggaaaggcuccaggagcagcc

SEQ ID NO: 2934021 - RNA, 20 nt, Human
ggaaaggcuccaggagcagc

SEQ ID NO: 2934022 - RNA, 19 nt, Human
ggaaaggcuccaggagcag

SEQ ID NO: 2934023 - RNA, 17 nt, Human
ggaaaggcuccaggagc

SEQ ID NO: 2934024 - RNA, 12 nt, Human
ggaaaggcucca

SEQ ID NO: 2934025 - RNA, 14 nt, Human
ggaaaggcuccagg

SEQ ID NO: 2934026 - RNA, 13 nt, Human
ggaaaggcuccag

SEQ ID NO: 2934027 - RNA, 19 nt, Human
ggaaaaucagccugcucca

SEQ ID NO: 2934028 - RNA, 23 nt, Human
ggaaaaucagccugcuccagcug

SEQ ID NO: 2934029 - RNA, 16 nt, Human
ggaaaucaaauaugca

SEQ ID NO: 2934030 - RNA, 21 nt, Human
ggaaaucaccgaaaacguggc

SEQ ID NO: 2934031 - RNA, 17 nt, Human
ggaaaucaaauaugcaa

SEQ ID NO: 2934032 - RNA, 14 nt, Human
ggaaaucaccgaaa

SEQ ID NO: 2934033 - RNA, 16 nt, Human
ggaacaggaaacugau

SEQ ID NO: 2934034 - RNA, 18 nt, Human
gcuugaggguugggcugg

SEQ ID NO: 2934035 - RNA, 20 nt, Human
gcuugaggguugggcuggug

SEQ ID NO: 2934036 - RNA, 15 nt, Human
gcuuugugauuuuug

SEQ ID NO: 2934037 - RNA, 21 nt, Human
gcuuuguuuguugucagcuga

SEQ ID NO: 2934038 - RNA, 18 nt, Human
ggaaaacaugcuacacac

SEQ ID NO: 2934039 - RNA, 14 nt, Human
ggaaaagcugcuga

SEQ ID NO: 2934040 - RNA, 18 nt, Human
ggaaaagcugcugacagu

SEQ ID NO: 2934041 - RNA, 20 nt, Human
ggaaaagcugcugacagugu

SEQ ID NO: 2934042 - RNA, 21 nt, Human
gcuuaggagaagucuucuauu

SEQ ID NO: 2934043 - RNA, 17 nt, Human
gcuuagucacugagaca

SEQ ID NO: 2934044 - RNA, 15 nt, Human
gcuuagucacugaga

SEQ ID NO: 2934045 - RNA, 20 nt, Human
gcuuagucacugagacagcc

SEQ ID NO: 2934046 - RNA, 19 nt, Human
gcuuagucacugagacagc

SEQ ID NO: 2934047 - RNA, 21 nt, Human
gcuuagucacugagacagccc

SEQ ID NO: 2934048 - RNA, 21 nt, Human
gcuguucaugaaagauucaau

SEQ ID NO: 2934049 - RNA, 12 nt, Human
gcuguucaugaa

SEQ ID NO: 2934050 - RNA, 13 nt, Human
gcuguucagcugg

SEQ ID NO: 2934051 - RNA, 14 nt, Human
gcuguucagcuggu

SEQ ID NO: 2934052 - RNA, 23 nt, Human
gcugccaauauccuaauaaaaag

SEQ ID NO: 2934053 - RNA, 20 nt, Human
gcugucuacacuaagagaga

SEQ ID NO: 2934054 - RNA, 21 nt, Human
gcugccaauauccuaauaaaa

SEQ ID NO: 2934055 - RNA, 20 nt, Human
gcugccaauauccuaauaaa

SEQ ID NO: 2934056 - RNA, 15 nt, Human
gcugccaaugggagc

SEQ ID NO: 2934057 - RNA, 19 nt, Human
gcugccaaugggagcucau

SEQ ID NO: 2934058 - RNA, 16 nt, Human
gcugccaaugggagcu

SEQ ID NO: 2934059 - RNA, 16 nt, Human
gcuucaguggcagcug

SEQ ID NO: 2934060 - RNA, 15 nt, Human
gcuucaguggcagcu

SEQ ID NO: 2934061 - RNA, 19 nt, Human
gcuuaucucaggggugugc

SEQ ID NO: 2934062 - RNA, 13 nt, Human
gcuuaucucaggg

SEQ ID NO: 2934063 - RNA, 12 nt, Human
gcuuauacacuu

SEQ ID NO: 2934064 - RNA, 17 nt, Human
gcuucaguggcagcugc

SEQ ID NO: 2934065 - RNA, 18 nt, Human
gcuucaguggcagcugcu

SEQ ID NO: 2934066 - RNA, 13 nt, Human
gcuucauuuccug

SEQ ID NO: 2934067 - RNA, 16 nt, Human
gcuucauuuccugugu

SEQ ID NO: 2934068 - RNA, 15 nt, Human
gcuucauccuccuca

SEQ ID NO: 2934069 - RNA, 12 nt, Human
gcuucauccucc

SEQ ID NO: 2934070 - RNA, 22 nt, Human
gcuucucccccacccccuaggg

SEQ ID NO: 2934071 - RNA, 16 nt, Human
gcuugaggguugggcu

SEQ ID NO: 2934072 - RNA, 15 nt, Human
gcuuccagugaggcu

SEQ ID NO: 2934073 - RNA, 17 nt, Human
gcuucauuuccuguguc

SEQ ID NO: 2934074 - RNA, 16 nt, Human
gcuuccagugaggcuc

SEQ ID NO: 2934075 - RNA, 16 nt, Human
gcccggcuccaggcuc

SEQ ID NO: 2934076 - RNA, 13 nt, Human
gccccugccaccc

SEQ ID NO: 2934077 - RNA, 14 nt, Human
gccccugccacccu

SEQ ID NO: 2934078 - RNA, 15 nt, Human
gccccugccacccug

SEQ ID NO: 2934079 - RNA, 17 nt, Human
gccccuguucuggcaga

SEQ ID NO: 2934080 - RNA, 21 nt, Human
gccccuguucuggcagaguug

SEQ ID NO: 2934081 - RNA, 15 nt, Human
gcagacucuacagag

SEQ ID NO: 2934082 - RNA, 17 nt, Human
gcccggcuccaggcucc

SEQ ID NO: 2934083 - RNA, 18 nt, Human
gcccggcuccaggcuccu

SEQ ID NO: 2934084 - RNA, 14 nt, Human
gcccugagcuuucu

SEQ ID NO: 2934085 - RNA, 16 nt, Human
gcccugagcuuucugc

SEQ ID NO: 2934086 - RNA, 12 nt, Human
gcccucugccca

SEQ ID NO: 2934087 - RNA, 22 nt, Human
gcccucuccugggcagcugccu

SEQ ID NO: 2934088 - RNA, 23 nt, Human
gcccucuccugggcagcugccuc

SEQ ID NO: 2934089 - RNA, 12 nt, Human
gcccucuccugg

SEQ ID NO: 2934090 - RNA, 13 nt, Human
gcccucuccuggg

SEQ ID NO: 2934091 - RNA, 22 nt, Human
gcccuucucuccagccccugga

SEQ ID NO: 2934092 - RNA, 21 nt, Human
gcccuucucuccagccccugg

SEQ ID NO: 2934093 - RNA, 19 nt, Human
gcccuucucuccagccccu

SEQ ID NO: 2934094 - RNA, 18 nt, Human
gccgagaucacgccacug

SEQ ID NO: 2934095 - RNA, 19 nt, Human
gccgagaucacgccacugc

SEQ ID NO: 2934096 - RNA, 17 nt, Human
gccgagauugcaccacu

SEQ ID NO: 2934097 - RNA, 18 nt, Human
gccgagauugcaccacug

SEQ ID NO: 2934098 - RNA, 16 nt, Human
gccgagaucacgccac

SEQ ID NO: 2934099 - RNA, 14 nt, Human
gcccuuuuucaaua

SEQ ID NO: 2934100 - RNA, 14 nt, Human
gcccugguggcagu

SEQ ID NO: 2934101 - RNA, 17 nt, Human
gcccugguggcaguggg

SEQ ID NO: 2934102 - RNA, 18 nt, Human
gcccugguggcaguggga

SEQ ID NO: 2934103 - RNA, 19 nt, Human
gcccugguggcagugggag

SEQ ID NO: 2934104 - RNA, 20 nt, Human
gcccugguggcagugggagc

SEQ ID NO: 2934105 - RNA, 21 nt, Human
gcccugguggcagugggagcu

SEQ ID NO: 2934106 - RNA, 22 nt, Human
gcccugguggcagugggagcug

SEQ ID NO: 2934107 - RNA, 23 nt, Human
gcccugguggcagugggagcugc

SEQ ID NO: 2934108 - RNA, 20 nt, Human
gccugggggcugggcagagg

SEQ ID NO: 2934109 - RNA, 17 nt, Human
gccugggcagaaggaag

SEQ ID NO: 2934110 - RNA, 16 nt, Human
gccugggcagaaggaa

SEQ ID NO: 2934111 - RNA, 18 nt, Human
gccugggcagaaggaaga

SEQ ID NO: 2934112 - RNA, 15 nt, Human
gccugggcagaagga

SEQ ID NO: 2934113 - RNA, 14 nt, Human
gccuggccagaugc

SEQ ID NO: 2934114 - RNA, 15 nt, Human
gccuggccagaugca

SEQ ID NO: 2934115 - RNA, 22 nt, Human
gccuggccagaugcaccagccc

SEQ ID NO: 2934116 - RNA, 14 nt, Human
gccuggauggggcu

SEQ ID NO: 2934117 - RNA, 15 nt, Human
gccuggauggggcug

SEQ ID NO: 2934118 - RNA, 19 nt, Human
gccucugcggagcacacug

SEQ ID NO: 2934119 - RNA, 21 nt, Human
gccucugcggagcacacuggc

SEQ ID NO: 2934120 - RNA, 24 nt, Human
gccucugcggagcacacuggcuca

SEQ ID NO: 2934121 - RNA, 22 nt, Human
gccugaagucacacagugaguc

SEQ ID NO: 2934122 - RNA, 18 nt, Human
gccucugccucugacaca

SEQ ID NO: 2934123 - RNA, 18 nt, Human
gccugcuccagcuguuca

SEQ ID NO: 2934124 - RNA, 16 nt, Human
gccugcuccagcuguu

SEQ ID NO: 2934125 - RNA, 15 nt, Human
gccugcuccagcugu

SEQ ID NO: 2934126 - RNA, 12 nt, Human
gccucagugcca

SEQ ID NO: 2934127 - RNA, 14 nt, Human
gccucagugccacu

SEQ ID NO: 2934128 - RNA, 23 nt, Human
gccucagccucccaaagugcugg

SEQ ID NO: 2934129 - RNA, 21 nt, Human
gccucacaguccuuaccagca

SEQ ID NO: 2934130 - RNA, 14 nt, Human
gccucaaccuccug

SEQ ID NO: 2934131 - RNA, 16 nt, Human
gccucaaccuccuggg

SEQ ID NO: 2934132 - RNA, 19 nt, Human
gccucaagugauucuccug

SEQ ID NO: 2934133 - RNA, 20 nt, Human
gccucaagugauucuccugc

SEQ ID NO: 2934134 - RNA, 21 nt, Human
gccucaagugauucuccugcc

SEQ ID NO: 2934135 - RNA, 17 nt, Human
gccuaagugcagccccg

SEQ ID NO: 2934136 - RNA, 19 nt, Human
gccgagauagccaaggcca

SEQ ID NO: 2934137 - RNA, 18 nt, Human
gcccuuuuucaauaacug

SEQ ID NO: 2934138 - RNA, 18 nt, Human
gccuaauaugaugacugu

SEQ ID NO: 2934139 - RNA, 22 nt, Human
gccuauauuuuuuguuaaauga

SEQ ID NO: 2934140 - RNA, 17 nt, Human
gccucucccugcugcuc

SEQ ID NO: 2934141 - RNA, 22 nt, Human
gccucucccugcugcuccuagg

SEQ ID NO: 2934142 - RNA, 18 nt, Human
gccucucccugcugcucc

SEQ ID NO: 2934143 - RNA, 19 nt, Human
gccucucccugcugcuccu

SEQ ID NO: 2934144 - RNA, 20 nt, Human
gccucucccugcugcuccua

SEQ ID NO: 2934145 - RNA, 21 nt, Human
gccucucccugcugcuccuag

SEQ ID NO: 2934146 - RNA, 23 nt, Human
gccucccgaauagcugggacuac

SEQ ID NO: 2934147 - RNA, 15 nt, Human
gccucccgaguagcu

SEQ ID NO: 2934148 - RNA, 15 nt, Human
gccucagugccacua

SEQ ID NO: 2934149 - RNA, 21 nt, Human
gccucccaacucaccccagcc

SEQ ID NO: 2934150 - RNA, 23 nt, Human
gccucccaacucaccccagcccc

SEQ ID NO: 2934151 - RNA, 22 nt, Human
gccucccaacucaccccagccc

SEQ ID NO: 2934152 - RNA, 21 nt, Human
gccucccgaauagcugggacu

SEQ ID NO: 2934153 - RNA, 14 nt, Human
gccucccacgacug

SEQ ID NO: 2934154 - RNA, 23 nt, Human
gccuccccuccucugcuugccau

SEQ ID NO: 2934155 - RNA, 21 nt, Human
gccucccacgacugcccggca

SEQ ID NO: 2934156 - RNA, 16 nt, Human
gcuaaaugugaaugau

SEQ ID NO: 2934157 - RNA, 13 nt, Human
gcuaaaugugaau

SEQ ID NO: 2934158 - RNA, 19 nt, Human
gcuaacacggugaaacccg

SEQ ID NO: 2934159 - RNA, 22 nt, Human
gcuaagagggagggagggcucc

SEQ ID NO: 2934160 - RNA, 21 nt, Human
gcuaagagggagggagggcuc

SEQ ID NO: 2934161 - RNA, 20 nt, Human
gcgugaacccaggaggcgga

SEQ ID NO: 2934162 - RNA, 16 nt, Human
gcgugagccacugcac

SEQ ID NO: 2934163 - RNA, 18 nt, Human
gcgugagccacugcaccg

SEQ ID NO: 2934164 - RNA, 23 nt, Human
gcgugagccacugcaccgggcca

SEQ ID NO: 2934165 - RNA, 18 nt, Human
gcgguccacccaggagcc

SEQ ID NO: 2934166 - RNA, 19 nt, Human
gcgguccacccaggagccc

SEQ ID NO: 2934167 - RNA, 12 nt, Human
gcggggacagcu

SEQ ID NO: 2934168 - RNA, 15 nt, Human
gcgggcuuccuccug

SEQ ID NO: 2934169 - RNA, 13 nt, Human
gcggggacagcuc

SEQ ID NO: 2934170 - RNA, 16 nt, Human
gcgguccacccaggag

SEQ ID NO: 2934171 - RNA, 15 nt, Human
gcuaucucccccagc

SEQ ID NO: 2934172 - RNA, 23 nt, Human
gcuaucucccccagccccauccu

SEQ ID NO: 2934173 - RNA, 22 nt, Human
gcuaucucccccagccccaucc

SEQ ID NO: 2934174 - RNA, 21 nt, Human
gcuaucucccccagccccauc

SEQ ID NO: 2934175 - RNA, 20 nt, Human
gcuaucucccccagccccau

SEQ ID NO: 2934176 - RNA, 19 nt, Human
gcuaucucccccagcccca

SEQ ID NO: 2934177 - RNA, 22 nt, Human
gcuagcagcagggagggcuucu

SEQ ID NO: 2934178 - RNA, 18 nt, Human
gcuaucucccccagcccc

SEQ ID NO: 2934179 - RNA, 17 nt, Human
gcuaucucccccagccc

SEQ ID NO: 2934180 - RNA, 16 nt, Human
gcuaucucccccagcc

SEQ ID NO: 2934181 - RNA, 21 nt, Human
gcuacccgggaagggggcugg

SEQ ID NO: 2934182 - RNA, 19 nt, Human
gcuagagguucaaagauau

SEQ ID NO: 2934183 - RNA, 21 nt, Human
gcuagagguucaaagauauuu

SEQ ID NO: 2934184 - RNA, 18 nt, Human
gcuagagguucaaagaua

SEQ ID NO: 2934185 - RNA, 15 nt, Human
gcuacccgggaaggg

SEQ ID NO: 2934186 - RNA, 14 nt, Human
gcuacccgggaagg

SEQ ID NO: 2934187 - RNA, 14 nt, Human
gcuaagcauuccaa

SEQ ID NO: 2934188 - RNA, 17 nt, Human
gcuaagcaaaaugugau

SEQ ID NO: 2934189 - RNA, 23 nt, Human
gcuaagagggagggagggcucca

SEQ ID NO: 2934190 - RNA, 13 nt, Human
gcuccaagcuccc

SEQ ID NO: 2934191 - RNA, 15 nt, Human
gcuccaagcucccag

SEQ ID NO: 2934192 - RNA, 14 nt, Human
gcuccaagcuccca

SEQ ID NO: 2934193 - RNA, 14 nt, Human
gcuccaagaauuuc

SEQ ID NO: 2934194 - RNA, 21 nt, Human
gcuccaagcucccaggcauuc

SEQ ID NO: 2934195 - RNA, 19 nt, Human
gcuccaagcucccaggcau

SEQ ID NO: 2934196 - RNA, 18 nt, Human
gcuccaagcucccaggca

SEQ ID NO: 2934197 - RNA, 17 nt, Human
gcuccaagcucccaggc

SEQ ID NO: 2934198 - RNA, 16 nt, Human
gcuccaagcucccagg

SEQ ID NO: 2934199 - RNA, 17 nt, Human
gcuccauccuccuggga

SEQ ID NO: 2934200 - RNA, 13 nt, Human
gcuccaggcuccu

SEQ ID NO: 2934201 - RNA, 11 nt, Human
gcuccagcugu

SEQ ID NO: 2934202 - RNA, 16 nt, Human
gcuccaggcuccuuua

SEQ ID NO: 2934203 - RNA, 23 nt, Human
gcuccaggcuccuuuagcgccca

SEQ ID NO: 2934204 - RNA, 15 nt, Human
gcucacccaguccug

SEQ ID NO: 2934205 - RNA, 17 nt, Human
gcucaccccaucauccc

SEQ ID NO: 2934206 - RNA, 19 nt, Human
gcucaccccaucaucccuu

SEQ ID NO: 2934207 - RNA, 20 nt, Human
gcucaccagccccagugccc

SEQ ID NO: 2934208 - RNA, 23 nt, Human
gcucaccagccccagugcccaca

SEQ ID NO: 2934209 - RNA, 18 nt, Human
gcucaccagccccagugc

SEQ ID NO: 2934210 - RNA, 19 nt, Human
gcucaccagccccagugcc

SEQ ID NO: 2934211 - RNA, 23 nt, Human
gcucagcaaaagaugcuucucac

SEQ ID NO: 2934212 - RNA, 22 nt, Human
gcucagcaaaagaugcuucuca

SEQ ID NO: 2934213 - RNA, 20 nt, Human
gcucagcaaaagaugcuucu

SEQ ID NO: 2934214 - RNA, 17 nt, Human
gcucagcaaaagaugcu

SEQ ID NO: 2934215 - RNA, 19 nt, Human
gcucaggugucccugcacu

SEQ ID NO: 2934216 - RNA, 21 nt, Human
gcucagcggggacagcuccuu

SEQ ID NO: 2934217 - RNA, 22 nt, Human
gcucagcggggacagcuccuuc

SEQ ID NO: 2934218 - RNA, 18 nt, Human
gcucaggugucccugcac

SEQ ID NO: 2934219 - RNA, 17 nt, Human
gcucaggugucccugca

SEQ ID NO: 2934220 - RNA, 20 nt, Human
gcucagcggggacagcuccu

SEQ ID NO: 2934221 - RNA, 19 nt, Human
gcucagcggggacagcucc

SEQ ID NO: 2934222 - RNA, 15 nt, Human
gcucagcggggacag

SEQ ID NO: 2934223 - RNA, 21 nt, Human
gcugacagacacaggcccggc

SEQ ID NO: 2934224 - RNA, 20 nt, Human
gcugacagacacaggcccgg

SEQ ID NO: 2934225 - RNA, 22 nt, Human
gcucuuccaggcugggagagcc

SEQ ID NO: 2934226 - RNA, 12 nt, Human
gcucuucuccag

SEQ ID NO: 2934227 - RNA, 18 nt, Human
gcucuuccaggcugggag

SEQ ID NO: 2934228 - RNA, 19 nt, Human
gcucuuccaggcugggaga

SEQ ID NO: 2934229 - RNA, 14 nt, Human
gcucuucuccaggc

SEQ ID NO: 2934230 - RNA, 16 nt, Human
gcucuucuccaggcug

SEQ ID NO: 2934231 - RNA, 23 nt, Human
gcugagugggggaucacagccuc

SEQ ID NO: 2934232 - RNA, 22 nt, Human
gcugagugggggaucacagccu

SEQ ID NO: 2934233 - RNA, 16 nt, Human
gcugauggugcaauga

SEQ ID NO: 2934234 - RNA, 15 nt, Human
gcugauggugcaaug

SEQ ID NO: 2934235 - RNA, 15 nt, Human
gcugagucugaaggc

SEQ ID NO: 2934236 - RNA, 18 nt, Human
gcugagucugaaggcugg

SEQ ID NO: 2934237 - RNA, 16 nt, Human
gcugagucugaaggcu

SEQ ID NO: 2934238 - RNA, 19 nt, Human
gcugagucugaaggcuggg

SEQ ID NO: 2934239 - RNA, 21 nt, Human
gcugauggugcaaugaccuuu

SEQ ID NO: 2934240 - RNA, 18 nt, Human
gcugauggugcaaugacc

SEQ ID NO: 2934241 - RNA, 20 nt, Human
gcugcaguugccagucaccc

SEQ ID NO: 2934242 - RNA, 18 nt, Human
gcugcaguugccagucac

SEQ ID NO: 2934243 - RNA, 21 nt, Human
gcugcaguugccagucacccc

SEQ ID NO: 2934244 - RNA, 13 nt, Human
gcugcaguuuuuu

SEQ ID NO: 2934245 - RNA, 15 nt, Human
gcugccaauauccua

SEQ ID NO: 2934246 - RNA, 14 nt, Human
gcugccaauauccu

SEQ ID NO: 2934247 - RNA, 19 nt, Human
gcugccaauauccuaauaa

SEQ ID NO: 2934248 - RNA, 18 nt, Human
gcugccaauauccuaaua

SEQ ID NO: 2934249 - RNA, 17 nt, Human
gcugccaauauccuaau

SEQ ID NO: 2934250 - RNA, 16 nt, Human
gcugccaauauccuaa

SEQ ID NO: 2934251 - RNA, 14 nt, Human
gcucuggacaggca

SEQ ID NO: 2934252 - RNA, 15 nt, Human
gcucuggacaggcau

SEQ ID NO: 2934253 - RNA, 16 nt, Human
gcucuggacaggcaug

SEQ ID NO: 2934254 - RNA, 21 nt, Human
gcucuggacaggcauguucuc

SEQ ID NO: 2934255 - RNA, 22 nt, Human
gcucuggacaggcauguucucu

SEQ ID NO: 2934256 - RNA, 19 nt, Human
gcucugcuccucuccccag

SEQ ID NO: 2934257 - RNA, 21 nt, Human
gcucugcuccucuccccagca

SEQ ID NO: 2934258 - RNA, 13 nt, Human
gcucugcugacag

SEQ ID NO: 2934259 - RNA, 14 nt, Human
gcucugcugacaga

SEQ ID NO: 2934260 - RNA, 18 nt, Human
gcucugcugacagacaca

SEQ ID NO: 2934261 - RNA, 19 nt, Human
gcucugcugacagacacag

SEQ ID NO: 2934262 - RNA, 20 nt, Human
gcucugcugacagacacagg

SEQ ID NO: 2934263 - RNA, 23 nt, Human
gcucugcugacagacacaggccc

SEQ ID NO: 2934264 - RNA, 13 nt, Human
gcucugcuccucu

SEQ ID NO: 2934265 - RNA, 14 nt, Human
gcucugcuccucuc

SEQ ID NO: 2934266 - RNA, 22 nt, Human
gcucugccucccaucacccgcu

SEQ ID NO: 2934267 - RNA, 15 nt, Human
gcucugccucccauc

SEQ ID NO: 2934268 - RNA, 14 nt, Human
gcucugccucccau

SEQ ID NO: 2934269 - RNA, 13 nt, Human
gcucugccuccca

SEQ ID NO: 2934270 - RNA, 14 nt, Human
gcucugcccuuggu

SEQ ID NO: 2934271 - RNA, 11 nt, Human
gcucugccucc

SEQ ID NO: 2934272 - RNA, 23 nt, Human
gcucugcccuugguuaggcauug

SEQ ID NO: 2934273 - RNA, 14 nt, Human
gcucucuggccuuc

SEQ ID NO: 2934274 - RNA, 15 nt, Human
gcucucuggccuucg

SEQ ID NO: 2934275 - RNA, 19 nt, Human
gcucucuggccuucggccu

SEQ ID NO: 2934276 - RNA, 20 nt, Human
gcucucuggccuucggccuc

SEQ ID NO: 2934277 - RNA, 16 nt, Human
gcucgagcaugccugg

SEQ ID NO: 2934278 - RNA, 15 nt, Human
gcucccuucccaccu

SEQ ID NO: 2934279 - RNA, 18 nt, Human
gcucccuucccaccucuc

SEQ ID NO: 2934280 - RNA, 16 nt, Human
gcucccuucccaccuc

SEQ ID NO: 2934281 - RNA, 15 nt, Human
gcuccuucuguccua

SEQ ID NO: 2934282 - RNA, 19 nt, Human
gcucccuucccaccucucu

SEQ ID NO: 2934283 - RNA, 21 nt, Human
gcuccuucuguccuacucugu

SEQ ID NO: 2934284 - RNA, 19 nt, Human
gcucuccgaccagacaccu

SEQ ID NO: 2934285 - RNA, 13 nt, Human
gcucuccgaccag

SEQ ID NO: 2934286 - RNA, 17 nt, Human
gcucuccgaccagacac

SEQ ID NO: 2934287 - RNA, 12 nt, Human
gcucucuggccu

SEQ ID NO: 2934288 - RNA, 13 nt, Human
gcucucuggccuu

SEQ ID NO: 2934289 - RNA, 11 nt, Human
gcucucuggcc

SEQ ID NO: 2934290 - RNA, 15 nt, Human
guaaauuaacuuuua

SEQ ID NO: 2934291 - RNA, 16 nt, Human
guaaauuaacuuuuau

SEQ ID NO: 2934292 - RNA, 17 nt, Human
guaaauuaacuuuuaua

SEQ ID NO: 2934293 - RNA, 21 nt, Human
guaaauuaacuuuuauaaacu

SEQ ID NO: 2934294 - RNA, 22 nt, Human
guaaauuaacuuuuauaaacuu

SEQ ID NO: 2934295 - RNA, 18 nt, Human
guaaaugggggugcauuu

SEQ ID NO: 2934296 - RNA, 19 nt, Human
guaaaugggggugcauuug

SEQ ID NO: 2934297 - RNA, 20 nt, Human
guaaaugggggugcauuuga

SEQ ID NO: 2934298 - RNA, 22 nt, Human
guaacuguuuagaugaauguca

SEQ ID NO: 2934299 - RNA, 23 nt, Human
guaaauuaacuuuuauaaacuuu

SEQ ID NO: 2934300 - RNA, 18 nt, Human
guaaggaauaccuguccc

SEQ ID NO: 2934301 - RNA, 13 nt, Human
guaaggaaugauu

SEQ ID NO: 2934302 - RNA, 23 nt, Human
guaaggaauaccugucccccuga

SEQ ID NO: 2934303 - RNA, 21 nt, Human
guaaggaauaccugucccccu

SEQ ID NO: 2934304 - RNA, 20 nt, Human
guaaggaauaccuguccccc

SEQ ID NO: 2934305 - RNA, 22 nt, Human
guaaguauucuuauuuaaugaa

SEQ ID NO: 2934306 - RNA, 17 nt, Human
guaagggaaacugccag

SEQ ID NO: 2934307 - RNA, 18 nt, Human
guaagggaaacugccagc

SEQ ID NO: 2934308 - RNA, 13 nt, Human
gguggccucccaa

SEQ ID NO: 2934309 - RNA, 21 nt, Human
gguucaagcgauucuucugcu

SEQ ID NO: 2934310 - RNA, 17 nt, Human
gguggccucccaacuca

SEQ ID NO: 2934311 - RNA, 20 nt, Human
gguucacugcaaccuccgcc

SEQ ID NO: 2934312 - RNA, 22 nt, Human
gguucaagcgauucuucugcuu

SEQ ID NO: 2934313 - RNA, 23 nt, Human
gguucaagcgauucuucugcuuc

SEQ ID NO: 2934314 - RNA, 14 nt, Human
gguugaagcaccaa

SEQ ID NO: 2934315 - RNA, 14 nt, Human
gguugggcuggugu

SEQ ID NO: 2934316 - RNA, 10 nt, Human
gguugugaau

SEQ ID NO: 2934317 - RNA, 13 nt, Human
gguuggugggggc

SEQ ID NO: 2934318 - RNA, 13 nt, Human
gguuuaagcuguu

SEQ ID NO: 2934319 - RNA, 23 nt, Human
gguuuugccauguuggccaggcu

SEQ ID NO: 2934320 - RNA, 20 nt, Human
gguuuucacauuggaaacaa

SEQ ID NO: 2934321 - RNA, 16 nt, Human
gguuuucuuuuaagaa

SEQ ID NO: 2934322 - RNA, 15 nt, Human
gguuuucuguucuuu

SEQ ID NO: 2934323 - RNA, 12 nt, Human
gguuuucuguuc

SEQ ID NO: 2934324 - RNA, 13 nt, Human
gguuuucuguucu

SEQ ID NO: 2934325 - RNA, 18 nt, Human
guaaaaaaugguguuuua

SEQ ID NO: 2934326 - RNA, 16 nt, Human
guaaaaaaugguguuu

SEQ ID NO: 2934327 - RNA, 23 nt, Human
guaaaaccacagcaguugaaaag

SEQ ID NO: 2934328 - RNA, 18 nt, Human
guaaaaccacagcaguug

SEQ ID NO: 2934329 - RNA, 16 nt, Human
guaaaaccacagcagu

SEQ ID NO: 2934330 - RNA, 15 nt, Human
guaaaaccacagcag

SEQ ID NO: 2934331 - RNA, 14 nt, Human
guaaaaccacagca

SEQ ID NO: 2934332 - RNA, 16 nt, Human
guacuuguggacacag

SEQ ID NO: 2934333 - RNA, 20 nt, Human
guacuuguggacacagcucu

SEQ ID NO: 2934334 - RNA, 20 nt, Human
guacuucuccacccugcucu

SEQ ID NO: 2934335 - RNA, 21 nt, Human
guacuucuccacccugcucuc

SEQ ID NO: 2934336 - RNA, 16 nt, Human
guacuucuccacccug

SEQ ID NO: 2934337 - RNA, 17 nt, Human
guacuucuccacccugc

SEQ ID NO: 2934338 - RNA, 18 nt, Human
guacuucuccacccugcu

SEQ ID NO: 2934339 - RNA, 19 nt, Human
guacuucuccacccugcuc

SEQ ID NO: 2934340 - RNA, 14 nt, Human
guacuuuuaagacu

SEQ ID NO: 2934341 - RNA, 21 nt, Human
guacuuguggacacagcucuu

SEQ ID NO: 2934342 - RNA, 23 nt, Human
guacuuuauuuucuauaauuuaa

SEQ ID NO: 2934343 - RNA, 15 nt, Human
guagaggagaaacug

SEQ ID NO: 2934344 - RNA, 15 nt, Human
guagagguacacuug

SEQ ID NO: 2934345 - RNA, 17 nt, Human
guagagguacacuugug

SEQ ID NO: 2934346 - RNA, 19 nt, Human
guagagguacacuugugaa

SEQ ID NO: 2934347 - RNA, 16 nt, Human
guagagcggagaaagg

SEQ ID NO: 2934348 - RNA, 18 nt, Human
guagagccagggucucac

SEQ ID NO: 2934349 - RNA, 18 nt, Human
guacuaacauuuauuuga

SEQ ID NO: 2934350 - RNA, 14 nt, Human
guacuucuccaccc

SEQ ID NO: 2934351 - RNA, 15 nt, Human
guacuucuccacccu

SEQ ID NO: 2934352 - RNA, 17 nt, Human
guacguugugcauuugg

SEQ ID NO: 2934353 - RNA, 15 nt, Human
guacuaaggaaucuu

SEQ ID NO: 2934354 - RNA, 23 nt, Human
guacuaaggaaucuuucugcuuu

SEQ ID NO: 2934355 - RNA, 14 nt, Human
guacgucugacagg

SEQ ID NO: 2934356 - RNA, 15 nt, Human
guacgucugacaggc

SEQ ID NO: 2934357 - RNA, 17 nt, Human
guacgucugacaggcaa

SEQ ID NO: 2934358 - RNA, 14 nt, Human
guacguugugcauu

SEQ ID NO: 2934359 - RNA, 15 nt, Human
guacguugugcauuu

SEQ ID NO: 2934360 - RNA, 16 nt, Human
guacguugugcauuug

SEQ ID NO: 2934361 - RNA, 13 nt, Human
guaccucuugagc

SEQ ID NO: 2934362 - RNA, 21 nt, Human
guaccucuugagccuugaacu

SEQ ID NO: 2934363 - RNA, 22 nt, Human
guaccucuugagccuugaacuu

SEQ ID NO: 2934364 - RNA, 16 nt, Human
guacccacugcucugg

SEQ ID NO: 2934365 - RNA, 15 nt, Human
guaccgcaaugugac

SEQ ID NO: 2934366 - RNA, 19 nt, Human
guacauacuuuuuggguuu

SEQ ID NO: 2934367 - RNA, 13 nt, Human
guacauacuuuuu

SEQ ID NO: 2934368 - RNA, 14 nt, Human
guacauacuuuuug

SEQ ID NO: 2934369 - RNA, 15 nt, Human
guacccacugcucug

SEQ ID NO: 2934370 - RNA, 20 nt, Human
guacauaaugcgugcauacc

SEQ ID NO: 2934371 - RNA, 19 nt, Human
guacagaguggaauaagac

SEQ ID NO: 2934372 - RNA, 15 nt, Human
guacaggacauauau

SEQ ID NO: 2934373 - RNA, 17 nt, Human
guacaggacauauauuu

SEQ ID NO: 2934374 - RNA, 23 nt, Human
guacaggacauauauuuuuuaaa

SEQ ID NO: 2934375 - RNA, 20 nt, Human
guacagcaaggagauuuaca

SEQ ID NO: 2934376 - RNA, 22 nt, Human
guacagagcccacgcccccacu

SEQ ID NO: 2934377 - RNA, 18 nt, Human
guacagagcccacgcccc

SEQ ID NO: 2934378 - RNA, 12 nt, Human
guacagagccca

SEQ ID NO: 2934379 - RNA, 15 nt, Human
guacacuugugaaua

SEQ ID NO: 2934380 - RNA, 16 nt, Human
guacagacaacaaacc

SEQ ID NO: 2934381 - RNA, 19 nt, Human
guacacuguuucaaacuuu

SEQ ID NO: 2934382 - RNA, 20 nt, Human
guacacuguuucaaacuuua

SEQ ID NO: 2934383 - RNA, 21 nt, Human
guacacuguuucaaacuuuac

SEQ ID NO: 2934384 - RNA, 14 nt, Human
guacacuugugaau

SEQ ID NO: 2934385 - RNA, 14 nt, Human
guaauuaaguacua

SEQ ID NO: 2934386 - RNA, 17 nt, Human
guaauuaaguacuaugu

SEQ ID NO: 2934387 - RNA, 20 nt, Human
guaauuaaguacuauguauc

SEQ ID NO: 2934388 - RNA, 21 nt, Human
guaauuaaguacuauguauca

SEQ ID NO: 2934389 - RNA, 18 nt, Human
guacacuguuucaaacuu

SEQ ID NO: 2934390 - RNA, 15 nt, Human
guaauuggaaaggca

SEQ ID NO: 2934391 - RNA, 17 nt, Human
guaaugaccaugaaaga

SEQ ID NO: 2934392 - RNA, 19 nt, Human
guaaugauaacuggaaacu

SEQ ID NO: 2934393 - RNA, 21 nt, Human
ggguagccacuggacugacga

SEQ ID NO: 2934394 - RNA, 23 nt, Human
ggguucccuuuuuuggcugcuga

SEQ ID NO: 2934395 - RNA, 22 nt, Human
ggguucuacccaggugcuagga

SEQ ID NO: 2934396 - RNA, 17 nt, Human
ggguucuacccaggugc

SEQ ID NO: 2934397 - RNA, 16 nt, Human
ggguuggccccugccc

SEQ ID NO: 2934398 - RNA, 19 nt, Human
ggguuggccccugcccggc

SEQ ID NO: 2934399 - RNA, 17 nt, Human
gguacccacugcucugg

SEQ ID NO: 2934400 - RNA, 16 nt, Human
gguacccacugcucug

SEQ ID NO: 2934401 - RNA, 15 nt, Human
ggguugggcuggugu

SEQ ID NO: 2934402 - RNA, 20 nt, Human
gguacuuguggacacagcuc

SEQ ID NO: 2934403 - RNA, 22 nt, Human
gguacuuguggacacagcucuu

SEQ ID NO: 2934404 - RNA, 21 nt, Human
gguacuuguggacacagcucu

SEQ ID NO: 2934405 - RNA, 22 nt, Human
gguacuucaaauccuugaagau

SEQ ID NO: 2934406 - RNA, 22 nt, Human
ggucccaccccacacacgccag

SEQ ID NO: 2934407 - RNA, 22 nt, Human
ggucccacucaguccauagcag

SEQ ID NO: 2934408 - RNA, 12 nt, Human
ggucccacucag

SEQ ID NO: 2934409 - RNA, 14 nt, Human
ggucccacucaguc

SEQ ID NO: 2934410 - RNA, 20 nt, Human
ggucccaucugcagggcccc

SEQ ID NO: 2934411 - RNA, 13 nt, Human
ggucccccuucca

SEQ ID NO: 2934412 - RNA, 23 nt, Human
ggucccccuuccauggacuuugu

SEQ ID NO: 2934413 - RNA, 18 nt, Human
ggucccccuuccauggac

SEQ ID NO: 2934414 - RNA, 12 nt, Human
ggucagagccug

SEQ ID NO: 2934415 - RNA, 22 nt, Human
ggucacucuggcagcucagaga

SEQ ID NO: 2934416 - RNA, 20 nt, Human
ggucacucuggcagcucaga

SEQ ID NO: 2934417 - RNA, 16 nt, Human
ggucacucuggcagcu

SEQ ID NO: 2934418 - RNA, 13 nt, Human
ggucagagccugc

SEQ ID NO: 2934419 - RNA, 14 nt, Human
ggucagagccugca

SEQ ID NO: 2934420 - RNA, 15 nt, Human
ggucagagccugcag

SEQ ID NO: 2934421 - RNA, 16 nt, Human
ggucagagccugcagu

SEQ ID NO: 2934422 - RNA, 12 nt, Human
ggucacucuggc

SEQ ID NO: 2934423 - RNA, 22 nt, Human
gguagacacacaugaaguccaa

SEQ ID NO: 2934424 - RNA, 23 nt, Human
gguagaauguuuucaaauguucu

SEQ ID NO: 2934425 - RNA, 15 nt, Human
gguagacacacauga

SEQ ID NO: 2934426 - RNA, 14 nt, Human
ggucccugguggca

SEQ ID NO: 2934427 - RNA, 22 nt, Human
ggucucacuauguugcccaggc

SEQ ID NO: 2934428 - RNA, 23 nt, Human
gguccuagaaauuccccacccug

SEQ ID NO: 2934429 - RNA, 22 nt, Human
ggucccugguggcagcucaccu

SEQ ID NO: 2934430 - RNA, 15 nt, Human
ggucugacccacugc

SEQ ID NO: 2934431 - RNA, 16 nt, Human
ggucugacccacugcu

SEQ ID NO: 2934432 - RNA, 21 nt, Human
ggucucacuauguugcccagg

SEQ ID NO: 2934433 - RNA, 12 nt, Human
ggucucacucug

SEQ ID NO: 2934434 - RNA, 16 nt, Human
ggucucacucugucgc

SEQ ID NO: 2934435 - RNA, 19 nt, Human
ggucugaggaauccagacc

SEQ ID NO: 2934436 - RNA, 16 nt, Human
ggugaacuugguuccc

SEQ ID NO: 2934437 - RNA, 18 nt, Human
ggugaagugaagacaaug

SEQ ID NO: 2934438 - RNA, 16 nt, Human
ggugaccucugccuga

SEQ ID NO: 2934439 - RNA, 14 nt, Human
ggugaccucugccu

SEQ ID NO: 2934440 - RNA, 15 nt, Human
gguggcagcugcggu

SEQ ID NO: 2934441 - RNA, 23 nt, Human
gguggcagcugcgguccacccag

SEQ ID NO: 2934442 - RNA, 11 nt, Human
gguggcagcug

SEQ ID NO: 2934443 - RNA, 13 nt, Human
gguggcagcucac

SEQ ID NO: 2934444 - RNA, 12 nt, Human
gguggcagcugc

SEQ ID NO: 2934445 - RNA, 13 nt, Human
gguggcagcugcg

SEQ ID NO: 2934446 - RNA, 22 nt, Human
ggugcuaucucccccagcccca

SEQ ID NO: 2934447 - RNA, 21 nt, Human
ggugcuaucucccccagcccc

SEQ ID NO: 2934448 - RNA, 23 nt, Human
ggugcuaucucccccagccccau

SEQ ID NO: 2934449 - RNA, 15 nt, Human
ggugcgaucuggguu

SEQ ID NO: 2934450 - RNA, 19 nt, Human
ggugcuacaaaaacacagc

SEQ ID NO: 2934451 - RNA, 14 nt, Human
gggcuucaguggca

SEQ ID NO: 2934452 - RNA, 14 nt, Human
gggcugcaccggcu

SEQ ID NO: 2934453 - RNA, 16 nt, Human
gggcugaggugggagg

SEQ ID NO: 2934454 - RNA, 13 nt, Human
gggcucugccucc

SEQ ID NO: 2934455 - RNA, 20 nt, Human
gggcucugccucccaucacc

SEQ ID NO: 2934456 - RNA, 17 nt, Human
gggcucugccucccauc

SEQ ID NO: 2934457 - RNA, 16 nt, Human
gggcucugccucccau

SEQ ID NO: 2934458 - RNA, 15 nt, Human
gggcucugccuccca

SEQ ID NO: 2934459 - RNA, 18 nt, Human
ggcucccagccaggcccu

SEQ ID NO: 2934460 - RNA, 16 nt, Human
ggcucccagccaggcc

SEQ ID NO: 2934461 - RNA, 17 nt, Human
ggcucccagccaggccc

SEQ ID NO: 2934462 - RNA, 14 nt, Human
ggcucccagccagg

SEQ ID NO: 2934463 - RNA, 15 nt, Human
ggcucccagccaggc

SEQ ID NO: 2934464 - RNA, 12 nt, Human
gggccuggaugc

SEQ ID NO: 2934465 - RNA, 19 nt, Human
gggccuggccugagcuggg

SEQ ID NO: 2934466 - RNA, 12 nt, Human
gggccuggcuca

SEQ ID NO: 2934467 - RNA, 16 nt, Human
gggccuggcucaggug

SEQ ID NO: 2934468 - RNA, 14 nt, Human
gggccuggcucagg

SEQ ID NO: 2934469 - RNA, 18 nt, Human
gggccuggucguuuucaa

SEQ ID NO: 2934470 - RNA, 16 nt, Human
gggcgcgguggcucac

SEQ ID NO: 2934471 - RNA, 13 nt, Human
gggcucccuuccc

SEQ ID NO: 2934472 - RNA, 23 nt, Human
gggcucccuucccaccucucuca

SEQ ID NO: 2934473 - RNA, 18 nt, Human
gggcucccuucccaccuc

SEQ ID NO: 2934474 - RNA, 17 nt, Human
gggcucccuucccaccu

SEQ ID NO: 2934475 - RNA, 14 nt, Human
gggcucccuuccca

SEQ ID NO: 2934476 - RNA, 20 nt, Human
gggcuucauccuccucagau

SEQ ID NO: 2934477 - RNA, 20 nt, Human
gggcuuggggaccagagcug

SEQ ID NO: 2934478 - RNA, 19 nt, Human
gggcuucaguggcagcugc

SEQ ID NO: 2934479 - RNA, 20 nt, Human
gggcuucaguggcagcugcu

SEQ ID NO: 2934480 - RNA, 19 nt, Human
gggcuucauccuccucaga

SEQ ID NO: 2934481 - RNA, 15 nt, Human
gggcuucaguggcag

SEQ ID NO: 2934482 - RNA, 16 nt, Human
gggcuucaguggcagc

SEQ ID NO: 2934483 - RNA, 17 nt, Human
gggcuucaguggcagcu

SEQ ID NO: 2934484 - RNA, 18 nt, Human
gggcuucaguggcagcug

SEQ ID NO: 2934485 - RNA, 21 nt, Human
gggcuuggggaccagagcugc

SEQ ID NO: 2934486 - RNA, 13 nt, Human
ggggaguggccac

SEQ ID NO: 2934487 - RNA, 17 nt, Human
ggggaucacagccucug

SEQ ID NO: 2934488 - RNA, 14 nt, Human
ggggcugcucccac

SEQ ID NO: 2934489 - RNA, 18 nt, Human
ggggcugcucccaccugg

SEQ ID NO: 2934490 - RNA, 17 nt, Human
ggggcugggcagaggaa

SEQ ID NO: 2934491 - RNA, 16 nt, Human
ggggcugggcagagga

SEQ ID NO: 2934492 - RNA, 13 nt, Human
ggggcugggacau

SEQ ID NO: 2934493 - RNA, 23 nt, Human
gggguucccuuuuuuggcugcug

SEQ ID NO: 2934494 - RNA, 19 nt, Human
ggguacuuguggacacagc

SEQ ID NO: 2934495 - RNA, 22 nt, Human
ggguacuuguggacacagcucu

SEQ ID NO: 2934496 - RNA, 23 nt, Human
ggguacuuguggacacagcucuu

SEQ ID NO: 2934497 - RNA, 23 nt, Human
ggguagagcggagaaaggaaggg

SEQ ID NO: 2934498 - RNA, 13 nt, Human
ggguacccacugc

SEQ ID NO: 2934499 - RNA, 15 nt, Human
ggguacccacugcuc

SEQ ID NO: 2934500 - RNA, 18 nt, Human
ggguacccacugcucugg

SEQ ID NO: 2934501 - RNA, 16 nt, Human
guauuuuaaaagaaug

SEQ ID NO: 2934502 - RNA, 17 nt, Human
guauuuuaaaagaauga

SEQ ID NO: 2934503 - RNA, 18 nt, Human
gucaagagggucugagga

SEQ ID NO: 2934504 - RNA, 19 nt, Human
gucaagagggucugaggaa

SEQ ID NO: 2934505 - RNA, 14 nt, Human
gucaaggcuuagac

SEQ ID NO: 2934506 - RNA, 13 nt, Human
gucaaggcuuaga

SEQ ID NO: 2934507 - RNA, 19 nt, Human
gucaagugaaaaaggagga

SEQ ID NO: 2934508 - RNA, 18 nt, Human
gucaagugaaaaaggagg

SEQ ID NO: 2934509 - RNA, 16 nt, Human
gucaagugaaaaagga

SEQ ID NO: 2934510 - RNA, 14 nt, Human
gucaagcauguauu

SEQ ID NO: 2934511 - RNA, 16 nt, Human
gucaagcauguauuuu

SEQ ID NO: 2934512 - RNA, 16 nt, Human
gucaauuacaggaagu

SEQ ID NO: 2934513 - RNA, 15 nt, Human
gucaauuacaggaag

SEQ ID NO: 2934514 - RNA, 13 nt, Human
gucaauuacagga

SEQ ID NO: 2934515 - RNA, 21 nt, Human
gucaauaaaauccauacauuu

SEQ ID NO: 2934516 - RNA, 15 nt, Human
gucaauaaaauccau

SEQ ID NO: 2934517 - RNA, 13 nt, Human
gucaccccggcca

SEQ ID NO: 2934518 - RNA, 20 nt, Human
gucaccugaagacucauucu

SEQ ID NO: 2934519 - RNA, 14 nt, Human
gucaccucauggaa

SEQ ID NO: 2934520 - RNA, 20 nt, Human
guagagguacacuugugaau

SEQ ID NO: 2934521 - RNA, 13 nt, Human
guagagugggagc

SEQ ID NO: 2934522 - RNA, 20 nt, Human
guauuacaguggggaaugaa

SEQ ID NO: 2934523 - RNA, 15 nt, Human
guagagugggagcug

SEQ ID NO: 2934524 - RNA, 22 nt, Human
guauuacaguggggaaugaaga

SEQ ID NO: 2934525 - RNA, 13 nt, Human
guauuacuucugc

SEQ ID NO: 2934526 - RNA, 14 nt, Human
guauuacuucugcu

SEQ ID NO: 2934527 - RNA, 15 nt, Human
guauuacuucugcua

SEQ ID NO: 2934528 - RNA, 14 nt, Human
guauuauaccuuuu

SEQ ID NO: 2934529 - RNA, 17 nt, Human
guauuucuaugaaauau

SEQ ID NO: 2934530 - RNA, 22 nt, Human
guauuucuaugaaauauuaugu

SEQ ID NO: 2934531 - RNA, 14 nt, Human
guccacccaggagc

SEQ ID NO: 2934532 - RNA, 13 nt, Human
guccacccaggag

SEQ ID NO: 2934533 - RNA, 15 nt, Human
guccacccaggagcc

SEQ ID NO: 2934534 - RNA, 16 nt, Human
guccacccaggagccc

SEQ ID NO: 2934535 - RNA, 15 nt, Human
gucccacucagucca

SEQ ID NO: 2934536 - RNA, 14 nt, Human
gucccacucagucc

SEQ ID NO: 2934537 - RNA, 17 nt, Human
gucccagauacuugggg

SEQ ID NO: 2934538 - RNA, 20 nt, Human
gucccagccagcaguucaga

SEQ ID NO: 2934539 - RNA, 13 nt, Human
gucagcuaaagaa

SEQ ID NO: 2934540 - RNA, 21 nt, Human
gucauauaagauucauauuua

SEQ ID NO: 2934541 - RNA, 17 nt, Human
gucugauucccaagcuc

SEQ ID NO: 2934542 - RNA, 18 nt, Human
gucugauucccaagcucu

SEQ ID NO: 2934543 - RNA, 19 nt, Human
gucugauucccaagcucug

SEQ ID NO: 2934544 - RNA, 21 nt, Human
gucugaggaauccagacccgg

SEQ ID NO: 2934545 - RNA, 20 nt, Human
gucugauucccaagcucugc

SEQ ID NO: 2934546 - RNA, 21 nt, Human
gucugauucccaagcucugcu

SEQ ID NO: 2934547 - RNA, 13 nt, Human
gucugacccacug

SEQ ID NO: 2934548 - RNA, 14 nt, Human
gucugacccacugc

SEQ ID NO: 2934549 - RNA, 15 nt, Human
gucugacccacugcu

SEQ ID NO: 2934550 - RNA, 18 nt, Human
gucugaggaauccagacc

SEQ ID NO: 2934551 - RNA, 19 nt, Human
gucugaggaauccagaccc

SEQ ID NO: 2934552 - RNA, 20 nt, Human
gucucacuauguugcccagg

SEQ ID NO: 2934553 - RNA, 21 nt, Human
gucucacuauguugcccaggc

SEQ ID NO: 2934554 - RNA, 13 nt, Human
gucucacuguugc

SEQ ID NO: 2934555 - RNA, 23 nt, Human
gucucacuauguugcccaggcag

SEQ ID NO: 2934556 - RNA, 16 nt, Human
gucucacuguugccca

SEQ ID NO: 2934557 - RNA, 17 nt, Human
gucucacuguugcccag

SEQ ID NO: 2934558 - RNA, 18 nt, Human
gucucacuguugcccagg

SEQ ID NO: 2934559 - RNA, 19 nt, Human
gucucacuguugcccaggc

SEQ ID NO: 2934560 - RNA, 20 nt, Human
gucucacuguugcccaggcu

SEQ ID NO: 2934561 - RNA, 21 nt, Human
gucucacuguugcccaggcug

SEQ ID NO: 2934562 - RNA, 22 nt, Human
gucucacuguugcccaggcugg

SEQ ID NO: 2934563 - RNA, 23 nt, Human
gucucacuguugcccaggcuggc

SEQ ID NO: 2934564 - RNA, 15 nt, Human
guccuuaccagcaga

SEQ ID NO: 2934565 - RNA, 17 nt, Human
guccuuaccagcagagc

SEQ ID NO: 2934566 - RNA, 16 nt, Human
guccuuaccagcagag

SEQ ID NO: 2934567 - RNA, 17 nt, Human
gucuacacuaagagaga

SEQ ID NO: 2934568 - RNA, 23 nt, Human
gucuacacuaagagagaaugaga

SEQ ID NO: 2934569 - RNA, 15 nt, Human
gucuacacugugcug

SEQ ID NO: 2934570 - RNA, 19 nt, Human
guccuauuauauucauucu

SEQ ID NO: 2934571 - RNA, 21 nt, Human
guccuauuauauucauucuuu

SEQ ID NO: 2934572 - RNA, 12 nt, Human
gucccagugccg

SEQ ID NO: 2934573 - RNA, 13 nt, Human
guccuacucugug

SEQ ID NO: 2934574 - RNA, 17 nt, Human
gucccugguggcagcuc

SEQ ID NO: 2934575 - RNA, 16 nt, Human
gucccugguggcagcu

SEQ ID NO: 2934576 - RNA, 15 nt, Human
guccuacucuguguc

SEQ ID NO: 2934577 - RNA, 23 nt, Human
guccuacucugugucaggugggg

SEQ ID NO: 2934578 - RNA, 23 nt, Human
guccuagaaauuccccacccuga

SEQ ID NO: 2934579 - RNA, 15 nt, Human
guccugggagugagc

SEQ ID NO: 2934580 - RNA, 16 nt, Human
guccugggagugagcu

SEQ ID NO: 2934581 - RNA, 17 nt, Human
guccuggcaugggaaug

SEQ ID NO: 2934582 - RNA, 12 nt, Human
guccucccaucu

SEQ ID NO: 2934583 - RNA, 14 nt, Human
guccucccaucuca

SEQ ID NO: 2934584 - RNA, 13 nt, Human
guccucccaucuc

SEQ ID NO: 2934585 - RNA, 23 nt, Human
guccucccaucucacacaugagc

SEQ ID NO: 2934586 - RNA, 19 nt, Human
guccugggagugagcuggu

SEQ ID NO: 2934587 - RNA, 17 nt, Human
guccugggagugagcug

SEQ ID NO: 2934588 - RNA, 18 nt, Human
guccugggagugagcugg

SEQ ID NO: 2934589 - RNA, 21 nt, Human
guccugucggagcccugucuc

SEQ ID NO: 2934590 - RNA, 20 nt, Human
guccugucggagcccugucu

SEQ ID NO: 2934591 - RNA, 18 nt, Human
guccugucggagcccugu

SEQ ID NO: 2934592 - RNA, 23 nt, Human
gugaauguaggcuggcuuucaga

SEQ ID NO: 2934593 - RNA, 19 nt, Human
gugaaaggaaagagggagg

SEQ ID NO: 2934594 - RNA, 14 nt, Human
gugaauaccccaag

SEQ ID NO: 2934595 - RNA, 23 nt, Human
gugaauaccccaagacucccaug

SEQ ID NO: 2934596 - RNA, 23 nt, Human
gugaaaagaaaaaugagccuggc

SEQ ID NO: 2934597 - RNA, 14 nt, Human
gugaaaagaaaaau

SEQ ID NO: 2934598 - RNA, 19 nt, Human
gugaaagaaaauaacaaua

SEQ ID NO: 2934599 - RNA, 12 nt, Human
gugaaacuggau

SEQ ID NO: 2934600 - RNA, 20 nt, Human
gugaaacucguuaauuugua

SEQ ID NO: 2934601 - RNA, 16 nt, Human
gugacaacacuugugu

SEQ ID NO: 2934602 - RNA, 16 nt, Human
gugacugaauuucuuu

SEQ ID NO: 2934603 - RNA, 18 nt, Human
gugacugaauuucuuuug

SEQ ID NO: 2934604 - RNA, 15 nt, Human
gugacugaauuucuu

SEQ ID NO: 2934605 - RNA, 11 nt, Human
gugaggaagcc

SEQ ID NO: 2934606 - RNA, 19 nt, Human
gugaggaagccgcuggggc

SEQ ID NO: 2934607 - RNA, 16 nt, Human
gugaggaagccgcugg

SEQ ID NO: 2934608 - RNA, 14 nt, Human
gugagcuacaaaug

SEQ ID NO: 2934609 - RNA, 13 nt, Human
gugagccacugca

SEQ ID NO: 2934610 - RNA, 17 nt, Human
gugacugaucucucgug

SEQ ID NO: 2934611 - RNA, 16 nt, Human
gugagcagucaggaaa

SEQ ID NO: 2934612 - RNA, 23 nt, Human
gugauucuccugccucagccucc

SEQ ID NO: 2934613 - RNA, 12 nt, Human
gugauuuucauu

SEQ ID NO: 2934614 - RNA, 14 nt, Human
gugauucuccugcc

SEQ ID NO: 2934615 - RNA, 16 nt, Human
gugauucuccugccuc

SEQ ID NO: 2934616 - RNA, 17 nt, Human
gugauucuccugccuca

SEQ ID NO: 2934617 - RNA, 18 nt, Human
gugauucuccugccucag

SEQ ID NO: 2934618 - RNA, 19 nt, Human
gugauucuccugccucagc

SEQ ID NO: 2934619 - RNA, 20 nt, Human
gugauucuccugccucagcc

SEQ ID NO: 2934620 - RNA, 22 nt, Human
gugauucuccugccucagccuc

SEQ ID NO: 2934621 - RNA, 20 nt, Human
gugauccucccaccucagcc

SEQ ID NO: 2934622 - RNA, 22 nt, Human
gugauccucccaccucagccuc

SEQ ID NO: 2934623 - RNA, 14 nt, Human
gugauccucccacc

SEQ ID NO: 2934624 - RNA, 15 nt, Human
gugauccucccaccu

SEQ ID NO: 2934625 - RNA, 18 nt, Human
gugauccucccaccucag

SEQ ID NO: 2934626 - RNA, 11 nt, Human
gugaggccaga

SEQ ID NO: 2934627 - RNA, 15 nt, Human
gugauccacccaccu

SEQ ID NO: 2934628 - RNA, 13 nt, Human
gugaggccagaga

SEQ ID NO: 2934629 - RNA, 18 nt, Human
gugauccacccaccucag

SEQ ID NO: 2934630 - RNA, 20 nt, Human
gugauccacccaccucagcc

SEQ ID NO: 2934631 - RNA, 20 nt, Human
gugcccacaggaucagucug

SEQ ID NO: 2934632 - RNA, 20 nt, Human
gugccagguuuuuggucuga

SEQ ID NO: 2934633 - RNA, 22 nt, Human
gugccagguuuuuggucugacc

SEQ ID NO: 2934634 - RNA, 21 nt, Human
gugcauaccacuuuuguucuu

SEQ ID NO: 2934635 - RNA, 13 nt, Human
gugcauaccacuu

SEQ ID NO: 2934636 - RNA, 14 nt, Human
gugcauaccacuuu

SEQ ID NO: 2934637 - RNA, 20 nt, Human
gugcaguauagaauaggcac

SEQ ID NO: 2934638 - RNA, 19 nt, Human
gugcauaaguuaacuucca

SEQ ID NO: 2934639 - RNA, 18 nt, Human
gugcaaauugucacagga

SEQ ID NO: 2934640 - RNA, 24 nt, Human
gugcuuggcccaggaguuuggcca

SEQ ID NO: 2934641 - RNA, 19 nt, Human
gugcuuggcccaggaguuu

SEQ ID NO: 2934642 - RNA, 17 nt, Human
gugcuuggcccaggagu

SEQ ID NO: 2934643 - RNA, 16 nt, Human
gugcuuggcccaggag

SEQ ID NO: 2934644 - RNA, 15 nt, Human
gugcuuggcccagga

SEQ ID NO: 2934645 - RNA, 14 nt, Human
gugcuuggcccagg

SEQ ID NO: 2934646 - RNA, 13 nt, Human
gugcuuggcccag

SEQ ID NO: 2934647 - RNA, 14 nt, Human
guggaaaauaacuc

SEQ ID NO: 2934648 - RNA, 18 nt, Human
guggaaaaauagccugcc

SEQ ID NO: 2934649 - RNA, 22 nt, Human
gugcugccauccagguucagcu

SEQ ID NO: 2934650 - RNA, 11 nt, Human
gugcugcccug

SEQ ID NO: 2934651 - RNA, 12 nt, Human
gugcuuggagga

SEQ ID NO: 2934652 - RNA, 15 nt, Human
gugcuuggaggaagg

SEQ ID NO: 2934653 - RNA, 13 nt, Human
gugcuuggaggaa

SEQ ID NO: 2934654 - RNA, 21 nt, Human
gugcugaguguacagagugga

SEQ ID NO: 2934655 - RNA, 12 nt, Human
gugcugcauuua

SEQ ID NO: 2934656 - RNA, 19 nt, Human
gugcugcauuuaaaagaua

SEQ ID NO: 2934657 - RNA, 20 nt, Human
gugcugcauuuaaaagauac

SEQ ID NO: 2934658 - RNA, 15 nt, Human
gugcugccauccagg

SEQ ID NO: 2934659 - RNA, 18 nt, Human
gugcugccauccagguuc

SEQ ID NO: 2934660 - RNA, 19 nt, Human
gugcugccauccagguuca

SEQ ID NO: 2934661 - RNA, 12 nt, Human
gugcugagucug

SEQ ID NO: 2934662 - RNA, 19 nt, Human
gugcugagucugaaggcug

SEQ ID NO: 2934663 - RNA, 18 nt, Human
gugcugagucugaaggcu

SEQ ID NO: 2934664 - RNA, 17 nt, Human
gugcugagucugaaggc

SEQ ID NO: 2934665 - RNA, 16 nt, Human
gugcugagucugaagg

SEQ ID NO: 2934666 - RNA, 15 nt, Human
gugcucuggacaggc

SEQ ID NO: 2934667 - RNA, 16 nt, Human
gugcucuggacaggca

SEQ ID NO: 2934668 - RNA, 21 nt, Human
gugccuuggggacaagagcag

SEQ ID NO: 2934669 - RNA, 17 nt, Human
gugcucuggacaggcau

SEQ ID NO: 2934670 - RNA, 18 nt, Human
gugcucuggacaggcaug

SEQ ID NO: 2934671 - RNA, 19 nt, Human
gugcugaaugguuuucaaa

SEQ ID NO: 2934672 - RNA, 20 nt, Human
gugcugaaugguuuucaaaa

SEQ ID NO: 2934673 - RNA, 23 nt, Human
gugcugaaugguuuucaaaauaa

SEQ ID NO: 2934674 - RNA, 20 nt, Human
guggagaagcggcuggcagc

SEQ ID NO: 2934675 - RNA, 16 nt, Human
guggaugccugguggc

SEQ ID NO: 2934676 - RNA, 18 nt, Human
guggaugccugguggcag

SEQ ID NO: 2934677 - RNA, 21 nt, Human
guggaucacgaggucaggaga

SEQ ID NO: 2934678 - RNA, 17 nt, Human
guggaguucaucuugaa

SEQ ID NO: 2934679 - RNA, 15 nt, Human
guggcagugggagcu

SEQ ID NO: 2934680 - RNA, 16 nt, Human
guggcagugggagcug

SEQ ID NO: 2934681 - RNA, 17 nt, Human
guggcagugggagcugc

SEQ ID NO: 2934682 - RNA, 19 nt, Human
guggcagcugcgguccacc

SEQ ID NO: 2934683 - RNA, 20 nt, Human
guggaugccugguggcagcu

SEQ ID NO: 2934684 - RNA, 21 nt, Human
guggcagcugcgguccaccca

SEQ ID NO: 2934685 - RNA, 22 nt, Human
guggcagcugcgguccacccag

SEQ ID NO: 2934686 - RNA, 23 nt, Human
guggcagcugcgguccacccagg

SEQ ID NO: 2934687 - RNA, 12 nt, Human
guggcagcugcu

SEQ ID NO: 2934688 - RNA, 13 nt, Human
guggcagcugcuu

SEQ ID NO: 2934689 - RNA, 19 nt, Human
guggcagcugcuuuugucu

SEQ ID NO: 2934690 - RNA, 23 nt, Human
guggccacaccucuaucccggcu

SEQ ID NO: 2934691 - RNA, 22 nt, Human
guggccacaccucuaucccggc

SEQ ID NO: 2934692 - RNA, 19 nt, Human
guggcagugggagcugccu

SEQ ID NO: 2934693 - RNA, 21 nt, Human
guggcagugggagcugccugu

SEQ ID NO: 2934694 - RNA, 18 nt, Human
ucacaagacccaaaaggc

SEQ ID NO: 2934695 - RNA, 22 nt, Human
ucacaagacccaaaaggcagaa

SEQ ID NO: 2934696 - RNA, 14 nt, Human
ucacauuggaaaca

SEQ ID NO: 2934697 - RNA, 20 nt, Human
ucacauuccugaacaggaua

SEQ ID NO: 2934698 - RNA, 15 nt, Human
ucacacacuuuggcu

SEQ ID NO: 2934699 - RNA, 23 nt, Human
ucacacaugagcaucaggccagg

SEQ ID NO: 2934700 - RNA, 22 nt, Human
ucacacaugagcaucaggccag

SEQ ID NO: 2934701 - RNA, 23 nt, Human
ucaccgaaaacguggcugcuuca

SEQ ID NO: 2934702 - RNA, 22 nt, Human
ucaccgaaaacguggcugcuuc

SEQ ID NO: 2934703 - RNA, 21 nt, Human
ucaccgaaaacguggcugcuu

SEQ ID NO: 2934704 - RNA, 20 nt, Human
ucaccgaaaacguggcugcu

SEQ ID NO: 2934705 - RNA, 19 nt, Human
ucaccgaaaacguggcugc

SEQ ID NO: 2934706 - RNA, 15 nt, Human
ucaccgaaaacgugg

SEQ ID NO: 2934707 - RNA, 19 nt, Human
ucacccgcuaagagggagg

SEQ ID NO: 2934708 - RNA, 14 nt, Human
ucaccgaaaacgug

SEQ ID NO: 2934709 - RNA, 12 nt, Human
ucacccuuuucu

SEQ ID NO: 2934710 - RNA, 18 nt, Human
ucacccgcuaagagggag

SEQ ID NO: 2934711 - RNA, 16 nt, Human
ucaccacaugugcaca

SEQ ID NO: 2934712 - RNA, 13 nt, Human
ucaccaagcccag

SEQ ID NO: 2934713 - RNA, 14 nt, Human
ucacauuuauucug

SEQ ID NO: 2934714 - RNA, 21 nt, Human
ucaccaaaucagcugcuacua

SEQ ID NO: 2934715 - RNA, 18 nt, Human
ucaccaacgucugugcca

SEQ ID NO: 2934716 - RNA, 17 nt, Human
ucaccaacgucugugcc

SEQ ID NO: 2934717 - RNA, 12 nt, Human
ucacauuuaaau

SEQ ID NO: 2934718 - RNA, 17 nt, Human
ucacauuggaaacaagu

SEQ ID NO: 2934719 - RNA, 17 nt, Human
ucaagcgauucuucugc

SEQ ID NO: 2934720 - RNA, 20 nt, Human
ucaagccaccaacauacucc

SEQ ID NO: 2934721 - RNA, 12 nt, Human
ucaagccaccaa

SEQ ID NO: 2934722 - RNA, 21 nt, Human
ucaagcgauucuucugcuuca

SEQ ID NO: 2934723 - RNA, 18 nt, Human
ucaagcgauucuucugcu

SEQ ID NO: 2934724 - RNA, 19 nt, Human
ucaagcgauucuucugcuu

SEQ ID NO: 2934725 - RNA, 14 nt, Human
ucaaggauccugag

SEQ ID NO: 2934726 - RNA, 13 nt, Human
ucaaggauccuga

SEQ ID NO: 2934727 - RNA, 17 nt, Human
ucaaggauccugagcca

SEQ ID NO: 2934728 - RNA, 16 nt, Human
ucaaggauccugagcc

SEQ ID NO: 2934729 - RNA, 15 nt, Human
ucaaggauccugagc

SEQ ID NO: 2934730 - RNA, 16 nt, Human
ucaaccuccugggcua

SEQ ID NO: 2934731 - RNA, 20 nt, Human
ucaaccccuucgcuccugug

SEQ ID NO: 2934732 - RNA, 15 nt, Human
ucaaccuccugggcu

SEQ ID NO: 2934733 - RNA, 18 nt, Human
ucaaccccuucgcuccug

SEQ ID NO: 2934734 - RNA, 19 nt, Human
ucaaccccuucgcuccugu

SEQ ID NO: 2934735 - RNA, 20 nt, Human
ucaacucuccuccagaguca

SEQ ID NO: 2934736 - RNA, 22 nt, Human
ucaacuccaaacugacucuuaa

SEQ ID NO: 2934737 - RNA, 17 nt, Human
ucaaauaugcaaagcac

SEQ ID NO: 2934738 - RNA, 16 nt, Human
ucaaauaugcaaagca

SEQ ID NO: 2934739 - RNA, 23 nt, Human
ucaaagagguuuuaaaaaaaucc

SEQ ID NO: 2934740 - RNA, 12 nt, Human
ucaaagagguuu

SEQ ID NO: 2934741 - RNA, 12 nt, Human
ucaaauguguac

SEQ ID NO: 2934742 - RNA, 16 nt, Human
ucaaauccuugaagau

SEQ ID NO: 2934743 - RNA, 15 nt, Human
ucaaauccuugaaga

SEQ ID NO: 2934744 - RNA, 19 nt, Human
ucaaauaugcaaagcacug

SEQ ID NO: 2934745 - RNA, 18 nt, Human
ucaaauaugcaaagcacu

SEQ ID NO: 2934746 - RNA, 20 nt, Human
uauuugcagugcaguauaga

SEQ ID NO: 2934747 - RNA, 22 nt, Human
uauuugcagugcaguauagaau

SEQ ID NO: 2934748 - RNA, 17 nt, Human
ucaaacauauauaacaa

SEQ ID NO: 2934749 - RNA, 22 nt, Human
ucaaacagucucaggaaaucaa

SEQ ID NO: 2934750 - RNA, 20 nt, Human
uauuguuuaaaaucauuucu

SEQ ID NO: 2934751 - RNA, 15 nt, Human
uauuuaaauagauga

SEQ ID NO: 2934752 - RNA, 17 nt, Human
uauuuaaauagaugaca

SEQ ID NO: 2934753 - RNA, 17 nt, Human
uauuuaugggauccugg

SEQ ID NO: 2934754 - RNA, 18 nt, Human
uauuugaaacacugguuu

SEQ ID NO: 2934755 - RNA, 23 nt, Human
uauuucuugugguuauaacuuaa

SEQ ID NO: 2934756 - RNA, 20 nt, Human
uauuucuugugguuauaacu

SEQ ID NO: 2934757 - RNA, 14 nt, Human
uauuucuaugaaau

SEQ ID NO: 2934758 - RNA, 15 nt, Human
uauuucuaugaaaua

SEQ ID NO: 2934759 - RNA, 13 nt, Human
uauuuauuacugu

SEQ ID NO: 2934760 - RNA, 13 nt, Human
uauuucuaugaaa

SEQ ID NO: 2934761 - RNA, 14 nt, Human
uauuuauuacugua

SEQ ID NO: 2934762 - RNA, 22 nt, Human
uauuuauuaaaugcccagcccc

SEQ ID NO: 2934763 - RNA, 23 nt, Human
uauugcauacuauuaaacaugcu

SEQ ID NO: 2934764 - RNA, 19 nt, Human
uauugcauacuauuaaaca

SEQ ID NO: 2934765 - RNA, 23 nt, Human
uauucauucuuuuugaaauguca

SEQ ID NO: 2934766 - RNA, 18 nt, Human
uauucauucuuuuugaaa

SEQ ID NO: 2934767 - RNA, 20 nt, Human
uauugauaugcuuauacacu

SEQ ID NO: 2934768 - RNA, 22 nt, Human
uauugcugauggugcaaugacc

SEQ ID NO: 2934769 - RNA, 23 nt, Human
uauugcugauggugcaaugaccu

SEQ ID NO: 2934770 - RNA, 13 nt, Human
uauugcccacgcu

SEQ ID NO: 2934771 - RNA, 14 nt, Human
uauugcccacgcug

SEQ ID NO: 2934772 - RNA, 14 nt, Human
uauugccaaugcua

SEQ ID NO: 2934773 - RNA, 15 nt, Human
uauugcccacgcugg

SEQ ID NO: 2934774 - RNA, 15 nt, Human
uauuguuuaaaauca

SEQ ID NO: 2934775 - RNA, 17 nt, Human
uauuguuuaaaaucauu

SEQ ID NO: 2934776 - RNA, 16 nt, Human
uauuguuuaaaaucau

SEQ ID NO: 2934777 - RNA, 12 nt, Human
uauuauuugcag

SEQ ID NO: 2934778 - RNA, 20 nt, Human
uauuauuugcagugcaguau

SEQ ID NO: 2934779 - RNA, 21 nt, Human
uauuauuugcagugcaguaua

SEQ ID NO: 2934780 - RNA, 16 nt, Human
uauuauguuaaaacug

SEQ ID NO: 2934781 - RNA, 12 nt, Human
uauuauaccuuu

SEQ ID NO: 2934782 - RNA, 13 nt, Human
uauuauaccuuuu

SEQ ID NO: 2934783 - RNA, 14 nt, Human
uauuaaggaagaca

SEQ ID NO: 2934784 - RNA, 14 nt, Human
uauuauaccuuuuu

SEQ ID NO: 2934785 - RNA, 17 nt, Human
uauuauauuuacaaaug

SEQ ID NO: 2934786 - RNA, 23 nt, Human
uauuauauucauucuuuuugaaa

SEQ ID NO: 2934787 - RNA, 17 nt, Human
uauuauauucauucuuu

SEQ ID NO: 2934788 - RNA, 13 nt, Human
uauuauauucauu

SEQ ID NO: 2934789 - RNA, 13 nt, Human
uauguguucuauu

SEQ ID NO: 2934790 - RNA, 12 nt, Human
uauguuaaaacu

SEQ ID NO: 2934791 - RNA, 14 nt, Human
uauguuaauauuuu

SEQ ID NO: 2934792 - RNA, 16 nt, Human
uauguuaauauuucug

SEQ ID NO: 2934793 - RNA, 13 nt, Human
uauguuaauauuu

SEQ ID NO: 2934794 - RNA, 19 nt, Human
uauguuagugcaaauuguc

SEQ ID NO: 2934795 - RNA, 19 nt, Human
uauggaggcuuugcauaga

SEQ ID NO: 2934796 - RNA, 15 nt, Human
uauuaaaugcccagc

SEQ ID NO: 2934797 - RNA, 19 nt, Human
uauuaaaugcccagccccu

SEQ ID NO: 2934798 - RNA, 17 nt, Human
uauuaaaugcccagccc

SEQ ID NO: 2934799 - RNA, 16 nt, Human
uauuaagaaagacuau

SEQ ID NO: 2934800 - RNA, 21 nt, Human
uauguugcccaggcaggucuu

SEQ ID NO: 2934801 - RNA, 17 nt, Human
uauguucuaagaaguga

SEQ ID NO: 2934802 - RNA, 22 nt, Human
uauguucuuaguggauguucug

SEQ ID NO: 2934803 - RNA, 19 nt, Human
uauauguuuuaagaggcag

SEQ ID NO: 2934804 - RNA, 14 nt, Human
uauccucuguugau

SEQ ID NO: 2934805 - RNA, 16 nt, Human
uaucuaaauguugaaa

SEQ ID NO: 2934806 - RNA, 15 nt, Human
uauccuucagccuga

SEQ ID NO: 2934807 - RNA, 14 nt, Human
uauccuucagccug

SEQ ID NO: 2934808 - RNA, 16 nt, Human
uaucgucacugcuuaa

SEQ ID NO: 2934809 - RNA, 21 nt, Human
uaucuaauauguaacaagcca

SEQ ID NO: 2934810 - RNA, 13 nt, Human
uaucuuacgaaaa

SEQ ID NO: 2934811 - RNA, 16 nt, Human
uaucuuacgaaaaaau

SEQ ID NO: 2934812 - RNA, 18 nt, Human
uaucuguucauauggaua

SEQ ID NO: 2934813 - RNA, 20 nt, Human
uaucugucauuugagcaggg

SEQ ID NO: 2934814 - RNA, 21 nt, Human
uaucugucauuugagcagggc

SEQ ID NO: 2934815 - RNA, 23 nt, Human
uaucugucauuugagcagggcuc

SEQ ID NO: 2934816 - RNA, 12 nt, Human
uaugacacaugc

SEQ ID NO: 2934817 - RNA, 22 nt, Human
uaugacacaugcaaggucauuu

SEQ ID NO: 2934818 - RNA, 17 nt, Human
uaugaauuacauuugua

SEQ ID NO: 2934819 - RNA, 23 nt, Human
uaugaauuacauuuguauaaaau

SEQ ID NO: 2934820 - RNA, 13 nt, Human
uaugcacacauuu

SEQ ID NO: 2934821 - RNA, 14 nt, Human
uaugcacacacaua

SEQ ID NO: 2934822 - RNA, 16 nt, Human
uaugcacacacauaua

SEQ ID NO: 2934823 - RNA, 14 nt, Human
uaugcacacauuuu

SEQ ID NO: 2934824 - RNA, 13 nt, Human
uaugcaaagucua

SEQ ID NO: 2934825 - RNA, 15 nt, Human
uaugcaaagcacuga

SEQ ID NO: 2934826 - RNA, 18 nt, Human
uaugcaaucaaaucugcu

SEQ ID NO: 2934827 - RNA, 12 nt, Human
uaugcaaagcac

SEQ ID NO: 2934828 - RNA, 14 nt, Human
uaugcaaagcacug

SEQ ID NO: 2934829 - RNA, 13 nt, Human
uaugcaaagcacu

SEQ ID NO: 2934830 - RNA, 23 nt, Human
uaugacuccagaauuucccaaag

SEQ ID NO: 2934831 - RNA, 17 nt, Human
uaugacuccagaauuuc

SEQ ID NO: 2934832 - RNA, 16 nt, Human
uaugacuccagaauuu

SEQ ID NO: 2934833 - RNA, 21 nt, Human
uaugagaaacuggcaaagcag

SEQ ID NO: 2934834 - RNA, 23 nt, Human
uaugauugccuuuuuauaacuuu

SEQ ID NO: 2934835 - RNA, 20 nt, Human
uaugauugccuuuuuauaac

SEQ ID NO: 2934836 - RNA, 16 nt, Human
uaugauucccagccag

SEQ ID NO: 2934837 - RNA, 16 nt, Human
uaugauucaaaugucu

SEQ ID NO: 2934838 - RNA, 21 nt, Human
uaugauucaaaugucuauaaa

SEQ ID NO: 2934839 - RNA, 15 nt, Human
uaugcuucuguuuua

SEQ ID NO: 2934840 - RNA, 16 nt, Human
uaugcuucuguuuuau

SEQ ID NO: 2934841 - RNA, 13 nt, Human
uaugcaugaagua

SEQ ID NO: 2934842 - RNA, 18 nt, Human
uaugcaugaaguaauaug

SEQ ID NO: 2934843 - RNA, 22 nt, Human
uaugcuuauacacuuacacuuu

SEQ ID NO: 2934844 - RNA, 17 nt, Human
uauggacaaugacccag

SEQ ID NO: 2934845 - RNA, 16 nt, Human
uauggaagcacccauu

SEQ ID NO: 2934846 - RNA, 19 nt, Human
uauggaacacucugagacu

SEQ ID NO: 2934847 - RNA, 18 nt, Human
uauggaacacucugagac

SEQ ID NO: 2934848 - RNA, 17 nt, Human
uauggaacacucugaga

SEQ ID NO: 2934849 - RNA, 16 nt, Human
uauggaacacucugag

SEQ ID NO: 2934850 - RNA, 13 nt, Human
uauggaacacucu

SEQ ID NO: 2934851 - RNA, 15 nt, Human
uaggcuauuccugag

SEQ ID NO: 2934852 - RNA, 17 nt, Human
uaggcuauuccugagag

SEQ ID NO: 2934853 - RNA, 11 nt, Human
uagggaaaaac

SEQ ID NO: 2934854 - RNA, 19 nt, Human
uagggaaaaaccagcgugu

SEQ ID NO: 2934855 - RNA, 21 nt, Human
uagggaaaaaccagcguguga

SEQ ID NO: 2934856 - RNA, 20 nt, Human
uagggaaaaaccagcgugug

SEQ ID NO: 2934857 - RNA, 16 nt, Human
uaggucagugcaaaua

SEQ ID NO: 2934858 - RNA, 18 nt, Human
uaggccuggccagaugca

SEQ ID NO: 2934859 - RNA, 15 nt, Human
uaggccuggccagau

SEQ ID NO: 2934860 - RNA, 19 nt, Human
uaggacccgucuccagcug

SEQ ID NO: 2934861 - RNA, 18 nt, Human
uaggccaugggacaggga

SEQ ID NO: 2934862 - RNA, 16 nt, Human
uaggccaugggacagg

SEQ ID NO: 2934863 - RNA, 12 nt, Human
uaggaauugacc

SEQ ID NO: 2934864 - RNA, 23 nt, Human
uaguauuuuuuacauuuuacaca

SEQ ID NO: 2934865 - RNA, 13 nt, Human
uagucaaauugug

SEQ ID NO: 2934866 - RNA, 14 nt, Human
uagugcaaauuguc

SEQ ID NO: 2934867 - RNA, 15 nt, Human
uagugcaaauuguca

SEQ ID NO: 2934868 - RNA, 18 nt, Human
uaguauuuuuuacauuuu

SEQ ID NO: 2934869 - RNA, 18 nt, Human
uaguauuucuaugaaaua

SEQ ID NO: 2934870 - RNA, 19 nt, Human
uaguauuucuaugaaauau

SEQ ID NO: 2934871 - RNA, 16 nt, Human
uaguauuucuaugaaa

SEQ ID NO: 2934872 - RNA, 13 nt, Human
uaggugacauaua

SEQ ID NO: 2934873 - RNA, 23 nt, Human
uaggugacagagugagacucugu

SEQ ID NO: 2934874 - RNA, 13 nt, Human
uaguaucaaaaga

SEQ ID NO: 2934875 - RNA, 18 nt, Human
uauaaacuuuaccuuuuu

SEQ ID NO: 2934876 - RNA, 21 nt, Human
uauaucuauauuuuacauaaa

SEQ ID NO: 2934877 - RNA, 20 nt, Human
uauaugcucugcauguuaca

SEQ ID NO: 2934878 - RNA, 21 nt, Human
uauaugcucugcauguuacau

SEQ ID NO: 2934879 - RNA, 13 nt, Human
uauaugcuucugu

SEQ ID NO: 2934880 - RNA, 17 nt, Human
ucaugcuguucaugaaa

SEQ ID NO: 2934881 - RNA, 14 nt, Human
ucauccacugugcc

SEQ ID NO: 2934882 - RNA, 17 nt, Human
ucauccacugugccaug

SEQ ID NO: 2934883 - RNA, 19 nt, Human
ucaucuugaauuguaagga

SEQ ID NO: 2934884 - RNA, 14 nt, Human
ucaucauccuaagc

SEQ ID NO: 2934885 - RNA, 17 nt, Human
ucaucaaugaaugaaug

SEQ ID NO: 2934886 - RNA, 20 nt, Human
ucaguguacauggaauaaca

SEQ ID NO: 2934887 - RNA, 12 nt, Human
ucauagcagcuu

SEQ ID NO: 2934888 - RNA, 11 nt, Human
ucauagcagcu

SEQ ID NO: 2934889 - RNA, 13 nt, Human
uccaaaguacacu

SEQ ID NO: 2934890 - RNA, 17 nt, Human
uccaaagaaauguaagg

SEQ ID NO: 2934891 - RNA, 14 nt, Human
uccaaagaaaugua

SEQ ID NO: 2934892 - RNA, 16 nt, Human
ucauuaggauggcuag

SEQ ID NO: 2934893 - RNA, 20 nt, Human
ucagguggggcagcuugagg

SEQ ID NO: 2934894 - RNA, 21 nt, Human
ucagucugauucccaagcucu

SEQ ID NO: 2934895 - RNA, 22 nt, Human
ucagucugauucccaagcucug

SEQ ID NO: 2934896 - RNA, 23 nt, Human
ucagucugauucccaagcucugc

SEQ ID NO: 2934897 - RNA, 16 nt, Human
ucaggugauccaccca

SEQ ID NO: 2934898 - RNA, 23 nt, Human
ucaggugagaagcagaggaagga

SEQ ID NO: 2934899 - RNA, 23 nt, Human
ucaggugauccacccaccucagc

SEQ ID NO: 2934900 - RNA, 18 nt, Human
ucagguggggcagcuuga

SEQ ID NO: 2934901 - RNA, 19 nt, Human
ucagguggggcagcuugag

SEQ ID NO: 2934902 - RNA, 21 nt, Human
ucaggccugggggcugggcag

SEQ ID NO: 2934903 - RNA, 23 nt, Human
ucagcuccagcucaccagcccca

SEQ ID NO: 2934904 - RNA, 24 nt, Human
ucagcuccagcucaccagccccag

SEQ ID NO: 2934905 - RNA, 23 nt, Human
ucagcucugcaagaauugaagca

SEQ ID NO: 2934906 - RNA, 23 nt, Human
ucaggaagcucagggccuggcuc

SEQ ID NO: 2934907 - RNA, 15 nt, Human
uccauacauuugugu

SEQ ID NO: 2934908 - RNA, 15 nt, Human
uccauagagagcaag

SEQ ID NO: 2934909 - RNA, 14 nt, Human
uccauagagagcaa

SEQ ID NO: 2934910 - RNA, 20 nt, Human
uccaugggccauaugaaaag

SEQ ID NO: 2934911 - RNA, 12 nt, Human
uccauacauuug

SEQ ID NO: 2934912 - RNA, 18 nt, Human
uccagguuuaagcuguua

SEQ ID NO: 2934913 - RNA, 19 nt, Human
uccagguagagggugugua

SEQ ID NO: 2934914 - RNA, 20 nt, Human
uccagguuuaagcuguuacu

SEQ ID NO: 2934915 - RNA, 14 nt, Human
uccagcugcugaga

SEQ ID NO: 2934916 - RNA, 20 nt, Human
uccaggggugggacacccug

SEQ ID NO: 2934917 - RNA, 19 nt, Human
uccaggggugggacacccu

SEQ ID NO: 2934918 - RNA, 15 nt, Human
uccaggagcagccac

SEQ ID NO: 2934919 - RNA, 14 nt, Human
uccaggagcagcca

SEQ ID NO: 2934920 - RNA, 13 nt, Human
uccaggagcagcc

SEQ ID NO: 2934921 - RNA, 12 nt, Human
uccaggagcagc

SEQ ID NO: 2934922 - RNA, 19 nt, Human
uccacuuucuagccagagg

SEQ ID NO: 2934923 - RNA, 23 nt, Human
uccacuuggucugugagaugcua

SEQ ID NO: 2934924 - RNA, 21 nt, Human
uccacuuucuagccagaggag

SEQ ID NO: 2934925 - RNA, 20 nt, Human
uccacuuucuagccagagga

SEQ ID NO: 2934926 - RNA, 21 nt, Human
uccacuuggucugugagaugc

SEQ ID NO: 2934927 - RNA, 17 nt, Human
uccacuuggucugugag

SEQ ID NO: 2934928 - RNA, 14 nt, Human
uccaaaguacacug

SEQ ID NO: 2934929 - RNA, 16 nt, Human
uccaaaguacacuguu

SEQ ID NO: 2934930 - RNA, 13 nt, Human
ucccaccuuggcu

SEQ ID NO: 2934931 - RNA, 14 nt, Human
ucccaccuggcucu

SEQ ID NO: 2934932 - RNA, 15 nt, Human
ucccaccuggcucug

SEQ ID NO: 2934933 - RNA, 16 nt, Human
ucccaccuggcucugu

SEQ ID NO: 2934934 - RNA, 19 nt, Human
ucccaccuggcucuguggc

SEQ ID NO: 2934935 - RNA, 16 nt, Human
ucccaccuuggcugca

SEQ ID NO: 2934936 - RNA, 17 nt, Human
ucccaccuuggcugcag

SEQ ID NO: 2934937 - RNA, 20 nt, Human
ucccagcugugcucuggaca

SEQ ID NO: 2934938 - RNA, 18 nt, Human
ucccaccuuggcugcagg

SEQ ID NO: 2934939 - RNA, 22 nt, Human
ucccaccucucucacuccuuga

SEQ ID NO: 2934940 - RNA, 20 nt, Human
uccaugugggcuaguugggc

SEQ ID NO: 2934941 - RNA, 24 nt, Human
ucccaggcauuccccaggaggcca

SEQ ID NO: 2934942 - RNA, 23 nt, Human
ucccaggcauuccccaggaggcc

SEQ ID NO: 2934943 - RNA, 20 nt, Human
ucccaccuggcucuguggcg

SEQ ID NO: 2934944 - RNA, 23 nt, Human
ucccagcugugcucuggacaggc

SEQ ID NO: 2934945 - RNA, 21 nt, Human
ucccagcugugcucuggacag

SEQ ID NO: 2934946 - RNA, 22 nt, Human
ucccagcugugcucuggacagg

SEQ ID NO: 2934947 - RNA, 15 nt, Human
ucccaucuuccaagg

SEQ ID NO: 2934948 - RNA, 21 nt, Human
ucccaucugugaaaggaaaga

SEQ ID NO: 2934949 - RNA, 18 nt, Human
ucccaugagccucagcau

SEQ ID NO: 2934950 - RNA, 19 nt, Human
ucccaugagccucagcauc

SEQ ID NO: 2934951 - RNA, 14 nt, Human
uccccaggaggcca

SEQ ID NO: 2934952 - RNA, 22 nt, Human
ucccccagccccauccucugua

SEQ ID NO: 2934953 - RNA, 21 nt, Human
ucccccagccccauccucugu

SEQ ID NO: 2934954 - RNA, 20 nt, Human
ucccccagccccauccucug

SEQ ID NO: 2934955 - RNA, 16 nt, Human
uccccaggaggccagc

SEQ ID NO: 2934956 - RNA, 15 nt, Human
uccccaggaggccag

SEQ ID NO: 2934957 - RNA, 17 nt, Human
ucccccagccccauccu

SEQ ID NO: 2934958 - RNA, 13 nt, Human
uccccaggaggcc

SEQ ID NO: 2934959 - RNA, 19 nt, Human
uccccagauugcaacaggc

SEQ ID NO: 2934960 - RNA, 20 nt, Human
uccccagauugcaacaggcu

SEQ ID NO: 2934961 - RNA, 22 nt, Human
uccccagauugcaacaggcugg

SEQ ID NO: 2934962 - RNA, 23 nt, Human
uccccagauugcaacaggcuggg

SEQ ID NO: 2934963 - RNA, 20 nt, Human
uccccagcaagugagagcug

SEQ ID NO: 2934964 - RNA, 21 nt, Human
uccccagcaagugagagcugg

SEQ ID NO: 2934965 - RNA, 22 nt, Human
uccccagcaagugagagcuggg

SEQ ID NO: 2934966 - RNA, 20 nt, Human
ucccaugagccucagcaucc

SEQ ID NO: 2934967 - RNA, 13 nt, Human
uccccagauugca

SEQ ID NO: 2934968 - RNA, 18 nt, Human
uccccagauugcaacagg

SEQ ID NO: 2934969 - RNA, 12 nt, Human
uccucccaccuc

SEQ ID NO: 2934970 - RNA, 10 nt, Human
uccuccaggu

SEQ ID NO: 2934971 - RNA, 16 nt, Human
uccuccacauuuguuu

SEQ ID NO: 2934972 - RNA, 13 nt, Human
uccuccacauuug

SEQ ID NO: 2934973 - RNA, 18 nt, Human
uccucauuagcauuuugc

SEQ ID NO: 2934974 - RNA, 22 nt, Human
uccucauuuuuauaaugucccu

SEQ ID NO: 2934975 - RNA, 23 nt, Human
uccuauauuguuuucaguguaca

SEQ ID NO: 2934976 - RNA, 21 nt, Human
uccuauauuguuuucagugua

SEQ ID NO: 2934977 - RNA, 23 nt, Human
uccuagugaaagaggcagcuuga

SEQ ID NO: 2934978 - RNA, 14 nt, Human
uccuagugaaagag

SEQ ID NO: 2934979 - RNA, 17 nt, Human
uccuagucauucuuccc

SEQ ID NO: 2934980 - RNA, 16 nt, Human
uccgcuuucuacccag

SEQ ID NO: 2934981 - RNA, 18 nt, Human
uccgcuuucuacccagcg

SEQ ID NO: 2934982 - RNA, 20 nt, Human
uccgcuuucuacccagcgag

SEQ ID NO: 2934983 - RNA, 20 nt, Human
uccuaagcuauucaguaaua

SEQ ID NO: 2934984 - RNA, 21 nt, Human
uccuaagcuauucaguaauaa

SEQ ID NO: 2934985 - RNA, 15 nt, Human
ucccuuggacauuuu

SEQ ID NO: 2934986 - RNA, 21 nt, Human
ucccuuggacauuuuaugucu

SEQ ID NO: 2934987 - RNA, 19 nt, Human
ucccuuggacauuuuaugu

SEQ ID NO: 2934988 - RNA, 18 nt, Human
ucccuuggacauuuuaug

SEQ ID NO: 2934989 - RNA, 16 nt, Human
ucccuuggacauuuua

SEQ ID NO: 2934990 - RNA, 14 nt, Human
uccgccucuugggu

SEQ ID NO: 2934991 - RNA, 15 nt, Human
ucccuuccucuuucc

SEQ ID NO: 2934992 - RNA, 16 nt, Human
ucccuuccucuuucca

SEQ ID NO: 2934993 - RNA, 15 nt, Human
ucccccuuccaugga

SEQ ID NO: 2934994 - RNA, 20 nt, Human
ucccuucacaaacccagugu

SEQ ID NO: 2934995 - RNA, 20 nt, Human
uccugcccuuaccugccagg

SEQ ID NO: 2934996 - RNA, 17 nt, Human
uccugcccuuaccugcc

SEQ ID NO: 2934997 - RNA, 22 nt, Human
uccuggacugagggggccugga

SEQ ID NO: 2934998 - RNA, 20 nt, Human
uccuggacugagggggccug

SEQ ID NO: 2934999 - RNA, 14 nt, Human
uccuggacugaggg

SEQ ID NO: 2935000 - RNA, 14 nt, Human
uccuggaguucugg

SEQ ID NO: 2935001 - RNA, 23 nt, Human
uccuggcacccggccccugcugg

SEQ ID NO: 2935002 - RNA, 22 nt, Human
uccuggcacccggccccugcug

SEQ ID NO: 2935003 - RNA, 16 nt, Human
uccuggcacugcuucc

SEQ ID NO: 2935004 - RNA, 13 nt, Human
uccuggcacugcu

SEQ ID NO: 2935005 - RNA, 13 nt, Human
uccuggcccaggg

SEQ ID NO: 2935006 - RNA, 22 nt, Human
uccuggcccagggcaucuggga

SEQ ID NO: 2935007 - RNA, 15 nt, Human
uccuggcccagggca

SEQ ID NO: 2935008 - RNA, 16 nt, Human
uccuggcccagggcau

SEQ ID NO: 2935009 - RNA, 19 nt, Human
uccuggcccagggcaucug

SEQ ID NO: 2935010 - RNA, 12 nt, Human
uccuggccucaa

SEQ ID NO: 2935011 - RNA, 22 nt, Human
uccuguaccucuugagccuuga

SEQ ID NO: 2935012 - RNA, 11 nt, Human
uccuguagccc

SEQ ID NO: 2935013 - RNA, 13 nt, Human
uccuguagcccua

SEQ ID NO: 2935014 - RNA, 21 nt, Human
uccugagccagauuucacucu

SEQ ID NO: 2935015 - RNA, 14 nt, Human
uccugccaggcaug

SEQ ID NO: 2935016 - RNA, 13 nt, Human
uccugccaggcau

SEQ ID NO: 2935017 - RNA, 17 nt, Human
uccugaggcuccacuug

SEQ ID NO: 2935018 - RNA, 19 nt, Human
uccugaggcuccacuuggu

SEQ ID NO: 2935019 - RNA, 20 nt, Human
uccugaggcuccacuugguc

SEQ ID NO: 2935020 - RNA, 18 nt, Human
uccugccccugagcccau

SEQ ID NO: 2935021 - RNA, 17 nt, Human
uccugccccugagccca

SEQ ID NO: 2935022 - RNA, 13 nt, Human
ucgugacaacacu

SEQ ID NO: 2935023 - RNA, 15 nt, Human
ucggccccaccagug

SEQ ID NO: 2935024 - RNA, 12 nt, Human
ucggagaagagc

SEQ ID NO: 2935025 - RNA, 16 nt, Human
ucggagaagagcuguu

SEQ ID NO: 2935026 - RNA, 14 nt, Human
ucggagaagagcug

SEQ ID NO: 2935027 - RNA, 18 nt, Human
ucuaaaggcuaccuuugu

SEQ ID NO: 2935028 - RNA, 17 nt, Human
ucuaaaggcuaccuuug

SEQ ID NO: 2935029 - RNA, 19 nt, Human
ucuaaaggcuaccuuugua

SEQ ID NO: 2935030 - RNA, 20 nt, Human
ucuaaaggcuaccuuuguau

SEQ ID NO: 2935031 - RNA, 21 nt, Human
ucuacacugugcugagucuga

SEQ ID NO: 2935032 - RNA, 15 nt, Human
ucuacagaggccaug

SEQ ID NO: 2935033 - RNA, 16 nt, Human
ucuacagaggccaugg

SEQ ID NO: 2935034 - RNA, 14 nt, Human
ucuaccuuccugca

SEQ ID NO: 2935035 - RNA, 16 nt, Human
ucuaggaagacuuugg

SEQ ID NO: 2935036 - RNA, 15 nt, Human
ucuaggaagacuuug

SEQ ID NO: 2935037 - RNA, 19 nt, Human
ucuaggaagacuuuggaaa

SEQ ID NO: 2935038 - RNA, 18 nt, Human
ucuaugaaauauuauguu

SEQ ID NO: 2935039 - RNA, 14 nt, Human
ucuaugacacaugc

SEQ ID NO: 2935040 - RNA, 17 nt, Human
ucuaugacacaugcaag

SEQ ID NO: 2935041 - RNA, 16 nt, Human
ucucauacucaccuca

SEQ ID NO: 2935042 - RNA, 18 nt, Human
ucucauacucaccucacc

SEQ ID NO: 2935043 - RNA, 19 nt, Human
ucuaugggacucaaugcac

SEQ ID NO: 2935044 - RNA, 12 nt, Human
ucuaugggacuc

SEQ ID NO: 2935045 - RNA, 13 nt, Human
ucuaugggacuca

SEQ ID NO: 2935046 - RNA, 23 nt, Human
ucucaguccaugaagauguagag

SEQ ID NO: 2935047 - RNA, 13 nt, Human
ucuccacccugcu

SEQ ID NO: 2935048 - RNA, 17 nt, Human
ucuccacccugcucucc

SEQ ID NO: 2935049 - RNA, 14 nt, Human
ucuccacccugcuc

SEQ ID NO: 2935050 - RNA, 16 nt, Human
ucuccacccugcucuc

SEQ ID NO: 2935051 - RNA, 22 nt, Human
ucuccaccugccagggacagag

SEQ ID NO: 2935052 - RNA, 19 nt, Human
ucuccaccugccagggaca

SEQ ID NO: 2935053 - RNA, 17 nt, Human
ucuccaccugccaggga

SEQ ID NO: 2935054 - RNA, 16 nt, Human
ucuccaccugccaggg

SEQ ID NO: 2935055 - RNA, 15 nt, Human
ucuccaccugccagg

SEQ ID NO: 2935056 - RNA, 14 nt, Human
ucuccaccugccag

SEQ ID NO: 2935057 - RNA, 18 nt, Human
ucucccugcugcuccuag

SEQ ID NO: 2935058 - RNA, 20 nt, Human
ucucccugcugcuccuagga

SEQ ID NO: 2935059 - RNA, 18 nt, Human
ucucccucagucuggccc

SEQ ID NO: 2935060 - RNA, 23 nt, Human
ucucccucagucuggcccuuccu

SEQ ID NO: 2935061 - RNA, 12 nt, Human
ucucccccagcc

SEQ ID NO: 2935062 - RNA, 15 nt, Human
ucuccagccccugga

SEQ ID NO: 2935063 - RNA, 14 nt, Human
ucuccagccccugg

SEQ ID NO: 2935064 - RNA, 13 nt, Human
ucuccagccccug

SEQ ID NO: 2935065 - RNA, 12 nt, Human
ucuccagccccu

SEQ ID NO: 2935066 - RNA, 13 nt, Human
ucuccagcugcug

SEQ ID NO: 2935067 - RNA, 15 nt, Human
ucuccagcugcugag

SEQ ID NO: 2935068 - RNA, 18 nt, Human
ucuccagccccuggaugc

SEQ ID NO: 2935069 - RNA, 16 nt, Human
ucuccagccccuggau

SEQ ID NO: 2935070 - RNA, 22 nt, Human
ucuccagccccuggaugcagcc

SEQ ID NO: 2935071 - RNA, 13 nt, Human
ugaaguccaagca

SEQ ID NO: 2935072 - RNA, 17 nt, Human
ugaaggccccgcccagg

SEQ ID NO: 2935073 - RNA, 11 nt, Human
ugaaguccaag

SEQ ID NO: 2935074 - RNA, 15 nt, Human
ugaagauacugaaau

SEQ ID NO: 2935075 - RNA, 16 nt, Human
ugaagauacugaaaua

SEQ ID NO: 2935076 - RNA, 18 nt, Human
ugaagauacugaaauaaa

SEQ ID NO: 2935077 - RNA, 23 nt, Human
ugaacauuuggguuacuauuucu

SEQ ID NO: 2935078 - RNA, 17 nt, Human
ugaacuccuggccucaa

SEQ ID NO: 2935079 - RNA, 14 nt, Human
ugaagauacugaaa

SEQ ID NO: 2935080 - RNA, 16 nt, Human
ugaaggccccgcccag

SEQ ID NO: 2935081 - RNA, 15 nt, Human
ugaaggccccgccca

SEQ ID NO: 2935082 - RNA, 22 nt, Human
ugaaggacauugcggacagcca

SEQ ID NO: 2935083 - RNA, 19 nt, Human
ugaaggacauugcggacag

SEQ ID NO: 2935084 - RNA, 20 nt, Human
ugaaggacauugcggacagc

SEQ ID NO: 2935085 - RNA, 16 nt, Human
ugaauuccuaaaauua

SEQ ID NO: 2935086 - RNA, 17 nt, Human
ugaauuccuaaaauuau

SEQ ID NO: 2935087 - RNA, 23 nt, Human
ugaauuccuaaaauuauggaaac

SEQ ID NO: 2935088 - RNA, 15 nt, Human
ugaauuaugaaacuu

SEQ ID NO: 2935089 - RNA, 17 nt, Human
ugaauuaugaaacuuuu

SEQ ID NO: 2935090 - RNA, 13 nt, Human
ugaauuaugaaac

SEQ ID NO: 2935091 - RNA, 14 nt, Human
ugaauuacauuugu

SEQ ID NO: 2935092 - RNA, 15 nt, Human
ugaauuacauuugua

SEQ ID NO: 2935093 - RNA, 16 nt, Human
ugaauuacauuuguau

SEQ ID NO: 2935094 - RNA, 18 nt, Human
ugaauuacauuuguauaa

SEQ ID NO: 2935095 - RNA, 20 nt, Human
ugaaugaauggcuaagcaaa

SEQ ID NO: 2935096 - RNA, 16 nt, Human
ugaccauucuccaccu

SEQ ID NO: 2935097 - RNA, 18 nt, Human
ugaccauucuccaccugc

SEQ ID NO: 2935098 - RNA, 17 nt, Human
ugaccauucuccaccug

SEQ ID NO: 2935099 - RNA, 20 nt, Human
ugaccgugaggccagagaca

SEQ ID NO: 2935100 - RNA, 16 nt, Human
ugaccgugaggccaga

SEQ ID NO: 2935101 - RNA, 14 nt, Human
ugaccgugaggcca

SEQ ID NO: 2935102 - RNA, 13 nt, Human
ugaccgugaggcc

SEQ ID NO: 2935103 - RNA, 13 nt, Human
ugacauauacaua

SEQ ID NO: 2935104 - RNA, 18 nt, Human
ugacauauacauacuuac

SEQ ID NO: 2935105 - RNA, 16 nt, Human
ugacaugggacauuug

SEQ ID NO: 2935106 - RNA, 17 nt, Human
ugacaugggacauuugc

SEQ ID NO: 2935107 - RNA, 18 nt, Human
ugacaugggacauuugcu

SEQ ID NO: 2935108 - RNA, 13 nt, Human
ugacaugucuuuu

SEQ ID NO: 2935109 - RNA, 15 nt, Human
ugacaugucuuuucu

SEQ ID NO: 2935110 - RNA, 18 nt, Human
ugaccacugcagaagaca

SEQ ID NO: 2935111 - RNA, 20 nt, Human
ugaccacugcagaagacagu

SEQ ID NO: 2935112 - RNA, 19 nt, Human
ugaccagcaccaucucucc

SEQ ID NO: 2935113 - RNA, 19 nt, Human
ugacagagugagacucugu

SEQ ID NO: 2935114 - RNA, 18 nt, Human
ugacagaggcagccccau

SEQ ID NO: 2935115 - RNA, 23 nt, Human
ugacagaggcagccccauucugc

SEQ ID NO: 2935116 - RNA, 14 nt, Human
ugacagagugagac

SEQ ID NO: 2935117 - RNA, 17 nt, Human
ugacagagugagacucu

SEQ ID NO: 2935118 - RNA, 13 nt, Human
ugacagaggcagc

SEQ ID NO: 2935119 - RNA, 20 nt, Human
ugacagacacaggcccggcu

SEQ ID NO: 2935120 - RNA, 23 nt, Human
ugacagacacaggcccggcucca

SEQ ID NO: 2935121 - RNA, 14 nt, Human
ugacagaggcagcc

SEQ ID NO: 2935122 - RNA, 15 nt, Human
ugacagaggcagccc

SEQ ID NO: 2935123 - RNA, 16 nt, Human
ugacagaggcagcccc

SEQ ID NO: 2935124 - RNA, 17 nt, Human
ugacagaggcagcccca

SEQ ID NO: 2935125 - RNA, 18 nt, Human
ugacaaggauugcuacug

SEQ ID NO: 2935126 - RNA, 15 nt, Human
ugacaagcucacaga

SEQ ID NO: 2935127 - RNA, 20 nt, Human
ugacaagcucacagaccuuu

SEQ ID NO: 2935128 - RNA, 12 nt, Human
ugacaagcucac

SEQ ID NO: 2935129 - RNA, 13 nt, Human
ugaaagggcccag

SEQ ID NO: 2935130 - RNA, 23 nt, Human
ugaaagggaguauuacaaaaaca

SEQ ID NO: 2935131 - RNA, 16 nt, Human
ugaaagguacuucaaa

SEQ ID NO: 2935132 - RNA, 18 nt, Human
ugaaagggcccagagagg

SEQ ID NO: 2935133 - RNA, 15 nt, Human
ugaaagguacuucaa

SEQ ID NO: 2935134 - RNA, 18 nt, Human
ugaaagcccugagcuuuc

SEQ ID NO: 2935135 - RNA, 18 nt, Human
ugaaagaggcagcuugaa

SEQ ID NO: 2935136 - RNA, 20 nt, Human
ugaaaagccucuguuuugau

SEQ ID NO: 2935137 - RNA, 22 nt, Human
ugaaaagccucuguuuugauau

SEQ ID NO: 2935138 - RNA, 19 nt, Human
ugaaaagccucuguuuuga

SEQ ID NO: 2935139 - RNA, 16 nt, Human
ugaaaagccucuguuu

SEQ ID NO: 2935140 - RNA, 19 nt, Human
ugaaaauuuugauguuuua

SEQ ID NO: 2935141 - RNA, 21 nt, Human
ugaaaauuuugauguuuuaag

SEQ ID NO: 2935142 - RNA, 13 nt, Human
ugaaaauuuugau

SEQ ID NO: 2935143 - RNA, 14 nt, Human
ugaaacauuuuguc

SEQ ID NO: 2935144 - RNA, 22 nt, Human
ugaaacaacaaauaggaauugu

SEQ ID NO: 2935145 - RNA, 13 nt, Human
ugaaaugucaguu

SEQ ID NO: 2935146 - RNA, 17 nt, Human
ugaaaugucaguucuga

SEQ ID NO: 2935147 - RNA, 13 nt, Human
ugaaaugucaacc

SEQ ID NO: 2935148 - RNA, 18 nt, Human
ugaaaugucaguucugau

SEQ ID NO: 2935149 - RNA, 20 nt, Human
ugaaaugucaguucugauau

SEQ ID NO: 2935150 - RNA, 18 nt, Human
ugaaauauuauguuaaaa

SEQ ID NO: 2935151 - RNA, 16 nt, Human
ugaaauauugacuuuu

SEQ ID NO: 2935152 - RNA, 19 nt, Human
ugaaauggacuuuuguaca

SEQ ID NO: 2935153 - RNA, 22 nt, Human
ugaacauuuggguuacuauuuc

SEQ ID NO: 2935154 - RNA, 17 nt, Human
ugaacauuucauggugu

SEQ ID NO: 2935155 - RNA, 22 nt, Human
ugaaccaagaacuuuccaggaa

SEQ ID NO: 2935156 - RNA, 23 nt, Human
ugaaccacaucuugcucugcuga

SEQ ID NO: 2935157 - RNA, 17 nt, Human
ugaaccaccacacccag

SEQ ID NO: 2935158 - RNA, 20 nt, Human
ugaaccaccacacccagccc

SEQ ID NO: 2935159 - RNA, 16 nt, Human
ugaacuccuggccuca

SEQ ID NO: 2935160 - RNA, 19 nt, Human
ugaacaguuguguuugaag

SEQ ID NO: 2935161 - RNA, 17 nt, Human
ugaacaguaacauagcu

SEQ ID NO: 2935162 - RNA, 23 nt, Human
ucuuucacccuuuucuguuugcu

SEQ ID NO: 2935163 - RNA, 17 nt, Human
ucuuucacauuuaaaua

SEQ ID NO: 2935164 - RNA, 21 nt, Human
ucuuguguguuuauugucaaa

SEQ ID NO: 2935165 - RNA, 16 nt, Human
ucuuguguguuuauug

SEQ ID NO: 2935166 - RNA, 23 nt, Human
ucuugcaauggcagccuuggcaa

SEQ ID NO: 2935167 - RNA, 20 nt, Human
ucuccucugcugcuggcugg

SEQ ID NO: 2935168 - RNA, 16 nt, Human
ucucccuucauccuuc

SEQ ID NO: 2935169 - RNA, 17 nt, Human
ucuuuggacacucacac

SEQ ID NO: 2935170 - RNA, 12 nt, Human
ucuuugccaagu

SEQ ID NO: 2935171 - RNA, 13 nt, Human
ucuuuccaaagua

SEQ ID NO: 2935172 - RNA, 14 nt, Human
ucuuuccaaaguac

SEQ ID NO: 2935173 - RNA, 21 nt, Human
ucuuucagccaagaauucuua

SEQ ID NO: 2935174 - RNA, 20 nt, Human
ucuuucagccaagaauucuu

SEQ ID NO: 2935175 - RNA, 19 nt, Human
ucuuucagccaagaauucu

SEQ ID NO: 2935176 - RNA, 16 nt, Human
ucuuucagccaagaau

SEQ ID NO: 2935177 - RNA, 19 nt, Human
ucuuuccacagaagcucca

SEQ ID NO: 2935178 - RNA, 22 nt, Human
ugauugccuuuuuauaacuuuu

SEQ ID NO: 2935179 - RNA, 17 nt, Human
ugauugccuuuuuauaa

SEQ ID NO: 2935180 - RNA, 21 nt, Human
ugauucuccugccucagccuc

SEQ ID NO: 2935181 - RNA, 23 nt, Human
ugauucagacagcugccugggau

SEQ ID NO: 2935182 - RNA, 21 nt, Human
ugauucagacagcugccuggg

SEQ ID NO: 2935183 - RNA, 20 nt, Human
ugauucagacagcugccugg

SEQ ID NO: 2935184 - RNA, 19 nt, Human
ugauucagacagcugccug

SEQ ID NO: 2935185 - RNA, 18 nt, Human
ugauucagacagcugccu

SEQ ID NO: 2935186 - RNA, 16 nt, Human
ugauugugucucuugg

SEQ ID NO: 2935187 - RNA, 15 nt, Human
ugauuuaaacacauu

SEQ ID NO: 2935188 - RNA, 18 nt, Human
ugauuuaaacacauuaaa

SEQ ID NO: 2935189 - RNA, 16 nt, Human
ugauuuaaacacauua

SEQ ID NO: 2935190 - RNA, 17 nt, Human
ugauuuaaacacauuaa

SEQ ID NO: 2935191 - RNA, 23 nt, Human
ugauugggcacaucauuucaaga

SEQ ID NO: 2935192 - RNA, 18 nt, Human
ugauugggcacaucauuu

SEQ ID NO: 2935193 - RNA, 20 nt, Human
ugauugggcacaucauuuca

SEQ ID NO: 2935194 - RNA, 21 nt, Human
ugauugggcacaucauuucaa

SEQ ID NO: 2935195 - RNA, 17 nt, Human
ugauugggcacaucauu

SEQ ID NO: 2935196 - RNA, 21 nt, Human
ugauuggaggggggagguggg

SEQ ID NO: 2935197 - RNA, 13 nt, Human
ugauuggaggggg

SEQ ID NO: 2935198 - RNA, 21 nt, Human
ugauucaccuccuaaaacaac

SEQ ID NO: 2935199 - RNA, 16 nt, Human
ugauucagacagcugc

SEQ ID NO: 2935200 - RNA, 15 nt, Human
ugauucagacagcug

SEQ ID NO: 2935201 - RNA, 14 nt, Human
ugauucagacagcu

SEQ ID NO: 2935202 - RNA, 13 nt, Human
ugauucagacagc

SEQ ID NO: 2935203 - RNA, 20 nt, Human
ugauucaacagguuuuccug

SEQ ID NO: 2935204 - RNA, 16 nt, Human
ugauuauuacuggcaa

SEQ ID NO: 2935205 - RNA, 21 nt, Human
ugauuaugaauuacauuugua

SEQ ID NO: 2935206 - RNA, 22 nt, Human
ugauuaugaauuacauuuguau

SEQ ID NO: 2935207 - RNA, 13 nt, Human
ugauuauauguca

SEQ ID NO: 2935208 - RNA, 17 nt, Human
ugauuaugaauuacauu

SEQ ID NO: 2935209 - RNA, 19 nt, Human
ugauuaugaauuacauuug

SEQ ID NO: 2935210 - RNA, 20 nt, Human
ugauguucuuucacccuuuu

SEQ ID NO: 2935211 - RNA, 16 nt, Human
ugauuaccagggacug

SEQ ID NO: 2935212 - RNA, 17 nt, Human
ugaucagcuuauugucu

SEQ ID NO: 2935213 - RNA, 24 nt, Human
ugaucagcuuauugucuagugaaa

SEQ ID NO: 2935214 - RNA, 14 nt, Human
ugauagcacagacc

SEQ ID NO: 2935215 - RNA, 13 nt, Human
ugauagcacagac

SEQ ID NO: 2935216 - RNA, 18 nt, Human
ugaucauguuuaugagaa

SEQ ID NO: 2935217 - RNA, 13 nt, Human
ugauccaagcugg

SEQ ID NO: 2935218 - RNA, 14 nt, Human
ugauccaagcuggu

SEQ ID NO: 2935219 - RNA, 15 nt, Human
ugauccaagcugguc

SEQ ID NO: 2935220 - RNA, 16 nt, Human
ugauccacccaccuca

SEQ ID NO: 2935221 - RNA, 17 nt, Human
ugaucucucgugauuga

SEQ ID NO: 2935222 - RNA, 17 nt, Human
ugauccacccaccucag

SEQ ID NO: 2935223 - RNA, 18 nt, Human
ugauccacccaccucagc

SEQ ID NO: 2935224 - RNA, 19 nt, Human
ugauccacccaccucagcc

SEQ ID NO: 2935225 - RNA, 14 nt, Human
ugaucuuuaaaaua

SEQ ID NO: 2935226 - RNA, 20 nt, Human
ugaucuucuuuauaauucua

SEQ ID NO: 2935227 - RNA, 16 nt, Human
ugaucuuugcagacag

SEQ ID NO: 2935228 - RNA, 17 nt, Human
ugaucuuuaaaauacac

SEQ ID NO: 2935229 - RNA, 23 nt, Human
ugaugcuacaggauuugaaauug

SEQ ID NO: 2935230 - RNA, 20 nt, Human
ugaugcuacaggauuugaaa

SEQ ID NO: 2935231 - RNA, 16 nt, Human
ugauguguuaucucuu

SEQ ID NO: 2935232 - RNA, 15 nt, Human
ugauggugguauguu

SEQ ID NO: 2935233 - RNA, 17 nt, Human
ugaugcuucuucagaga

SEQ ID NO: 2935234 - RNA, 16 nt, Human
ugaugcuucuucagag

SEQ ID NO: 2935235 - RNA, 16 nt, Human
ugauaacuggaaacuu

SEQ ID NO: 2935236 - RNA, 14 nt, Human
ugagugagcaugcc

SEQ ID NO: 2935237 - RNA, 20 nt, Human
ugaguugauagcacagaccc

SEQ ID NO: 2935238 - RNA, 16 nt, Human
ugaguugauagcacag

SEQ ID NO: 2935239 - RNA, 19 nt, Human
ugaguccagaaguuugaga

SEQ ID NO: 2935240 - RNA, 13 nt, Human
ugaguccagaagu

SEQ ID NO: 2935241 - RNA, 18 nt, Human
ugagucgaggacagggag

SEQ ID NO: 2935242 - RNA, 19 nt, Human
ugagucgaggacagggagg

SEQ ID NO: 2935243 - RNA, 18 nt, Human
ugagucugaaggcugggu

SEQ ID NO: 2935244 - RNA, 17 nt, Human
ugagucugaaggcuggg

SEQ ID NO: 2935245 - RNA, 15 nt, Human
ugagucugaaggcug

SEQ ID NO: 2935246 - RNA, 13 nt, Human
ugagucugaaggc

SEQ ID NO: 2935247 - RNA, 13 nt, Human
ugagcugggauga

SEQ ID NO: 2935248 - RNA, 12 nt, Human
ugaggcauuugu

SEQ ID NO: 2935249 - RNA, 19 nt, Human
ugaggcauuuguuugaacu

SEQ ID NO: 2935250 - RNA, 20 nt, Human
ugaggcauuuguuugaacug

SEQ ID NO: 2935251 - RNA, 23 nt, Human
ugaggcuagugugguguuuccug

SEQ ID NO: 2935252 - RNA, 17 nt, Human
ugaggcuaguguggugu

SEQ ID NO: 2935253 - RNA, 21 nt, Human
ugaggcauuuguuugaacuga

SEQ ID NO: 2935254 - RNA, 13 nt, Human
ugaggugggagga

SEQ ID NO: 2935255 - RNA, 12 nt, Human
ugaggugggagg

SEQ ID NO: 2935256 - RNA, 16 nt, Human
ugagggagaugccaug

SEQ ID NO: 2935257 - RNA, 17 nt, Human
ugagggaacagagaggu

SEQ ID NO: 2935258 - RNA, 18 nt, Human
ugaggcuccacuuggucu

SEQ ID NO: 2935259 - RNA, 20 nt, Human
ugaggcuccacuuggucugu

SEQ ID NO: 2935260 - RNA, 14 nt, Human
ugaggcucugcccu

SEQ ID NO: 2935261 - RNA, 13 nt, Human
ugaggcucugccc

SEQ ID NO: 2935262 - RNA, 22 nt, Human
ugagccucagcauccuggcacc

SEQ ID NO: 2935263 - RNA, 18 nt, Human
ugagccucagcauccugg

SEQ ID NO: 2935264 - RNA, 21 nt, Human
ugagccucagcauccuggcac

SEQ ID NO: 2935265 - RNA, 19 nt, Human
ugagccgagaucacgccac

SEQ ID NO: 2935266 - RNA, 21 nt, Human
ugagccgagaucacgccacug

SEQ ID NO: 2935267 - RNA, 17 nt, Human
ugagccucagcauccug

SEQ ID NO: 2935268 - RNA, 19 nt, Human
ugagcagggcucagcgggg

SEQ ID NO: 2935269 - RNA, 16 nt, Human
ugagcagggcucagcg

SEQ ID NO: 2935270 - RNA, 17 nt, Human
ugagcagggcucagcgg

SEQ ID NO: 2935271 - RNA, 16 nt, Human
ugagcaucaggccagg

SEQ ID NO: 2935272 - RNA, 13 nt, Human
ugagccccaaaag

SEQ ID NO: 2935273 - RNA, 20 nt, Human
ugagcaucaggccaggcccu

SEQ ID NO: 2935274 - RNA, 19 nt, Human
ugagcaucaggccaggccc

SEQ ID NO: 2935275 - RNA, 18 nt, Human
ugagcaucaggccaggcc

SEQ ID NO: 2935276 - RNA, 19 nt, Human
ugagacucgcgacaaugca

SEQ ID NO: 2935277 - RNA, 20 nt, Human
ugaccucaggugauccaccc

SEQ ID NO: 2935278 - RNA, 21 nt, Human
ugaccucaggugauccaccca

SEQ ID NO: 2935279 - RNA, 12 nt, Human
ugagcagggcuc

SEQ ID NO: 2935280 - RNA, 13 nt, Human
ugagcagggcuca

SEQ ID NO: 2935281 - RNA, 14 nt, Human
ugagcagggcucag

SEQ ID NO: 2935282 - RNA, 15 nt, Human
ugagcagggcucagc

SEQ ID NO: 2935283 - RNA, 15 nt, Human
ugagaucagccuggg

SEQ ID NO: 2935284 - RNA, 14 nt, Human
ugagaucagccugg

SEQ ID NO: 2935285 - RNA, 15 nt, Human
ugagaucaaaacggu

SEQ ID NO: 2935286 - RNA, 16 nt, Human
ugagagugaacaaauu

SEQ ID NO: 2935287 - RNA, 23 nt, Human
ugagacucgcgacaaugcaaacc

SEQ ID NO: 2935288 - RNA, 22 nt, Human
ugagacucgcgacaaugcaaac

SEQ ID NO: 2935289 - RNA, 21 nt, Human
ugagacucgcgacaaugcaaa

SEQ ID NO: 2935290 - RNA, 20 nt, Human
ugagacucgcgacaaugcaa

SEQ ID NO: 2935291 - RNA, 21 nt, Human
ugcuacuguccuacccacccu

SEQ ID NO: 2935292 - RNA, 22 nt, Human
ugcuacuguccuacccacccuc

SEQ ID NO: 2935293 - RNA, 23 nt, Human
ugcucuccgaccagacaccuuga

SEQ ID NO: 2935294 - RNA, 17 nt, Human
ugcucacauaucuguca

SEQ ID NO: 2935295 - RNA, 22 nt, Human
ugcuaggaacacuccuucacag

SEQ ID NO: 2935296 - RNA, 20 nt, Human
ugcuaggaacacuccuucac

SEQ ID NO: 2935297 - RNA, 21 nt, Human
ugcuaggaacacuccuucaca

SEQ ID NO: 2935298 - RNA, 13 nt, Human
ugcuagaacuccc

SEQ ID NO: 2935299 - RNA, 14 nt, Human
ugcuagaacucccu

SEQ ID NO: 2935300 - RNA, 15 nt, Human
ugcuagaacucccuu

SEQ ID NO: 2935301 - RNA, 17 nt, Human
ugcuagaacucccuuuc

SEQ ID NO: 2935302 - RNA, 17 nt, Human
ugcuguucaugaaagau

SEQ ID NO: 2935303 - RNA, 21 nt, Human
ugcuguucacuggacacuuca

SEQ ID NO: 2935304 - RNA, 16 nt, Human
ugcuguucaugaaaga

SEQ ID NO: 2935305 - RNA, 13 nt, Human
ugcuggguguggc

SEQ ID NO: 2935306 - RNA, 20 nt, Human
ugcugggggggauuguaaaa

SEQ ID NO: 2935307 - RNA, 17 nt, Human
ugcugggcuugucugua

SEQ ID NO: 2935308 - RNA, 19 nt, Human
ugcugcugccccugcacag

SEQ ID NO: 2935309 - RNA, 12 nt, Human
ugcugcugcccc

SEQ ID NO: 2935310 - RNA, 12 nt, Human
ugcugcuugagg

SEQ ID NO: 2935311 - RNA, 20 nt, Human
ugcugggauuacagguguga

SEQ ID NO: 2935312 - RNA, 19 nt, Human
ugcugcuugaggcaacuca

SEQ ID NO: 2935313 - RNA, 17 nt, Human
ugcugcauuuaaaagau

SEQ ID NO: 2935314 - RNA, 18 nt, Human
ugcugcauuuaaaagaua

SEQ ID NO: 2935315 - RNA, 19 nt, Human
ugcugcauuuaaaagauac

SEQ ID NO: 2935316 - RNA, 19 nt, Human
ugcugccaauauccuaaua

SEQ ID NO: 2935317 - RNA, 18 nt, Human
ugcugccaauauccuaau

SEQ ID NO: 2935318 - RNA, 17 nt, Human
ugcugccaauauccuaa

SEQ ID NO: 2935319 - RNA, 16 nt, Human
ugcugccaauauccua

SEQ ID NO: 2935320 - RNA, 15 nt, Human
ugcugccaauauccu

SEQ ID NO: 2935321 - RNA, 14 nt, Human
ugcugcauuuaaaa

SEQ ID NO: 2935322 - RNA, 23 nt, Human
ugcugcauuuaaaagauacaguu

SEQ ID NO: 2935323 - RNA, 21 nt, Human
ugcugccaauauccuaauaaa

SEQ ID NO: 2935324 - RNA, 22 nt, Human
ugcugccaauauccuaauaaaa

SEQ ID NO: 2935325 - RNA, 22 nt, Human
ugcaucaauuuuucuuauuuca

SEQ ID NO: 2935326 - RNA, 15 nt, Human
ugcauauugcauacu

SEQ ID NO: 2935327 - RNA, 23 nt, Human
ugcauauugcauacuauuaaaca

SEQ ID NO: 2935328 - RNA, 16 nt, Human
ugcaguugccagucac

SEQ ID NO: 2935329 - RNA, 12 nt, Human
ugcaguucugaa

SEQ ID NO: 2935330 - RNA, 20 nt, Human
ugcaguggugcgaucugggu

SEQ ID NO: 2935331 - RNA, 21 nt, Human
ugcaguggugcgaucuggguu

SEQ ID NO: 2935332 - RNA, 21 nt, Human
ugcaguuacacuaaaagguga

SEQ ID NO: 2935333 - RNA, 17 nt, Human
ugauuuaauaugcaaag

SEQ ID NO: 2935334 - RNA, 15 nt, Human
ugauuuaauaugcaa

SEQ ID NO: 2935335 - RNA, 16 nt, Human
ugcagggacagagcau

SEQ ID NO: 2935336 - RNA, 13 nt, Human
ugcagggaguccg

SEQ ID NO: 2935337 - RNA, 20 nt, Human
ugccacccuggggagaaagu

SEQ ID NO: 2935338 - RNA, 14 nt, Human
ugccaggcauggug

SEQ ID NO: 2935339 - RNA, 10 nt, Human
ugccaggcau

SEQ ID NO: 2935340 - RNA, 16 nt, Human
ugccacuaaauugaca

SEQ ID NO: 2935341 - RNA, 22 nt, Human
ugccaggaagccagcaggcucu

SEQ ID NO: 2935342 - RNA, 20 nt, Human
ugccaggaagccagcaggcu

SEQ ID NO: 2935343 - RNA, 17 nt, Human
ugccaaagaagcagacc

SEQ ID NO: 2935344 - RNA, 23 nt, Human
ugcauuuggugguuucagaaaug

SEQ ID NO: 2935345 - RNA, 21 nt, Human
ugcauuuggugguuucagaaa

SEQ ID NO: 2935346 - RNA, 13 nt, Human
ugcaucagcugcu

SEQ ID NO: 2935347 - RNA, 16 nt, Human
ugccccuggcagcccc

SEQ ID NO: 2935348 - RNA, 12 nt, Human
ugcccggcugcg

SEQ ID NO: 2935349 - RNA, 14 nt, Human
ugcccggcugcgga

SEQ ID NO: 2935350 - RNA, 18 nt, Human
ugcccaggcuggcgugca

SEQ ID NO: 2935351 - RNA, 19 nt, Human
ugcccaggcuggcgugcag

SEQ ID NO: 2935352 - RNA, 13 nt, Human
ugcccaggcuggc

SEQ ID NO: 2935353 - RNA, 20 nt, Human
ugcccaggcuggcgugcagu

SEQ ID NO: 2935354 - RNA, 14 nt, Human
ugcccugcccaccu

SEQ ID NO: 2935355 - RNA, 15 nt, Human
ugcccugcccaccug

SEQ ID NO: 2935356 - RNA, 20 nt, Human
ugcccugcccaccuggccuc

SEQ ID NO: 2935357 - RNA, 16 nt, Human
ugcccugcccaccugg

SEQ ID NO: 2935358 - RNA, 14 nt, Human
ugccucaagagaag

SEQ ID NO: 2935359 - RNA, 15 nt, Human
ugccucaagagaagg

SEQ ID NO: 2935360 - RNA, 23 nt, Human
uggacaggcauguucucugagga

SEQ ID NO: 2935361 - RNA, 19 nt, Human
uggacugagggggccugga

SEQ ID NO: 2935362 - RNA, 23 nt, Human
uggacugagggggccuggaugcc

SEQ ID NO: 2935363 - RNA, 20 nt, Human
uggacugagggggccuggau

SEQ ID NO: 2935364 - RNA, 22 nt, Human
uggacugagggggccuggaugc

SEQ ID NO: 2935365 - RNA, 23 nt, Human
uggaggaaggaaacccagcucug

SEQ ID NO: 2935366 - RNA, 21 nt, Human
uggaggaaggaaacccagcuc

SEQ ID NO: 2935367 - RNA, 19 nt, Human
uggaucuguauguguucua

SEQ ID NO: 2935368 - RNA, 13 nt, Human
uggcaaagcagaa

SEQ ID NO: 2935369 - RNA, 18 nt, Human
uggcaaagcagaauguga

SEQ ID NO: 2935370 - RNA, 15 nt, Human
uggcaaacagggccu

SEQ ID NO: 2935371 - RNA, 16 nt, Human
uggcaaacagggccuc

SEQ ID NO: 2935372 - RNA, 18 nt, Human
uggcaaacagggccucug

SEQ ID NO: 2935373 - RNA, 19 nt, Human
uggcaaacagggccucugc

SEQ ID NO: 2935374 - RNA, 20 nt, Human
uggcaaacagggccucugcg

SEQ ID NO: 2935375 - RNA, 24 nt, Human
uggcaaacagggccucugcggagc

SEQ ID NO: 2935376 - RNA, 16 nt, Human
uggcaaaaaggcagga

SEQ ID NO: 2935377 - RNA, 12 nt, Human
uggcaaaaaggc

SEQ ID NO: 2935378 - RNA, 15 nt, Human
uggcacuauaaugua

SEQ ID NO: 2935379 - RNA, 16 nt, Human
uggcacuauaauguaa

SEQ ID NO: 2935380 - RNA, 20 nt, Human
uggcaauagucaaauugugu

SEQ ID NO: 2935381 - RNA, 15 nt, Human
uggcacuaguauuuc

SEQ ID NO: 2935382 - RNA, 11 nt, Human
uggcugcuuca

SEQ ID NO: 2935383 - RNA, 15 nt, Human
uggcugggggccuca

SEQ ID NO: 2935384 - RNA, 15 nt, Human
uggcugcuucaagga

SEQ ID NO: 2935385 - RNA, 23 nt, Human
uggccucccaacucaccccagcc

SEQ ID NO: 2935386 - RNA, 23 nt, Human
uggcgcagcauauucaggaagcu

SEQ ID NO: 2935387 - RNA, 22 nt, Human
uggcgcagcauauucaggaagc

SEQ ID NO: 2935388 - RNA, 23 nt, Human
uggcgagccauuugucccaagug

SEQ ID NO: 2935389 - RNA, 22 nt, Human
uggcgagccauuugucccaagu

SEQ ID NO: 2935390 - RNA, 16 nt, Human
uggcgcugccccuggc

SEQ ID NO: 2935391 - RNA, 23 nt, Human
uggcgcugccccuggcagccccu

SEQ ID NO: 2935392 - RNA, 15 nt, Human
uggcgcugccccugg

SEQ ID NO: 2935393 - RNA, 14 nt, Human
uggccccugcccgg

SEQ ID NO: 2935394 - RNA, 15 nt, Human
uggccccugcccggc

SEQ ID NO: 2935395 - RNA, 16 nt, Human
uggccccugcccggcu

SEQ ID NO: 2935396 - RNA, 13 nt, Human
uggccaggcuggu

SEQ ID NO: 2935397 - RNA, 16 nt, Human
uggcccaggguggcca

SEQ ID NO: 2935398 - RNA, 17 nt, Human
uggcccaggguggccac

SEQ ID NO: 2935399 - RNA, 18 nt, Human
uggcccaggguggccaca

SEQ ID NO: 2935400 - RNA, 17 nt, Human
uggccagaugcaccagc

SEQ ID NO: 2935401 - RNA, 18 nt, Human
uggccagaugcaccagcc

SEQ ID NO: 2935402 - RNA, 19 nt, Human
uggcagaguugaagacaga

SEQ ID NO: 2935403 - RNA, 17 nt, Human
uggcagaguugaagaca

SEQ ID NO: 2935404 - RNA, 21 nt, Human
uggcagaguggauucuugaac

SEQ ID NO: 2935405 - RNA, 15 nt, Human
uggcagaguugaaga

SEQ ID NO: 2935406 - RNA, 19 nt, Human
uggccagaugcaccagccc

SEQ ID NO: 2935407 - RNA, 17 nt, Human
uggguacuuguggacac

SEQ ID NO: 2935408 - RNA, 18 nt, Human
uggguacuuguggacaca

SEQ ID NO: 2935409 - RNA, 18 nt, Human
uggguauagauguugcua

SEQ ID NO: 2935410 - RNA, 14 nt, Human
uggguauagauguu

SEQ ID NO: 2935411 - RNA, 16 nt, Human
ugggggaguggccaca

SEQ ID NO: 2935412 - RNA, 22 nt, Human
ugggcuucauccuccucagauc

SEQ ID NO: 2935413 - RNA, 15 nt, Human
uggggaugagaaagg

SEQ ID NO: 2935414 - RNA, 23 nt, Human
uggggaugagaaagguugaagca

SEQ ID NO: 2935415 - RNA, 20 nt, Human
uggggccaguuggucccccu

SEQ ID NO: 2935416 - RNA, 16 nt, Human
ugggagugggcccaau

SEQ ID NO: 2935417 - RNA, 14 nt, Human
ugggagugggccca

SEQ ID NO: 2935418 - RNA, 20 nt, Human
uggcugggggccucagugcc

SEQ ID NO: 2935419 - RNA, 16 nt, Human
uggcugggggccucag

SEQ ID NO: 2935420 - RNA, 17 nt, Human
uggcugggggccucagu

SEQ ID NO: 2935421 - RNA, 14 nt, Human
ugggauccuccagg

SEQ ID NO: 2935422 - RNA, 13 nt, Human
ugggauccuccag

SEQ ID NO: 2935423 - RNA, 12 nt, Human
ugggauccucca

SEQ ID NO: 2935424 - RNA, 22 nt, Human
ugggauuacaagcgugagccac

SEQ ID NO: 2935425 - RNA, 18 nt, Human
ugggcagagcagagacca

SEQ ID NO: 2935426 - RNA, 22 nt, Human
ugggcagagcagagaccauccc

SEQ ID NO: 2935427 - RNA, 14 nt, Human
ugggccuggcuccc

SEQ ID NO: 2935428 - RNA, 23 nt, Human
ugggcagagcagagaccaucccu

SEQ ID NO: 2935429 - RNA, 12 nt, Human
ugggcagcugcc

SEQ ID NO: 2935430 - RNA, 13 nt, Human
ugggcagcugccu

SEQ ID NO: 2935431 - RNA, 14 nt, Human
ugggcagcugccuc

SEQ ID NO: 2935432 - RNA, 15 nt, Human
ugggcagcugccucc

SEQ ID NO: 2935433 - RNA, 17 nt, Human
ugggcagcugccucccc

SEQ ID NO: 2935434 - RNA, 19 nt, Human
ugggcagcugccuccccuc

SEQ ID NO: 2935435 - RNA, 14 nt, Human
uggucggaaaacau

SEQ ID NO: 2935436 - RNA, 17 nt, Human
uggucggaaaacaugcu

SEQ ID NO: 2935437 - RNA, 13 nt, Human
uggugaccucugc

SEQ ID NO: 2935438 - RNA, 14 nt, Human
uggugaccucugcc

SEQ ID NO: 2935439 - RNA, 19 nt, Human
uggucuacacugugcugag

SEQ ID NO: 2935440 - RNA, 18 nt, Human
uggucuacacugugcuga

SEQ ID NO: 2935441 - RNA, 17 nt, Human
uggucuacacugugcug

SEQ ID NO: 2935442 - RNA, 16 nt, Human
uggucuacacugugcu

SEQ ID NO: 2935443 - RNA, 15 nt, Human
uggucuacacugugc

SEQ ID NO: 2935444 - RNA, 20 nt, Human
uggugcaaugaccuuucaau

SEQ ID NO: 2935445 - RNA, 21 nt, Human
uggugcaaugaccuuucaaua

SEQ ID NO: 2935446 - RNA, 22 nt, Human
uggugauuuagcaggaagcugu

SEQ ID NO: 2935447 - RNA, 16 nt, Human
uggugauuuagcagga

SEQ ID NO: 2935448 - RNA, 15 nt, Human
uggugaccucugccu

SEQ ID NO: 2935449 - RNA, 16 nt, Human
uggugaccucugccug

SEQ ID NO: 2935450 - RNA, 17 nt, Human
uggugaccucugccuga

SEQ ID NO: 2935451 - RNA, 22 nt, Human
uggugaccucugccugaaguca

SEQ ID NO: 2935452 - RNA, 19 nt, Human
uggugacuuuccucuuugg

SEQ ID NO: 2935453 - RNA, 19 nt, Human
ugguccuaaucuucugaac

SEQ ID NO: 2935454 - RNA, 17 nt, Human
ugguccuaaucuucuga

SEQ ID NO: 2935455 - RNA, 23 nt, Human
ugguccugcugcaguugccaguc

SEQ ID NO: 2935456 - RNA, 15 nt, Human
ugguccugcugcagu

SEQ ID NO: 2935457 - RNA, 13 nt, Human
ugguccugcugca

SEQ ID NO: 2935458 - RNA, 23 nt, Human
uggucccccuuccauggacuuug

SEQ ID NO: 2935459 - RNA, 18 nt, Human
uggucccccuuccaugga

SEQ ID NO: 2935460 - RNA, 16 nt, Human
uggucccccuuccaug

SEQ ID NO: 2935461 - RNA, 15 nt, Human
uggucccccuuccau

SEQ ID NO: 2935462 - RNA, 13 nt, Human
uggucccacucag

SEQ ID NO: 2935463 - RNA, 16 nt, Human
uggucccagccagcag

SEQ ID NO: 2935464 - RNA, 14 nt, Human
uggucccccuucca

SEQ ID NO: 2935465 - RNA, 17 nt, Human
uggucacaggaaguaga

SEQ ID NO: 2935466 - RNA, 14 nt, Human
uggucaacauuucu

SEQ ID NO: 2935467 - RNA, 22 nt, Human
uggucacaggaaguagaggagg

SEQ ID NO: 2935468 - RNA, 18 nt, Human
ugguaugaucacggcuca

SEQ ID NO: 2935469 - RNA, 15 nt, Human
ugguauuugaaacac

SEQ ID NO: 2935470 - RNA, 13 nt, Human
ugguauguuuuca

SEQ ID NO: 2935471 - RNA, 14 nt, Human
uuaaaagcauuuuu

SEQ ID NO: 2935472 - RNA, 19 nt, Human
uuaaaauacacacucaaau

SEQ ID NO: 2935473 - RNA, 21 nt, Human
uuaaaauaccagccaguaaau

SEQ ID NO: 2935474 - RNA, 18 nt, Human
uuaaaagaugaaaauauu

SEQ ID NO: 2935475 - RNA, 15 nt, Human
uuaaaagaugaaaau

SEQ ID NO: 2935476 - RNA, 21 nt, Human
uuaaacucugagugcaaacuu

SEQ ID NO: 2935477 - RNA, 22 nt, Human
uguuuuaagaggcagggucuca

SEQ ID NO: 2935478 - RNA, 18 nt, Human
uguuuuaaggaugcuugu

SEQ ID NO: 2935479 - RNA, 22 nt, Human
uuaaaagaauauuuuaacuucc

SEQ ID NO: 2935480 - RNA, 21 nt, Human
uuaaaagaauauuuuaacuuc

SEQ ID NO: 2935481 - RNA, 14 nt, Human
uuaaaagauacagu

SEQ ID NO: 2935482 - RNA, 17 nt, Human
uuaaaagauacaguuac

SEQ ID NO: 2935483 - RNA, 19 nt, Human
uguuuggggaugagaaagg

SEQ ID NO: 2935484 - RNA, 23 nt, Human
uguuuccuggcacugcuuccagu

SEQ ID NO: 2935485 - RNA, 13 nt, Human
uguuugugauuga

SEQ ID NO: 2935486 - RNA, 20 nt, Human
uguuuuaagaggcagggucu

SEQ ID NO: 2935487 - RNA, 15 nt, Human
uguuucaaacuuuac

SEQ ID NO: 2935488 - RNA, 21 nt, Human
uguuucaaacauauauaacaa

SEQ ID NO: 2935489 - RNA, 22 nt, Human
uguuucaaacauauauaacaau

SEQ ID NO: 2935490 - RNA, 19 nt, Human
uguuucaaacauauauaac

SEQ ID NO: 2935491 - RNA, 16 nt, Human
uguuuagauaauacac

SEQ ID NO: 2935492 - RNA, 19 nt, Human
uuaaugguaguuuuacagu

SEQ ID NO: 2935493 - RNA, 21 nt, Human
uuacaagcgugagccacugca

SEQ ID NO: 2935494 - RNA, 20 nt, Human
uuacaagcgugagccacugc

SEQ ID NO: 2935495 - RNA, 17 nt, Human
uuaagcuguuacugucu

SEQ ID NO: 2935496 - RNA, 18 nt, Human
uuaauauugauaugcuua

SEQ ID NO: 2935497 - RNA, 22 nt, Human
uuaauauugauaugcuuauaca

SEQ ID NO: 2935498 - RNA, 17 nt, Human
uuaaccacuucagcuga

SEQ ID NO: 2935499 - RNA, 16 nt, Human
uuaacuuuuauaaacu

SEQ ID NO: 2935500 - RNA, 17 nt, Human
uuaacuuuuauaaacuu

SEQ ID NO: 2935501 - RNA, 15 nt, Human
uuaacuuuuauaaac

SEQ ID NO: 2935502 - RNA, 16 nt, Human
uuaacuucacauauug

SEQ ID NO: 2935503 - RNA, 17 nt, Human
uuaguagagacaggguu

SEQ ID NO: 2935504 - RNA, 22 nt, Human
uuaguagagguacacuugugaa

SEQ ID NO: 2935505 - RNA, 23 nt, Human
uuaguagagguacacuugugaau

SEQ ID NO: 2935506 - RNA, 20 nt, Human
uuaggagaagucuucuauuu

SEQ ID NO: 2935507 - RNA, 18 nt, Human
uuaggauguugaaaaagu

SEQ ID NO: 2935508 - RNA, 18 nt, Human
uuaguaugaggcauuugu

SEQ ID NO: 2935509 - RNA, 16 nt, Human
uuaguaugaggcauuu

SEQ ID NO: 2935510 - RNA, 12 nt, Human
uuagcuggaaaa

SEQ ID NO: 2935511 - RNA, 13 nt, Human
uuagcuggaaaag

SEQ ID NO: 2935512 - RNA, 14 nt, Human
uuagaguugauacu

SEQ ID NO: 2935513 - RNA, 22 nt, Human
uuagauaauacaccacuacauu

SEQ ID NO: 2935514 - RNA, 20 nt, Human
uuagaugcaguucugaagaa

SEQ ID NO: 2935515 - RNA, 21 nt, Human
uuagaugcaguucugaagaag

SEQ ID NO: 2935516 - RNA, 21 nt, Human
uuacuuaaaccgccaaggcug

SEQ ID NO: 2935517 - RNA, 22 nt, Human
uuacuuaagacuuaaugagacu

SEQ ID NO: 2935518 - RNA, 18 nt, Human
uuacuuagguguggggga

SEQ ID NO: 2935519 - RNA, 11 nt, Human
uuacuucugcu

SEQ ID NO: 2935520 - RNA, 12 nt, Human
uuacuucugcua

SEQ ID NO: 2935521 - RNA, 23 nt, Human
uuacuucuuauacauuugauaaa

SEQ ID NO: 2935522 - RNA, 13 nt, Human
uuacuaaguuuuu

SEQ ID NO: 2935523 - RNA, 14 nt, Human
uuacuaaguuuuua

SEQ ID NO: 2935524 - RNA, 16 nt, Human
uuacuaauagacaauu

SEQ ID NO: 2935525 - RNA, 17 nt, Human
uuacuaguuucccuugc

SEQ ID NO: 2935526 - RNA, 14 nt, Human
uuagacagucccug

SEQ ID NO: 2935527 - RNA, 18 nt, Human
uuagacagucccugccaa

SEQ ID NO: 2935528 - RNA, 17 nt, Human
uuagacagucccugcca

SEQ ID NO: 2935529 - RNA, 16 nt, Human
uuagacagucccugcc

SEQ ID NO: 2935530 - RNA, 20 nt, Human
uuagacccucaugcugccaa

SEQ ID NO: 2935531 - RNA, 19 nt, Human
uuagacccucaugcugcca

SEQ ID NO: 2935532 - RNA, 13 nt, Human
uuacuuuaaacua

SEQ ID NO: 2935533 - RNA, 17 nt, Human
uuacuuuaaaaggagcc

SEQ ID NO: 2935534 - RNA, 18 nt, Human
uuacuuuaaaaggagcca

SEQ ID NO: 2935535 - RNA, 14 nt, Human
uuacuuuguguuca

SEQ ID NO: 2935536 - RNA, 19 nt, Human
uuagaaacacaacuauauu

SEQ ID NO: 2935537 - RNA, 15 nt, Human
uuagacagucccugc

SEQ ID NO: 2935538 - RNA, 17 nt, Human
uucccuugaugaagaag

SEQ ID NO: 2935539 - RNA, 13 nt, Human
uuccucauuagca

SEQ ID NO: 2935540 - RNA, 22 nt, Human
uucccuuugacgccaucccagc

SEQ ID NO: 2935541 - RNA, 21 nt, Human
uucccuuugacgccaucccag

SEQ ID NO: 2935542 - RNA, 20 nt, Human
uucccuuugacgccauccca

SEQ ID NO: 2935543 - RNA, 20 nt, Human
uuccuugaguugauucagcu

SEQ ID NO: 2935544 - RNA, 14 nt, Human
uuccuggcacugcu

SEQ ID NO: 2935545 - RNA, 17 nt, Human
uuccugccaggcauggu

SEQ ID NO: 2935546 - RNA, 15 nt, Human
uuccugaugcuucuu

SEQ ID NO: 2935547 - RNA, 19 nt, Human
uuccugaugcuucuucaga

SEQ ID NO: 2935548 - RNA, 18 nt, Human
uuccugaugcuucuucag

SEQ ID NO: 2935549 - RNA, 17 nt, Human
uucuaaagcugccagcc

SEQ ID NO: 2935550 - RNA, 13 nt, Human
uucuaaagcugcc

SEQ ID NO: 2935551 - RNA, 22 nt, Human
uucggccuccauccugaggcuc

SEQ ID NO: 2935552 - RNA, 20 nt, Human
uucgggaggucgaggcagga

SEQ ID NO: 2935553 - RNA, 17 nt, Human
uuccuuggacucauuuu

SEQ ID NO: 2935554 - RNA, 20 nt, Human
uuccuuggacucauuuuaaa

SEQ ID NO: 2935555 - RNA, 19 nt, Human
uuccagauccuggaaauca

SEQ ID NO: 2935556 - RNA, 15 nt, Human
uuccaaauucugcuu

SEQ ID NO: 2935557 - RNA, 21 nt, Human
uucaucuugaauuguaaggaa

SEQ ID NO: 2935558 - RNA, 17 nt, Human
uucaugaaagauucaau

SEQ ID NO: 2935559 - RNA, 15 nt, Human
uucaugaaagauuca

SEQ ID NO: 2935560 - RNA, 17 nt, Human
uucaucuugaauuguaa

SEQ ID NO: 2935561 - RNA, 13 nt, Human
uucaggaagcuca

SEQ ID NO: 2935562 - RNA, 11 nt, Human
uucaggaagcu

SEQ ID NO: 2935563 - RNA, 15 nt, Human
uucauuuccuguguc

SEQ ID NO: 2935564 - RNA, 16 nt, Human
uucauuuccugugucu

SEQ ID NO: 2935565 - RNA, 16 nt, Human
uuccccaggaggccag

SEQ ID NO: 2935566 - RNA, 15 nt, Human
uuccccaggaggcca

SEQ ID NO: 2935567 - RNA, 16 nt, Human
uucccauuugcuccuu

SEQ ID NO: 2935568 - RNA, 11 nt, Human
uucccucccuu

SEQ ID NO: 2935569 - RNA, 17 nt, Human
uucccucccuuccucuu

SEQ ID NO: 2935570 - RNA, 20 nt, Human
uucccucccuuccucuuucc

SEQ ID NO: 2935571 - RNA, 21 nt, Human
uuccccaggaggccagccuug

SEQ ID NO: 2935572 - RNA, 20 nt, Human
uuccccaggaggccagccuu

SEQ ID NO: 2935573 - RNA, 19 nt, Human
uuccccaggaggccagccu

SEQ ID NO: 2935574 - RNA, 18 nt, Human
uuccccaggaggccagcc

SEQ ID NO: 2935575 - RNA, 17 nt, Human
uuccccaggaggccagc

SEQ ID NO: 2935576 - RNA, 15 nt, Human
uuauuuuacuuuuug

SEQ ID NO: 2935577 - RNA, 13 nt, Human
uuauuuuacuuuu

SEQ ID NO: 2935578 - RNA, 17 nt, Human
uuauuuuaauucaguug

SEQ ID NO: 2935579 - RNA, 15 nt, Human
uuauuuuaauaaugu

SEQ ID NO: 2935580 - RNA, 16 nt, Human
uuauuuuaauaauguu

SEQ ID NO: 2935581 - RNA, 17 nt, Human
uuauugucaaaguggug

SEQ ID NO: 2935582 - RNA, 15 nt, Human
uuauugucuagugaa

SEQ ID NO: 2935583 - RNA, 18 nt, Human
uuauugucaaagugguga

SEQ ID NO: 2935584 - RNA, 17 nt, Human
uucaauuuuaaacauau

SEQ ID NO: 2935585 - RNA, 20 nt, Human
uucaauaggaaaaacugauu

SEQ ID NO: 2935586 - RNA, 18 nt, Human
uucaauaggaaaaacuga

SEQ ID NO: 2935587 - RNA, 15 nt, Human
uucaauaggaaaaac

SEQ ID NO: 2935588 - RNA, 13 nt, Human
uucaauaggaaaa

SEQ ID NO: 2935589 - RNA, 18 nt, Human
uucacggaagagccuugc

SEQ ID NO: 2935590 - RNA, 15 nt, Human
uucacgugguccuaa

SEQ ID NO: 2935591 - RNA, 13 nt, Human
uucacucuccuug

SEQ ID NO: 2935592 - RNA, 20 nt, Human
uucagacauagaauuaacac

SEQ ID NO: 2935593 - RNA, 19 nt, Human
uucagagacuccugcaggc

SEQ ID NO: 2935594 - RNA, 16 nt, Human
uucagacauagaauua

SEQ ID NO: 2935595 - RNA, 21 nt, Human
uucagacagcugccugggauc

SEQ ID NO: 2935596 - RNA, 13 nt, Human
uucagagcugccc

SEQ ID NO: 2935597 - RNA, 14 nt, Human
uuaguuccuugagu

SEQ ID NO: 2935598 - RNA, 16 nt, Human
uuaguuccucauuagc

SEQ ID NO: 2935599 - RNA, 14 nt, Human
uuaucuagauacug

SEQ ID NO: 2935600 - RNA, 16 nt, Human
uuaucuagauacugua

SEQ ID NO: 2935601 - RNA, 17 nt, Human
uuaucuagauacuguau

SEQ ID NO: 2935602 - RNA, 16 nt, Human
uuaugcaugaaguaau

SEQ ID NO: 2935603 - RNA, 22 nt, Human
uuaugcaugaaguaauaugcac

SEQ ID NO: 2935604 - RNA, 21 nt, Human
uuauggcacuaguauuucuau

SEQ ID NO: 2935605 - RNA, 16 nt, Human
uuauggaacacucuga

SEQ ID NO: 2935606 - RNA, 15 nt, Human
uuauugauguuuuca

SEQ ID NO: 2935607 - RNA, 15 nt, Human
uuauugcccacgcug

SEQ ID NO: 2935608 - RNA, 13 nt, Human
uuauugaagcaga

SEQ ID NO: 2935609 - RNA, 15 nt, Human
uuauugaagcagagu

SEQ ID NO: 2935610 - RNA, 16 nt, Human
uuauugaagcagagug

SEQ ID NO: 2935611 - RNA, 17 nt, Human
uuauugaagcagagugg

SEQ ID NO: 2935612 - RNA, 12 nt, Human
uuauugaagcag

SEQ ID NO: 2935613 - RNA, 11 nt, Human
uuauucugcuc

SEQ ID NO: 2935614 - RNA, 17 nt, Human
uuauggcuauaggugcu

SEQ ID NO: 2935615 - RNA, 16 nt, Human
uuauuacuguaagaaa

SEQ ID NO: 2935616 - RNA, 17 nt, Human
uuauuacuguaagaaaa

SEQ ID NO: 2935617 - RNA, 18 nt, Human
uuauuacuguaagaaaau

SEQ ID NO: 2935618 - RNA, 19 nt, Human
uuuacaguguuucuggcuu

SEQ ID NO: 2935619 - RNA, 17 nt, Human
uuuacaguguuucuggc

SEQ ID NO: 2935620 - RNA, 16 nt, Human
uuuaauaugcaaaguc

SEQ ID NO: 2935621 - RNA, 12 nt, Human
uuuaauaugcaa

SEQ ID NO: 2935622 - RNA, 13 nt, Human
uuuacagagacag

SEQ ID NO: 2935623 - RNA, 14 nt, Human
uuuaacagaaaugu

SEQ ID NO: 2935624 - RNA, 15 nt, Human
uuuaacagaaaugua

SEQ ID NO: 2935625 - RNA, 14 nt, Human
uuuaaccucuaaau

SEQ ID NO: 2935626 - RNA, 19 nt, Human
uuuaauaauguuucaaaca

SEQ ID NO: 2935627 - RNA, 13 nt, Human
uuuaauaaaccau

SEQ ID NO: 2935628 - RNA, 14 nt, Human
uuuaauaauguuuc

SEQ ID NO: 2935629 - RNA, 15 nt, Human
uuuaauaauguuuca

SEQ ID NO: 2935630 - RNA, 23 nt, Human
uuuauccuagucauucuucccua

SEQ ID NO: 2935631 - RNA, 15 nt, Human
uuuaucuguucauau

SEQ ID NO: 2935632 - RNA, 16 nt, Human
uuuaucuguucauaug

SEQ ID NO: 2935633 - RNA, 22 nt, Human
uuuaugagaaacuggcaaagca

SEQ ID NO: 2935634 - RNA, 22 nt, Human
uuuauccuagucauucuucccu

SEQ ID NO: 2935635 - RNA, 12 nt, Human
uuuauacauaaa

SEQ ID NO: 2935636 - RNA, 20 nt, Human
uuuauacauaaacaagacca

SEQ ID NO: 2935637 - RNA, 19 nt, Human
uuuagacccuauugcugcu

SEQ ID NO: 2935638 - RNA, 22 nt, Human
uuuagacccuauugcugcuuga

SEQ ID NO: 2935639 - RNA, 18 nt, Human
uuuauaaacuuuaccuuu

SEQ ID NO: 2935640 - RNA, 20 nt, Human
uuguuuggggaugagaaagg

SEQ ID NO: 2935641 - RNA, 24 nt, Human
uugucuuuggacccugaggcccag

SEQ ID NO: 2935642 - RNA, 20 nt, Human
uugucuuuggacccugaggc

SEQ ID NO: 2935643 - RNA, 15 nt, Human
uugucuuuggacccu

SEQ ID NO: 2935644 - RNA, 23 nt, Human
uuguuuaaugguaguuuuacagu

SEQ ID NO: 2935645 - RNA, 12 nt, Human
uuguuuaauggu

SEQ ID NO: 2935646 - RNA, 15 nt, Human
uuguuauuuauugaa

SEQ ID NO: 2935647 - RNA, 20 nt, Human
uuguuauuuauugaaaugau

SEQ ID NO: 2935648 - RNA, 17 nt, Human
uuguuuaaaaucauuuc

SEQ ID NO: 2935649 - RNA, 18 nt, Human
uuguuuaaaaucauuucu

SEQ ID NO: 2935650 - RNA, 13 nt, Human
uuuaaacauaucc

SEQ ID NO: 2935651 - RNA, 22 nt, Human
uuuaaacauauccaaguuugaa

SEQ ID NO: 2935652 - RNA, 14 nt, Human
uuuaaacacauuaa

SEQ ID NO: 2935653 - RNA, 15 nt, Human
uuuaaacacauuaaa

SEQ ID NO: 2935654 - RNA, 12 nt, Human
uuuaaacauauc

SEQ ID NO: 2935655 - RNA, 15 nt, Human
uuuaaacuacauuag

SEQ ID NO: 2935656 - RNA, 13 nt, Human
uuuaacagaaaug

SEQ ID NO: 2935657 - RNA, 16 nt, Human
uuuaaacaaaauagaa

SEQ ID NO: 2935658 - RNA, 13 nt, Human
uuuaaacaaaaua

SEQ ID NO: 2935659 - RNA, 12 nt, Human
uuuaaaaugucu

SEQ ID NO: 2935660 - RNA, 15 nt, Human
uuuaaaagcauuuuu

SEQ ID NO: 2935661 - RNA, 14 nt, Human
uuuaaaagcauuuu

SEQ ID NO: 2935662 - RNA, 13 nt, Human
uuuaaaagauaca

SEQ ID NO: 2935663 - RNA, 17 nt, Human
uuuaaaagaaugauuau

SEQ ID NO: 2935664 - RNA, 14 nt, Human
uuuaaaagaaugau

SEQ ID NO: 2935665 - RNA, 16 nt, Human
uuuaaaaucauuucug

SEQ ID NO: 2935666 - RNA, 16 nt, Human
uuuaaaauaagucuga

SEQ ID NO: 2935667 - RNA, 19 nt, Human
uuuaaaauacacacucaaa

SEQ ID NO: 2935668 - RNA, 19 nt, Human
uuucuuguguguuuauugu

SEQ ID NO: 2935669 - RNA, 18 nt, Human
uuugaagcacagugauca

SEQ ID NO: 2935670 - RNA, 21 nt, Human
uuugaaauuguauuacaaauc

SEQ ID NO: 2935671 - RNA, 17 nt, Human
uuugagaucagccuggg

SEQ ID NO: 2935672 - RNA, 16 nt, Human
uuugagaucagccugg

SEQ ID NO: 2935673 - RNA, 21 nt, Human
uuugaagguagaauguuuuca

SEQ ID NO: 2935674 - RNA, 18 nt, Human
uuugauauggguaguauu

SEQ ID NO: 2935675 - RNA, 14 nt, Human
uuugauaugugaac

SEQ ID NO: 2935676 - RNA, 15 nt, Human
uuugauaugugaaca

SEQ ID NO: 2935677 - RNA, 17 nt, Human
uuugauaugugaacagu

SEQ ID NO: 2935678 - RNA, 20 nt, Human
uuugccaauuugcacauuaa

SEQ ID NO: 2935679 - RNA, 15 nt, Human
uuugccaauuugcac

SEQ ID NO: 2935680 - RNA, 16 nt, Human
uuugcuugaaagaaaa

SEQ ID NO: 2935681 - RNA, 14 nt, Human
uuugcuugaaagaa

SEQ ID NO: 2935682 - RNA, 23 nt, Human
uuugcuuuauggguuuggcuugu

SEQ ID NO: 2935683 - RNA, 19 nt, Human
uuuggacccugaggcccag

SEQ ID NO: 2935684 - RNA, 15 nt, Human
uuuggacccugaggc

SEQ ID NO: 2935685 - RNA, 22 nt, Human
uuugguugguaacucuguaauu

SEQ ID NO: 2935686 - RNA, 14 nt, Human
uuugguuauuuuac

SEQ ID NO: 2935687 - RNA, 17 nt, Human
uuuggguuuauuuggaa

SEQ ID NO: 2935688 - RNA, 18 nt, Human
uuugguaaggggaauuga

SEQ ID NO: 2935689 - RNA, 22 nt, Human
uuucacaguguguggucaacau

SEQ ID NO: 2935690 - RNA, 16 nt, Human
uuucacacaaacaagg

SEQ ID NO: 2935691 - RNA, 17 nt, Human
uuucagccaagaauucu

SEQ ID NO: 2935692 - RNA, 16 nt, Human
uuucagccaagaauuc

SEQ ID NO: 2935693 - RNA, 19 nt, Human
uuucuaaaucuccaaaaua

SEQ ID NO: 2935694 - RNA, 23 nt, Human
uuuccuggcacugcuuccaguga

SEQ ID NO: 2935695 - RNA, 19 nt, Human
uuuccuggcacugcuucca

SEQ ID NO: 2935696 - RNA, 14 nt, Human
uuucugaaauaaca

SEQ ID NO: 2935697 - RNA, 12 nt, Human
uuucugaaauuu

SEQ ID NO: 2935698 - RNA, 22 nt, Human
uuucuacccagcgagcccuggu

SEQ ID NO: 2935699 - RNA, 15 nt, Human
uuucuacccagcgag

SEQ ID NO: 2935700 - RNA, 18 nt, Human
uuucuacccagcgagccc

SEQ ID NO: 2935701 - RNA, 12 nt, Human
uuucucuaggaa

SEQ ID NO: 2935702 - RNA, 20 nt, Human
uucuggcagaguugaagaca

SEQ ID NO: 2935703 - RNA, 24 nt, Human
uucuaaguaaaaccacagcaguug

SEQ ID NO: 2935704 - RNA, 13 nt, Human
uucuuguauuuau

SEQ ID NO: 2935705 - RNA, 13 nt, Human
uucuucagagacu

SEQ ID NO: 2935706 - RNA, 19 nt, Human
uucuuaggguuaugauuaa

SEQ ID NO: 2935707 - RNA, 17 nt, Human
uucuuagggaaggauac

SEQ ID NO: 2935708 - RNA, 14 nt, Human
uugaagcagagugg

SEQ ID NO: 2935709 - RNA, 12 nt, Human
uugaagcagagu

SEQ ID NO: 2935710 - RNA, 20 nt, Human
uugaagcacagugaucaagu

SEQ ID NO: 2935711 - RNA, 21 nt, Human
uugaagagguuuuaaagcuuc

SEQ ID NO: 2935712 - RNA, 13 nt, Human
uugaagauucuau

SEQ ID NO: 2935713 - RNA, 23 nt, Human
uugaagauucuauguuaauauuu

SEQ ID NO: 2935714 - RNA, 22 nt, Human
uugaagauucuauguuaauauu

SEQ ID NO: 2935715 - RNA, 16 nt, Human
uugaagagguuuuaaa

SEQ ID NO: 2935716 - RNA, 17 nt, Human
uugaacuuugaccucug

SEQ ID NO: 2935717 - RNA, 18 nt, Human
uugaacuuugaccucugc

SEQ ID NO: 2935718 - RNA, 16 nt, Human
uugaaugaugccauga

SEQ ID NO: 2935719 - RNA, 12 nt, Human
uugaaugaugcc

SEQ ID NO: 2935720 - RNA, 15 nt, Human
uugaaacacugguuu

SEQ ID NO: 2935721 - RNA, 15 nt, Human
uugaacuuugaccuc

SEQ ID NO: 2935722 - RNA, 18 nt, Human
uucuuuccacagaagcuc

SEQ ID NO: 2935723 - RNA, 21 nt, Human
uucuuuccugaggcugggcuc

SEQ ID NO: 2935724 - RNA, 21 nt, Human
uugaaaaucuuauaauuuaaa

SEQ ID NO: 2935725 - RNA, 19 nt, Human
uugagccuugaacuuugac

SEQ ID NO: 2935726 - RNA, 22 nt, Human
uugaauuccuaaaauuauggaa

SEQ ID NO: 2935727 - RNA, 15 nt, Human
uugagccuugaacuu

SEQ ID NO: 2935728 - RNA, 16 nt, Human
uugagccuugaacuuu

SEQ ID NO: 2935729 - RNA, 14 nt, Human
uugagccuugaacu

SEQ ID NO: 2935730 - RNA, 14 nt, Human
uugagccugggagg

SEQ ID NO: 2935731 - RNA, 21 nt, Human
uugauucagacagcugccugg

SEQ ID NO: 2935732 - RNA, 17 nt, Human
uugauucagacagcugc

SEQ ID NO: 2935733 - RNA, 23 nt, Human
uugauucagacagcugccuggga

SEQ ID NO: 2935734 - RNA, 16 nt, Human
uugauucagcucugca

SEQ ID NO: 2935735 - RNA, 16 nt, Human
uugauaugugaacagu

SEQ ID NO: 2935736 - RNA, 16 nt, Human
uugauaugcuuauaca

SEQ ID NO: 2935737 - RNA, 20 nt, Human
uugauaugccuuuucccaac

SEQ ID NO: 2935738 - RNA, 17 nt, Human
uugauucauaaugacuu

SEQ ID NO: 2935739 - RNA, 13 nt, Human
uugauucauaaug

SEQ ID NO: 2935740 - RNA, 23 nt, Human
uugcagacaggcaagcaccuccu

SEQ ID NO: 2935741 - RNA, 23 nt, Human
uugcagcucuccccuucucugua

SEQ ID NO: 2935742 - RNA, 13 nt, Human
uugccaucccucc

SEQ ID NO: 2935743 - RNA, 16 nt, Human
uugccauguuggccag

SEQ ID NO: 2935744 - RNA, 17 nt, Human
uugccauguuggccagg

SEQ ID NO: 2935745 - RNA, 18 nt, Human
uugccauguuggccaggc

SEQ ID NO: 2935746 - RNA, 19 nt, Human
uugccauguuggccaggcu

SEQ ID NO: 2935747 - RNA, 22 nt, Human
uugccaucccucccuccaccuc

SEQ ID NO: 2935748 - RNA, 23 nt, Human
uugccaucccucccuccaccucc

SEQ ID NO: 2935749 - RNA, 14 nt, Human
uugccaucccuccc

SEQ ID NO: 2935750 - RNA, 16 nt, Human
uugccaucccucccuc

SEQ ID NO: 2935751 - RNA, 17 nt, Human
uugccaucccucccucc

SEQ ID NO: 2935752 - RNA, 18 nt, Human
uugccaucccucccucca

SEQ ID NO: 2935753 - RNA, 18 nt, Human
uugguaacucuguaauuc

SEQ ID NO: 2935754 - RNA, 20 nt, Human
uugggcacaucauuucaaga

SEQ ID NO: 2935755 - RNA, 20 nt, Human
uugguaaggggaauugagga

SEQ ID NO: 2935756 - RNA, 13 nt, Human
uugguccugcugc

SEQ ID NO: 2935757 - RNA, 20 nt, Human
uuggucugacccacugcuuu

SEQ ID NO: 2935758 - RNA, 12 nt, Human
uuguaaaauggu

SEQ ID NO: 2935759 - RNA, 13 nt, Human
uuguaaaauggug

SEQ ID NO: 2935760 - RNA, 23 nt, Human
uuggcuucacggaagagccuugc

SEQ ID NO: 2935761 - RNA, 20 nt, Human
uuguauuuuacuaauaaaau

SEQ ID NO: 2935762 - RNA, 14 nt, Human
uugucuaugggacu

SEQ ID NO: 2935763 - RNA, 22 nt, Human
uugucaaaguggugagaggcau

SEQ ID NO: 2935764 - RNA, 22 nt, Human
uugucuuaaaaaguggaaaaau

SEQ ID NO: 2935765 - RNA, 20 nt, Human
uugucuaugggacucaaugc

SEQ ID NO: 2935766 - RNA, 15 nt, Human
uuguagcauccugga

SEQ ID NO: 2935767 - RNA, 22 nt, Human
uuguagaagucacauuccugaa

SEQ ID NO: 2935768 - RNA, 17 nt, Human
uuguagaagucacauuc

SEQ ID NO: 2935769 - RNA, 20 nt, Human
uuguaccacuuuugcaaaua

SEQ ID NO: 2935770 - RNA, 16 nt, Human
uuguaccgcaauguga

SEQ ID NO: 2935771 - RNA, 20 nt, Human
uuguaaaauggugugaccac

SEQ ID NO: 2935772 - RNA, 17 nt, Human
uugccuuuuuauaacuu

SEQ ID NO: 2935773 - RNA, 18 nt, Human
uugccuuggcugcaguuu

SEQ ID NO: 2935774 - RNA, 20 nt, Human
uugccauguuggccaggcug

SEQ ID NO: 2935775 - RNA, 21 nt, Human
uugccauguuggccaggcugg

SEQ ID NO: 2935776 - RNA, 16 nt, Human
uugcugcuuguacacu

SEQ ID NO: 2935777 - RNA, 16 nt, Human
uugcugucccuuuucc

SEQ ID NO: 2935778 - RNA, 18 nt, Human
uugcugucccuuuuccuu

SEQ ID NO: 2935779 - RNA, 21 nt, Human
uugcugcugauuuaaacacau

SEQ ID NO: 2935780 - RNA, 17 nt, Human
uugcugcugauuuaaac

SEQ ID NO: 2935781 - RNA, 19 nt, Human
uugcugcugauuuaaacac

SEQ ID NO: 2935782 - RNA, 16 nt, Human
uugcugcuugaggcaa

SEQ ID NO: 2935783 - RNA, 14 nt, Human
uugcugcuugaggc

SEQ ID NO: 2935784 - RNA, 23 nt, Human
uugcuaacagcaacacaaagcuu

SEQ ID NO: 2935785 - RNA, 16 nt, Human
uugcuaagcauuccaa

SEQ ID NO: 2935786 - RNA, 18 nt, Human
uugcuaagcauuccaacu

SEQ ID NO: 2935787 - RNA, 15 nt, Human
uuggacauuuuaugu

SEQ ID NO: 2935788 - RNA, 15 nt, Human
uuggauuguccccga

SEQ ID NO: 2935789 - RNA, 21 nt, Human
uuggacccugaggcccagagg

SEQ ID NO: 2935790 - RNA, 19 nt, Human
uuggacccugaggcccaga

SEQ ID NO: 2935791 - RNA, 18 nt, Human
uuggacccugaggcccag

SEQ ID NO: 2935792 - RNA, 15 nt, Human
uuggacccugaggcc

SEQ ID NO: 2935793 - RNA, 18 nt, Human
uuggacaaaauggaauac

SEQ ID NO: 2935794 - RNA, 19 nt, Human
uuggaagcuccgcuuucua

SEQ ID NO: 2935795 - RNA, 17 nt, Human
uuuguguacuuuuaaga

SEQ ID NO: 2935796 - RNA, 13 nt, Human
uuuguguacuuuu

SEQ ID NO: 2935797 - RNA, 14 nt, Human
uuuguguacuuuua

SEQ ID NO: 2935798 - RNA, 14 nt, Human
cucguuaauuugua

SEQ ID NO: 2935799 - RNA, 15 nt, Human
cucgaacuggcugca

SEQ ID NO: 2935800 - RNA, 13 nt, Human
cucgaacuggcug

SEQ ID NO: 2935801 - RNA, 14 nt, Human
cucgaacuggcugc

SEQ ID NO: 2935802 - RNA, 12 nt, Human
cuccuaaaacaa

SEQ ID NO: 2935803 - RNA, 20 nt, Human
cuccuaaaacaacagaugua

SEQ ID NO: 2935804 - RNA, 13 nt, Human
cuccuaaaacaac

SEQ ID NO: 2935805 - RNA, 16 nt, Human
cuccucugcugcuggc

SEQ ID NO: 2935806 - RNA, 12 nt, Human
cuccucugcuug

SEQ ID NO: 2935807 - RNA, 14 nt, Human
cuccucugcuugcc

SEQ ID NO: 2935808 - RNA, 18 nt, Human
cuccucugcugcuggcug

SEQ ID NO: 2935809 - RNA, 12 nt, Human
cuccugggcagc

SEQ ID NO: 2935810 - RNA, 18 nt, Human
cuccuggcccacugcauc

SEQ ID NO: 2935811 - RNA, 16 nt, Human
cuccuggcccacugca

SEQ ID NO: 2935812 - RNA, 22 nt, Human
cuccugggcagcugccuccccu

SEQ ID NO: 2935813 - RNA, 23 nt, Human
cuccugggauuggcugugaacug

SEQ ID NO: 2935814 - RNA, 18 nt, Human
cuccugggauuggcugug

SEQ ID NO: 2935815 - RNA, 18 nt, Human
cuccugggcagcugccuc

SEQ ID NO: 2935816 - RNA, 19 nt, Human
cuccugggcagcugccucc

SEQ ID NO: 2935817 - RNA, 14 nt, Human
cuccugggcagcug

SEQ ID NO: 2935818 - RNA, 15 nt, Human
cuccugggcagcugc

SEQ ID NO: 2935819 - RNA, 16 nt, Human
cuccugggcagcugcc

SEQ ID NO: 2935820 - RNA, 17 nt, Human
cuccugggcagcugccu

SEQ ID NO: 2935821 - RNA, 21 nt, Human
cuccucugcuugccaucccuc

SEQ ID NO: 2935822 - RNA, 15 nt, Human
cuccucugcuugcca

SEQ ID NO: 2935823 - RNA, 16 nt, Human
cuccucugcuugccau

SEQ ID NO: 2935824 - RNA, 17 nt, Human
cuccucugcuugccauc

SEQ ID NO: 2935825 - RNA, 20 nt, Human
cuccucugcuugccaucccu

SEQ ID NO: 2935826 - RNA, 22 nt, Human
cucccccagccccauccucugu

SEQ ID NO: 2935827 - RNA, 20 nt, Human
cucccccagccccauccucu

SEQ ID NO: 2935828 - RNA, 15 nt, Human
cucccccagccccau

SEQ ID NO: 2935829 - RNA, 13 nt, Human
cuccaagaauuuc

SEQ ID NO: 2935830 - RNA, 14 nt, Human
cuccaagaauuucu

SEQ ID NO: 2935831 - RNA, 21 nt, Human
cuccaagaccuucuccuucac

SEQ ID NO: 2935832 - RNA, 22 nt, Human
cuccaagaccuucuccuucacc

SEQ ID NO: 2935833 - RNA, 24 nt, Human
cuccaagcaggacauggacaagga

SEQ ID NO: 2935834 - RNA, 22 nt, Human
cuccaagcaggacauggacaag

SEQ ID NO: 2935835 - RNA, 14 nt, Human
cuccaagcaggaca

SEQ ID NO: 2935836 - RNA, 13 nt, Human
cuccaagcaggac

SEQ ID NO: 2935837 - RNA, 16 nt, Human
cuccaagcucccaggc

SEQ ID NO: 2935838 - RNA, 15 nt, Human
cuccaagcucccagg

SEQ ID NO: 2935839 - RNA, 14 nt, Human
cuccaagcucccag

SEQ ID NO: 2935840 - RNA, 13 nt, Human
cuccaagcuccca

SEQ ID NO: 2935841 - RNA, 13 nt, Human
cuccacuuggucu

SEQ ID NO: 2935842 - RNA, 15 nt, Human
cuccacuuggucugu

SEQ ID NO: 2935843 - RNA, 16 nt, Human
cuccacuuggucugug

SEQ ID NO: 2935844 - RNA, 17 nt, Human
cuccacuuggucuguga

SEQ ID NO: 2935845 - RNA, 21 nt, Human
cuccacuuggucugugagaug

SEQ ID NO: 2935846 - RNA, 22 nt, Human
cuccacuuggucugugagaugc

SEQ ID NO: 2935847 - RNA, 15 nt, Human
cucccaccuggcucu

SEQ ID NO: 2935848 - RNA, 22 nt, Human
cucccaccuggcucuguggcga

SEQ ID NO: 2935849 - RNA, 13 nt, Human
cucccaccuggcu

SEQ ID NO: 2935850 - RNA, 14 nt, Human
cucccaccuggcuc

SEQ ID NO: 2935851 - RNA, 19 nt, Human
cuccccaugauguuuagaa

SEQ ID NO: 2935852 - RNA, 23 nt, Human
cuccacuuggucugugagaugcu

SEQ ID NO: 2935853 - RNA, 19 nt, Human
cuccacuuucuagccagag

SEQ ID NO: 2935854 - RNA, 16 nt, Human
cuccacuuucuagcca

SEQ ID NO: 2935855 - RNA, 18 nt, Human
cucuugagccuugaacuu

SEQ ID NO: 2935856 - RNA, 16 nt, Human
cucuugagccuugaac

SEQ ID NO: 2935857 - RNA, 17 nt, Human
cucuugagccuugaacu

SEQ ID NO: 2935858 - RNA, 23 nt, Human
cugacaacacucauugaccugag

SEQ ID NO: 2935859 - RNA, 22 nt, Human
cugacaacacucauugaccuga

SEQ ID NO: 2935860 - RNA, 21 nt, Human
cugaaggccccgcccaggcuu

SEQ ID NO: 2935861 - RNA, 19 nt, Human
cugaaggccccgcccaggc

SEQ ID NO: 2935862 - RNA, 18 nt, Human
cugaaggccccgcccagg

SEQ ID NO: 2935863 - RNA, 23 nt, Human
cugaaggacauugcggacagcca

SEQ ID NO: 2935864 - RNA, 15 nt, Human
cugaaacaacaaaua

SEQ ID NO: 2935865 - RNA, 13 nt, Human
cucugcugacaga

SEQ ID NO: 2935866 - RNA, 14 nt, Human
cucugcugacagac

SEQ ID NO: 2935867 - RNA, 16 nt, Human
cucugcugacagacac

SEQ ID NO: 2935868 - RNA, 14 nt, Human
cucugguccauaga

SEQ ID NO: 2935869 - RNA, 13 nt, Human
cucugcuccucuc

SEQ ID NO: 2935870 - RNA, 18 nt, Human
cucugcuccucuccccag

SEQ ID NO: 2935871 - RNA, 18 nt, Human
cucugcacuccccugcug

SEQ ID NO: 2935872 - RNA, 20 nt, Human
cucugcacuccccugcuggg

SEQ ID NO: 2935873 - RNA, 21 nt, Human
cucugcacuccccugcugggu

SEQ ID NO: 2935874 - RNA, 16 nt, Human
cucuccccuucucugu

SEQ ID NO: 2935875 - RNA, 14 nt, Human
cucuucaaucucuu

SEQ ID NO: 2935876 - RNA, 18 nt, Human
cucuucagaucucuaacu

SEQ ID NO: 2935877 - RNA, 19 nt, Human
cucuucagaucucuaacuu

SEQ ID NO: 2935878 - RNA, 14 nt, Human
cucuuauugcccac

SEQ ID NO: 2935879 - RNA, 15 nt, Human
cucuuauugcccacg

SEQ ID NO: 2935880 - RNA, 19 nt, Human
cucuuauugcccacgcugg

SEQ ID NO: 2935881 - RNA, 20 nt, Human
cucuuauugcccacgcugga

SEQ ID NO: 2935882 - RNA, 13 nt, Human
cucuuauugccca

SEQ ID NO: 2935883 - RNA, 22 nt, Human
cucuuagaugcaguucugaaga

SEQ ID NO: 2935884 - RNA, 21 nt, Human
cucuuagaugcaguucugaag

SEQ ID NO: 2935885 - RNA, 21 nt, Human
cugagauccuggacugagggg

SEQ ID NO: 2935886 - RNA, 13 nt, Human
cugagauccugga

SEQ ID NO: 2935887 - RNA, 15 nt, Human
cugagauccuggacu

SEQ ID NO: 2935888 - RNA, 17 nt, Human
cugagauccuggacuga

SEQ ID NO: 2935889 - RNA, 21 nt, Human
cugagaucaaaacgguuuuac

SEQ ID NO: 2935890 - RNA, 15 nt, Human
cugagcuuucugcua

SEQ ID NO: 2935891 - RNA, 14 nt, Human
cugagcuuucugcu

SEQ ID NO: 2935892 - RNA, 23 nt, Human
cugaggacacuaaccacgcugga

SEQ ID NO: 2935893 - RNA, 21 nt, Human
cugaggaauccagacccggcu

SEQ ID NO: 2935894 - RNA, 20 nt, Human
cugaggacacuaaccacgcu

SEQ ID NO: 2935895 - RNA, 17 nt, Human
cugaggaauccagaccc

SEQ ID NO: 2935896 - RNA, 20 nt, Human
cugaggaauccagacccggc

SEQ ID NO: 2935897 - RNA, 14 nt, Human
cugaggaauccaga

SEQ ID NO: 2935898 - RNA, 21 nt, Human
cugaguacguugugcauuugg

SEQ ID NO: 2935899 - RNA, 18 nt, Human
cugaguacguugugcauu

SEQ ID NO: 2935900 - RNA, 17 nt, Human
cugaguacguugugcau

SEQ ID NO: 2935901 - RNA, 19 nt, Human
cugaguacguugugcauuu

SEQ ID NO: 2935902 - RNA, 20 nt, Human
cugaguacguugugcauuug

SEQ ID NO: 2935903 - RNA, 21 nt, Human
cugagaggacuuuucuuugug

SEQ ID NO: 2935904 - RNA, 22 nt, Human
cugagaggacuuuucuuugugg

SEQ ID NO: 2935905 - RNA, 17 nt, Human
cugagaguagagucacu

SEQ ID NO: 2935906 - RNA, 22 nt, Human
cugagacucgcgacaaugcaaa

SEQ ID NO: 2935907 - RNA, 22 nt, Human
cugacccaugcugcccugugag

SEQ ID NO: 2935908 - RNA, 21 nt, Human
cugacccaugcugcccuguga

SEQ ID NO: 2935909 - RNA, 20 nt, Human
cugagacucgcgacaaugca

SEQ ID NO: 2935910 - RNA, 21 nt, Human
cugagacucgcgacaaugcaa

SEQ ID NO: 2935911 - RNA, 23 nt, Human
cugagacagcccgggcucugccu

SEQ ID NO: 2935912 - RNA, 16 nt, Human
cggagucccaccuugg

SEQ ID NO: 2935913 - RNA, 12 nt, Human
cgggccacagag

SEQ ID NO: 2935914 - RNA, 14 nt, Human
cgggccacagagaa

SEQ ID NO: 2935915 - RNA, 13 nt, Human
cggcuccaggcuc

SEQ ID NO: 2935916 - RNA, 14 nt, Human
cggcuccaggcucc

SEQ ID NO: 2935917 - RNA, 15 nt, Human
cggcuccaggcuccu

SEQ ID NO: 2935918 - RNA, 16 nt, Human
cggcuccaggcuccuu

SEQ ID NO: 2935919 - RNA, 12 nt, Human
cggcuccaggcu

SEQ ID NO: 2935920 - RNA, 16 nt, Human
cggcucacugcagccu

SEQ ID NO: 2935921 - RNA, 18 nt, Human
cggagucccaccuuggcu

SEQ ID NO: 2935922 - RNA, 20 nt, Human
cggagucccaccuuggcugc

SEQ ID NO: 2935923 - RNA, 15 nt, Human
cggcucacugcagcc

SEQ ID NO: 2935924 - RNA, 14 nt, Human
cggcucacugcagc

SEQ ID NO: 2935925 - RNA, 15 nt, Human
cggggacagcuccuu

SEQ ID NO: 2935926 - RNA, 13 nt, Human
cgguguggagaag

SEQ ID NO: 2935927 - RNA, 18 nt, Human
cgguguuauuccaaggga

SEQ ID NO: 2935928 - RNA, 18 nt, Human
cgguguggagaagcggcu

SEQ ID NO: 2935929 - RNA, 14 nt, Human
cggggacagcuccu

SEQ ID NO: 2935930 - RNA, 17 nt, Human
cgggcucugccucccau

SEQ ID NO: 2935931 - RNA, 13 nt, Human
cgggcucugccuc

SEQ ID NO: 2935932 - RNA, 15 nt, Human
cgggcucagcaaaag

SEQ ID NO: 2935933 - RNA, 16 nt, Human
cgggcucugccuccca

SEQ ID NO: 2935934 - RNA, 14 nt, Human
cgggcucugccucc

SEQ ID NO: 2935935 - RNA, 11 nt, Human
cgggcucagca

SEQ ID NO: 2935936 - RNA, 16 nt, Human
cgguuuuacugcagcu

SEQ ID NO: 2935937 - RNA, 16 nt, Human
cgugaggccagagaca

SEQ ID NO: 2935938 - RNA, 17 nt, Human
cgugaguccuggcaugg

SEQ ID NO: 2935939 - RNA, 16 nt, Human
cgugaguccuggcaug

SEQ ID NO: 2935940 - RNA, 17 nt, Human
cgugaggccagagacac

SEQ ID NO: 2935941 - RNA, 20 nt, Human
cguguaaccauggacccaau

SEQ ID NO: 2935942 - RNA, 15 nt, Human
cguggugauuuagca

SEQ ID NO: 2935943 - RNA, 22 nt, Human
cguggugauuuagcaggaagcu

SEQ ID NO: 2935944 - RNA, 14 nt, Human
cgugguggcaggca

SEQ ID NO: 2935945 - RNA, 18 nt, Human
ccuuucaauaggaaaaac

SEQ ID NO: 2935946 - RNA, 21 nt, Human
ccuuucaauaggaaaaacuga

SEQ ID NO: 2935947 - RNA, 17 nt, Human
ccuuuugagugccuuac

SEQ ID NO: 2935948 - RNA, 15 nt, Human
ccuuuugagugccuu

SEQ ID NO: 2935949 - RNA, 16 nt, Human
ccuugccgucuaccug

SEQ ID NO: 2935950 - RNA, 14 nt, Human
ccuuuaagagaaau

SEQ ID NO: 2935951 - RNA, 17 nt, Human
cgacugcccggcagggu

SEQ ID NO: 2935952 - RNA, 20 nt, Human
cgacccuugccgucuaccug

SEQ ID NO: 2935953 - RNA, 19 nt, Human
cgacccuugccgucuaccu

SEQ ID NO: 2935954 - RNA, 13 nt, Human
cgacaaugcaaac

SEQ ID NO: 2935955 - RNA, 12 nt, Human
cgacaaugcaaa

SEQ ID NO: 2935956 - RNA, 12 nt, Human
ccuuuuuauaac

SEQ ID NO: 2935957 - RNA, 15 nt, Human
ccuuuuuauaacuuu

SEQ ID NO: 2935958 - RNA, 21 nt, Human
ccuuuuuauaacuuuuuauau

SEQ ID NO: 2935959 - RNA, 16 nt, Human
ccuuuuucaauaacug

SEQ ID NO: 2935960 - RNA, 21 nt, Human
ccuuuuuuagaguugauacua

SEQ ID NO: 2935961 - RNA, 14 nt, Human
cgccuacaggagug

SEQ ID NO: 2935962 - RNA, 16 nt, Human
cgaguagcugggacua

SEQ ID NO: 2935963 - RNA, 14 nt, Human
cgauagugguggug

SEQ ID NO: 2935964 - RNA, 18 nt, Human
cgcaggcccccaggugcc

SEQ ID NO: 2935965 - RNA, 22 nt, Human
cgcaggauucuuccucccuccc

SEQ ID NO: 2935966 - RNA, 23 nt, Human
cuagaauuugauaugugaacagu

SEQ ID NO: 2935967 - RNA, 21 nt, Human
cuagcauacguacacauuuua

SEQ ID NO: 2935968 - RNA, 23 nt, Human
cuagcauacguacacauuuuauu

SEQ ID NO: 2935969 - RNA, 22 nt, Human
cuagaagauuuugaaauuuuua

SEQ ID NO: 2935970 - RNA, 12 nt, Human
cuagaacucccu

SEQ ID NO: 2935971 - RNA, 13 nt, Human
cuagaacucccuu

SEQ ID NO: 2935972 - RNA, 11 nt, Human
cuaauaaaaag

SEQ ID NO: 2935973 - RNA, 23 nt, Human
cuaaguuuuuauggcuuuugugc

SEQ ID NO: 2935974 - RNA, 13 nt, Human
cuaauaaaaaggu

SEQ ID NO: 2935975 - RNA, 14 nt, Human
cuaauaaaaaggug

SEQ ID NO: 2935976 - RNA, 15 nt, Human
cuaauaaaaagguga

SEQ ID NO: 2935977 - RNA, 23 nt, Human
cuaagugauccucccaccucagc

SEQ ID NO: 2935978 - RNA, 23 nt, Human
cuaaguaaaaccacagcaguuga

SEQ ID NO: 2935979 - RNA, 22 nt, Human
cuaaguaaaaccacagcaguug

SEQ ID NO: 2935980 - RNA, 21 nt, Human
cuaagugguacuaacuuuccu

SEQ ID NO: 2935981 - RNA, 20 nt, Human
cuaaguuuuuauggcuuuug

SEQ ID NO: 2935982 - RNA, 20 nt, Human
cgugugugugcguccugucg

SEQ ID NO: 2935983 - RNA, 20 nt, Human
cuaaguaaaaccacagcagu

SEQ ID NO: 2935984 - RNA, 17 nt, Human
cuaccuuuguauucucu

SEQ ID NO: 2935985 - RNA, 20 nt, Human
cuacaugagguacugagagu

SEQ ID NO: 2935986 - RNA, 18 nt, Human
cuacaugagguacugaga

SEQ ID NO: 2935987 - RNA, 20 nt, Human
cuacaguccucccaucucac

SEQ ID NO: 2935988 - RNA, 21 nt, Human
cuacaguugaaaaacagcuga

SEQ ID NO: 2935989 - RNA, 19 nt, Human
cuacaguugaaaaacagcu

SEQ ID NO: 2935990 - RNA, 18 nt, Human
cuacauacuauggaauuu

SEQ ID NO: 2935991 - RNA, 22 nt, Human
cuacaguugaaaaacagcugag

SEQ ID NO: 2935992 - RNA, 15 nt, Human
cuacaaaaacacagc

SEQ ID NO: 2935993 - RNA, 18 nt, Human
cuacaaaaacacagcaag

SEQ ID NO: 2935994 - RNA, 19 nt, Human
cuacaguccucccaucuca

SEQ ID NO: 2935995 - RNA, 17 nt, Human
cuacaaaaacacagcaa

SEQ ID NO: 2935996 - RNA, 16 nt, Human
cuacaaaaacacagca

SEQ ID NO: 2935997 - RNA, 12 nt, Human
cuagccagagga

SEQ ID NO: 2935998 - RNA, 15 nt, Human
cuagccagaggagag

SEQ ID NO: 2935999 - RNA, 13 nt, Human
cuagccagaggag

SEQ ID NO: 2936000 - RNA, 23 nt, Human
cuaguuguuugauucagacagcu

SEQ ID NO: 2936001 - RNA, 22 nt, Human
cuaguuguuugauucagacagc

SEQ ID NO: 2936002 - RNA, 13 nt, Human
cuaguuugauuaa

SEQ ID NO: 2936003 - RNA, 21 nt, Human
cuaguuugauuaaauucuugc

SEQ ID NO: 2936004 - RNA, 22 nt, Human
cuaguuugauuaaauucuugca

SEQ ID NO: 2936005 - RNA, 15 nt, Human
cuaucucccccagcc

SEQ ID NO: 2936006 - RNA, 14 nt, Human
cuaucuaaauguug

SEQ ID NO: 2936007 - RNA, 12 nt, Human
cucaauugugaa

SEQ ID NO: 2936008 - RNA, 13 nt, Human
cucaauugugaaa

SEQ ID NO: 2936009 - RNA, 13 nt, Human
cucaaugcacuga

SEQ ID NO: 2936010 - RNA, 15 nt, Human
cucaaugcacugaca

SEQ ID NO: 2936011 - RNA, 17 nt, Human
cucaauaaacauuucau

SEQ ID NO: 2936012 - RNA, 21 nt, Human
cucaauaaacauuucauuucc

SEQ ID NO: 2936013 - RNA, 21 nt, Human
cucaaacuaacaggcuuagug

SEQ ID NO: 2936014 - RNA, 20 nt, Human
cucaaacucuugaccucagg

SEQ ID NO: 2936015 - RNA, 15 nt, Human
cuauuuuuguuuuua

SEQ ID NO: 2936016 - RNA, 21 nt, Human
cuauuuuuguuuuuauuaaaa

SEQ ID NO: 2936017 - RNA, 21 nt, Human
cuauuaaacaugcuguacaua

SEQ ID NO: 2936018 - RNA, 17 nt, Human
cuaucucccccagcccc

SEQ ID NO: 2936019 - RNA, 16 nt, Human
cuaucucccccagccc

SEQ ID NO: 2936020 - RNA, 17 nt, Human
cucaaaacugcacuguc

SEQ ID NO: 2936021 - RNA, 23 nt, Human
cucaaaauaccaugccauuuaaa

SEQ ID NO: 2936022 - RNA, 18 nt, Human
cucaaaagcugggcaggu

SEQ ID NO: 2936023 - RNA, 22 nt, Human
ccugucuaaugaaaccuguguc

SEQ ID NO: 2936024 - RNA, 22 nt, Human
ccugucggagcccugucuccuc

SEQ ID NO: 2936025 - RNA, 15 nt, Human
ccugucuaaugaaac

SEQ ID NO: 2936026 - RNA, 21 nt, Human
ccugguggcagugggagcugc

SEQ ID NO: 2936027 - RNA, 16 nt, Human
ccugucggagcccugu

SEQ ID NO: 2936028 - RNA, 21 nt, Human
ccugucggagcccugucuccu

SEQ ID NO: 2936029 - RNA, 17 nt, Human
ccugucggagcccuguc

SEQ ID NO: 2936030 - RNA, 15 nt, Human
ccuguaaucacagcu

SEQ ID NO: 2936031 - RNA, 22 nt, Human
ccuggccucugcacuccccugc

SEQ ID NO: 2936032 - RNA, 21 nt, Human
ccuggccucugcacuccccug

SEQ ID NO: 2936033 - RNA, 20 nt, Human
ccuggccucugcacuccccu

SEQ ID NO: 2936034 - RNA, 22 nt, Human
ccuggccuagcauacguacaca

SEQ ID NO: 2936035 - RNA, 16 nt, Human
ccuggccucugcacuc

SEQ ID NO: 2936036 - RNA, 13 nt, Human
ccugcccaggccc

SEQ ID NO: 2936037 - RNA, 13 nt, Human
ccugcccaccugg

SEQ ID NO: 2936038 - RNA, 20 nt, Human
ccugcccaccuggccucugc

SEQ ID NO: 2936039 - RNA, 14 nt, Human
ccugcccaccuggc

SEQ ID NO: 2936040 - RNA, 12 nt, Human
ccugcccaccug

SEQ ID NO: 2936041 - RNA, 20 nt, Human
ccugcugcaguugccaguca

SEQ ID NO: 2936042 - RNA, 21 nt, Human
ccugcugcaguugccagucac

SEQ ID NO: 2936043 - RNA, 13 nt, Human
ccugcugcuccua

SEQ ID NO: 2936044 - RNA, 15 nt, Human
ccugcugcuccuagg

SEQ ID NO: 2936045 - RNA, 16 nt, Human
ccugcugcuccuagga

SEQ ID NO: 2936046 - RNA, 17 nt, Human
ccugcugcuccuaggac

SEQ ID NO: 2936047 - RNA, 19 nt, Human
ccugccucgaacuggcugc

SEQ ID NO: 2936048 - RNA, 21 nt, Human
ccugccucgaacuggcugcaa

SEQ ID NO: 2936049 - RNA, 23 nt, Human
ccugccucgaacuggcugcaaag

SEQ ID NO: 2936050 - RNA, 19 nt, Human
ccugcugcaguugccaguc

SEQ ID NO: 2936051 - RNA, 17 nt, Human
ccugcugcaguugccag

SEQ ID NO: 2936052 - RNA, 18 nt, Human
ccugcacuugcagacucu

SEQ ID NO: 2936053 - RNA, 14 nt, Human
ccugcagagggcac

SEQ ID NO: 2936054 - RNA, 16 nt, Human
ccugcacuugcagacu

SEQ ID NO: 2936055 - RNA, 17 nt, Human
ccugcacuugcagacuc

SEQ ID NO: 2936056 - RNA, 13 nt, Human
ccucuuucccucc

SEQ ID NO: 2936057 - RNA, 11 nt, Human
ccucuuucccu

SEQ ID NO: 2936058 - RNA, 14 nt, Human
cccuucgcuccugu

SEQ ID NO: 2936059 - RNA, 15 nt, Human
cccuucgcuccugug

SEQ ID NO: 2936060 - RNA, 21 nt, Human
cccuucucuccagccccugga

SEQ ID NO: 2936061 - RNA, 22 nt, Human
cccuucucuccagccccuggau

SEQ ID NO: 2936062 - RNA, 13 nt, Human
ccggccccugcug

SEQ ID NO: 2936063 - RNA, 13 nt, Human
cccuucgcuccug

SEQ ID NO: 2936064 - RNA, 20 nt, Human
cccugugauggggcccugcc

SEQ ID NO: 2936065 - RNA, 19 nt, Human
cccugugauggggcccugc

SEQ ID NO: 2936066 - RNA, 18 nt, Human
cccugugauggggcccug

SEQ ID NO: 2936067 - RNA, 17 nt, Human
cccugugauggggcccu

SEQ ID NO: 2936068 - RNA, 19 nt, Human
cccugucuccucucucugu

SEQ ID NO: 2936069 - RNA, 13 nt, Human
cccugucuaauga

SEQ ID NO: 2936070 - RNA, 16 nt, Human
cccugucuaaugaaac

SEQ ID NO: 2936071 - RNA, 23 nt, Human
cccugucucaaaaaaagaaaaag

SEQ ID NO: 2936072 - RNA, 20 nt, Human
cccugucucaaaaaaagaaa

SEQ ID NO: 2936073 - RNA, 14 nt, Human
ccggccccugcugg

SEQ ID NO: 2936074 - RNA, 16 nt, Human
ccucccaucucacaca

SEQ ID NO: 2936075 - RNA, 13 nt, Human
ccucccaucucac

SEQ ID NO: 2936076 - RNA, 15 nt, Human
ccucccaccucagcc

SEQ ID NO: 2936077 - RNA, 17 nt, Human
ccucccaccucagccuc

SEQ ID NO: 2936078 - RNA, 21 nt, Human
ccucauuuuuauaaugucccu

SEQ ID NO: 2936079 - RNA, 23 nt, Human
ccucauggaauuggagcucgugg

SEQ ID NO: 2936080 - RNA, 21 nt, Human
ccucaugcugccaauauccua

SEQ ID NO: 2936081 - RNA, 20 nt, Human
ccucaugcugccaauauccu

SEQ ID NO: 2936082 - RNA, 20 nt, Human
cccucaacucuccuccagag

SEQ ID NO: 2936083 - RNA, 20 nt, Human
cccucaagagcaaaguagau

SEQ ID NO: 2936084 - RNA, 17 nt, Human
ccccuucugacccaugc

SEQ ID NO: 2936085 - RNA, 16 nt, Human
ccccuucugacccaug

SEQ ID NO: 2936086 - RNA, 18 nt, Human
cccggcuuuggugcgggg

SEQ ID NO: 2936087 - RNA, 12 nt, Human
cccgggaagggg

SEQ ID NO: 2936088 - RNA, 12 nt, Human
cccggcugcgga

SEQ ID NO: 2936089 - RNA, 15 nt, Human
ccccauucugccugc

SEQ ID NO: 2936090 - RNA, 13 nt, Human
ccccauucugccu

SEQ ID NO: 2936091 - RNA, 14 nt, Human
ccccauucugccug

SEQ ID NO: 2936092 - RNA, 19 nt, Human
ccccuucgcuccugugucu

SEQ ID NO: 2936093 - RNA, 14 nt, Human
ccccuucgcuccug

SEQ ID NO: 2936094 - RNA, 15 nt, Human
ccccuucgcuccugu

SEQ ID NO: 2936095 - RNA, 17 nt, Human
ccccuucgcuccugugu

SEQ ID NO: 2936096 - RNA, 18 nt, Human
ccccugcacuccagccug

SEQ ID NO: 2936097 - RNA, 21 nt, Human
ccccagauugcaacaggcugg

SEQ ID NO: 2936098 - RNA, 22 nt, Human
ccccagauugcaacaggcuggg

SEQ ID NO: 2936099 - RNA, 23 nt, Human
ccccagauugcaacaggcugggc

SEQ ID NO: 2936100 - RNA, 17 nt, Human
ccccagcaagugagagc

SEQ ID NO: 2936101 - RNA, 19 nt, Human
ccccagcaagugagagcug

SEQ ID NO: 2936102 - RNA, 20 nt, Human
ccccagcaagugagagcugg

SEQ ID NO: 2936103 - RNA, 17 nt, Human
ccccauccucuguacag

SEQ ID NO: 2936104 - RNA, 24 nt, Human
ccccaucugcgggggcagugcuca

SEQ ID NO: 2936105 - RNA, 22 nt, Human
ccccauccucuguacagagccc

SEQ ID NO: 2936106 - RNA, 21 nt, Human
ccccauccucuguacagagcc

SEQ ID NO: 2936107 - RNA, 19 nt, Human
ccccauccucuguacagag

SEQ ID NO: 2936108 - RNA, 20 nt, Human
cccauucugccugcccaggc

SEQ ID NO: 2936109 - RNA, 21 nt, Human
cccauucugccugcccaggcc

SEQ ID NO: 2936110 - RNA, 22 nt, Human
cccauucugccugcccaggccc

SEQ ID NO: 2936111 - RNA, 20 nt, Human
cccagcacuuugggaggcug

SEQ ID NO: 2936112 - RNA, 14 nt, Human
cccagcccacuucu

SEQ ID NO: 2936113 - RNA, 23 nt, Human
cccaggaaaggcuccaggagcag

SEQ ID NO: 2936114 - RNA, 22 nt, Human
cccaggaaaggcuccaggagca

SEQ ID NO: 2936115 - RNA, 21 nt, Human
cccaggaaaggcuccaggagc

SEQ ID NO: 2936116 - RNA, 21 nt, Human
cccagcugugcucuggacagg

SEQ ID NO: 2936117 - RNA, 23 nt, Human
cccagcugugcucuggacaggca

SEQ ID NO: 2936118 - RNA, 19 nt, Human
cccaggaaaggcuccagga

SEQ ID NO: 2936119 - RNA, 15 nt, Human
cccaggcuuagucac

SEQ ID NO: 2936120 - RNA, 20 nt, Human
cccaggcuuagucacugaga

SEQ ID NO: 2936121 - RNA, 21 nt, Human
cccaggcuggcgugcaguggu

SEQ ID NO: 2936122 - RNA, 19 nt, Human
ccagcagagcaccuuagac

SEQ ID NO: 2936123 - RNA, 23 nt, Human
ccagcagagcaccuuagacaguc

SEQ ID NO: 2936124 - RNA, 16 nt, Human
ccagcuuaucucaggg

SEQ ID NO: 2936125 - RNA, 21 nt, Human
ccaggaaaggcuccaggagca

SEQ ID NO: 2936126 - RNA, 23 nt, Human
ccaggaaaggcuccaggagcagc

SEQ ID NO: 2936127 - RNA, 22 nt, Human
ccaggaaaggcuccaggagcag

SEQ ID NO: 2936128 - RNA, 21 nt, Human
ccagccccuggaugcagccuc

SEQ ID NO: 2936129 - RNA, 10 nt, Human
ccagccccuu

SEQ ID NO: 2936130 - RNA, 14 nt, Human
ccagcagccuggac

SEQ ID NO: 2936131 - RNA, 15 nt, Human
ccagcagccuggacc

SEQ ID NO: 2936132 - RNA, 20 nt, Human
ccagcagccuggacccugug

SEQ ID NO: 2936133 - RNA, 19 nt, Human
ccagcagccuggacccugu

SEQ ID NO: 2936134 - RNA, 20 nt, Human
ccaggauuauugucaaagaa

SEQ ID NO: 2936135 - RNA, 14 nt, Human
ccaggcugggagag

SEQ ID NO: 2936136 - RNA, 13 nt, Human
ccaggcugggaga

SEQ ID NO: 2936137 - RNA, 21 nt, Human
ccaggcugggagagccuucca

SEQ ID NO: 2936138 - RNA, 18 nt, Human
ccaggcugggagagccuu

SEQ ID NO: 2936139 - RNA, 17 nt, Human
ccaggcugggagagccu

SEQ ID NO: 2936140 - RNA, 15 nt, Human
ccaggcugggagagc

SEQ ID NO: 2936141 - RNA, 22 nt, Human
ccaggcugggagagccuuccag

SEQ ID NO: 2936142 - RNA, 19 nt, Human
ccagucaccccggccaccu

SEQ ID NO: 2936143 - RNA, 21 nt, Human
ccagucaccccggccaccugc

SEQ ID NO: 2936144 - RNA, 20 nt, Human
ccagucaccccggccaccug

SEQ ID NO: 2936145 - RNA, 13 nt, Human
ccagucaccccgg

SEQ ID NO: 2936146 - RNA, 12 nt, Human
ccagucaccccg

SEQ ID NO: 2936147 - RNA, 16 nt, Human
ccauccccuguagagu

SEQ ID NO: 2936148 - RNA, 13 nt, Human
ccaugagccucag

SEQ ID NO: 2936149 - RNA, 14 nt, Human
ccaugagccucagc

SEQ ID NO: 2936150 - RNA, 18 nt, Human
ccaugagccucagcaucc

SEQ ID NO: 2936151 - RNA, 19 nt, Human
ccaugagccucagcauccu

SEQ ID NO: 2936152 - RNA, 13 nt, Human
ccaugaguccccu

SEQ ID NO: 2936153 - RNA, 13 nt, Human
ccaugggccuccu

SEQ ID NO: 2936154 - RNA, 16 nt, Human
ccaugaguccccuguu

SEQ ID NO: 2936155 - RNA, 15 nt, Human
ccaugaguccccugu

SEQ ID NO: 2936156 - RNA, 14 nt, Human
ccaugaguccccug

SEQ ID NO: 2936157 - RNA, 23 nt, Human
ccaucccaaacccuucagugcca

SEQ ID NO: 2936158 - RNA, 12 nt, Human
ccaucccagccc

SEQ ID NO: 2936159 - RNA, 13 nt, Human
ccauacauuugug

SEQ ID NO: 2936160 - RNA, 14 nt, Human
ccauacauuugugu

SEQ ID NO: 2936161 - RNA, 14 nt, Human
ccaugggccuccug

SEQ ID NO: 2936162 - RNA, 15 nt, Human
ccaugggccuccugu

SEQ ID NO: 2936163 - RNA, 17 nt, Human
ccauuuacuuaagacuu

SEQ ID NO: 2936164 - RNA, 23 nt, Human
ccauuuacuuaagacuuaaugag

SEQ ID NO: 2936165 - RNA, 22 nt, Human
ccauuuaaagcuuauuaaaacu

SEQ ID NO: 2936166 - RNA, 17 nt, Human
cauauucuguuggccag

SEQ ID NO: 2936167 - RNA, 18 nt, Human
cauauucuguuggccagu

SEQ ID NO: 2936168 - RNA, 14 nt, Human
cauauggauaaaua

SEQ ID NO: 2936169 - RNA, 19 nt, Human
caguggugguuuucuguuc

SEQ ID NO: 2936170 - RNA, 20 nt, Human
caguggugguuuucuguucu

SEQ ID NO: 2936171 - RNA, 21 nt, Human
caguggugguuuucuguucuu

SEQ ID NO: 2936172 - RNA, 22 nt, Human
caguggugguuuucuguucuuu

SEQ ID NO: 2936173 - RNA, 18 nt, Human
caucuguuacacaaagaa

SEQ ID NO: 2936174 - RNA, 14 nt, Human
caucuuaaaaacaa

SEQ ID NO: 2936175 - RNA, 22 nt, Human
cauccuggcacccggccccugc

SEQ ID NO: 2936176 - RNA, 12 nt, Human
cauccuggaaua

SEQ ID NO: 2936177 - RNA, 21 nt, Human
cauccccuguagagugggagc

SEQ ID NO: 2936178 - RNA, 12 nt, Human
caucacuucccu

SEQ ID NO: 2936179 - RNA, 14 nt, Human
caucacuucccuac

SEQ ID NO: 2936180 - RNA, 15 nt, Human
cauccuggcacccgg

SEQ ID NO: 2936181 - RNA, 15 nt, Human
cauuaguuuugaaga

SEQ ID NO: 2936182 - RNA, 14 nt, Human
cauuaguuuugaag

SEQ ID NO: 2936183 - RNA, 17 nt, Human
cauuauauagcaguaaa

SEQ ID NO: 2936184 - RNA, 16 nt, Human
cauuaguuuugaagau

SEQ ID NO: 2936185 - RNA, 20 nt, Human
cauuauauagcaguaaaaaa

SEQ ID NO: 2936186 - RNA, 13 nt, Human
cauucuccaccug

SEQ ID NO: 2936187 - RNA, 16 nt, Human
cauucuccaccugcca

SEQ ID NO: 2936188 - RNA, 14 nt, Human
cauucuccaccugc

SEQ ID NO: 2936189 - RNA, 19 nt, Human
cauguuggccaggcugguc

SEQ ID NO: 2936190 - RNA, 16 nt, Human
cauguuggccaggcug

SEQ ID NO: 2936191 - RNA, 14 nt, Human
cauguuggccaggc

SEQ ID NO: 2936192 - RNA, 15 nt, Human
cauguuggccaggcu

SEQ ID NO: 2936193 - RNA, 17 nt, Human
caugggaaugaauguca

SEQ ID NO: 2936194 - RNA, 16 nt, Human
caugggaaugaauguc

SEQ ID NO: 2936195 - RNA, 15 nt, Human
caugggaaugaaugu

SEQ ID NO: 2936196 - RNA, 14 nt, Human
caugggaaugaaug

SEQ ID NO: 2936197 - RNA, 20 nt, Human
caugcuccuggcccacugca

SEQ ID NO: 2936198 - RNA, 13 nt, Human
caugauguuuucc

SEQ ID NO: 2936199 - RNA, 14 nt, Human
caugcuacacacug

SEQ ID NO: 2936200 - RNA, 20 nt, Human
caugcuacacacugcauguu

SEQ ID NO: 2936201 - RNA, 23 nt, Human
caugcuacacacugcauguuugu

SEQ ID NO: 2936202 - RNA, 14 nt, Human
caugauguuuagaa

SEQ ID NO: 2936203 - RNA, 22 nt, Human
ccacuccggcccuccagagccc

SEQ ID NO: 2936204 - RNA, 21 nt, Human
ccacuccggcccuccagagcc

SEQ ID NO: 2936205 - RNA, 20 nt, Human
ccacuccggcccuccagagc

SEQ ID NO: 2936206 - RNA, 17 nt, Human
ccacucccugcaaccug

SEQ ID NO: 2936207 - RNA, 13 nt, Human
ccacgcccccacu

SEQ ID NO: 2936208 - RNA, 19 nt, Human
ccacgcccccacuggugac

SEQ ID NO: 2936209 - RNA, 18 nt, Human
ccacgcccccacugguga

SEQ ID NO: 2936210 - RNA, 17 nt, Human
ccacgcccccacuggug

SEQ ID NO: 2936211 - RNA, 16 nt, Human
ccacgcccccacuggu

SEQ ID NO: 2936212 - RNA, 21 nt, Human
ccaccuuugaagaaguaagga

SEQ ID NO: 2936213 - RNA, 19 nt, Human
ccaccgcagacaggaccag

SEQ ID NO: 2936214 - RNA, 22 nt, Human
ccaccgcagacaggaccaggga

SEQ ID NO: 2936215 - RNA, 15 nt, Human
ccaccaucaagccac

SEQ ID NO: 2936216 - RNA, 17 nt, Human
ccaccacacccagccca

SEQ ID NO: 2936217 - RNA, 17 nt, Human
ccaccaccaauugccaa

SEQ ID NO: 2936218 - RNA, 24 nt, Human
ccaccagugccucucccugcugcu

SEQ ID NO: 2936219 - RNA, 14 nt, Human
ccaccaucaagcca

SEQ ID NO: 2936220 - RNA, 13 nt, Human
ccaccaucaagcc

SEQ ID NO: 2936221 - RNA, 23 nt, Human
ccacagcaguugaaaagacucca

SEQ ID NO: 2936222 - RNA, 18 nt, Human
ccacagcaguugaaaaga

SEQ ID NO: 2936223 - RNA, 17 nt, Human
ccacagcaguugaaaag

SEQ ID NO: 2936224 - RNA, 12 nt, Human
ccacagcaguug

SEQ ID NO: 2936225 - RNA, 17 nt, Human
ccaaaacugagcauaag

SEQ ID NO: 2936226 - RNA, 21 nt, Human
ccaaaacucuccucugcugcu

SEQ ID NO: 2936227 - RNA, 20 nt, Human
ccaaaacucuccucugcugc

SEQ ID NO: 2936228 - RNA, 22 nt, Human
cauuuuuuuuaagaaaaaggau

SEQ ID NO: 2936229 - RNA, 20 nt, Human
cauuuguguugaagagguuu

SEQ ID NO: 2936230 - RNA, 16 nt, Human
cauuuguguugaagag

SEQ ID NO: 2936231 - RNA, 19 nt, Human
cauuuguauaaaauaauuu

SEQ ID NO: 2936232 - RNA, 20 nt, Human
cauuuguauaaaauaauuuu

SEQ ID NO: 2936233 - RNA, 17 nt, Human
cauuuguauaaaauaau

SEQ ID NO: 2936234 - RNA, 14 nt, Human
ccaaugggagcuca

SEQ ID NO: 2936235 - RNA, 17 nt, Human
ccaaugggagcucaugg

SEQ ID NO: 2936236 - RNA, 17 nt, Human
ccaauauuuaccagacc

SEQ ID NO: 2936237 - RNA, 15 nt, Human
ccaaugauggucacc

SEQ ID NO: 2936238 - RNA, 14 nt, Human
ccaaugcacuuugu

SEQ ID NO: 2936239 - RNA, 18 nt, Human
ccaagcucugcuccucuc

SEQ ID NO: 2936240 - RNA, 12 nt, Human
ccaagcucugcu

SEQ ID NO: 2936241 - RNA, 17 nt, Human
ccaagcucugcuccucu

SEQ ID NO: 2936242 - RNA, 13 nt, Human
ccaagcucugcuc

SEQ ID NO: 2936243 - RNA, 18 nt, Human
ccaacucaccccagcccc

SEQ ID NO: 2936244 - RNA, 17 nt, Human
ccaacucaccccagccc

SEQ ID NO: 2936245 - RNA, 16 nt, Human
ccaacucaccccagcc

SEQ ID NO: 2936246 - RNA, 17 nt, Human
ccaaauguucaucaaug

SEQ ID NO: 2936247 - RNA, 14 nt, Human
ccaacucaccccag

SEQ ID NO: 2936248 - RNA, 23 nt, Human
ccaaauggaaaugggcagagcag

SEQ ID NO: 2936249 - RNA, 21 nt, Human
caggcugggcuucaguggcag

SEQ ID NO: 2936250 - RNA, 22 nt, Human
caggcugggcuucaguggcagc

SEQ ID NO: 2936251 - RNA, 20 nt, Human
caggcugggcuucaguggca

SEQ ID NO: 2936252 - RNA, 15 nt, Human
caggcugggagagcc

SEQ ID NO: 2936253 - RNA, 14 nt, Human
caggcugggagagc

SEQ ID NO: 2936254 - RNA, 12 nt, Human
caggcugggaga

SEQ ID NO: 2936255 - RNA, 20 nt, Human
caggggaaaaucagccugcu

SEQ ID NO: 2936256 - RNA, 19 nt, Human
caggggaaaaucagccugc

SEQ ID NO: 2936257 - RNA, 21 nt, Human
cagggcucagcggggacagcu

SEQ ID NO: 2936258 - RNA, 23 nt, Human
cagggcucagcggggacagcucc

SEQ ID NO: 2936259 - RNA, 18 nt, Human
caggcagauacaggaaaa

SEQ ID NO: 2936260 - RNA, 13 nt, Human
caggccagaggga

SEQ ID NO: 2936261 - RNA, 15 nt, Human
caggccagagggagu

SEQ ID NO: 2936262 - RNA, 23 nt, Human
caggccagcugcuugggcuucau

SEQ ID NO: 2936263 - RNA, 21 nt, Human
caggccagcugcuugggcuuc

SEQ ID NO: 2936264 - RNA, 19 nt, Human
caggccagcugcuugggcu

SEQ ID NO: 2936265 - RNA, 17 nt, Human
caggccagcugcuuggg

SEQ ID NO: 2936266 - RNA, 18 nt, Human
caggccaggcccucugcc

SEQ ID NO: 2936267 - RNA, 17 nt, Human
caggccaggcccucugc

SEQ ID NO: 2936268 - RNA, 19 nt, Human
caggccaggcccucugccc

SEQ ID NO: 2936269 - RNA, 20 nt, Human
caggccaggcccucugccca

SEQ ID NO: 2936270 - RNA, 15 nt, Human
caggugcacaagcuc

SEQ ID NO: 2936271 - RNA, 22 nt, Human
caggugauccacccaccucagc

SEQ ID NO: 2936272 - RNA, 23 nt, Human
caggugauccacccaccucagcc

SEQ ID NO: 2936273 - RNA, 20 nt, Human
caggugcacaagcuccaagc

SEQ ID NO: 2936274 - RNA, 19 nt, Human
caggugcacaagcuccaag

SEQ ID NO: 2936275 - RNA, 18 nt, Human
caggugcacaagcuccaa

SEQ ID NO: 2936276 - RNA, 17 nt, Human
caggugcacaagcucca

SEQ ID NO: 2936277 - RNA, 21 nt, Human
caggugauccacccaccucag

SEQ ID NO: 2936278 - RNA, 20 nt, Human
caggugauccacccaccuca

SEQ ID NO: 2936279 - RNA, 19 nt, Human
cagguuuucuuuuaagaau

SEQ ID NO: 2936280 - RNA, 16 nt, Human
cagguuuuccugaaga

SEQ ID NO: 2936281 - RNA, 18 nt, Human
cagguuuucuuuuaagaa

SEQ ID NO: 2936282 - RNA, 12 nt, Human
cagguuuuccug

SEQ ID NO: 2936283 - RNA, 14 nt, Human
cagguuuaagcugu

SEQ ID NO: 2936284 - RNA, 21 nt, Human
cagguuggugggggccucggu

SEQ ID NO: 2936285 - RNA, 19 nt, Human
caggugccaguuauggcua

SEQ ID NO: 2936286 - RNA, 21 nt, Human
caggugcacaagcuccaagcu

SEQ ID NO: 2936287 - RNA, 15 nt, Human
cagucaccucaugga

SEQ ID NO: 2936288 - RNA, 19 nt, Human
cagucaccucauggaauug

SEQ ID NO: 2936289 - RNA, 15 nt, Human
cagucacauuccaag

SEQ ID NO: 2936290 - RNA, 16 nt, Human
cagucaccucauggaa

SEQ ID NO: 2936291 - RNA, 20 nt, Human
caguggugcgaucuggguuc

SEQ ID NO: 2936292 - RNA, 21 nt, Human
caguggugcgaucuggguuca

SEQ ID NO: 2936293 - RNA, 18 nt, Human
caguggugguuuucuguu

SEQ ID NO: 2936294 - RNA, 14 nt, Human
caguggggaaugaa

SEQ ID NO: 2936295 - RNA, 13 nt, Human
cagugcccacagg

SEQ ID NO: 2936296 - RNA, 15 nt, Human
cagugcccacaggau

SEQ ID NO: 2936297 - RNA, 17 nt, Human
cagugcaugcugucccu

SEQ ID NO: 2936298 - RNA, 16 nt, Human
cagugcaugcuguccc

SEQ ID NO: 2936299 - RNA, 17 nt, Human
cagugcccacaggauca

SEQ ID NO: 2936300 - RNA, 20 nt, Human
cagugggagcugccuguuca

SEQ ID NO: 2936301 - RNA, 23 nt, Human
cagugggagcugccuguucagcu

SEQ ID NO: 2936302 - RNA, 14 nt, Human
cagugcaugcuguc

SEQ ID NO: 2936303 - RNA, 13 nt, Human
cagugcaugcugu

SEQ ID NO: 2936304 - RNA, 15 nt, Human
cagucuggaaugcag

SEQ ID NO: 2936305 - RNA, 14 nt, Human
cagucugcuuagaa

SEQ ID NO: 2936306 - RNA, 17 nt, Human
cagucugcuuagaaaua

SEQ ID NO: 2936307 - RNA, 15 nt, Human
cagucugcuuagaaa

SEQ ID NO: 2936308 - RNA, 16 nt, Human
cagucugcuuagaaau

SEQ ID NO: 2936309 - RNA, 17 nt, Human
cagucuggaaugcagug

SEQ ID NO: 2936310 - RNA, 20 nt, Human
cagucugacuguuuccauca

SEQ ID NO: 2936311 - RNA, 20 nt, Human
cagcaucauggagguuugaa

SEQ ID NO: 2936312 - RNA, 17 nt, Human
cagauugcaacaggcug

SEQ ID NO: 2936313 - RNA, 22 nt, Human
cagauucuuuccugaggcuggg

SEQ ID NO: 2936314 - RNA, 20 nt, Human
cagauucuuuccugaggcug

SEQ ID NO: 2936315 - RNA, 16 nt, Human
cagcacgauuucuguu

SEQ ID NO: 2936316 - RNA, 18 nt, Human
cagcacgauuucuguuua

SEQ ID NO: 2936317 - RNA, 19 nt, Human
cagcacgauuucuguuuag

SEQ ID NO: 2936318 - RNA, 20 nt, Human
cagcacgauuucuguuuaga

SEQ ID NO: 2936319 - RNA, 16 nt, Human
cagcagugagacuggg

SEQ ID NO: 2936320 - RNA, 13 nt, Human
cagcaguucagag

SEQ ID NO: 2936321 - RNA, 22 nt, Human
cagcaguugaaaagacuccaaa

SEQ ID NO: 2936322 - RNA, 23 nt, Human
cagaggggguggccucccaacuc

SEQ ID NO: 2936323 - RNA, 22 nt, Human
cagaggggguggccucccaacu

SEQ ID NO: 2936324 - RNA, 21 nt, Human
cagaguaggcuauuccugaga

SEQ ID NO: 2936325 - RNA, 17 nt, Human
cagagguugcagugagc

SEQ ID NO: 2936326 - RNA, 16 nt, Human
cagagguugcagugag

SEQ ID NO: 2936327 - RNA, 12 nt, Human
cagauccuggaa

SEQ ID NO: 2936328 - RNA, 19 nt, Human
cagauucuuuccugaggcu

SEQ ID NO: 2936329 - RNA, 18 nt, Human
cagauucuuuccugaggc

SEQ ID NO: 2936330 - RNA, 17 nt, Human
cagauucuuuccugagg

SEQ ID NO: 2936331 - RNA, 15 nt, Human
cagauucuuuccuga

SEQ ID NO: 2936332 - RNA, 18 nt, Human
cagcggggacagcuccuu

SEQ ID NO: 2936333 - RNA, 19 nt, Human
cagcggggacagcuccuuc

SEQ ID NO: 2936334 - RNA, 21 nt, Human
cagcggggacagcuccuucug

SEQ ID NO: 2936335 - RNA, 19 nt, Human
cagccugcuaauuccccag

SEQ ID NO: 2936336 - RNA, 12 nt, Human
cagccugcucca

SEQ ID NO: 2936337 - RNA, 19 nt, Human
cagccgagauagccaaggc

SEQ ID NO: 2936338 - RNA, 17 nt, Human
cagccucugaaaaccaa

SEQ ID NO: 2936339 - RNA, 18 nt, Human
caggaaaagcugcugaca

SEQ ID NO: 2936340 - RNA, 15 nt, Human
caggaaaagcugcug

SEQ ID NO: 2936341 - RNA, 16 nt, Human
caggaaaagcugcuga

SEQ ID NO: 2936342 - RNA, 19 nt, Human
cagcugagggugagugggu

SEQ ID NO: 2936343 - RNA, 12 nt, Human
cagcugccuggg

SEQ ID NO: 2936344 - RNA, 14 nt, Human
cagcugccugggau

SEQ ID NO: 2936345 - RNA, 13 nt, Human
cagcugccuggga

SEQ ID NO: 2936346 - RNA, 19 nt, Human
cagcugugcucuggacagg

SEQ ID NO: 2936347 - RNA, 20 nt, Human
cagcugugcucuggacaggc

SEQ ID NO: 2936348 - RNA, 24 nt, Human
cagcugugcucuggacaggcaugu

SEQ ID NO: 2936349 - RNA, 19 nt, Human
cagcuguucagcugguuga

SEQ ID NO: 2936350 - RNA, 20 nt, Human
cagcuccccucggagaagag

SEQ ID NO: 2936351 - RNA, 22 nt, Human
cagcuccccucggagaagagcu

SEQ ID NO: 2936352 - RNA, 21 nt, Human
cagcuccccucggagaagagc

SEQ ID NO: 2936353 - RNA, 17 nt, Human
auuuaaucuuuuaugau

SEQ ID NO: 2936354 - RNA, 14 nt, Human
auuuaaucuuuuau

SEQ ID NO: 2936355 - RNA, 14 nt, Human
auuuaaugaaagac

SEQ ID NO: 2936356 - RNA, 14 nt, Human
auuuaauaugcaaa

SEQ ID NO: 2936357 - RNA, 15 nt, Human
auuuaauaugcaaag

SEQ ID NO: 2936358 - RNA, 16 nt, Human
auuuaauaugcaaagu

SEQ ID NO: 2936359 - RNA, 23 nt, Human
auuucaagaaguccccucuccuc

SEQ ID NO: 2936360 - RNA, 15 nt, Human
auuucucauguugaa

SEQ ID NO: 2936361 - RNA, 20 nt, Human
auuucuaugaaauauuaugu

SEQ ID NO: 2936362 - RNA, 15 nt, Human
auuucuaugaaauau

SEQ ID NO: 2936363 - RNA, 18 nt, Human
auuucuaugaaauauuau

SEQ ID NO: 2936364 - RNA, 14 nt, Human
auuucuguuuagau

SEQ ID NO: 2936365 - RNA, 16 nt, Human
auuucuguuuagauaa

SEQ ID NO: 2936366 - RNA, 12 nt, Human
auuucuguuuag

SEQ ID NO: 2936367 - RNA, 17 nt, Human
auuguaaaugugcuuuu

SEQ ID NO: 2936368 - RNA, 15 nt, Human
auuguaaaugugcuu

SEQ ID NO: 2936369 - RNA, 14 nt, Human
auuguaaaugugcu

SEQ ID NO: 2936370 - RNA, 16 nt, Human
auuguaaggaaugauu

SEQ ID NO: 2936371 - RNA, 15 nt, Human
auuguaaggaaugau

SEQ ID NO: 2936372 - RNA, 19 nt, Human
auuguucuuaguuugcagu

SEQ ID NO: 2936373 - RNA, 19 nt, Human
auuguuuaaaaucauuucu

SEQ ID NO: 2936374 - RNA, 18 nt, Human
auugacuuuuuauggcac

SEQ ID NO: 2936375 - RNA, 16 nt, Human
auucucuccuguaccu

SEQ ID NO: 2936376 - RNA, 19 nt, Human
auucugagaugacuauuca

SEQ ID NO: 2936377 - RNA, 17 nt, Human
auucuugccaaauauaa

SEQ ID NO: 2936378 - RNA, 21 nt, Human
auuccugaugcuucuucagag

SEQ ID NO: 2936379 - RNA, 19 nt, Human
auucucuccuguaccucuu

SEQ ID NO: 2936380 - RNA, 21 nt, Human
auucucuccuguaccucuuga

SEQ ID NO: 2936381 - RNA, 13 nt, Human
auuccugaacagg

SEQ ID NO: 2936382 - RNA, 22 nt, Human
auucuuuccugaggcugggcuc

SEQ ID NO: 2936383 - RNA, 17 nt, Human
auucuuuccugaggcug

SEQ ID NO: 2936384 - RNA, 20 nt, Human
auucauauuuacuucuuaua

SEQ ID NO: 2936385 - RNA, 18 nt, Human
auucauauuuacuucuua

SEQ ID NO: 2936386 - RNA, 19 nt, Human
auucauauuuacuucuuau

SEQ ID NO: 2936387 - RNA, 17 nt, Human
auucacaaaguaauuug

SEQ ID NO: 2936388 - RNA, 21 nt, Human
auucacaaaguaauuuggaaa

SEQ ID NO: 2936389 - RNA, 20 nt, Human
auuaaauucuugcaaaguau

SEQ ID NO: 2936390 - RNA, 14 nt, Human
auuaaauucuugca

SEQ ID NO: 2936391 - RNA, 18 nt, Human
auuaaauucuugcaaagu

SEQ ID NO: 2936392 - RNA, 16 nt, Human
auucacaaaguaauuu

SEQ ID NO: 2936393 - RNA, 18 nt, Human
auucacaagacccaaaag

SEQ ID NO: 2936394 - RNA, 12 nt, Human
auuuuuuuuucc

SEQ ID NO: 2936395 - RNA, 16 nt, Human
auuuuuuuuuccuuca

SEQ ID NO: 2936396 - RNA, 13 nt, Human
auuuuuuuuuccu

SEQ ID NO: 2936397 - RNA, 13 nt, Human
auuuuuaagugcu

SEQ ID NO: 2936398 - RNA, 13 nt, Human
caaaaaaaauuag

SEQ ID NO: 2936399 - RNA, 18 nt, Human
caaaaaaaauuagccggg

SEQ ID NO: 2936400 - RNA, 17 nt, Human
auuuuuuuuuccuucag

SEQ ID NO: 2936401 - RNA, 15 nt, Human
caaaagcugggcagg

SEQ ID NO: 2936402 - RNA, 14 nt, Human
auuuguuugaacug

SEQ ID NO: 2936403 - RNA, 16 nt, Human
auuuguuugaacugau

SEQ ID NO: 2936404 - RNA, 13 nt, Human
auuuguuugaacu

SEQ ID NO: 2936405 - RNA, 22 nt, Human
caagacccuuguggucccaccc

SEQ ID NO: 2936406 - RNA, 19 nt, Human
caagacccuugugguccca

SEQ ID NO: 2936407 - RNA, 18 nt, Human
caagacccuugugguccc

SEQ ID NO: 2936408 - RNA, 23 nt, Human
caagaauuucuaggacugaauua

SEQ ID NO: 2936409 - RNA, 20 nt, Human
caagaaguccccucuccucc

SEQ ID NO: 2936410 - RNA, 20 nt, Human
caagaauuucuaggacugaa

SEQ ID NO: 2936411 - RNA, 15 nt, Human
caacucaccccagcc

SEQ ID NO: 2936412 - RNA, 13 nt, Human
caacucaccccag

SEQ ID NO: 2936413 - RNA, 16 nt, Human
caacucaccccagccc

SEQ ID NO: 2936414 - RNA, 15 nt, Human
caacccccagccugc

SEQ ID NO: 2936415 - RNA, 16 nt, Human
caacccccagccugcu

SEQ ID NO: 2936416 - RNA, 17 nt, Human
caacccccagccugcua

SEQ ID NO: 2936417 - RNA, 21 nt, Human
caacuaucucauuuccaagca

SEQ ID NO: 2936418 - RNA, 19 nt, Human
caacccaaauguucaucaa

SEQ ID NO: 2936419 - RNA, 18 nt, Human
caaccacugcgaccacaa

SEQ ID NO: 2936420 - RNA, 23 nt, Human
caacaaaccuguuucugcagcca

SEQ ID NO: 2936421 - RNA, 18 nt, Human
caaaguaauuuggaaauu

SEQ ID NO: 2936422 - RNA, 20 nt, Human
caaaguaauuuggaaauuag

SEQ ID NO: 2936423 - RNA, 14 nt, Human
caaagaugcagccg

SEQ ID NO: 2936424 - RNA, 13 nt, Human
caaagaugcagcc

SEQ ID NO: 2936425 - RNA, 21 nt, Human
caaaguacacuguuucaaacu

SEQ ID NO: 2936426 - RNA, 16 nt, Human
caaaguacacuguuuc

SEQ ID NO: 2936427 - RNA, 20 nt, Human
caaaguacacuguuucaaac

SEQ ID NO: 2936428 - RNA, 17 nt, Human
caaaucagcugcuacua

SEQ ID NO: 2936429 - RNA, 23 nt, Human
caaaucagguuuucuuuuaagaa

SEQ ID NO: 2936430 - RNA, 15 nt, Human
caaauccuugaagau

SEQ ID NO: 2936431 - RNA, 20 nt, Human
caacaccuuguuucccucuc

SEQ ID NO: 2936432 - RNA, 22 nt, Human
caacaccucugcacaagcugca

SEQ ID NO: 2936433 - RNA, 17 nt, Human
cacuguugcccaggcug

SEQ ID NO: 2936434 - RNA, 19 nt, Human
cacuguuucaaacuuuacu

SEQ ID NO: 2936435 - RNA, 11 nt, Human
cacuugugaau

SEQ ID NO: 2936436 - RNA, 12 nt, Human
cacuugugaaua

SEQ ID NO: 2936437 - RNA, 17 nt, Human
cacuuggucugugagau

SEQ ID NO: 2936438 - RNA, 20 nt, Human
cacuuggucugugagaugcu

SEQ ID NO: 2936439 - RNA, 17 nt, Human
cacuggugacaugucuu

SEQ ID NO: 2936440 - RNA, 14 nt, Human
cacuguugcccagg

SEQ ID NO: 2936441 - RNA, 15 nt, Human
cacuguugcccaggc

SEQ ID NO: 2936442 - RNA, 16 nt, Human
cacuguugcccaggcu

SEQ ID NO: 2936443 - RNA, 23 nt, Human
cacugggcuuggggaccagagcu

SEQ ID NO: 2936444 - RNA, 20 nt, Human
cacugggcuuggggaccaga

SEQ ID NO: 2936445 - RNA, 22 nt, Human
cacugggcuuggggaccagagc

SEQ ID NO: 2936446 - RNA, 17 nt, Human
cagaaauguguuaucac

SEQ ID NO: 2936447 - RNA, 21 nt, Human
cagaaguuucugccgcagccc

SEQ ID NO: 2936448 - RNA, 20 nt, Human
cagaaguuucugccgcagcc

SEQ ID NO: 2936449 - RNA, 22 nt, Human
cagaaguuucugccgcagcccu

SEQ ID NO: 2936450 - RNA, 20 nt, Human
cacggagggugacgggggug

SEQ ID NO: 2936451 - RNA, 14 nt, Human
cacggccaggccag

SEQ ID NO: 2936452 - RNA, 15 nt, Human
cacggccaggccaga

SEQ ID NO: 2936453 - RNA, 16 nt, Human
cacggccaggccagag

SEQ ID NO: 2936454 - RNA, 23 nt, Human
cacuacggaauaguuggcuagga

SEQ ID NO: 2936455 - RNA, 17 nt, Human
cacucuuauugcccacg

SEQ ID NO: 2936456 - RNA, 18 nt, Human
cacucuuauugcccacgc

SEQ ID NO: 2936457 - RNA, 19 nt, Human
cacucuuauugcccacgcu

SEQ ID NO: 2936458 - RNA, 14 nt, Human
caccuuugaagaag

SEQ ID NO: 2936459 - RNA, 17 nt, Human
caccuuuguccccaccg

SEQ ID NO: 2936460 - RNA, 15 nt, Human
caccuuuguccccac

SEQ ID NO: 2936461 - RNA, 14 nt, Human
caccuuugucccca

SEQ ID NO: 2936462 - RNA, 13 nt, Human
caccuuggcucaa

SEQ ID NO: 2936463 - RNA, 22 nt, Human
caccuugcagcucuccccuucu

SEQ ID NO: 2936464 - RNA, 19 nt, Human
caccuugacagggcacacc

SEQ ID NO: 2936465 - RNA, 17 nt, Human
caccugccagggacaga

SEQ ID NO: 2936466 - RNA, 15 nt, Human
caccuugcagcucuc

SEQ ID NO: 2936467 - RNA, 13 nt, Human
caccuugcagcuc

SEQ ID NO: 2936468 - RNA, 13 nt, Human
caccugccaggga

SEQ ID NO: 2936469 - RNA, 23 nt, Human
caccucaaaauaccaugccauuu

SEQ ID NO: 2936470 - RNA, 16 nt, Human
caccugccagggacag

SEQ ID NO: 2936471 - RNA, 14 nt, Human
caccugccagggac

SEQ ID NO: 2936472 - RNA, 21 nt, Human
caccuacaugagguacugaga

SEQ ID NO: 2936473 - RNA, 16 nt, Human
caccguuaucgguguc

SEQ ID NO: 2936474 - RNA, 19 nt, Human
caauaaacauuucauuucc

SEQ ID NO: 2936475 - RNA, 20 nt, Human
caaguauuagaauaccacag

SEQ ID NO: 2936476 - RNA, 14 nt, Human
caaguauuagaaua

SEQ ID NO: 2936477 - RNA, 14 nt, Human
cacaagccuucggc

SEQ ID NO: 2936478 - RNA, 16 nt, Human
cacaagacugcacauc

SEQ ID NO: 2936479 - RNA, 12 nt, Human
caauuuaaaaaa

SEQ ID NO: 2936480 - RNA, 16 nt, Human
cacaagacccuugugg

SEQ ID NO: 2936481 - RNA, 14 nt, Human
cacaagacccuugu

SEQ ID NO: 2936482 - RNA, 22 nt, Human
caaugcugugcccuaaagugua

SEQ ID NO: 2936483 - RNA, 22 nt, Human
caaugcuggcuguuggcugggg

SEQ ID NO: 2936484 - RNA, 23 nt, Human
caaugcuggcuguuggcuggggg

SEQ ID NO: 2936485 - RNA, 14 nt, Human
caaugcuguauuuu

SEQ ID NO: 2936486 - RNA, 23 nt, Human
caaugcuguauuuuaaaagaaug

SEQ ID NO: 2936487 - RNA, 12 nt, Human
caauauuucaga

SEQ ID NO: 2936488 - RNA, 20 nt, Human
caauauuucagauaaucaca

SEQ ID NO: 2936489 - RNA, 16 nt, Human
cacaucuugcucugcu

SEQ ID NO: 2936490 - RNA, 17 nt, Human
cacaucuugcucugcug

SEQ ID NO: 2936491 - RNA, 22 nt, Human
cacaucagcacgauuucuguuu

SEQ ID NO: 2936492 - RNA, 20 nt, Human
cacaucagcacgauuucugu

SEQ ID NO: 2936493 - RNA, 21 nt, Human
cacaucagcacgauuucuguu

SEQ ID NO: 2936494 - RNA, 18 nt, Human
cacaucuugcucugcuga

SEQ ID NO: 2936495 - RNA, 15 nt, Human
cacauuuuauuuuau

SEQ ID NO: 2936496 - RNA, 17 nt, Human
caccaacauacucccau

SEQ ID NO: 2936497 - RNA, 21 nt, Human
caccaacauacucccaucugu

SEQ ID NO: 2936498 - RNA, 20 nt, Human
caccaacauacucccaucug

SEQ ID NO: 2936499 - RNA, 13 nt, Human
cacauuuuucuua

SEQ ID NO: 2936500 - RNA, 14 nt, Human
cacauuuuucuuag

SEQ ID NO: 2936501 - RNA, 17 nt, Human
cacauuuuuuaaaugca

SEQ ID NO: 2936502 - RNA, 21 nt, Human
cacauuuuuuaaaugcaccug

SEQ ID NO: 2936503 - RNA, 24 nt, Human
cacccaggagccccgaggccuucu

SEQ ID NO: 2936504 - RNA, 19 nt, Human
cacccagcccacuucugcc

SEQ ID NO: 2936505 - RNA, 20 nt, Human
cacccaggagccccgaggcc

SEQ ID NO: 2936506 - RNA, 23 nt, Human
cacccaggagccccgaggccuuc

SEQ ID NO: 2936507 - RNA, 21 nt, Human
caccagcccuuagcagggaaa

SEQ ID NO: 2936508 - RNA, 15 nt, Human
caccagcagccugga

SEQ ID NO: 2936509 - RNA, 12 nt, Human
caccagcagccu

SEQ ID NO: 2936510 - RNA, 14 nt, Human
caccagcagccugg

SEQ ID NO: 2936511 - RNA, 23 nt, Human
caccaacauacucccaucuguga

SEQ ID NO: 2936512 - RNA, 16 nt, Human
cacccagcccacuucu

SEQ ID NO: 2936513 - RNA, 17 nt, Human
cacccagcccacuucug

SEQ ID NO: 2936514 - RNA, 22 nt, Human
cacagcuaacauggaaguacua

SEQ ID NO: 2936515 - RNA, 20 nt, Human
cacagcucuguccugggagu

SEQ ID NO: 2936516 - RNA, 23 nt, Human
cacagcucuguccugggagugag

SEQ ID NO: 2936517 - RNA, 10 nt, Human
cacagcucuu

SEQ ID NO: 2936518 - RNA, 19 nt, Human
cacagcucuguccugggag

SEQ ID NO: 2936519 - RNA, 16 nt, Human
cacagcuaacauggaa

SEQ ID NO: 2936520 - RNA, 15 nt, Human
cacagcuaacaugga

SEQ ID NO: 2936521 - RNA, 19 nt, Human
cacagacccugcccugugg

SEQ ID NO: 2936522 - RNA, 21 nt, Human
cacagacccugcccugugggc

SEQ ID NO: 2936523 - RNA, 20 nt, Human
cacagacccugcccuguggg

SEQ ID NO: 2936524 - RNA, 16 nt, Human
cacaguauuacuucug

SEQ ID NO: 2936525 - RNA, 18 nt, Human
cacaguauuacuucugcu

SEQ ID NO: 2936526 - RNA, 19 nt, Human
cacaguauuacuucugcua

SEQ ID NO: 2936527 - RNA, 23 nt, Human
ggccucccaacucaccccagccc

SEQ ID NO: 2936528 - RNA, 22 nt, Human
ggccucccaacucaccccagcc

SEQ ID NO: 2936529 - RNA, 20 nt, Human
ggccucccaacucaccccag

SEQ ID NO: 2936530 - RNA, 13 nt, Human
ggccucagugcca

SEQ ID NO: 2936531 - RNA, 17 nt, Human
ggccucccaacucaccc

SEQ ID NO: 2936532 - RNA, 19 nt, Human
ggccucccaacucacccca

SEQ ID NO: 2936533 - RNA, 18 nt, Human
ggccucccaacucacccc

SEQ ID NO: 2936534 - RNA, 15 nt, Human
ggccagaugcaccag

SEQ ID NO: 2936535 - RNA, 16 nt, Human
ggccagaugcaccagc

SEQ ID NO: 2936536 - RNA, 16 nt, Human
ggccugcaagggagug

SEQ ID NO: 2936537 - RNA, 11 nt, Human
ggccuggaugc

SEQ ID NO: 2936538 - RNA, 20 nt, Human
ggccuggaugcccccugugg

SEQ ID NO: 2936539 - RNA, 16 nt, Human
ggccuggccagaugca

SEQ ID NO: 2936540 - RNA, 12 nt, Human
ggccuggccaga

SEQ ID NO: 2936541 - RNA, 15 nt, Human
ggccuggccagaugc

SEQ ID NO: 2936542 - RNA, 20 nt, Human
ggcuaagugauccucccacc

SEQ ID NO: 2936543 - RNA, 16 nt, Human
ggcuaauguacugcau

SEQ ID NO: 2936544 - RNA, 13 nt, Human
ggcuaccuuugua

SEQ ID NO: 2936545 - RNA, 14 nt, Human
ggcuaccuuuguau

SEQ ID NO: 2936546 - RNA, 15 nt, Human
ggcgugaacccagga

SEQ ID NO: 2936547 - RNA, 15 nt, Human
ggcuaacuuggguua

SEQ ID NO: 2936548 - RNA, 20 nt, Human
ggcuaagcuucacuguaaaa

SEQ ID NO: 2936549 - RNA, 21 nt, Human
ggcgagccauuugucccaagu

SEQ ID NO: 2936550 - RNA, 20 nt, Human
ggccuuccccuggcacuggc

SEQ ID NO: 2936551 - RNA, 18 nt, Human
ggccuucggccuccaucc

SEQ ID NO: 2936552 - RNA, 16 nt, Human
ggccuucggccuccau

SEQ ID NO: 2936553 - RNA, 14 nt, Human
ggccuuccccuggc

SEQ ID NO: 2936554 - RNA, 13 nt, Human
ggcucacugcagc

SEQ ID NO: 2936555 - RNA, 14 nt, Human
ggcucacugcagcc

SEQ ID NO: 2936556 - RNA, 15 nt, Human
ggcucacugcagccu

SEQ ID NO: 2936557 - RNA, 14 nt, Human
ggcucuuccaggcu

SEQ ID NO: 2936558 - RNA, 15 nt, Human
ggcucuuccaggcug

SEQ ID NO: 2936559 - RNA, 18 nt, Human
ggcucuuccaggcuggga

SEQ ID NO: 2936560 - RNA, 17 nt, Human
ggcucuuccaggcuggg

SEQ ID NO: 2936561 - RNA, 13 nt, Human
ggcucccuuccca

SEQ ID NO: 2936562 - RNA, 13 nt, Human
ggcuggccuggcc

SEQ ID NO: 2936563 - RNA, 15 nt, Human
ggcuggccuggcccc

SEQ ID NO: 2936564 - RNA, 14 nt, Human
ggcuggccuggccc

SEQ ID NO: 2936565 - RNA, 22 nt, Human
aaaaaacugcugacuguuuucu

SEQ ID NO: 2936566 - RNA, 14 nt, Human
aaaaaggaggaaga

SEQ ID NO: 2936567 - RNA, 21 nt, Human
aaaaaggaugcacagaguugu

SEQ ID NO: 2936568 - RNA, 12 nt, Human
aaaaaggcagga

SEQ ID NO: 2936569 - RNA, 14 nt, Human
ggcuggguuggagg

SEQ ID NO: 2936570 - RNA, 22 nt, Human
ggcuggguucuacccaggugcu

SEQ ID NO: 2936571 - RNA, 13 nt, Human
aaaaauacaaaaa

SEQ ID NO: 2936572 - RNA, 22 nt, Human
ggagguaaggaauaccuguccc

SEQ ID NO: 2936573 - RNA, 21 nt, Human
ggagggugacgggggugaacu

SEQ ID NO: 2936574 - RNA, 23 nt, Human
ggaggugggauccuccaggugca

SEQ ID NO: 2936575 - RNA, 22 nt, Human
ggaggugggauccuccaggugc

SEQ ID NO: 2936576 - RNA, 20 nt, Human
ggaggcggaccuuguaguga

SEQ ID NO: 2936577 - RNA, 14 nt, Human
ggaggggggaggug

SEQ ID NO: 2936578 - RNA, 13 nt, Human
ggaggggggaggu

SEQ ID NO: 2936579 - RNA, 15 nt, Human
ggaguggccacagaa

SEQ ID NO: 2936580 - RNA, 22 nt, Human
ggagugggcccaaugcacuuug

SEQ ID NO: 2936581 - RNA, 12 nt, Human
ggagugggccca

SEQ ID NO: 2936582 - RNA, 16 nt, Human
ggaguggccacagaaa

SEQ ID NO: 2936583 - RNA, 19 nt, Human
ggaguuauugaagcagagu

SEQ ID NO: 2936584 - RNA, 18 nt, Human
ggaucucuugagccuggg

SEQ ID NO: 2936585 - RNA, 23 nt, Human
ggauccugagccagauuucacuc

SEQ ID NO: 2936586 - RNA, 20 nt, Human
ggauccugagccagauuuca

SEQ ID NO: 2936587 - RNA, 19 nt, Human
ggauccugagccagauuuc

SEQ ID NO: 2936588 - RNA, 18 nt, Human
ggauccugagccagauuu

SEQ ID NO: 2936589 - RNA, 16 nt, Human
ggauccugagccagau

SEQ ID NO: 2936590 - RNA, 15 nt, Human
ggauccugagccaga

SEQ ID NO: 2936591 - RNA, 16 nt, Human
ggaguucaucuugaau

SEQ ID NO: 2936592 - RNA, 22 nt, Human
ggauuuaacagaaauguacagc

SEQ ID NO: 2936593 - RNA, 16 nt, Human
ggauuuaacagaaaug

SEQ ID NO: 2936594 - RNA, 17 nt, Human
ggauuuaacagaaaugu

SEQ ID NO: 2936595 - RNA, 23 nt, Human
ggauugugccuaauguguuugag

SEQ ID NO: 2936596 - RNA, 12 nt, Human
ggauuuaacaga

SEQ ID NO: 2936597 - RNA, 20 nt, Human
ggauuguccccgacccuugc

SEQ ID NO: 2936598 - RNA, 16 nt, Human
ggauuguccccgaccc

SEQ ID NO: 2936599 - RNA, 14 nt, Human
ggaugaaaaaauaa

SEQ ID NO: 2936600 - RNA, 13 nt, Human
ggauuguccccga

SEQ ID NO: 2936601 - RNA, 15 nt, Human
ggcaaaaaggcagga

SEQ ID NO: 2936602 - RNA, 18 nt, Human
ggcacaccgggcacucag

SEQ ID NO: 2936603 - RNA, 16 nt, Human
ggcacugcuuccagug

SEQ ID NO: 2936604 - RNA, 14 nt, Human
ggcacaucauuuca

SEQ ID NO: 2936605 - RNA, 15 nt, Human
ggcacaucauuucaa

SEQ ID NO: 2936606 - RNA, 18 nt, Human
ggcacaucagcacgauuu

SEQ ID NO: 2936607 - RNA, 18 nt, Human
ggcaggaggaucacuuga

SEQ ID NO: 2936608 - RNA, 16 nt, Human
ggcagccccauucugc

SEQ ID NO: 2936609 - RNA, 20 nt, Human
ggcagccccauucugccugc

SEQ ID NO: 2936610 - RNA, 21 nt, Human
ggcagccccauucugccugcc

SEQ ID NO: 2936611 - RNA, 22 nt, Human
ggcagccccauucugccugccc

SEQ ID NO: 2936612 - RNA, 13 nt, Human
ggcagccaggcca

SEQ ID NO: 2936613 - RNA, 20 nt, Human
ggcacugcuuccagugaggc

SEQ ID NO: 2936614 - RNA, 14 nt, Human
ggcauuugcugaau

SEQ ID NO: 2936615 - RNA, 19 nt, Human
ggccaaaggaagcacaugc

SEQ ID NO: 2936616 - RNA, 16 nt, Human
ggccaaaggaagcaca

SEQ ID NO: 2936617 - RNA, 14 nt, Human
ggccaaaggaagca

SEQ ID NO: 2936618 - RNA, 17 nt, Human
ggcauuuguuugaacug

SEQ ID NO: 2936619 - RNA, 13 nt, Human
ggccaaaggaagc

SEQ ID NO: 2936620 - RNA, 17 nt, Human
ggccagagggagugaca

SEQ ID NO: 2936621 - RNA, 19 nt, Human
ggccagagggagugacaga

SEQ ID NO: 2936622 - RNA, 18 nt, Human
ggccagagacacaagccu

SEQ ID NO: 2936623 - RNA, 17 nt, Human
ggccagagacacaagcc

SEQ ID NO: 2936624 - RNA, 20 nt, Human
gguuuguaaauuaacuuuua

SEQ ID NO: 2936625 - RNA, 17 nt, Human
gguuuucacauuggaaa

SEQ ID NO: 2936626 - RNA, 19 nt, Human
gguuuuauuguuuaaaauc

SEQ ID NO: 2936627 - RNA, 22 nt, Human
gguuucuaaagcugccagccga

SEQ ID NO: 2936628 - RNA, 16 nt, Human
gguuucuaaagcugcc

SEQ ID NO: 2936629 - RNA, 15 nt, Human
gguuucagaaaugug

SEQ ID NO: 2936630 - RNA, 14 nt, Human
aaaguguauuuuuu

SEQ ID NO: 2936631 - RNA, 21 nt, Human
aaaguguauuuuuuuacuaau

SEQ ID NO: 2936632 - RNA, 22 nt, Human
aaaguagaucaugcauagagug

SEQ ID NO: 2936633 - RNA, 21 nt, Human
aaaguaucccuacuguaauuu

SEQ ID NO: 2936634 - RNA, 20 nt, Human
aaaguagaagucuuagaugu

SEQ ID NO: 2936635 - RNA, 22 nt, Human
aaaguagaagucuuagauguau

SEQ ID NO: 2936636 - RNA, 14 nt, Human
aaaguaauuuggaa

SEQ ID NO: 2936637 - RNA, 22 nt, Human
aaaguaauuuggaaauuagguu

SEQ ID NO: 2936638 - RNA, 18 nt, Human
aaaguacacuguuucaaa

SEQ ID NO: 2936639 - RNA, 19 nt, Human
aaaguacacuguuucaaac

SEQ ID NO: 2936640 - RNA, 23 nt, Human
gguucccuuugacgccaucccag

SEQ ID NO: 2936641 - RNA, 22 nt, Human
gguucccuuuuuuggcugcuga

SEQ ID NO: 2936642 - RNA, 17 nt, Human
gguucccauuugcuccu

SEQ ID NO: 2936643 - RNA, 19 nt, Human
gguguuuccuggcacugcu

SEQ ID NO: 2936644 - RNA, 17 nt, Human
gguguuuccuggcacug

SEQ ID NO: 2936645 - RNA, 13 nt, Human
ggugggggccucg

SEQ ID NO: 2936646 - RNA, 12 nt, Human
gguguggagaag

SEQ ID NO: 2936647 - RNA, 23 nt, Human
gguguggagaagcggcuggcagc

SEQ ID NO: 2936648 - RNA, 14 nt, Human
gguguggagaagcg

SEQ ID NO: 2936649 - RNA, 13 nt, Human
ggugugggggaag

SEQ ID NO: 2936650 - RNA, 11 nt, Human
gguguggggga

SEQ ID NO: 2936651 - RNA, 20 nt, Human
aaagggauggcaagaugugg

SEQ ID NO: 2936652 - RNA, 20 nt, Human
aaagggcccagagagggugg

SEQ ID NO: 2936653 - RNA, 21 nt, Human
aaagggguaggguuuaaagau

SEQ ID NO: 2936654 - RNA, 20 nt, Human
aaagggcuguuauaaucuuu

SEQ ID NO: 2936655 - RNA, 22 nt, Human
aaagggcuguuauaaucuuuca

SEQ ID NO: 2936656 - RNA, 19 nt, Human
gguggggaccucaggccug

SEQ ID NO: 2936657 - RNA, 16 nt, Human
ggugggacacccugug

SEQ ID NO: 2936658 - RNA, 13 nt, Human
ggugggacacccu

SEQ ID NO: 2936659 - RNA, 17 nt, Human
ggugggacacccuguga

SEQ ID NO: 2936660 - RNA, 20 nt, Human
ggugggaggaucucuugagc

SEQ ID NO: 2936661 - RNA, 18 nt, Human
gguggcuggguuggaggg

SEQ ID NO: 2936662 - RNA, 12 nt, Human
gguggcuggguu

SEQ ID NO: 2936663 - RNA, 16 nt, Human
aaagcagaacagugau

SEQ ID NO: 2936664 - RNA, 20 nt, Human
gguggcaccagcagccugga

SEQ ID NO: 2936665 - RNA, 14 nt, Human
gguggcaccagcag

SEQ ID NO: 2936666 - RNA, 21 nt, Human
ggugcugccauccagguucag

SEQ ID NO: 2936667 - RNA, 12 nt, Human
aaacuuuaugcu

SEQ ID NO: 2936668 - RNA, 19 nt, Human
aaacuuuaugcuaagugaa

SEQ ID NO: 2936669 - RNA, 14 nt, Human
aaagcuaggccugg

SEQ ID NO: 2936670 - RNA, 16 nt, Human
aaagcuaggccuggcc

SEQ ID NO: 2936671 - RNA, 13 nt, Human
aaagcagugcaug

SEQ ID NO: 2936672 - RNA, 13 nt, Human
aaagcugccagcc

SEQ ID NO: 2936673 - RNA, 12 nt, Human
aaagcugccagc

SEQ ID NO: 2936674 - RNA, 22 nt, Human
aaagcugccagccgagauagcc

SEQ ID NO: 2936675 - RNA, 13 nt, Human
guaauaaacucau

SEQ ID NO: 2936676 - RNA, 23 nt, Human
guaauccuagcacuuugggaggc

SEQ ID NO: 2936677 - RNA, 15 nt, Human
guaauuugugauaca

SEQ ID NO: 2936678 - RNA, 17 nt, Human
guaauuugugauacaau

SEQ ID NO: 2936679 - RNA, 20 nt, Human
guaauuugugauacaaugcu

SEQ ID NO: 2936680 - RNA, 21 nt, Human
guaauuuuuuuaucgucacug

SEQ ID NO: 2936681 - RNA, 17 nt, Human
aaauaauuagguauuuu

SEQ ID NO: 2936682 - RNA, 13 nt, Human
guaaacacaucua

SEQ ID NO: 2936683 - RNA, 14 nt, Human
aaauaaugugaaac

SEQ ID NO: 2936684 - RNA, 22 nt, Human
aaauaaugugaaacuggauuaa

SEQ ID NO: 2936685 - RNA, 22 nt, Human
aaaguguauuuuuuuacuaaua

SEQ ID NO: 2936686 - RNA, 17 nt, Human
guaacauagcugugauu

SEQ ID NO: 2936687 - RNA, 20 nt, Human
guaacaggaaaauuuuaaaa

SEQ ID NO: 2936688 - RNA, 19 nt, Human
guaacaggaaaauuuuaaa

SEQ ID NO: 2936689 - RNA, 16 nt, Human
guaacaagccacccca

SEQ ID NO: 2936690 - RNA, 21 nt, Human
aaauauugguugggaugacuu

SEQ ID NO: 2936691 - RNA, 23 nt, Human
aaaucagccugcuccagcuguuc

SEQ ID NO: 2936692 - RNA, 21 nt, Human
aaaucagccugcuccagcugu

SEQ ID NO: 2936693 - RNA, 19 nt, Human
aaaucagccugcuccagcu

SEQ ID NO: 2936694 - RNA, 14 nt, Human
aaauauguuucaca

SEQ ID NO: 2936695 - RNA, 22 nt, Human
aaauauguuucacacaaacaag

SEQ ID NO: 2936696 - RNA, 17 nt, Human
aaauaugcaaagcacug

SEQ ID NO: 2936697 - RNA, 16 nt, Human
aaauaugcaaagcacu

SEQ ID NO: 2936698 - RNA, 15 nt, Human
aaauaugcaaagcac

SEQ ID NO: 2936699 - RNA, 13 nt, Human
aaauaugcaaagc

SEQ ID NO: 2936700 - RNA, 12 nt, Human
aaauaucugaaa

SEQ ID NO: 2936701 - RNA, 14 nt, Human
aaauaucugaaaau

SEQ ID NO: 2936702 - RNA, 17 nt, Human
aaauaucugaaaaugua

SEQ ID NO: 2936703 - RNA, 18 nt, Human
aaauaucugaaaauguau

SEQ ID NO: 2936704 - RNA, 19 nt, Human
aaauaucugaaaauguaug

SEQ ID NO: 2936705 - RNA, 21 nt, Human
aaauaucugaaaauguaugug

SEQ ID NO: 2936706 - RNA, 22 nt, Human
aaauaucugaaaauguaugugu

SEQ ID NO: 2936707 - RNA, 23 nt, Human
aaauaucugaaaauguaugugua

SEQ ID NO: 2936708 - RNA, 15 nt, Human
aaauauaggaacuua

SEQ ID NO: 2936709 - RNA, 20 nt, Human
aaauacgugggcauucaaau

SEQ ID NO: 2936710 - RNA, 21 nt, Human
aaauacgugggcauucaaaug

SEQ ID NO: 2936711 - RNA, 16 nt, Human
guacacacacauacac

SEQ ID NO: 2936712 - RNA, 19 nt, Human
aaauaccagccaguaaaug

SEQ ID NO: 2936713 - RNA, 21 nt, Human
aaauaccaugccauuuaaagc

SEQ ID NO: 2936714 - RNA, 20 nt, Human
aaauaccagccaguaaaugg

SEQ ID NO: 2936715 - RNA, 21 nt, Human
aaauaccagccaguaaauggg

SEQ ID NO: 2936716 - RNA, 18 nt, Human
aaauauaugcuaagucuu

SEQ ID NO: 2936717 - RNA, 23 nt, Human
aaauaucccuuggacauuuuaug

SEQ ID NO: 2936718 - RNA, 22 nt, Human
aaauaucccuuggacauuuuau

SEQ ID NO: 2936719 - RNA, 22 nt, Human
aaauaucacuugucaauaaaau

SEQ ID NO: 2936720 - RNA, 18 nt, Human
gguaacuagggaagauaa

SEQ ID NO: 2936721 - RNA, 23 nt, Human
ggguuuugccauguuggccaggc

SEQ ID NO: 2936722 - RNA, 20 nt, Human
ggguuuugccauguuggcca

SEQ ID NO: 2936723 - RNA, 20 nt, Human
ggguuuuauuguuuaaaauc

SEQ ID NO: 2936724 - RNA, 21 nt, Human
aaacguggcugcuucaaggau

SEQ ID NO: 2936725 - RNA, 20 nt, Human
aaacguggcugcuucaagga

SEQ ID NO: 2936726 - RNA, 19 nt, Human
aaacuguuaauaguucagg

SEQ ID NO: 2936727 - RNA, 18 nt, Human
gggugggacacccuguga

SEQ ID NO: 2936728 - RNA, 15 nt, Human
gggugggacacccug

SEQ ID NO: 2936729 - RNA, 19 nt, Human
aaacuuaaucuaaauggaa

SEQ ID NO: 2936730 - RNA, 20 nt, Human
gguaggguaagugagagagg

SEQ ID NO: 2936731 - RNA, 16 nt, Human
gguauagauguugcua

SEQ ID NO: 2936732 - RNA, 14 nt, Human
gguaucaggugcug

SEQ ID NO: 2936733 - RNA, 20 nt, Human
gguaaggaauaccugucccc

SEQ ID NO: 2936734 - RNA, 18 nt, Human
aaacuuuacuauggcccu

SEQ ID NO: 2936735 - RNA, 22 nt, Human
aaacuugauguguuaucucuua

SEQ ID NO: 2936736 - RNA, 19 nt, Human
gguaucaggugcugccauc

SEQ ID NO: 2936737 - RNA, 14 nt, Human
ggucagugcaaaua

SEQ ID NO: 2936738 - RNA, 22 nt, Human
aaaccugugucucugagaguag

SEQ ID NO: 2936739 - RNA, 15 nt, Human
aaacauuucauuucc

SEQ ID NO: 2936740 - RNA, 19 nt, Human
aaacauuuugucauauaag

SEQ ID NO: 2936741 - RNA, 20 nt, Human
gggucacucuggcagcucag

SEQ ID NO: 2936742 - RNA, 14 nt, Human
gggucacucuggca

SEQ ID NO: 2936743 - RNA, 13 nt, Human
ggggaccagagcu

SEQ ID NO: 2936744 - RNA, 12 nt, Human
ggggaccagagc

SEQ ID NO: 2936745 - RNA, 18 nt, Human
aaaauguauguguaagua

SEQ ID NO: 2936746 - RNA, 14 nt, Human
ggggaccagagcug

SEQ ID NO: 2936747 - RNA, 19 nt, Human
ggggccaguuggucccccu

SEQ ID NO: 2936748 - RNA, 17 nt, Human
gggggaucacagccucu

SEQ ID NO: 2936749 - RNA, 21 nt, Human
gggggcagugcucacccacac

SEQ ID NO: 2936750 - RNA, 14 nt, Human
gggggcugcuccca

SEQ ID NO: 2936751 - RNA, 11 nt, Human
gggggcuggga

SEQ ID NO: 2936752 - RNA, 21 nt, Human
ggggucacucuggcagcucag

SEQ ID NO: 2936753 - RNA, 16 nt, Human
gggguaaggugcaucu

SEQ ID NO: 2936754 - RNA, 13 nt, Human
ggggguggccucc

SEQ ID NO: 2936755 - RNA, 15 nt, Human
gggggcugggcagag

SEQ ID NO: 2936756 - RNA, 17 nt, Human
gggccaugucagacaca

SEQ ID NO: 2936757 - RNA, 14 nt, Human
gggccaggagccuc

SEQ ID NO: 2936758 - RNA, 13 nt, Human
gggccaggagccu

SEQ ID NO: 2936759 - RNA, 12 nt, Human
gggccaggagcc

SEQ ID NO: 2936760 - RNA, 15 nt, Human
gggcgugguggcagg

SEQ ID NO: 2936761 - RNA, 21 nt, Human
gggcggugagaggggaacaga

SEQ ID NO: 2936762 - RNA, 13 nt, Human
gggccucagugcc

SEQ ID NO: 2936763 - RNA, 14 nt, Human
gggccucagugcca

SEQ ID NO: 2936764 - RNA, 15 nt, Human
gggccucagugccac

SEQ ID NO: 2936765 - RNA, 18 nt, Human
gggccucuuaugggcugg

SEQ ID NO: 2936766 - RNA, 21 nt, Human
gggccucugcggagcacacug

SEQ ID NO: 2936767 - RNA, 23 nt, Human
gggccucugcggagcacacuggc

SEQ ID NO: 2936768 - RNA, 22 nt, Human
gggccucgguguggagaagcgg

SEQ ID NO: 2936769 - RNA, 15 nt, Human
gggcucccagccagg

SEQ ID NO: 2936770 - RNA, 17 nt, Human
gggcucccagccaggcc

SEQ ID NO: 2936771 - RNA, 19 nt, Human
gggcucccagccaggcccu

SEQ ID NO: 2936772 - RNA, 19 nt, Human
gggcugcaccggcuggccu

SEQ ID NO: 2936773 - RNA, 17 nt, Human
gggcugcaccggcuggc

SEQ ID NO: 2936774 - RNA, 21 nt, Human
gggcucagcggggacagcucc

SEQ ID NO: 2936775 - RNA, 13 nt, Human
gggcuccagacac

SEQ ID NO: 2936776 - RNA, 10 nt, Human
gggcuccaga

SEQ ID NO: 2936777 - RNA, 22 nt, Human
gggcucagcaaaagaugcuucu

SEQ ID NO: 2936778 - RNA, 15 nt, Human
gggcuaguugggcuu

SEQ ID NO: 2936779 - RNA, 17 nt, Human
gggcucagcggggacag

SEQ ID NO: 2936780 - RNA, 19 nt, Human
gggcucagcggggacagcu

SEQ ID NO: 2936781 - RNA, 13 nt, Human
gggcugcucccac

SEQ ID NO: 2936782 - RNA, 21 nt, Human
gggcugcaccggcuggccugg

SEQ ID NO: 2936783 - RNA, 20 nt, Human
gggcugcaccggcuggccug

SEQ ID NO: 2936784 - RNA, 18 nt, Human
gggcugcucccaccuggc

SEQ ID NO: 2936785 - RNA, 21 nt, Human
gggcugcucccaccuggcucu

SEQ ID NO: 2936786 - RNA, 22 nt, Human
gggcugcucccaccuggcucug

SEQ ID NO: 2936787 - RNA, 23 nt, Human
gggcugcucccaccuggcucugu

SEQ ID NO: 2936788 - RNA, 15 nt, Human
gggcugggcagagga

SEQ ID NO: 2936789 - RNA, 12 nt, Human
gggcugggcaga

SEQ ID NO: 2936790 - RNA, 16 nt, Human
aaaauggguuuuacug

SEQ ID NO: 2936791 - RNA, 17 nt, Human
gggcuggguucuaccca

SEQ ID NO: 2936792 - RNA, 22 nt, Human
gggcugggccucggaccccacu

SEQ ID NO: 2936793 - RNA, 20 nt, Human
aaaaugguguuuuaucuucu

SEQ ID NO: 2936794 - RNA, 22 nt, Human
aaaaugguagcauuuuaaacaa

SEQ ID NO: 2936795 - RNA, 16 nt, Human
aaaaugguuuaaaugg

SEQ ID NO: 2936796 - RNA, 18 nt, Human
aaaaugguuuaaaugguc

SEQ ID NO: 2936797 - RNA, 20 nt, Human
aaaauggaagacagcucuua

SEQ ID NO: 2936798 - RNA, 17 nt, Human
aaaauagaauugacauu

SEQ ID NO: 2936799 - RNA, 13 nt, Human
aaaauagaaaguu

SEQ ID NO: 2936800 - RNA, 17 nt, Human
aaaaucucaauauuuca

SEQ ID NO: 2936801 - RNA, 16 nt, Human
aaaauauuuuccugcc

SEQ ID NO: 2936802 - RNA, 11 nt, Human
aaaaggcagga

SEQ ID NO: 2936803 - RNA, 17 nt, Human
aaaagguuaauaaagua

SEQ ID NO: 2936804 - RNA, 16 nt, Human
aaaagguuaauaaagu

SEQ ID NO: 2936805 - RNA, 22 nt, Human
aaaaggagccaauuuaaagaaa

SEQ ID NO: 2936806 - RNA, 13 nt, Human
aaaaggaugcaca

SEQ ID NO: 2936807 - RNA, 14 nt, Human
aaaaggaugcacag

SEQ ID NO: 2936808 - RNA, 15 nt, Human
aaaaggaugcacaga

SEQ ID NO: 2936809 - RNA, 19 nt, Human
aaaaggaugcacagaguug

SEQ ID NO: 2936810 - RNA, 22 nt, Human
aaaaggaugcacagaguuguua

SEQ ID NO: 2936811 - RNA, 13 nt, Human
aaaauaagucuga

SEQ ID NO: 2936812 - RNA, 19 nt, Human
aaaauaauuagguauuuuc

SEQ ID NO: 2936813 - RNA, 14 nt, Human
aaaauaaucucuga

SEQ ID NO: 2936814 - RNA, 11 nt, Human
aaaauaauuuu

SEQ ID NO: 2936815 - RNA, 13 nt, Human
aaaauaccaagga

SEQ ID NO: 2936816 - RNA, 14 nt, Human
aaaauacacacuca

SEQ ID NO: 2936817 - RNA, 16 nt, Human
aaaauaauuuuuauau

SEQ ID NO: 2936818 - RNA, 17 nt, Human
aaaauaauuuuuauauu

SEQ ID NO: 2936819 - RNA, 16 nt, Human
gcggccuuuggcuuca

SEQ ID NO: 2936820 - RNA, 15 nt, Human
gcggcuggcagccca

SEQ ID NO: 2936821 - RNA, 21 nt, Human
gcgcagcauauucaggaagcu

SEQ ID NO: 2936822 - RNA, 20 nt, Human
gcgcagcauauucaggaagc

SEQ ID NO: 2936823 - RNA, 23 nt, Human
gcgauucuucugcuucagccucc

SEQ ID NO: 2936824 - RNA, 23 nt, Human
gccuugaccauucuccaccugcc

SEQ ID NO: 2936825 - RNA, 22 nt, Human
gcgauucuucugcuucagccuc

SEQ ID NO: 2936826 - RNA, 17 nt, Human
gcgauucuucugcuuca

SEQ ID NO: 2936827 - RNA, 23 nt, Human
gccuugaacuuugaccucugcag

SEQ ID NO: 2936828 - RNA, 22 nt, Human
gccuugaccauucuccaccugc

SEQ ID NO: 2936829 - RNA, 21 nt, Human
gccuugaccauucuccaccug

SEQ ID NO: 2936830 - RNA, 16 nt, Human
gccuugaccauucucc

SEQ ID NO: 2936831 - RNA, 18 nt, Human
gccugggcaacagagcaa

SEQ ID NO: 2936832 - RNA, 20 nt, Human
gccugggcaacagagcaaga

SEQ ID NO: 2936833 - RNA, 21 nt, Human
gccugggcaacagagcaagac

SEQ ID NO: 2936834 - RNA, 11 nt, Human
gccugggcaga

SEQ ID NO: 2936835 - RNA, 21 nt, Human
gccugggaucccucauccuca

SEQ ID NO: 2936836 - RNA, 23 nt, Human
gccugggaucccucauccucaua

SEQ ID NO: 2936837 - RNA, 19 nt, Human
gccugugccucugggacug

SEQ ID NO: 2936838 - RNA, 14 nt, Human
gccuugaacuuuga

SEQ ID NO: 2936839 - RNA, 15 nt, Human
gccuguucagcucca

SEQ ID NO: 2936840 - RNA, 14 nt, Human
gccuguucagcucc

SEQ ID NO: 2936841 - RNA, 16 nt, Human
gccuguucagcuccag

SEQ ID NO: 2936842 - RNA, 17 nt, Human
gccuguucagcuccagc

SEQ ID NO: 2936843 - RNA, 15 nt, Human
gccuucucugaagga

SEQ ID NO: 2936844 - RNA, 16 nt, Human
gccuucucugaaggac

SEQ ID NO: 2936845 - RNA, 23 nt, Human
gccuucggccuccauccugaggc

SEQ ID NO: 2936846 - RNA, 20 nt, Human
gcucagggccuggcucaggu

SEQ ID NO: 2936847 - RNA, 17 nt, Human
gcucagggccuggcuca

SEQ ID NO: 2936848 - RNA, 13 nt, Human
gcucaggaguuug

SEQ ID NO: 2936849 - RNA, 19 nt, Human
gcucagggccuggcucagg

SEQ ID NO: 2936850 - RNA, 18 nt, Human
gcucagggccuggcucag

SEQ ID NO: 2936851 - RNA, 18 nt, Human
gcuaagugauccucccac

SEQ ID NO: 2936852 - RNA, 22 nt, Human
gcuaagugauccucccaccuca

SEQ ID NO: 2936853 - RNA, 20 nt, Human
gcuaggaccccuccaugugg

SEQ ID NO: 2936854 - RNA, 22 nt, Human
gcuaggugacauauacauacuu

SEQ ID NO: 2936855 - RNA, 14 nt, Human
gcuaguugggcuuc

SEQ ID NO: 2936856 - RNA, 16 nt, Human
gcuaguugggcuuccu

SEQ ID NO: 2936857 - RNA, 17 nt, Human
gccccuggcagccccug

SEQ ID NO: 2936858 - RNA, 16 nt, Human
gccccuggcagccccu

SEQ ID NO: 2936859 - RNA, 15 nt, Human
gcccugcccaccugg

SEQ ID NO: 2936860 - RNA, 14 nt, Human
gcccugcccaccug

SEQ ID NO: 2936861 - RNA, 23 nt, Human
gcccuuaccugccaggaagccag

SEQ ID NO: 2936862 - RNA, 22 nt, Human
gcccuuaccugccaggaagcca

SEQ ID NO: 2936863 - RNA, 21 nt, Human
gcccuuaccugccaggaagcc

SEQ ID NO: 2936864 - RNA, 17 nt, Human
gcccugugggcccccaa

SEQ ID NO: 2936865 - RNA, 16 nt, Human
gcccugugggccccca

SEQ ID NO: 2936866 - RNA, 16 nt, Human
gccuacaggagugagc

SEQ ID NO: 2936867 - RNA, 12 nt, Human
gccuagcauacg

SEQ ID NO: 2936868 - RNA, 19 nt, Human
gccuagcauacguacacau

SEQ ID NO: 2936869 - RNA, 17 nt, Human
gccuacaggagugagca

SEQ ID NO: 2936870 - RNA, 22 nt, Human
gccucauguccacugguucuuc

SEQ ID NO: 2936871 - RNA, 12 nt, Human
gccuccauccug

SEQ ID NO: 2936872 - RNA, 14 nt, Human
gccucugggacugg

SEQ ID NO: 2936873 - RNA, 16 nt, Human
gccucgaacuggcugc

SEQ ID NO: 2936874 - RNA, 13 nt, Human
gccucgaacuggc

SEQ ID NO: 2936875 - RNA, 22 nt, Human
gccuccuuugugaggaagccgc

SEQ ID NO: 2936876 - RNA, 13 nt, Human
gccuccauccuga

SEQ ID NO: 2936877 - RNA, 14 nt, Human
gccuccauccugag

SEQ ID NO: 2936878 - RNA, 11 nt, Human
gccccaaaagg

SEQ ID NO: 2936879 - RNA, 21 nt, Human
gccccaaaacucuccucugcu

SEQ ID NO: 2936880 - RNA, 20 nt, Human
gccccaaaacucuccucugc

SEQ ID NO: 2936881 - RNA, 16 nt, Human
gccccaccagugccuc

SEQ ID NO: 2936882 - RNA, 17 nt, Human
gccccaccagugccucu

SEQ ID NO: 2936883 - RNA, 18 nt, Human
gccccaccagugccucuc

SEQ ID NO: 2936884 - RNA, 22 nt, Human
gccccaccagugccucucccug

SEQ ID NO: 2936885 - RNA, 13 nt, Human
gccccaccagugc

SEQ ID NO: 2936886 - RNA, 14 nt, Human
gccccaccagugcc

SEQ ID NO: 2936887 - RNA, 15 nt, Human
gccccaccagugccu

SEQ ID NO: 2936888 - RNA, 18 nt, Human
gccccacagccccaucug

SEQ ID NO: 2936889 - RNA, 12 nt, Human
gccccugcuggu

SEQ ID NO: 2936890 - RNA, 15 nt, Human
gccccugcugguuca

SEQ ID NO: 2936891 - RNA, 16 nt, Human
gccccugcugguucag

SEQ ID NO: 2936892 - RNA, 15 nt, Human
gccccuggcagcccc

SEQ ID NO: 2936893 - RNA, 12 nt, Human
gccccuggcagc

SEQ ID NO: 2936894 - RNA, 18 nt, Human
gcccaggccccugccacc

SEQ ID NO: 2936895 - RNA, 22 nt, Human
gcccaggccccugccacccugg

SEQ ID NO: 2936896 - RNA, 20 nt, Human
gcccaggccccugccacccu

SEQ ID NO: 2936897 - RNA, 21 nt, Human
gcccaggccccugccacccug

SEQ ID NO: 2936898 - RNA, 11 nt, Human
gcccaggcccc

SEQ ID NO: 2936899 - RNA, 12 nt, Human
gcccaggccccu

SEQ ID NO: 2936900 - RNA, 11 nt, Human
gcccaggcagg

SEQ ID NO: 2936901 - RNA, 20 nt, Human
gcccaggaguuuggccagaa

SEQ ID NO: 2936902 - RNA, 19 nt, Human
gcccaggaguuuggccaga

SEQ ID NO: 2936903 - RNA, 23 nt, Human
gcccacgcuggagugcagugagc

SEQ ID NO: 2936904 - RNA, 19 nt, Human
gcccacgcuggagugcagu

SEQ ID NO: 2936905 - RNA, 21 nt, Human
gcccacgcuggagugcaguga

SEQ ID NO: 2936906 - RNA, 13 nt, Human
gcccacuucugcc

SEQ ID NO: 2936907 - RNA, 23 nt, Human
gcccaggaaaggcuccaggagca

SEQ ID NO: 2936908 - RNA, 22 nt, Human
gcccaggaaaggcuccaggagc

SEQ ID NO: 2936909 - RNA, 24 nt, Human
gcccaggaaaggcuccaggagcag

SEQ ID NO: 2936910 - RNA, 21 nt, Human
gcccacgcccccacuggugac

SEQ ID NO: 2936911 - RNA, 17 nt, Human
gcccacgcccccacugg

SEQ ID NO: 2936912 - RNA, 16 nt, Human
gcccacgcccccacug

SEQ ID NO: 2936913 - RNA, 15 nt, Human
gcccacgcccccacu

SEQ ID NO: 2936914 - RNA, 18 nt, Human
gcauuuacuuuguguuca

SEQ ID NO: 2936915 - RNA, 12 nt, Human
gcauuuagaugu

SEQ ID NO: 2936916 - RNA, 19 nt, Human
gcauuuaggccaugggaca

SEQ ID NO: 2936917 - RNA, 13 nt, Human
gcauuuagaugua

SEQ ID NO: 2936918 - RNA, 16 nt, Human
gcugagauccuggacu

SEQ ID NO: 2936919 - RNA, 14 nt, Human
gcugagauccugga

SEQ ID NO: 2936920 - RNA, 22 nt, Human
gcugagauccuggacugagggg

SEQ ID NO: 2936921 - RNA, 16 nt, Human
gcugaggcaggagacu

SEQ ID NO: 2936922 - RNA, 21 nt, Human
gcugaggcaggagacuggcgu

SEQ ID NO: 2936923 - RNA, 14 nt, Human
gcugaggcaggaga

SEQ ID NO: 2936924 - RNA, 13 nt, Human
gcugaggcaggag

SEQ ID NO: 2936925 - RNA, 14 nt, Human
gcugaggugggagg

SEQ ID NO: 2936926 - RNA, 23 nt, Human
gcugagggugagugggugaauaa

SEQ ID NO: 2936927 - RNA, 18 nt, Human
gcugagggugagugggug

SEQ ID NO: 2936928 - RNA, 13 nt, Human
gcugcaccggcug

SEQ ID NO: 2936929 - RNA, 19 nt, Human
gcugcacccucaggcaggu

SEQ ID NO: 2936930 - RNA, 18 nt, Human
gcugcacccucaggcagg

SEQ ID NO: 2936931 - RNA, 16 nt, Human
gcugccccugcacagc

SEQ ID NO: 2936932 - RNA, 19 nt, Human
gcugccccuggcagccccu

SEQ ID NO: 2936933 - RNA, 18 nt, Human
gcugccccuggcagcccc

SEQ ID NO: 2936934 - RNA, 20 nt, Human
gcugccccuggcagccccug

SEQ ID NO: 2936935 - RNA, 17 nt, Human
gcugccccuggcagccc

SEQ ID NO: 2936936 - RNA, 21 nt, Human
gcugccugggaucccucaucc

SEQ ID NO: 2936937 - RNA, 17 nt, Human
gcugccuguucagcucc

SEQ ID NO: 2936938 - RNA, 12 nt, Human
gcugccuguuca

SEQ ID NO: 2936939 - RNA, 13 nt, Human
gcugccuguucag

SEQ ID NO: 2936940 - RNA, 20 nt, Human
gcugccugggaucccucauc

SEQ ID NO: 2936941 - RNA, 16 nt, Human
gcugccucucccauca

SEQ ID NO: 2936942 - RNA, 21 nt, Human
gcuggguucuacccaggugcu

SEQ ID NO: 2936943 - RNA, 20 nt, Human
gcuggguucuacccaggugc

SEQ ID NO: 2936944 - RNA, 17 nt, Human
gcuggguucuacccagg

SEQ ID NO: 2936945 - RNA, 18 nt, Human
gcuggguucuacccaggu

SEQ ID NO: 2936946 - RNA, 23 nt, Human
gcugggguggggaccucaggccu

SEQ ID NO: 2936947 - RNA, 22 nt, Human
gcugggguggggaccucaggcc

SEQ ID NO: 2936948 - RNA, 14 nt, Human
gcugggcagguugg

SEQ ID NO: 2936949 - RNA, 17 nt, Human
gcuggcuguuggcuggg

SEQ ID NO: 2936950 - RNA, 20 nt, Human
gcuggcuguuggcugggggc

SEQ ID NO: 2936951 - RNA, 23 nt, Human
gcuggcuguuggcugggggccuc

SEQ ID NO: 2936952 - RNA, 19 nt, Human
gcugggguggggaccucag

SEQ ID NO: 2936953 - RNA, 17 nt, Human
gcugggguggggaccuc

SEQ ID NO: 2936954 - RNA, 14 nt, Human
gcuggcgugcagug

SEQ ID NO: 2936955 - RNA, 15 nt, Human
gcuggcgugcagugg

SEQ ID NO: 2936956 - RNA, 18 nt, Human
gcuggcgugcaguggugc

SEQ ID NO: 2936957 - RNA, 18 nt, Human
gcuggcuguuggcugggg

SEQ ID NO: 2936958 - RNA, 19 nt, Human
gcuggcuguuggcuggggg

SEQ ID NO: 2936959 - RNA, 13 nt, Human
gcugcugaaacaa

SEQ ID NO: 2936960 - RNA, 12 nt, Human
gcugcugaaggc

SEQ ID NO: 2936961 - RNA, 17 nt, Human
gcuguaucccaugagcc

SEQ ID NO: 2936962 - RNA, 21 nt, Human
gcuguauuuuaaaagaaugau

SEQ ID NO: 2936963 - RNA, 20 nt, Human
gcuguauuuuaaaagaauga

SEQ ID NO: 2936964 - RNA, 18 nt, Human
gcuguauuuuaaaagaau

SEQ ID NO: 2936965 - RNA, 13 nt, Human
gcugugcucugga

SEQ ID NO: 2936966 - RNA, 14 nt, Human
gcugugcugcccug

SEQ ID NO: 2936967 - RNA, 15 nt, Human
gcugugcucuggaca

SEQ ID NO: 2936968 - RNA, 16 nt, Human
gcugugcucuggacag

SEQ ID NO: 2936969 - RNA, 14 nt, Human
gcuguuggcugggg

SEQ ID NO: 2936970 - RNA, 16 nt, Human
gcuguuggcugggggc

SEQ ID NO: 2936971 - RNA, 20 nt, Human
gcuguuggcugggggccuca

SEQ ID NO: 2936972 - RNA, 15 nt, Human
gcuguuggcuggggg

SEQ ID NO: 2936973 - RNA, 17 nt, Human
gcugugcugcccugccc

SEQ ID NO: 2936974 - RNA, 16 nt, Human
gcugugcugcccugcc

SEQ ID NO: 2936975 - RNA, 15 nt, Human
gcugugcugcccugc

SEQ ID NO: 2936976 - RNA, 19 nt, Human
gcuugggcuucauccuccu

SEQ ID NO: 2936977 - RNA, 22 nt, Human
gcuuggggaccagagcugccac

SEQ ID NO: 2936978 - RNA, 21 nt, Human
gcuuggggaccagagcugcca

SEQ ID NO: 2936979 - RNA, 20 nt, Human
gcuuggggaccagagcugcc

SEQ ID NO: 2936980 - RNA, 18 nt, Human
gcuuggggaccagagcug

SEQ ID NO: 2936981 - RNA, 17 nt, Human
gcuuggggaccagagcu

SEQ ID NO: 2936982 - RNA, 23 nt, Human
gcuuucuacccagcgagcccugg

SEQ ID NO: 2936983 - RNA, 13 nt, Human
gcuuucuacccag

SEQ ID NO: 2936984 - RNA, 19 nt, Human
gcuuucuacccagcgagcc

SEQ ID NO: 2936985 - RNA, 22 nt, Human
gcuuucuacccagcgagcccug

SEQ ID NO: 2936986 - RNA, 14 nt, Human
gcuuaacuucacau

SEQ ID NO: 2936987 - RNA, 17 nt, Human
gcuuaacuucacauauu

SEQ ID NO: 2936988 - RNA, 16 nt, Human
gcuucuucagagacuc

SEQ ID NO: 2936989 - RNA, 16 nt, Human
gcuuaacuucacauau

SEQ ID NO: 2936990 - RNA, 16 nt, Human
gcuuggggaccagagc

SEQ ID NO: 2936991 - RNA, 23 nt, Human
gcuugggcuucauccuccucaga

SEQ ID NO: 2936992 - RNA, 19 nt, Human
gcuugaccgugaggccaga

SEQ ID NO: 2936993 - RNA, 18 nt, Human
gcuugaccgugaggccag

SEQ ID NO: 2936994 - RNA, 17 nt, Human
gcuugaccgugaggcca

SEQ ID NO: 2936995 - RNA, 23 nt, Human
gcuucuucagagacuccugcagg

SEQ ID NO: 2936996 - RNA, 16 nt, Human
gcuugaccgugaggcc

SEQ ID NO: 2936997 - RNA, 21 nt, Human
gcuucuucagagacuccugca

SEQ ID NO: 2936998 - RNA, 19 nt, Human
gcuucuucagagacuccug

SEQ ID NO: 2936999 - RNA, 13 nt, Human
gcuuuugcauauu

SEQ ID NO: 2937000 - RNA, 17 nt, Human
ggaaaggaaugcaaaga

SEQ ID NO: 2937001 - RNA, 24 nt, Human
ggaaaggaagugggacuggcacua

SEQ ID NO: 2937002 - RNA, 13 nt, Human
ggaaaggaaugca

SEQ ID NO: 2937003 - RNA, 14 nt, Human
ggaaagaggcucug

SEQ ID NO: 2937004 - RNA, 20 nt, Human
ggaaagacuuuuccaacccu

SEQ ID NO: 2937005 - RNA, 17 nt, Human
ggaaagaguaggaagac

SEQ ID NO: 2937006 - RNA, 16 nt, Human
ggaaagaguaggaaga

SEQ ID NO: 2937007 - RNA, 19 nt, Human
ggaaagcaaaggagauugg

SEQ ID NO: 2937008 - RNA, 17 nt, Human
ggaaacagaugaaaagc

SEQ ID NO: 2937009 - RNA, 20 nt, Human
ggaaacagcuaaugggacac

SEQ ID NO: 2937010 - RNA, 15 nt, Human
ggaaacccagcucug

SEQ ID NO: 2937011 - RNA, 13 nt, Human
ggaaacugccagc

SEQ ID NO: 2937012 - RNA, 15 nt, Human
gcuuuuuaauauuga

SEQ ID NO: 2937013 - RNA, 13 nt, Human
gcuuuugugcauu

SEQ ID NO: 2937014 - RNA, 19 nt, Human
gcuuuugugcauuaucuag

SEQ ID NO: 2937015 - RNA, 16 nt, Human
ggaaaaaauaacaaug

SEQ ID NO: 2937016 - RNA, 19 nt, Human
ggaaaucaggguuaguauu

SEQ ID NO: 2937017 - RNA, 23 nt, Human
ggaaaucaccgaaaacguggcug

SEQ ID NO: 2937018 - RNA, 21 nt, Human
ggaagccagcaggcucucagg

SEQ ID NO: 2937019 - RNA, 23 nt, Human
ggaagccagcaggcucucaggcc

SEQ ID NO: 2937020 - RNA, 22 nt, Human
ggaagccagcaggcucucaggc

SEQ ID NO: 2937021 - RNA, 18 nt, Human
ggaagccgcuggggccag

SEQ ID NO: 2937022 - RNA, 13 nt, Human
ggacauggacaag

SEQ ID NO: 2937023 - RNA, 19 nt, Human
ggacauauauuuuuuaaaa

SEQ ID NO: 2937024 - RNA, 23 nt, Human
ggacacccugugauggggcccug

SEQ ID NO: 2937025 - RNA, 13 nt, Human
ggacacccuguga

SEQ ID NO: 2937026 - RNA, 23 nt, Human
ggacaggcauguucucugaggac

SEQ ID NO: 2937027 - RNA, 17 nt, Human
ggacagggaggugaccc

SEQ ID NO: 2937028 - RNA, 21 nt, Human
ggacagucaccucauggaauu

SEQ ID NO: 2937029 - RNA, 17 nt, Human
ggacagucaccucaugg

SEQ ID NO: 2937030 - RNA, 18 nt, Human
ggacagucaccucaugga

SEQ ID NO: 2937031 - RNA, 19 nt, Human
ggaaugaaugucaguguga

SEQ ID NO: 2937032 - RNA, 20 nt, Human
ggaaugauauaagguuuuuu

SEQ ID NO: 2937033 - RNA, 12 nt, Human
ggacacagcucu

SEQ ID NO: 2937034 - RNA, 13 nt, Human
ggacacagcucuu

SEQ ID NO: 2937035 - RNA, 12 nt, Human
ggacacccugug

SEQ ID NO: 2937036 - RNA, 16 nt, Human
ggaauauauaaccagu

SEQ ID NO: 2937037 - RNA, 19 nt, Human
ggaauacucuuauaucuau

SEQ ID NO: 2937038 - RNA, 19 nt, Human
ggaauaccugucccccuga

SEQ ID NO: 2937039 - RNA, 16 nt, Human
ggaauaccuguccccc

SEQ ID NO: 2937040 - RNA, 15 nt, Human
ggaauaccugucccc

SEQ ID NO: 2937041 - RNA, 21 nt, Human
ggaagcucagggccuggcuca

SEQ ID NO: 2937042 - RNA, 17 nt, Human
ggaagcucagggccugg

SEQ ID NO: 2937043 - RNA, 16 nt, Human
ggaagcucagggccug

SEQ ID NO: 2937044 - RNA, 18 nt, Human
gcauccaguaucuugaag

SEQ ID NO: 2937045 - RNA, 17 nt, Human
gcauccaguaucuugaa

SEQ ID NO: 2937046 - RNA, 14 nt, Human
gcauccaguaucuu

SEQ ID NO: 2937047 - RNA, 13 nt, Human
gcauccuggcacc

SEQ ID NO: 2937048 - RNA, 21 nt, Human
gcauggcugccaaugggagcu

SEQ ID NO: 2937049 - RNA, 16 nt, Human
gcaugguuuggagcug

SEQ ID NO: 2937050 - RNA, 19 nt, Human
gcaugugaugagaggaaau

SEQ ID NO: 2937051 - RNA, 18 nt, Human
gcaugugaugagaggaaa

SEQ ID NO: 2937052 - RNA, 21 nt, Human
gcaugugaugagaggaaauca

SEQ ID NO: 2937053 - RNA, 15 nt, Human
gcauugugggaaggg

SEQ ID NO: 2937054 - RNA, 13 nt, Human
gcauugugggaag

SEQ ID NO: 2937055 - RNA, 15 nt, Human
gcauuuacuuugugu

SEQ ID NO: 2937056 - RNA, 18 nt, Human
gcauuuaaaagauacagu

SEQ ID NO: 2937057 - RNA, 22 nt, Human
gcauuuaaaagauacaguuacu

SEQ ID NO: 2937058 - RNA, 18 nt, Human
gcauugugggaaggggag

SEQ ID NO: 2937059 - RNA, 16 nt, Human
gcauugugggaagggg

SEQ ID NO: 2937060 - RNA, 16 nt, Human
gcauuuaaaagauaca

SEQ ID NO: 2937061 - RNA, 17 nt, Human
gcauuuaaaagauacag

SEQ ID NO: 2937062 - RNA, 15 nt, Human
gcauacguacacauu

SEQ ID NO: 2937063 - RNA, 16 nt, Human
gcauacguacacauuu

SEQ ID NO: 2937064 - RNA, 17 nt, Human
gcauacguacacauuuu

SEQ ID NO: 2937065 - RNA, 13 nt, Human
gcagugaugucac

SEQ ID NO: 2937066 - RNA, 22 nt, Human
gcaguuguugcccacagcugua

SEQ ID NO: 2937067 - RNA, 14 nt, Human
gcagugagacuggg

SEQ ID NO: 2937068 - RNA, 13 nt, Human
gcagugagacugg

SEQ ID NO: 2937069 - RNA, 14 nt, Human
gcagucuucaguuu

SEQ ID NO: 2937070 - RNA, 15 nt, Human
gcagcucuccccuuc

SEQ ID NO: 2937071 - RNA, 18 nt, Human
gcagcccaccccucaaca

SEQ ID NO: 2937072 - RNA, 15 nt, Human
gcagccacauuccug

SEQ ID NO: 2937073 - RNA, 20 nt, Human
gcacucagaagacacugaug

SEQ ID NO: 2937074 - RNA, 17 nt, Human
gcacucagaagacacug

SEQ ID NO: 2937075 - RNA, 18 nt, Human
gcaagugagagcugggug

SEQ ID NO: 2937076 - RNA, 14 nt, Human
gcacuccagccugg

SEQ ID NO: 2937077 - RNA, 14 nt, Human
gcacuccccugcug

SEQ ID NO: 2937078 - RNA, 13 nt, Human
gcacuccccugcu

SEQ ID NO: 2937079 - RNA, 19 nt, Human
gcacuuuguucuggcucuu

SEQ ID NO: 2937080 - RNA, 18 nt, Human
gcacuuuguucuggcucu

SEQ ID NO: 2937081 - RNA, 15 nt, Human
gcacuccccugcugg

SEQ ID NO: 2937082 - RNA, 12 nt, Human
gcacuccccugc

SEQ ID NO: 2937083 - RNA, 22 nt, Human
gcacuuuguucuggcucuucca

SEQ ID NO: 2937084 - RNA, 12 nt, Human
gcagaacaguga

SEQ ID NO: 2937085 - RNA, 13 nt, Human
gcagaacagugau

SEQ ID NO: 2937086 - RNA, 23 nt, Human
gcagcauauucaggaagcucagg

SEQ ID NO: 2937087 - RNA, 19 nt, Human
gcagcauauucaggaagcu

SEQ ID NO: 2937088 - RNA, 18 nt, Human
gcagcauauucaggaagc

SEQ ID NO: 2937089 - RNA, 17 nt, Human
gcagcauauucaggaag

SEQ ID NO: 2937090 - RNA, 14 nt, Human
gcagagggcacaga

SEQ ID NO: 2937091 - RNA, 21 nt, Human
gcagaggaaagcaaaggagau

SEQ ID NO: 2937092 - RNA, 20 nt, Human
gcagaggaaagcaaaggaga

SEQ ID NO: 2937093 - RNA, 18 nt, Human
gcagaggaaagcaaagga

SEQ ID NO: 2937094 - RNA, 14 nt, Human
gcagaggaaagcaa

SEQ ID NO: 2937095 - RNA, 13 nt, Human
gcagaggaaagca

SEQ ID NO: 2937096 - RNA, 18 nt, Human
gcagaacagugauuacca

SEQ ID NO: 2937097 - RNA, 22 nt, Human
gcagaacagugauuaccaggga

SEQ ID NO: 2937098 - RNA, 19 nt, Human
gaucucuugagccugggag

SEQ ID NO: 2937099 - RNA, 18 nt, Human
gaucucuugagccuggga

SEQ ID NO: 2937100 - RNA, 15 nt, Human
gaucucuaacuucac

SEQ ID NO: 2937101 - RNA, 14 nt, Human
gaugauccuaggca

SEQ ID NO: 2937102 - RNA, 13 nt, Human
gaugauccuaggc

SEQ ID NO: 2937103 - RNA, 22 nt, Human
gaugauuggaggggggaggugg

SEQ ID NO: 2937104 - RNA, 23 nt, Human
gaugcuucucacugccaugccag

SEQ ID NO: 2937105 - RNA, 21 nt, Human
gaugcuucuucagagacuccu

SEQ ID NO: 2937106 - RNA, 20 nt, Human
gaugcuucuucagagacucc

SEQ ID NO: 2937107 - RNA, 17 nt, Human
gaugcuucuucagagac

SEQ ID NO: 2937108 - RNA, 16 nt, Human
gauacaguuacucaga

SEQ ID NO: 2937109 - RNA, 19 nt, Human
gauacaguuacucagaauu

SEQ ID NO: 2937110 - RNA, 23 nt, Human
gauacaguuacucagaauucucu

SEQ ID NO: 2937111 - RNA, 12 nt, Human
gauacugaaaua

SEQ ID NO: 2937112 - RNA, 17 nt, Human
gauacuguaucaugaca

SEQ ID NO: 2937113 - RNA, 21 nt, Human
gauacuguaucaugacaaaga

SEQ ID NO: 2937114 - RNA, 12 nt, Human
gauccaagcugg

SEQ ID NO: 2937115 - RNA, 16 nt, Human
gauccaagcugguccc

SEQ ID NO: 2937116 - RNA, 17 nt, Human
gauccaagcugguccca

SEQ ID NO: 2937117 - RNA, 19 nt, Human
gauccaagcuggucccacu

SEQ ID NO: 2937118 - RNA, 22 nt, Human
gauccacccaccucagccuccc

SEQ ID NO: 2937119 - RNA, 20 nt, Human
gauccacccaccucagccuc

SEQ ID NO: 2937120 - RNA, 21 nt, Human
gauccacccaccucagccucc

SEQ ID NO: 2937121 - RNA, 21 nt, Human
gauccaagcuggucccacuca

SEQ ID NO: 2937122 - RNA, 18 nt, Human
gauccacccaccucagcc

SEQ ID NO: 2937123 - RNA, 19 nt, Human
gauccacccaccucagccu

SEQ ID NO: 2937124 - RNA, 23 nt, Human
gaucaaaagguuaauaaaguaau

SEQ ID NO: 2937125 - RNA, 17 nt, Human
gauauuuuuuucuuuuc

SEQ ID NO: 2937126 - RNA, 20 nt, Human
gaucaaaagguuaauaaagu

SEQ ID NO: 2937127 - RNA, 16 nt, Human
gcaagugagagcuggg

SEQ ID NO: 2937128 - RNA, 15 nt, Human
gcaagugagagcugg

SEQ ID NO: 2937129 - RNA, 20 nt, Human
gcaaccuccgccucuugggu

SEQ ID NO: 2937130 - RNA, 14 nt, Human
gcaacccccagccu

SEQ ID NO: 2937131 - RNA, 15 nt, Human
gcaacccccagccug

SEQ ID NO: 2937132 - RNA, 16 nt, Human
gcaacccccagccugc

SEQ ID NO: 2937133 - RNA, 19 nt, Human
gcaaccuccgccucuuggg

SEQ ID NO: 2937134 - RNA, 13 nt, Human
gcaaccaccacca

SEQ ID NO: 2937135 - RNA, 18 nt, Human
gcaaccaccaccaaccac

SEQ ID NO: 2937136 - RNA, 16 nt, Human
gcaaccaccaccaacc

SEQ ID NO: 2937137 - RNA, 16 nt, Human
gcaacaggcugggcuu

SEQ ID NO: 2937138 - RNA, 19 nt, Human
gcaacaggcugggcuucag

SEQ ID NO: 2937139 - RNA, 14 nt, Human
gcaacaggcugggc

SEQ ID NO: 2937140 - RNA, 15 nt, Human
gcaacaggcugggcu

SEQ ID NO: 2937141 - RNA, 13 nt, Human
gcaacaggcuggg

SEQ ID NO: 2937142 - RNA, 12 nt, Human
gauucuucugcu

SEQ ID NO: 2937143 - RNA, 13 nt, Human
gauucuucugcuu

SEQ ID NO: 2937144 - RNA, 15 nt, Human
gauucuucugcuuca

SEQ ID NO: 2937145 - RNA, 14 nt, Human
gauuuaauaugcaa

SEQ ID NO: 2937146 - RNA, 19 nt, Human
gauuuaacagaaauguaca

SEQ ID NO: 2937147 - RNA, 20 nt, Human
gauucuucugcuucagccuc

SEQ ID NO: 2937148 - RNA, 16 nt, Human
gauuuaacagaaaugu

SEQ ID NO: 2937149 - RNA, 17 nt, Human
gauuuaacagaaaugua

SEQ ID NO: 2937150 - RNA, 18 nt, Human
gauuuaacagaaauguac

SEQ ID NO: 2937151 - RNA, 11 nt, Human
gauuucacucu

SEQ ID NO: 2937152 - RNA, 18 nt, Human
gauuuuuuuuuccuucag

SEQ ID NO: 2937153 - RNA, 17 nt, Human
gauuuuuuuuuccuuca

SEQ ID NO: 2937154 - RNA, 12 nt, Human
gauuucacucuc

SEQ ID NO: 2937155 - RNA, 16 nt, Human
gauuuuuuuuuccuuc

SEQ ID NO: 2937156 - RNA, 17 nt, Human
gcaaaagaugcuucuca

SEQ ID NO: 2937157 - RNA, 22 nt, Human
gcaaaagaugcuucucacugcc

SEQ ID NO: 2937158 - RNA, 14 nt, Human
gcaaaaaggcagga

SEQ ID NO: 2937159 - RNA, 21 nt, Human
gauuuuuuuuuccuucagugc

SEQ ID NO: 2937160 - RNA, 22 nt, Human
gagcuguucacagccagacugg

SEQ ID NO: 2937161 - RNA, 13 nt, Human
gagcccugguggc

SEQ ID NO: 2937162 - RNA, 14 nt, Human
gagcccugguggca

SEQ ID NO: 2937163 - RNA, 20 nt, Human
gagcuguucacagccagacu

SEQ ID NO: 2937164 - RNA, 17 nt, Human
gagcuguucacagccag

SEQ ID NO: 2937165 - RNA, 17 nt, Human
gagccccgaggccuucu

SEQ ID NO: 2937166 - RNA, 20 nt, Human
gagccccacagccccaucug

SEQ ID NO: 2937167 - RNA, 17 nt, Human
gagccccacccucagau

SEQ ID NO: 2937168 - RNA, 13 nt, Human
gagccccgaggcc

SEQ ID NO: 2937169 - RNA, 14 nt, Human
gagccccgaggccu

SEQ ID NO: 2937170 - RNA, 16 nt, Human
gagccccacccucaga

SEQ ID NO: 2937171 - RNA, 12 nt, Human
gagccccacagc

SEQ ID NO: 2937172 - RNA, 13 nt, Human
gagccccacagcc

SEQ ID NO: 2937173 - RNA, 14 nt, Human
gagccccacagccc

SEQ ID NO: 2937174 - RNA, 13 nt, Human
gagcaucaggcca

SEQ ID NO: 2937175 - RNA, 16 nt, Human
gagcaucaggccaggc

SEQ ID NO: 2937176 - RNA, 15 nt, Human
gagcaucaggccagg

SEQ ID NO: 2937177 - RNA, 13 nt, Human
gagcaugccugga

SEQ ID NO: 2937178 - RNA, 21 nt, Human
gagcaugccuggauggggcug

SEQ ID NO: 2937179 - RNA, 21 nt, Human
gagcagggcucagcggggaca

SEQ ID NO: 2937180 - RNA, 14 nt, Human
gagcaucaggccag

SEQ ID NO: 2937181 - RNA, 14 nt, Human
gagcagucaggaaa

SEQ ID NO: 2937182 - RNA, 14 nt, Human
gagggccugcaagg

SEQ ID NO: 2937183 - RNA, 21 nt, Human
gagggccugcaagggagugag

SEQ ID NO: 2937184 - RNA, 17 nt, Human
gagggccugcaagggag

SEQ ID NO: 2937185 - RNA, 21 nt, Human
gaggcauuuguuugaacugau

SEQ ID NO: 2937186 - RNA, 15 nt, Human
gaggcuccacuuggu

SEQ ID NO: 2937187 - RNA, 12 nt, Human
gaggcuccacuu

SEQ ID NO: 2937188 - RNA, 21 nt, Human
gaggcaugugaugagaggaaa

SEQ ID NO: 2937189 - RNA, 20 nt, Human
gaggcaugugaugagaggaa

SEQ ID NO: 2937190 - RNA, 22 nt, Human
gaggcaugugaugagaggaaau

SEQ ID NO: 2937191 - RNA, 19 nt, Human
gaggcauuuguuugaacug

SEQ ID NO: 2937192 - RNA, 13 nt, Human
gaggcugaggcag

SEQ ID NO: 2937193 - RNA, 18 nt, Human
gaggcugagaugggagaa

SEQ ID NO: 2937194 - RNA, 17 nt, Human
gaggcuccacuuggucu

SEQ ID NO: 2937195 - RNA, 21 nt, Human
gaggacgcucucuggccuucg

SEQ ID NO: 2937196 - RNA, 20 nt, Human
gaggacgcucucuggccuuc

SEQ ID NO: 2937197 - RNA, 23 nt, Human
gaggacuccaggcagcagacaca

SEQ ID NO: 2937198 - RNA, 18 nt, Human
gaggacuccaggcagcag

SEQ ID NO: 2937199 - RNA, 16 nt, Human
gaggacuuuucuuugu

SEQ ID NO: 2937200 - RNA, 20 nt, Human
gaggacuuuucuuuguggcu

SEQ ID NO: 2937201 - RNA, 23 nt, Human
gaggacuuuucuuuguggcuucc

SEQ ID NO: 2937202 - RNA, 18 nt, Human
gaggcagggucucacucu

SEQ ID NO: 2937203 - RNA, 19 nt, Human
gaggcagggucucacucug

SEQ ID NO: 2937204 - RNA, 20 nt, Human
gaggcagggucucacucugu

SEQ ID NO: 2937205 - RNA, 12 nt, Human
gaggagagagga

SEQ ID NO: 2937206 - RNA, 15 nt, Human
gaggagagaggaccc

SEQ ID NO: 2937207 - RNA, 14 nt, Human
gaggagagaggacc

SEQ ID NO: 2937208 - RNA, 12 nt, Human
gaggagaaacug

SEQ ID NO: 2937209 - RNA, 14 nt, Human
gaggagaaacugga

SEQ ID NO: 2937210 - RNA, 21 nt, Human
gagauugugccccugcacucc

SEQ ID NO: 2937211 - RNA, 14 nt, Human
gagauuggaaggaa

SEQ ID NO: 2937212 - RNA, 21 nt, Human
gagauugcaccacugcacucc

SEQ ID NO: 2937213 - RNA, 20 nt, Human
gagaugcuagaacucccuuu

SEQ ID NO: 2937214 - RNA, 16 nt, Human
gagaugcuagaacucc

SEQ ID NO: 2937215 - RNA, 15 nt, Human
gagaggacccccuga

SEQ ID NO: 2937216 - RNA, 12 nt, Human
gagaggaaauca

SEQ ID NO: 2937217 - RNA, 20 nt, Human
gagagcugggugucaagagg

SEQ ID NO: 2937218 - RNA, 13 nt, Human
gagagcugggugu

SEQ ID NO: 2937219 - RNA, 21 nt, Human
gagagcuagcagcagggaggg

SEQ ID NO: 2937220 - RNA, 15 nt, Human
gagagcuagcagcag

SEQ ID NO: 2937221 - RNA, 20 nt, Human
gagagccuuccagggguggg

SEQ ID NO: 2937222 - RNA, 18 nt, Human
gagagccuuccaggggug

SEQ ID NO: 2937223 - RNA, 15 nt, Human
gagacuccauaguuu

SEQ ID NO: 2937224 - RNA, 16 nt, Human
gagagccuuccagggg

SEQ ID NO: 2937225 - RNA, 15 nt, Human
gagagccuuccaggg

SEQ ID NO: 2937226 - RNA, 14 nt, Human
gagacuccugcagg

SEQ ID NO: 2937227 - RNA, 13 nt, Human
gagacuccugcag

SEQ ID NO: 2937228 - RNA, 14 nt, Human
gacuuuuccaaccc

SEQ ID NO: 2937229 - RNA, 22 nt, Human
gacuuuuuauggcacuaguauu

SEQ ID NO: 2937230 - RNA, 19 nt, Human
gacuuuuccaacccucauc

SEQ ID NO: 2937231 - RNA, 20 nt, Human
gacuuuuccaacccucauca

SEQ ID NO: 2937232 - RNA, 15 nt, Human
gagaaugaaagggcc

SEQ ID NO: 2937233 - RNA, 23 nt, Human
gagaaugaaagggcccagagagg

SEQ ID NO: 2937234 - RNA, 21 nt, Human
gagacccugucucaaaaaaag

SEQ ID NO: 2937235 - RNA, 18 nt, Human
gagaccugcccucaagag

SEQ ID NO: 2937236 - RNA, 18 nt, Human
gagacgggggcagagagg

SEQ ID NO: 2937237 - RNA, 16 nt, Human
gagacggagucccacc

SEQ ID NO: 2937238 - RNA, 19 nt, Human
gagacggagucccaccuug

SEQ ID NO: 2937239 - RNA, 14 nt, Human
gagacggaguccca

SEQ ID NO: 2937240 - RNA, 15 nt, Human
gaauauauaaccagu

SEQ ID NO: 2937241 - RNA, 13 nt, Human
gaauauugccaau

SEQ ID NO: 2937242 - RNA, 11 nt, Human
gaauauugcug

SEQ ID NO: 2937243 - RNA, 13 nt, Human
gaauauugcugau

SEQ ID NO: 2937244 - RNA, 12 nt, Human
gaauauugcuga

SEQ ID NO: 2937245 - RNA, 22 nt, Human
gaauaucuccgucaacucauau

SEQ ID NO: 2937246 - RNA, 24 nt, Human
gaauauugcugauggugcaaugac

SEQ ID NO: 2937247 - RNA, 23 nt, Human
gaauauugcugauggugcaauga

SEQ ID NO: 2937248 - RNA, 22 nt, Human
gaauauugcugauggugcaaug

SEQ ID NO: 2937249 - RNA, 14 nt, Human
gaaugaauggcuaa

SEQ ID NO: 2937250 - RNA, 15 nt, Human
gaaugaauggcuaag

SEQ ID NO: 2937251 - RNA, 20 nt, Human
gaaugaauggcuaagcaaaa

SEQ ID NO: 2937252 - RNA, 14 nt, Human
gaaugauuaugaau

SEQ ID NO: 2937253 - RNA, 14 nt, Human
gaaugauuaauuaa

SEQ ID NO: 2937254 - RNA, 14 nt, Human
gaaugaugccauga

SEQ ID NO: 2937255 - RNA, 20 nt, Human
gaaugaugauccuaggcauu

SEQ ID NO: 2937256 - RNA, 15 nt, Human
gaauguuugccucug

SEQ ID NO: 2937257 - RNA, 19 nt, Human
gaaugcacaaacagaggcc

SEQ ID NO: 2937258 - RNA, 16 nt, Human
gaauguuugccucugc

SEQ ID NO: 2937259 - RNA, 17 nt, Human
gaauguuugccucugcc

SEQ ID NO: 2937260 - RNA, 18 nt, Human
gaaugcacaaacagaggc

SEQ ID NO: 2937261 - RNA, 22 nt, Human
gaaugauuaugaauuacauuug

SEQ ID NO: 2937262 - RNA, 20 nt, Human
gaauuacauuuguauaaaau

SEQ ID NO: 2937263 - RNA, 15 nt, Human
gaauuacauuuguau

SEQ ID NO: 2937264 - RNA, 18 nt, Human
gaauuacauuuguauaaa

SEQ ID NO: 2937265 - RNA, 13 nt, Human
gaauuacauuugu

SEQ ID NO: 2937266 - RNA, 18 nt, Human
gaauguuugccucugccu

SEQ ID NO: 2937267 - RNA, 19 nt, Human
gaauguuugccucugccuc

SEQ ID NO: 2937268 - RNA, 17 nt, Human
gaauguuuucaaauguu

SEQ ID NO: 2937269 - RNA, 14 nt, Human
gaauuaacacauga

SEQ ID NO: 2937270 - RNA, 15 nt, Human
gaauuaacacaugau

SEQ ID NO: 2937271 - RNA, 17 nt, Human
gacacagcucuucucca

SEQ ID NO: 2937272 - RNA, 21 nt, Human
gacacagcucuucuccaggcu

SEQ ID NO: 2937273 - RNA, 15 nt, Human
gacacagauuggcca

SEQ ID NO: 2937274 - RNA, 12 nt, Human
gacacagcucuu

SEQ ID NO: 2937275 - RNA, 19 nt, Human
gacacagcucuucuccagg

SEQ ID NO: 2937276 - RNA, 20 nt, Human
gacacagcucuucuccaggc

SEQ ID NO: 2937277 - RNA, 14 nt, Human
gaauuaugaaacuu

SEQ ID NO: 2937278 - RNA, 19 nt, Human
gacaaacugcauauguacu

SEQ ID NO: 2937279 - RNA, 17 nt, Human
gacccucaugcugccaa

SEQ ID NO: 2937280 - RNA, 16 nt, Human
gacccucaugcugcca

SEQ ID NO: 2937281 - RNA, 14 nt, Human
gacccucaugcugc

SEQ ID NO: 2937282 - RNA, 12 nt, Human
gacccucaugcu

SEQ ID NO: 2937283 - RNA, 19 nt, Human
gaccucaggugauccaccc

SEQ ID NO: 2937284 - RNA, 21 nt, Human
gaccucaggugagaagcagag

SEQ ID NO: 2937285 - RNA, 20 nt, Human
gaccucaggugauccaccca

SEQ ID NO: 2937286 - RNA, 21 nt, Human
gaccucaggugauccacccac

SEQ ID NO: 2937287 - RNA, 19 nt, Human
gaccucaggccugggggcu

SEQ ID NO: 2937288 - RNA, 19 nt, Human
gaccucaggugagaagcag

SEQ ID NO: 2937289 - RNA, 18 nt, Human
gaccucaggugagaagca

SEQ ID NO: 2937290 - RNA, 14 nt, Human
gaccucaggccugg

SEQ ID NO: 2937291 - RNA, 23 nt, Human
gacccucaugcugccaauauccu

SEQ ID NO: 2937292 - RNA, 22 nt, Human
gacccucaugcugccaauaucc

SEQ ID NO: 2937293 - RNA, 21 nt, Human
gacccucaugcugccaauauc

SEQ ID NO: 2937294 - RNA, 18 nt, Human
gacccucaugcugccaau

SEQ ID NO: 2937295 - RNA, 15 nt, Human
gacgcugugcugccc

SEQ ID NO: 2937296 - RNA, 18 nt, Human
gacgcugugcugcccugc

SEQ ID NO: 2937297 - RNA, 17 nt, Human
gacgcugugcugcccug

SEQ ID NO: 2937298 - RNA, 16 nt, Human
gacgcugugcugcccu

SEQ ID NO: 2937299 - RNA, 14 nt, Human
gacgcucucuggcc

SEQ ID NO: 2937300 - RNA, 23 nt, Human
gacgcuacccgggaagggggcug

SEQ ID NO: 2937301 - RNA, 22 nt, Human
gacgcuacccgggaagggggcu

SEQ ID NO: 2937302 - RNA, 21 nt, Human
gacgccaucccagccccaaug

SEQ ID NO: 2937303 - RNA, 19 nt, Human
gacgccaucccagccccaa

SEQ ID NO: 2937304 - RNA, 13 nt, Human
gacgccaucccag

SEQ ID NO: 2937305 - RNA, 12 nt, Human
gacgccauccca

SEQ ID NO: 2937306 - RNA, 16 nt, Human
gaccucugcagcaaua

SEQ ID NO: 2937307 - RNA, 18 nt, Human
gaccucugcagcaauaaa

SEQ ID NO: 2937308 - RNA, 22 nt, Human
gaccucugcagcaauaaagcag

SEQ ID NO: 2937309 - RNA, 20 nt, Human
gacauuuuaugucuuucuug

SEQ ID NO: 2937310 - RNA, 16 nt, Human
gacauuuuaugucuuu

SEQ ID NO: 2937311 - RNA, 17 nt, Human
gacauugcggacagcca

SEQ ID NO: 2937312 - RNA, 23 nt, Human
gacauugcggacagccacggcca

SEQ ID NO: 2937313 - RNA, 20 nt, Human
gacagucccugccaauggac

SEQ ID NO: 2937314 - RNA, 16 nt, Human
gacagucccugccaau

SEQ ID NO: 2937315 - RNA, 15 nt, Human
gacagucccugccaa

SEQ ID NO: 2937316 - RNA, 14 nt, Human
gacagucccugcca

SEQ ID NO: 2937317 - RNA, 12 nt, Human
gacagucccugc

SEQ ID NO: 2937318 - RNA, 18 nt, Human
gacagucaccucauggaa

SEQ ID NO: 2937319 - RNA, 11 nt, Human
gacagcucuua

SEQ ID NO: 2937320 - RNA, 10 nt, Human
gacagcucuu

SEQ ID NO: 2937321 - RNA, 19 nt, Human
gacagcuccuucuguccua

SEQ ID NO: 2937322 - RNA, 12 nt, Human
gacagcucugca

SEQ ID NO: 2937323 - RNA, 16 nt, Human
gacagcuccuucuguc

SEQ ID NO: 2937324 - RNA, 16 nt, Human
gacagcccgggcucug

SEQ ID NO: 2937325 - RNA, 17 nt, Human
gacagcuccuucugucc

SEQ ID NO: 2937326 - RNA, 18 nt, Human
gacagcuccuucuguccu

SEQ ID NO: 2937327 - RNA, 14 nt, Human
gacagcccgggcuc

SEQ ID NO: 2937328 - RNA, 22 nt, Human
cugucuaaugaaaccugugucu

SEQ ID NO: 2937329 - RNA, 23 nt, Human
cugucggagcccugucuccucuc

SEQ ID NO: 2937330 - RNA, 20 nt, Human
cuguccugggagugagcugg

SEQ ID NO: 2937331 - RNA, 13 nt, Human
cuguccugggagu

SEQ ID NO: 2937332 - RNA, 14 nt, Human
cuguccugggagug

SEQ ID NO: 2937333 - RNA, 14 nt, Human
cugucauuugagca

SEQ ID NO: 2937334 - RNA, 15 nt, Human
cuguagagugggagc

SEQ ID NO: 2937335 - RNA, 20 nt, Human
cuguaagaaaauaucacuug

SEQ ID NO: 2937336 - RNA, 18 nt, Human
cuggucuuauuuguaaag

SEQ ID NO: 2937337 - RNA, 22 nt, Human
cuggugacaugucuuuucuugc

SEQ ID NO: 2937338 - RNA, 12 nt, Human
cuguucagcugg

SEQ ID NO: 2937339 - RNA, 16 nt, Human
cuguucagcuccagcu

SEQ ID NO: 2937340 - RNA, 18 nt, Human
cuguucagcuccagcuca

SEQ ID NO: 2937341 - RNA, 19 nt, Human
cuguucagcuccagcucac

SEQ ID NO: 2937342 - RNA, 22 nt, Human
cuguucagcuccagcucaccag

SEQ ID NO: 2937343 - RNA, 14 nt, Human
cuguucagcuccag

SEQ ID NO: 2937344 - RNA, 15 nt, Human
cuguucagcuccagc

SEQ ID NO: 2937345 - RNA, 22 nt, Human
cuguucacagccagacuggcac

SEQ ID NO: 2937346 - RNA, 19 nt, Human
cuguucacagccagacugg

SEQ ID NO: 2937347 - RNA, 12 nt, Human
cuguucacagcc

SEQ ID NO: 2937348 - RNA, 18 nt, Human
cugugcucuggacaggca

SEQ ID NO: 2937349 - RNA, 19 nt, Human
cugugcucuggacaggcau

SEQ ID NO: 2937350 - RNA, 22 nt, Human
cugugucagguggggcagcuug

SEQ ID NO: 2937351 - RNA, 17 nt, Human
cuguuacugucuucagu

SEQ ID NO: 2937352 - RNA, 13 nt, Human
cuguuacugucuu

SEQ ID NO: 2937353 - RNA, 19 nt, Human
cuguuauaaucuuucacag

SEQ ID NO: 2937354 - RNA, 17 nt, Human
cugugcucuggacaggc

SEQ ID NO: 2937355 - RNA, 15 nt, Human
cugugcucuggacag

SEQ ID NO: 2937356 - RNA, 23 nt, Human
cugugagaugcuagaacucccuu

SEQ ID NO: 2937357 - RNA, 21 nt, Human
cugugagaugcuagaacuccc

SEQ ID NO: 2937358 - RNA, 18 nt, Human
cuguugcccaggcuggcg

SEQ ID NO: 2937359 - RNA, 15 nt, Human
cuguuggccagugug

SEQ ID NO: 2937360 - RNA, 12 nt, Human
cuguuggccagu

SEQ ID NO: 2937361 - RNA, 13 nt, Human
cuuaaauaaugug

SEQ ID NO: 2937362 - RNA, 14 nt, Human
cuuaaauaauguga

SEQ ID NO: 2937363 - RNA, 16 nt, Human
cuuaaauaaugugaaa

SEQ ID NO: 2937364 - RNA, 19 nt, Human
cuuaaauaaugugaaacug

SEQ ID NO: 2937365 - RNA, 13 nt, Human
cuuaaaaaugguu

SEQ ID NO: 2937366 - RNA, 20 nt, Human
cuuaaaaaugguuuaaaugg

SEQ ID NO: 2937367 - RNA, 12 nt, Human
cuuaaaaauggu

SEQ ID NO: 2937368 - RNA, 12 nt, Human
cuggcucugugg

SEQ ID NO: 2937369 - RNA, 13 nt, Human
cuggcucuuccag

SEQ ID NO: 2937370 - RNA, 15 nt, Human
cuggcucuuccaggc

SEQ ID NO: 2937371 - RNA, 14 nt, Human
cuggcucuuccagg

SEQ ID NO: 2937372 - RNA, 13 nt, Human
cuggcucuguggc

SEQ ID NO: 2937373 - RNA, 14 nt, Human
cuggcucuguggcg

SEQ ID NO: 2937374 - RNA, 23 nt, Human
cuggcucuguggcgagccauuug

SEQ ID NO: 2937375 - RNA, 16 nt, Human
cugggacuacaggcac

SEQ ID NO: 2937376 - RNA, 17 nt, Human
cugggacuacaggcacc

SEQ ID NO: 2937377 - RNA, 21 nt, Human
cugggacuacaggcacccacc

SEQ ID NO: 2937378 - RNA, 17 nt, Human
cugggacuacaggugug

SEQ ID NO: 2937379 - RNA, 16 nt, Human
cuggcagcucagagag

SEQ ID NO: 2937380 - RNA, 19 nt, Human
cuggcagcucagagagggu

SEQ ID NO: 2937381 - RNA, 17 nt, Human
cuggcagcucagagagg

SEQ ID NO: 2937382 - RNA, 19 nt, Human
cuggcagaguugaagacag

SEQ ID NO: 2937383 - RNA, 21 nt, Human
cuggcagaguugaagacagag

SEQ ID NO: 2937384 - RNA, 20 nt, Human
cuggcagaguugaagacaga

SEQ ID NO: 2937385 - RNA, 23 nt, Human
cuggcagccccuguucuggcaga

SEQ ID NO: 2937386 - RNA, 22 nt, Human
cuggcagaguugaagacagagc

SEQ ID NO: 2937387 - RNA, 13 nt, Human
cuggcagccccug

SEQ ID NO: 2937388 - RNA, 16 nt, Human
cugcuucaaggauccu

SEQ ID NO: 2937389 - RNA, 14 nt, Human
cugcuucaaggauc

SEQ ID NO: 2937390 - RNA, 19 nt, Human
cugcuucaaggauccugag

SEQ ID NO: 2937391 - RNA, 23 nt, Human
cugcuucagccucccgaguagcu

SEQ ID NO: 2937392 - RNA, 14 nt, Human
cugcuuccagugag

SEQ ID NO: 2937393 - RNA, 23 nt, Human
cuggaaaaguauguuagugcaaa

SEQ ID NO: 2937394 - RNA, 22 nt, Human
cuggaguuauugaagcagagug

SEQ ID NO: 2937395 - RNA, 21 nt, Human
cuggaguuauugaagcagagu

SEQ ID NO: 2937396 - RNA, 23 nt, Human
cuggaguuauugaagcagagugg

SEQ ID NO: 2937397 - RNA, 24 nt, Human
cuggaguuauugaagcagaguggc

SEQ ID NO: 2937398 - RNA, 21 nt, Human
cuggagaaaauggacguguua

SEQ ID NO: 2937399 - RNA, 15 nt, Human
cuggaugcagccuca

SEQ ID NO: 2937400 - RNA, 18 nt, Human
cuggaugcagccucacag

SEQ ID NO: 2937401 - RNA, 17 nt, Human
cuggaugcagccucaca

SEQ ID NO: 2937402 - RNA, 16 nt, Human
cuggaugcagccucac

SEQ ID NO: 2937403 - RNA, 23 nt, Human
cugcccuuaccugccaggaagcc

SEQ ID NO: 2937404 - RNA, 22 nt, Human
cugcccuuaccugccaggaagc

SEQ ID NO: 2937405 - RNA, 11 nt, Human
cugcccugugg

SEQ ID NO: 2937406 - RNA, 12 nt, Human
cugcccuguggg

SEQ ID NO: 2937407 - RNA, 19 nt, Human
cugcccuuaccugccagga

SEQ ID NO: 2937408 - RNA, 24 nt, Human
cugcccugugaguacuacaguccu

SEQ ID NO: 2937409 - RNA, 17 nt, Human
cugccuccccuccucug

SEQ ID NO: 2937410 - RNA, 18 nt, Human
cugccuccccuccucugc

SEQ ID NO: 2937411 - RNA, 14 nt, Human
cugccuccccuccu

SEQ ID NO: 2937412 - RNA, 19 nt, Human
cugccucgaacuggcugca

SEQ ID NO: 2937413 - RNA, 20 nt, Human
cugccucgaacuggcugcaa

SEQ ID NO: 2937414 - RNA, 14 nt, Human
cugccucgaacugg

SEQ ID NO: 2937415 - RNA, 23 nt, Human
cugccuccuuugugaggaagccg

SEQ ID NO: 2937416 - RNA, 21 nt, Human
cugccuccuuugugaggaagc

SEQ ID NO: 2937417 - RNA, 17 nt, Human
cugccuccuuugugagg

SEQ ID NO: 2937418 - RNA, 14 nt, Human
cugccuccuuugug

SEQ ID NO: 2937419 - RNA, 19 nt, Human
cugccuccccuccucugcu

SEQ ID NO: 2937420 - RNA, 20 nt, Human
cugccuccccuccucugcuu

SEQ ID NO: 2937421 - RNA, 16 nt, Human
cugcugagauccugga

SEQ ID NO: 2937422 - RNA, 17 nt, Human
cugcugagauccuggac

SEQ ID NO: 2937423 - RNA, 18 nt, Human
cugcugagauccuggacu

SEQ ID NO: 2937424 - RNA, 19 nt, Human
cugcugagauccuggacug

SEQ ID NO: 2937425 - RNA, 23 nt, Human
cugcugagauccuggacugaggg

SEQ ID NO: 2937426 - RNA, 22 nt, Human
cugcugagccucacagcaguga

SEQ ID NO: 2937427 - RNA, 20 nt, Human
cugccuguucagcuccagcu

SEQ ID NO: 2937428 - RNA, 23 nt, Human
cugccuguucagcuccagcucac

SEQ ID NO: 2937429 - RNA, 17 nt, Human
cugcuaucaaagagguu

SEQ ID NO: 2937430 - RNA, 18 nt, Human
cugcugaaggcucgagca

SEQ ID NO: 2937431 - RNA, 23 nt, Human
cugcugaaggcucgagcaugccu

SEQ ID NO: 2937432 - RNA, 24 nt, Human
cugcugaaggcucgagcaugccug

SEQ ID NO: 2937433 - RNA, 15 nt, Human
cuugauguguuaucu

SEQ ID NO: 2937434 - RNA, 19 nt, Human
cuugauucauaaugacuua

SEQ ID NO: 2937435 - RNA, 19 nt, Human
cuugccgucuaccugaggg

SEQ ID NO: 2937436 - RNA, 18 nt, Human
cuugccgucuaccugagg

SEQ ID NO: 2937437 - RNA, 15 nt, Human
cuuggauuguccccg

SEQ ID NO: 2937438 - RNA, 15 nt, Human
cuuggcccaggaguu

SEQ ID NO: 2937439 - RNA, 20 nt, Human
cuuggauuguccccgacccu

SEQ ID NO: 2937440 - RNA, 18 nt, Human
cuuggauuguccccgacc

SEQ ID NO: 2937441 - RNA, 23 nt, Human
cuuggcccaggaguuuggccaga

SEQ ID NO: 2937442 - RNA, 22 nt, Human
cuuggcccaggaguuuggccag

SEQ ID NO: 2937443 - RNA, 20 nt, Human
cuuggcccaggaguuuggcc

SEQ ID NO: 2937444 - RNA, 16 nt, Human
cuuggcccaggaguuu

SEQ ID NO: 2937445 - RNA, 22 nt, Human
cuuggcgcugccccuggcagcc

SEQ ID NO: 2937446 - RNA, 21 nt, Human
cuuggcgcugccccuggcagc

SEQ ID NO: 2937447 - RNA, 23 nt, Human
cuuggcgcugccccuggcagccc

SEQ ID NO: 2937448 - RNA, 17 nt, Human
cuuucaauaggaaaaac

SEQ ID NO: 2937449 - RNA, 15 nt, Human
cuuuaagaacuaaaa

SEQ ID NO: 2937450 - RNA, 22 nt, Human
cuugucuuuggacccugaggcc

SEQ ID NO: 2937451 - RNA, 21 nt, Human
cuugucuuuggacccugaggc

SEQ ID NO: 2937452 - RNA, 22 nt, Human
cuuuaaugucacaggcaggucc

SEQ ID NO: 2937453 - RNA, 15 nt, Human
cuuucaauaggaaaa

SEQ ID NO: 2937454 - RNA, 14 nt, Human
cuuucaauaggaaa

SEQ ID NO: 2937455 - RNA, 17 nt, Human
cuuuaaugucacaggca

SEQ ID NO: 2937456 - RNA, 18 nt, Human
cuuuaaugucacaggcag

SEQ ID NO: 2937457 - RNA, 19 nt, Human
cuuuaaugucacaggcagg

SEQ ID NO: 2937458 - RNA, 20 nt, Human
cuuuaaugucacaggcaggu

SEQ ID NO: 2937459 - RNA, 15 nt, Human
cuugguccugcugca

SEQ ID NO: 2937460 - RNA, 20 nt, Human
cuugguccugcugcaguugc

SEQ ID NO: 2937461 - RNA, 18 nt, Human
cuugguccugcugcaguu

SEQ ID NO: 2937462 - RNA, 17 nt, Human
cuugguccugcugcagu

SEQ ID NO: 2937463 - RNA, 16 nt, Human
cuugguccugcugcag

SEQ ID NO: 2937464 - RNA, 13 nt, Human
cuugucuguagau

SEQ ID NO: 2937465 - RNA, 20 nt, Human
cuugucuuuggacccugagg

SEQ ID NO: 2937466 - RNA, 19 nt, Human
cuugucuuuggacccugag

SEQ ID NO: 2937467 - RNA, 23 nt, Human
cuuggucucagugucaaugcagc

SEQ ID NO: 2937468 - RNA, 22 nt, Human
cuugguccugcugcaguugcca

SEQ ID NO: 2937469 - RNA, 16 nt, Human
cuugguucccauuugc

SEQ ID NO: 2937470 - RNA, 20 nt, Human
cuugguucccauuugcuccu

SEQ ID NO: 2937471 - RNA, 13 nt, Human
cuucuuauacauu

SEQ ID NO: 2937472 - RNA, 16 nt, Human
cuucuuauacauuuga

SEQ ID NO: 2937473 - RNA, 17 nt, Human
cuucugacccaugcugc

SEQ ID NO: 2937474 - RNA, 16 nt, Human
cuucugacccaugcug

SEQ ID NO: 2937475 - RNA, 18 nt, Human
cuucugacccaugcugcc

SEQ ID NO: 2937476 - RNA, 14 nt, Human
cuucuauauaauuc

SEQ ID NO: 2937477 - RNA, 22 nt, Human
cuucuauuuauuuauuuauuca

SEQ ID NO: 2937478 - RNA, 16 nt, Human
cuucuauuuauuuauu

SEQ ID NO: 2937479 - RNA, 19 nt, Human
cuucugaacuuggcgcugc

SEQ ID NO: 2937480 - RNA, 22 nt, Human
cuucugaacuuggcgcugcccc

SEQ ID NO: 2937481 - RNA, 15 nt, Human
cuucugacccaugcu

SEQ ID NO: 2937482 - RNA, 22 nt, Human
cuucucuguauuccuagaaacu

SEQ ID NO: 2937483 - RNA, 12 nt, Human
cuuccucccucc

SEQ ID NO: 2937484 - RNA, 13 nt, Human
cuuccucccuccc

SEQ ID NO: 2937485 - RNA, 14 nt, Human
cuuccucccucccu

SEQ ID NO: 2937486 - RNA, 21 nt, Human
gaacaaggcaaggcugucaau

SEQ ID NO: 2937487 - RNA, 18 nt, Human
gaacaaggcaaggcuguc

SEQ ID NO: 2937488 - RNA, 17 nt, Human
gaacaaggcaaggcugu

SEQ ID NO: 2937489 - RNA, 15 nt, Human
gaacaaggcaaggcu

SEQ ID NO: 2937490 - RNA, 14 nt, Human
gaacaaggcaaggc

SEQ ID NO: 2937491 - RNA, 23 nt, Human
gaaacuucagcgguuuauauaag

SEQ ID NO: 2937492 - RNA, 23 nt, Human
gaacaaauuuacagagacagaaa

SEQ ID NO: 2937493 - RNA, 19 nt, Human
gaaauuuuuauuaaauuau

SEQ ID NO: 2937494 - RNA, 17 nt, Human
gaacaaauuuacagaga

SEQ ID NO: 2937495 - RNA, 18 nt, Human
gaacaaauuuacagagac

SEQ ID NO: 2937496 - RNA, 18 nt, Human
gaaauuuuuauuaaauua

SEQ ID NO: 2937497 - RNA, 18 nt, Human
gaaaugaaagcagggacu

SEQ ID NO: 2937498 - RNA, 23 nt, Human
gaaaucaaauaugcaaagcacug

SEQ ID NO: 2937499 - RNA, 17 nt, Human
gaaaugaaagcagggac

SEQ ID NO: 2937500 - RNA, 17 nt, Human
gaaaucaccgaaaacgu

SEQ ID NO: 2937501 - RNA, 18 nt, Human
gaaagacuaucuaaaugu

SEQ ID NO: 2937502 - RNA, 16 nt, Human
gaaaggcuccaggagc

SEQ ID NO: 2937503 - RNA, 19 nt, Human
gaaaggcuccaggagcagc

SEQ ID NO: 2937504 - RNA, 18 nt, Human
gaaaggcuccaggagcag

SEQ ID NO: 2937505 - RNA, 17 nt, Human
gaaaggcuccaggagca

SEQ ID NO: 2937506 - RNA, 21 nt, Human
gaaaguacuucuccacccugc

SEQ ID NO: 2937507 - RNA, 16 nt, Human
gaaaucaaauaugcaa

SEQ ID NO: 2937508 - RNA, 21 nt, Human
gaaaucaaauaugcaaagcac

SEQ ID NO: 2937509 - RNA, 18 nt, Human
gaaaauuuugauguuuua

SEQ ID NO: 2937510 - RNA, 14 nt, Human
gaaaauuuuaaaaa

SEQ ID NO: 2937511 - RNA, 19 nt, Human
gaaaagccucuguuuugau

SEQ ID NO: 2937512 - RNA, 15 nt, Human
gaaaagccucuguuu

SEQ ID NO: 2937513 - RNA, 17 nt, Human
gaaaaaaugguagcauu

SEQ ID NO: 2937514 - RNA, 19 nt, Human
gaaaaaaugguagcauuuu

SEQ ID NO: 2937515 - RNA, 22 nt, Human
gaaaaaaugguagcauuuuaaa

SEQ ID NO: 2937516 - RNA, 20 nt, Human
gaaaaaauuuacuuuaaacu

SEQ ID NO: 2937517 - RNA, 21 nt, Human
gaaaagacuccaaagaaaugu

SEQ ID NO: 2937518 - RNA, 18 nt, Human
gaaaagacuccaaagaaa

SEQ ID NO: 2937519 - RNA, 20 nt, Human
gaaaagacuccaaagaaaug

SEQ ID NO: 2937520 - RNA, 18 nt, Human
cuuuugccguuauuaaaa

SEQ ID NO: 2937521 - RNA, 16 nt, Human
cuuuugccguuauuaa

SEQ ID NO: 2937522 - RNA, 15 nt, Human
cuuuuggucugugug

SEQ ID NO: 2937523 - RNA, 16 nt, Human
cuuuuggucuguguga

SEQ ID NO: 2937524 - RNA, 17 nt, Human
cuuuugucuaugggacu

SEQ ID NO: 2937525 - RNA, 19 nt, Human
cuuuuguagaagucacauu

SEQ ID NO: 2937526 - RNA, 14 nt, Human
cuuuugugcauuau

SEQ ID NO: 2937527 - RNA, 18 nt, Human
cuuuugugcauuaucuag

SEQ ID NO: 2937528 - RNA, 21 nt, Human
cuuuuuuuuuuuuuuugacaa

SEQ ID NO: 2937529 - RNA, 19 nt, Human
gaaaaaauauuuuccugcc

SEQ ID NO: 2937530 - RNA, 15 nt, Human
guuuuaaagcuucca

SEQ ID NO: 2937531 - RNA, 19 nt, Human
guuuggacaaaauggaaua

SEQ ID NO: 2937532 - RNA, 21 nt, Human
aaguaauaugcacacauuuuu

SEQ ID NO: 2937533 - RNA, 18 nt, Human
aaguaauaugcacacauu

SEQ ID NO: 2937534 - RNA, 20 nt, Human
aaguaauaugcacacauuuu

SEQ ID NO: 2937535 - RNA, 17 nt, Human
aaguaauaugcacacau

SEQ ID NO: 2937536 - RNA, 12 nt, Human
guuuucuguucu

SEQ ID NO: 2937537 - RNA, 14 nt, Human
guuuucuguucuuu

SEQ ID NO: 2937538 - RNA, 15 nt, Human
guuuucuguucuuuc

SEQ ID NO: 2937539 - RNA, 16 nt, Human
guuuucuguucuuucu

SEQ ID NO: 2937540 - RNA, 18 nt, Human
guuuuaaggaugcuugua

SEQ ID NO: 2937541 - RNA, 22 nt, Human
guuuuaaggaugcuuguacaua

SEQ ID NO: 2937542 - RNA, 23 nt, Human
aaguauucuuauuuaaugaaaga

SEQ ID NO: 2937543 - RNA, 21 nt, Human
aaguauucuuauuuaaugaaa

SEQ ID NO: 2937544 - RNA, 16 nt, Human
aaguauuauaccuuuu

SEQ ID NO: 2937545 - RNA, 19 nt, Human
aaguauuauaccuuuuuua

SEQ ID NO: 2937546 - RNA, 14 nt, Human
aaguacuauaauuu

SEQ ID NO: 2937547 - RNA, 17 nt, Human
aaguacuauaauuuacc

SEQ ID NO: 2937548 - RNA, 13 nt, Human
aaguacuauguau

SEQ ID NO: 2937549 - RNA, 16 nt, Human
aaguaauuuggaaauu

SEQ ID NO: 2937550 - RNA, 19 nt, Human
aaguaaugauaacuggaaa

SEQ ID NO: 2937551 - RNA, 19 nt, Human
aaguacuucuccacccugc

SEQ ID NO: 2937552 - RNA, 20 nt, Human
aaguacuucuccacccugcu

SEQ ID NO: 2937553 - RNA, 18 nt, Human
aaguacuucuccacccug

SEQ ID NO: 2937554 - RNA, 15 nt, Human
aaguauuauaccuuu

SEQ ID NO: 2937555 - RNA, 18 nt, Human
aaguauguuagugcaaau

SEQ ID NO: 2937556 - RNA, 19 nt, Human
aaguauguuagugcaaauu

SEQ ID NO: 2937557 - RNA, 16 nt, Human
aaggaaacccagcucu

SEQ ID NO: 2937558 - RNA, 20 nt, Human
guuguuugauucagacagcu

SEQ ID NO: 2937559 - RNA, 23 nt, Human
guuguuugauucagacagcugcc

SEQ ID NO: 2937560 - RNA, 22 nt, Human
aaggaaacccagcucuggucca

SEQ ID NO: 2937561 - RNA, 17 nt, Human
aaggaaacccagcucug

SEQ ID NO: 2937562 - RNA, 21 nt, Human
guuuaagugacugauggcuaa

SEQ ID NO: 2937563 - RNA, 15 nt, Human
guuucacacaaacaa

SEQ ID NO: 2937564 - RNA, 17 nt, Human
guuucaaacuuuacuau

SEQ ID NO: 2937565 - RNA, 16 nt, Human
guuuaugagaaacugg

SEQ ID NO: 2937566 - RNA, 14 nt, Human
guuuaugauuccac

SEQ ID NO: 2937567 - RNA, 13 nt, Human
aagguagaauguu

SEQ ID NO: 2937568 - RNA, 14 nt, Human
aagguagaauguuu

SEQ ID NO: 2937569 - RNA, 13 nt, Human
aaggggagaguaa

SEQ ID NO: 2937570 - RNA, 23 nt, Human
aagggggcugggacaugggaaag

SEQ ID NO: 2937571 - RNA, 12 nt, Human
aagggggcuggg

SEQ ID NO: 2937572 - RNA, 20 nt, Human
aaggcugucaauuacaggaa

SEQ ID NO: 2937573 - RNA, 22 nt, Human
aaggcugggggaagaagcucuc

SEQ ID NO: 2937574 - RNA, 19 nt, Human
aaggcugggggaagaagcu

SEQ ID NO: 2937575 - RNA, 11 nt, Human
guuucagaaau

SEQ ID NO: 2937576 - RNA, 13 nt, Human
guuucagaaaugu

SEQ ID NO: 2937577 - RNA, 14 nt, Human
aaggcugggggaag

SEQ ID NO: 2937578 - RNA, 16 nt, Human
aaggcugggggaagaa

SEQ ID NO: 2937579 - RNA, 15 nt, Human
aagggcuguuauaau

SEQ ID NO: 2937580 - RNA, 17 nt, Human
aagggcuguuauaaucu

SEQ ID NO: 2937581 - RNA, 17 nt, Human
aaggggaauugaggaca

SEQ ID NO: 2937582 - RNA, 20 nt, Human
aaguuugagaucagccuggg

SEQ ID NO: 2937583 - RNA, 9 nt, Human
uaaaauggu

SEQ ID NO: 2937584 - RNA, 19 nt, Human
aaguuauuuuuaauuuggu

SEQ ID NO: 2937585 - RNA, 21 nt, Human
aaguuucugccgcagcccugc

SEQ ID NO: 2937586 - RNA, 19 nt, Human
aaguuucugccgcagcccu

SEQ ID NO: 2937587 - RNA, 13 nt, Human
aaguuugaacauu

SEQ ID NO: 2937588 - RNA, 21 nt, Human
aaguuugaauuccuaaaauua

SEQ ID NO: 2937589 - RNA, 23 nt, Human
aaguuauuaagagguaagacuua

SEQ ID NO: 2937590 - RNA, 21 nt, Human
aaguuauuaagagguaagacu

SEQ ID NO: 2937591 - RNA, 22 nt, Human
aaguuauuaagagguaagacuu

SEQ ID NO: 2937592 - RNA, 13 nt, Human
aagugugguagag

SEQ ID NO: 2937593 - RNA, 23 nt, Human
aaguguauuuuuuuacuaauaga

SEQ ID NO: 2937594 - RNA, 23 nt, Human
aagugauccucccaccucagccu

SEQ ID NO: 2937595 - RNA, 20 nt, Human
aagugauucuccugccucag

SEQ ID NO: 2937596 - RNA, 13 nt, Human
aagugauccuccc

SEQ ID NO: 2937597 - RNA, 19 nt, Human
aagugauccucccaccuca

SEQ ID NO: 2937598 - RNA, 20 nt, Human
aagugauccucccaccucag

SEQ ID NO: 2937599 - RNA, 13 nt, Human
uaaaagucuugug

SEQ ID NO: 2937600 - RNA, 13 nt, Human
uaaaagaauauuu

SEQ ID NO: 2937601 - RNA, 19 nt, Human
uaaaaggugaccaaugaug

SEQ ID NO: 2937602 - RNA, 14 nt, Human
uaaaauaagucuga

SEQ ID NO: 2937603 - RNA, 20 nt, Human
uaaaauaauuuuuauauuug

SEQ ID NO: 2937604 - RNA, 15 nt, Human
uaaaauaagucugau

SEQ ID NO: 2937605 - RNA, 17 nt, Human
uaaaauaagucugauuu

SEQ ID NO: 2937606 - RNA, 18 nt, Human
uaaaauaagucugauuua

SEQ ID NO: 2937607 - RNA, 19 nt, Human
uaaaauaagucugauuuaa

SEQ ID NO: 2937608 - RNA, 22 nt, Human
uaaaauaauuuuuauauuugaa

SEQ ID NO: 2937609 - RNA, 21 nt, Human
uaaaauacacacucaaaucaa

SEQ ID NO: 2937610 - RNA, 13 nt, Human
uaaaacccaagug

SEQ ID NO: 2937611 - RNA, 12 nt, Human
uaaaacuuuuua

SEQ ID NO: 2937612 - RNA, 15 nt, Human
uaaaacuuuuuaaaa

SEQ ID NO: 2937613 - RNA, 15 nt, Human
uaaaaaugagguacu

SEQ ID NO: 2937614 - RNA, 23 nt, Human
uaaaaaucucaaauuucuaaauc

SEQ ID NO: 2937615 - RNA, 13 nt, Human
uaaaaccacagca

SEQ ID NO: 2937616 - RNA, 15 nt, Human
uaaaaccacagcagu

SEQ ID NO: 2937617 - RNA, 14 nt, Human
uaaaaccacagcag

SEQ ID NO: 2937618 - RNA, 22 nt, Human
uaaaaaugagguacucuccugg

SEQ ID NO: 2937619 - RNA, 15 nt, Human
uaaaaaggugaccau

SEQ ID NO: 2937620 - RNA, 13 nt, Human
uaaaaaggugacc

SEQ ID NO: 2937621 - RNA, 21 nt, Human
uaaaaaaaaaccugagcccca

SEQ ID NO: 2937622 - RNA, 14 nt, Human
aagcacaugccucu

SEQ ID NO: 2937623 - RNA, 20 nt, Human
aagcacaugccucucucagg

SEQ ID NO: 2937624 - RNA, 19 nt, Human
aagcacaugccucucucag

SEQ ID NO: 2937625 - RNA, 16 nt, Human
aagcacaugccucucu

SEQ ID NO: 2937626 - RNA, 15 nt, Human
aagcacaugccucuc

SEQ ID NO: 2937627 - RNA, 17 nt, Human
gugugaauaccccaaga

SEQ ID NO: 2937628 - RNA, 16 nt, Human
aagcacacuugacauc

SEQ ID NO: 2937629 - RNA, 12 nt, Human
guguuugaagca

SEQ ID NO: 2937630 - RNA, 21 nt, Human
aagcacaugccucucucaggc

SEQ ID NO: 2937631 - RNA, 13 nt, Human
aagcaccuccugc

SEQ ID NO: 2937632 - RNA, 14 nt, Human
aagcaccuccugcc

SEQ ID NO: 2937633 - RNA, 15 nt, Human
aagcaccuccugccu

SEQ ID NO: 2937634 - RNA, 16 nt, Human
aagcaccuccugccuc

SEQ ID NO: 2937635 - RNA, 17 nt, Human
aagcacugacuucuaag

SEQ ID NO: 2937636 - RNA, 16 nt, Human
aagcacugacuucuaa

SEQ ID NO: 2937637 - RNA, 17 nt, Human
aagcaccuccugccucg

SEQ ID NO: 2937638 - RNA, 16 nt, Human
aagcacuaaacaaaga

SEQ ID NO: 2937639 - RNA, 18 nt, Human
aagcauuguaaaugugcu

SEQ ID NO: 2937640 - RNA, 12 nt, Human
aagcaugugaga

SEQ ID NO: 2937641 - RNA, 20 nt, Human
aagcacugacuucuaaguaa

SEQ ID NO: 2937642 - RNA, 19 nt, Human
aagcacugacuucuaagua

SEQ ID NO: 2937643 - RNA, 17 nt, Human
aagccaaagcuaggccu

SEQ ID NO: 2937644 - RNA, 18 nt, Human
aagccaaagcuaggccug

SEQ ID NO: 2937645 - RNA, 19 nt, Human
aagcauuguaaaugugcuu

SEQ ID NO: 2937646 - RNA, 17 nt, Human
aagcaacccaaauguuc

SEQ ID NO: 2937647 - RNA, 23 nt, Human
aagaucaaaagguuaauaaagua

SEQ ID NO: 2937648 - RNA, 20 nt, Human
aagaucaaaagguuaauaaa

SEQ ID NO: 2937649 - RNA, 22 nt, Human
gugucaccugaagacucauucu

SEQ ID NO: 2937650 - RNA, 14 nt, Human
gugucagguggggc

SEQ ID NO: 2937651 - RNA, 18 nt, Human
gugucagguggggcagcu

SEQ ID NO: 2937652 - RNA, 14 nt, Human
gugucaccugaaga

SEQ ID NO: 2937653 - RNA, 23 nt, Human
gugugaaccaccacacccagccc

SEQ ID NO: 2937654 - RNA, 19 nt, Human
gugucagguggggcagcuu

SEQ ID NO: 2937655 - RNA, 22 nt, Human
gugucuuaauuaaaagaauauu

SEQ ID NO: 2937656 - RNA, 15 nt, Human
guguaaacacaucua

SEQ ID NO: 2937657 - RNA, 14 nt, Human
guguaaacacaucu

SEQ ID NO: 2937658 - RNA, 15 nt, Human
gugguuucagaaaug

SEQ ID NO: 2937659 - RNA, 23 nt, Human
gugcugcccugcccaccuggccu

SEQ ID NO: 2937660 - RNA, 14 nt, Human
aagaggcagggucu

SEQ ID NO: 2937661 - RNA, 11 nt, Human
aagaggcaggg

SEQ ID NO: 2937662 - RNA, 22 nt, Human
aagagggagggagggcuccaga

SEQ ID NO: 2937663 - RNA, 21 nt, Human
aagagggagggagggcuccag

SEQ ID NO: 2937664 - RNA, 17 nt, Human
aagagggugggugggua

SEQ ID NO: 2937665 - RNA, 22 nt, Human
aagagggucugaggaauccaga

SEQ ID NO: 2937666 - RNA, 14 nt, Human
aagauagcagggca

SEQ ID NO: 2937667 - RNA, 15 nt, Human
aagauagcagggcau

SEQ ID NO: 2937668 - RNA, 19 nt, Human
guuagagguucccuuugac

SEQ ID NO: 2937669 - RNA, 19 nt, Human
guuauuauauuuacaaaug

SEQ ID NO: 2937670 - RNA, 21 nt, Human
guuauuuuauugauuauuacu

SEQ ID NO: 2937671 - RNA, 16 nt, Human
guuauuuuacuuuuug

SEQ ID NO: 2937672 - RNA, 15 nt, Human
guuauuuuacuuuuu

SEQ ID NO: 2937673 - RNA, 17 nt, Human
guuauuauauuuacaaa

SEQ ID NO: 2937674 - RNA, 18 nt, Human
guuaaucauuagguguga

SEQ ID NO: 2937675 - RNA, 23 nt, Human
guucagcuuguaaauagcucagg

SEQ ID NO: 2937676 - RNA, 20 nt, Human
guucaggguuggccccugcc

SEQ ID NO: 2937677 - RNA, 21 nt, Human
guucaggguuggccccugccc

SEQ ID NO: 2937678 - RNA, 22 nt, Human
guucaggguuggccccugcccg

SEQ ID NO: 2937679 - RNA, 21 nt, Human
aagccgugauuuucauugcug

SEQ ID NO: 2937680 - RNA, 17 nt, Human
guucagguaacaggcag

SEQ ID NO: 2937681 - RNA, 18 nt, Human
guucagguaacaggcaga

SEQ ID NO: 2937682 - RNA, 16 nt, Human
aagccucccacgacug

SEQ ID NO: 2937683 - RNA, 15 nt, Human
aagccuccuccagcc

SEQ ID NO: 2937684 - RNA, 21 nt, Human
aagccuuggggcugaugcagu

SEQ ID NO: 2937685 - RNA, 18 nt, Human
aagcuuauuaaaacucau

SEQ ID NO: 2937686 - RNA, 17 nt, Human
aagcucugcuccucucc

SEQ ID NO: 2937687 - RNA, 13 nt, Human
aagcuuuugcaua

SEQ ID NO: 2937688 - RNA, 22 nt, Human
aagcuuuugcauauugcauacu

SEQ ID NO: 2937689 - RNA, 15 nt, Human
aagcuuuugcauauu

SEQ ID NO: 2937690 - RNA, 19 nt, Human
aagcuuuugcauauugcau

SEQ ID NO: 2937691 - RNA, 22 nt, Human
guucccuuuuuuggcugcugaa

SEQ ID NO: 2937692 - RNA, 21 nt, Human
guucccuuuuuuggcugcuga

SEQ ID NO: 2937693 - RNA, 18 nt, Human
guucccuugaugaagaag

SEQ ID NO: 2937694 - RNA, 19 nt, Human
guugauagcacagacccug

SEQ ID NO: 2937695 - RNA, 14 nt, Human
guugauagcacaga

SEQ ID NO: 2937696 - RNA, 15 nt, Human
guucuugguuuguaa

SEQ ID NO: 2937697 - RNA, 18 nt, Human
guucuugguuuguaaauu

SEQ ID NO: 2937698 - RNA, 14 nt, Human
guucuugguuugua

SEQ ID NO: 2937699 - RNA, 12 nt, Human
guucucugagga

SEQ ID NO: 2937700 - RNA, 15 nt, Human
guucucucuucucca

SEQ ID NO: 2937701 - RNA, 15 nt, Human
guucucugcccucca

SEQ ID NO: 2937702 - RNA, 13 nt, Human
guucucugcccuc

SEQ ID NO: 2937703 - RNA, 14 nt, Human
guucuaguguuuuc

SEQ ID NO: 2937704 - RNA, 13 nt, Human
guucucuccuucu

SEQ ID NO: 2937705 - RNA, 17 nt, Human
guucuaguguuuucaau

SEQ ID NO: 2937706 - RNA, 19 nt, Human
guucuagcauggcugccaa

SEQ ID NO: 2937707 - RNA, 14 nt, Human
guucuuaauucuua

SEQ ID NO: 2937708 - RNA, 17 nt, Human
guucuuaauucuuagcu

SEQ ID NO: 2937709 - RNA, 18 nt, Human
guucucugcccuccaaga

SEQ ID NO: 2937710 - RNA, 17 nt, Human
guucucugcccuccaag

SEQ ID NO: 2937711 - RNA, 13 nt, Human
guucuuaauucuu

SEQ ID NO: 2937712 - RNA, 17 nt, Human
aaauuccaagugauuga

SEQ ID NO: 2937713 - RNA, 23 nt, Human
aaauuguuugacggcaagguuua

SEQ ID NO: 2937714 - RNA, 17 nt, Human
aaauuguauuacaaauc

SEQ ID NO: 2937715 - RNA, 14 nt, Human
aaauuauggaaaca

SEQ ID NO: 2937716 - RNA, 21 nt, Human
aaauuauggaaacagaugaaa

SEQ ID NO: 2937717 - RNA, 15 nt, Human
aaaugugcuuuuaaa

SEQ ID NO: 2937718 - RNA, 18 nt, Human
aaaugugccuucauuuuu

SEQ ID NO: 2937719 - RNA, 18 nt, Human
guauucucuccuguaccu

SEQ ID NO: 2937720 - RNA, 24 nt, Human
aaaugucuaguuguaacaccauga

SEQ ID NO: 2937721 - RNA, 21 nt, Human
aaaugucucuuuaaugucaca

SEQ ID NO: 2937722 - RNA, 21 nt, Human
gucagaaguuucugccgcagc

SEQ ID NO: 2937723 - RNA, 14 nt, Human
gucaggaaagagaa

SEQ ID NO: 2937724 - RNA, 13 nt, Human
gucaggaaagaga

SEQ ID NO: 2937725 - RNA, 15 nt, Human
gucacugcuuaacuu

SEQ ID NO: 2937726 - RNA, 21 nt, Human
gucacugcuuaacuucacaua

SEQ ID NO: 2937727 - RNA, 16 nt, Human
gucagguggggcagcu

SEQ ID NO: 2937728 - RNA, 17 nt, Human
gucagguggggcagcuu

SEQ ID NO: 2937729 - RNA, 18 nt, Human
gucagguggggcagcuug

SEQ ID NO: 2937730 - RNA, 22 nt, Human
gucagguggggcagcuugaggg

SEQ ID NO: 2937731 - RNA, 19 nt, Human
gucagucugcuuagaaaua

SEQ ID NO: 2937732 - RNA, 12 nt, Human
aaauuucuaaau

SEQ ID NO: 2937733 - RNA, 13 nt, Human
aaauuucuaaauc

SEQ ID NO: 2937734 - RNA, 15 nt, Human
aaauuucuaaaucuc

SEQ ID NO: 2937735 - RNA, 18 nt, Human
gucacauuccugaacagg

SEQ ID NO: 2937736 - RNA, 22 nt, Human
gucaccaaaucagcugcuacua

SEQ ID NO: 2937737 - RNA, 12 nt, Human
gucacaggcagg

SEQ ID NO: 2937738 - RNA, 20 nt, Human
gucacaggaaguagaggagg

SEQ ID NO: 2937739 - RNA, 20 nt, Human
gucaauuaccagaaagauaa

SEQ ID NO: 2937740 - RNA, 21 nt, Human
gucaauuaccagaaagauaac

SEQ ID NO: 2937741 - RNA, 22 nt, Human
gucaauuacaggaaguacugga

SEQ ID NO: 2937742 - RNA, 21 nt, Human
gucaauuuuguuauguauauu

SEQ ID NO: 2937743 - RNA, 13 nt, Human
gucacaggaagua

SEQ ID NO: 2937744 - RNA, 15 nt, Human
gucacaggaaguaga

SEQ ID NO: 2937745 - RNA, 12 nt, Human
gucaccaagccc

SEQ ID NO: 2937746 - RNA, 15 nt, Human
gucaccaagcccagu

SEQ ID NO: 2937747 - RNA, 23 nt, Human
gucacucuggcagcucagagagg

SEQ ID NO: 2937748 - RNA, 16 nt, Human
gucacugagacagccc

SEQ ID NO: 2937749 - RNA, 15 nt, Human
gucacugagacagcc

SEQ ID NO: 2937750 - RNA, 14 nt, Human
gucacugagacagc

SEQ ID NO: 2937751 - RNA, 22 nt, Human
gucacucuggcagcucagagag

SEQ ID NO: 2937752 - RNA, 10 nt, Human
gucacugcuu

SEQ ID NO: 2937753 - RNA, 23 nt, Human
gucacugagacagcccgggcucu

SEQ ID NO: 2937754 - RNA, 21 nt, Human
gucacugagacagcccgggcu

SEQ ID NO: 2937755 - RNA, 18 nt, Human
gucacugagacagcccgg

SEQ ID NO: 2937756 - RNA, 17 nt, Human
gucacugagacagcccg

SEQ ID NO: 2937757 - RNA, 13 nt, Human
aacagucucagga

SEQ ID NO: 2937758 - RNA, 18 nt, Human
aacaguccauugaaaggg

SEQ ID NO: 2937759 - RNA, 15 nt, Human
aacauagcugugauu

SEQ ID NO: 2937760 - RNA, 12 nt, Human
aacauauauaac

SEQ ID NO: 2937761 - RNA, 14 nt, Human
aacagucucaggaa

SEQ ID NO: 2937762 - RNA, 14 nt, Human
aacauaaaauacaa

SEQ ID NO: 2937763 - RNA, 14 nt, Human
guccucuuuucuga

SEQ ID NO: 2937764 - RNA, 16 nt, Human
guccuggcaugggaau

SEQ ID NO: 2937765 - RNA, 17 nt, Human
guccugcugcaguugcc

SEQ ID NO: 2937766 - RNA, 19 nt, Human
guccugcugcaguugccag

SEQ ID NO: 2937767 - RNA, 12 nt, Human
gucgaggcagga

SEQ ID NO: 2937768 - RNA, 16 nt, Human
gucgaggacagggagg

SEQ ID NO: 2937769 - RNA, 20 nt, Human
gucuauuuacggaacucaaa

SEQ ID NO: 2937770 - RNA, 15 nt, Human
gucuaugggacucaa

SEQ ID NO: 2937771 - RNA, 22 nt, Human
gucuaugggacucaaugcacug

SEQ ID NO: 2937772 - RNA, 16 nt, Human
gucuaccugaggggcc

SEQ ID NO: 2937773 - RNA, 15 nt, Human
gucuaccugaggggc

SEQ ID NO: 2937774 - RNA, 13 nt, Human
gucuaccugaggg

SEQ ID NO: 2937775 - RNA, 14 nt, Human
gucuaccugagggg

SEQ ID NO: 2937776 - RNA, 18 nt, Human
guccccuguuuguuucug

SEQ ID NO: 2937777 - RNA, 22 nt, Human
guccccuguuuguuucugaaag

SEQ ID NO: 2937778 - RNA, 19 nt, Human
gucccuuacgugaguccug

SEQ ID NO: 2937779 - RNA, 18 nt, Human
gucccuuacgugaguccu

SEQ ID NO: 2937780 - RNA, 18 nt, Human
gucccugguggcagcuca

SEQ ID NO: 2937781 - RNA, 19 nt, Human
gucccugguggcagcucac

SEQ ID NO: 2937782 - RNA, 13 nt, Human
gucccaagugcca

SEQ ID NO: 2937783 - RNA, 14 nt, Human
gucccaagugccaa

SEQ ID NO: 2937784 - RNA, 15 nt, Human
gucccaccccacaca

SEQ ID NO: 2937785 - RNA, 22 nt, Human
guccccaccgcagacaggacca

SEQ ID NO: 2937786 - RNA, 18 nt, Human
guccccaccgcagacagg

SEQ ID NO: 2937787 - RNA, 19 nt, Human
gucauuugagcagggcuca

SEQ ID NO: 2937788 - RNA, 22 nt, Human
guccaugaagauguagaggaga

SEQ ID NO: 2937789 - RNA, 17 nt, Human
gucauuugagcagggcu

SEQ ID NO: 2937790 - RNA, 18 nt, Human
aacacugguuuuaaauau

SEQ ID NO: 2937791 - RNA, 19 nt, Human
aacacuguucucugcccuc

SEQ ID NO: 2937792 - RNA, 16 nt, Human
aacacugguuuuaaau

SEQ ID NO: 2937793 - RNA, 16 nt, Human
aacacuguucucugcc

SEQ ID NO: 2937794 - RNA, 18 nt, Human
aacacuguucucugcccu

SEQ ID NO: 2937795 - RNA, 17 nt, Human
aacacuguucucugccc

SEQ ID NO: 2937796 - RNA, 21 nt, Human
aacacucacauuuauucugcu

SEQ ID NO: 2937797 - RNA, 19 nt, Human
aacacaaacgggcucagca

SEQ ID NO: 2937798 - RNA, 19 nt, Human
aaauuucuaaaucuccaaa

SEQ ID NO: 2937799 - RNA, 17 nt, Human
aacacaacuauauuguu

SEQ ID NO: 2937800 - RNA, 21 nt, Human
aacacaaagcuuuugcauauu

SEQ ID NO: 2937801 - RNA, 12 nt, Human
aacacaaagcuu

SEQ ID NO: 2937802 - RNA, 18 nt, Human
aacacaaagcuuuugcau

SEQ ID NO: 2937803 - RNA, 19 nt, Human
aacacaaagcuuuugcaua

SEQ ID NO: 2937804 - RNA, 20 nt, Human
aacacaaagcuuuugcauau

SEQ ID NO: 2937805 - RNA, 20 nt, Human
aacacagcaagggugauggg

SEQ ID NO: 2937806 - RNA, 18 nt, Human
aacacagcaagggugaug

SEQ ID NO: 2937807 - RNA, 18 nt, Human
gugaauaaccugaggauu

SEQ ID NO: 2937808 - RNA, 23 nt, Human
gugacagaggcagccccauucug

SEQ ID NO: 2937809 - RNA, 20 nt, Human
gugacagagugagacucugu

SEQ ID NO: 2937810 - RNA, 22 nt, Human
gugacagagugagacucugucu

SEQ ID NO: 2937811 - RNA, 23 nt, Human
gugaauaauacaguaucucaggg

SEQ ID NO: 2937812 - RNA, 22 nt, Human
gugagacccugucucaaaaaaa

SEQ ID NO: 2937813 - RNA, 14 nt, Human
gugagacucugucu

SEQ ID NO: 2937814 - RNA, 16 nt, Human
gugagacucugucuca

SEQ ID NO: 2937815 - RNA, 19 nt, Human
gugacaugucuuuucuugc

SEQ ID NO: 2937816 - RNA, 16 nt, Human
aacugcauuggcuuug

SEQ ID NO: 2937817 - RNA, 23 nt, Human
aacugauuuuuuuuuccuucagu

SEQ ID NO: 2937818 - RNA, 22 nt, Human
aacugauuuuuuuuuccuucag

SEQ ID NO: 2937819 - RNA, 21 nt, Human
aacugauuuuuuuuuccuuca

SEQ ID NO: 2937820 - RNA, 20 nt, Human
aacugauuuuuuuuuccuuc

SEQ ID NO: 2937821 - RNA, 23 nt, Human
aacucuccucugcugcuggcugg

SEQ ID NO: 2937822 - RNA, 22 nt, Human
aacucuccucugcugcuggcug

SEQ ID NO: 2937823 - RNA, 18 nt, Human
gugaggcucugcccuugg

SEQ ID NO: 2937824 - RNA, 17 nt, Human
gugagucaccaagccca

SEQ ID NO: 2937825 - RNA, 23 nt, Human
gugaguacuacaguccucccauc

SEQ ID NO: 2937826 - RNA, 19 nt, Human
gugagucaccaagcccagu

SEQ ID NO: 2937827 - RNA, 17 nt, Human
aacucuccucugcugcu

SEQ ID NO: 2937828 - RNA, 21 nt, Human
gugaguacuacaguccuccca

SEQ ID NO: 2937829 - RNA, 21 nt, Human
aacucuccucugcugcuggcu

SEQ ID NO: 2937830 - RNA, 19 nt, Human
aacucuccucugcugcugg

SEQ ID NO: 2937831 - RNA, 18 nt, Human
gugagacucugucucaaa

SEQ ID NO: 2937832 - RNA, 13 nt, Human
gugaggcucugcc

SEQ ID NO: 2937833 - RNA, 12 nt, Human
gugaggcucugc

SEQ ID NO: 2937834 - RNA, 17 nt, Human
gugaggcucugcccuug

SEQ ID NO: 2937835 - RNA, 16 nt, Human
gugaggcucugcccuu

SEQ ID NO: 2937836 - RNA, 15 nt, Human
gugaggcucugcccu

SEQ ID NO: 2937837 - RNA, 14 nt, Human
gugaggcucugccc

SEQ ID NO: 2937838 - RNA, 13 nt, Human
aacgucugugcca

SEQ ID NO: 2937839 - RNA, 12 nt, Human
aacgucuuaaau

SEQ ID NO: 2937840 - RNA, 14 nt, Human
aacgucuuaaauau

SEQ ID NO: 2937841 - RNA, 15 nt, Human
aacgucuuaaauauu

SEQ ID NO: 2937842 - RNA, 15 nt, Human
aacuaaaauguucua

SEQ ID NO: 2937843 - RNA, 17 nt, Human
aacuagggaagauaaua

SEQ ID NO: 2937844 - RNA, 13 nt, Human
aacguggcugcuu

SEQ ID NO: 2937845 - RNA, 12 nt, Human
aacguggcugcu

SEQ ID NO: 2937846 - RNA, 24 nt, Human
aacucauuuuuguuuucauuaucu

SEQ ID NO: 2937847 - RNA, 21 nt, Human
aacucauuuuuguuuucauua

SEQ ID NO: 2937848 - RNA, 14 nt, Human
gucucaaaaaaaca

SEQ ID NO: 2937849 - RNA, 17 nt, Human
gucucaaaaaaagaaaa

SEQ ID NO: 2937850 - RNA, 23 nt, Human
gucucuuuaaugucacaggcagg

SEQ ID NO: 2937851 - RNA, 14 nt, Human
gucugcuuagaaau

SEQ ID NO: 2937852 - RNA, 20 nt, Human
gucugacaggcaaugcuggc

SEQ ID NO: 2937853 - RNA, 15 nt, Human
gucugacaggcaaug

SEQ ID NO: 2937854 - RNA, 18 nt, Human
gucugacaggcaaugcug

SEQ ID NO: 2937855 - RNA, 12 nt, Human
gucugacaggca

SEQ ID NO: 2937856 - RNA, 13 nt, Human
gucugacaggcaa

SEQ ID NO: 2937857 - RNA, 14 nt, Human
gucugacaggcaau

SEQ ID NO: 2937858 - RNA, 15 nt, Human
gucuggaaugcagug

SEQ ID NO: 2937859 - RNA, 16 nt, Human
gucuggaaugcagugg

SEQ ID NO: 2937860 - RNA, 19 nt, Human
gucuuauauauuguagaua

SEQ ID NO: 2937861 - RNA, 14 nt, Human
gucuuaauuaaaag

SEQ ID NO: 2937862 - RNA, 18 nt, Human
aagaaaaaugagccuggc

SEQ ID NO: 2937863 - RNA, 17 nt, Human
aagaaaaaugagccugg

SEQ ID NO: 2937864 - RNA, 19 nt, Human
aagaaaaaauauuuucccu

SEQ ID NO: 2937865 - RNA, 18 nt, Human
aagaaaaagaaaaagaaa

SEQ ID NO: 2937866 - RNA, 13 nt, Human
aagaaaaagaaaa

SEQ ID NO: 2937867 - RNA, 21 nt, Human
aacuuuaccuuuuuuauacau

SEQ ID NO: 2937868 - RNA, 22 nt, Human
aacuuuaccuuuuuuauacaua

SEQ ID NO: 2937869 - RNA, 23 nt, Human
aacuuuaccuuuuuuauacauaa

SEQ ID NO: 2937870 - RNA, 11 nt, Human
aagaaacauuu

SEQ ID NO: 2937871 - RNA, 15 nt, Human
aagaaaauaguggug

SEQ ID NO: 2937872 - RNA, 16 nt, Human
aagaaaauaccaagga

SEQ ID NO: 2937873 - RNA, 21 nt, Human
aagaaaauaguggugugauuu

SEQ ID NO: 2937874 - RNA, 22 nt, Human
aagaaaauaguggugugauuug

SEQ ID NO: 2937875 - RNA, 14 nt, Human
aagaaagaaaauca

SEQ ID NO: 2937876 - RNA, 13 nt, Human
aagaaagaaaauc

SEQ ID NO: 2937877 - RNA, 16 nt, Human
aagaaagaaaaucagg

SEQ ID NO: 2937878 - RNA, 16 nt, Human
gugcucugaucaucca

SEQ ID NO: 2937879 - RNA, 13 nt, Human
gugcucuggacag

SEQ ID NO: 2937880 - RNA, 14 nt, Human
gugcucuggacagg

SEQ ID NO: 2937881 - RNA, 15 nt, Human
gugcugcccugccca

SEQ ID NO: 2937882 - RNA, 14 nt, Human
gugcugcccugccc

SEQ ID NO: 2937883 - RNA, 13 nt, Human
gugcugcccugcc

SEQ ID NO: 2937884 - RNA, 12 nt, Human
gugcugcccugc

SEQ ID NO: 2937885 - RNA, 22 nt, Human
gugcuacaaaaacacagcaagg

SEQ ID NO: 2937886 - RNA, 21 nt, Human
gugcuacaaaaacacagcaag

SEQ ID NO: 2937887 - RNA, 18 nt, Human
gugcuaguaauuggaaag

SEQ ID NO: 2937888 - RNA, 18 nt, Human
gugcuaucucccccagcc

SEQ ID NO: 2937889 - RNA, 15 nt, Human
gugcuaucuccccca

SEQ ID NO: 2937890 - RNA, 21 nt, Human
gugcacaugcacgugugugca

SEQ ID NO: 2937891 - RNA, 21 nt, Human
gugcacaagcuccaagcuccc

SEQ ID NO: 2937892 - RNA, 16 nt, Human
gugcacaagcuccaag

SEQ ID NO: 2937893 - RNA, 13 nt, Human
gugcacaagcucc

SEQ ID NO: 2937894 - RNA, 18 nt, Human
gugcaaugaccuuucaau

SEQ ID NO: 2937895 - RNA, 23 nt, Human
gugccaaaaacaacaacaaaaug

SEQ ID NO: 2937896 - RNA, 21 nt, Human
gugcauuuggugguuucagaa

SEQ ID NO: 2937897 - RNA, 18 nt, Human
gugcacgcacacugucug

SEQ ID NO: 2937898 - RNA, 17 nt, Human
gugcauuugaggucugu

SEQ ID NO: 2937899 - RNA, 19 nt, Human
gugcauuugaggucuguuc

SEQ ID NO: 2937900 - RNA, 19 nt, Human
gugauguauguguaauaaa

SEQ ID NO: 2937901 - RNA, 23 nt, Human
gugauccucccaccucagccucc

SEQ ID NO: 2937902 - RNA, 17 nt, Human
gugauuaccagggacug

SEQ ID NO: 2937903 - RNA, 11 nt, Human
gugauuaccag

SEQ ID NO: 2937904 - RNA, 16 nt, Human
gugauuaccagggacu

SEQ ID NO: 2937905 - RNA, 14 nt, Human
aacuucacauauug

SEQ ID NO: 2937906 - RNA, 22 nt, Human
aacuucacauauugauuuccgu

SEQ ID NO: 2937907 - RNA, 22 nt, Human
aacuucaccauauuaccacaga

SEQ ID NO: 2937908 - RNA, 23 nt, Human
aacuuccuuggacucauuuuaaa

SEQ ID NO: 2937909 - RNA, 14 nt, Human
aacuucagaguucu

SEQ ID NO: 2937910 - RNA, 13 nt, Human
aacuucagacaua

SEQ ID NO: 2937911 - RNA, 18 nt, Human
aacuucagcgguuuauau

SEQ ID NO: 2937912 - RNA, 22 nt, Human
aacuuccuuggacucauuuuaa

SEQ ID NO: 2937913 - RNA, 17 nt, Human
acaaaggggcuuaauua

SEQ ID NO: 2937914 - RNA, 22 nt, Human
acaaaggaugcccaaagaugca

SEQ ID NO: 2937915 - RNA, 18 nt, Human
acaaaaggauaaugaaua

SEQ ID NO: 2937916 - RNA, 11 nt, Human
acaaaagcaug

SEQ ID NO: 2937917 - RNA, 22 nt, Human
acaaaagcaugugagacugguu

SEQ ID NO: 2937918 - RNA, 19 nt, Human
uagaggagaaacuggaacu

SEQ ID NO: 2937919 - RNA, 18 nt, Human
uagaugacauugacuauu

SEQ ID NO: 2937920 - RNA, 19 nt, Human
uagaugacauugacuauuu

SEQ ID NO: 2937921 - RNA, 19 nt, Human
uagauauaugcucugcaug

SEQ ID NO: 2937922 - RNA, 15 nt, Human
uagauauaugcucug

SEQ ID NO: 2937923 - RNA, 22 nt, Human
uagaggagaaacuggaacucuc

SEQ ID NO: 2937924 - RNA, 19 nt, Human
uagcauggcugccaauggg

SEQ ID NO: 2937925 - RNA, 15 nt, Human
uagaugcaguucuga

SEQ ID NO: 2937926 - RNA, 14 nt, Human
uagccaaggccaaa

SEQ ID NO: 2937927 - RNA, 22 nt, Human
uagcauuuugcuaaaugugaau

SEQ ID NO: 2937928 - RNA, 21 nt, Human
uagccaaggccaaaggaagca

SEQ ID NO: 2937929 - RNA, 16 nt, Human
uagcauuuugcuaaau

SEQ ID NO: 2937930 - RNA, 14 nt, Human
uagcauuuuaaaca

SEQ ID NO: 2937931 - RNA, 15 nt, Human
uagcauuuuaaacaa

SEQ ID NO: 2937932 - RNA, 16 nt, Human
uagcauuuuaaacaaa

SEQ ID NO: 2937933 - RNA, 18 nt, Human
uagcauuuuaaacaaaau

SEQ ID NO: 2937934 - RNA, 23 nt, Human
uagcauuuuaaacaaaauagaaa

SEQ ID NO: 2937935 - RNA, 18 nt, Human
uagcauguccuaaugcuu

SEQ ID NO: 2937936 - RNA, 19 nt, Human
acaagaccacguuucuaaa

SEQ ID NO: 2937937 - RNA, 20 nt, Human
acaagacccaaaaggcagaa

SEQ ID NO: 2937938 - RNA, 19 nt, Human
acaagacccuugugguccc

SEQ ID NO: 2937939 - RNA, 21 nt, Human
acaacacucauugaccugagg

SEQ ID NO: 2937940 - RNA, 23 nt, Human
acaacacucauugaccugaggcc

SEQ ID NO: 2937941 - RNA, 15 nt, Human
uagccagaggagaga

SEQ ID NO: 2937942 - RNA, 11 nt, Human
uagccagagga

SEQ ID NO: 2937943 - RNA, 18 nt, Human
acaaauuuacagagacag

SEQ ID NO: 2937944 - RNA, 19 nt, Human
acaaauuuacagagacaga

SEQ ID NO: 2937945 - RNA, 12 nt, Human
acaaugacuuac

SEQ ID NO: 2937946 - RNA, 17 nt, Human
acaaugacuuacuguac

SEQ ID NO: 2937947 - RNA, 18 nt, Human
acaaugacuuacuguaca

SEQ ID NO: 2937948 - RNA, 15 nt, Human
uagcuaggugacaua

SEQ ID NO: 2937949 - RNA, 17 nt, Human
uagcuaggugacauaua

SEQ ID NO: 2937950 - RNA, 18 nt, Human
acaagaccacguuucuaa

SEQ ID NO: 2937951 - RNA, 13 nt, Human
acaagacugcaca

SEQ ID NO: 2937952 - RNA, 14 nt, Human
acaagacugcacau

SEQ ID NO: 2937953 - RNA, 23 nt, Human
acaauacaucccuuaccugggaa

SEQ ID NO: 2937954 - RNA, 20 nt, Human
uaggagaagucuucuauuua

SEQ ID NO: 2937955 - RNA, 12 nt, Human
uaggagcaugag

SEQ ID NO: 2937956 - RNA, 19 nt, Human
uaggaaauauuuauuuuaa

SEQ ID NO: 2937957 - RNA, 18 nt, Human
uaggaaauauuuauuuua

SEQ ID NO: 2937958 - RNA, 17 nt, Human
uaggcacuuuaaaacac

SEQ ID NO: 2937959 - RNA, 16 nt, Human
uaggcacuuuaaaaca

SEQ ID NO: 2937960 - RNA, 14 nt, Human
uaggcauuguggga

SEQ ID NO: 2937961 - RNA, 20 nt, Human
uaggcauuugcugaauacag

SEQ ID NO: 2937962 - RNA, 16 nt, Human
uaggcauuugcugaau

SEQ ID NO: 2937963 - RNA, 21 nt, Human
uagggaaggauacaaaagcau

SEQ ID NO: 2937964 - RNA, 15 nt, Human
uagggagagaagaua

SEQ ID NO: 2937965 - RNA, 14 nt, Human
uagggagagaagau

SEQ ID NO: 2937966 - RNA, 18 nt, Human
uaguucagguaacaggca

SEQ ID NO: 2937967 - RNA, 20 nt, Human
uaguuccaccaucaagccac

SEQ ID NO: 2937968 - RNA, 23 nt, Human
acaccauaagcuacugccauccu

SEQ ID NO: 2937969 - RNA, 21 nt, Human
acaccauaagcuacugccauc

SEQ ID NO: 2937970 - RNA, 22 nt, Human
acaccauaagcuacugccaucc

SEQ ID NO: 2937971 - RNA, 18 nt, Human
acacaugauccugcaauu

SEQ ID NO: 2937972 - RNA, 21 nt, Human
acacaugagcaucaggccagg

SEQ ID NO: 2937973 - RNA, 15 nt, Human
acacaugaaguccaa

SEQ ID NO: 2937974 - RNA, 15 nt, Human
acacaucagcuugcc

SEQ ID NO: 2937975 - RNA, 13 nt, Human
acacauuuuauuu

SEQ ID NO: 2937976 - RNA, 14 nt, Human
acacauuuuauuuu

SEQ ID NO: 2937977 - RNA, 19 nt, Human
acacauuuuauuuuauuau

SEQ ID NO: 2937978 - RNA, 20 nt, Human
acacauuuuauuuuauuaug

SEQ ID NO: 2937979 - RNA, 21 nt, Human
acaccucugcacaagcugcac

SEQ ID NO: 2937980 - RNA, 19 nt, Human
acaccucugcacaagcugc

SEQ ID NO: 2937981 - RNA, 16 nt, Human
acaccgggcacucaga

SEQ ID NO: 2937982 - RNA, 19 nt, Human
acacccugugauggggccc

SEQ ID NO: 2937983 - RNA, 20 nt, Human
acacuaaccacgcuggaccu

SEQ ID NO: 2937984 - RNA, 20 nt, Human
uauaacuuuuuauauucuca

SEQ ID NO: 2937985 - RNA, 12 nt, Human
uauaacuuuuua

SEQ ID NO: 2937986 - RNA, 17 nt, Human
uauaacuuuuuauauuc

SEQ ID NO: 2937987 - RNA, 16 nt, Human
uauaacuuaaugaaaa

SEQ ID NO: 2937988 - RNA, 14 nt, Human
uauaacuuaaugaa

SEQ ID NO: 2937989 - RNA, 18 nt, Human
uauaacuuaaugaaaaca

SEQ ID NO: 2937990 - RNA, 19 nt, Human
uauaacuuaaugaaaacaa

SEQ ID NO: 2937991 - RNA, 20 nt, Human
acacucacauuuauucugcu

SEQ ID NO: 2937992 - RNA, 18 nt, Human
acacucaaaucaagaaac

SEQ ID NO: 2937993 - RNA, 13 nt, Human
acacuaagagaga

SEQ ID NO: 2937994 - RNA, 19 nt, Human
acacucaaaucaagaaacu

SEQ ID NO: 2937995 - RNA, 15 nt, Human
acacucaaaagcugg

SEQ ID NO: 2937996 - RNA, 17 nt, Human
acaaugugaaaagaaaa

SEQ ID NO: 2937997 - RNA, 19 nt, Human
acaaugugaaaagaaaaau

SEQ ID NO: 2937998 - RNA, 14 nt, Human
acacacacauacac

SEQ ID NO: 2937999 - RNA, 18 nt, Human
acaaugcuguauuuuaaa

SEQ ID NO: 2938000 - RNA, 22 nt, Human
acaaugcuguauuuuaaaagaa

SEQ ID NO: 2938001 - RNA, 21 nt, Human
acaaugcugugcccuaaagug

SEQ ID NO: 2938002 - RNA, 22 nt, Human
acaaugcugugcccuaaagugu

SEQ ID NO: 2938003 - RNA, 23 nt, Human
acaaugcugugcccuaaagugua

SEQ ID NO: 2938004 - RNA, 24 nt, Human
acaaugcugugcccuaaaguguau

SEQ ID NO: 2938005 - RNA, 22 nt, Human
acacacacgcgugcacacacca

SEQ ID NO: 2938006 - RNA, 17 nt, Human
acacacagcucuguccu

SEQ ID NO: 2938007 - RNA, 13 nt, Human
acacacagcucug

SEQ ID NO: 2938008 - RNA, 14 nt, Human
acacacagcucugu

SEQ ID NO: 2938009 - RNA, 14 nt, Human
acacaccagagccc

SEQ ID NO: 2938010 - RNA, 15 nt, Human
acacaccagagccca

SEQ ID NO: 2938011 - RNA, 20 nt, Human
acacaccagagcccaccuug

SEQ ID NO: 2938012 - RNA, 21 nt, Human
acacacgcgugcacacaccag

SEQ ID NO: 2938013 - RNA, 21 nt, Human
acacacugcauguuugugauu

SEQ ID NO: 2938014 - RNA, 15 nt, Human
acacacucaaaucaa

SEQ ID NO: 2938015 - RNA, 19 nt, Human
acacauaagccaaaacuga

SEQ ID NO: 2938016 - RNA, 13 nt, Human
acacagugagucg

SEQ ID NO: 2938017 - RNA, 19 nt, Human
acacaguauuacuucugcu

SEQ ID NO: 2938018 - RNA, 22 nt, Human
acacaguauuacuucugcuaca

SEQ ID NO: 2938019 - RNA, 20 nt, Human
acacacuguacacauaagcc

SEQ ID NO: 2938020 - RNA, 17 nt, Human
acacacuguacacauaa

SEQ ID NO: 2938021 - RNA, 18 nt, Human
acacaguauuacuucugc

SEQ ID NO: 2938022 - RNA, 16 nt, Human
acacaguauuacuucu

SEQ ID NO: 2938023 - RNA, 23 nt, Human
uaguguuggagaagaacugaaau

SEQ ID NO: 2938024 - RNA, 22 nt, Human
uaguguuuucaauuuuaaacau

SEQ ID NO: 2938025 - RNA, 23 nt, Human
uaguguuuucaauuuuaaacaua

SEQ ID NO: 2938026 - RNA, 21 nt, Human
uaguguuuucaauuuuaaaca

SEQ ID NO: 2938027 - RNA, 17 nt, Human
uaguguuggagaagaac

SEQ ID NO: 2938028 - RNA, 22 nt, Human
uagugaaacucguuaauuugua

SEQ ID NO: 2938029 - RNA, 15 nt, Human
acagacccugcccug

SEQ ID NO: 2938030 - RNA, 14 nt, Human
acagacccugcccu

SEQ ID NO: 2938031 - RNA, 13 nt, Human
acagacccugccc

SEQ ID NO: 2938032 - RNA, 15 nt, Human
uauauuguuugcuaa

SEQ ID NO: 2938033 - RNA, 17 nt, Human
acagaaauguacagcaa

SEQ ID NO: 2938034 - RNA, 14 nt, Human
acagaaauguacag

SEQ ID NO: 2938035 - RNA, 16 nt, Human
acagaaauguacagca

SEQ ID NO: 2938036 - RNA, 17 nt, Human
acagaaaauucuucucc

SEQ ID NO: 2938037 - RNA, 13 nt, Human
acagaaauguaca

SEQ ID NO: 2938038 - RNA, 20 nt, Human
acagaaaauggaagacagcu

SEQ ID NO: 2938039 - RNA, 19 nt, Human
uauaauuuugugaagcaaa

SEQ ID NO: 2938040 - RNA, 15 nt, Human
uaucaaguauagaaa

SEQ ID NO: 2938041 - RNA, 16 nt, Human
uaucaaguauagaaaa

SEQ ID NO: 2938042 - RNA, 19 nt, Human
uaucaaguauagaaaaucu

SEQ ID NO: 2938043 - RNA, 17 nt, Human
uaucccuuggacauuuu

SEQ ID NO: 2938044 - RNA, 19 nt, Human
uaucccuuggacauuuuau

SEQ ID NO: 2938045 - RNA, 18 nt, Human
uaucccuuggacauuuua

SEQ ID NO: 2938046 - RNA, 12 nt, Human
uauccuaauaaa

SEQ ID NO: 2938047 - RNA, 18 nt, Human
uauccuaauaaaaaggug

SEQ ID NO: 2938048 - RNA, 15 nt, Human
uauccuaauaaaaag

SEQ ID NO: 2938049 - RNA, 19 nt, Human
uauccuaauaaaaagguga

SEQ ID NO: 2938050 - RNA, 22 nt, Human
uauccuaauaaaaaggugacca

SEQ ID NO: 2938051 - RNA, 15 nt, Human
uaucuauauuuuaca

SEQ ID NO: 2938052 - RNA, 11 nt, Human
acagagaaagu

SEQ ID NO: 2938053 - RNA, 18 nt, Human
acagagaaaguacuucuc

SEQ ID NO: 2938054 - RNA, 13 nt, Human
uaucucccccagc

SEQ ID NO: 2938055 - RNA, 14 nt, Human
uaucucccccagcc

SEQ ID NO: 2938056 - RNA, 23 nt, Human
uaucuauauuuuacauaaauuua

SEQ ID NO: 2938057 - RNA, 18 nt, Human
acagauugaauuugccua

SEQ ID NO: 2938058 - RNA, 12 nt, Human
acagauugaauu

SEQ ID NO: 2938059 - RNA, 12 nt, Human
acagaugaaaag

SEQ ID NO: 2938060 - RNA, 17 nt, Human
acagcaaggagauuuac

SEQ ID NO: 2938061 - RNA, 14 nt, Human
acagagcccacgcc

SEQ ID NO: 2938062 - RNA, 15 nt, Human
acagagcccacgccc

SEQ ID NO: 2938063 - RNA, 19 nt, Human
acagagcccacgcccccac

SEQ ID NO: 2938064 - RNA, 18 nt, Human
acagagcccacgccccca

SEQ ID NO: 2938065 - RNA, 16 nt, Human
acagcaaggagauuua

SEQ ID NO: 2938066 - RNA, 21 nt, Human
acagcaaggagauuuacaacu

SEQ ID NO: 2938067 - RNA, 17 nt, Human
acagcccgggcucugcc

SEQ ID NO: 2938068 - RNA, 19 nt, Human
acagcccgggcucugccuc

SEQ ID NO: 2938069 - RNA, 18 nt, Human
acagcccgggcucugccu

SEQ ID NO: 2938070 - RNA, 21 nt, Human
uaugaaauauuauguuaaaac

SEQ ID NO: 2938071 - RNA, 16 nt, Human
uaugauuaaguaauga

SEQ ID NO: 2938072 - RNA, 20 nt, Human
uaugauuaaguaaugauaac

SEQ ID NO: 2938073 - RNA, 21 nt, Human
uaugauuaaguaaugauaacu

SEQ ID NO: 2938074 - RNA, 11 nt, Human
uaugcauuuga

SEQ ID NO: 2938075 - RNA, 23 nt, Human
uaugcauuugaaaauuuugaugu

SEQ ID NO: 2938076 - RNA, 24 nt, Human
uaugcauuugaaaauuuugauguu

SEQ ID NO: 2938077 - RNA, 17 nt, Human
uaugccugggcagaagg

SEQ ID NO: 2938078 - RNA, 19 nt, Human
uaugccccauucaacaucu

SEQ ID NO: 2938079 - RNA, 15 nt, Human
uaugccccauucaac

SEQ ID NO: 2938080 - RNA, 15 nt, Human
uaugcuuauacacuu

SEQ ID NO: 2938081 - RNA, 18 nt, Human
uauggcuuuugugcauua

SEQ ID NO: 2938082 - RNA, 21 nt, Human
uauggcuuuugugcauuaucu

SEQ ID NO: 2938083 - RNA, 17 nt, Human
uauggcuuuugugcauu

SEQ ID NO: 2938084 - RNA, 13 nt, Human
uauggguuuggcu

SEQ ID NO: 2938085 - RNA, 16 nt, Human
acagccucuuagaugc

SEQ ID NO: 2938086 - RNA, 19 nt, Human
acaggcuuagugauguaau

SEQ ID NO: 2938087 - RNA, 20 nt, Human
acaggcuuagugauguaauu

SEQ ID NO: 2938088 - RNA, 20 nt, Human
acagggaggacgcucucugg

SEQ ID NO: 2938089 - RNA, 21 nt, Human
acagggaggacgcucucuggc

SEQ ID NO: 2938090 - RNA, 12 nt, Human
acaggcugggcu

SEQ ID NO: 2938091 - RNA, 22 nt, Human
acaggcugggcuucaguggcag

SEQ ID NO: 2938092 - RNA, 23 nt, Human
acaggcugggcuucaguggcagc

SEQ ID NO: 2938093 - RNA, 14 nt, Human
acaggcuuagugau

SEQ ID NO: 2938094 - RNA, 13 nt, Human
acaguaauaaaug

SEQ ID NO: 2938095 - RNA, 12 nt, Human
acagggcacacc

SEQ ID NO: 2938096 - RNA, 20 nt, Human
acagggcacaccgggcacuc

SEQ ID NO: 2938097 - RNA, 16 nt, Human
acagucaccucaugga

SEQ ID NO: 2938098 - RNA, 17 nt, Human
acagucaccucauggaa

SEQ ID NO: 2938099 - RNA, 18 nt, Human
acagucaccucauggaau

SEQ ID NO: 2938100 - RNA, 23 nt, Human
uauucaaacagucucaggaaauc

SEQ ID NO: 2938101 - RNA, 15 nt, Human
uauucaaacagucuc

SEQ ID NO: 2938102 - RNA, 13 nt, Human
uauuacuucugcu

SEQ ID NO: 2938103 - RNA, 14 nt, Human
uauuacuucugcua

SEQ ID NO: 2938104 - RNA, 14 nt, Human
uauuacuguaagaa

SEQ ID NO: 2938105 - RNA, 18 nt, Human
uauucaguggcuaacuug

SEQ ID NO: 2938106 - RNA, 20 nt, Human
uauucaguaauaacucuacc

SEQ ID NO: 2938107 - RNA, 14 nt, Human
uauucaggaagcuc

SEQ ID NO: 2938108 - RNA, 17 nt, Human
acaggaaguagaggagg

SEQ ID NO: 2938109 - RNA, 13 nt, Human
acaggaaguacug

SEQ ID NO: 2938110 - RNA, 15 nt, Human
acaggaaaagcugcu

SEQ ID NO: 2938111 - RNA, 16 nt, Human
acaggaaaagcugcug

SEQ ID NO: 2938112 - RNA, 17 nt, Human
acaggaaaagcugcuga

SEQ ID NO: 2938113 - RNA, 22 nt, Human
acaggaaccacaagacugcaca

SEQ ID NO: 2938114 - RNA, 13 nt, Human
acagcuaacaugg

SEQ ID NO: 2938115 - RNA, 14 nt, Human
acaggcauguucuc

SEQ ID NO: 2938116 - RNA, 14 nt, Human
acaggcagguccag

SEQ ID NO: 2938117 - RNA, 16 nt, Human
acaggcagguccaggg

SEQ ID NO: 2938118 - RNA, 16 nt, Human
acaggagugagcacua

SEQ ID NO: 2938119 - RNA, 14 nt, Human
acaggaucagucug

SEQ ID NO: 2938120 - RNA, 13 nt, Human
acaggcaggucca

SEQ ID NO: 2938121 - RNA, 14 nt, Human
acaggacauauauu

SEQ ID NO: 2938122 - RNA, 17 nt, Human
acaggacauauauuuuu

SEQ ID NO: 2938123 - RNA, 23 nt, Human
acaggaccagggauuuccaugau

SEQ ID NO: 2938124 - RNA, 22 nt, Human
acaggcauguucucugaggaca

SEQ ID NO: 2938125 - RNA, 15 nt, Human
acaggcauguucucu

SEQ ID NO: 2938126 - RNA, 18 nt, Human
acaggcauguucucugag

SEQ ID NO: 2938127 - RNA, 19 nt, Human
acaggcauguucucugagg

SEQ ID NO: 2938128 - RNA, 20 nt, Human
acaggcauguucucugagga

SEQ ID NO: 2938129 - RNA, 20 nt, Human
uauguggaguucaucuugaa

SEQ ID NO: 2938130 - RNA, 12 nt, Human
uaugugaacagu

SEQ ID NO: 2938131 - RNA, 22 nt, Human
uaugugaacaguuguguuugaa

SEQ ID NO: 2938132 - RNA, 23 nt, Human
uauguuuuuguucaguuuaucug

SEQ ID NO: 2938133 - RNA, 16 nt, Human
uauuaaaacucauuuu

SEQ ID NO: 2938134 - RNA, 13 nt, Human
uauguguaauaaa

SEQ ID NO: 2938135 - RNA, 16 nt, Human
uauguguaauaaauau

SEQ ID NO: 2938136 - RNA, 21 nt, Human
uauguuuucaggcuagaugua

SEQ ID NO: 2938137 - RNA, 20 nt, Human
uacucugccacuuuauuucu

SEQ ID NO: 2938138 - RNA, 12 nt, Human
uacucuguguca

SEQ ID NO: 2938139 - RNA, 16 nt, Human
uacuggagaaaaugga

SEQ ID NO: 2938140 - RNA, 13 nt, Human
uacuguaagaaaa

SEQ ID NO: 2938141 - RNA, 14 nt, Human
uacuguaagaaaau

SEQ ID NO: 2938142 - RNA, 19 nt, Human
uacuguaauuugugauaca

SEQ ID NO: 2938143 - RNA, 20 nt, Human
uacuguaauuugugauacaa

SEQ ID NO: 2938144 - RNA, 18 nt, Human
uacuguaauuugugauac

SEQ ID NO: 2938145 - RNA, 18 nt, Human
uacuguacaugaaaacac

SEQ ID NO: 2938146 - RNA, 22 nt, Human
uacuguacaugaaaacacauuu

SEQ ID NO: 2938147 - RNA, 21 nt, Human
uacuguacaugaaaacacauu

SEQ ID NO: 2938148 - RNA, 22 nt, Human
aauugacccacaagaaaugaaa

SEQ ID NO: 2938149 - RNA, 21 nt, Human
aauugacccacaagaaaugaa

SEQ ID NO: 2938150 - RNA, 13 nt, Human
uacuacuccugua

SEQ ID NO: 2938151 - RNA, 17 nt, Human
uacuacuccuguaggaa

SEQ ID NO: 2938152 - RNA, 23 nt, Human
uacuauggcccuggccuagcaua

SEQ ID NO: 2938153 - RNA, 12 nt, Human
uacuauguauca

SEQ ID NO: 2938154 - RNA, 13 nt, Human
uacuauguaucaa

SEQ ID NO: 2938155 - RNA, 14 nt, Human
uacuauguaucaau

SEQ ID NO: 2938156 - RNA, 22 nt, Human
uacucuccuggaaauauuaaga

SEQ ID NO: 2938157 - RNA, 23 nt, Human
uacucuccuggaaauauuaagaa

SEQ ID NO: 2938158 - RNA, 18 nt, Human
uacgggaggguaaggcug

SEQ ID NO: 2938159 - RNA, 12 nt, Human
uacguacacauu

SEQ ID NO: 2938160 - RNA, 13 nt, Human
uacguacacauuu

SEQ ID NO: 2938161 - RNA, 15 nt, Human
uacguugugcauuug

SEQ ID NO: 2938162 - RNA, 16 nt, Human
uacguugugcauuugg

SEQ ID NO: 2938163 - RNA, 22 nt, Human
uacgccaggggaaaaucagccu

SEQ ID NO: 2938164 - RNA, 15 nt, Human
aauuccuaaaauuau

SEQ ID NO: 2938165 - RNA, 20 nt, Human
aauuauucuauaauuuccau

SEQ ID NO: 2938166 - RNA, 23 nt, Human
aauuauucuauaauuuccauuua

SEQ ID NO: 2938167 - RNA, 17 nt, Human
aauuauugauguuuuca

SEQ ID NO: 2938168 - RNA, 22 nt, Human
aauuagguugaaacauaucucu

SEQ ID NO: 2938169 - RNA, 15 nt, Human
aauuagguugaaaca

SEQ ID NO: 2938170 - RNA, 17 nt, Human
aauuagguugaaacaua

SEQ ID NO: 2938171 - RNA, 18 nt, Human
aauuagguugaaacauau

SEQ ID NO: 2938172 - RNA, 14 nt, Human
aauuagguugaaac

SEQ ID NO: 2938173 - RNA, 13 nt, Human
aauucacaaagua

SEQ ID NO: 2938174 - RNA, 17 nt, Human
aauucacaaaguaauuu

SEQ ID NO: 2938175 - RNA, 18 nt, Human
aauuccaagugauugaaa

SEQ ID NO: 2938176 - RNA, 12 nt, Human
aauuccccagau

SEQ ID NO: 2938177 - RNA, 14 nt, Human
aauuccccacccug

SEQ ID NO: 2938178 - RNA, 22 nt, Human
aauuccacuuauaggaauugac

SEQ ID NO: 2938179 - RNA, 23 nt, Human
uaccugccaggaagccagcaggc

SEQ ID NO: 2938180 - RNA, 20 nt, Human
uaccugccaggaagccagca

SEQ ID NO: 2938181 - RNA, 18 nt, Human
uaccugccaggaagccag

SEQ ID NO: 2938182 - RNA, 10 nt, Human
uaccuguccc

SEQ ID NO: 2938183 - RNA, 17 nt, Human
uaccugucccccugaca

SEQ ID NO: 2938184 - RNA, 16 nt, Human
uaccugucccccugac

SEQ ID NO: 2938185 - RNA, 14 nt, Human
uaccugucccccug

SEQ ID NO: 2938186 - RNA, 13 nt, Human
uaccugucccccu

SEQ ID NO: 2938187 - RNA, 11 nt, Human
aauuacaggaa

SEQ ID NO: 2938188 - RNA, 15 nt, Human
aauuagccaagugug

SEQ ID NO: 2938189 - RNA, 12 nt, Human
aauggcagccuu

SEQ ID NO: 2938190 - RNA, 16 nt, Human
aauggcagccuuggca

SEQ ID NO: 2938191 - RNA, 22 nt, Human
uacagaguggaauaagacagag

SEQ ID NO: 2938192 - RNA, 20 nt, Human
uacagaguggaauaagacag

SEQ ID NO: 2938193 - RNA, 19 nt, Human
uacagacaaagcguggugg

SEQ ID NO: 2938194 - RNA, 22 nt, Human
uacagacaacaaaccuguuucu

SEQ ID NO: 2938195 - RNA, 19 nt, Human
uacacauuuuauuuuauua

SEQ ID NO: 2938196 - RNA, 21 nt, Human
uacacauuuuauuuuauuaug

SEQ ID NO: 2938197 - RNA, 22 nt, Human
uacacauuuuauuuuauuaugc

SEQ ID NO: 2938198 - RNA, 14 nt, Human
uacacuaagagaga

SEQ ID NO: 2938199 - RNA, 23 nt, Human
uacacauuuuauuuuauuaugca

SEQ ID NO: 2938200 - RNA, 15 nt, Human
uacacuaaaagguga

SEQ ID NO: 2938201 - RNA, 21 nt, Human
aaugcacuuuguucuggcucu

SEQ ID NO: 2938202 - RNA, 17 nt, Human
aaugaccuuucaauagg

SEQ ID NO: 2938203 - RNA, 16 nt, Human
aaugaccuuucaauag

SEQ ID NO: 2938204 - RNA, 18 nt, Human
aaugaccuuucaauagga

SEQ ID NO: 2938205 - RNA, 21 nt, Human
uacaaugcugugcccuaaagu

SEQ ID NO: 2938206 - RNA, 22 nt, Human
aaugcacuuuguucuggcucuu

SEQ ID NO: 2938207 - RNA, 21 nt, Human
aauggacguguuaugacucca

SEQ ID NO: 2938208 - RNA, 14 nt, Human
aauggaaccacucu

SEQ ID NO: 2938209 - RNA, 20 nt, Human
aauggacuaacuugucuuug

SEQ ID NO: 2938210 - RNA, 23 nt, Human
aauggacguguuaugacuccaga

SEQ ID NO: 2938211 - RNA, 21 nt, Human
aauggaaaugggcagagcaga

SEQ ID NO: 2938212 - RNA, 20 nt, Human
aauggaaaugggcagagcag

SEQ ID NO: 2938213 - RNA, 12 nt, Human
aaugcccagccc

SEQ ID NO: 2938214 - RNA, 11 nt, Human
aaugcccagcc

SEQ ID NO: 2938215 - RNA, 16 nt, Human
aaugcuguauuuuaaa

SEQ ID NO: 2938216 - RNA, 16 nt, Human
uacaggugugagucac

SEQ ID NO: 2938217 - RNA, 24 nt, Human
uacauaaugcgugcauaccacuuu

SEQ ID NO: 2938218 - RNA, 21 nt, Human
uacauaaugcgugcauaccac

SEQ ID NO: 2938219 - RNA, 23 nt, Human
uacauaaugcgugcauaccacuu

SEQ ID NO: 2938220 - RNA, 20 nt, Human
uacaucccuuaccugggaaa

SEQ ID NO: 2938221 - RNA, 15 nt, Human
aaugugaaacuggau

SEQ ID NO: 2938222 - RNA, 14 nt, Human
aaugugaaacugga

SEQ ID NO: 2938223 - RNA, 19 nt, Human
aaugugaaaagaaaaauga

SEQ ID NO: 2938224 - RNA, 19 nt, Human
aauguauguguaaguauuc

SEQ ID NO: 2938225 - RNA, 20 nt, Human
aauguauguguaaguauucu

SEQ ID NO: 2938226 - RNA, 17 nt, Human
aaugugaaaagaaaaau

SEQ ID NO: 2938227 - RNA, 22 nt, Human
aauguauuacaguggggaauga

SEQ ID NO: 2938228 - RNA, 21 nt, Human
aauguucucucuucuccaccu

SEQ ID NO: 2938229 - RNA, 11 nt, Human
aauuaacuuuu

SEQ ID NO: 2938230 - RNA, 21 nt, Human
aauuaaugucaguauuucaac

SEQ ID NO: 2938231 - RNA, 20 nt, Human
uacauguguguauauguaga

SEQ ID NO: 2938232 - RNA, 16 nt, Human
uacauguguguauaug

SEQ ID NO: 2938233 - RNA, 18 nt, Human
uaccaccagucugacugu

SEQ ID NO: 2938234 - RNA, 13 nt, Human
uacauucuguuaa

SEQ ID NO: 2938235 - RNA, 18 nt, Human
uaagcacacuugacauca

SEQ ID NO: 2938236 - RNA, 22 nt, Human
uaagcuguuacugucuucagua

SEQ ID NO: 2938237 - RNA, 16 nt, Human
aaucaggguuaguauu

SEQ ID NO: 2938238 - RNA, 21 nt, Human
aaucaggguuaguauugucca

SEQ ID NO: 2938239 - RNA, 22 nt, Human
aaucaggguuaguauuguccag

SEQ ID NO: 2938240 - RNA, 22 nt, Human
aauaugcacacauuuuuuaaau

SEQ ID NO: 2938241 - RNA, 16 nt, Human
aauaugcacacauuuu

SEQ ID NO: 2938242 - RNA, 17 nt, Human
aauaugcacacauuuuu

SEQ ID NO: 2938243 - RNA, 21 nt, Human
uaagacuuaguacuaucugug

SEQ ID NO: 2938244 - RNA, 15 nt, Human
uaagagaaaugagcu

SEQ ID NO: 2938245 - RNA, 21 nt, Human
aauaugccccauucaacaucu

SEQ ID NO: 2938246 - RNA, 24 nt, Human
aauaugccccauucaacaucuagu

SEQ ID NO: 2938247 - RNA, 15 nt, Human
aauauuuauuuuaau

SEQ ID NO: 2938248 - RNA, 19 nt, Human
aauauuuauuuuaauaaug

SEQ ID NO: 2938249 - RNA, 18 nt, Human
aauauuuauuuuaauaau

SEQ ID NO: 2938250 - RNA, 13 nt, Human
aauauuuaaucuu

SEQ ID NO: 2938251 - RNA, 13 nt, Human
uaacuucacauau

SEQ ID NO: 2938252 - RNA, 21 nt, Human
uaacuucacauauugauuucc

SEQ ID NO: 2938253 - RNA, 14 nt, Human
uaacuucaccauau

SEQ ID NO: 2938254 - RNA, 17 nt, Human
uaacuuccaauuuacau

SEQ ID NO: 2938255 - RNA, 20 nt, Human
uaacgauaaaagacagugaa

SEQ ID NO: 2938256 - RNA, 16 nt, Human
uaacuuucugaaauaa

SEQ ID NO: 2938257 - RNA, 13 nt, Human
uaagacagagacc

SEQ ID NO: 2938258 - RNA, 18 nt, Human
uaagaagugaaaaucuac

SEQ ID NO: 2938259 - RNA, 21 nt, Human
aauaguucagguaacaggcag

SEQ ID NO: 2938260 - RNA, 13 nt, Human
aauaguuggcuag

SEQ ID NO: 2938261 - RNA, 22 nt, Human
aauaguggugugauuuggggau

SEQ ID NO: 2938262 - RNA, 16 nt, Human
aauaguggugugauuu

SEQ ID NO: 2938263 - RNA, 16 nt, Human
aauagucaaauugugu

SEQ ID NO: 2938264 - RNA, 18 nt, Human
uaacauggacaugaucuu

SEQ ID NO: 2938265 - RNA, 23 nt, Human
uaacauggacaugaucuucuuua

SEQ ID NO: 2938266 - RNA, 22 nt, Human
aauaucacuugucaauaaaauc

SEQ ID NO: 2938267 - RNA, 20 nt, Human
aauaucacuugucaauaaaa

SEQ ID NO: 2938268 - RNA, 13 nt, Human
uaauguacugcau

SEQ ID NO: 2938269 - RNA, 17 nt, Human
uaaugucaguauuucaa

SEQ ID NO: 2938270 - RNA, 18 nt, Human
uaaugucacaggcagguc

SEQ ID NO: 2938271 - RNA, 17 nt, Human
aaugaaacauuuuguca

SEQ ID NO: 2938272 - RNA, 17 nt, Human
aaugaaaccugugucuc

SEQ ID NO: 2938273 - RNA, 16 nt, Human
aaugaaagacuguaca

SEQ ID NO: 2938274 - RNA, 17 nt, Human
aaugaaagacuguacaa

SEQ ID NO: 2938275 - RNA, 15 nt, Human
aaugaccuuucaaua

SEQ ID NO: 2938276 - RNA, 22 nt, Human
aaugaaugucagugugacugau

SEQ ID NO: 2938277 - RNA, 13 nt, Human
aaugaaugucacu

SEQ ID NO: 2938278 - RNA, 13 nt, Human
aaugaaugucagu

SEQ ID NO: 2938279 - RNA, 22 nt, Human
aaugaauggcuaagcaaaaugu

SEQ ID NO: 2938280 - RNA, 18 nt, Human
uaauagacaauuuauuau

SEQ ID NO: 2938281 - RNA, 22 nt, Human
uaauagacaauuuauuauggca

SEQ ID NO: 2938282 - RNA, 16 nt, Human
uaauacaccacuacau

SEQ ID NO: 2938283 - RNA, 14 nt, Human
uaauacaccacuac

SEQ ID NO: 2938284 - RNA, 18 nt, Human
uaauacaccacuacauuc

SEQ ID NO: 2938285 - RNA, 19 nt, Human
uaauacaccacuacauucu

SEQ ID NO: 2938286 - RNA, 14 nt, Human
uaauagacaauuua

SEQ ID NO: 2938287 - RNA, 16 nt, Human
uaauagacaauuuauu

SEQ ID NO: 2938288 - RNA, 13 nt, Human
uaaugaaaacaau

SEQ ID NO: 2938289 - RNA, 16 nt, Human
uaaugaaaacaaugca

SEQ ID NO: 2938290 - RNA, 17 nt, Human
uaaugaaugaaacauuu

SEQ ID NO: 2938291 - RNA, 11 nt, Human
uaaucuuuuau

SEQ ID NO: 2938292 - RNA, 13 nt, Human
uaaucuuucacag

SEQ ID NO: 2938293 - RNA, 12 nt, Human
uaauaaacucau

SEQ ID NO: 2938294 - RNA, 12 nt, Human
aaucaugaauua

SEQ ID NO: 2938295 - RNA, 15 nt, Human
aaucaugaauuaguu

SEQ ID NO: 2938296 - RNA, 19 nt, Human
uaaguauucuuauuuaaug

SEQ ID NO: 2938297 - RNA, 20 nt, Human
uaaguauucuuauuuaauga

SEQ ID NO: 2938298 - RNA, 17 nt, Human
uaaguacuauguaucaa

SEQ ID NO: 2938299 - RNA, 13 nt, Human
uaaguacuaugua

SEQ ID NO: 2938300 - RNA, 16 nt, Human
uaaguacuauguauca

SEQ ID NO: 2938301 - RNA, 16 nt, Human
uaagcuuguauuccuu

SEQ ID NO: 2938302 - RNA, 19 nt, Human
uaaguaaugauaacuggaa

SEQ ID NO: 2938303 - RNA, 15 nt, Human
aaucauuagguguga

SEQ ID NO: 2938304 - RNA, 17 nt, Human
aaucauuaggugugacu

SEQ ID NO: 2938305 - RNA, 23 nt, Human
aaucauuaggugugacugaauuu

SEQ ID NO: 2938306 - RNA, 23 nt, Human
aaucgcuccaccuugcagcucuc

SEQ ID NO: 2938307 - RNA, 19 nt, Human
aaucuggauucauauuuaa

SEQ ID NO: 2938308 - RNA, 18 nt, Human
aaucuggauucauauuua

SEQ ID NO: 2938309 - RNA, 17 nt, Human
aaucuggauucauauuu

SEQ ID NO: 2938310 - RNA, 16 nt, Human
aaucuggauucauauu

SEQ ID NO: 2938311 - RNA, 19 nt, Human
aaucuacacuccagugaga

SEQ ID NO: 2938312 - RNA, 19 nt, Human
aaucuuauaauuuaaaaua

SEQ ID NO: 2938313 - RNA, 23 nt, Human
ucacuugaacccgggaggcagag

SEQ ID NO: 2938314 - RNA, 10 nt, Human
ucacuugagu

SEQ ID NO: 2938315 - RNA, 15 nt, Human
accaguguuguggau

SEQ ID NO: 2938316 - RNA, 17 nt, Human
accaguguuguggauuu

SEQ ID NO: 2938317 - RNA, 14 nt, Human
accagucugacugu

SEQ ID NO: 2938318 - RNA, 23 nt, Human
ucacuguugcccaggcuggcgug

SEQ ID NO: 2938319 - RNA, 19 nt, Human
ucacuguugcccaggcugg

SEQ ID NO: 2938320 - RNA, 15 nt, Human
ucacugcagccucaa

SEQ ID NO: 2938321 - RNA, 13 nt, Human
ucacugcagccuc

SEQ ID NO: 2938322 - RNA, 16 nt, Human
ucacugagacagcccg

SEQ ID NO: 2938323 - RNA, 14 nt, Human
ucacugcagccuca

SEQ ID NO: 2938324 - RNA, 22 nt, Human
ucacugagacagcccgggcucu

SEQ ID NO: 2938325 - RNA, 21 nt, Human
ucacugagacagcccgggcuc

SEQ ID NO: 2938326 - RNA, 17 nt, Human
ucacugagacagcccgg

SEQ ID NO: 2938327 - RNA, 22 nt, Human
accagcgugugacuacuccccc

SEQ ID NO: 2938328 - RNA, 17 nt, Human
accacuacauucuguua

SEQ ID NO: 2938329 - RNA, 16 nt, Human
accacuacauucuguu

SEQ ID NO: 2938330 - RNA, 15 nt, Human
accacuacauucugu

SEQ ID NO: 2938331 - RNA, 14 nt, Human
ucaccucauggaau

SEQ ID NO: 2938332 - RNA, 12 nt, Human
ucaccucaugga

SEQ ID NO: 2938333 - RNA, 13 nt, Human
ucaccucauggaa

SEQ ID NO: 2938334 - RNA, 16 nt, Human
ucaauucuugccaaau

SEQ ID NO: 2938335 - RNA, 12 nt, Human
ucaauugugaaa

SEQ ID NO: 2938336 - RNA, 16 nt, Human
ucaauugugaaaaaau

SEQ ID NO: 2938337 - RNA, 13 nt, Human
ucaauuuuaaaca

SEQ ID NO: 2938338 - RNA, 14 nt, Human
ucaauuuuaaacau

SEQ ID NO: 2938339 - RNA, 15 nt, Human
ucaauuuuaaacaua

SEQ ID NO: 2938340 - RNA, 16 nt, Human
ucaauuuuaaacauau

SEQ ID NO: 2938341 - RNA, 21 nt, Human
ucacaacagauuauuaccuua

SEQ ID NO: 2938342 - RNA, 17 nt, Human
ucacaaaggaugcccaa

SEQ ID NO: 2938343 - RNA, 13 nt, Human
ucacagccucuga

SEQ ID NO: 2938344 - RNA, 20 nt, Human
ucacaguucucuccuucuuc

SEQ ID NO: 2938345 - RNA, 16 nt, Human
ucacaguucucuccuu

SEQ ID NO: 2938346 - RNA, 16 nt, Human
ucacacugucuucuga

SEQ ID NO: 2938347 - RNA, 20 nt, Human
ucacagaugggugcuuggag

SEQ ID NO: 2938348 - RNA, 17 nt, Human
accacaucuugcucugc

SEQ ID NO: 2938349 - RNA, 18 nt, Human
accacaucuugcucugcu

SEQ ID NO: 2938350 - RNA, 19 nt, Human
accacaucuugcucugcug

SEQ ID NO: 2938351 - RNA, 18 nt, Human
accacaugugcacaugca

SEQ ID NO: 2938352 - RNA, 16 nt, Human
accacaucuugcucug

SEQ ID NO: 2938353 - RNA, 15 nt, Human
accaccacacccagc

SEQ ID NO: 2938354 - RNA, 20 nt, Human
accaccacacccagcccacu

SEQ ID NO: 2938355 - RNA, 15 nt, Human
acauguaauuaagua

SEQ ID NO: 2938356 - RNA, 17 nt, Human
acauguaauuaaguacu

SEQ ID NO: 2938357 - RNA, 19 nt, Human
acauguaauuaaguacuau

SEQ ID NO: 2938358 - RNA, 21 nt, Human
acauguaauuaaguacuaugu

SEQ ID NO: 2938359 - RNA, 22 nt, Human
acauguaauuaaguacuaugua

SEQ ID NO: 2938360 - RNA, 22 nt, Human
acauggcuggagcuagaauuug

SEQ ID NO: 2938361 - RNA, 11 nt, Human
acaugggacau

SEQ ID NO: 2938362 - RNA, 14 nt, Human
acaugggacauuug

SEQ ID NO: 2938363 - RNA, 21 nt, Human
acaugggacauuugcucaugg

SEQ ID NO: 2938364 - RNA, 15 nt, Human
acaugggacauuugc

SEQ ID NO: 2938365 - RNA, 20 nt, Human
acaugggacauuugcucaug

SEQ ID NO: 2938366 - RNA, 16 nt, Human
acaugaaguccaagca

SEQ ID NO: 2938367 - RNA, 16 nt, Human
acaugagguacugaga

SEQ ID NO: 2938368 - RNA, 20 nt, Human
acaugagguacugagaguga

SEQ ID NO: 2938369 - RNA, 20 nt, Human
acaugcuguacauacuuuuu

SEQ ID NO: 2938370 - RNA, 21 nt, Human
acaugcuguacauacuuuuug

SEQ ID NO: 2938371 - RNA, 23 nt, Human
acaugagguacugagagugaaca

SEQ ID NO: 2938372 - RNA, 15 nt, Human
acaugcuacacacug

SEQ ID NO: 2938373 - RNA, 21 nt, Human
acaugcuacacacugcauguu

SEQ ID NO: 2938374 - RNA, 20 nt, Human
ucaacugcaucaagauguga

SEQ ID NO: 2938375 - RNA, 14 nt, Human
ucaaccagcagaug

SEQ ID NO: 2938376 - RNA, 17 nt, Human
ucaacauuucucauguu

SEQ ID NO: 2938377 - RNA, 13 nt, Human
ucaaauuucuaaa

SEQ ID NO: 2938378 - RNA, 23 nt, Human
acauguaauuaaguacuauguau

SEQ ID NO: 2938379 - RNA, 11 nt, Human
acauucccugc

SEQ ID NO: 2938380 - RNA, 15 nt, Human
acauguccaagaagc

SEQ ID NO: 2938381 - RNA, 14 nt, Human
acauuccugaacag

SEQ ID NO: 2938382 - RNA, 15 nt, Human
acauuccugaacagg

SEQ ID NO: 2938383 - RNA, 14 nt, Human
acauuccugaugcu

SEQ ID NO: 2938384 - RNA, 15 nt, Human
ucaaauugugugaaa

SEQ ID NO: 2938385 - RNA, 18 nt, Human
ucaaauugugugaaaggu

SEQ ID NO: 2938386 - RNA, 17 nt, Human
acauugacuauuuuugu

SEQ ID NO: 2938387 - RNA, 14 nt, Human
acauugacuauuuu

SEQ ID NO: 2938388 - RNA, 18 nt, Human
acauuuuauuuuauuaug

SEQ ID NO: 2938389 - RNA, 14 nt, Human
acauuuuauuuuau

SEQ ID NO: 2938390 - RNA, 19 nt, Human
acauuuuauuuuauuaugc

SEQ ID NO: 2938391 - RNA, 20 nt, Human
acauuuuauuuuauuaugca

SEQ ID NO: 2938392 - RNA, 23 nt, Human
accaaaaaucucaauauuucaga

SEQ ID NO: 2938393 - RNA, 21 nt, Human
acauuuuuuaaaugcaccugg

SEQ ID NO: 2938394 - RNA, 17 nt, Human
acauuuuuuaaaugcac

SEQ ID NO: 2938395 - RNA, 14 nt, Human
acauuuuuuaaaug

SEQ ID NO: 2938396 - RNA, 16 nt, Human
acauuuuuuaaaugca

SEQ ID NO: 2938397 - RNA, 21 nt, Human
acauuuuuaagugcugcauuu

SEQ ID NO: 2938398 - RNA, 22 nt, Human
acauuuuuaagugcugcauuua

SEQ ID NO: 2938399 - RNA, 23 nt, Human
acauuuuuaagugcugcauuuaa

SEQ ID NO: 2938400 - RNA, 19 nt, Human
acauuuuuaagugcugcau

SEQ ID NO: 2938401 - RNA, 19 nt, Human
ucaaucuggauucauauuu

SEQ ID NO: 2938402 - RNA, 19 nt, Human
ucaauauuucagauaauca

SEQ ID NO: 2938403 - RNA, 15 nt, Human
ucaauauuucagaua

SEQ ID NO: 2938404 - RNA, 13 nt, Human
acauugaaaucua

SEQ ID NO: 2938405 - RNA, 17 nt, Human
acauugaaaucuaggaa

SEQ ID NO: 2938406 - RNA, 19 nt, Human
acauugaaaucuaggaaaa

SEQ ID NO: 2938407 - RNA, 20 nt, Human
acauugaaaucuaggaaaau

SEQ ID NO: 2938408 - RNA, 23 nt, Human
acauugaaaucuaggaaaauuau

SEQ ID NO: 2938409 - RNA, 23 nt, Human
ucaaugaaugaaugaauggcuaa

SEQ ID NO: 2938410 - RNA, 22 nt, Human
ucaaguccucuuuucugagagg

SEQ ID NO: 2938411 - RNA, 22 nt, Human
ucaauaucuuuuuuuuaauaaa

SEQ ID NO: 2938412 - RNA, 10 nt, Human
ucagugccuu

SEQ ID NO: 2938413 - RNA, 9 nt, Human
ucagugccu

SEQ ID NO: 2938414 - RNA, 15 nt, Human
ucagugccuuaugga

SEQ ID NO: 2938415 - RNA, 14 nt, Human
ucagugccuuaugg

SEQ ID NO: 2938416 - RNA, 12 nt, Human
ucagugccuuau

SEQ ID NO: 2938417 - RNA, 11 nt, Human
ucagugccuua

SEQ ID NO: 2938418 - RNA, 19 nt, Human
accgaaaacguggcugcuu

SEQ ID NO: 2938419 - RNA, 17 nt, Human
accgaaaacguggcugc

SEQ ID NO: 2938420 - RNA, 12 nt, Human
ucagugccacua

SEQ ID NO: 2938421 - RNA, 16 nt, Human
ucagugccaaaaacaa

SEQ ID NO: 2938422 - RNA, 12 nt, Human
ucaguggcagcu

SEQ ID NO: 2938423 - RNA, 11 nt, Human
ucaguggcagc

SEQ ID NO: 2938424 - RNA, 18 nt, Human
ucagugccuuauggaaca

SEQ ID NO: 2938425 - RNA, 16 nt, Human
ucagugccuuauggaa

SEQ ID NO: 2938426 - RNA, 15 nt, Human
ucaguuuuugugaaa

SEQ ID NO: 2938427 - RNA, 17 nt, Human
ucaguuuuugugaaaag

SEQ ID NO: 2938428 - RNA, 19 nt, Human
accgagggggcugcuccca

SEQ ID NO: 2938429 - RNA, 20 nt, Human
accgagggggcugcucccac

SEQ ID NO: 2938430 - RNA, 15 nt, Human
ucauauuuucaugcu

SEQ ID NO: 2938431 - RNA, 15 nt, Human
ucauauggauaaaua

SEQ ID NO: 2938432 - RNA, 15 nt, Human
ucauauuuacuucuu

SEQ ID NO: 2938433 - RNA, 23 nt, Human
ucauauuuacuucuuauacauuu

SEQ ID NO: 2938434 - RNA, 15 nt, Human
ucauaguaugguggc

SEQ ID NO: 2938435 - RNA, 18 nt, Human
ucauaguaugguggcugg

SEQ ID NO: 2938436 - RNA, 19 nt, Human
ucauaguaugguggcuggg

SEQ ID NO: 2938437 - RNA, 14 nt, Human
ucauaaccuagccu

SEQ ID NO: 2938438 - RNA, 18 nt, Human
ucauauaagauucauauu

SEQ ID NO: 2938439 - RNA, 21 nt, Human
ucauaguaugguggcuggguu

SEQ ID NO: 2938440 - RNA, 17 nt, Human
ucauguuuaugagaaac

SEQ ID NO: 2938441 - RNA, 15 nt, Human
ucaugaaagauucaa

SEQ ID NO: 2938442 - RNA, 16 nt, Human
ucaugaaagauucaau

SEQ ID NO: 2938443 - RNA, 17 nt, Human
ucaugaaagauucaaug

SEQ ID NO: 2938444 - RNA, 16 nt, Human
accgcagacaggacca

SEQ ID NO: 2938445 - RNA, 12 nt, Human
accgcagacagg

SEQ ID NO: 2938446 - RNA, 20 nt, Human
accucccacaaaggagagcu

SEQ ID NO: 2938447 - RNA, 16 nt, Human
ucaggguuggccccug

SEQ ID NO: 2938448 - RNA, 19 nt, Human
ucagggucccugguggcag

SEQ ID NO: 2938449 - RNA, 23 nt, Human
ucaggccaggcccucugcccacu

SEQ ID NO: 2938450 - RNA, 20 nt, Human
ucaggccaggcccucugccc

SEQ ID NO: 2938451 - RNA, 22 nt, Human
ucaggccaggcccucugcccac

SEQ ID NO: 2938452 - RNA, 21 nt, Human
ucaggccaggcccucugccca

SEQ ID NO: 2938453 - RNA, 14 nt, Human
ucagcuccagcuca

SEQ ID NO: 2938454 - RNA, 21 nt, Human
ucagcuuguaaauagcucagg

SEQ ID NO: 2938455 - RNA, 22 nt, Human
ucagcuuguaaauagcucaggu

SEQ ID NO: 2938456 - RNA, 23 nt, Human
ucagguaacaggcagauacagga

SEQ ID NO: 2938457 - RNA, 21 nt, Human
ucagguaacaggcagauacag

SEQ ID NO: 2938458 - RNA, 22 nt, Human
ucagguaacaggcagauacagg

SEQ ID NO: 2938459 - RNA, 14 nt, Human
acccggccccugcu

SEQ ID NO: 2938460 - RNA, 15 nt, Human
acccggccccugcug

SEQ ID NO: 2938461 - RNA, 16 nt, Human
acccggccccugcugg

SEQ ID NO: 2938462 - RNA, 22 nt, Human
acccggccccugcugguucagg

SEQ ID NO: 2938463 - RNA, 17 nt, Human
acccggccccugcuggu

SEQ ID NO: 2938464 - RNA, 20 nt, Human
acccggccccugcugguuca

SEQ ID NO: 2938465 - RNA, 15 nt, Human
acccgggaggcagag

SEQ ID NO: 2938466 - RNA, 17 nt, Human
acccgggaggcagaggu

SEQ ID NO: 2938467 - RNA, 13 nt, Human
acccgggaagggg

SEQ ID NO: 2938468 - RNA, 12 nt, Human
acccgggaaggg

SEQ ID NO: 2938469 - RNA, 14 nt, Human
acccgucuccagcu

SEQ ID NO: 2938470 - RNA, 16 nt, Human
acccgucuccagcugc

SEQ ID NO: 2938471 - RNA, 14 nt, Human
acccucucaaacua

SEQ ID NO: 2938472 - RNA, 18 nt, Human
acccugaaagcccugagc

SEQ ID NO: 2938473 - RNA, 16 nt, Human
acccugaaagcccuga

SEQ ID NO: 2938474 - RNA, 14 nt, Human
acccugaggcccag

SEQ ID NO: 2938475 - RNA, 13 nt, Human
acccugaggccca

SEQ ID NO: 2938476 - RNA, 22 nt, Human
acccugcccugugggcccccaa

SEQ ID NO: 2938477 - RNA, 17 nt, Human
acccugcccugugggcc

SEQ ID NO: 2938478 - RNA, 15 nt, Human
acccugcccuguggg

SEQ ID NO: 2938479 - RNA, 16 nt, Human
acccugaggcccagag

SEQ ID NO: 2938480 - RNA, 15 nt, Human
acccugaggcccaga

SEQ ID NO: 2938481 - RNA, 15 nt, Human
accgaaaacguggcu

SEQ ID NO: 2938482 - RNA, 17 nt, Human
acccuugccgucuaccu

SEQ ID NO: 2938483 - RNA, 23 nt, Human
acccuuguggucccaccccacac

SEQ ID NO: 2938484 - RNA, 20 nt, Human
acccuuguggucccacccca

SEQ ID NO: 2938485 - RNA, 15 nt, Human
accccaucaucccuu

SEQ ID NO: 2938486 - RNA, 18 nt, Human
accccaucucuacaaaaa

SEQ ID NO: 2938487 - RNA, 23 nt, Human
ucagcuaaagaaguuugaacauu

SEQ ID NO: 2938488 - RNA, 15 nt, Human
ucagcuaaagaaguu

SEQ ID NO: 2938489 - RNA, 18 nt, Human
ucagcuaaagaaguuuga

SEQ ID NO: 2938490 - RNA, 12 nt, Human
ucagcuccagcu

SEQ ID NO: 2938491 - RNA, 19 nt, Human
ucagcggggacagcuccuu

SEQ ID NO: 2938492 - RNA, 20 nt, Human
ucagcggggacagcuccuuc

SEQ ID NO: 2938493 - RNA, 21 nt, Human
ucagcggggacagcuccuucu

SEQ ID NO: 2938494 - RNA, 23 nt, Human
ucagcggggacagcuccuucugu

SEQ ID NO: 2938495 - RNA, 18 nt, Human
ucagcggggacagcuccu

SEQ ID NO: 2938496 - RNA, 17 nt, Human
accccacacacgccaga

SEQ ID NO: 2938497 - RNA, 22 nt, Human
accccagccccaaaacucuccu

SEQ ID NO: 2938498 - RNA, 20 nt, Human
accccagcaauuaugaaaau

SEQ ID NO: 2938499 - RNA, 13 nt, Human
accccagccccaa

SEQ ID NO: 2938500 - RNA, 12 nt, Human
acccaggaggcg

SEQ ID NO: 2938501 - RNA, 19 nt, Human
acccaggagccccgaggcc

SEQ ID NO: 2938502 - RNA, 23 nt, Human
acccaggagccccgaggccuucu

SEQ ID NO: 2938503 - RNA, 14 nt, Human
ucagcccucagaau

SEQ ID NO: 2938504 - RNA, 12 nt, Human
ucagauuugaac

SEQ ID NO: 2938505 - RNA, 21 nt, Human
ucagauuugaacucuucaauc

SEQ ID NO: 2938506 - RNA, 22 nt, Human
accauaagcuacugccauccug

SEQ ID NO: 2938507 - RNA, 17 nt, Human
accauaagcuacugcca

SEQ ID NO: 2938508 - RNA, 18 nt, Human
accauaagcuacugccau

SEQ ID NO: 2938509 - RNA, 16 nt, Human
accauaagcuacugcc

SEQ ID NO: 2938510 - RNA, 18 nt, Human
accaguguuguggauuua

SEQ ID NO: 2938511 - RNA, 15 nt, Human
ucagcaaaagaugcu

SEQ ID NO: 2938512 - RNA, 21 nt, Human
acucuuaagaagacugcauua

SEQ ID NO: 2938513 - RNA, 16 nt, Human
acucuuauaucuauau

SEQ ID NO: 2938514 - RNA, 17 nt, Human
acucuuauaucuauauu

SEQ ID NO: 2938515 - RNA, 18 nt, Human
acucuuauaucuauauuu

SEQ ID NO: 2938516 - RNA, 14 nt, Human
acucuugaccucag

SEQ ID NO: 2938517 - RNA, 19 nt, Human
acucuuauaucuauauuuu

SEQ ID NO: 2938518 - RNA, 15 nt, Human
acucuugaccucagg

SEQ ID NO: 2938519 - RNA, 16 nt, Human
acucuugaccucaggu

SEQ ID NO: 2938520 - RNA, 23 nt, Human
uccucauacccacccccacccaa

SEQ ID NO: 2938521 - RNA, 22 nt, Human
uccucauaguaugguggcuggg

SEQ ID NO: 2938522 - RNA, 17 nt, Human
acucugccacuuuauuu

SEQ ID NO: 2938523 - RNA, 15 nt, Human
acucuggcagcucag

SEQ ID NO: 2938524 - RNA, 13 nt, Human
acucuggcagcuc

SEQ ID NO: 2938525 - RNA, 23 nt, Human
acucuccuuggugucgggcauga

SEQ ID NO: 2938526 - RNA, 16 nt, Human
acucuccuuggugucg

SEQ ID NO: 2938527 - RNA, 22 nt, Human
acucugagugcaaacuucagag

SEQ ID NO: 2938528 - RNA, 22 nt, Human
acucugagacucgcgacaaugc

SEQ ID NO: 2938529 - RNA, 11 nt, Human
acucugagacu

SEQ ID NO: 2938530 - RNA, 12 nt, Human
acucuccucugc

SEQ ID NO: 2938531 - RNA, 14 nt, Human
acucuccucugcug

SEQ ID NO: 2938532 - RNA, 13 nt, Human
acucuccucugcu

SEQ ID NO: 2938533 - RNA, 21 nt, Human
acucuccucugcugcuggcug

SEQ ID NO: 2938534 - RNA, 16 nt, Human
acucuccucugcugcu

SEQ ID NO: 2938535 - RNA, 15 nt, Human
acucuccuugguguc

SEQ ID NO: 2938536 - RNA, 18 nt, Human
acucuccuggaaauauua

SEQ ID NO: 2938537 - RNA, 17 nt, Human
acucuccuccagaguca

SEQ ID NO: 2938538 - RNA, 14 nt, Human
acucuccuccagag

SEQ ID NO: 2938539 - RNA, 24 nt, Human
acuccuugaaaacacuguucucug

SEQ ID NO: 2938540 - RNA, 23 nt, Human
acuccuugaaaacacuguucucu

SEQ ID NO: 2938541 - RNA, 18 nt, Human
ucccuuugacgccauccc

SEQ ID NO: 2938542 - RNA, 16 nt, Human
ucccuuugacgccauc

SEQ ID NO: 2938543 - RNA, 20 nt, Human
ucccuuggauuguccccgac

SEQ ID NO: 2938544 - RNA, 19 nt, Human
ucccuuggauuguccccga

SEQ ID NO: 2938545 - RNA, 22 nt, Human
ucccugguggcagcucaccucu

SEQ ID NO: 2938546 - RNA, 19 nt, Human
ucccuuuuuuggcugcuga

SEQ ID NO: 2938547 - RNA, 17 nt, Human
ucccuuuuuuggcugcu

SEQ ID NO: 2938548 - RNA, 19 nt, Human
ucccuuugacgccauccca

SEQ ID NO: 2938549 - RNA, 22 nt, Human
ucccuuuuuuggcugcugaagg

SEQ ID NO: 2938550 - RNA, 20 nt, Human
ucccuuuuuuggcugcugaa

SEQ ID NO: 2938551 - RNA, 23 nt, Human
ucccuuuuuuggcugcugaaggc

SEQ ID NO: 2938552 - RNA, 12 nt, Human
acuccuggccuc

SEQ ID NO: 2938553 - RNA, 13 nt, Human
uccuaggcauuug

SEQ ID NO: 2938554 - RNA, 13 nt, Human
acuccuggccuca

SEQ ID NO: 2938555 - RNA, 14 nt, Human
acuccuggccucaa

SEQ ID NO: 2938556 - RNA, 20 nt, Human
uccuaggacccgucuccagc

SEQ ID NO: 2938557 - RNA, 18 nt, Human
uccuaggagguaaugacc

SEQ ID NO: 2938558 - RNA, 20 nt, Human
uccuaggagguaaugaccau

SEQ ID NO: 2938559 - RNA, 15 nt, Human
uccuacucuguguca

SEQ ID NO: 2938560 - RNA, 12 nt, Human
uccuacucugug

SEQ ID NO: 2938561 - RNA, 13 nt, Human
uccuacucugugu

SEQ ID NO: 2938562 - RNA, 14 nt, Human
uccuacucuguguc

SEQ ID NO: 2938563 - RNA, 14 nt, Human
acuccugcaggcag

SEQ ID NO: 2938564 - RNA, 12 nt, Human
acuccugcaggc

SEQ ID NO: 2938565 - RNA, 22 nt, Human
acuccugcaggcagccaggcca

SEQ ID NO: 2938566 - RNA, 16 nt, Human
acuccugcaggcagcc

SEQ ID NO: 2938567 - RNA, 15 nt, Human
acuccugcaggcagc

SEQ ID NO: 2938568 - RNA, 11 nt, Human
acuccuggccu

SEQ ID NO: 2938569 - RNA, 17 nt, Human
ucccugguggcagcuca

SEQ ID NO: 2938570 - RNA, 16 nt, Human
ucccugguggcagcuc

SEQ ID NO: 2938571 - RNA, 21 nt, Human
ucccugguggcagcucaccuc

SEQ ID NO: 2938572 - RNA, 20 nt, Human
ucccugguggcagcucaccu

SEQ ID NO: 2938573 - RNA, 19 nt, Human
ucccugguggcagcucacc

SEQ ID NO: 2938574 - RNA, 18 nt, Human
ucccugguggcagcucac

SEQ ID NO: 2938575 - RNA, 13 nt, Human
acucaccccagcc

SEQ ID NO: 2938576 - RNA, 16 nt, Human
acucaccccagcccca

SEQ ID NO: 2938577 - RNA, 15 nt, Human
acucaccccagcccc

SEQ ID NO: 2938578 - RNA, 14 nt, Human
acucaccccagccc

SEQ ID NO: 2938579 - RNA, 19 nt, Human
acuccagugagacagcucu

SEQ ID NO: 2938580 - RNA, 15 nt, Human
acugagcauaagucc

SEQ ID NO: 2938581 - RNA, 13 nt, Human
acugauaaagaug

SEQ ID NO: 2938582 - RNA, 21 nt, Human
acugauaaagaugagugagca

SEQ ID NO: 2938583 - RNA, 14 nt, Human
acugcaccgggcca

SEQ ID NO: 2938584 - RNA, 16 nt, Human
acugcaccgggccaca

SEQ ID NO: 2938585 - RNA, 20 nt, Human
acugcacuauagccuaggug

SEQ ID NO: 2938586 - RNA, 19 nt, Human
uccugaugcuucuucagag

SEQ ID NO: 2938587 - RNA, 21 nt, Human
uccugaugcuucuucagagac

SEQ ID NO: 2938588 - RNA, 20 nt, Human
uccugaugcuucuucagaga

SEQ ID NO: 2938589 - RNA, 21 nt, Human
acugcacuauagccuagguga

SEQ ID NO: 2938590 - RNA, 14 nt, Human
acugcacuccagcc

SEQ ID NO: 2938591 - RNA, 17 nt, Human
acugcacuccagccugg

SEQ ID NO: 2938592 - RNA, 18 nt, Human
acugcacuccagccuggg

SEQ ID NO: 2938593 - RNA, 20 nt, Human
acugcacuccagccugggug

SEQ ID NO: 2938594 - RNA, 19 nt, Human
acugcacuccagccugggu

SEQ ID NO: 2938595 - RNA, 21 nt, Human
uccugccucgaacuggcugca

SEQ ID NO: 2938596 - RNA, 14 nt, Human
uccugcaggcagcc

SEQ ID NO: 2938597 - RNA, 13 nt, Human
uccugcaggcagc

SEQ ID NO: 2938598 - RNA, 12 nt, Human
uccugcaggcag

SEQ ID NO: 2938599 - RNA, 21 nt, Human
uccugcugcaguugccaguca

SEQ ID NO: 2938600 - RNA, 15 nt, Human
uccugggagcuuuug

SEQ ID NO: 2938601 - RNA, 12 nt, Human
uccugggaguga

SEQ ID NO: 2938602 - RNA, 14 nt, Human
uccugggagugagc

SEQ ID NO: 2938603 - RNA, 17 nt, Human
uccugggagugagcugg

SEQ ID NO: 2938604 - RNA, 22 nt, Human
uccuggaauaucuccgucaacu

SEQ ID NO: 2938605 - RNA, 16 nt, Human
uccuggaaaucagggu

SEQ ID NO: 2938606 - RNA, 15 nt, Human
uccuggaaauauuaa

SEQ ID NO: 2938607 - RNA, 21 nt, Human
acugaacaguaacauagcugu

SEQ ID NO: 2938608 - RNA, 15 nt, Human
acugaacaguaacau

SEQ ID NO: 2938609 - RNA, 19 nt, Human
uccucuuuccaucuacccu

SEQ ID NO: 2938610 - RNA, 21 nt, Human
uccucuuuggucuacacugug

SEQ ID NO: 2938611 - RNA, 19 nt, Human
uccucuuuggucuacacug

SEQ ID NO: 2938612 - RNA, 11 nt, Human
uccucccuccc

SEQ ID NO: 2938613 - RNA, 14 nt, Human
uccucccucccucu

SEQ ID NO: 2938614 - RNA, 11 nt, Human
uccucuuucca

SEQ ID NO: 2938615 - RNA, 12 nt, Human
uccucuuuccau

SEQ ID NO: 2938616 - RNA, 22 nt, Human
uccugaaaacccuugccaugug

SEQ ID NO: 2938617 - RNA, 22 nt, Human
uccucuuuggucuacacugugc

SEQ ID NO: 2938618 - RNA, 13 nt, Human
acugacucuuaag

SEQ ID NO: 2938619 - RNA, 14 nt, Human
acugacucuuaaga

SEQ ID NO: 2938620 - RNA, 15 nt, Human
acugacucuuaagaa

SEQ ID NO: 2938621 - RNA, 16 nt, Human
acugacucuuaagaag

SEQ ID NO: 2938622 - RNA, 22 nt, Human
acugacuucuaaguaaaaccac

SEQ ID NO: 2938623 - RNA, 16 nt, Human
acugacuucuaaguaa

SEQ ID NO: 2938624 - RNA, 15 nt, Human
acugacuucuaagua

SEQ ID NO: 2938625 - RNA, 13 nt, Human
acugacuucuaag

SEQ ID NO: 2938626 - RNA, 17 nt, Human
acugacucuuaagaaga

SEQ ID NO: 2938627 - RNA, 18 nt, Human
acugacucuuaagaagac

SEQ ID NO: 2938628 - RNA, 20 nt, Human
acugacucuuaagaagacug

SEQ ID NO: 2938629 - RNA, 21 nt, Human
acugagacagcccgggcucug

SEQ ID NO: 2938630 - RNA, 18 nt, Human
acugagacagcccgggcu

SEQ ID NO: 2938631 - RNA, 15 nt, Human
acugagacagcccgg

SEQ ID NO: 2938632 - RNA, 22 nt, Human
acugagaugugaacacaucagc

SEQ ID NO: 2938633 - RNA, 17 nt, Human
acugagaugugaacaca

SEQ ID NO: 2938634 - RNA, 18 nt, Human
acugagagugaacaaauu

SEQ ID NO: 2938635 - RNA, 23 nt, Human
acugagacagcccgggcucugcc

SEQ ID NO: 2938636 - RNA, 22 nt, Human
acugagacagcccgggcucugc

SEQ ID NO: 2938637 - RNA, 20 nt, Human
uccacuggguguaaacacau

SEQ ID NO: 2938638 - RNA, 17 nt, Human
uccacuggguguaaaca

SEQ ID NO: 2938639 - RNA, 21 nt, Human
uccacugugccaugugccagg

SEQ ID NO: 2938640 - RNA, 22 nt, Human
uccacugguucuucuuggucuc

SEQ ID NO: 2938641 - RNA, 13 nt, Human
accuuuuuuauac

SEQ ID NO: 2938642 - RNA, 20 nt, Human
accuuuuggucuggagggaa

SEQ ID NO: 2938643 - RNA, 18 nt, Human
accuuuguccccaccgca

SEQ ID NO: 2938644 - RNA, 17 nt, Human
accuuuguccccaccgc

SEQ ID NO: 2938645 - RNA, 20 nt, Human
accuugaacuggguacuugu

SEQ ID NO: 2938646 - RNA, 19 nt, Human
accuugaaaacuuuaugcu

SEQ ID NO: 2938647 - RNA, 13 nt, Human
uccagacacaugu

SEQ ID NO: 2938648 - RNA, 15 nt, Human
uccagaauuucccaa

SEQ ID NO: 2938649 - RNA, 14 nt, Human
uccagaauuuccca

SEQ ID NO: 2938650 - RNA, 18 nt, Human
acgaauauugcugauggu

SEQ ID NO: 2938651 - RNA, 15 nt, Human
acgaauauugcugau

SEQ ID NO: 2938652 - RNA, 13 nt, Human
acgaaaaaauggu

SEQ ID NO: 2938653 - RNA, 13 nt, Human
acgaaagaaggca

SEQ ID NO: 2938654 - RNA, 23 nt, Human
uccaggcugggagagccuuccag

SEQ ID NO: 2938655 - RNA, 10 nt, Human
uccaggcucc

SEQ ID NO: 2938656 - RNA, 12 nt, Human
uccaggcuccuu

SEQ ID NO: 2938657 - RNA, 22 nt, Human
uccaggcuccuuuagcgcccag

SEQ ID NO: 2938658 - RNA, 21 nt, Human
uccaggcugggagagccuucc

SEQ ID NO: 2938659 - RNA, 20 nt, Human
uccaggcugggagagccuuc

SEQ ID NO: 2938660 - RNA, 15 nt, Human
uccaguaucuugaag

SEQ ID NO: 2938661 - RNA, 14 nt, Human
uccaguaucuugaa

SEQ ID NO: 2938662 - RNA, 18 nt, Human
acggcuuuuacuuaaacc

SEQ ID NO: 2938663 - RNA, 16 nt, Human
acggcucacugcagcc

SEQ ID NO: 2938664 - RNA, 15 nt, Human
acggcucacugcagc

SEQ ID NO: 2938665 - RNA, 17 nt, Human
acggcucacugcagccu

SEQ ID NO: 2938666 - RNA, 18 nt, Human
acggcucacugcagccuc

SEQ ID NO: 2938667 - RNA, 12 nt, Human
acggccaggcca

SEQ ID NO: 2938668 - RNA, 23 nt, Human
uccagucauuauguuaauauuuc

SEQ ID NO: 2938669 - RNA, 21 nt, Human
uccagucauuauguuaauauu

SEQ ID NO: 2938670 - RNA, 15 nt, Human
uccagucauuauguu

SEQ ID NO: 2938671 - RNA, 14 nt, Human
uccagucauuaugu

SEQ ID NO: 2938672 - RNA, 18 nt, Human
uccaguaucuugaagacu

SEQ ID NO: 2938673 - RNA, 16 nt, Human
uccaguaucuugaaga

SEQ ID NO: 2938674 - RNA, 23 nt, Human
uccagugaggcucugcccuuggu

SEQ ID NO: 2938675 - RNA, 22 nt, Human
uccagugaggcucugcccuugg

SEQ ID NO: 2938676 - RNA, 16 nt, Human
uccagugaggcucugc

SEQ ID NO: 2938677 - RNA, 18 nt, Human
uccagugagacagcucug

SEQ ID NO: 2938678 - RNA, 15 nt, Human
uccagugaggcucug

SEQ ID NO: 2938679 - RNA, 21 nt, Human
acgcuacccgggaagggggcu

SEQ ID NO: 2938680 - RNA, 14 nt, Human
acgaauauugcuga

SEQ ID NO: 2938681 - RNA, 21 nt, Human
acgaauauugcugauggugca

SEQ ID NO: 2938682 - RNA, 23 nt, Human
acggagucccaccuuggcugcag

SEQ ID NO: 2938683 - RNA, 17 nt, Human
acgcuggagugcaguga

SEQ ID NO: 2938684 - RNA, 20 nt, Human
acgcuggaccuugaacuggg

SEQ ID NO: 2938685 - RNA, 23 nt, Human
acgcuggaccuugaacuggguac

SEQ ID NO: 2938686 - RNA, 15 nt, Human
acgcuggagugcagu

SEQ ID NO: 2938687 - RNA, 16 nt, Human
acgcuggagugcagug

SEQ ID NO: 2938688 - RNA, 13 nt, Human
acgcuggaccuug

SEQ ID NO: 2938689 - RNA, 11 nt, Human
acgcucucugg

SEQ ID NO: 2938690 - RNA, 16 nt, Human
ucccccagccccaucc

SEQ ID NO: 2938691 - RNA, 15 nt, Human
ucccccagccccauc

SEQ ID NO: 2938692 - RNA, 13 nt, Human
ucccccagcccca

SEQ ID NO: 2938693 - RNA, 11 nt, Human
ucccccagccc

SEQ ID NO: 2938694 - RNA, 21 nt, Human
uccccaggaggccagccuuga

SEQ ID NO: 2938695 - RNA, 20 nt, Human
uccccaggaggccagccuug

SEQ ID NO: 2938696 - RNA, 17 nt, Human
uccccaggaggccagcc

SEQ ID NO: 2938697 - RNA, 22 nt, Human
ucccagcuacucgggaggcuga

SEQ ID NO: 2938698 - RNA, 23 nt, Human
ucccagcuacucgggaggcugag

SEQ ID NO: 2938699 - RNA, 12 nt, Human
uccccacccuga

SEQ ID NO: 2938700 - RNA, 18 nt, Human
uccccaggaggccagccu

SEQ ID NO: 2938701 - RNA, 16 nt, Human
uccccaccgcagacag

SEQ ID NO: 2938702 - RNA, 15 nt, Human
uccccaccgcagaca

SEQ ID NO: 2938703 - RNA, 23 nt, Human
uccccacccugaaagcccugagc

SEQ ID NO: 2938704 - RNA, 14 nt, Human
acuauguugcccag

SEQ ID NO: 2938705 - RNA, 22 nt, Human
acuauggcccuggccuagcaua

SEQ ID NO: 2938706 - RNA, 15 nt, Human
acuauguugcccagg

SEQ ID NO: 2938707 - RNA, 16 nt, Human
acuauguugcccaggc

SEQ ID NO: 2938708 - RNA, 16 nt, Human
acucaaugcacugaca

SEQ ID NO: 2938709 - RNA, 20 nt, Human
acuauagccuaggugacaga

SEQ ID NO: 2938710 - RNA, 22 nt, Human
acuauagccuaggugacagagu

SEQ ID NO: 2938711 - RNA, 18 nt, Human
acuauagccuaggugaca

SEQ ID NO: 2938712 - RNA, 17 nt, Human
acuauauuguuugcuaa

SEQ ID NO: 2938713 - RNA, 22 nt, Human
acuauauuguuugcuaagcauu

SEQ ID NO: 2938714 - RNA, 17 nt, Human
acuaucacugguuuggu

SEQ ID NO: 2938715 - RNA, 15 nt, Human
acuaucucauuucca

SEQ ID NO: 2938716 - RNA, 16 nt, Human
acuaucuaaauguuga

SEQ ID NO: 2938717 - RNA, 21 nt, Human
acuaucuaaauguugaaagau

SEQ ID NO: 2938718 - RNA, 16 nt, Human
acuaucucauuuccaa

SEQ ID NO: 2938719 - RNA, 17 nt, Human
acuaucucauuuccaag

SEQ ID NO: 2938720 - RNA, 18 nt, Human
ucccagauacuugggggg

SEQ ID NO: 2938721 - RNA, 16 nt, Human
ucccagauacuugggg

SEQ ID NO: 2938722 - RNA, 22 nt, Human
acguuucuaaaggcuaccuuug

SEQ ID NO: 2938723 - RNA, 15 nt, Human
acuaauuuuaaaaug

SEQ ID NO: 2938724 - RNA, 13 nt, Human
acguugugcauuu

SEQ ID NO: 2938725 - RNA, 15 nt, Human
acguuucuaaaggcu

SEQ ID NO: 2938726 - RNA, 16 nt, Human
acguuucuaaaggcua

SEQ ID NO: 2938727 - RNA, 14 nt, Human
acguugugcauuug

SEQ ID NO: 2938728 - RNA, 15 nt, Human
acguugugcauuugg

SEQ ID NO: 2938729 - RNA, 18 nt, Human
acguggcugcuucaagga

SEQ ID NO: 2938730 - RNA, 17 nt, Human
acguggcugcuucaagg

SEQ ID NO: 2938731 - RNA, 21 nt, Human
acguggcugcuucaaggaucc

SEQ ID NO: 2938732 - RNA, 19 nt, Human
acguggcugcuucaaggau

SEQ ID NO: 2938733 - RNA, 12 nt, Human
uccauccugagg

SEQ ID NO: 2938734 - RNA, 15 nt, Human
uccauccugaggcuc

SEQ ID NO: 2938735 - RNA, 11 nt, Human
uccauccugag

SEQ ID NO: 2938736 - RNA, 15 nt, Human
ucuccuccagaguca

SEQ ID NO: 2938737 - RNA, 16 nt, Human
ucuccucugcugcugg

SEQ ID NO: 2938738 - RNA, 15 nt, Human
ucuccucugcugcug

SEQ ID NO: 2938739 - RNA, 18 nt, Human
ucuccucugcugcuggcu

SEQ ID NO: 2938740 - RNA, 17 nt, Human
ucuccucugcugcuggc

SEQ ID NO: 2938741 - RNA, 14 nt, Human
acuuucugaaauaa

SEQ ID NO: 2938742 - RNA, 20 nt, Human
acuuucugaaauaacauggc

SEQ ID NO: 2938743 - RNA, 12 nt, Human
acuuuaccuuuu

SEQ ID NO: 2938744 - RNA, 19 nt, Human
ucuccaagcaggacaugga

SEQ ID NO: 2938745 - RNA, 18 nt, Human
ucuccaagcaggacaugg

SEQ ID NO: 2938746 - RNA, 12 nt, Human
ucuccacccugc

SEQ ID NO: 2938747 - RNA, 23 nt, Human
ucuccccagcaagugagagcugg

SEQ ID NO: 2938748 - RNA, 21 nt, Human
ucucccuuggauuguccccga

SEQ ID NO: 2938749 - RNA, 17 nt, Human
ucuccgaccagacaccu

SEQ ID NO: 2938750 - RNA, 23 nt, Human
ucuccgaccagacaccuugacag

SEQ ID NO: 2938751 - RNA, 17 nt, Human
agaaaaaauauuuuccc

SEQ ID NO: 2938752 - RNA, 15 nt, Human
ucuccuucaccuuug

SEQ ID NO: 2938753 - RNA, 14 nt, Human
ucuccuucaccuuu

SEQ ID NO: 2938754 - RNA, 16 nt, Human
ucuccuucaccuuugu

SEQ ID NO: 2938755 - RNA, 13 nt, Human
ucuccuuguguua

SEQ ID NO: 2938756 - RNA, 21 nt, Human
ucuccuuguguuacuaaguuu

SEQ ID NO: 2938757 - RNA, 22 nt, Human
acuuuuuauauucucagcagag

SEQ ID NO: 2938758 - RNA, 12 nt, Human
acuuuuuauauu

SEQ ID NO: 2938759 - RNA, 15 nt, Human
acuuuuuauauucuc

SEQ ID NO: 2938760 - RNA, 16 nt, Human
acuuuuuauauucuca

SEQ ID NO: 2938761 - RNA, 15 nt, Human
acuuuuguucuuggu

SEQ ID NO: 2938762 - RNA, 23 nt, Human
acuuuuguucuugguuuguaaau

SEQ ID NO: 2938763 - RNA, 22 nt, Human
acuuugguuauuuuacuuuuug

SEQ ID NO: 2938764 - RNA, 23 nt, Human
acuuugguuauuuuacuuuuugg

SEQ ID NO: 2938765 - RNA, 18 nt, Human
acuuuguguucaccuugu

SEQ ID NO: 2938766 - RNA, 20 nt, Human
acuuuguuaguuucuccaag

SEQ ID NO: 2938767 - RNA, 14 nt, Human
acuuuguucuggcu

SEQ ID NO: 2938768 - RNA, 21 nt, Human
acuuuguuaguuucuccaagc

SEQ ID NO: 2938769 - RNA, 12 nt, Human
acuuuuguucuu

SEQ ID NO: 2938770 - RNA, 13 nt, Human
acuuuuguucuug

SEQ ID NO: 2938771 - RNA, 10 nt, Human
acuuugguua

SEQ ID NO: 2938772 - RNA, 13 nt, Human
acuuugguuauuu

SEQ ID NO: 2938773 - RNA, 21 nt, Human
acuuugguuauuuuacuuuuu

SEQ ID NO: 2938774 - RNA, 12 nt, Human
acuuugaccucu

SEQ ID NO: 2938775 - RNA, 13 nt, Human
acuuugaccucug

SEQ ID NO: 2938776 - RNA, 20 nt, Human
ucucacuauguugcccaggc

SEQ ID NO: 2938777 - RNA, 21 nt, Human
ucucacuauguugcccaggca

SEQ ID NO: 2938778 - RNA, 22 nt, Human
ucucacuauguugcccaggcag

SEQ ID NO: 2938779 - RNA, 23 nt, Human
ucucacuauguugcccaggcagg

SEQ ID NO: 2938780 - RNA, 23 nt, Human
acuugcagacucuacagaggcca

SEQ ID NO: 2938781 - RNA, 19 nt, Human
acuugcagacucuacagag

SEQ ID NO: 2938782 - RNA, 22 nt, Human
acuugcagacucuacagaggcc

SEQ ID NO: 2938783 - RNA, 15 nt, Human
acuugugaauaaaga

SEQ ID NO: 2938784 - RNA, 21 nt, Human
acuugucuuuggacccugagg

SEQ ID NO: 2938785 - RNA, 18 nt, Human
acuugucuuuggacccug

SEQ ID NO: 2938786 - RNA, 20 nt, Human
acuugucuuuggacccugag

SEQ ID NO: 2938787 - RNA, 19 nt, Human
acuuguggacacagcucuu

SEQ ID NO: 2938788 - RNA, 22 nt, Human
acuuguggacacagcucuucuc

SEQ ID NO: 2938789 - RNA, 15 nt, Human
acuugucaauaaaau

SEQ ID NO: 2938790 - RNA, 21 nt, Human
ucucaggccagcugcuugggc

SEQ ID NO: 2938791 - RNA, 18 nt, Human
ucucaggccagcugcuug

SEQ ID NO: 2938792 - RNA, 17 nt, Human
ucucaggccagcugcuu

SEQ ID NO: 2938793 - RNA, 16 nt, Human
ucucauuugucacaca

SEQ ID NO: 2938794 - RNA, 16 nt, Human
ucuccaagcaggacau

SEQ ID NO: 2938795 - RNA, 15 nt, Human
ucuccaagcaggaca

SEQ ID NO: 2938796 - RNA, 14 nt, Human
ucucauuugucaca

SEQ ID NO: 2938797 - RNA, 15 nt, Human
ucucauuuccaagca

SEQ ID NO: 2938798 - RNA, 10 nt, Human
ucucaggcca

SEQ ID NO: 2938799 - RNA, 12 nt, Human
ucucaggccaaa

SEQ ID NO: 2938800 - RNA, 13 nt, Human
ucucaggccagcu

SEQ ID NO: 2938801 - RNA, 12 nt, Human
ucucaggccagc

SEQ ID NO: 2938802 - RNA, 12 nt, Human
ucucaggaaauc

SEQ ID NO: 2938803 - RNA, 12 nt, Human
ucucagcagagu

SEQ ID NO: 2938804 - RNA, 13 nt, Human
ucucagcagagug

SEQ ID NO: 2938805 - RNA, 14 nt, Human
ucucagcagagugc

SEQ ID NO: 2938806 - RNA, 23 nt, Human
ucucaggaaaucaaauaugcaaa

SEQ ID NO: 2938807 - RNA, 21 nt, Human
ucucaggaaaucaaauaugca

SEQ ID NO: 2938808 - RNA, 14 nt, Human
ucucaggaaaucaa

SEQ ID NO: 2938809 - RNA, 15 nt, Human
ucuauuuauuuguga

SEQ ID NO: 2938810 - RNA, 14 nt, Human
ucuauuuauuuauu

SEQ ID NO: 2938811 - RNA, 13 nt, Human
ucuauuuauuuau

SEQ ID NO: 2938812 - RNA, 17 nt, Human
ucucacuauguugccca

SEQ ID NO: 2938813 - RNA, 19 nt, Human
ucucacuauguugcccagg

SEQ ID NO: 2938814 - RNA, 16 nt, Human
ucucacuauguugccc

SEQ ID NO: 2938815 - RNA, 16 nt, Human
ucuauguuaauauuuu

SEQ ID NO: 2938816 - RNA, 14 nt, Human
ucuauguuaauauu

SEQ ID NO: 2938817 - RNA, 23 nt, Human
ucuaugggacucaaugcacugac

SEQ ID NO: 2938818 - RNA, 13 nt, Human
ucuagauacugua

SEQ ID NO: 2938819 - RNA, 18 nt, Human
ucuagcauggcugccaau

SEQ ID NO: 2938820 - RNA, 16 nt, Human
acuucaucccucuggg

SEQ ID NO: 2938821 - RNA, 22 nt, Human
ucuauaacaaaggauacuuauu

SEQ ID NO: 2938822 - RNA, 23 nt, Human
ucuauaacaaaggauacuuauuu

SEQ ID NO: 2938823 - RNA, 13 nt, Human
ucuauaaaccgaa

SEQ ID NO: 2938824 - RNA, 23 nt, Human
ucuaguuguuugauucagacagc

SEQ ID NO: 2938825 - RNA, 21 nt, Human
ucuaguuugauuaaauucuug

SEQ ID NO: 2938826 - RNA, 17 nt, Human
ucuaggaaauauuuauu

SEQ ID NO: 2938827 - RNA, 16 nt, Human
ucuaggaaauauuuau

SEQ ID NO: 2938828 - RNA, 13 nt, Human
ucuagccagagga

SEQ ID NO: 2938829 - RNA, 12 nt, Human
ucuaggaagacu

SEQ ID NO: 2938830 - RNA, 22 nt, Human
ucuaguuguuugauucagacag

SEQ ID NO: 2938831 - RNA, 20 nt, Human
acuuaaauaaugugaaacug

SEQ ID NO: 2938832 - RNA, 11 nt, Human
acuuaagacuu

SEQ ID NO: 2938833 - RNA, 13 nt, Human
acuuaagcacacu

SEQ ID NO: 2938834 - RNA, 17 nt, Human
acuuaaucuaaauggaa

SEQ ID NO: 2938835 - RNA, 19 nt, Human
acuuaaucuaaauggaacc

SEQ ID NO: 2938836 - RNA, 16 nt, Human
acuuaaugagacuuua

SEQ ID NO: 2938837 - RNA, 16 nt, Human
acuuaaugaaaacaau

SEQ ID NO: 2938838 - RNA, 18 nt, Human
acuuaaugaaaacaaugc

SEQ ID NO: 2938839 - RNA, 15 nt, Human
acuuaaugaaaacaa

SEQ ID NO: 2938840 - RNA, 22 nt, Human
acuuaaucuaaauggaaccacu

SEQ ID NO: 2938841 - RNA, 16 nt, Human
acuuacacuuuaugca

SEQ ID NO: 2938842 - RNA, 15 nt, Human
acuuagguguggggg

SEQ ID NO: 2938843 - RNA, 22 nt, Human
acuuacuguacaugaaaacaca

SEQ ID NO: 2938844 - RNA, 19 nt, Human
acuuaaugagacuuuaaaa

SEQ ID NO: 2938845 - RNA, 17 nt, Human
acuuacacuuuaugcac

SEQ ID NO: 2938846 - RNA, 21 nt, Human
acuuacuguacaugaaaacac

SEQ ID NO: 2938847 - RNA, 16 nt, Human
acuuacuguacaugaa

SEQ ID NO: 2938848 - RNA, 18 nt, Human
acuguucucugcccucca

SEQ ID NO: 2938849 - RNA, 17 nt, Human
acuguucucugcccucc

SEQ ID NO: 2938850 - RNA, 16 nt, Human
acuguucucugcccuc

SEQ ID NO: 2938851 - RNA, 21 nt, Human
ucuacccuggcacuauaaugu

SEQ ID NO: 2938852 - RNA, 20 nt, Human
ucuacccagcgagcccuggu

SEQ ID NO: 2938853 - RNA, 14 nt, Human
ucuacccaggugcu

SEQ ID NO: 2938854 - RNA, 19 nt, Human
ucuacccuggcacuauaau

SEQ ID NO: 2938855 - RNA, 14 nt, Human
ucuacccuggcacu

SEQ ID NO: 2938856 - RNA, 21 nt, Human
ucuacagaggccaugggccuc

SEQ ID NO: 2938857 - RNA, 19 nt, Human
ucuacccagcgagcccugg

SEQ ID NO: 2938858 - RNA, 19 nt, Human
ucuaaguaaaaccacagca

SEQ ID NO: 2938859 - RNA, 15 nt, Human
ucuaaguaaaaccac

SEQ ID NO: 2938860 - RNA, 14 nt, Human
ucuaaguaaaacca

SEQ ID NO: 2938861 - RNA, 18 nt, Human
uccugggagugagcuggu

SEQ ID NO: 2938862 - RNA, 13 nt, Human
uccugggcagcug

SEQ ID NO: 2938863 - RNA, 12 nt, Human
uccugggcagcu

SEQ ID NO: 2938864 - RNA, 21 nt, Human
agaauguuuucaaauguucuc

SEQ ID NO: 2938865 - RNA, 15 nt, Human
agaauguuuucaaau

SEQ ID NO: 2938866 - RNA, 15 nt, Human
agaauuaacacauga

SEQ ID NO: 2938867 - RNA, 23 nt, Human
agaaguuucugccgcagcccugc

SEQ ID NO: 2938868 - RNA, 22 nt, Human
agaaguuucugccgcagcccug

SEQ ID NO: 2938869 - RNA, 21 nt, Human
agaaguuucugccgcagcccu

SEQ ID NO: 2938870 - RNA, 19 nt, Human
agaaggcauggacuucugg

SEQ ID NO: 2938871 - RNA, 13 nt, Human
ucuguuuagauaa

SEQ ID NO: 2938872 - RNA, 22 nt, Human
ucuguucuuuccaaaguacacu

SEQ ID NO: 2938873 - RNA, 17 nt, Human
ucugugaugacauuccc

SEQ ID NO: 2938874 - RNA, 13 nt, Human
ucuguucuuucca

SEQ ID NO: 2938875 - RNA, 12 nt, Human
ucuguuggccag

SEQ ID NO: 2938876 - RNA, 17 nt, Human
ucuguuggccaguguga

SEQ ID NO: 2938877 - RNA, 22 nt, Human
ucugugaaaggaaagagggagg

SEQ ID NO: 2938878 - RNA, 14 nt, Human
ucugugagaugcua

SEQ ID NO: 2938879 - RNA, 23 nt, Human
ucugugagaugcuagaacucccu

SEQ ID NO: 2938880 - RNA, 17 nt, Human
ucugugagaugcuagaa

SEQ ID NO: 2938881 - RNA, 22 nt, Human
ucugugagaugcuagaacuccc

SEQ ID NO: 2938882 - RNA, 17 nt, Human
agacaccuugacagggc

SEQ ID NO: 2938883 - RNA, 18 nt, Human
agacaccuugacagggca

SEQ ID NO: 2938884 - RNA, 20 nt, Human
agacacauguccaagaagcc

SEQ ID NO: 2938885 - RNA, 16 nt, Human
agacacauguccaaga

SEQ ID NO: 2938886 - RNA, 14 nt, Human
agacacaugccagg

SEQ ID NO: 2938887 - RNA, 21 nt, Human
agacacaugccagggccaugu

SEQ ID NO: 2938888 - RNA, 13 nt, Human
agacagagaccug

SEQ ID NO: 2938889 - RNA, 24 nt, Human
agacagagccccacccucagaugc

SEQ ID NO: 2938890 - RNA, 16 nt, Human
agacaggaccagggau

SEQ ID NO: 2938891 - RNA, 22 nt, Human
agacagagccccacccucagau

SEQ ID NO: 2938892 - RNA, 16 nt, Human
agaauugauugggcac

SEQ ID NO: 2938893 - RNA, 22 nt, Human
agaauugauugggcacaucauu

SEQ ID NO: 2938894 - RNA, 23 nt, Human
agaauugauugggcacaucauuu

SEQ ID NO: 2938895 - RNA, 15 nt, Human
agaauugacauugaa

SEQ ID NO: 2938896 - RNA, 16 nt, Human
agaauugacauugaaa

SEQ ID NO: 2938897 - RNA, 17 nt, Human
agaauugacauugaaau

SEQ ID NO: 2938898 - RNA, 18 nt, Human
agaauugacauugaaauc

SEQ ID NO: 2938899 - RNA, 19 nt, Human
agaauugacauugaaaucu

SEQ ID NO: 2938900 - RNA, 22 nt, Human
agaauuugauaugugaacaguu

SEQ ID NO: 2938901 - RNA, 21 nt, Human
agaauuugauaugugaacagu

SEQ ID NO: 2938902 - RNA, 24 nt, Human
agaauugauugggcacaucauuuc

SEQ ID NO: 2938903 - RNA, 16 nt, Human
agacacaggcccggcu

SEQ ID NO: 2938904 - RNA, 12 nt, Human
agacacaggccc

SEQ ID NO: 2938905 - RNA, 13 nt, Human
agacacaggcccg

SEQ ID NO: 2938906 - RNA, 12 nt, Human
agacacacauga

SEQ ID NO: 2938907 - RNA, 22 nt, Human
ucugagugcaaacuucagaguu

SEQ ID NO: 2938908 - RNA, 23 nt, Human
ucugagugcaaacuucagaguuc

SEQ ID NO: 2938909 - RNA, 17 nt, Human
ucugaucauccacugug

SEQ ID NO: 2938910 - RNA, 21 nt, Human
ucugaucauccacugugccau

SEQ ID NO: 2938911 - RNA, 14 nt, Human
ucugagugcaaacu

SEQ ID NO: 2938912 - RNA, 21 nt, Human
ucugagacucgcgacaaugca

SEQ ID NO: 2938913 - RNA, 14 nt, Human
agaaauguacagca

SEQ ID NO: 2938914 - RNA, 15 nt, Human
agaaauguacagcaa

SEQ ID NO: 2938915 - RNA, 17 nt, Human
ucugcacuccccugcug

SEQ ID NO: 2938916 - RNA, 16 nt, Human
ucugcacuccccugcu

SEQ ID NO: 2938917 - RNA, 15 nt, Human
ucugcacuccccugc

SEQ ID NO: 2938918 - RNA, 14 nt, Human
ucugcacuccccug

SEQ ID NO: 2938919 - RNA, 17 nt, Human
ucugcagcaauaaagca

SEQ ID NO: 2938920 - RNA, 18 nt, Human
ucugcagauaaacaguag

SEQ ID NO: 2938921 - RNA, 15 nt, Human
ucugcagauaaacag

SEQ ID NO: 2938922 - RNA, 15 nt, Human
ucugacacacagcuc

SEQ ID NO: 2938923 - RNA, 12 nt, Human
ucugacacacag

SEQ ID NO: 2938924 - RNA, 13 nt, Human
ucugacacacagc

SEQ ID NO: 2938925 - RNA, 14 nt, Human
ucugacacacagcu

SEQ ID NO: 2938926 - RNA, 21 nt, Human
ucugaaggacauugcggacag

SEQ ID NO: 2938927 - RNA, 14 nt, Human
agaaaugaaagcag

SEQ ID NO: 2938928 - RNA, 15 nt, Human
ucugccgcagcccug

SEQ ID NO: 2938929 - RNA, 14 nt, Human
ucugccgcagcccu

SEQ ID NO: 2938930 - RNA, 19 nt, Human
ucugcccuccaagaccuuc

SEQ ID NO: 2938931 - RNA, 18 nt, Human
ucugcccuccaagaccuu

SEQ ID NO: 2938932 - RNA, 21 nt, Human
ucugcccacucccugcaaccu

SEQ ID NO: 2938933 - RNA, 18 nt, Human
ucugcccacucccugcaa

SEQ ID NO: 2938934 - RNA, 18 nt, Human
ucugcgggggcagugcuc

SEQ ID NO: 2938935 - RNA, 20 nt, Human
ucugcgggggcagugcucac

SEQ ID NO: 2938936 - RNA, 22 nt, Human
ucugcggagcacacuggcucac

SEQ ID NO: 2938937 - RNA, 21 nt, Human
ucugcggagcacacuggcuca

SEQ ID NO: 2938938 - RNA, 14 nt, Human
ucugcggagcacac

SEQ ID NO: 2938939 - RNA, 21 nt, Human
ucugccugcccaggccccugc

SEQ ID NO: 2938940 - RNA, 22 nt, Human
ucugccugcccaggccccugcc

SEQ ID NO: 2938941 - RNA, 22 nt, Human
ucugccgcagcccugcagaggg

SEQ ID NO: 2938942 - RNA, 17 nt, Human
ucugcucacauaucugu

SEQ ID NO: 2938943 - RNA, 19 nt, Human
ucugcucacauaucuguca

SEQ ID NO: 2938944 - RNA, 20 nt, Human
ucugcucacauaucugucau

SEQ ID NO: 2938945 - RNA, 13 nt, Human
ucugcuucagccu

SEQ ID NO: 2938946 - RNA, 14 nt, Human
ucugcuucagccuc

SEQ ID NO: 2938947 - RNA, 15 nt, Human
ucugcuucagccucc

SEQ ID NO: 2938948 - RNA, 14 nt, Human
ucugcuugccaucc

SEQ ID NO: 2938949 - RNA, 23 nt, Human
ucugcuugccaucccucccucca

SEQ ID NO: 2938950 - RNA, 17 nt, Human
ucugcuugccaucccuc

SEQ ID NO: 2938951 - RNA, 20 nt, Human
ucugcuugccaucccucccu

SEQ ID NO: 2938952 - RNA, 16 nt, Human
ucugcuugccaucccu

SEQ ID NO: 2938953 - RNA, 18 nt, Human
agaagauuuugaaauuuu

SEQ ID NO: 2938954 - RNA, 17 nt, Human
ucugcccacucccugca

SEQ ID NO: 2938955 - RNA, 16 nt, Human
ucugcccacucccugc

SEQ ID NO: 2938956 - RNA, 22 nt, Human
agaagcccaggaaaggcuccag

SEQ ID NO: 2938957 - RNA, 21 nt, Human
agaagcccaggaaaggcucca

SEQ ID NO: 2938958 - RNA, 20 nt, Human
agaagcccaggaaaggcucc

SEQ ID NO: 2938959 - RNA, 18 nt, Human
agaagcccaggaaaggcu

SEQ ID NO: 2938960 - RNA, 16 nt, Human
agaagcccaggaaagg

SEQ ID NO: 2938961 - RNA, 12 nt, Human
agaagcccagga

SEQ ID NO: 2938962 - RNA, 18 nt, Human
agaagaugguaccaccag

SEQ ID NO: 2938963 - RNA, 14 nt, Human
agaagaacugaaau

SEQ ID NO: 2938964 - RNA, 13 nt, Human
agaagaacugaaa

SEQ ID NO: 2938965 - RNA, 17 nt, Human
agauuucacucuccuug

SEQ ID NO: 2938966 - RNA, 19 nt, Human
agauuucacucuccuuggu

SEQ ID NO: 2938967 - RNA, 21 nt, Human
agauugugccccugcacucca

SEQ ID NO: 2938968 - RNA, 13 nt, Human
agauucauauuua

SEQ ID NO: 2938969 - RNA, 16 nt, Human
agauucauauuuacuu

SEQ ID NO: 2938970 - RNA, 12 nt, Human
ugacuuacugua

SEQ ID NO: 2938971 - RNA, 20 nt, Human
ugacuuacuguacaugaaaa

SEQ ID NO: 2938972 - RNA, 23 nt, Human
ugacuauuuuuguuuuuauuaaa

SEQ ID NO: 2938973 - RNA, 18 nt, Human
ugacuauuuuuguuuuua

SEQ ID NO: 2938974 - RNA, 22 nt, Human
ugacuauuuuuguuuuuauuaa

SEQ ID NO: 2938975 - RNA, 11 nt, Human
ugacuguuuuu

SEQ ID NO: 2938976 - RNA, 21 nt, Human
ugacuguuuucucuugagagg

SEQ ID NO: 2938977 - RNA, 16 nt, Human
ugacuauaaccuuguu

SEQ ID NO: 2938978 - RNA, 12 nt, Human
ugaccuuucaau

SEQ ID NO: 2938979 - RNA, 19 nt, Human
ugacuauucugagaugacu

SEQ ID NO: 2938980 - RNA, 21 nt, Human
ugacuauucugagaugacuau

SEQ ID NO: 2938981 - RNA, 22 nt, Human
ugacuauucugagaugacuauu

SEQ ID NO: 2938982 - RNA, 15 nt, Human
ugaccuuuaagagaa

SEQ ID NO: 2938983 - RNA, 22 nt, Human
agaugugaacacaucagcuugc

SEQ ID NO: 2938984 - RNA, 17 nt, Human
agaugugaacacaucag

SEQ ID NO: 2938985 - RNA, 22 nt, Human
agauguauguacuucaugcugu

SEQ ID NO: 2938986 - RNA, 23 nt, Human
agauguaugcacacacauauauu

SEQ ID NO: 2938987 - RNA, 14 nt, Human
agauguaugcacac

SEQ ID NO: 2938988 - RNA, 18 nt, Human
agauguaugcacacacau

SEQ ID NO: 2938989 - RNA, 20 nt, Human
agauguaugcacacacauau

SEQ ID NO: 2938990 - RNA, 21 nt, Human
ugacagggcacaccgggcacu

SEQ ID NO: 2938991 - RNA, 22 nt, Human
ugacagggcacaccgggcacuc

SEQ ID NO: 2938992 - RNA, 17 nt, Human
ugacaggcaaugcuggc

SEQ ID NO: 2938993 - RNA, 19 nt, Human
ugacaggcaaugcuggcug

SEQ ID NO: 2938994 - RNA, 13 nt, Human
ugacauucccugc

SEQ ID NO: 2938995 - RNA, 13 nt, Human
ugacauguuuuau

SEQ ID NO: 2938996 - RNA, 16 nt, Human
ugacacgaauauugcu

SEQ ID NO: 2938997 - RNA, 19 nt, Human
ugacacgaauauugcugau

SEQ ID NO: 2938998 - RNA, 14 nt, Human
ugacagauugaauu

SEQ ID NO: 2938999 - RNA, 22 nt, Human
ugacagagugagacucugucuc

SEQ ID NO: 2939000 - RNA, 15 nt, Human
ugacacuuaaaaaug

SEQ ID NO: 2939001 - RNA, 13 nt, Human
agaugcacaugag

SEQ ID NO: 2939002 - RNA, 16 nt, Human
agaugcacaugagcug

SEQ ID NO: 2939003 - RNA, 20 nt, Human
agaugcaguucugaagaaga

SEQ ID NO: 2939004 - RNA, 21 nt, Human
agaugcaguucugaagaagau

SEQ ID NO: 2939005 - RNA, 19 nt, Human
agaugcuagaacucccuuu

SEQ ID NO: 2939006 - RNA, 13 nt, Human
agauguaugcaca

SEQ ID NO: 2939007 - RNA, 21 nt, Human
agaugcuagaacucccuuuca

SEQ ID NO: 2939008 - RNA, 15 nt, Human
agaugcuagaacucc

SEQ ID NO: 2939009 - RNA, 18 nt, Human
agaucucuaacuucacca

SEQ ID NO: 2939010 - RNA, 13 nt, Human
agauccuggaaau

SEQ ID NO: 2939011 - RNA, 17 nt, Human
agcaagugagagcuggg

SEQ ID NO: 2939012 - RNA, 21 nt, Human
agcacagcuucauuuccugug

SEQ ID NO: 2939013 - RNA, 16 nt, Human
agcacaugccucucuc

SEQ ID NO: 2939014 - RNA, 18 nt, Human
agcacaugccucucucag

SEQ ID NO: 2939015 - RNA, 22 nt, Human
agcacaugccucucucaggcca

SEQ ID NO: 2939016 - RNA, 21 nt, Human
agcacaugccucucucaggcc

SEQ ID NO: 2939017 - RNA, 20 nt, Human
agcacaugccucucucaggc

SEQ ID NO: 2939018 - RNA, 19 nt, Human
agcacaugccucucucagg

SEQ ID NO: 2939019 - RNA, 23 nt, Human
agcacaugccucucucaggccaa

SEQ ID NO: 2939020 - RNA, 16 nt, Human
agcaccaucucuccuc

SEQ ID NO: 2939021 - RNA, 13 nt, Human
agcaccuccugcc

SEQ ID NO: 2939022 - RNA, 14 nt, Human
agcaccuccugccu

SEQ ID NO: 2939023 - RNA, 16 nt, Human
agcaccuccugccucg

SEQ ID NO: 2939024 - RNA, 12 nt, Human
ugagccacugca

SEQ ID NO: 2939025 - RNA, 13 nt, Human
ugagccacugcac

SEQ ID NO: 2939026 - RNA, 21 nt, Human
ugagccagauuucacucuccu

SEQ ID NO: 2939027 - RNA, 20 nt, Human
ugagccagauuucacucucc

SEQ ID NO: 2939028 - RNA, 14 nt, Human
ugagccacugcacc

SEQ ID NO: 2939029 - RNA, 19 nt, Human
ugagccagauuucacucuc

SEQ ID NO: 2939030 - RNA, 18 nt, Human
ugagccagauuucacucu

SEQ ID NO: 2939031 - RNA, 16 nt, Human
agcaagugagacccug

SEQ ID NO: 2939032 - RNA, 15 nt, Human
agcaagugagagcug

SEQ ID NO: 2939033 - RNA, 16 nt, Human
agcaagugagagcugg

SEQ ID NO: 2939034 - RNA, 22 nt, Human
agcaagggugaugggaaagcau

SEQ ID NO: 2939035 - RNA, 20 nt, Human
agcaagggugaugggaaagc

SEQ ID NO: 2939036 - RNA, 14 nt, Human
agcaaggagauuua

SEQ ID NO: 2939037 - RNA, 17 nt, Human
agcaaggagauuuacaa

SEQ ID NO: 2939038 - RNA, 19 nt, Human
agcaaggagauuuacaacu

SEQ ID NO: 2939039 - RNA, 16 nt, Human
agcaagggugauggga

SEQ ID NO: 2939040 - RNA, 16 nt, Human
agauuuuccugaaaac

SEQ ID NO: 2939041 - RNA, 20 nt, Human
ugagaagcagaggaaggaga

SEQ ID NO: 2939042 - RNA, 15 nt, Human
agauuuuccugaaaa

SEQ ID NO: 2939043 - RNA, 14 nt, Human
agauuuuccugaaa

SEQ ID NO: 2939044 - RNA, 11 nt, Human
ugagacagagu

SEQ ID NO: 2939045 - RNA, 21 nt, Human
ugagacagaguuuucacucuu

SEQ ID NO: 2939046 - RNA, 13 nt, Human
ugagacagcccgg

SEQ ID NO: 2939047 - RNA, 20 nt, Human
ugagacuuuaaaagcauuuu

SEQ ID NO: 2939048 - RNA, 14 nt, Human
ugagacuuuaaaag

SEQ ID NO: 2939049 - RNA, 18 nt, Human
ugagacuuuaaaagcauu

SEQ ID NO: 2939050 - RNA, 12 nt, Human
ugagacuuuaaa

SEQ ID NO: 2939051 - RNA, 13 nt, Human
ugagacuuuaaaa

SEQ ID NO: 2939052 - RNA, 22 nt, Human
ugagacuggggccacuacauuu

SEQ ID NO: 2939053 - RNA, 23 nt, Human
ugagacuggggccacuacauuug

SEQ ID NO: 2939054 - RNA, 16 nt, Human
ugagagacacacugaa

SEQ ID NO: 2939055 - RNA, 17 nt, Human
ugagagacacacugaag

SEQ ID NO: 2939056 - RNA, 19 nt, Human
ugagagacacacugaagaa

SEQ ID NO: 2939057 - RNA, 20 nt, Human
ugagagacacacugaagaag

SEQ ID NO: 2939058 - RNA, 20 nt, Human
ugagacucugucucaaaaaa

SEQ ID NO: 2939059 - RNA, 20 nt, Human
ugagacucugucucagucca

SEQ ID NO: 2939060 - RNA, 12 nt, Human
ugagacagcucu

SEQ ID NO: 2939061 - RNA, 22 nt, Human
ugagacagcccgggcucugccu

SEQ ID NO: 2939062 - RNA, 20 nt, Human
ugagacagcccgggcucugc

SEQ ID NO: 2939063 - RNA, 19 nt, Human
ugagacagcccgggcucug

SEQ ID NO: 2939064 - RNA, 18 nt, Human
ugagacagcccgggcucu

SEQ ID NO: 2939065 - RNA, 17 nt, Human
ugagacagcccgggcuc

SEQ ID NO: 2939066 - RNA, 24 nt, Human
ugagaugugaacacaucagcuugc

SEQ ID NO: 2939067 - RNA, 19 nt, Human
ugagaugugaacacaucag

SEQ ID NO: 2939068 - RNA, 18 nt, Human
ugagaugugaacacauca

SEQ ID NO: 2939069 - RNA, 23 nt, Human
ugagaggacuuuucuuuguggcu

SEQ ID NO: 2939070 - RNA, 17 nt, Human
ugagaggaaaucaccga

SEQ ID NO: 2939071 - RNA, 13 nt, Human
ugagaugugaaca

SEQ ID NO: 2939072 - RNA, 14 nt, Human
ugagagcugggugu

SEQ ID NO: 2939073 - RNA, 10 nt, Human
ugagaggaaa

SEQ ID NO: 2939074 - RNA, 16 nt, Human
ugagagcugcaugugu

SEQ ID NO: 2939075 - RNA, 14 nt, Human
ugagaggaaaucac

SEQ ID NO: 2939076 - RNA, 13 nt, Human
ugagaggaaauca

SEQ ID NO: 2939077 - RNA, 12 nt, Human
ugagaggaaauc

SEQ ID NO: 2939078 - RNA, 11 nt, Human
ugagaggaaau

SEQ ID NO: 2939079 - RNA, 23 nt, Human
ugagagcaguuugguuucuagca

SEQ ID NO: 2939080 - RNA, 21 nt, Human
ugagagcaguuugguuucuag

SEQ ID NO: 2939081 - RNA, 21 nt, Human
ugagagacacacugaagaagc

SEQ ID NO: 2939082 - RNA, 22 nt, Human
ugagagacacacugaagaagca

SEQ ID NO: 2939083 - RNA, 14 nt, Human
ugaaaacacauuuu

SEQ ID NO: 2939084 - RNA, 12 nt, Human
ugaaaacacauu

SEQ ID NO: 2939085 - RNA, 13 nt, Human
ugaaaacacauuu

SEQ ID NO: 2939086 - RNA, 17 nt, Human
ugaaaauaaucucugau

SEQ ID NO: 2939087 - RNA, 17 nt, Human
ugaaaauauuuguauca

SEQ ID NO: 2939088 - RNA, 18 nt, Human
ugaaaauaaucucugauu

SEQ ID NO: 2939089 - RNA, 22 nt, Human
ugaaaauaaucucugauucccu

SEQ ID NO: 2939090 - RNA, 15 nt, Human
ugaaaacacauuuuu

SEQ ID NO: 2939091 - RNA, 17 nt, Human
ugaaaacacauuuuucu

SEQ ID NO: 2939092 - RNA, 19 nt, Human
ugaaaacacauuuuucuua

SEQ ID NO: 2939093 - RNA, 20 nt, Human
ugaaaaucuuauaauuuaaa

SEQ ID NO: 2939094 - RNA, 22 nt, Human
ugaaaauauuuguaucacaaau

SEQ ID NO: 2939095 - RNA, 21 nt, Human
ugaaaauauuuguaucacaaa

SEQ ID NO: 2939096 - RNA, 22 nt, Human
ugaaacugagaugugaacacau

SEQ ID NO: 2939097 - RNA, 13 nt, Human
ugaaagaaaauaa

SEQ ID NO: 2939098 - RNA, 17 nt, Human
ugaaacuggauuaaacu

SEQ ID NO: 2939099 - RNA, 18 nt, Human
ugaaacuggauuaaacuu

SEQ ID NO: 2939100 - RNA, 11 nt, Human
agagacuccug

SEQ ID NO: 2939101 - RNA, 12 nt, Human
agagacuccugc

SEQ ID NO: 2939102 - RNA, 14 nt, Human
agagacuccugcag

SEQ ID NO: 2939103 - RNA, 13 nt, Human
agagacuccugca

SEQ ID NO: 2939104 - RNA, 23 nt, Human
agagaccaucccugaaggccccg

SEQ ID NO: 2939105 - RNA, 22 nt, Human
agagaccaucccugaaggcccc

SEQ ID NO: 2939106 - RNA, 18 nt, Human
agagaccaucccugaagg

SEQ ID NO: 2939107 - RNA, 18 nt, Human
ugaaagaggaaugaagua

SEQ ID NO: 2939108 - RNA, 21 nt, Human
agagaccaucccugaaggccc

SEQ ID NO: 2939109 - RNA, 19 nt, Human
agagaccaucccugaaggc

SEQ ID NO: 2939110 - RNA, 17 nt, Human
ugaaagaggaaugaagu

SEQ ID NO: 2939111 - RNA, 22 nt, Human
ugaaagacuguacaaaguagaa

SEQ ID NO: 2939112 - RNA, 18 nt, Human
ugaaagacuguacaaagu

SEQ ID NO: 2939113 - RNA, 19 nt, Human
ugaaagacuguacaaagua

SEQ ID NO: 2939114 - RNA, 16 nt, Human
ugaaagacuguacaaa

SEQ ID NO: 2939115 - RNA, 12 nt, Human
ugaaacuuuugg

SEQ ID NO: 2939116 - RNA, 22 nt, Human
ugaaagaaaauaccaaggaaca

SEQ ID NO: 2939117 - RNA, 16 nt, Human
agacucccaugaggga

SEQ ID NO: 2939118 - RNA, 14 nt, Human
agacuccauaguuu

SEQ ID NO: 2939119 - RNA, 16 nt, Human
agacuccauaguuugg

SEQ ID NO: 2939120 - RNA, 13 nt, Human
agacuccugcagg

SEQ ID NO: 2939121 - RNA, 23 nt, Human
agacuggcgugaacccaggaggc

SEQ ID NO: 2939122 - RNA, 17 nt, Human
agacuggcgugaaccca

SEQ ID NO: 2939123 - RNA, 18 nt, Human
agacuggcgugaacccag

SEQ ID NO: 2939124 - RNA, 22 nt, Human
agacuggcgugaacccaggagg

SEQ ID NO: 2939125 - RNA, 23 nt, Human
agacuggcacaguuuucugagaa

SEQ ID NO: 2939126 - RNA, 18 nt, Human
agacuggcacaguuuucu

SEQ ID NO: 2939127 - RNA, 21 nt, Human
agacuggcacaguuuucugag

SEQ ID NO: 2939128 - RNA, 20 nt, Human
agacuggcacaguuuucuga

SEQ ID NO: 2939129 - RNA, 18 nt, Human
ucuuuaaugucacaggca

SEQ ID NO: 2939130 - RNA, 19 nt, Human
ucuuuaaugucacaggcag

SEQ ID NO: 2939131 - RNA, 15 nt, Human
ucuuuaaugucacag

SEQ ID NO: 2939132 - RNA, 20 nt, Human
agacaggcaagcaccuccug

SEQ ID NO: 2939133 - RNA, 12 nt, Human
ucuuuccugagg

SEQ ID NO: 2939134 - RNA, 22 nt, Human
agacuccaaagaaauguaaggg

SEQ ID NO: 2939135 - RNA, 17 nt, Human
agacuuugguuauuuua

SEQ ID NO: 2939136 - RNA, 23 nt, Human
agacuuugguuauuuuacuuuuu

SEQ ID NO: 2939137 - RNA, 15 nt, Human
agagacacaagccuu

SEQ ID NO: 2939138 - RNA, 19 nt, Human
agagacacaagccuucggc

SEQ ID NO: 2939139 - RNA, 16 nt, Human
agagacacaagccuuc

SEQ ID NO: 2939140 - RNA, 19 nt, Human
agacuuuggaaagaguagg

SEQ ID NO: 2939141 - RNA, 15 nt, Human
agacuuuuccaaccc

SEQ ID NO: 2939142 - RNA, 15 nt, Human
agacuuuggaaagac

SEQ ID NO: 2939143 - RNA, 15 nt, Human
agacuuuggaaagag

SEQ ID NO: 2939144 - RNA, 17 nt, Human
agacuuuggaaagacuu

SEQ ID NO: 2939145 - RNA, 14 nt, Human
agacuggggccacu

SEQ ID NO: 2939146 - RNA, 20 nt, Human
agacugguuccauggccucu

SEQ ID NO: 2939147 - RNA, 14 nt, Human
ucuuuguggcuucc

SEQ ID NO: 2939148 - RNA, 14 nt, Human
agagacagaaagca

SEQ ID NO: 2939149 - RNA, 16 nt, Human
agagacacacugaaga

SEQ ID NO: 2939150 - RNA, 20 nt, Human
ucuuuguacagacaacaaac

SEQ ID NO: 2939151 - RNA, 15 nt, Human
ucuuuguacagacaa

SEQ ID NO: 2939152 - RNA, 14 nt, Human
ucuuuguacagaca

SEQ ID NO: 2939153 - RNA, 17 nt, Human
ugaaguacucauacaug

SEQ ID NO: 2939154 - RNA, 13 nt, Human
ugaagucacacag

SEQ ID NO: 2939155 - RNA, 12 nt, Human
ugaauaauacag

SEQ ID NO: 2939156 - RNA, 21 nt, Human
ugaauaaccugaggauucuau

SEQ ID NO: 2939157 - RNA, 13 nt, Human
ugaauaauacagu

SEQ ID NO: 2939158 - RNA, 19 nt, Human
ugaaguaaaauguggcagg

SEQ ID NO: 2939159 - RNA, 18 nt, Human
ugaaguaaaauguggcag

SEQ ID NO: 2939160 - RNA, 15 nt, Human
ugaaguaauaugcac

SEQ ID NO: 2939161 - RNA, 16 nt, Human
ugaaguaauaugcaca

SEQ ID NO: 2939162 - RNA, 20 nt, Human
ugaaguaauaugcacacauu

SEQ ID NO: 2939163 - RNA, 21 nt, Human
ugaaguaauaugcacacauuu

SEQ ID NO: 2939164 - RNA, 22 nt, Human
ugaaguaauaugcacacauuuu

SEQ ID NO: 2939165 - RNA, 17 nt, Human
ugaagauuuaccacuug

SEQ ID NO: 2939166 - RNA, 20 nt, Human
ugaagauuuaccacuugugu

SEQ ID NO: 2939167 - RNA, 20 nt, Human
agagguucaaagauauuuug

SEQ ID NO: 2939168 - RNA, 16 nt, Human
agagguucaaagauau

SEQ ID NO: 2939169 - RNA, 19 nt, Human
agagguucaaagauauuuu

SEQ ID NO: 2939170 - RNA, 15 nt, Human
agagggagguaagga

SEQ ID NO: 2939171 - RNA, 15 nt, Human
agagggagugacaga

SEQ ID NO: 2939172 - RNA, 20 nt, Human
agagggagugacagaggcag

SEQ ID NO: 2939173 - RNA, 13 nt, Human
agagguucaaaga

SEQ ID NO: 2939174 - RNA, 22 nt, Human
agaggcugccucucccaucacu

SEQ ID NO: 2939175 - RNA, 21 nt, Human
agaggcagccccauucugccu

SEQ ID NO: 2939176 - RNA, 22 nt, Human
agaggcagccccauucugccug

SEQ ID NO: 2939177 - RNA, 21 nt, Human
agaggcagggucucacucugu

SEQ ID NO: 2939178 - RNA, 23 nt, Human
agaggcagccccauucugccugc

SEQ ID NO: 2939179 - RNA, 18 nt, Human
agagcuguucacagccag

SEQ ID NO: 2939180 - RNA, 22 nt, Human
ugaagaagcaccaaucaugaau

SEQ ID NO: 2939181 - RNA, 13 nt, Human
ugaagacagagcu

SEQ ID NO: 2939182 - RNA, 22 nt, Human
ugaagacaaugacuuacuguac

SEQ ID NO: 2939183 - RNA, 23 nt, Human
ugaagacaaugacuuacuguaca

SEQ ID NO: 2939184 - RNA, 21 nt, Human
ugaagacaaugacuuacugua

SEQ ID NO: 2939185 - RNA, 22 nt, Human
ugaaccaccacacccagcccac

SEQ ID NO: 2939186 - RNA, 21 nt, Human
ugaaccaccacacccagccca

SEQ ID NO: 2939187 - RNA, 13 nt, Human
ugaacaaauuuac

SEQ ID NO: 2939188 - RNA, 22 nt, Human
ugaacccauauuuguacaccaa

SEQ ID NO: 2939189 - RNA, 18 nt, Human
ugaacccgggaggcagag

SEQ ID NO: 2939190 - RNA, 15 nt, Human
ugaaauuuccuggga

SEQ ID NO: 2939191 - RNA, 19 nt, Human
ugaaauuuuuauuaaauua

SEQ ID NO: 2939192 - RNA, 21 nt, Human
ugaaauuuccugggagcuuuu

SEQ ID NO: 2939193 - RNA, 20 nt, Human
ugaaauuuuuauuaaauuau

SEQ ID NO: 2939194 - RNA, 13 nt, Human
ugaaauaaacguc

SEQ ID NO: 2939195 - RNA, 18 nt, Human
ugaaauaaacgucuuaaa

SEQ ID NO: 2939196 - RNA, 22 nt, Human
ugaaauaaacgucuuaaauauu

SEQ ID NO: 2939197 - RNA, 23 nt, Human
ugaaauaaacgucuuaaauauuc

SEQ ID NO: 2939198 - RNA, 17 nt, Human
ugaaauaacauggccuu

SEQ ID NO: 2939199 - RNA, 16 nt, Human
ugaaauaacauggccu

SEQ ID NO: 2939200 - RNA, 16 nt, Human
agagauugugguuuca

SEQ ID NO: 2939201 - RNA, 15 nt, Human
agagcugcccucucc

SEQ ID NO: 2939202 - RNA, 19 nt, Human
agagcugcccucuccuggg

SEQ ID NO: 2939203 - RNA, 20 nt, Human
agagcugcccucuccugggc

SEQ ID NO: 2939204 - RNA, 16 nt, Human
agagcugcccucuccu

SEQ ID NO: 2939205 - RNA, 17 nt, Human
agagcugcccucuccug

SEQ ID NO: 2939206 - RNA, 18 nt, Human
agagcugcccucuccugg

SEQ ID NO: 2939207 - RNA, 20 nt, Human
uguacaugaaaacacauuuu

SEQ ID NO: 2939208 - RNA, 19 nt, Human
uguacaugaaaacacauuu

SEQ ID NO: 2939209 - RNA, 17 nt, Human
uguacaugaaaacacau

SEQ ID NO: 2939210 - RNA, 18 nt, Human
uguacaugaaaacacauu

SEQ ID NO: 2939211 - RNA, 17 nt, Human
uguagacaguuggguuu

SEQ ID NO: 2939212 - RNA, 21 nt, Human
uguagaagucacauuccugaa

SEQ ID NO: 2939213 - RNA, 17 nt, Human
uguaauuugugauacaa

SEQ ID NO: 2939214 - RNA, 21 nt, Human
uguaauuugugauacaaugcu

SEQ ID NO: 2939215 - RNA, 16 nt, Human
uguaauuugugauaca

SEQ ID NO: 2939216 - RNA, 18 nt, Human
uguaaggaaugauuaauu

SEQ ID NO: 2939217 - RNA, 19 nt, Human
uguacaaaguagaagucuu

SEQ ID NO: 2939218 - RNA, 23 nt, Human
uguacaaaguagaagucuuagau

SEQ ID NO: 2939219 - RNA, 14 nt, Human
agguggggcagcuu

SEQ ID NO: 2939220 - RNA, 23 nt, Human
agguggggucacucuggcagcuc

SEQ ID NO: 2939221 - RNA, 13 nt, Human
agguggggcagcu

SEQ ID NO: 2939222 - RNA, 23 nt, Human
aggugugaaccaccacacccagc

SEQ ID NO: 2939223 - RNA, 18 nt, Human
aggugugacugaauuucu

SEQ ID NO: 2939224 - RNA, 22 nt, Human
aggugugaaccaccacacccag

SEQ ID NO: 2939225 - RNA, 20 nt, Human
aggugugacugaauuucuuu

SEQ ID NO: 2939226 - RNA, 14 nt, Human
aggugugagucacc

SEQ ID NO: 2939227 - RNA, 20 nt, Human
aggugugagucaccaagccc

SEQ ID NO: 2939228 - RNA, 12 nt, Human
agguugugaaug

SEQ ID NO: 2939229 - RNA, 13 nt, Human
uguaaggaaugau

SEQ ID NO: 2939230 - RNA, 15 nt, Human
uguaaggaaugauua

SEQ ID NO: 2939231 - RNA, 14 nt, Human
uguaaggaaugauu

SEQ ID NO: 2939232 - RNA, 17 nt, Human
uguaagaaaauaucacu

SEQ ID NO: 2939233 - RNA, 18 nt, Human
uguaagaaaauaucacuu

SEQ ID NO: 2939234 - RNA, 22 nt, Human
uguaagcucuacugaggugcua

SEQ ID NO: 2939235 - RNA, 13 nt, Human
ugguuuucuguuc

SEQ ID NO: 2939236 - RNA, 15 nt, Human
ugguuuucuguucuu

SEQ ID NO: 2939237 - RNA, 21 nt, Human
aggugauccacccaccucagc

SEQ ID NO: 2939238 - RNA, 23 nt, Human
aggugauccacccaccucagccu

SEQ ID NO: 2939239 - RNA, 12 nt, Human
ugguuuucuguu

SEQ ID NO: 2939240 - RNA, 15 nt, Human
ugguuuguucccugu

SEQ ID NO: 2939241 - RNA, 21 nt, Human
ugguuuguaaauuaacuuuua

SEQ ID NO: 2939242 - RNA, 14 nt, Human
ugguuucagaaaug

SEQ ID NO: 2939243 - RNA, 15 nt, Human
ugguuucagaaaugu

SEQ ID NO: 2939244 - RNA, 15 nt, Human
ugguuucuagcauga

SEQ ID NO: 2939245 - RNA, 16 nt, Human
ugguuauuuuacuuuu

SEQ ID NO: 2939246 - RNA, 15 nt, Human
ugguuauuuuacuuu

SEQ ID NO: 2939247 - RNA, 18 nt, Human
ugguuauuuuacuuuuug

SEQ ID NO: 2939248 - RNA, 17 nt, Human
ugguguuuccuggcacu

SEQ ID NO: 2939249 - RNA, 15 nt, Human
ugguguuuccuggca

SEQ ID NO: 2939250 - RNA, 20 nt, Human
ugguucaggguuggccccug

SEQ ID NO: 2939251 - RNA, 22 nt, Human
ugguucaggguuggccccugcc

SEQ ID NO: 2939252 - RNA, 23 nt, Human
ugguucaggguuggccccugccc

SEQ ID NO: 2939253 - RNA, 12 nt, Human
ugguggcagcug

SEQ ID NO: 2939254 - RNA, 23 nt, Human
uggugugaccacugcagaagaca

SEQ ID NO: 2939255 - RNA, 23 nt, Human
ugguggcagcucaccucucccuu

SEQ ID NO: 2939256 - RNA, 20 nt, Human
ugguggcagcucaccucucc

SEQ ID NO: 2939257 - RNA, 19 nt, Human
ugguggcagcucaccucuc

SEQ ID NO: 2939258 - RNA, 16 nt, Human
ugguggcagcucaccu

SEQ ID NO: 2939259 - RNA, 12 nt, Human
ugguggcagcuc

SEQ ID NO: 2939260 - RNA, 15 nt, Human
ugguggcagagugga

SEQ ID NO: 2939261 - RNA, 22 nt, Human
agggugaugggaaagcauugua

SEQ ID NO: 2939262 - RNA, 21 nt, Human
agggugaugggaaagcauugu

SEQ ID NO: 2939263 - RNA, 14 nt, Human
uggguggaugccug

SEQ ID NO: 2939264 - RNA, 23 nt, Human
uggguggaugccugguggcagcu

SEQ ID NO: 2939265 - RNA, 20 nt, Human
uggucaccaaaucagcugcu

SEQ ID NO: 2939266 - RNA, 23 nt, Human
uggucaccaaaucagcugcuacu

SEQ ID NO: 2939267 - RNA, 21 nt, Human
uggucaccaaaucagcugcua

SEQ ID NO: 2939268 - RNA, 16 nt, Human
ugguccauagagagca

SEQ ID NO: 2939269 - RNA, 15 nt, Human
ugguccauagagagc

SEQ ID NO: 2939270 - RNA, 16 nt, Human
aggguaucaggugcug

SEQ ID NO: 2939271 - RNA, 19 nt, Human
aggguacuaaggaaucuuu

SEQ ID NO: 2939272 - RNA, 21 nt, Human
aggggcuuaauuauugauguu

SEQ ID NO: 2939273 - RNA, 13 nt, Human
agggggcugggac

SEQ ID NO: 2939274 - RNA, 16 nt, Human
aggggaauugaggaca

SEQ ID NO: 2939275 - RNA, 18 nt, Human
aggucuugaacuccuggc

SEQ ID NO: 2939276 - RNA, 22 nt, Human
aggucuugaacuccuggccuca

SEQ ID NO: 2939277 - RNA, 20 nt, Human
aggucuugaacuccuggccu

SEQ ID NO: 2939278 - RNA, 21 nt, Human
aggucuugaacuccuggccuc

SEQ ID NO: 2939279 - RNA, 22 nt, Human
aggucauuuuuuuuaagaaaaa

SEQ ID NO: 2939280 - RNA, 23 nt, Human
aggucauuuuuuuuaagaaaaag

SEQ ID NO: 2939281 - RNA, 15 nt, Human
aggucagugcaaaua

SEQ ID NO: 2939282 - RNA, 21 nt, Human
aggucaaggcugcagugagcc

SEQ ID NO: 2939283 - RNA, 17 nt, Human
agguaugcaaucaaauc

SEQ ID NO: 2939284 - RNA, 17 nt, Human
aggguugggcugguguc

SEQ ID NO: 2939285 - RNA, 14 nt, Human
aggguuuaaagaug

SEQ ID NO: 2939286 - RNA, 20 nt, Human
aggguuuauguuuaggaugu

SEQ ID NO: 2939287 - RNA, 13 nt, Human
aggguuggccccu

SEQ ID NO: 2939288 - RNA, 14 nt, Human
aggguuggccccug

SEQ ID NO: 2939289 - RNA, 13 nt, Human
aggguugggcugg

SEQ ID NO: 2939290 - RNA, 15 nt, Human
aggguugggcuggug

SEQ ID NO: 2939291 - RNA, 19 nt, Human
uggugaacagaacaaaagg

SEQ ID NO: 2939292 - RNA, 17 nt, Human
aggguggugaccucugc

SEQ ID NO: 2939293 - RNA, 18 nt, Human
aggguggugaccucugcc

SEQ ID NO: 2939294 - RNA, 19 nt, Human
aggguggugaccucugccu

SEQ ID NO: 2939295 - RNA, 17 nt, Human
aggguuaugauuaagua

SEQ ID NO: 2939296 - RNA, 18 nt, Human
uggucugacccacugcuu

SEQ ID NO: 2939297 - RNA, 12 nt, Human
uggucuguguga

SEQ ID NO: 2939298 - RNA, 22 nt, Human
uggucugugagaugcuagaacu

SEQ ID NO: 2939299 - RNA, 16 nt, Human
uggucuuauuuguaaa

SEQ ID NO: 2939300 - RNA, 19 nt, Human
ugguccauagagagcaaga

SEQ ID NO: 2939301 - RNA, 22 nt, Human
ugguccaugggccauaugaaaa

SEQ ID NO: 2939302 - RNA, 14 nt, Human
ugugaagagaacca

SEQ ID NO: 2939303 - RNA, 14 nt, Human
ugugaagcaaaauu

SEQ ID NO: 2939304 - RNA, 19 nt, Human
ugugagcacaaagguagcu

SEQ ID NO: 2939305 - RNA, 22 nt, Human
ugugagaugcuagaacucccuu

SEQ ID NO: 2939306 - RNA, 14 nt, Human
agucuucuauuuau

SEQ ID NO: 2939307 - RNA, 23 nt, Human
agugaaaaaggaggaagagaaaa

SEQ ID NO: 2939308 - RNA, 20 nt, Human
agugaaaaaggaggaagaga

SEQ ID NO: 2939309 - RNA, 17 nt, Human
agugaaaaaggaggaag

SEQ ID NO: 2939310 - RNA, 11 nt, Human
agugaaaaagg

SEQ ID NO: 2939311 - RNA, 19 nt, Human
ugugauuuuugguauuuga

SEQ ID NO: 2939312 - RNA, 21 nt, Human
ugugauuuuugguauuugaaa

SEQ ID NO: 2939313 - RNA, 20 nt, Human
ugugauuuuugguauuugaa

SEQ ID NO: 2939314 - RNA, 17 nt, Human
ugugauggggcccugcc

SEQ ID NO: 2939315 - RNA, 16 nt, Human
agugagccgagauugu

SEQ ID NO: 2939316 - RNA, 16 nt, Human
ugugauggggcccugc

SEQ ID NO: 2939317 - RNA, 15 nt, Human
ugugauggggcccug

SEQ ID NO: 2939318 - RNA, 14 nt, Human
agugagagcugggu

SEQ ID NO: 2939319 - RNA, 21 nt, Human
agugagcagucaggaaagaga

SEQ ID NO: 2939320 - RNA, 13 nt, Human
agugagacucugu

SEQ ID NO: 2939321 - RNA, 21 nt, Human
agugagacccugucucaaaaa

SEQ ID NO: 2939322 - RNA, 17 nt, Human
agugagacccugucuca

SEQ ID NO: 2939323 - RNA, 22 nt, Human
agugagacuggggccacuacau

SEQ ID NO: 2939324 - RNA, 22 nt, Human
agugagacucugucucaaaaaa

SEQ ID NO: 2939325 - RNA, 16 nt, Human
agugagacucugucuc

SEQ ID NO: 2939326 - RNA, 17 nt, Human
agugagacucugucuca

SEQ ID NO: 2939327 - RNA, 17 nt, Human
agugaaagaaaauaaca

SEQ ID NO: 2939328 - RNA, 16 nt, Human
agugaaagaggcagcu

SEQ ID NO: 2939329 - RNA, 14 nt, Human
agugagacagcucu

SEQ ID NO: 2939330 - RNA, 22 nt, Human
agugaaagaggcagcuugaaac

SEQ ID NO: 2939331 - RNA, 14 nt, Human
ugucuucacaacag

SEQ ID NO: 2939332 - RNA, 15 nt, Human
ugucuugcaauggca

SEQ ID NO: 2939333 - RNA, 17 nt, Human
ugucuugcaauggcagc

SEQ ID NO: 2939334 - RNA, 18 nt, Human
ugucuugcaauggcagcc

SEQ ID NO: 2939335 - RNA, 20 nt, Human
ugucuugcaauggcagccuu

SEQ ID NO: 2939336 - RNA, 21 nt, Human
ugucuugcaauggcagccuug

SEQ ID NO: 2939337 - RNA, 16 nt, Human
ugugaaccaccacacc

SEQ ID NO: 2939338 - RNA, 22 nt, Human
ugugaaccaccacacccagccc

SEQ ID NO: 2939339 - RNA, 23 nt, Human
ugugaaccaccacacccagccca

SEQ ID NO: 2939340 - RNA, 22 nt, Human
ugugaacaguuguguuugaagc

SEQ ID NO: 2939341 - RNA, 15 nt, Human
ugugaaccaccacac

SEQ ID NO: 2939342 - RNA, 21 nt, Human
ugucucuugguccugcugcag

SEQ ID NO: 2939343 - RNA, 20 nt, Human
ugucucuugguccugcugca

SEQ ID NO: 2939344 - RNA, 19 nt, Human
ugucucuugguccugcugc

SEQ ID NO: 2939345 - RNA, 18 nt, Human
ugucucuugguccugcug

SEQ ID NO: 2939346 - RNA, 22 nt, Human
ugucucuuuaaugucacaggca

SEQ ID NO: 2939347 - RNA, 21 nt, Human
ugucucuuuaaugucacaggc

SEQ ID NO: 2939348 - RNA, 22 nt, Human
ugucucuugguccugcugcagu

SEQ ID NO: 2939349 - RNA, 12 nt, Human
ugucuuaauuaa

SEQ ID NO: 2939350 - RNA, 14 nt, Human
ugucuuaauuaaaa

SEQ ID NO: 2939351 - RNA, 15 nt, Human
ugucuccucucucug

SEQ ID NO: 2939352 - RNA, 22 nt, Human
aguccccucuccuccacauuug

SEQ ID NO: 2939353 - RNA, 16 nt, Human
agucccugccaaugga

SEQ ID NO: 2939354 - RNA, 14 nt, Human
agucccugccaaug

SEQ ID NO: 2939355 - RNA, 13 nt, Human
agucccugccaau

SEQ ID NO: 2939356 - RNA, 23 nt, Human
aguccccuguuuguuucugaaag

SEQ ID NO: 2939357 - RNA, 13 nt, Human
ugucucugagagu

SEQ ID NO: 2939358 - RNA, 17 nt, Human
ugucucuacuaaaaaua

SEQ ID NO: 2939359 - RNA, 23 nt, Human
agguuuggacaaaauggaauacu

SEQ ID NO: 2939360 - RNA, 12 nt, Human
uguagagccagg

SEQ ID NO: 2939361 - RNA, 15 nt, Human
uguagagccaggguc

SEQ ID NO: 2939362 - RNA, 15 nt, Human
uguaucccaugagcc

SEQ ID NO: 2939363 - RNA, 14 nt, Human
uguauguguaagua

SEQ ID NO: 2939364 - RNA, 16 nt, Human
uguauguguaauaaau

SEQ ID NO: 2939365 - RNA, 17 nt, Human
uguauguguaauaaaua

SEQ ID NO: 2939366 - RNA, 15 nt, Human
ugucaaaguggugag

SEQ ID NO: 2939367 - RNA, 14 nt, Human
ugucaaagugguga

SEQ ID NO: 2939368 - RNA, 20 nt, Human
ugucaaccccaaguuaguuc

SEQ ID NO: 2939369 - RNA, 19 nt, Human
ugucaaaguggugagaggc

SEQ ID NO: 2939370 - RNA, 16 nt, Human
ugucaaaguggugaga

SEQ ID NO: 2939371 - RNA, 13 nt, Human
aguagcugggacu

SEQ ID NO: 2939372 - RNA, 14 nt, Human
aguagcugggacua

SEQ ID NO: 2939373 - RNA, 15 nt, Human
aguauuguccagguc

SEQ ID NO: 2939374 - RNA, 16 nt, Human
aguauuguccaggucu

SEQ ID NO: 2939375 - RNA, 20 nt, Human
agucacauuccaagccucau

SEQ ID NO: 2939376 - RNA, 16 nt, Human
agucacugagacagcc

SEQ ID NO: 2939377 - RNA, 15 nt, Human
agucacugagacagc

SEQ ID NO: 2939378 - RNA, 17 nt, Human
agucacugagacagccc

SEQ ID NO: 2939379 - RNA, 15 nt, Human
ugucagcauagaagu

SEQ ID NO: 2939380 - RNA, 15 nt, Human
aguauuauaccuuuu

SEQ ID NO: 2939381 - RNA, 14 nt, Human
aguauuauaccuuu

SEQ ID NO: 2939382 - RNA, 22 nt, Human
aguagcugggacuacaggcacc

SEQ ID NO: 2939383 - RNA, 19 nt, Human
aguagcugggacuacaggc

SEQ ID NO: 2939384 - RNA, 21 nt, Human
aguagcugggacuacaggcac

SEQ ID NO: 2939385 - RNA, 21 nt, Human
aguauuagaauaccacaggaa

SEQ ID NO: 2939386 - RNA, 18 nt, Human
aguauguuagugcaaauu

SEQ ID NO: 2939387 - RNA, 21 nt, Human
aguauguuagugcaaauuguc

SEQ ID NO: 2939388 - RNA, 21 nt, Human
aguccccucuccuccacauuu

SEQ ID NO: 2939389 - RNA, 19 nt, Human
aguccccuguuuguuucug

SEQ ID NO: 2939390 - RNA, 14 nt, Human
aguccccuguuugu

SEQ ID NO: 2939391 - RNA, 21 nt, Human
agucccaccuuggcugcaggg

SEQ ID NO: 2939392 - RNA, 23 nt, Human
agucccaccuuggcugcagggag

SEQ ID NO: 2939393 - RNA, 20 nt, Human
agucccaccuuggcugcagg

SEQ ID NO: 2939394 - RNA, 15 nt, Human
agucagucauucaga

SEQ ID NO: 2939395 - RNA, 21 nt, Human
agucagucauucagauaugau

SEQ ID NO: 2939396 - RNA, 19 nt, Human
agucagggguucccuuuuu

SEQ ID NO: 2939397 - RNA, 12 nt, Human
ugucccuuuucc

SEQ ID NO: 2939398 - RNA, 14 nt, Human
ugucccugcacuug

SEQ ID NO: 2939399 - RNA, 20 nt, Human
ugucagcuaaagaaguuuga

SEQ ID NO: 2939400 - RNA, 16 nt, Human
ugucagccauuccugu

SEQ ID NO: 2939401 - RNA, 23 nt, Human
ugucagcuccccucggagaagag

SEQ ID NO: 2939402 - RNA, 21 nt, Human
ugucagcuccccucggagaag

SEQ ID NO: 2939403 - RNA, 20 nt, Human
ugucagcuccccucggagaa

SEQ ID NO: 2939404 - RNA, 18 nt, Human
uuagcaggaagcugugag

SEQ ID NO: 2939405 - RNA, 23 nt, Human
uuagaugcaguucugaagaagau

SEQ ID NO: 2939406 - RNA, 22 nt, Human
uuagaugcaguucugaagaaga

SEQ ID NO: 2939407 - RNA, 19 nt, Human
auaauacaguaucucaggg

SEQ ID NO: 2939408 - RNA, 21 nt, Human
auaaucuuucacaggggacag

SEQ ID NO: 2939409 - RNA, 14 nt, Human
auaauucuacuuug

SEQ ID NO: 2939410 - RNA, 14 nt, Human
auaaugaauacuuu

SEQ ID NO: 2939411 - RNA, 23 nt, Human
auaagaaccuuuugagugccuua

SEQ ID NO: 2939412 - RNA, 17 nt, Human
auaaguuaacuuccaau

SEQ ID NO: 2939413 - RNA, 22 nt, Human
auaagaaccuuuugagugccuu

SEQ ID NO: 2939414 - RNA, 22 nt, Human
auaaguuaacuuccaauuuaca

SEQ ID NO: 2939415 - RNA, 23 nt, Human
auaauacaccacuacauucuguu

SEQ ID NO: 2939416 - RNA, 21 nt, Human
auaauacaccacuacauucug

SEQ ID NO: 2939417 - RNA, 19 nt, Human
auaaaugugccuucauuuu

SEQ ID NO: 2939418 - RNA, 20 nt, Human
auaaccaguguuguggauuu

SEQ ID NO: 2939419 - RNA, 12 nt, Human
auaacuggaaac

SEQ ID NO: 2939420 - RNA, 16 nt, Human
auaacuggaacacucu

SEQ ID NO: 2939421 - RNA, 18 nt, Human
auaacuggaacacucuau

SEQ ID NO: 2939422 - RNA, 23 nt, Human
uuaccauuuugggguacccacug

SEQ ID NO: 2939423 - RNA, 22 nt, Human
uuacaggaaguacuggagaaaa

SEQ ID NO: 2939424 - RNA, 18 nt, Human
uuacaggaaguacuggag

SEQ ID NO: 2939425 - RNA, 21 nt, Human
auaacuggaacacucuauaac

SEQ ID NO: 2939426 - RNA, 23 nt, Human
auaacuggaacacucuauaacaa

SEQ ID NO: 2939427 - RNA, 16 nt, Human
uuacaggaaguacugg

SEQ ID NO: 2939428 - RNA, 15 nt, Human
uuacaggaaguacug

SEQ ID NO: 2939429 - RNA, 17 nt, Human
aguuuucugagaaagac

SEQ ID NO: 2939430 - RNA, 14 nt, Human
aguuuucugagaaa

SEQ ID NO: 2939431 - RNA, 13 nt, Human
aguuuucugagaa

SEQ ID NO: 2939432 - RNA, 12 nt, Human
aguuuucugaga

SEQ ID NO: 2939433 - RNA, 16 nt, Human
auaaaccgaacugaug

SEQ ID NO: 2939434 - RNA, 13 nt, Human
auaaacuuuaccu

SEQ ID NO: 2939435 - RNA, 15 nt, Human
auaaacuuuaccuuu

SEQ ID NO: 2939436 - RNA, 18 nt, Human
auaaacgucuuaaauauu

SEQ ID NO: 2939437 - RNA, 15 nt, Human
auaaacgucuuaaau

SEQ ID NO: 2939438 - RNA, 16 nt, Human
auaaacgucuuaaaua

SEQ ID NO: 2939439 - RNA, 15 nt, Human
auaaacucauuucua

SEQ ID NO: 2939440 - RNA, 16 nt, Human
uuagcccugaacauuu

SEQ ID NO: 2939441 - RNA, 21 nt, Human
uuagccguggugauuuagcag

SEQ ID NO: 2939442 - RNA, 15 nt, Human
uuagcccugaacauu

SEQ ID NO: 2939443 - RNA, 21 nt, Human
uuauaacuuaaugaaaacaau

SEQ ID NO: 2939444 - RNA, 17 nt, Human
uuauaacuuuuuauauu

SEQ ID NO: 2939445 - RNA, 15 nt, Human
uuauaacuuaaugaa

SEQ ID NO: 2939446 - RNA, 14 nt, Human
uuauaacuuuuuau

SEQ ID NO: 2939447 - RNA, 16 nt, Human
uuauaacuuuuuauau

SEQ ID NO: 2939448 - RNA, 21 nt, Human
auaauuuuuauauuugaaaua

SEQ ID NO: 2939449 - RNA, 22 nt, Human
auaauuuuuauauuugaaauau

SEQ ID NO: 2939450 - RNA, 22 nt, Human
auacaaaaaaaaaaaaaaauua

SEQ ID NO: 2939451 - RNA, 12 nt, Human
auacaaaagcau

SEQ ID NO: 2939452 - RNA, 13 nt, Human
auacaaaagcaug

SEQ ID NO: 2939453 - RNA, 15 nt, Human
auacaaaagcaugug

SEQ ID NO: 2939454 - RNA, 14 nt, Human
auaauuuuuauauu

SEQ ID NO: 2939455 - RNA, 16 nt, Human
auaauuuuuauauuug

SEQ ID NO: 2939456 - RNA, 19 nt, Human
auaauuuuuauauuugaaa

SEQ ID NO: 2939457 - RNA, 13 nt, Human
auaauuuugugaa

SEQ ID NO: 2939458 - RNA, 14 nt, Human
auaauuuugugaag

SEQ ID NO: 2939459 - RNA, 15 nt, Human
auaauuuugugaagc

SEQ ID NO: 2939460 - RNA, 20 nt, Human
auaauuuugugaagcaaaau

SEQ ID NO: 2939461 - RNA, 19 nt, Human
uuauauagcaagacauuau

SEQ ID NO: 2939462 - RNA, 22 nt, Human
uuauauauauuuuuuucugaaa

SEQ ID NO: 2939463 - RNA, 13 nt, Human
uuauauagcaaga

SEQ ID NO: 2939464 - RNA, 18 nt, Human
uuauauaagcuuguauuc

SEQ ID NO: 2939465 - RNA, 13 nt, Human
auacuacaguuug

SEQ ID NO: 2939466 - RNA, 15 nt, Human
auacuacaguuuguu

SEQ ID NO: 2939467 - RNA, 16 nt, Human
auacuacaguuuguua

SEQ ID NO: 2939468 - RNA, 20 nt, Human
auacuacaguuuguuaguau

SEQ ID NO: 2939469 - RNA, 21 nt, Human
auacuaaccagcagaaaugcc

SEQ ID NO: 2939470 - RNA, 17 nt, Human
auaccagccaguaaaug

SEQ ID NO: 2939471 - RNA, 19 nt, Human
auaccagccaguaaauggg

SEQ ID NO: 2939472 - RNA, 15 nt, Human
uuaucagaacuaugu

SEQ ID NO: 2939473 - RNA, 14 nt, Human
auacaggaaaagcu

SEQ ID NO: 2939474 - RNA, 19 nt, Human
auacaggaaaagcugcuga

SEQ ID NO: 2939475 - RNA, 20 nt, Human
auacaggaaaagcugcugac

SEQ ID NO: 2939476 - RNA, 21 nt, Human
auacaguucggugagcuacaa

SEQ ID NO: 2939477 - RNA, 16 nt, Human
auacauuugauaaagu

SEQ ID NO: 2939478 - RNA, 20 nt, Human
auacaucccuuaccugggaa

SEQ ID NO: 2939479 - RNA, 20 nt, Human
aguucggugagcuacaaaug

SEQ ID NO: 2939480 - RNA, 21 nt, Human
aguuauuuuuauuuauuuaaa

SEQ ID NO: 2939481 - RNA, 14 nt, Human
aguucagagcugcc

SEQ ID NO: 2939482 - RNA, 15 nt, Human
aguucagagcugccc

SEQ ID NO: 2939483 - RNA, 16 nt, Human
aguucagagcugcccu

SEQ ID NO: 2939484 - RNA, 17 nt, Human
aguucagagcugcccuc

SEQ ID NO: 2939485 - RNA, 18 nt, Human
aguucagagcugcccucu

SEQ ID NO: 2939486 - RNA, 16 nt, Human
uguugggccaggagcc

SEQ ID NO: 2939487 - RNA, 13 nt, Human
uguugggccagga

SEQ ID NO: 2939488 - RNA, 13 nt, Human
uguugucagcuga

SEQ ID NO: 2939489 - RNA, 18 nt, Human
aguuacccaaauuaagag

SEQ ID NO: 2939490 - RNA, 17 nt, Human
aguuacccaaauuaaga

SEQ ID NO: 2939491 - RNA, 18 nt, Human
uguucuuuccaaaguaca

SEQ ID NO: 2939492 - RNA, 19 nt, Human
aguuauugaagcagagugg

SEQ ID NO: 2939493 - RNA, 23 nt, Human
aguuauugaagcagaguggcagu

SEQ ID NO: 2939494 - RNA, 16 nt, Human
aguuauugaagcagag

SEQ ID NO: 2939495 - RNA, 17 nt, Human
aguuauugaagcagagu

SEQ ID NO: 2939496 - RNA, 18 nt, Human
aguuauugaagcagagug

SEQ ID NO: 2939497 - RNA, 14 nt, Human
aguuauugaagcag

SEQ ID NO: 2939498 - RNA, 21 nt, Human
aguuauuaagagguaagacuu

SEQ ID NO: 2939499 - RNA, 20 nt, Human
aguuauuauauuuacaaaug

SEQ ID NO: 2939500 - RNA, 19 nt, Human
aguuauggcuauaggugcu

SEQ ID NO: 2939501 - RNA, 19 nt, Human
agugggugaauaauacagu

SEQ ID NO: 2939502 - RNA, 21 nt, Human
agugguuccuaauccucuagg

SEQ ID NO: 2939503 - RNA, 21 nt, Human
aguguacauggaauaacaugu

SEQ ID NO: 2939504 - RNA, 22 nt, Human
aguguacauggaauaacaugua

SEQ ID NO: 2939505 - RNA, 18 nt, Human
agugggugaauaauacag

SEQ ID NO: 2939506 - RNA, 13 nt, Human
agugggugaauaa

SEQ ID NO: 2939507 - RNA, 23 nt, Human
aguggcagucuucaguuugcaga

SEQ ID NO: 2939508 - RNA, 20 nt, Human
agugggggaguggccacaga

SEQ ID NO: 2939509 - RNA, 19 nt, Human
agugggggaguggccacag

SEQ ID NO: 2939510 - RNA, 11 nt, Human
aguggcagcug

SEQ ID NO: 2939511 - RNA, 12 nt, Human
aguggcagcugc

SEQ ID NO: 2939512 - RNA, 13 nt, Human
aguggcagcugcu

SEQ ID NO: 2939513 - RNA, 14 nt, Human
aguggcagcugcuu

SEQ ID NO: 2939514 - RNA, 20 nt, Human
aguggcagcugcuuuugucu

SEQ ID NO: 2939515 - RNA, 23 nt, Human
aguguacauggaauaacauguaa

SEQ ID NO: 2939516 - RNA, 19 nt, Human
uguucuugguuuguaaauu

SEQ ID NO: 2939517 - RNA, 13 nt, Human
uguucuuuccaaa

SEQ ID NO: 2939518 - RNA, 14 nt, Human
uguucuuuccaaag

SEQ ID NO: 2939519 - RNA, 17 nt, Human
uguucuugguuuguaaa

SEQ ID NO: 2939520 - RNA, 18 nt, Human
uguucuugguuuguaaau

SEQ ID NO: 2939521 - RNA, 14 nt, Human
uguucugggacaca

SEQ ID NO: 2939522 - RNA, 15 nt, Human
uguucugggacacag

SEQ ID NO: 2939523 - RNA, 14 nt, Human
uguucuuaauucuu

SEQ ID NO: 2939524 - RNA, 16 nt, Human
uguucuuaauucuuag

SEQ ID NO: 2939525 - RNA, 12 nt, Human
uguucugggaca

SEQ ID NO: 2939526 - RNA, 13 nt, Human
uguucugggacac

SEQ ID NO: 2939527 - RNA, 19 nt, Human
aguugcaaggcaaauguuu

SEQ ID NO: 2939528 - RNA, 20 nt, Human
aguugcaaggcaaauguuua

SEQ ID NO: 2939529 - RNA, 23 nt, Human
aguugauucagcucugcaagaau

SEQ ID NO: 2939530 - RNA, 18 nt, Human
aguugauucagcucugca

SEQ ID NO: 2939531 - RNA, 17 nt, Human
aguugauucagcucugc

SEQ ID NO: 2939532 - RNA, 15 nt, Human
aguugauucagcucu

SEQ ID NO: 2939533 - RNA, 14 nt, Human
aguugauucagcuc

SEQ ID NO: 2939534 - RNA, 13 nt, Human
aguugauucagcu

SEQ ID NO: 2939535 - RNA, 21 nt, Human
aguugauaugccuuuucccaa

SEQ ID NO: 2939536 - RNA, 23 nt, Human
aguugauagcacagacccugccc

SEQ ID NO: 2939537 - RNA, 22 nt, Human
aguugauagcacagacccugcc

SEQ ID NO: 2939538 - RNA, 22 nt, Human
aguucuugccuuggcugcaguu

SEQ ID NO: 2939539 - RNA, 14 nt, Human
aguugauagcacag

SEQ ID NO: 2939540 - RNA, 21 nt, Human
aguugauagcacagacccugc

SEQ ID NO: 2939541 - RNA, 20 nt, Human
aguugauagcacagacccug

SEQ ID NO: 2939542 - RNA, 19 nt, Human
aguugauagcacagacccu

SEQ ID NO: 2939543 - RNA, 15 nt, Human
aguugauagcacaga

SEQ ID NO: 2939544 - RNA, 15 nt, Human
aguucugaagaagau

SEQ ID NO: 2939545 - RNA, 13 nt, Human
aguucugaagaag

SEQ ID NO: 2939546 - RNA, 14 nt, Human
aguucugaagaaga

SEQ ID NO: 2939547 - RNA, 14 nt, Human
uguuuuaggagcau

SEQ ID NO: 2939548 - RNA, 13 nt, Human
uguuuuauaauuu

SEQ ID NO: 2939549 - RNA, 20 nt, Human
uguuuuauaauuuugugaag

SEQ ID NO: 2939550 - RNA, 21 nt, Human
uguuuuauauagcaagacauu

SEQ ID NO: 2939551 - RNA, 17 nt, Human
uguuuuauauagcaaga

SEQ ID NO: 2939552 - RNA, 15 nt, Human
uguuuucaguguaca

SEQ ID NO: 2939553 - RNA, 21 nt, Human
uguuuucaauuuuaaacauau

SEQ ID NO: 2939554 - RNA, 18 nt, Human
uguuuucaauuuuaaaca

SEQ ID NO: 2939555 - RNA, 14 nt, Human
uguuuucaaauguu

SEQ ID NO: 2939556 - RNA, 13 nt, Human
uguuuucaaaugu

SEQ ID NO: 2939557 - RNA, 17 nt, Human
uguuuucaguguacaug

SEQ ID NO: 2939558 - RNA, 15 nt, Human
uguuuucucuugaga

SEQ ID NO: 2939559 - RNA, 12 nt, Human
aguucucuccuu

SEQ ID NO: 2939560 - RNA, 13 nt, Human
aguucucuccuuc

SEQ ID NO: 2939561 - RNA, 16 nt, Human
aguucucuccuucuuc

SEQ ID NO: 2939562 - RNA, 15 nt, Human
uguuuggggaugaga

SEQ ID NO: 2939563 - RNA, 19 nt, Human
uguuugcuaagcauuccaa

SEQ ID NO: 2939564 - RNA, 14 nt, Human
uguugucagcugaa

SEQ ID NO: 2939565 - RNA, 14 nt, Human
uguuugccucugcc

SEQ ID NO: 2939566 - RNA, 16 nt, Human
uguuugccucugccuc

SEQ ID NO: 2939567 - RNA, 15 nt, Human
uguuugcuaagcauu

SEQ ID NO: 2939568 - RNA, 12 nt, Human
aguuuggccaga

SEQ ID NO: 2939569 - RNA, 21 nt, Human
aguuucuccaagcaggacaug

SEQ ID NO: 2939570 - RNA, 15 nt, Human
aguuucuccaagcag

SEQ ID NO: 2939571 - RNA, 13 nt, Human
aguuucuccaagc

SEQ ID NO: 2939572 - RNA, 16 nt, Human
uuaaauucuugcaaag

SEQ ID NO: 2939573 - RNA, 13 nt, Human
uuaaauucuugca

SEQ ID NO: 2939574 - RNA, 22 nt, Human
aguuuucacucuuauugcccac

SEQ ID NO: 2939575 - RNA, 16 nt, Human
aguuugguuucuagca

SEQ ID NO: 2939576 - RNA, 14 nt, Human
aguuuggccagaag

SEQ ID NO: 2939577 - RNA, 13 nt, Human
aguuuggccagaa

SEQ ID NO: 2939578 - RNA, 18 nt, Human
uuaaaaaguggaaaaaua

SEQ ID NO: 2939579 - RNA, 17 nt, Human
uuaaaacaacacucaca

SEQ ID NO: 2939580 - RNA, 20 nt, Human
uuaaaaaugguuuaaauggu

SEQ ID NO: 2939581 - RNA, 22 nt, Human
aguugcauagguuuaauaauuu

SEQ ID NO: 2939582 - RNA, 20 nt, Human
aguugccagucaccccggcc

SEQ ID NO: 2939583 - RNA, 15 nt, Human
uuaaaaaagaaacau

SEQ ID NO: 2939584 - RNA, 18 nt, Human
uuaaaaaagaaacauuug

SEQ ID NO: 2939585 - RNA, 13 nt, Human
uuaaauaaaucau

SEQ ID NO: 2939586 - RNA, 15 nt, Human
uuaaauaaaucauaa

SEQ ID NO: 2939587 - RNA, 19 nt, Human
uuaaauaaugugaaacugg

SEQ ID NO: 2939588 - RNA, 22 nt, Human
uuaaauaaugugaaacuggauu

SEQ ID NO: 2939589 - RNA, 20 nt, Human
uuaaauaaugugaaacugga

SEQ ID NO: 2939590 - RNA, 21 nt, Human
uuaaauaaugugaaacuggau

SEQ ID NO: 2939591 - RNA, 17 nt, Human
uuaaaccgccaaggcug

SEQ ID NO: 2939592 - RNA, 14 nt, Human
agcuaggugacaua

SEQ ID NO: 2939593 - RNA, 19 nt, Human
agcuaggugacauauacau

SEQ ID NO: 2939594 - RNA, 20 nt, Human
agcuaggugacauauacaua

SEQ ID NO: 2939595 - RNA, 21 nt, Human
agcuaggccuggccagaugca

SEQ ID NO: 2939596 - RNA, 19 nt, Human
agcuauggugucauaggcu

SEQ ID NO: 2939597 - RNA, 19 nt, Human
agcuauucaguaauaacuc

SEQ ID NO: 2939598 - RNA, 13 nt, Human
agcucagggccug

SEQ ID NO: 2939599 - RNA, 12 nt, Human
agcucagggccu

SEQ ID NO: 2939600 - RNA, 19 nt, Human
agcucagggccuggcucag

SEQ ID NO: 2939601 - RNA, 18 nt, Human
agcucagggccuggcuca

SEQ ID NO: 2939602 - RNA, 20 nt, Human
agcucagggccuggcucagg

SEQ ID NO: 2939603 - RNA, 15 nt, Human
agcuccaagaauuuc

SEQ ID NO: 2939604 - RNA, 15 nt, Human
agcuccaagcuccca

SEQ ID NO: 2939605 - RNA, 18 nt, Human
agcuccaagaauuucuag

SEQ ID NO: 2939606 - RNA, 16 nt, Human
agcuccaagcucccag

SEQ ID NO: 2939607 - RNA, 22 nt, Human
ugccauuuaaagcuuauuaaaa

SEQ ID NO: 2939608 - RNA, 20 nt, Human
ugcccaaagaugcagccggu

SEQ ID NO: 2939609 - RNA, 17 nt, Human
ugcccaaagaugcagcc

SEQ ID NO: 2939610 - RNA, 17 nt, Human
ugcccagccccuucuga

SEQ ID NO: 2939611 - RNA, 16 nt, Human
ugcccagccccuucug

SEQ ID NO: 2939612 - RNA, 12 nt, Human
ugcccagccccu

SEQ ID NO: 2939613 - RNA, 13 nt, Human
ugcccagccccuu

SEQ ID NO: 2939614 - RNA, 14 nt, Human
ugcccaggccccug

SEQ ID NO: 2939615 - RNA, 15 nt, Human
ugcccaggccccugc

SEQ ID NO: 2939616 - RNA, 17 nt, Human
ugcccaggccccugcca

SEQ ID NO: 2939617 - RNA, 18 nt, Human
ugcccaggccccugccac

SEQ ID NO: 2939618 - RNA, 23 nt, Human
ugccccgaacauguuuuucuucu

SEQ ID NO: 2939619 - RNA, 20 nt, Human
ugcccuaaaguguauuuuuu

SEQ ID NO: 2939620 - RNA, 16 nt, Human
ugccccauucaacauc

SEQ ID NO: 2939621 - RNA, 18 nt, Human
ugccagcuuaucucaggg

SEQ ID NO: 2939622 - RNA, 13 nt, Human
agcggcuggcagc

SEQ ID NO: 2939623 - RNA, 16 nt, Human
ugccagugccugggug

SEQ ID NO: 2939624 - RNA, 12 nt, Human
ugccagugccug

SEQ ID NO: 2939625 - RNA, 15 nt, Human
ugccagugccugggu

SEQ ID NO: 2939626 - RNA, 22 nt, Human
agcggggacagcuccuucuguc

SEQ ID NO: 2939627 - RNA, 23 nt, Human
agcggcuggcagcccaccccuca

SEQ ID NO: 2939628 - RNA, 19 nt, Human
agcggggacagcuccuucu

SEQ ID NO: 2939629 - RNA, 20 nt, Human
agcggggacagcuccuucug

SEQ ID NO: 2939630 - RNA, 20 nt, Human
ugcauuugaggucuguucuu

SEQ ID NO: 2939631 - RNA, 21 nt, Human
ugcauuugaggucuguucuuu

SEQ ID NO: 2939632 - RNA, 17 nt, Human
ugccagccacugugaua

SEQ ID NO: 2939633 - RNA, 19 nt, Human
ugcauuugaggucuguucu

SEQ ID NO: 2939634 - RNA, 18 nt, Human
ugcauuugaggucuguuc

SEQ ID NO: 2939635 - RNA, 20 nt, Human
ugcauuuaaaagauacaguu

SEQ ID NO: 2939636 - RNA, 22 nt, Human
agcgauucuucugcuucagccu

SEQ ID NO: 2939637 - RNA, 23 nt, Human
agccuugaccauucuccaccugc

SEQ ID NO: 2939638 - RNA, 22 nt, Human
agccuugaccauucuccaccug

SEQ ID NO: 2939639 - RNA, 13 nt, Human
agccuugaacuuu

SEQ ID NO: 2939640 - RNA, 16 nt, Human
agccuugaacuuugac

SEQ ID NO: 2939641 - RNA, 22 nt, Human
agccuugaacuuugaccucugc

SEQ ID NO: 2939642 - RNA, 15 nt, Human
agccuugaacuuuga

SEQ ID NO: 2939643 - RNA, 20 nt, Human
ugcagcucuccccuucucug

SEQ ID NO: 2939644 - RNA, 22 nt, Human
ugcagcucuccccuucucugua

SEQ ID NO: 2939645 - RNA, 18 nt, Human
agccuuccagggguggga

SEQ ID NO: 2939646 - RNA, 13 nt, Human
agcuccagcucac

SEQ ID NO: 2939647 - RNA, 17 nt, Human
agcuccagcucaccagc

SEQ ID NO: 2939648 - RNA, 19 nt, Human
agcuccaagcucccaggca

SEQ ID NO: 2939649 - RNA, 18 nt, Human
agcuccaagcucccaggc

SEQ ID NO: 2939650 - RNA, 17 nt, Human
agcuccaagcucccagg

SEQ ID NO: 2939651 - RNA, 22 nt, Human
ugcccucuccugggcagcugcc

SEQ ID NO: 2939652 - RNA, 23 nt, Human
ugcccucuccugggcagcugccu

SEQ ID NO: 2939653 - RNA, 16 nt, Human
ugcccucuccugggca

SEQ ID NO: 2939654 - RNA, 17 nt, Human
ugcccucuccugggcag

SEQ ID NO: 2939655 - RNA, 18 nt, Human
ugcccucuccugggcagc

SEQ ID NO: 2939656 - RNA, 20 nt, Human
ugcccucuccugggcagcug

SEQ ID NO: 2939657 - RNA, 13 nt, Human
ugcccucuccugg

SEQ ID NO: 2939658 - RNA, 14 nt, Human
ugcccucuccuggg

SEQ ID NO: 2939659 - RNA, 15 nt, Human
ugcccucuccugggc

SEQ ID NO: 2939660 - RNA, 12 nt, Human
ugcccucuccug

SEQ ID NO: 2939661 - RNA, 22 nt, Human
agcuccuucuguccuacucugu

SEQ ID NO: 2939662 - RNA, 23 nt, Human
agcuccuucuguccuacucugug

SEQ ID NO: 2939663 - RNA, 21 nt, Human
agcuccagcucaccagcccca

SEQ ID NO: 2939664 - RNA, 18 nt, Human
agcuccagcucaccagcc

SEQ ID NO: 2939665 - RNA, 19 nt, Human
agcuccagcucaccagccc

SEQ ID NO: 2939666 - RNA, 23 nt, Human
agcucugcccauccugccccuga

SEQ ID NO: 2939667 - RNA, 17 nt, Human
ugccugcccaggccccu

SEQ ID NO: 2939668 - RNA, 18 nt, Human
ugccugcccaggccccug

SEQ ID NO: 2939669 - RNA, 19 nt, Human
ugccugcccaggccccugc

SEQ ID NO: 2939670 - RNA, 14 nt, Human
ugccucugacacac

SEQ ID NO: 2939671 - RNA, 16 nt, Human
ugccucugacacacag

SEQ ID NO: 2939672 - RNA, 11 nt, Human
ugccucugccu

SEQ ID NO: 2939673 - RNA, 15 nt, Human
agcugggacuacagg

SEQ ID NO: 2939674 - RNA, 23 nt, Human
agcugcuuuugucuaugggacuc

SEQ ID NO: 2939675 - RNA, 24 nt, Human
agcugcuuuugucuaugggacuca

SEQ ID NO: 2939676 - RNA, 13 nt, Human
agcugccuguuca

SEQ ID NO: 2939677 - RNA, 22 nt, Human
agcugcuuuugucuaugggacu

SEQ ID NO: 2939678 - RNA, 16 nt, Human
agcugcccucuccugg

SEQ ID NO: 2939679 - RNA, 10 nt, Human
agcugccugu

SEQ ID NO: 2939680 - RNA, 21 nt, Human
agcugcccucuccugggcagc

SEQ ID NO: 2939681 - RNA, 19 nt, Human
agcugcccucuccugggca

SEQ ID NO: 2939682 - RNA, 20 nt, Human
agcugcccucuccugggcag

SEQ ID NO: 2939683 - RNA, 17 nt, Human
agcugcccucuccuggg

SEQ ID NO: 2939684 - RNA, 18 nt, Human
agcugcccucuccugggc

SEQ ID NO: 2939685 - RNA, 22 nt, Human
ugcccuuaccugccaggaagcc

SEQ ID NO: 2939686 - RNA, 18 nt, Human
ugcccugugggcccccaa

SEQ ID NO: 2939687 - RNA, 15 nt, Human
ugcccugugggcccc

SEQ ID NO: 2939688 - RNA, 15 nt, Human
agcucuucuccaggc

SEQ ID NO: 2939689 - RNA, 16 nt, Human
agcucuucuccaggcu

SEQ ID NO: 2939690 - RNA, 23 nt, Human
ugcccugugaguacuacaguccu

SEQ ID NO: 2939691 - RNA, 19 nt, Human
ugcccuuaccugccaggaa

SEQ ID NO: 2939692 - RNA, 20 nt, Human
ugccgcagcccugcagaggg

SEQ ID NO: 2939693 - RNA, 15 nt, Human
ugccucaccccuugc

SEQ ID NO: 2939694 - RNA, 11 nt, Human
ugccuccccuc

SEQ ID NO: 2939695 - RNA, 12 nt, Human
ugccuccccucc

SEQ ID NO: 2939696 - RNA, 13 nt, Human
ugccuccccuccu

SEQ ID NO: 2939697 - RNA, 14 nt, Human
ugccuccccuccuc

SEQ ID NO: 2939698 - RNA, 15 nt, Human
ugccuccccuccucu

SEQ ID NO: 2939699 - RNA, 16 nt, Human
ugccuccccuccucug

SEQ ID NO: 2939700 - RNA, 16 nt, Human
ugccucucucaggcca

SEQ ID NO: 2939701 - RNA, 17 nt, Human
ugccucucucaggccaa

SEQ ID NO: 2939702 - RNA, 22 nt, Human
ugccucccaucacccgcuaaga

SEQ ID NO: 2939703 - RNA, 18 nt, Human
ugccucagaaaacaagga

SEQ ID NO: 2939704 - RNA, 21 nt, Human
ugcaaaccaucauugaaaucu

SEQ ID NO: 2939705 - RNA, 21 nt, Human
agcccaggccuccuacagcuu

SEQ ID NO: 2939706 - RNA, 17 nt, Human
agccccaaaacucuccu

SEQ ID NO: 2939707 - RNA, 16 nt, Human
agccccaaaacucucc

SEQ ID NO: 2939708 - RNA, 20 nt, Human
agccccauucugccugccca

SEQ ID NO: 2939709 - RNA, 18 nt, Human
agccccaaaacucuccuc

SEQ ID NO: 2939710 - RNA, 21 nt, Human
agccccauucugccugcccag

SEQ ID NO: 2939711 - RNA, 22 nt, Human
agccccauucugccugcccagg

SEQ ID NO: 2939712 - RNA, 14 nt, Human
agcccugguggcag

SEQ ID NO: 2939713 - RNA, 15 nt, Human
agcccugguggcagu

SEQ ID NO: 2939714 - RNA, 16 nt, Human
agcccugguggcagug

SEQ ID NO: 2939715 - RNA, 21 nt, Human
ugcacacaccagagcccaccu

SEQ ID NO: 2939716 - RNA, 17 nt, Human
ugcacacaccagagccc

SEQ ID NO: 2939717 - RNA, 18 nt, Human
ugcacacaccagagccca

SEQ ID NO: 2939718 - RNA, 22 nt, Human
ugcagccucaaccuccugggcu

SEQ ID NO: 2939719 - RNA, 20 nt, Human
ugcagccucaaccuccuggg

SEQ ID NO: 2939720 - RNA, 21 nt, Human
ugcagccucaaccuccugggc

SEQ ID NO: 2939721 - RNA, 23 nt, Human
agccucugaaaaccaauguucuc

SEQ ID NO: 2939722 - RNA, 22 nt, Human
agccucacagcagugagacugg

SEQ ID NO: 2939723 - RNA, 18 nt, Human
agccucacaguccuuacc

SEQ ID NO: 2939724 - RNA, 17 nt, Human
agccucacaguccuuac

SEQ ID NO: 2939725 - RNA, 14 nt, Human
agccucacagcagu

SEQ ID NO: 2939726 - RNA, 18 nt, Human
agccucacagcagugaga

SEQ ID NO: 2939727 - RNA, 20 nt, Human
agccucaaccuccugggcua

SEQ ID NO: 2939728 - RNA, 19 nt, Human
agccucaaccuccugggcu

SEQ ID NO: 2939729 - RNA, 18 nt, Human
agccgagaucacgccacu

SEQ ID NO: 2939730 - RNA, 21 nt, Human
agcccuuagcagggaaacagc

SEQ ID NO: 2939731 - RNA, 17 nt, Human
agccgagaucacgccac

SEQ ID NO: 2939732 - RNA, 21 nt, Human
agccgagauagccaaggccaa

SEQ ID NO: 2939733 - RNA, 20 nt, Human
agccgagauagccaaggcca

SEQ ID NO: 2939734 - RNA, 16 nt, Human
ugcagacucuacagag

SEQ ID NO: 2939735 - RNA, 17 nt, Human
ugcagacucuacagagg

SEQ ID NO: 2939736 - RNA, 16 nt, Human
agcccuuagcagggaa

SEQ ID NO: 2939737 - RNA, 18 nt, Human
agcccugucuccucucuc

SEQ ID NO: 2939738 - RNA, 11 nt, Human
agcccugucuc

SEQ ID NO: 2939739 - RNA, 19 nt, Human
ugcacuccccugcugggug

SEQ ID NO: 2939740 - RNA, 17 nt, Human
ugcacuccccugcuggg

SEQ ID NO: 2939741 - RNA, 16 nt, Human
ugcacuccccugcugg

SEQ ID NO: 2939742 - RNA, 11 nt, Human
ugcacacauuu

SEQ ID NO: 2939743 - RNA, 12 nt, Human
ugcacacauuuu

SEQ ID NO: 2939744 - RNA, 13 nt, Human
ugcacacauuuuu

SEQ ID NO: 2939745 - RNA, 15 nt, Human
ugcacacauuuuuua

SEQ ID NO: 2939746 - RNA, 22 nt, Human
ugcagacaggcaagcaccuccu

SEQ ID NO: 2939747 - RNA, 15 nt, Human
ugcagaagacaguau

SEQ ID NO: 2939748 - RNA, 14 nt, Human
ugcagaagacagua

SEQ ID NO: 2939749 - RNA, 15 nt, Human
ugauucccugauuua

SEQ ID NO: 2939750 - RNA, 16 nt, Human
ugauucccugauuuaa

SEQ ID NO: 2939751 - RNA, 22 nt, Human
ugauucccaagcucugcuccuc

SEQ ID NO: 2939752 - RNA, 23 nt, Human
ugauucccaagcucugcuccucu

SEQ ID NO: 2939753 - RNA, 21 nt, Human
ugauucauaaugacuuaagca

SEQ ID NO: 2939754 - RNA, 16 nt, Human
ugauucauaaugacuu

SEQ ID NO: 2939755 - RNA, 15 nt, Human
ugauucauaaugacu

SEQ ID NO: 2939756 - RNA, 14 nt, Human
agcccaggaaaggc

SEQ ID NO: 2939757 - RNA, 18 nt, Human
ugauuuccguuaaaauac

SEQ ID NO: 2939758 - RNA, 22 nt, Human
ugauuuccguuaaaauaccagc

SEQ ID NO: 2939759 - RNA, 17 nt, Human
ugauuuagcaggaagcu

SEQ ID NO: 2939760 - RNA, 20 nt, Human
ugauuuagcaggaagcugug

SEQ ID NO: 2939761 - RNA, 17 nt, Human
ugauuuggggauauuuu

SEQ ID NO: 2939762 - RNA, 21 nt, Human
agccaguaaaugggggugcau

SEQ ID NO: 2939763 - RNA, 13 nt, Human
agccaguaaaugg

SEQ ID NO: 2939764 - RNA, 13 nt, Human
agcccacuucugc

SEQ ID NO: 2939765 - RNA, 14 nt, Human
agcccacuucugcc

SEQ ID NO: 2939766 - RNA, 15 nt, Human
agcccacuucugcca

SEQ ID NO: 2939767 - RNA, 18 nt, Human
agccacugcaccgggcca

SEQ ID NO: 2939768 - RNA, 19 nt, Human
agccacugcaccgggccac

SEQ ID NO: 2939769 - RNA, 15 nt, Human
agccagcaguucaga

SEQ ID NO: 2939770 - RNA, 17 nt, Human
agccagcaguucagagc

SEQ ID NO: 2939771 - RNA, 19 nt, Human
agccagcaguucagagcug

SEQ ID NO: 2939772 - RNA, 11 nt, Human
agccagaggag

SEQ ID NO: 2939773 - RNA, 10 nt, Human
agccagagga

SEQ ID NO: 2939774 - RNA, 22 nt, Human
agccagcaguucagagcugccc

SEQ ID NO: 2939775 - RNA, 20 nt, Human
agccagcaguucagagcugc

SEQ ID NO: 2939776 - RNA, 21 nt, Human
agccagcaguucagagcugcc

SEQ ID NO: 2939777 - RNA, 13 nt, Human
ugauggugcaaug

SEQ ID NO: 2939778 - RNA, 15 nt, Human
ugauggugcaaugac

SEQ ID NO: 2939779 - RNA, 19 nt, Human
ugauuaaauucuugcaaag

SEQ ID NO: 2939780 - RNA, 20 nt, Human
ugauuaaauucuugcaaagu

SEQ ID NO: 2939781 - RNA, 18 nt, Human
ugauuaaguaaugauaac

SEQ ID NO: 2939782 - RNA, 19 nt, Human
ugauuaaccacuucagcug

SEQ ID NO: 2939783 - RNA, 16 nt, Human
agccacugcaccgggc

SEQ ID NO: 2939784 - RNA, 23 nt, Human
ugauuaaguaaugauaacuggaa

SEQ ID NO: 2939785 - RNA, 22 nt, Human
ugauccucccaccucagccucc

SEQ ID NO: 2939786 - RNA, 16 nt, Human
ugauccucccaccuca

SEQ ID NO: 2939787 - RNA, 21 nt, Human
ugauccucccaccucagccuc

SEQ ID NO: 2939788 - RNA, 15 nt, Human
ugauccucccaccuc

SEQ ID NO: 2939789 - RNA, 16 nt, Human
ugauccuaguuccacc

SEQ ID NO: 2939790 - RNA, 18 nt, Human
ugaugacauucccugcua

SEQ ID NO: 2939791 - RNA, 15 nt, Human
ugaugacauucccug

SEQ ID NO: 2939792 - RNA, 13 nt, Human
ugaugacuguuuu

SEQ ID NO: 2939793 - RNA, 11 nt, Human
ugaugaagaag

SEQ ID NO: 2939794 - RNA, 12 nt, Human
ugaugaagaagu

SEQ ID NO: 2939795 - RNA, 23 nt, Human
ugaugcuucuucagagacuccug

SEQ ID NO: 2939796 - RNA, 14 nt, Human
ugaugggaaagcau

SEQ ID NO: 2939797 - RNA, 16 nt, Human
ugaugagaggaaauca

SEQ ID NO: 2939798 - RNA, 15 nt, Human
ugaugagaggaaauc

SEQ ID NO: 2939799 - RNA, 14 nt, Human
ugaugagaggaaau

SEQ ID NO: 2939800 - RNA, 13 nt, Human
ugaugagaggaaa

SEQ ID NO: 2939801 - RNA, 19 nt, Human
ugaugggaaagcauuguaa

SEQ ID NO: 2939802 - RNA, 19 nt, Human
ugauggggcccugccuccu

SEQ ID NO: 2939803 - RNA, 16 nt, Human
ugauggggcccugccu

SEQ ID NO: 2939804 - RNA, 15 nt, Human
ugauggggcccugcc

SEQ ID NO: 2939805 - RNA, 14 nt, Human
ugauggggcccugc

SEQ ID NO: 2939806 - RNA, 18 nt, Human
uggacacagcucuucucc

SEQ ID NO: 2939807 - RNA, 15 nt, Human
uggacacagcucuuc

SEQ ID NO: 2939808 - RNA, 16 nt, Human
uggacacagcucuucu

SEQ ID NO: 2939809 - RNA, 13 nt, Human
uggacccugaggc

SEQ ID NO: 2939810 - RNA, 12 nt, Human
uggacccugagg

SEQ ID NO: 2939811 - RNA, 14 nt, Human
uggacccugaggcc

SEQ ID NO: 2939812 - RNA, 19 nt, Human
aggauuuugauccaagcug

SEQ ID NO: 2939813 - RNA, 19 nt, Human
aggaugcccaaagaugcag

SEQ ID NO: 2939814 - RNA, 14 nt, Human
aggaugcccaaaga

SEQ ID NO: 2939815 - RNA, 20 nt, Human
aggaugaucuaggaagacuu

SEQ ID NO: 2939816 - RNA, 14 nt, Human
aggcaaauguuuau

SEQ ID NO: 2939817 - RNA, 17 nt, Human
aggcaacucaucuuagg

SEQ ID NO: 2939818 - RNA, 22 nt, Human
uggaauuucucccagucauuua

SEQ ID NO: 2939819 - RNA, 18 nt, Human
uggaauuggagcucgugg

SEQ ID NO: 2939820 - RNA, 22 nt, Human
uggaaauuagguugaaacauau

SEQ ID NO: 2939821 - RNA, 20 nt, Human
uggaaauauuaagaaagacu

SEQ ID NO: 2939822 - RNA, 23 nt, Human
uggaaaugggcagagcagagacc

SEQ ID NO: 2939823 - RNA, 19 nt, Human
uggaaauuagguugaaaca

SEQ ID NO: 2939824 - RNA, 20 nt, Human
uggaaauuagguugaaacau

SEQ ID NO: 2939825 - RNA, 21 nt, Human
uggaaauuagguugaaacaua

SEQ ID NO: 2939826 - RNA, 17 nt, Human
aggaugaucuaggaaga

SEQ ID NO: 2939827 - RNA, 16 nt, Human
aggaugaucuaggaag

SEQ ID NO: 2939828 - RNA, 18 nt, Human
aggauccugagccagauu

SEQ ID NO: 2939829 - RNA, 17 nt, Human
aggauccugagccagau

SEQ ID NO: 2939830 - RNA, 22 nt, Human
aggaucucuugagccugggagg

SEQ ID NO: 2939831 - RNA, 21 nt, Human
aggaucucuugagccugggag

SEQ ID NO: 2939832 - RNA, 21 nt, Human
aggauacaaaagcaugugaga

SEQ ID NO: 2939833 - RNA, 16 nt, Human
aggauccugagccaga

SEQ ID NO: 2939834 - RNA, 15 nt, Human
aggauccugagccag

SEQ ID NO: 2939835 - RNA, 14 nt, Human
aggaguuuggccag

SEQ ID NO: 2939836 - RNA, 18 nt, Human
aggaguuuggccagaagu

SEQ ID NO: 2939837 - RNA, 17 nt, Human
aggaguuuggccagaag

SEQ ID NO: 2939838 - RNA, 16 nt, Human
aggaguuuggccagaa

SEQ ID NO: 2939839 - RNA, 15 nt, Human
aggaguuuggccaga

SEQ ID NO: 2939840 - RNA, 19 nt, Human
ugcuugggcuucauccucc

SEQ ID NO: 2939841 - RNA, 12 nt, Human
uggaaaggaaug

SEQ ID NO: 2939842 - RNA, 15 nt, Human
uggaaaggaaugcaa

SEQ ID NO: 2939843 - RNA, 21 nt, Human
uggaaaggaaugcaaagauga

SEQ ID NO: 2939844 - RNA, 22 nt, Human
uggaaaggaaugcaaagaugaa

SEQ ID NO: 2939845 - RNA, 15 nt, Human
uggaaauauuaagaa

SEQ ID NO: 2939846 - RNA, 21 nt, Human
ugcuuggaggaaggaaaccca

SEQ ID NO: 2939847 - RNA, 12 nt, Human
ugcuuggcccag

SEQ ID NO: 2939848 - RNA, 16 nt, Human
ugcuuggcccaggagu

SEQ ID NO: 2939849 - RNA, 15 nt, Human
ugcuuggcccaggag

SEQ ID NO: 2939850 - RNA, 23 nt, Human
ugcuuggcccaggaguuuggcca

SEQ ID NO: 2939851 - RNA, 18 nt, Human
ugcuuggcccaggaguuu

SEQ ID NO: 2939852 - RNA, 18 nt, Human
ugcuugcugcugauuuaa

SEQ ID NO: 2939853 - RNA, 16 nt, Human
ugcuugggcuucaucc

SEQ ID NO: 2939854 - RNA, 12 nt, Human
ugcuugggcuuc

SEQ ID NO: 2939855 - RNA, 15 nt, Human
ugcuugccaucccuc

SEQ ID NO: 2939856 - RNA, 16 nt, Human
ugcuugccaucccucc

SEQ ID NO: 2939857 - RNA, 14 nt, Human
aggagcagccacau

SEQ ID NO: 2939858 - RNA, 22 nt, Human
aggagccccgaggccuucucug

SEQ ID NO: 2939859 - RNA, 17 nt, Human
aggagauuggaaggaac

SEQ ID NO: 2939860 - RNA, 23 nt, Human
aggacuuuucuuuguggcuuccu

SEQ ID NO: 2939861 - RNA, 11 nt, Human
aggagaaacug

SEQ ID NO: 2939862 - RNA, 19 nt, Human
aggacugaauuaugaaacu

SEQ ID NO: 2939863 - RNA, 20 nt, Human
aggacugaauuaugaaacuu

SEQ ID NO: 2939864 - RNA, 19 nt, Human
aggacauugcggacagcca

SEQ ID NO: 2939865 - RNA, 23 nt, Human
aggacauugcggacagccacggc

SEQ ID NO: 2939866 - RNA, 15 nt, Human
aggacauugcggaca

SEQ ID NO: 2939867 - RNA, 17 nt, Human
aggacauugcggacagc

SEQ ID NO: 2939868 - RNA, 18 nt, Human
aggacauugcggacagcc

SEQ ID NO: 2939869 - RNA, 15 nt, Human
ugcuguacauacuuu

SEQ ID NO: 2939870 - RNA, 17 nt, Human
ugcuguacauacuuuuu

SEQ ID NO: 2939871 - RNA, 22 nt, Human
ugcuguacauacuuuuuggguu

SEQ ID NO: 2939872 - RNA, 11 nt, Human
ugcuguacaua

SEQ ID NO: 2939873 - RNA, 18 nt, Human
ugcuguaacuuucugaaa

SEQ ID NO: 2939874 - RNA, 23 nt, Human
ugcuguauuuuaaaagaaugauu

SEQ ID NO: 2939875 - RNA, 16 nt, Human
ugcuggcugguuagag

SEQ ID NO: 2939876 - RNA, 12 nt, Human
ugcugcccugug

SEQ ID NO: 2939877 - RNA, 14 nt, Human
ugcugcccugugag

SEQ ID NO: 2939878 - RNA, 13 nt, Human
ugcugcccuguga

SEQ ID NO: 2939879 - RNA, 15 nt, Human
ugcugcccugugagu

SEQ ID NO: 2939880 - RNA, 13 nt, Human
ugcuggagcucug

SEQ ID NO: 2939881 - RNA, 14 nt, Human
ugcuggagcucugc

SEQ ID NO: 2939882 - RNA, 13 nt, Human
ugcuuauacacuu

SEQ ID NO: 2939883 - RNA, 12 nt, Human
ugcuucaaggau

SEQ ID NO: 2939884 - RNA, 13 nt, Human
ugcuucagccucc

SEQ ID NO: 2939885 - RNA, 14 nt, Human
ugcuucagccuccc

SEQ ID NO: 2939886 - RNA, 19 nt, Human
ugcuucaaggauccugagc

SEQ ID NO: 2939887 - RNA, 18 nt, Human
ugcuucaaggauccugag

SEQ ID NO: 2939888 - RNA, 16 nt, Human
ugcuucaaggauccug

SEQ ID NO: 2939889 - RNA, 22 nt, Human
aggacagggaggugaccccagg

SEQ ID NO: 2939890 - RNA, 23 nt, Human
aggacagcccuucuuuccacaga

SEQ ID NO: 2939891 - RNA, 23 nt, Human
aggacacuaaccacgcuggaccu

SEQ ID NO: 2939892 - RNA, 19 nt, Human
aggacacuaaccacgcugg

SEQ ID NO: 2939893 - RNA, 14 nt, Human
aggacacugauaug

SEQ ID NO: 2939894 - RNA, 21 nt, Human
ugcucugcugacagacacagg

SEQ ID NO: 2939895 - RNA, 22 nt, Human
ugcucugcugacagacacaggc

SEQ ID NO: 2939896 - RNA, 16 nt, Human
ugcucugcugacagac

SEQ ID NO: 2939897 - RNA, 14 nt, Human
ugcugagucugaag

SEQ ID NO: 2939898 - RNA, 15 nt, Human
ugcugagucugaagg

SEQ ID NO: 2939899 - RNA, 13 nt, Human
ugcuccagccugg

SEQ ID NO: 2939900 - RNA, 19 nt, Human
ugcuccagcuguucagcug

SEQ ID NO: 2939901 - RNA, 16 nt, Human
ugcuccagcuguucag

SEQ ID NO: 2939902 - RNA, 18 nt, Human
ugcucccaccuggcucug

SEQ ID NO: 2939903 - RNA, 17 nt, Human
ugcucccaccuggcucu

SEQ ID NO: 2939904 - RNA, 19 nt, Human
agcugggacuacaggcacc

SEQ ID NO: 2939905 - RNA, 16 nt, Human
agcugggacuacaggc

SEQ ID NO: 2939906 - RNA, 18 nt, Human
agcugggacuacaggcac

SEQ ID NO: 2939907 - RNA, 22 nt, Human
aggaagcacaugccucucucag

SEQ ID NO: 2939908 - RNA, 15 nt, Human
aggaagccagcaggc

SEQ ID NO: 2939909 - RNA, 14 nt, Human
aggaagccagcagg

SEQ ID NO: 2939910 - RNA, 24 nt, Human
aggaagcacaugccucucucaggc

SEQ ID NO: 2939911 - RNA, 23 nt, Human
aggaagcacaugccucucucagg

SEQ ID NO: 2939912 - RNA, 14 nt, Human
aggaagacuuugga

SEQ ID NO: 2939913 - RNA, 13 nt, Human
aggaagacuuugg

SEQ ID NO: 2939914 - RNA, 19 nt, Human
aggaagacuucaucccucu

SEQ ID NO: 2939915 - RNA, 13 nt, Human
aggaagacuucau

SEQ ID NO: 2939916 - RNA, 23 nt, Human
ugcugagucugaaggcuggguuc

SEQ ID NO: 2939917 - RNA, 22 nt, Human
ugcugagucugaaggcuggguu

SEQ ID NO: 2939918 - RNA, 21 nt, Human
ugcugagucugaaggcugggu

SEQ ID NO: 2939919 - RNA, 18 nt, Human
ugcugagucugaaggcug

SEQ ID NO: 2939920 - RNA, 17 nt, Human
ugcugagucugaaggcu

SEQ ID NO: 2939921 - RNA, 16 nt, Human
ugcugagucugaaggc

SEQ ID NO: 2939922 - RNA, 15 nt, Human
aggaaggagaggaga

SEQ ID NO: 2939923 - RNA, 19 nt, Human
aggaaggaaacccagcucu

SEQ ID NO: 2939924 - RNA, 18 nt, Human
aggaagcugugagagcag

SEQ ID NO: 2939925 - RNA, 17 nt, Human
aggaagcuuacaugccu

SEQ ID NO: 2939926 - RNA, 18 nt, Human
aggaaggaaacccagcuc

SEQ ID NO: 2939927 - RNA, 13 nt, Human
aggaagccagcag

SEQ ID NO: 2939928 - RNA, 17 nt, Human
aggaagccagcaggcuc

SEQ ID NO: 2939929 - RNA, 23 nt, Human
aggaauugacccacaagaaauga

SEQ ID NO: 2939930 - RNA, 11 nt, Human
aggaauuuaaa

SEQ ID NO: 2939931 - RNA, 20 nt, Human
ugggaaagggauuuucagcc

SEQ ID NO: 2939932 - RNA, 16 nt, Human
ugggaaaggggaaguu

SEQ ID NO: 2939933 - RNA, 21 nt, Human
ugggaaagcauuguaaaugug

SEQ ID NO: 2939934 - RNA, 23 nt, Human
uggcuucacggaagagccuugcg

SEQ ID NO: 2939935 - RNA, 22 nt, Human
uggcuucacggaagagccuugc

SEQ ID NO: 2939936 - RNA, 13 nt, Human
uggcuguuggcug

SEQ ID NO: 2939937 - RNA, 14 nt, Human
uggcugugucuccc

SEQ ID NO: 2939938 - RNA, 15 nt, Human
uggcuguuggcuggg

SEQ ID NO: 2939939 - RNA, 17 nt, Human
uggcuuaaaacaacacu

SEQ ID NO: 2939940 - RNA, 22 nt, Human
uggcuauuagagaucaaccccu

SEQ ID NO: 2939941 - RNA, 19 nt, Human
uggcuaugcauuugaaaau

SEQ ID NO: 2939942 - RNA, 15 nt, Human
uggcuaugcauuuga

SEQ ID NO: 2939943 - RNA, 17 nt, Human
uggcuaugcauuugaaa

SEQ ID NO: 2939944 - RNA, 14 nt, Human
uggcuaugcauuug

SEQ ID NO: 2939945 - RNA, 19 nt, Human
aggcuggcuuucagaguag

SEQ ID NO: 2939946 - RNA, 14 nt, Human
aggcugggagagcc

SEQ ID NO: 2939947 - RNA, 22 nt, Human
uggcuagagguucaaagauauu

SEQ ID NO: 2939948 - RNA, 17 nt, Human
aggcuggcuuucagagu

SEQ ID NO: 2939949 - RNA, 18 nt, Human
aggcuggcgugcaguggu

SEQ ID NO: 2939950 - RNA, 20 nt, Human
aggcuggcgugcaguggugc

SEQ ID NO: 2939951 - RNA, 12 nt, Human
uggcugcaaagg

SEQ ID NO: 2939952 - RNA, 18 nt, Human
uggcucaaguccucuuuu

SEQ ID NO: 2939953 - RNA, 19 nt, Human
uggcucuuccaggcuggga

SEQ ID NO: 2939954 - RNA, 21 nt, Human
uggcucuuccaggcugggaga

SEQ ID NO: 2939955 - RNA, 20 nt, Human
uggcucuuccaggcugggag

SEQ ID NO: 2939956 - RNA, 15 nt, Human
uggcugcagggaguc

SEQ ID NO: 2939957 - RNA, 13 nt, Human
uggcugcagggag

SEQ ID NO: 2939958 - RNA, 14 nt, Human
uggcugcagggagu

SEQ ID NO: 2939959 - RNA, 20 nt, Human
uggcugccaaugggagcuca

SEQ ID NO: 2939960 - RNA, 18 nt, Human
uggcugccaaugggagcu

SEQ ID NO: 2939961 - RNA, 13 nt, Human
aggcuggcgugca

SEQ ID NO: 2939962 - RNA, 17 nt, Human
aggcuggcgugcagugg

SEQ ID NO: 2939963 - RNA, 16 nt, Human
aggcucugcccuuggu

SEQ ID NO: 2939964 - RNA, 21 nt, Human
aggcucucaggccagcugcuu

SEQ ID NO: 2939965 - RNA, 11 nt, Human
aggcucugccc

SEQ ID NO: 2939966 - RNA, 12 nt, Human
aggcucugcccu

SEQ ID NO: 2939967 - RNA, 13 nt, Human
aggcucugcccuu

SEQ ID NO: 2939968 - RNA, 15 nt, Human
aggcucugcccuugg

SEQ ID NO: 2939969 - RNA, 14 nt, Human
aggcucugcccuug

SEQ ID NO: 2939970 - RNA, 20 nt, Human
aggcucucaggccagcugcu

SEQ ID NO: 2939971 - RNA, 19 nt, Human
aggcucucaggccagcugc

SEQ ID NO: 2939972 - RNA, 18 nt, Human
aggcucucaggccagcug

SEQ ID NO: 2939973 - RNA, 16 nt, Human
aggcucucaggccagc

SEQ ID NO: 2939974 - RNA, 15 nt, Human
aggcucucaggccag

SEQ ID NO: 2939975 - RNA, 14 nt, Human
aggcucucaggcca

SEQ ID NO: 2939976 - RNA, 12 nt, Human
aggcucucaggc

SEQ ID NO: 2939977 - RNA, 11 nt, Human
aggcucucagg

SEQ ID NO: 2939978 - RNA, 21 nt, Human
aggcucgagcaugccuggaug

SEQ ID NO: 2939979 - RNA, 19 nt, Human
aggcucgagcaugccugga

SEQ ID NO: 2939980 - RNA, 18 nt, Human
aggcucgagcaugccugg

SEQ ID NO: 2939981 - RNA, 17 nt, Human
aggcucgagcaugccug

SEQ ID NO: 2939982 - RNA, 15 nt, Human
aggcucgagcaugcc

SEQ ID NO: 2939983 - RNA, 19 nt, Human
aggcuccuuuagcgcccag

SEQ ID NO: 2939984 - RNA, 12 nt, Human
aggcucgagcau

SEQ ID NO: 2939985 - RNA, 21 nt, Human
uggccccugcccggcugcgga

SEQ ID NO: 2939986 - RNA, 20 nt, Human
uggccccugcccggcugcgg

SEQ ID NO: 2939987 - RNA, 22 nt, Human
aggccuggccagaugcaccagc

SEQ ID NO: 2939988 - RNA, 23 nt, Human
aggccuggccagaugcaccagcc

SEQ ID NO: 2939989 - RNA, 23 nt, Human
aggccugggggcugggcagagga

SEQ ID NO: 2939990 - RNA, 15 nt, Human
aggccuggccagaug

SEQ ID NO: 2939991 - RNA, 16 nt, Human
aggccuggccagaugc

SEQ ID NO: 2939992 - RNA, 17 nt, Human
aggccuggccagaugca

SEQ ID NO: 2939993 - RNA, 21 nt, Human
aggccuggccagaugcaccag

SEQ ID NO: 2939994 - RNA, 13 nt, Human
uggccucugcacu

SEQ ID NO: 2939995 - RNA, 17 nt, Human
uggccucugcacucccc

SEQ ID NO: 2939996 - RNA, 15 nt, Human
uggccucugcacucc

SEQ ID NO: 2939997 - RNA, 14 nt, Human
uggccucugcacuc

SEQ ID NO: 2939998 - RNA, 15 nt, Human
uggccaggcuggucu

SEQ ID NO: 2939999 - RNA, 17 nt, Human
uggccaggcuggucuca

SEQ ID NO: 2940000 - RNA, 15 nt, Human
uggcaugggaaugaa

SEQ ID NO: 2940001 - RNA, 12 nt, Human
uggcaugggaau

SEQ ID NO: 2940002 - RNA, 15 nt, Human
aggcccucugcccac

SEQ ID NO: 2940003 - RNA, 14 nt, Human
aggcccucugccca

SEQ ID NO: 2940004 - RNA, 13 nt, Human
aggcccucugccc

SEQ ID NO: 2940005 - RNA, 12 nt, Human
uggcagccccug

SEQ ID NO: 2940006 - RNA, 20 nt, Human
aggccacaagacccuugugg

SEQ ID NO: 2940007 - RNA, 12 nt, Human
aggccagagaca

SEQ ID NO: 2940008 - RNA, 22 nt, Human
uggcagaguugaagacagagcu

SEQ ID NO: 2940009 - RNA, 15 nt, Human
uggcacccggccccu

SEQ ID NO: 2940010 - RNA, 16 nt, Human
uggcacccggccccug

SEQ ID NO: 2940011 - RNA, 21 nt, Human
uggcagaguugaagacagagc

SEQ ID NO: 2940012 - RNA, 12 nt, Human
uggauguucuga

SEQ ID NO: 2940013 - RNA, 20 nt, Human
uggcacaguuuucugagaaa

SEQ ID NO: 2940014 - RNA, 22 nt, Human
uggauuaaacuuaaucuaaaug

SEQ ID NO: 2940015 - RNA, 22 nt, Human
uggcacaguuuucugagaaaga

SEQ ID NO: 2940016 - RNA, 20 nt, Human
uggcacaucagcacgauuuc

SEQ ID NO: 2940017 - RNA, 18 nt, Human
uggcaccagcagccugga

SEQ ID NO: 2940018 - RNA, 22 nt, Human
uggaguuauugaagcagagugg

SEQ ID NO: 2940019 - RNA, 15 nt, Human
aggccacaagacccu

SEQ ID NO: 2940020 - RNA, 15 nt, Human
uggaugccugguggc

SEQ ID NO: 2940021 - RNA, 20 nt, Human
uggaguucaucuugaauugu

SEQ ID NO: 2940022 - RNA, 17 nt, Human
uggaguucaucuugaau

SEQ ID NO: 2940023 - RNA, 16 nt, Human
uggaguucaucuugaa

SEQ ID NO: 2940024 - RNA, 18 nt, Human
uggaugccugguggcagc

SEQ ID NO: 2940025 - RNA, 19 nt, Human
uggaugccugguggcagcu

SEQ ID NO: 2940026 - RNA, 18 nt, Human
aggccaaggugggaggau

SEQ ID NO: 2940027 - RNA, 20 nt, Human
aggccaaaggaagcacaugc

SEQ ID NO: 2940028 - RNA, 23 nt, Human
aggccaaaggaagcacaugccuc

SEQ ID NO: 2940029 - RNA, 20 nt, Human
aggccaaacucaccugcccc

SEQ ID NO: 2940030 - RNA, 14 nt, Human
aggccaaaggaagc

SEQ ID NO: 2940031 - RNA, 18 nt, Human
aggcauuuguuugaacug

SEQ ID NO: 2940032 - RNA, 16 nt, Human
aggccaaacucaccug

SEQ ID NO: 2940033 - RNA, 18 nt, Human
uggacgagaaaacaauaa

SEQ ID NO: 2940034 - RNA, 18 nt, Human
auccuggcccagggcauc

SEQ ID NO: 2940035 - RNA, 21 nt, Human
auccuggcccagggcaucugg

SEQ ID NO: 2940036 - RNA, 23 nt, Human
auccuggacugagggggccugga

SEQ ID NO: 2940037 - RNA, 17 nt, Human
auccuggcccagggcau

SEQ ID NO: 2940038 - RNA, 22 nt, Human
auccuggcacccggccccugcu

SEQ ID NO: 2940039 - RNA, 23 nt, Human
auccuggcacccggccccugcug

SEQ ID NO: 2940040 - RNA, 16 nt, Human
auccuggacugagggg

SEQ ID NO: 2940041 - RNA, 15 nt, Human
auccuggaguucugg

SEQ ID NO: 2940042 - RNA, 17 nt, Human
auccuggcacccggccc

SEQ ID NO: 2940043 - RNA, 19 nt, Human
auccuggcacccggccccu

SEQ ID NO: 2940044 - RNA, 20 nt, Human
auccuggcacccggccccug

SEQ ID NO: 2940045 - RNA, 21 nt, Human
auccuggcacccggccccugc

SEQ ID NO: 2940046 - RNA, 11 nt, Human
auccugagcca

SEQ ID NO: 2940047 - RNA, 13 nt, Human
auccugagccaga

SEQ ID NO: 2940048 - RNA, 12 nt, Human
auccugagccag

SEQ ID NO: 2940049 - RNA, 17 nt, Human
auccucuuugagugaag

SEQ ID NO: 2940050 - RNA, 20 nt, Human
uucuuuugccguuauuaaaa

SEQ ID NO: 2940051 - RNA, 13 nt, Human
auccucuguugau

SEQ ID NO: 2940052 - RNA, 20 nt, Human
auccucuguacagagcccac

SEQ ID NO: 2940053 - RNA, 18 nt, Human
auccucuguacagagccc

SEQ ID NO: 2940054 - RNA, 13 nt, Human
auccugccccuga

SEQ ID NO: 2940055 - RNA, 22 nt, Human
auccugaggcuccacuuggucu

SEQ ID NO: 2940056 - RNA, 16 nt, Human
auccugcaauuccacu

SEQ ID NO: 2940057 - RNA, 11 nt, Human
auccugaggcu

SEQ ID NO: 2940058 - RNA, 13 nt, Human
auccugaggcucc

SEQ ID NO: 2940059 - RNA, 16 nt, Human
auccugaggcuccacu

SEQ ID NO: 2940060 - RNA, 18 nt, Human
auccugaggcuccacuug

SEQ ID NO: 2940061 - RNA, 21 nt, Human
auccugagccagauuucacuc

SEQ ID NO: 2940062 - RNA, 17 nt, Human
auccugagccagauuuc

SEQ ID NO: 2940063 - RNA, 15 nt, Human
auccugagccagauu

SEQ ID NO: 2940064 - RNA, 14 nt, Human
auccugagccagau

SEQ ID NO: 2940065 - RNA, 15 nt, Human
aucuaaauguugaaa

SEQ ID NO: 2940066 - RNA, 19 nt, Human
aucuaaauggaaccacucu

SEQ ID NO: 2940067 - RNA, 14 nt, Human
aucgugacaacacu

SEQ ID NO: 2940068 - RNA, 15 nt, Human
aucgugacaacacuu

SEQ ID NO: 2940069 - RNA, 18 nt, Human
aucgucacugcuuaacuu

SEQ ID NO: 2940070 - RNA, 14 nt, Human
aucgucacugcuua

SEQ ID NO: 2940071 - RNA, 15 nt, Human
uugaagguagaaugu

SEQ ID NO: 2940072 - RNA, 19 nt, Human
uugaagguagaauguuuuc

SEQ ID NO: 2940073 - RNA, 16 nt, Human
uugaagguagaauguu

SEQ ID NO: 2940074 - RNA, 14 nt, Human
uugaaguaaaaugu

SEQ ID NO: 2940075 - RNA, 16 nt, Human
uugaaggaugcugucu

SEQ ID NO: 2940076 - RNA, 14 nt, Human
uugaaggaugcugu

SEQ ID NO: 2940077 - RNA, 17 nt, Human
uugacacuuaaaaaugg

SEQ ID NO: 2940078 - RNA, 24 nt, Human
uugaccauucuccaccugccaggg

SEQ ID NO: 2940079 - RNA, 17 nt, Human
uugaccauucuccaccu

SEQ ID NO: 2940080 - RNA, 19 nt, Human
uugaccauucuccaccugc

SEQ ID NO: 2940081 - RNA, 18 nt, Human
uugaccauucuccaccug

SEQ ID NO: 2940082 - RNA, 19 nt, Human
uugacagggcacaccgggc

SEQ ID NO: 2940083 - RNA, 19 nt, Human
uugacacuuaaaaaugguu

SEQ ID NO: 2940084 - RNA, 12 nt, Human
uugauaaaguaa

SEQ ID NO: 2940085 - RNA, 15 nt, Human
uugaggucuguucuu

SEQ ID NO: 2940086 - RNA, 16 nt, Human
uugaggucuguucuuu

SEQ ID NO: 2940087 - RNA, 17 nt, Human
uucuguuuuauaauuuu

SEQ ID NO: 2940088 - RNA, 16 nt, Human
uucuguuuuauaauuu

SEQ ID NO: 2940089 - RNA, 21 nt, Human
uucuguuggccagugugacaa

SEQ ID NO: 2940090 - RNA, 13 nt, Human
uucuguuuagaua

SEQ ID NO: 2940091 - RNA, 18 nt, Human
uucuguuuagauaauaca

SEQ ID NO: 2940092 - RNA, 22 nt, Human
uucuucuccacuuucuagccag

SEQ ID NO: 2940093 - RNA, 12 nt, Human
uucuuucuggcu

SEQ ID NO: 2940094 - RNA, 17 nt, Human
uucuuucuggcuaugca

SEQ ID NO: 2940095 - RNA, 20 nt, Human
uucuuucuggcuaugcauuu

SEQ ID NO: 2940096 - RNA, 16 nt, Human
auccaauugcugcuug

SEQ ID NO: 2940097 - RNA, 15 nt, Human
uucugccugcccagg

SEQ ID NO: 2940098 - RNA, 16 nt, Human
uucugccugcccaggc

SEQ ID NO: 2940099 - RNA, 17 nt, Human
auccagguucagcuugu

SEQ ID NO: 2940100 - RNA, 14 nt, Human
auccaguaucuuga

SEQ ID NO: 2940101 - RNA, 11 nt, Human
aucccagcccc

SEQ ID NO: 2940102 - RNA, 13 nt, Human
aucccaugagccu

SEQ ID NO: 2940103 - RNA, 16 nt, Human
aucccaugagccucag

SEQ ID NO: 2940104 - RNA, 22 nt, Human
aucccugaaggccccgcccagg

SEQ ID NO: 2940105 - RNA, 20 nt, Human
aucccucccuccaccucccu

SEQ ID NO: 2940106 - RNA, 17 nt, Human
aucccugaaggccccgc

SEQ ID NO: 2940107 - RNA, 17 nt, Human
aucccaugagccucagc

SEQ ID NO: 2940108 - RNA, 18 nt, Human
aucccaugagccucagca

SEQ ID NO: 2940109 - RNA, 14 nt, Human
aucccucccuccac

SEQ ID NO: 2940110 - RNA, 16 nt, Human
aucccucccuccaccu

SEQ ID NO: 2940111 - RNA, 17 nt, Human
aucccucccuccaccuc

SEQ ID NO: 2940112 - RNA, 18 nt, Human
aucccucccuccaccucc

SEQ ID NO: 2940113 - RNA, 14 nt, Human
aucaggugcugcca

SEQ ID NO: 2940114 - RNA, 19 nt, Human
aucagucugauucccaagc

SEQ ID NO: 2940115 - RNA, 14 nt, Human
aucacuuccaugac

SEQ ID NO: 2940116 - RNA, 17 nt, Human
aucaggugcugccaucc

SEQ ID NO: 2940117 - RNA, 19 nt, Human
aucaggugcugccauccag

SEQ ID NO: 2940118 - RNA, 15 nt, Human
aucaggugcugccau

SEQ ID NO: 2940119 - RNA, 23 nt, Human
aucacuugaacccgggaggcaga

SEQ ID NO: 2940120 - RNA, 23 nt, Human
aucauaguggcuuaaaacaacac

SEQ ID NO: 2940121 - RNA, 15 nt, Human
aucauaaaacuugau

SEQ ID NO: 2940122 - RNA, 16 nt, Human
aucauuaggugugacu

SEQ ID NO: 2940123 - RNA, 21 nt, Human
aucauccacugugccaugugc

SEQ ID NO: 2940124 - RNA, 23 nt, Human
aucauccacugugccaugugcca

SEQ ID NO: 2940125 - RNA, 20 nt, Human
uucucuaguuugauuaaauu

SEQ ID NO: 2940126 - RNA, 21 nt, Human
uucucuaguuugauuaaauuc

SEQ ID NO: 2940127 - RNA, 14 nt, Human
uucucucaucuguu

SEQ ID NO: 2940128 - RNA, 19 nt, Human
uucugcagccacuauuguu

SEQ ID NO: 2940129 - RNA, 12 nt, Human
aucauugaaauc

SEQ ID NO: 2940130 - RNA, 13 nt, Human
aucauugaaaucu

SEQ ID NO: 2940131 - RNA, 14 nt, Human
auauuguuugcuaa

SEQ ID NO: 2940132 - RNA, 13 nt, Human
auauuguuuucag

SEQ ID NO: 2940133 - RNA, 13 nt, Human
auauuuaaucuuu

SEQ ID NO: 2940134 - RNA, 13 nt, Human
auauuuacaaaug

SEQ ID NO: 2940135 - RNA, 15 nt, Human
auauugauaugcuua

SEQ ID NO: 2940136 - RNA, 18 nt, Human
auauucucacagcuccaa

SEQ ID NO: 2940137 - RNA, 20 nt, Human
auauugguugggaugacuug

SEQ ID NO: 2940138 - RNA, 19 nt, Human
auauugguugggaugacuu

SEQ ID NO: 2940139 - RNA, 22 nt, Human
auauugcugauggugcaaugac

SEQ ID NO: 2940140 - RNA, 16 nt, Human
uuccagugaggcucug

SEQ ID NO: 2940141 - RNA, 15 nt, Human
uuccagugaggcucu

SEQ ID NO: 2940142 - RNA, 17 nt, Human
auauuaccacagacaua

SEQ ID NO: 2940143 - RNA, 16 nt, Human
auauuaagaaagacua

SEQ ID NO: 2940144 - RNA, 15 nt, Human
auauuaagaaagacu

SEQ ID NO: 2940145 - RNA, 17 nt, Human
auauuaagaaagacuau

SEQ ID NO: 2940146 - RNA, 22 nt, Human
auauuaagaaagacuaucuaaa

SEQ ID NO: 2940147 - RNA, 22 nt, Human
uuccuguuuuuauuauuaacaa

SEQ ID NO: 2940148 - RNA, 22 nt, Human
uuccuggcacugcuuccaguga

SEQ ID NO: 2940149 - RNA, 20 nt, Human
uuccuggcacugcuuccagu

SEQ ID NO: 2940150 - RNA, 12 nt, Human
uuccugaacagg

SEQ ID NO: 2940151 - RNA, 19 nt, Human
uuccuggcacugcuuccag

SEQ ID NO: 2940152 - RNA, 22 nt, Human
uuccucuuuuuauuuaguuccu

SEQ ID NO: 2940153 - RNA, 15 nt, Human
aucaaauaugcaaag

SEQ ID NO: 2940154 - RNA, 15 nt, Human
auauuuuuuaaaaua

SEQ ID NO: 2940155 - RNA, 17 nt, Human
auauuuuuuaaaauaag

SEQ ID NO: 2940156 - RNA, 21 nt, Human
aucaacugcaucaagauguga

SEQ ID NO: 2940157 - RNA, 16 nt, Human
aucaaggguacacugc

SEQ ID NO: 2940158 - RNA, 23 nt, Human
auauuuuuuaaaauaagucugau

SEQ ID NO: 2940159 - RNA, 18 nt, Human
aucaaauaugcaaagcac

SEQ ID NO: 2940160 - RNA, 17 nt, Human
aucaaauaugcaaagca

SEQ ID NO: 2940161 - RNA, 16 nt, Human
aucaaauaugcaaagc

SEQ ID NO: 2940162 - RNA, 21 nt, Human
aucaaggguacacugccuucu

SEQ ID NO: 2940163 - RNA, 13 nt, Human
aucaauuuaaaaa

SEQ ID NO: 2940164 - RNA, 14 nt, Human
aucacgccacugca

SEQ ID NO: 2940165 - RNA, 15 nt, Human
aucacgccacugcac

SEQ ID NO: 2940166 - RNA, 17 nt, Human
aucacgccacugcacua

SEQ ID NO: 2940167 - RNA, 14 nt, Human
aucaauuuuucuua

SEQ ID NO: 2940168 - RNA, 14 nt, Human
uucaggguuggccc

SEQ ID NO: 2940169 - RNA, 16 nt, Human
uucaggguuggccccu

SEQ ID NO: 2940170 - RNA, 17 nt, Human
uucaggguuggccccug

SEQ ID NO: 2940171 - RNA, 19 nt, Human
uucaggguuggccccugcc

SEQ ID NO: 2940172 - RNA, 22 nt, Human
uucaggguuggccccugcccgg

SEQ ID NO: 2940173 - RNA, 15 nt, Human
uucagguaacaggca

SEQ ID NO: 2940174 - RNA, 16 nt, Human
uucagguaacaggcag

SEQ ID NO: 2940175 - RNA, 17 nt, Human
uucagcgguuuauauaa

SEQ ID NO: 2940176 - RNA, 16 nt, Human
uucagaaauguguuau

SEQ ID NO: 2940177 - RNA, 16 nt, Human
uucagauaugauucaa

SEQ ID NO: 2940178 - RNA, 17 nt, Human
uucagauaugauucaaa

SEQ ID NO: 2940179 - RNA, 18 nt, Human
uucagauaugauucaaau

SEQ ID NO: 2940180 - RNA, 19 nt, Human
uucagauaugauucaaaug

SEQ ID NO: 2940181 - RNA, 15 nt, Human
uucaucaaugaauga

SEQ ID NO: 2940182 - RNA, 13 nt, Human
auauaugcuaagu

SEQ ID NO: 2940183 - RNA, 21 nt, Human
auauauguuuuaagaggcagg

SEQ ID NO: 2940184 - RNA, 22 nt, Human
auauauguuuuaagaggcaggg

SEQ ID NO: 2940185 - RNA, 17 nt, Human
uucagguaacaggcaga

SEQ ID NO: 2940186 - RNA, 14 nt, Human
uucaguaagccgug

SEQ ID NO: 2940187 - RNA, 21 nt, Human
uuccacaagagcccaggccuc

SEQ ID NO: 2940188 - RNA, 17 nt, Human
uuccaggcugggagagc

SEQ ID NO: 2940189 - RNA, 15 nt, Human
uuccaggcugggaga

SEQ ID NO: 2940190 - RNA, 13 nt, Human
uuccaggcuggga

SEQ ID NO: 2940191 - RNA, 16 nt, Human
uuccaguaaugagcuu

SEQ ID NO: 2940192 - RNA, 17 nt, Human
uuccagguuuaagcugu

SEQ ID NO: 2940193 - RNA, 18 nt, Human
uuccagguuuaagcuguu

SEQ ID NO: 2940194 - RNA, 22 nt, Human
uuccaauuuacauacucugcuu

SEQ ID NO: 2940195 - RNA, 19 nt, Human
uucauucuuuuugaaaugu

SEQ ID NO: 2940196 - RNA, 14 nt, Human
uucauuaguuuuga

SEQ ID NO: 2940197 - RNA, 19 nt, Human
uucauuaguuuugaagauu

SEQ ID NO: 2940198 - RNA, 14 nt, Human
uucauuaucucaaa

SEQ ID NO: 2940199 - RNA, 14 nt, Human
auaugcaaagcacu

SEQ ID NO: 2940200 - RNA, 13 nt, Human
auaugcaaagcac

SEQ ID NO: 2940201 - RNA, 20 nt, Human
uucaugcuguucaugaaaga

SEQ ID NO: 2940202 - RNA, 22 nt, Human
uucaugcuguucaugaaagauu

SEQ ID NO: 2940203 - RNA, 16 nt, Human
auauguagauguaugc

SEQ ID NO: 2940204 - RNA, 18 nt, Human
auauguagauguaugcac

SEQ ID NO: 2940205 - RNA, 20 nt, Human
auauguagauguaugcacac

SEQ ID NO: 2940206 - RNA, 23 nt, Human
auauguagauguaugcacacaca

SEQ ID NO: 2940207 - RNA, 21 nt, Human
auauguggaguucaucuugaa

SEQ ID NO: 2940208 - RNA, 20 nt, Human
auauguggaguucaucuuga

SEQ ID NO: 2940209 - RNA, 16 nt, Human
auauggguaguauuuu

SEQ ID NO: 2940210 - RNA, 23 nt, Human
auauguaccuaacgaaguauccu

SEQ ID NO: 2940211 - RNA, 22 nt, Human
uuucgcaggauucuuccucccu

SEQ ID NO: 2940212 - RNA, 18 nt, Human
uuucgcaggauucuuccu

SEQ ID NO: 2940213 - RNA, 23 nt, Human
uuuccuucauucaacccaccugc

SEQ ID NO: 2940214 - RNA, 21 nt, Human
uuuccuucagugccuuaugga

SEQ ID NO: 2940215 - RNA, 18 nt, Human
uuuccuucagugccuuau

SEQ ID NO: 2940216 - RNA, 22 nt, Human
uuuccuucagugccuuauggaa

SEQ ID NO: 2940217 - RNA, 21 nt, Human
uuuccuucauucaacccaccu

SEQ ID NO: 2940218 - RNA, 22 nt, Human
augggccaccgccuugcccagc

SEQ ID NO: 2940219 - RNA, 17 nt, Human
augggccuccugugugu

SEQ ID NO: 2940220 - RNA, 12 nt, Human
uuuccugugucu

SEQ ID NO: 2940221 - RNA, 15 nt, Human
uuuccuucagugccu

SEQ ID NO: 2940222 - RNA, 12 nt, Human
uuuccuucagug

SEQ ID NO: 2940223 - RNA, 11 nt, Human
uuuccuucagu

SEQ ID NO: 2940224 - RNA, 20 nt, Human
uuuccuucaagaaugcagua

SEQ ID NO: 2940225 - RNA, 13 nt, Human
augggagcucaug

SEQ ID NO: 2940226 - RNA, 18 nt, Human
augggcaacccccagccu

SEQ ID NO: 2940227 - RNA, 19 nt, Human
augggcaacccccagccug

SEQ ID NO: 2940228 - RNA, 21 nt, Human
augggcaacccccagccugcu

SEQ ID NO: 2940229 - RNA, 17 nt, Human
augggccaccgccuugc

SEQ ID NO: 2940230 - RNA, 18 nt, Human
augggccaccgccuugcc

SEQ ID NO: 2940231 - RNA, 15 nt, Human
augggccuccugugu

SEQ ID NO: 2940232 - RNA, 15 nt, Human
augggcagagcagag

SEQ ID NO: 2940233 - RNA, 14 nt, Human
augggcagagcaga

SEQ ID NO: 2940234 - RNA, 13 nt, Human
augggcagagcag

SEQ ID NO: 2940235 - RNA, 21 nt, Human
auggacccaauauuuaccaga

SEQ ID NO: 2940236 - RNA, 19 nt, Human
auggacaugaucuucuuua

SEQ ID NO: 2940237 - RNA, 17 nt, Human
auggaauuucucccagu

SEQ ID NO: 2940238 - RNA, 21 nt, Human
auggcuauaggugcuacaaaa

SEQ ID NO: 2940239 - RNA, 22 nt, Human
augggacauuugcucauggaau

SEQ ID NO: 2940240 - RNA, 21 nt, Human
augggacauuugcucauggaa

SEQ ID NO: 2940241 - RNA, 19 nt, Human
auggcuauaggugcuacaa

SEQ ID NO: 2940242 - RNA, 16 nt, Human
auggcuauaggugcua

SEQ ID NO: 2940243 - RNA, 18 nt, Human
auggccucuucagaucuc

SEQ ID NO: 2940244 - RNA, 22 nt, Human
uuucuaggacugaauuaugaaa

SEQ ID NO: 2940245 - RNA, 21 nt, Human
uuucuaggacugaauuaugaa

SEQ ID NO: 2940246 - RNA, 17 nt, Human
uuucuaggacugaauua

SEQ ID NO: 2940247 - RNA, 15 nt, Human
uuucuaugacacaug

SEQ ID NO: 2940248 - RNA, 21 nt, Human
uuucuaugacacaugcaaggu

SEQ ID NO: 2940249 - RNA, 13 nt, Human
uuucuaugaaaua

SEQ ID NO: 2940250 - RNA, 14 nt, Human
uuucuaugaaauau

SEQ ID NO: 2940251 - RNA, 20 nt, Human
uuucuaugaaauauuauguu

SEQ ID NO: 2940252 - RNA, 18 nt, Human
uuucucacagaagaugaa

SEQ ID NO: 2940253 - RNA, 22 nt, Human
uuucucacagaagaugaagcac

SEQ ID NO: 2940254 - RNA, 16 nt, Human
uuucugccgcagcccu

SEQ ID NO: 2940255 - RNA, 14 nt, Human
uuucugccgcagcc

SEQ ID NO: 2940256 - RNA, 15 nt, Human
uuucucauguugaaa

SEQ ID NO: 2940257 - RNA, 13 nt, Human
uuucucauguuga

SEQ ID NO: 2940258 - RNA, 14 nt, Human
uuucugcaucagcu

SEQ ID NO: 2940259 - RNA, 13 nt, Human
uuucuuuguggcu

SEQ ID NO: 2940260 - RNA, 23 nt, Human
uuugaaacacugguuuuaaauau

SEQ ID NO: 2940261 - RNA, 13 nt, Human
auggggcccugcc

SEQ ID NO: 2940262 - RNA, 14 nt, Human
auggggcccugccu

SEQ ID NO: 2940263 - RNA, 23 nt, Human
augggcuggguucuacccaggug

SEQ ID NO: 2940264 - RNA, 14 nt, Human
uuugaaauauugac

SEQ ID NO: 2940265 - RNA, 14 nt, Human
uuuaccuuuuuuau

SEQ ID NO: 2940266 - RNA, 19 nt, Human
uuuaccuuuuuuauacaua

SEQ ID NO: 2940267 - RNA, 20 nt, Human
uuuaccuuuuuuauacauaa

SEQ ID NO: 2940268 - RNA, 17 nt, Human
augcuacacacugcaug

SEQ ID NO: 2940269 - RNA, 18 nt, Human
augcuacacacugcaugu

SEQ ID NO: 2940270 - RNA, 18 nt, Human
uuuacuaauagacaauuu

SEQ ID NO: 2940271 - RNA, 14 nt, Human
uuuacuaauagaca

SEQ ID NO: 2940272 - RNA, 17 nt, Human
uuuacuaauagacaauu

SEQ ID NO: 2940273 - RNA, 21 nt, Human
uuuaccuuuuuuauacauaaa

SEQ ID NO: 2940274 - RNA, 24 nt, Human
uuuaaagcuuauuaaaacucauuu

SEQ ID NO: 2940275 - RNA, 16 nt, Human
uuuaaagcuuccauug

SEQ ID NO: 2940276 - RNA, 23 nt, Human
augccuaccaauauuuaaucuuu

SEQ ID NO: 2940277 - RNA, 17 nt, Human
augccuaccaauauuua

SEQ ID NO: 2940278 - RNA, 16 nt, Human
augccuaccaauauuu

SEQ ID NO: 2940279 - RNA, 14 nt, Human
augcgcuguggcca

SEQ ID NO: 2940280 - RNA, 13 nt, Human
augcuaagugaaa

SEQ ID NO: 2940281 - RNA, 16 nt, Human
uuuagcccugaacauu

SEQ ID NO: 2940282 - RNA, 18 nt, Human
uuuauauagcaagacauu

SEQ ID NO: 2940283 - RNA, 22 nt, Human
uuuauauagcaagacauuauau

SEQ ID NO: 2940284 - RNA, 15 nt, Human
uuuagauaauacacc

SEQ ID NO: 2940285 - RNA, 17 nt, Human
uuuagaugaaugucagu

SEQ ID NO: 2940286 - RNA, 18 nt, Human
uuuagaguugauacuaca

SEQ ID NO: 2940287 - RNA, 13 nt, Human
uuuagauaauaca

SEQ ID NO: 2940288 - RNA, 17 nt, Human
uuuauaugcuucuguuu

SEQ ID NO: 2940289 - RNA, 19 nt, Human
uuuauuaaaugcccagccc

SEQ ID NO: 2940290 - RNA, 16 nt, Human
uuuauuacuguaagaa

SEQ ID NO: 2940291 - RNA, 23 nt, Human
augcugucuacacuaagagagaa

SEQ ID NO: 2940292 - RNA, 14 nt, Human
augcuguauuuuaa

SEQ ID NO: 2940293 - RNA, 19 nt, Human
augcugugcccuaaagugu

SEQ ID NO: 2940294 - RNA, 22 nt, Human
augcuggcuguuggcugggggc

SEQ ID NO: 2940295 - RNA, 19 nt, Human
uuuauuacuguaagaaaau

SEQ ID NO: 2940296 - RNA, 17 nt, Human
auggaacacucugagac

SEQ ID NO: 2940297 - RNA, 18 nt, Human
auggaacacucugagacu

SEQ ID NO: 2940298 - RNA, 21 nt, Human
auggaaguacuauaauuuacc

SEQ ID NO: 2940299 - RNA, 16 nt, Human
auggaacauaaaauac

SEQ ID NO: 2940300 - RNA, 16 nt, Human
uuuauuuuaauaaugu

SEQ ID NO: 2940301 - RNA, 14 nt, Human
auggaauaacaugu

SEQ ID NO: 2940302 - RNA, 15 nt, Human
auggaauaacaugua

SEQ ID NO: 2940303 - RNA, 14 nt, Human
uuucacucuccuug

SEQ ID NO: 2940304 - RNA, 24 nt, Human
uuucacucuuauugcccacgcugg

SEQ ID NO: 2940305 - RNA, 15 nt, Human
uuucacucuccuugg

SEQ ID NO: 2940306 - RNA, 19 nt, Human
uuuccagguuuaagcuguu

SEQ ID NO: 2940307 - RNA, 23 nt, Human
auggaauuggagcucgugggaca

SEQ ID NO: 2940308 - RNA, 18 nt, Human
uugugaagcaaaauuuuu

SEQ ID NO: 2940309 - RNA, 22 nt, Human
uugugaaggcaggggaauguau

SEQ ID NO: 2940310 - RNA, 14 nt, Human
uugugaauaaagag

SEQ ID NO: 2940311 - RNA, 22 nt, Human
uuguucccugugucauuucaaa

SEQ ID NO: 2940312 - RNA, 18 nt, Human
augaucacggcucacugc

SEQ ID NO: 2940313 - RNA, 19 nt, Human
augaucacggcucacugca

SEQ ID NO: 2940314 - RNA, 15 nt, Human
augaucacggcucac

SEQ ID NO: 2940315 - RNA, 23 nt, Human
augaucacggcucacugcagccu

SEQ ID NO: 2940316 - RNA, 16 nt, Human
augauccuaggcauuu

SEQ ID NO: 2940317 - RNA, 14 nt, Human
augaucuucuuuau

SEQ ID NO: 2940318 - RNA, 22 nt, Human
augcaaggucauuuuuuuuaag

SEQ ID NO: 2940319 - RNA, 16 nt, Human
augcaccuggaauaua

SEQ ID NO: 2940320 - RNA, 14 nt, Human
augcaccuggaaua

SEQ ID NO: 2940321 - RNA, 14 nt, Human
augcaaggucauuu

SEQ ID NO: 2940322 - RNA, 16 nt, Human
augcaaggucauuuuu

SEQ ID NO: 2940323 - RNA, 22 nt, Human
augcaaaccaucauugaaaucu

SEQ ID NO: 2940324 - RNA, 21 nt, Human
augcaaaccaucauugaaauc

SEQ ID NO: 2940325 - RNA, 20 nt, Human
augcaaaccaucauugaaau

SEQ ID NO: 2940326 - RNA, 19 nt, Human
augcaaaccaucauugaaa

SEQ ID NO: 2940327 - RNA, 18 nt, Human
augcaaaccaucauugaa

SEQ ID NO: 2940328 - RNA, 16 nt, Human
augcaaaccaucauug

SEQ ID NO: 2940329 - RNA, 15 nt, Human
augaucuucuuuaua

SEQ ID NO: 2940330 - RNA, 18 nt, Human
augaucuucuuuauaauu

SEQ ID NO: 2940331 - RNA, 19 nt, Human
augcaccuggaauauauaa

SEQ ID NO: 2940332 - RNA, 16 nt, Human
uuguuuuuauuaaaag

SEQ ID NO: 2940333 - RNA, 20 nt, Human
uuuaaaaaagaaacauuugg

SEQ ID NO: 2940334 - RNA, 15 nt, Human
augagcaucaggcca

SEQ ID NO: 2940335 - RNA, 17 nt, Human
augagcaucaggccagg

SEQ ID NO: 2940336 - RNA, 16 nt, Human
augagcaucaggccag

SEQ ID NO: 2940337 - RNA, 21 nt, Human
augagcaucaggccaggcccu

SEQ ID NO: 2940338 - RNA, 20 nt, Human
augagcaucaggccaggccc

SEQ ID NO: 2940339 - RNA, 19 nt, Human
augagcaucaggccaggcc

SEQ ID NO: 2940340 - RNA, 18 nt, Human
augagcaucaggccaggc

SEQ ID NO: 2940341 - RNA, 15 nt, Human
augagccgcccaagg

SEQ ID NO: 2940342 - RNA, 22 nt, Human
augagcaucaggccaggcccuc

SEQ ID NO: 2940343 - RNA, 16 nt, Human
augagccgcccaaggc

SEQ ID NO: 2940344 - RNA, 18 nt, Human
augagccgcccaaggccu

SEQ ID NO: 2940345 - RNA, 19 nt, Human
augagccgcccaaggccuu

SEQ ID NO: 2940346 - RNA, 21 nt, Human
augagccgcccaaggccuucc

SEQ ID NO: 2940347 - RNA, 22 nt, Human
augagccgcccaaggccuuccc

SEQ ID NO: 2940348 - RNA, 12 nt, Human
augagccucagc

SEQ ID NO: 2940349 - RNA, 15 nt, Human
augagccucagcauc

SEQ ID NO: 2940350 - RNA, 16 nt, Human
augagccucagcaucc

SEQ ID NO: 2940351 - RNA, 16 nt, Human
augagaggaaaucacc

SEQ ID NO: 2940352 - RNA, 15 nt, Human
augagaggaaaucac

SEQ ID NO: 2940353 - RNA, 14 nt, Human
augagaggaaauca

SEQ ID NO: 2940354 - RNA, 13 nt, Human
augagaggaaauc

SEQ ID NO: 2940355 - RNA, 12 nt, Human
augagaggaaau

SEQ ID NO: 2940356 - RNA, 21 nt, Human
uugucggccccaccagugccu

SEQ ID NO: 2940357 - RNA, 22 nt, Human
augaggucagagccugcaguua

SEQ ID NO: 2940358 - RNA, 17 nt, Human
augagccucagcauccu

SEQ ID NO: 2940359 - RNA, 18 nt, Human
augagccucagcauccug

SEQ ID NO: 2940360 - RNA, 15 nt, Human
augauaaaacacaaa

SEQ ID NO: 2940361 - RNA, 18 nt, Human
uugucacacacuuuggcu

SEQ ID NO: 2940362 - RNA, 14 nt, Human
augauaacuggaaa

SEQ ID NO: 2940363 - RNA, 13 nt, Human
uuguauaaaauaa

SEQ ID NO: 2940364 - RNA, 19 nt, Human
uuguauaaaauaauuuuua

SEQ ID NO: 2940365 - RNA, 20 nt, Human
uuguaaggaaugauuaauua

SEQ ID NO: 2940366 - RNA, 23 nt, Human
uuguaguguuggagaagaacuga

SEQ ID NO: 2940367 - RNA, 23 nt, Human
augaauuaguuuuauaugcuucu

SEQ ID NO: 2940368 - RNA, 22 nt, Human
augaauuacauuuguauaaaau

SEQ ID NO: 2940369 - RNA, 21 nt, Human
augaauuaguuuuauaugcuu

SEQ ID NO: 2940370 - RNA, 20 nt, Human
augacacgaauauugcugau

SEQ ID NO: 2940371 - RNA, 19 nt, Human
augacacgaauauugcuga

SEQ ID NO: 2940372 - RNA, 22 nt, Human
uugggguacccacugcucuggu

SEQ ID NO: 2940373 - RNA, 19 nt, Human
uugguuaggcauuguggga

SEQ ID NO: 2940374 - RNA, 21 nt, Human
uuguaacuguuuagaugaaug

SEQ ID NO: 2940375 - RNA, 22 nt, Human
uuguaacuguuuagaugaaugu

SEQ ID NO: 2940376 - RNA, 14 nt, Human
uuguaaggaaugau

SEQ ID NO: 2940377 - RNA, 23 nt, Human
uugggcacuauuuauuuacaaau

SEQ ID NO: 2940378 - RNA, 16 nt, Human
uugggcacuauuuauu

SEQ ID NO: 2940379 - RNA, 17 nt, Human
uugggguacccacugcu

SEQ ID NO: 2940380 - RNA, 19 nt, Human
uuggggaagaacgaagcca

SEQ ID NO: 2940381 - RNA, 13 nt, Human
augaaccacaucu

SEQ ID NO: 2940382 - RNA, 20 nt, Human
augaaccacaucuugcucug

SEQ ID NO: 2940383 - RNA, 17 nt, Human
augaauuacauuuguau

SEQ ID NO: 2940384 - RNA, 18 nt, Human
augaauuacauuuguaua

SEQ ID NO: 2940385 - RNA, 19 nt, Human
augaauuacauuuguauaa

SEQ ID NO: 2940386 - RNA, 23 nt, Human
uuggccugucuuuggauuguuaa

SEQ ID NO: 2940387 - RNA, 18 nt, Human
uuggaaagaguaggaaga

SEQ ID NO: 2940388 - RNA, 21 nt, Human
uuggcuagagguucaaagaua

SEQ ID NO: 2940389 - RNA, 22 nt, Human
uuggcuaggaccccuccaugug

SEQ ID NO: 2940390 - RNA, 22 nt, Human
uuggcuagagguucaaagauau

SEQ ID NO: 2940391 - RNA, 13 nt, Human
uuggcugcaggga

SEQ ID NO: 2940392 - RNA, 14 nt, Human
uuggcugcagggag

SEQ ID NO: 2940393 - RNA, 15 nt, Human
uuggcugcugaaggc

SEQ ID NO: 2940394 - RNA, 11 nt, Human
uuggcugcuga

SEQ ID NO: 2940395 - RNA, 13 nt, Human
aucuuuuaugauu

SEQ ID NO: 2940396 - RNA, 20 nt, Human
augaaagacuguacaaagua

SEQ ID NO: 2940397 - RNA, 21 nt, Human
augaaauauuauguuaaaacu

SEQ ID NO: 2940398 - RNA, 20 nt, Human
augaaauauuauguuaaaac

SEQ ID NO: 2940399 - RNA, 17 nt, Human
uuggaaagaguaggaag

SEQ ID NO: 2940400 - RNA, 18 nt, Human
uugcugauggugcaauga

SEQ ID NO: 2940401 - RNA, 17 nt, Human
uugcugauggugcaaug

SEQ ID NO: 2940402 - RNA, 20 nt, Human
uugcuaagugaggaugaaaa

SEQ ID NO: 2940403 - RNA, 19 nt, Human
uugcugaauacagaggcaa

SEQ ID NO: 2940404 - RNA, 11 nt, Human
uugcucaugga

SEQ ID NO: 2940405 - RNA, 12 nt, Human
uugcucauggaa

SEQ ID NO: 2940406 - RNA, 22 nt, Human
auuuauuaaaugcccagccccu

SEQ ID NO: 2940407 - RNA, 18 nt, Human
auuuaguauuuuguuuca

SEQ ID NO: 2940408 - RNA, 13 nt, Human
auuuagauguaua

SEQ ID NO: 2940409 - RNA, 12 nt, Human
auuuaacagaaa

SEQ ID NO: 2940410 - RNA, 14 nt, Human
auuuaacagaaaug

SEQ ID NO: 2940411 - RNA, 13 nt, Human
auuuacuuaagac

SEQ ID NO: 2940412 - RNA, 17 nt, Human
auuuacuucuuauacau

SEQ ID NO: 2940413 - RNA, 14 nt, Human
auuuacuucuuaua

SEQ ID NO: 2940414 - RNA, 16 nt, Human
auuuacuucuuauaca

SEQ ID NO: 2940415 - RNA, 15 nt, Human
auuuagaaauauaau

SEQ ID NO: 2940416 - RNA, 19 nt, Human
auuuacuuaagacuuaaug

SEQ ID NO: 2940417 - RNA, 14 nt, Human
auuuauucugcuca

SEQ ID NO: 2940418 - RNA, 23 nt, Human
auuucaaacagucucccuuccua

SEQ ID NO: 2940419 - RNA, 19 nt, Human
auuuauuuuaauaauguuu

SEQ ID NO: 2940420 - RNA, 20 nt, Human
auuuauuuuaauaauguuuc

SEQ ID NO: 2940421 - RNA, 12 nt, Human
auuucaagaagu

SEQ ID NO: 2940422 - RNA, 12 nt, Human
auuucauuucuu

SEQ ID NO: 2940423 - RNA, 17 nt, Human
auuuccagccaaagccu

SEQ ID NO: 2940424 - RNA, 15 nt, Human
auuuccguuaaaaua

SEQ ID NO: 2940425 - RNA, 16 nt, Human
auuuccguuaaaauac

SEQ ID NO: 2940426 - RNA, 14 nt, Human
auuugaaaauuuug

SEQ ID NO: 2940427 - RNA, 14 nt, Human
auuugaaauauuga

SEQ ID NO: 2940428 - RNA, 14 nt, Human
auuuauucauuagu

SEQ ID NO: 2940429 - RNA, 13 nt, Human
auuuauuuacaaa

SEQ ID NO: 2940430 - RNA, 15 nt, Human
auuuauuuacaaaug

SEQ ID NO: 2940431 - RNA, 16 nt, Human
auuuauuuacaaaugu

SEQ ID NO: 2940432 - RNA, 13 nt, Human
auuuauucugcuc

SEQ ID NO: 2940433 - RNA, 18 nt, Human
auuuauuuacaaauguuu

SEQ ID NO: 2940434 - RNA, 14 nt, Human
auuuauuuauucau

SEQ ID NO: 2940435 - RNA, 17 nt, Human
auuuauuuuaauaaugu

SEQ ID NO: 2940436 - RNA, 17 nt, Human
auugaaaucuaggaaaa

SEQ ID NO: 2940437 - RNA, 15 nt, Human
auugacauugaaauc

SEQ ID NO: 2940438 - RNA, 17 nt, Human
auugacauugaaaucua

SEQ ID NO: 2940439 - RNA, 18 nt, Human
auugacauugaaaucuag

SEQ ID NO: 2940440 - RNA, 22 nt, Human
auugacauugaaaucuaggaaa

SEQ ID NO: 2940441 - RNA, 18 nt, Human
auugacccacaagaaaug

SEQ ID NO: 2940442 - RNA, 16 nt, Human
auucuuuuugaaaugu

SEQ ID NO: 2940443 - RNA, 15 nt, Human
auugaaaaaccauuu

SEQ ID NO: 2940444 - RNA, 20 nt, Human
auuggggcucccagccaggc

SEQ ID NO: 2940445 - RNA, 21 nt, Human
auuggggcucccagccaggcc

SEQ ID NO: 2940446 - RNA, 22 nt, Human
auuggggcucccagccaggccc

SEQ ID NO: 2940447 - RNA, 23 nt, Human
auuggggcucccagccaggcccu

SEQ ID NO: 2940448 - RNA, 17 nt, Human
auugggcacaucauuuc

SEQ ID NO: 2940449 - RNA, 18 nt, Human
auugggcacaucauuuca

SEQ ID NO: 2940450 - RNA, 19 nt, Human
auugggcacaucauuucaa

SEQ ID NO: 2940451 - RNA, 21 nt, Human
auugggcacaucauuucaaga

SEQ ID NO: 2940452 - RNA, 23 nt, Human
auugggcacaucauuucaagaag

SEQ ID NO: 2940453 - RNA, 21 nt, Human
auugggcacuauuuauuuaca

SEQ ID NO: 2940454 - RNA, 13 nt, Human
auucuuauuuaau

SEQ ID NO: 2940455 - RNA, 14 nt, Human
auucuuauuuaaug

SEQ ID NO: 2940456 - RNA, 18 nt, Human
auucuuauuuaaugaaag

SEQ ID NO: 2940457 - RNA, 13 nt, Human
auucuucuccacu

SEQ ID NO: 2940458 - RNA, 13 nt, Human
auucuuccucccu

SEQ ID NO: 2940459 - RNA, 22 nt, Human
auucuuccucccucccucuuuc

SEQ ID NO: 2940460 - RNA, 15 nt, Human
auuguauuacaaauc

SEQ ID NO: 2940461 - RNA, 20 nt, Human
auuguccccgacccuugccg

SEQ ID NO: 2940462 - RNA, 19 nt, Human
auuguccccgacccuugcc

SEQ ID NO: 2940463 - RNA, 17 nt, Human
auuguccccgacccuug

SEQ ID NO: 2940464 - RNA, 14 nt, Human
auugugucucuugg

SEQ ID NO: 2940465 - RNA, 18 nt, Human
auugugucucuugguccu

SEQ ID NO: 2940466 - RNA, 12 nt, Human
auuugugagacu

SEQ ID NO: 2940467 - RNA, 14 nt, Human
auuugugagacugu

SEQ ID NO: 2940468 - RNA, 14 nt, Human
auuugugauacaau

SEQ ID NO: 2940469 - RNA, 21 nt, Human
auuuguuuugccaauuugcac

SEQ ID NO: 2940470 - RNA, 23 nt, Human
auuuguuuugccaauuugcacau

SEQ ID NO: 2940471 - RNA, 17 nt, Human
auuuuaaaagaaugauu

SEQ ID NO: 2940472 - RNA, 23 nt, Human
auuugaagguagaauguuuucaa

SEQ ID NO: 2940473 - RNA, 18 nt, Human
auuugaagguagaauguu

SEQ ID NO: 2940474 - RNA, 19 nt, Human
auuuguauaaaauaauuuu

SEQ ID NO: 2940475 - RNA, 15 nt, Human
auuuguauaaaauaa

SEQ ID NO: 2940476 - RNA, 18 nt, Human
auuuguauaaaauaauuu

SEQ ID NO: 2940477 - RNA, 17 nt, Human
auuuuacuuuuuggaaa

SEQ ID NO: 2940478 - RNA, 14 nt, Human
auuuuacuuuuugg

SEQ ID NO: 2940479 - RNA, 21 nt, Human
auuuuacuuuaaaaggagcca

SEQ ID NO: 2940480 - RNA, 13 nt, Human
auuuuacauaaau

SEQ ID NO: 2940481 - RNA, 16 nt, Human
auuuuacauaaauuua

SEQ ID NO: 2940482 - RNA, 17 nt, Human
auuuuacauaaauuuag

SEQ ID NO: 2940483 - RNA, 15 nt, Human
auuuuaauucaguug

SEQ ID NO: 2940484 - RNA, 21 nt, Human
auuuuaaacauauccaaguuu

SEQ ID NO: 2940485 - RNA, 21 nt, Human
auuuuaaacaaaauagaaagu

SEQ ID NO: 2940486 - RNA, 15 nt, Human
auuuuaaacaaaaua

SEQ ID NO: 2940487 - RNA, 18 nt, Human
auuuuaaaagaaugauua

SEQ ID NO: 2940488 - RNA, 22 nt, Human
auuuuaaaagaaugauuaugaa

SEQ ID NO: 2940489 - RNA, 22 nt, Human
auuuucaguuauuauauuuaca

SEQ ID NO: 2940490 - RNA, 20 nt, Human
uuuucauuuaggugaggaag

SEQ ID NO: 2940491 - RNA, 14 nt, Human
uuuucucuaggaaa

SEQ ID NO: 2940492 - RNA, 18 nt, Human
uuuucugagaaagacuau

SEQ ID NO: 2940493 - RNA, 15 nt, Human
uuuucugagaaagac

SEQ ID NO: 2940494 - RNA, 14 nt, Human
uuuucaguguacau

SEQ ID NO: 2940495 - RNA, 11 nt, Human
uuuuauuuuau

SEQ ID NO: 2940496 - RNA, 13 nt, Human
uuuuauuaugcau

SEQ ID NO: 2940497 - RNA, 16 nt, Human
auuaaacaugcuguac

SEQ ID NO: 2940498 - RNA, 15 nt, Human
auuaaaaaucucaaa

SEQ ID NO: 2940499 - RNA, 19 nt, Human
auuaaaaaucucaaauuuc

SEQ ID NO: 2940500 - RNA, 23 nt, Human
auuaaaacacaacaucuuuuucu

SEQ ID NO: 2940501 - RNA, 20 nt, Human
auuaaaaaucucaaauuucu

SEQ ID NO: 2940502 - RNA, 22 nt, Human
auuaaaaaucucaaauuucuaa

SEQ ID NO: 2940503 - RNA, 15 nt, Human
auguuuucaggcuag

SEQ ID NO: 2940504 - RNA, 17 nt, Human
auguuuucaggcuagau

SEQ ID NO: 2940505 - RNA, 21 nt, Human
auguuuucaggcuagauguau

SEQ ID NO: 2940506 - RNA, 19 nt, Human
augugcuaguaauuggaaa

SEQ ID NO: 2940507 - RNA, 22 nt, Human
augugccagguuuuuggucuga

SEQ ID NO: 2940508 - RNA, 16 nt, Human
uuuuaauaauguuuca

SEQ ID NO: 2940509 - RNA, 20 nt, Human
auggggcccugccuccuuug

SEQ ID NO: 2940510 - RNA, 12 nt, Human
uuuuaauaaugu

SEQ ID NO: 2940511 - RNA, 13 nt, Human
uuuuaauaauguu

SEQ ID NO: 2940512 - RNA, 14 nt, Human
uuuuaauaauguuu

SEQ ID NO: 2940513 - RNA, 24 nt, Human
auguggaguucaucuugaauugua

SEQ ID NO: 2940514 - RNA, 20 nt, Human
auguggaguucaucuugaau

SEQ ID NO: 2940515 - RNA, 22 nt, Human
auguuaauauuuuagguguaaa

SEQ ID NO: 2940516 - RNA, 13 nt, Human
auguuaauauuuu

SEQ ID NO: 2940517 - RNA, 13 nt, Human
auguuaauauuuc

SEQ ID NO: 2940518 - RNA, 14 nt, Human
auguguucuauuca

SEQ ID NO: 2940519 - RNA, 20 nt, Human
auguugcccaggcaggucuu

SEQ ID NO: 2940520 - RNA, 16 nt, Human
auguugcccaggcagg

SEQ ID NO: 2940521 - RNA, 17 nt, Human
auguugcccaggcaggu

SEQ ID NO: 2940522 - RNA, 12 nt, Human
auguugcccagg

SEQ ID NO: 2940523 - RNA, 18 nt, Human
auguucaucaaugaauga

SEQ ID NO: 2940524 - RNA, 17 nt, Human
uuuugagugccuuacac

SEQ ID NO: 2940525 - RNA, 17 nt, Human
uuuugauccaagcuggu

SEQ ID NO: 2940526 - RNA, 18 nt, Human
uuuugcaaauaaguguau

SEQ ID NO: 2940527 - RNA, 18 nt, Human
uuuugcauauugcauacu

SEQ ID NO: 2940528 - RNA, 15 nt, Human
uuuugcauauugcau

SEQ ID NO: 2940529 - RNA, 18 nt, Human
uuuugccaauuugcacau

SEQ ID NO: 2940530 - RNA, 19 nt, Human
uuuugccaauuugcacauu

SEQ ID NO: 2940531 - RNA, 16 nt, Human
uuuugccaauuugcac

SEQ ID NO: 2940532 - RNA, 23 nt, Human
uuuugccauguuggccaggcugg

SEQ ID NO: 2940533 - RNA, 17 nt, Human
uuuugugcauuaucuag

SEQ ID NO: 2940534 - RNA, 20 nt, Human
uuuugugcauuaucuagaua

SEQ ID NO: 2940535 - RNA, 15 nt, Human
uuuuguuccacaagu

SEQ ID NO: 2940536 - RNA, 21 nt, Human
uuuuguuccacaaguuaaaua

SEQ ID NO: 2940537 - RNA, 22 nt, Human
uuuuuagacagagucucacugu

SEQ ID NO: 2940538 - RNA, 11 nt, Human
uuuuuacuaau

SEQ ID NO: 2940539 - RNA, 12 nt, Human
uuuuuauggcuu

SEQ ID NO: 2940540 - RNA, 20 nt, Human
uuuuuaucgucacugcuuaa

SEQ ID NO: 2940541 - RNA, 19 nt, Human
uuuuuauauuugaaauauu

SEQ ID NO: 2940542 - RNA, 17 nt, Human
uuuuuauauuugaaaua

SEQ ID NO: 2940543 - RNA, 16 nt, Human
auuacauuuguauaaa

SEQ ID NO: 2940544 - RNA, 12 nt, Human
auuaccagggac

SEQ ID NO: 2940545 - RNA, 17 nt, Human
auuacauuuguauaaaa

SEQ ID NO: 2940546 - RNA, 18 nt, Human
auuacauuuguauaaaau

SEQ ID NO: 2940547 - RNA, 21 nt, Human
auuacaguggggaaugaagau

SEQ ID NO: 2940548 - RNA, 14 nt, Human
auuaaguacuaugu

SEQ ID NO: 2940549 - RNA, 22 nt, Human
uuuuuauggcuuuugugcauua

SEQ ID NO: 2940550 - RNA, 20 nt, Human
uuuuuauggcuuuugugcau

SEQ ID NO: 2940551 - RNA, 21 nt, Human
uuuuuauggcuuuugugcauu

SEQ ID NO: 2940552 - RNA, 21 nt, Human
auuaaguaaugauaacuggaa

SEQ ID NO: 2940553 - RNA, 23 nt, Human
auuaaguaaugauaacuggaaac

SEQ ID NO: 2940554 - RNA, 19 nt, Human
uuuuuguagagccaggguc

SEQ ID NO: 2940555 - RNA, 20 nt, Human
uuuuuguagagccagggucu

SEQ ID NO: 2940556 - RNA, 19 nt, Human
uuuuugugaaaagcuccau

SEQ ID NO: 2940557 - RNA, 17 nt, Human
auucccugauuuaauau

SEQ ID NO: 2940558 - RNA, 16 nt, Human
auucccaagcucugcu

SEQ ID NO: 2940559 - RNA, 14 nt, Human
auucccaagcucug

SEQ ID NO: 2940560 - RNA, 15 nt, Human
auucccaagcucugc

SEQ ID NO: 2940561 - RNA, 17 nt, Human
auuauauagcaguaaaa

SEQ ID NO: 2940562 - RNA, 14 nt, Human
auucaggaagcuca

SEQ ID NO: 2940563 - RNA, 15 nt, Human
auucaguaauaacuc

SEQ ID NO: 2940564 - RNA, 19 nt, Human
auucaguaauaacucuacc

SEQ ID NO: 2940565 - RNA, 18 nt, Human
auucagauaugauucaaa

SEQ ID NO: 2940566 - RNA, 20 nt, Human
auucaggaagcucagggccu

SEQ ID NO: 2940567 - RNA, 19 nt, Human
auucaggaagcucagggcc

SEQ ID NO: 2940568 - RNA, 17 nt, Human
auucaggaagcucaggg

SEQ ID NO: 2940569 - RNA, 18 nt, Human
auucuauguuaauauuuu

SEQ ID NO: 2940570 - RNA, 15 nt, Human
auucuauguuaauau

SEQ ID NO: 2940571 - RNA, 12 nt, Human
auucuauaauuu

SEQ ID NO: 2940572 - RNA, 20 nt, Human
auucuccaccugccagggac

SEQ ID NO: 2940573 - RNA, 19 nt, Human
auucuccaccugccaggga

SEQ ID NO: 2940574 - RNA, 16 nt, Human
auucuccuuguguuac

SEQ ID NO: 2940575 - RNA, 20 nt, Human
auucuccugccucagccucc

SEQ ID NO: 2940576 - RNA, 19 nt, Human
auucuccugccucagccuc

SEQ ID NO: 2940577 - RNA, 15 nt, Human
auucuccugccucag

SEQ ID NO: 2940578 - RNA, 17 nt, Human
auucuccugccucagcc

SEQ ID NO: 2940579 - RNA, 11 nt, Human
auucuccugcc

SEQ ID NO: 2940580 - RNA, 14 nt, Human
auucuccugccuca

SEQ ID NO: 2940581 - RNA, 13 nt, Human
auucuccugccuc

SEQ ID NO: 2940582 - RNA, 21 nt, Human
auucuccaccugccagggaca

SEQ ID NO: 2940583 - RNA, 20 nt, Human
auucagauaugauucaaaug

SEQ ID NO: 2940584 - RNA, 14 nt, Human
aaaaacacaaaagu

SEQ ID NO: 2940585 - RNA, 14 nt, Human
aaaacaaggaugaa

SEQ ID NO: 2940586 - RNA, 13 nt, Human
aaaaauuuacuuu

SEQ ID NO: 2940587 - RNA, 18 nt, Human
aaaaauuuacuuuaaacu

SEQ ID NO: 2940588 - RNA, 19 nt, Human
aaaaauuuacuuuaaacua

SEQ ID NO: 2940589 - RNA, 17 nt, Human
aaaacaaggaugaauua

SEQ ID NO: 2940590 - RNA, 18 nt, Human
aaaacacagcaaggguga

SEQ ID NO: 2940591 - RNA, 12 nt, Human
aaaacacauuuu

SEQ ID NO: 2940592 - RNA, 13 nt, Human
aaaacacagcaag

SEQ ID NO: 2940593 - RNA, 12 nt, Human
aaaacacagcaa

SEQ ID NO: 2940594 - RNA, 15 nt, Human
aaaaacugauuuuuu

SEQ ID NO: 2940595 - RNA, 14 nt, Human
aaaaacauggccuu

SEQ ID NO: 2940596 - RNA, 13 nt, Human
aaaaacugauuuu

SEQ ID NO: 2940597 - RNA, 12 nt, Human
aaaaagaggcua

SEQ ID NO: 2940598 - RNA, 16 nt, Human
aagauuuaccacuugu

SEQ ID NO: 2940599 - RNA, 13 nt, Human
aagaaauuugugg

SEQ ID NO: 2940600 - RNA, 14 nt, Human
aagcagaggaagga

SEQ ID NO: 2940601 - RNA, 23 nt, Human
aagcagaccauuggggcucccag

SEQ ID NO: 2940602 - RNA, 22 nt, Human
aagcagaccauuggggcuccca

SEQ ID NO: 2940603 - RNA, 13 nt, Human
aagccagauuuuc

SEQ ID NO: 2940604 - RNA, 18 nt, Human
aagccauaauuguucuua

SEQ ID NO: 2940605 - RNA, 16 nt, Human
aaggcaaggcugucaa

SEQ ID NO: 2940606 - RNA, 18 nt, Human
aaggcaaggcugucaauu

SEQ ID NO: 2940607 - RNA, 17 nt, Human
aaggcaaggcugucaau

SEQ ID NO: 2940608 - RNA, 11 nt, Human
aagcugggcag

SEQ ID NO: 2940609 - RNA, 13 nt, Human
aagcugggcaggu

SEQ ID NO: 2940610 - RNA, 18 nt, Human
aaggacauugcggacagc

SEQ ID NO: 2940611 - RNA, 20 nt, Human
aagcugcacccucaggcagg

SEQ ID NO: 2940612 - RNA, 21 nt, Human
aagcugcacccucaggcaggu

SEQ ID NO: 2940613 - RNA, 22 nt, Human
aagcugcacccucaggcaggug

SEQ ID NO: 2940614 - RNA, 12 nt, Human
aagcguggugga

SEQ ID NO: 2940615 - RNA, 16 nt, Human
aauaaugugaaacugg

SEQ ID NO: 2940616 - RNA, 21 nt, Human
aauaauccuaaacauaugaau

SEQ ID NO: 2940617 - RNA, 22 nt, Human
aaguuguaggcauaaagucagg

SEQ ID NO: 2940618 - RNA, 14 nt, Human
aauaaaauggguuu

SEQ ID NO: 2940619 - RNA, 14 nt, Human
aauaaguguauuuu

SEQ ID NO: 2940620 - RNA, 17 nt, Human
aauaaacgucuuaaaua

SEQ ID NO: 2940621 - RNA, 16 nt, Human
aauaaacgucuuaaau

SEQ ID NO: 2940622 - RNA, 19 nt, Human
aauaaaauggguuuuacug

SEQ ID NO: 2940623 - RNA, 22 nt, Human
aagugcugggauuacaggugug

SEQ ID NO: 2940624 - RNA, 20 nt, Human
aagguuaauguucaucaucc

SEQ ID NO: 2940625 - RNA, 15 nt, Human
aagguuaauaaagua

SEQ ID NO: 2940626 - RNA, 16 nt, Human
aagguuaauaaaguaa

SEQ ID NO: 2940627 - RNA, 11 nt, Human
aaggugggagg

SEQ ID NO: 2940628 - RNA, 21 nt, Human
aaguaucaaguauagaaaauc

SEQ ID NO: 2940629 - RNA, 17 nt, Human
aaguaucaaguauagaa

SEQ ID NO: 2940630 - RNA, 18 nt, Human
aaguaucaaguauagaaa

SEQ ID NO: 2940631 - RNA, 19 nt, Human
aaguaucaaguauagaaaa

SEQ ID NO: 2940632 - RNA, 11 nt, Human
aaguacuucuu

SEQ ID NO: 2940633 - RNA, 16 nt, Human
aaguaucccuacugua

SEQ ID NO: 2940634 - RNA, 21 nt, Human
aaguccccucuccuccacauu

SEQ ID NO: 2940635 - RNA, 20 nt, Human
aaguccccucuccuccacau

SEQ ID NO: 2940636 - RNA, 16 nt, Human
aagucuuagauguaua

SEQ ID NO: 2940637 - RNA, 16 nt, Human
aaugguagcauuuuaa

SEQ ID NO: 2940638 - RNA, 19 nt, Human
aaugguagcauuuuaaaca

SEQ ID NO: 2940639 - RNA, 21 nt, Human
aaugguagcauuuuaaacaaa

SEQ ID NO: 2940640 - RNA, 14 nt, Human
aaugguagcauuuu

SEQ ID NO: 2940641 - RNA, 14 nt, Human
aaugguaguuuuac

SEQ ID NO: 2940642 - RNA, 13 nt, Human
aaugggcagagca

SEQ ID NO: 2940643 - RNA, 15 nt, Human
aaugggcagagcaga

SEQ ID NO: 2940644 - RNA, 22 nt, Human
aaugucaguuguuauuuauuga

SEQ ID NO: 2940645 - RNA, 20 nt, Human
aaugucucuuuaaugucaca

SEQ ID NO: 2940646 - RNA, 18 nt, Human
aaugucaguucugauaug

SEQ ID NO: 2940647 - RNA, 23 nt, Human
aaugucaguucugauauggaagc

SEQ ID NO: 2940648 - RNA, 20 nt, Human
aaugucaguuguuauuuauu

SEQ ID NO: 2940649 - RNA, 19 nt, Human
aaugucaguuguuauuuau

SEQ ID NO: 2940650 - RNA, 22 nt, Human
aaugucuaguuguaacaccaug

SEQ ID NO: 2940651 - RNA, 21 nt, Human
aaugucagugugacugaucuc

SEQ ID NO: 2940652 - RNA, 17 nt, Human
aaugucagugugacuga

SEQ ID NO: 2940653 - RNA, 13 nt, Human
aaugucaguguga

SEQ ID NO: 2940654 - RNA, 16 nt, Human
aaugucagugugacug

SEQ ID NO: 2940655 - RNA, 15 nt, Human
aaugucagugugacu

SEQ ID NO: 2940656 - RNA, 18 nt, Human
aauuaaaacacaacaucu

SEQ ID NO: 2940657 - RNA, 19 nt, Human
aauguuugccucugccucu

SEQ ID NO: 2940658 - RNA, 18 nt, Human
aauguuugccucugccuc

SEQ ID NO: 2940659 - RNA, 14 nt, Human
aauuaguuuuauau

SEQ ID NO: 2940660 - RNA, 17 nt, Human
aauuaguuuuauaugcu

SEQ ID NO: 2940661 - RNA, 20 nt, Human
aauuaguuuuauaugcuucu

SEQ ID NO: 2940662 - RNA, 18 nt, Human
aauuaguggcacuugcuu

SEQ ID NO: 2940663 - RNA, 18 nt, Human
aauauaggaacuuaaaua

SEQ ID NO: 2940664 - RNA, 20 nt, Human
aauauaggaacuuaaauaau

SEQ ID NO: 2940665 - RNA, 21 nt, Human
aauauaggaacuuaaauaaug

SEQ ID NO: 2940666 - RNA, 16 nt, Human
aauauuauguuaaaac

SEQ ID NO: 2940667 - RNA, 19 nt, Human
aaucacacugucuucugau

SEQ ID NO: 2940668 - RNA, 15 nt, Human
aaucaagaaacuuaa

SEQ ID NO: 2940669 - RNA, 13 nt, Human
aaucacaauacau

SEQ ID NO: 2940670 - RNA, 19 nt, Human
aaugaugccaugaggaaca

SEQ ID NO: 2940671 - RNA, 14 nt, Human
aaucuccaaaauaa

SEQ ID NO: 2940672 - RNA, 13 nt, Human
aaucuccaaaaua

SEQ ID NO: 2940673 - RNA, 13 nt, Human
aauccauacauuu

SEQ ID NO: 2940674 - RNA, 22 nt, Human
aaucugcuuuuuaaagaaugcu

SEQ ID NO: 2940675 - RNA, 16 nt, Human
aaugaaccacaucuug

SEQ ID NO: 2940676 - RNA, 17 nt, Human
aaugaaccacaucuugc

SEQ ID NO: 2940677 - RNA, 23 nt, Human
aaugaaccacaucuugcucugcu

SEQ ID NO: 2940678 - RNA, 21 nt, Human
aaugaugauccuaggcauuug

SEQ ID NO: 2940679 - RNA, 17 nt, Human
aaugaagauacugaaau

SEQ ID NO: 2940680 - RNA, 20 nt, Human
aaugauaacuggaaacuuca

SEQ ID NO: 2940681 - RNA, 17 nt, Human
aaugauaacuggaaacu

SEQ ID NO: 2940682 - RNA, 12 nt, Human
aaugaagauacu

SEQ ID NO: 2940683 - RNA, 15 nt, Human
aacugaacuucagag

SEQ ID NO: 2940684 - RNA, 15 nt, Human
aacucaccugccccu

SEQ ID NO: 2940685 - RNA, 16 nt, Human
aacucaccugccccuc

SEQ ID NO: 2940686 - RNA, 20 nt, Human
aacucaccuggcaucuuaca

SEQ ID NO: 2940687 - RNA, 12 nt, Human
aacucaccccag

SEQ ID NO: 2940688 - RNA, 19 nt, Human
aacuuauggggccaaaaua

SEQ ID NO: 2940689 - RNA, 17 nt, Human
aacuuaaauaaugugaa

SEQ ID NO: 2940690 - RNA, 19 nt, Human
aacugauuuuuuuuuccuu

SEQ ID NO: 2940691 - RNA, 17 nt, Human
aacugauuuuuuuuucc

SEQ ID NO: 2940692 - RNA, 16 nt, Human
aacugaucauguuuau

SEQ ID NO: 2940693 - RNA, 18 nt, Human
aacugaucauguuuauga

SEQ ID NO: 2940694 - RNA, 20 nt, Human
aacugaucauguuuaugaga

SEQ ID NO: 2940695 - RNA, 23 nt, Human
aacugaucauguuuaugagaaac

SEQ ID NO: 2940696 - RNA, 23 nt, Human
aacugacacaugcugaacaucac

SEQ ID NO: 2940697 - RNA, 13 nt, Human
aacuucacauauu

SEQ ID NO: 2940698 - RNA, 12 nt, Human
aacuuuuauaaa

SEQ ID NO: 2940699 - RNA, 15 nt, Human
aacuuuuauaaacuu

SEQ ID NO: 2940700 - RNA, 19 nt, Human
aacuuugaccucugcagca

SEQ ID NO: 2940701 - RNA, 20 nt, Human
aacuuugaccucugcagcaa

SEQ ID NO: 2940702 - RNA, 13 nt, Human
aacuuugaccucu

SEQ ID NO: 2940703 - RNA, 14 nt, Human
aacuuugaccucug

SEQ ID NO: 2940704 - RNA, 17 nt, Human
aacuuugaccucugcag

SEQ ID NO: 2940705 - RNA, 16 nt, Human
aacuuuuauaaacuuu

SEQ ID NO: 2940706 - RNA, 19 nt, Human
aacuuuuauaaacuuuacc

SEQ ID NO: 2940707 - RNA, 16 nt, Human
aacuuuuuauauucuc

SEQ ID NO: 2940708 - RNA, 14 nt, Human
aagaaauguaaggg

SEQ ID NO: 2940709 - RNA, 13 nt, Human
aagaaauguaagg

SEQ ID NO: 2940710 - RNA, 19 nt, Human
aacacauuuuucuuaggga

SEQ ID NO: 2940711 - RNA, 15 nt, Human
aacacgagcaggcua

SEQ ID NO: 2940712 - RNA, 19 nt, Human
aacaaaggauacuuauuua

SEQ ID NO: 2940713 - RNA, 15 nt, Human
aacaaaggauacuua

SEQ ID NO: 2940714 - RNA, 14 nt, Human
aacaacgaaagaag

SEQ ID NO: 2940715 - RNA, 15 nt, Human
aacaaaauagaaagu

SEQ ID NO: 2940716 - RNA, 22 nt, Human
aaccacucuaucaaguauuaua

SEQ ID NO: 2940717 - RNA, 23 nt, Human
aacauguaauuaaguacuaugua

SEQ ID NO: 2940718 - RNA, 14 nt, Human
aacauguaauuaag

SEQ ID NO: 2940719 - RNA, 21 nt, Human
aacauguaauuaaguacuaug

SEQ ID NO: 2940720 - RNA, 14 nt, Human
aacccuggugacca

SEQ ID NO: 2940721 - RNA, 14 nt, Human
aaacagaugaaaag

SEQ ID NO: 2940722 - RNA, 17 nt, Human
aaacagaugaaaagccu

SEQ ID NO: 2940723 - RNA, 22 nt, Human
aaacacuguucucugcccucca

SEQ ID NO: 2940724 - RNA, 19 nt, Human
aaacacuguucucugcccu

SEQ ID NO: 2940725 - RNA, 13 nt, Human
aaaacacauuuuu

SEQ ID NO: 2940726 - RNA, 15 nt, Human
aaaacacauuuuucu

SEQ ID NO: 2940727 - RNA, 13 nt, Human
aaaauucagugga

SEQ ID NO: 2940728 - RNA, 18 nt, Human
aaacacuguucucugccc

SEQ ID NO: 2940729 - RNA, 11 nt, Human
aaagagguuuu

SEQ ID NO: 2940730 - RNA, 17 nt, Human
aaacugacucuuaagaa

SEQ ID NO: 2940731 - RNA, 15 nt, Human
aaacugccagcaacg

SEQ ID NO: 2940732 - RNA, 14 nt, Human
aaacugccagcaac

SEQ ID NO: 2940733 - RNA, 16 nt, Human
aaacugacucuuaaga

SEQ ID NO: 2940734 - RNA, 19 nt, Human
aaacugccagcaacgcagg

SEQ ID NO: 2940735 - RNA, 19 nt, Human
aaagaugaaggucuguuuu

SEQ ID NO: 2940736 - RNA, 18 nt, Human
aaagaugaaggucuguuu

SEQ ID NO: 2940737 - RNA, 17 nt, Human
aaagaugaaaauauuug

SEQ ID NO: 2940738 - RNA, 16 nt, Human
aaagaugaaaauauuu

SEQ ID NO: 2940739 - RNA, 13 nt, Human
aaagaugaaaaua

SEQ ID NO: 2940740 - RNA, 14 nt, Human
aaagugcugggauu

SEQ ID NO: 2940741 - RNA, 11 nt, Human
aaagugcuggg

SEQ ID NO: 2940742 - RNA, 17 nt, Human
aaauaaacgucuuaaau

SEQ ID NO: 2940743 - RNA, 12 nt, Human
aaauaacaauga

SEQ ID NO: 2940744 - RNA, 22 nt, Human
aaauagaaaguugcaaggcaaa

SEQ ID NO: 2940745 - RNA, 16 nt, Human
aaauagaaaguugcaa

SEQ ID NO: 2940746 - RNA, 20 nt, Human
aaauagaauugacauugaaa

SEQ ID NO: 2940747 - RNA, 18 nt, Human
aaauggaagacagcucuu

SEQ ID NO: 2940748 - RNA, 16 nt, Human
aaauggaaaugggcag

SEQ ID NO: 2940749 - RNA, 20 nt, Human
aaauggacguguuaugacuc

SEQ ID NO: 2940750 - RNA, 22 nt, Human
aaauggacguguuaugacucca

SEQ ID NO: 2940751 - RNA, 21 nt, Human
aaauggacguguuaugacucc

SEQ ID NO: 2940752 - RNA, 16 nt, Human
aaaucuucauggaauu

SEQ ID NO: 2940753 - RNA, 20 nt, Human
aaaucuucauggaauucaca

SEQ ID NO: 2940754 - RNA, 22 nt, Human
aaaucuucauggaauucacaaa

SEQ ID NO: 2940755 - RNA, 16 nt, Human
aaaucaaauaugcaaa

SEQ ID NO: 2940756 - RNA, 19 nt, Human
aaaucaaauaugcaaagca

SEQ ID NO: 2940757 - RNA, 18 nt, Human
aaaucaaauaugcaaagc

SEQ ID NO: 2940758 - RNA, 13 nt, Human
acaaagacugagu

SEQ ID NO: 2940759 - RNA, 13 nt, Human
acaacuauauugu

SEQ ID NO: 2940760 - RNA, 21 nt, Human
acaaaccuguuucugcagcca

SEQ ID NO: 2940761 - RNA, 15 nt, Human
acaaacgggcucagc

SEQ ID NO: 2940762 - RNA, 20 nt, Human
acaaaauggaauacucuuau

SEQ ID NO: 2940763 - RNA, 20 nt, Human
acaaaauguaggguuauaau

SEQ ID NO: 2940764 - RNA, 15 nt, Human
acaaaauggaauacu

SEQ ID NO: 2940765 - RNA, 19 nt, Human
acaaaauggaauacucuua

SEQ ID NO: 2940766 - RNA, 20 nt, Human
acaagucagucauucagaua

SEQ ID NO: 2940767 - RNA, 15 nt, Human
acacggacacucaaa

SEQ ID NO: 2940768 - RNA, 14 nt, Human
acacuaaccacgcu

SEQ ID NO: 2940769 - RNA, 15 nt, Human
acacuaaccacgcug

SEQ ID NO: 2940770 - RNA, 11 nt, Human
acacagcucug

SEQ ID NO: 2940771 - RNA, 12 nt, Human
acacagcucugu

SEQ ID NO: 2940772 - RNA, 21 nt, Human
acaccacuacauucuguuaau

SEQ ID NO: 2940773 - RNA, 12 nt, Human
acaccagagccc

SEQ ID NO: 2940774 - RNA, 16 nt, Human
acaauuuauuauggca

SEQ ID NO: 2940775 - RNA, 15 nt, Human
acaauuuauuauggc

SEQ ID NO: 2940776 - RNA, 13 nt, Human
acacaaagcuuuu

SEQ ID NO: 2940777 - RNA, 18 nt, Human
acacaaagcuuuugcaua

SEQ ID NO: 2940778 - RNA, 18 nt, Human
acacaaacgggcucagca

SEQ ID NO: 2940779 - RNA, 20 nt, Human
acaggugugaaccaccacac

SEQ ID NO: 2940780 - RNA, 23 nt, Human
acaggugugaaccaccacaccca

SEQ ID NO: 2940781 - RNA, 18 nt, Human
acaggcaagcaccuccug

SEQ ID NO: 2940782 - RNA, 15 nt, Human
acaggcaagcaccuc

SEQ ID NO: 2940783 - RNA, 16 nt, Human
acaggcaagcaccucc

SEQ ID NO: 2940784 - RNA, 12 nt, Human
acagcuccuucu

SEQ ID NO: 2940785 - RNA, 13 nt, Human
acagcuccuucug

SEQ ID NO: 2940786 - RNA, 14 nt, Human
acagcuccuucugu

SEQ ID NO: 2940787 - RNA, 23 nt, Human
acagcugccugggaucccucauc

SEQ ID NO: 2940788 - RNA, 13 nt, Human
acagcugccuggg

SEQ ID NO: 2940789 - RNA, 14 nt, Human
acagcugccuggga

SEQ ID NO: 2940790 - RNA, 20 nt, Human
acagcucugcauacucauua

SEQ ID NO: 2940791 - RNA, 18 nt, Human
acacuguccuauuauauu

SEQ ID NO: 2940792 - RNA, 21 nt, Human
acagaggggguggccucccaa

SEQ ID NO: 2940793 - RNA, 22 nt, Human
acagaggggguggccucccaac

SEQ ID NO: 2940794 - RNA, 12 nt, Human
acagagucucac

SEQ ID NO: 2940795 - RNA, 14 nt, Human
acagagucucacug

SEQ ID NO: 2940796 - RNA, 16 nt, Human
acagcaggcugccagu

SEQ ID NO: 2940797 - RNA, 18 nt, Human
acagcaggcugccagugc

SEQ ID NO: 2940798 - RNA, 20 nt, Human
acagcaggcugccagugccu

SEQ ID NO: 2940799 - RNA, 15 nt, Human
acagcaggcugccag

SEQ ID NO: 2940800 - RNA, 17 nt, Human
acagagucucacuguug

SEQ ID NO: 2940801 - RNA, 19 nt, Human
acagagucucacuguugcc

SEQ ID NO: 2940802 - RNA, 14 nt, Human
acagcagugagacu

SEQ ID NO: 2940803 - RNA, 21 nt, Human
acagcagugagacuggggcca

SEQ ID NO: 2940804 - RNA, 18 nt, Human
acagcaguugaaaagacu

SEQ ID NO: 2940805 - RNA, 15 nt, Human
acagcaguugaaaag

SEQ ID NO: 2940806 - RNA, 15 nt, Human
acagccaugauucuu

SEQ ID NO: 2940807 - RNA, 19 nt, Human
acagccacggccaggccag

SEQ ID NO: 2940808 - RNA, 16 nt, Human
acagccagacuggcac

SEQ ID NO: 2940809 - RNA, 15 nt, Human
acagccagacuggca

SEQ ID NO: 2940810 - RNA, 13 nt, Human
acagccagacugg

SEQ ID NO: 2940811 - RNA, 13 nt, Human
acauuaaagguac

SEQ ID NO: 2940812 - RNA, 12 nt, Human
acauuaaaugac

SEQ ID NO: 2940813 - RNA, 11 nt, Human
acauuaaauga

SEQ ID NO: 2940814 - RNA, 15 nt, Human
acauuaaaugacucu

SEQ ID NO: 2940815 - RNA, 23 nt, Human
acaugcacagcuaacauggaagu

SEQ ID NO: 2940816 - RNA, 20 nt, Human
acaugcacagcuaacaugga

SEQ ID NO: 2940817 - RNA, 19 nt, Human
acaugcaaggucauuuuuu

SEQ ID NO: 2940818 - RNA, 18 nt, Human
acaugcaaggucauuuuu

SEQ ID NO: 2940819 - RNA, 21 nt, Human
acauguuuuucuucucccuca

SEQ ID NO: 2940820 - RNA, 13 nt, Human
acauguuacaaca

SEQ ID NO: 2940821 - RNA, 22 nt, Human
acaucagcacgauuucuguuua

SEQ ID NO: 2940822 - RNA, 20 nt, Human
acaucagcacgauuucuguu

SEQ ID NO: 2940823 - RNA, 21 nt, Human
acaucagcacgauuucuguuu

SEQ ID NO: 2940824 - RNA, 19 nt, Human
acaucagcacgauuucugu

SEQ ID NO: 2940825 - RNA, 23 nt, Human
acauaaacaagaccacguuucua

SEQ ID NO: 2940826 - RNA, 17 nt, Human
accagcagccuggaccc

SEQ ID NO: 2940827 - RNA, 14 nt, Human
accagcagccugga

SEQ ID NO: 2940828 - RNA, 13 nt, Human
accagcagccugg

SEQ ID NO: 2940829 - RNA, 15 nt, Human
accacguuucuaaag

SEQ ID NO: 2940830 - RNA, 19 nt, Human
accacguuucuaaaggcua

SEQ ID NO: 2940831 - RNA, 14 nt, Human
accacuacauucug

SEQ ID NO: 2940832 - RNA, 18 nt, Human
acauuuggguuacuauuu

SEQ ID NO: 2940833 - RNA, 21 nt, Human
acauuuggguuacuauuucuu

SEQ ID NO: 2940834 - RNA, 14 nt, Human
acauuuguauaaaa

SEQ ID NO: 2940835 - RNA, 18 nt, Human
acauuugcucauggaauu

SEQ ID NO: 2940836 - RNA, 16 nt, Human
acauuugcucauggaa

SEQ ID NO: 2940837 - RNA, 20 nt, Human
accccucaacaccucugcac

SEQ ID NO: 2940838 - RNA, 22 nt, Human
accaucccugaaggccccgccc

SEQ ID NO: 2940839 - RNA, 21 nt, Human
accaucccugaaggccccgcc

SEQ ID NO: 2940840 - RNA, 16 nt, Human
accaucaugucuggcu

SEQ ID NO: 2940841 - RNA, 17 nt, Human
accaucaugucuggcua

SEQ ID NO: 2940842 - RNA, 16 nt, Human
accaucccugaaggcc

SEQ ID NO: 2940843 - RNA, 18 nt, Human
accaucccugaaggcccc

SEQ ID NO: 2940844 - RNA, 14 nt, Human
accaucaugucugg

SEQ ID NO: 2940845 - RNA, 15 nt, Human
accccggccaccugc

SEQ ID NO: 2940846 - RNA, 16 nt, Human
acccaugcugcccugu

SEQ ID NO: 2940847 - RNA, 19 nt, Human
acccaugcugcccugugag

SEQ ID NO: 2940848 - RNA, 18 nt, Human
acccaugcugcccuguga

SEQ ID NO: 2940849 - RNA, 17 nt, Human
acccaugcugcccugug

SEQ ID NO: 2940850 - RNA, 16 nt, Human
acccaaguccaagcau

SEQ ID NO: 2940851 - RNA, 16 nt, Human
acccaagggccuggcc

SEQ ID NO: 2940852 - RNA, 13 nt, Human
acccaagggccug

SEQ ID NO: 2940853 - RNA, 14 nt, Human
acccaucuuaaaaa

SEQ ID NO: 2940854 - RNA, 15 nt, Human
acccacaagaaauga

SEQ ID NO: 2940855 - RNA, 13 nt, Human
acuguuucaaacu

SEQ ID NO: 2940856 - RNA, 14 nt, Human
acuguuuagaugaa

SEQ ID NO: 2940857 - RNA, 23 nt, Human
acuuauuguagcauccuggaaua

SEQ ID NO: 2940858 - RNA, 20 nt, Human
acuuauuguagcauccugga

SEQ ID NO: 2940859 - RNA, 18 nt, Human
acuuauuuaaauagauga

SEQ ID NO: 2940860 - RNA, 13 nt, Human
acuuauuuaaaua

SEQ ID NO: 2940861 - RNA, 19 nt, Human
acuucacauauugauuucc

SEQ ID NO: 2940862 - RNA, 18 nt, Human
acuucugccauauucugu

SEQ ID NO: 2940863 - RNA, 14 nt, Human
acuuggucugugag

SEQ ID NO: 2940864 - RNA, 13 nt, Human
acuuggucuguga

SEQ ID NO: 2940865 - RNA, 15 nt, Human
acuuggucugugaga

SEQ ID NO: 2940866 - RNA, 18 nt, Human
acuuguaaaggaauuuaa

SEQ ID NO: 2940867 - RNA, 20 nt, Human
acuuguaaaggaauuuaaaa

SEQ ID NO: 2940868 - RNA, 19 nt, Human
acuuguaaaggaauuuaaa

SEQ ID NO: 2940869 - RNA, 17 nt, Human
acuggguguaaacacau

SEQ ID NO: 2940870 - RNA, 16 nt, Human
acuggguguaaacaca

SEQ ID NO: 2940871 - RNA, 14 nt, Human
acuggagaaaaugg

SEQ ID NO: 2940872 - RNA, 15 nt, Human
acuggaagcacagcu

SEQ ID NO: 2940873 - RNA, 14 nt, Human
acuggaagcacagc

SEQ ID NO: 2940874 - RNA, 12 nt, Human
acuggaacucuc

SEQ ID NO: 2940875 - RNA, 12 nt, Human
acugucuucagu

SEQ ID NO: 2940876 - RNA, 20 nt, Human
agaaaggaggggauagagag

SEQ ID NO: 2940877 - RNA, 23 nt, Human
agaaaggaggggauagagagaga

SEQ ID NO: 2940878 - RNA, 15 nt, Human
agaaauaaaguuucu

SEQ ID NO: 2940879 - RNA, 18 nt, Human
agaaauaaaguuucuguu

SEQ ID NO: 2940880 - RNA, 23 nt, Human
acuuuguucuggcucuuccaggc

SEQ ID NO: 2940881 - RNA, 23 nt, Human
acuuuccuucauucaacccaccu

SEQ ID NO: 2940882 - RNA, 23 nt, Human
agaaaauggaagacagcucuuau

SEQ ID NO: 2940883 - RNA, 20 nt, Human
agaaaauggacguguuauga

SEQ ID NO: 2940884 - RNA, 15 nt, Human
agaaaauggacgugu

SEQ ID NO: 2940885 - RNA, 23 nt, Human
agaaaauggacguguuaugacuc

SEQ ID NO: 2940886 - RNA, 22 nt, Human
agaaaauggacguguuaugacu

SEQ ID NO: 2940887 - RNA, 15 nt, Human
agaaaaguuuauaaa

SEQ ID NO: 2940888 - RNA, 18 nt, Human
agaaaaguugaauuuuac

SEQ ID NO: 2940889 - RNA, 21 nt, Human
agaaaaguugaauuuuacaug

SEQ ID NO: 2940890 - RNA, 20 nt, Human
acuuuuccguuucagcggaa

SEQ ID NO: 2940891 - RNA, 15 nt, Human
acuuuuauaaacuuu

SEQ ID NO: 2940892 - RNA, 19 nt, Human
acuuuuauaaacuuuaccu

SEQ ID NO: 2940893 - RNA, 22 nt, Human
acuuuuauaaacuuuaccuuuu

SEQ ID NO: 2940894 - RNA, 18 nt, Human
acucuuaaaacccaagug

SEQ ID NO: 2940895 - RNA, 11 nt, Human
acucuuaaaac

SEQ ID NO: 2940896 - RNA, 16 nt, Human
acucugugucaggugg

SEQ ID NO: 2940897 - RNA, 14 nt, Human
acucuaucaaguau

SEQ ID NO: 2940898 - RNA, 22 nt, Human
acucuauaacaaaggauacuua

SEQ ID NO: 2940899 - RNA, 16 nt, Human
acucuaucaaguauua

SEQ ID NO: 2940900 - RNA, 18 nt, Human
acucuacccucuuagaaa

SEQ ID NO: 2940901 - RNA, 13 nt, Human
acucuacccucuu

SEQ ID NO: 2940902 - RNA, 21 nt, Human
acucuacccucuuagaaaaac

SEQ ID NO: 2940903 - RNA, 16 nt, Human
acucuaccugcacacu

SEQ ID NO: 2940904 - RNA, 12 nt, Human
acucccuuucaa

SEQ ID NO: 2940905 - RNA, 13 nt, Human
acucccuuucaac

SEQ ID NO: 2940906 - RNA, 18 nt, Human
acucaaaagcugggcagg

SEQ ID NO: 2940907 - RNA, 11 nt, Human
acuauaaugua

SEQ ID NO: 2940908 - RNA, 16 nt, Human
acucaaacucuuaaaa

SEQ ID NO: 2940909 - RNA, 17 nt, Human
acucaaacucuuaaaac

SEQ ID NO: 2940910 - RNA, 14 nt, Human
acucccccaggugg

SEQ ID NO: 2940911 - RNA, 17 nt, Human
acuccccugcugggugu

SEQ ID NO: 2940912 - RNA, 13 nt, Human
acuccccugcugg

SEQ ID NO: 2940913 - RNA, 14 nt, Human
acuagcuauggugu

SEQ ID NO: 2940914 - RNA, 12 nt, Human
acgauuucuguu

SEQ ID NO: 2940915 - RNA, 13 nt, Human
acgauuucuguuu

SEQ ID NO: 2940916 - RNA, 18 nt, Human
acgccacugcacuauagc

SEQ ID NO: 2940917 - RNA, 14 nt, Human
acgauuucuguuua

SEQ ID NO: 2940918 - RNA, 17 nt, Human
acgauuucuguuuagau

SEQ ID NO: 2940919 - RNA, 15 nt, Human
acuaaguuuuuaugg

SEQ ID NO: 2940920 - RNA, 22 nt, Human
acuaaguuuuuauggcuuuugu

SEQ ID NO: 2940921 - RNA, 18 nt, Human
acgcugugcugcccugcc

SEQ ID NO: 2940922 - RNA, 16 nt, Human
acgugcacgcacacug

SEQ ID NO: 2940923 - RNA, 17 nt, Human
acgcugugcugcccugc

SEQ ID NO: 2940924 - RNA, 16 nt, Human
acgcugugcugcccug

SEQ ID NO: 2940925 - RNA, 15 nt, Human
acgcugugcugcccu

SEQ ID NO: 2940926 - RNA, 15 nt, Human
acuaagagagaauga

SEQ ID NO: 2940927 - RNA, 16 nt, Human
acuaagagagaaugag

SEQ ID NO: 2940928 - RNA, 11 nt, Human
acguggcugcu

SEQ ID NO: 2940929 - RNA, 15 nt, Human
acguggcugcuucaa

SEQ ID NO: 2940930 - RNA, 14 nt, Human
acguggcugcuuca

SEQ ID NO: 2940931 - RNA, 13 nt, Human
acguggcugcuuc

SEQ ID NO: 2940932 - RNA, 20 nt, Human
accugccccucaacucuccu

SEQ ID NO: 2940933 - RNA, 23 nt, Human
accugccccucaacucuccucca

SEQ ID NO: 2940934 - RNA, 21 nt, Human
accucugcacaagcugcaccc

SEQ ID NO: 2940935 - RNA, 18 nt, Human
accucugcacaagcugca

SEQ ID NO: 2940936 - RNA, 16 nt, Human
accucugcacaagcug

SEQ ID NO: 2940937 - RNA, 23 nt, Human
accuuucaauaggaaaaacugau

SEQ ID NO: 2940938 - RNA, 21 nt, Human
accuuucaauaggaaaaacug

SEQ ID NO: 2940939 - RNA, 17 nt, Human
accuuucaauaggaaaa

SEQ ID NO: 2940940 - RNA, 14 nt, Human
accuuggcugcagg

SEQ ID NO: 2940941 - RNA, 16 nt, Human
accuuucaauaggaaa

SEQ ID NO: 2940942 - RNA, 12 nt, Human
accuuggcucaa

SEQ ID NO: 2940943 - RNA, 14 nt, Human
accuuggcucaagu

SEQ ID NO: 2940944 - RNA, 12 nt, Human
accuuggcugca

SEQ ID NO: 2940945 - RNA, 21 nt, Human
auaacagaagaaaauagaauu

SEQ ID NO: 2940946 - RNA, 14 nt, Human
auaacagaagaaaa

SEQ ID NO: 2940947 - RNA, 17 nt, Human
auaacagaagaaaauag

SEQ ID NO: 2940948 - RNA, 22 nt, Human
auaaguccucuagugaauguag

SEQ ID NO: 2940949 - RNA, 11 nt, Human
auaagucugau

SEQ ID NO: 2940950 - RNA, 13 nt, Human
auaagucugauuu

SEQ ID NO: 2940951 - RNA, 14 nt, Human
auaagucugauuua

SEQ ID NO: 2940952 - RNA, 13 nt, Human
auaaguguauuuu

SEQ ID NO: 2940953 - RNA, 21 nt, Human
auaaguguauuuugaaauugu

SEQ ID NO: 2940954 - RNA, 19 nt, Human
auaaugugaaacuggauua

SEQ ID NO: 2940955 - RNA, 21 nt, Human
auaaugugaaacuggauuaaa

SEQ ID NO: 2940956 - RNA, 18 nt, Human
auaaugugaaacuggauu

SEQ ID NO: 2940957 - RNA, 13 nt, Human
auacuuauuuaaa

SEQ ID NO: 2940958 - RNA, 22 nt, Human
auacuuacauguguguauaugu

SEQ ID NO: 2940959 - RNA, 12 nt, Human
auaccugucccc

SEQ ID NO: 2940960 - RNA, 14 nt, Human
auaauuacuauguc

SEQ ID NO: 2940961 - RNA, 13 nt, Human
auauucaggaagc

SEQ ID NO: 2940962 - RNA, 16 nt, Human
auauucaggaagcuca

SEQ ID NO: 2940963 - RNA, 14 nt, Human
auauucaggaagcu

SEQ ID NO: 2940964 - RNA, 18 nt, Human
auauuuauuuuaauaaug

SEQ ID NO: 2940965 - RNA, 14 nt, Human
auauuuauuacugu

SEQ ID NO: 2940966 - RNA, 19 nt, Human
auauuuauuacuguaagaa

SEQ ID NO: 2940967 - RNA, 19 nt, Human
auauccuaggagguaauga

SEQ ID NO: 2940968 - RNA, 22 nt, Human
auaugccugggcagaaggaaga

SEQ ID NO: 2940969 - RNA, 23 nt, Human
auaugcuucuguuuuauaauuuu

SEQ ID NO: 2940970 - RNA, 19 nt, Human
auaugcuuauacacuuaca

SEQ ID NO: 2940971 - RNA, 14 nt, Human
auaugcuuauacac

SEQ ID NO: 2940972 - RNA, 16 nt, Human
auaugcuuauacacuu

SEQ ID NO: 2940973 - RNA, 23 nt, Human
auauccuaauaaaaaggugacca

SEQ ID NO: 2940974 - RNA, 19 nt, Human
auaucccuuggacauuuua

SEQ ID NO: 2940975 - RNA, 11 nt, Human
auaucacuucc

SEQ ID NO: 2940976 - RNA, 18 nt, Human
auaucacuugucaauaaa

SEQ ID NO: 2940977 - RNA, 15 nt, Human
auaucaauuuaaaaa

SEQ ID NO: 2940978 - RNA, 17 nt, Human
auauagcaagacauuau

SEQ ID NO: 2940979 - RNA, 23 nt, Human
auauagcuaggugacauauacau

SEQ ID NO: 2940980 - RNA, 15 nt, Human
auauacauacuuaca

SEQ ID NO: 2940981 - RNA, 22 nt, Human
auauacauacuuacaugugugu

SEQ ID NO: 2940982 - RNA, 16 nt, Human
auauaggaacuuaaau

SEQ ID NO: 2940983 - RNA, 22 nt, Human
auacuuauuuaaauagaugaca

SEQ ID NO: 2940984 - RNA, 15 nt, Human
auacuuauuuaaaua

SEQ ID NO: 2940985 - RNA, 21 nt, Human
auacuuauuuaaauagaugac

SEQ ID NO: 2940986 - RNA, 15 nt, Human
auaguaugguggcug

SEQ ID NO: 2940987 - RNA, 22 nt, Human
auauaauuccuguuuuuauuau

SEQ ID NO: 2940988 - RNA, 16 nt, Human
auauaauuccuguuuu

SEQ ID NO: 2940989 - RNA, 16 nt, Human
auaguaugguggcugg

SEQ ID NO: 2940990 - RNA, 23 nt, Human
agugugacaaggauugcuacugu

SEQ ID NO: 2940991 - RNA, 21 nt, Human
agugucuuaauuaaaagaaua

SEQ ID NO: 2940992 - RNA, 18 nt, Human
agugauuaccagggacug

SEQ ID NO: 2940993 - RNA, 15 nt, Human
agugauuaccaggga

SEQ ID NO: 2940994 - RNA, 18 nt, Human
aguuacagacaaagcgug

SEQ ID NO: 2940995 - RNA, 17 nt, Human
aguuacagacaaagcgu

SEQ ID NO: 2940996 - RNA, 19 nt, Human
aguuguaccgcaaugugac

SEQ ID NO: 2940997 - RNA, 18 nt, Human
aguuguaccgcaauguga

SEQ ID NO: 2940998 - RNA, 15 nt, Human
aguugaauuuuacau

SEQ ID NO: 2940999 - RNA, 13 nt, Human
aguuguuacauuu

SEQ ID NO: 2941000 - RNA, 15 nt, Human
aguuguuacauuuuu

SEQ ID NO: 2941001 - RNA, 16 nt, Human
aguuguuacauuuuua

SEQ ID NO: 2941002 - RNA, 13 nt, Human
aguccugcccgcc

SEQ ID NO: 2941003 - RNA, 13 nt, Human
agugauccuccca

SEQ ID NO: 2941004 - RNA, 12 nt, Human
agucauuauguu

SEQ ID NO: 2941005 - RNA, 18 nt, Human
agucauuauguuaauauu

SEQ ID NO: 2941006 - RNA, 23 nt, Human
agucauucagauaugauucaaau

SEQ ID NO: 2941007 - RNA, 15 nt, Human
agucauucagauaug

SEQ ID NO: 2941008 - RNA, 20 nt, Human
agucauucagauaugauuca

SEQ ID NO: 2941009 - RNA, 21 nt, Human
aguccaagcauuuagauguau

SEQ ID NO: 2941010 - RNA, 16 nt, Human
aguccaagcauuuaga

SEQ ID NO: 2941011 - RNA, 11 nt, Human
aguccaagcau

SEQ ID NO: 2941012 - RNA, 13 nt, Human
agucauucuuuaa

SEQ ID NO: 2941013 - RNA, 14 nt, Human
agucauucuucccu

SEQ ID NO: 2941014 - RNA, 16 nt, Human
agucaaggcuuagacc

SEQ ID NO: 2941015 - RNA, 16 nt, Human
agucaagugaaaaagg

SEQ ID NO: 2941016 - RNA, 14 nt, Human
agucaaggcuuaga

SEQ ID NO: 2941017 - RNA, 15 nt, Human
agucaaauuguguga

SEQ ID NO: 2941018 - RNA, 17 nt, Human
agucaaauugugugaaa

SEQ ID NO: 2941019 - RNA, 13 nt, Human
agucaaauugugu

SEQ ID NO: 2941020 - RNA, 20 nt, Human
agucaagugaaaaaggagga

SEQ ID NO: 2941021 - RNA, 17 nt, Human
aucuucuuuauaauucu

SEQ ID NO: 2941022 - RNA, 17 nt, Human
aucuugaagacuuuucu

SEQ ID NO: 2941023 - RNA, 22 nt, Human
aucucucgugauugauaagaac

SEQ ID NO: 2941024 - RNA, 22 nt, Human
aucuucauggaauucacaaagu

SEQ ID NO: 2941025 - RNA, 23 nt, Human
aucuucauggaauucacaaagua

SEQ ID NO: 2941026 - RNA, 23 nt, Human
aucuucuauauaauuccuguuuu

SEQ ID NO: 2941027 - RNA, 19 nt, Human
aucuuccaacucaaacucu

SEQ ID NO: 2941028 - RNA, 22 nt, Human
aucuuauaauuuaaaauaugcu

SEQ ID NO: 2941029 - RNA, 19 nt, Human
augaaaauaaucucugauu

SEQ ID NO: 2941030 - RNA, 17 nt, Human
augaaaauaaucucuga

SEQ ID NO: 2941031 - RNA, 17 nt, Human
augaaaagccucuguuu

SEQ ID NO: 2941032 - RNA, 12 nt, Human
augacccagugg

SEQ ID NO: 2941033 - RNA, 18 nt, Human
augacuauucaguggcua

SEQ ID NO: 2941034 - RNA, 16 nt, Human
augacuccagaauuuc

SEQ ID NO: 2941035 - RNA, 12 nt, Human
augacuccagaa

SEQ ID NO: 2941036 - RNA, 17 nt, Human
augacuccagaauuucc

SEQ ID NO: 2941037 - RNA, 12 nt, Human
augagccuggca

SEQ ID NO: 2941038 - RNA, 18 nt, Human
augacucuucccucaaau

SEQ ID NO: 2941039 - RNA, 14 nt, Human
augagccuggcaag

SEQ ID NO: 2941040 - RNA, 13 nt, Human
augagccuggcaa

SEQ ID NO: 2941041 - RNA, 13 nt, Human
aucgaugcagugc

SEQ ID NO: 2941042 - RNA, 14 nt, Human
auccuccucagauc

SEQ ID NO: 2941043 - RNA, 11 nt, Human
auccuccucag

SEQ ID NO: 2941044 - RNA, 22 nt, Human
auccuccaggugcacaagcucc

SEQ ID NO: 2941045 - RNA, 19 nt, Human
auccuccaggugcacaagc

SEQ ID NO: 2941046 - RNA, 14 nt, Human
auccuccaggugca

SEQ ID NO: 2941047 - RNA, 13 nt, Human
auccuccaggugc

SEQ ID NO: 2941048 - RNA, 15 nt, Human
aucccuacuguaauu

SEQ ID NO: 2941049 - RNA, 22 nt, Human
auccucauacccacccccaccc

SEQ ID NO: 2941050 - RNA, 19 nt, Human
auccucauacccaccccca

SEQ ID NO: 2941051 - RNA, 18 nt, Human
auccucauacccaccccc

SEQ ID NO: 2941052 - RNA, 18 nt, Human
auccacccaccucagccu

SEQ ID NO: 2941053 - RNA, 20 nt, Human
auccacccaccucagccucc

SEQ ID NO: 2941054 - RNA, 16 nt, Human
auccacccaccucagc

SEQ ID NO: 2941055 - RNA, 12 nt, Human
aucagcugcuac

SEQ ID NO: 2941056 - RNA, 21 nt, Human
aucagccugggcaaugugaua

SEQ ID NO: 2941057 - RNA, 20 nt, Human
aucagccugggcaaugugau

SEQ ID NO: 2941058 - RNA, 11 nt, Human
aucagccuggg

SEQ ID NO: 2941059 - RNA, 19 nt, Human
aucauggagguuugaagau

SEQ ID NO: 2941060 - RNA, 17 nt, Human
aucagcugcugaaacaa

SEQ ID NO: 2941061 - RNA, 20 nt, Human
aucagccugcuccagcuguu

SEQ ID NO: 2941062 - RNA, 13 nt, Human
aucagcugcuacu

SEQ ID NO: 2941063 - RNA, 23 nt, Human
aucagcugcuacuacuccuguag

SEQ ID NO: 2941064 - RNA, 13 nt, Human
auguguaauaaau

SEQ ID NO: 2941065 - RNA, 17 nt, Human
auguguaauaaauaugu

SEQ ID NO: 2941066 - RNA, 22 nt, Human
auguguaauaaauauguuucac

SEQ ID NO: 2941067 - RNA, 14 nt, Human
auguguaaguauuc

SEQ ID NO: 2941068 - RNA, 20 nt, Human
augugggcuaguugggcuuc

SEQ ID NO: 2941069 - RNA, 18 nt, Human
auguucucugaggacacu

SEQ ID NO: 2941070 - RNA, 20 nt, Human
auguucuuucacccuuuucu

SEQ ID NO: 2941071 - RNA, 15 nt, Human
auguucuuaauucuu

SEQ ID NO: 2941072 - RNA, 20 nt, Human
auguucuuaguggauguucu

SEQ ID NO: 2941073 - RNA, 22 nt, Human
auguucugacccugcuucaaau

SEQ ID NO: 2941074 - RNA, 14 nt, Human
auguucuuaauucu

SEQ ID NO: 2941075 - RNA, 16 nt, Human
auguuuuaagaggcag

SEQ ID NO: 2941076 - RNA, 18 nt, Human
auguuuuaagaggcaggg

SEQ ID NO: 2941077 - RNA, 17 nt, Human
auuaaaugacucuuccc

SEQ ID NO: 2941078 - RNA, 15 nt, Human
auuaaaugcccagcc

SEQ ID NO: 2941079 - RNA, 14 nt, Human
auuaaaugcccagc

SEQ ID NO: 2941080 - RNA, 21 nt, Human
auuaaaugacucuucccucaa

SEQ ID NO: 2941081 - RNA, 11 nt, Human
auuaaauuaug

SEQ ID NO: 2941082 - RNA, 16 nt, Human
auuaaaugcccagccc

SEQ ID NO: 2941083 - RNA, 13 nt, Human
auuaaauucuugc

SEQ ID NO: 2941084 - RNA, 21 nt, Human
augucagacacagauuggcca

SEQ ID NO: 2941085 - RNA, 15 nt, Human
augucacuucuggau

SEQ ID NO: 2941086 - RNA, 18 nt, Human
augucacuucuggauaua

SEQ ID NO: 2941087 - RNA, 13 nt, Human
augucagacacag

SEQ ID NO: 2941088 - RNA, 15 nt, Human
augucagacacagau

SEQ ID NO: 2941089 - RNA, 20 nt, Human
augucagacacagauuggcc

SEQ ID NO: 2941090 - RNA, 15 nt, Human
augucacaggcaggu

SEQ ID NO: 2941091 - RNA, 14 nt, Human
augucacaggcagg

SEQ ID NO: 2941092 - RNA, 16 nt, Human
augucacaggcagguc

SEQ ID NO: 2941093 - RNA, 15 nt, Human
auggucggaaaacau

SEQ ID NO: 2941094 - RNA, 16 nt, Human
auguaaguaaacgguc

SEQ ID NO: 2941095 - RNA, 20 nt, Human
auguaagggaaacugccagc

SEQ ID NO: 2941096 - RNA, 17 nt, Human
auguaagcucuacugag

SEQ ID NO: 2941097 - RNA, 22 nt, Human
auguaagggaaacugccagcaa

SEQ ID NO: 2941098 - RNA, 21 nt, Human
auguaagggaaacugccagca

SEQ ID NO: 2941099 - RNA, 15 nt, Human
augggaaugaauguc

SEQ ID NO: 2941100 - RNA, 23 nt, Human
auggcugccaaugggagcucaug

SEQ ID NO: 2941101 - RNA, 22 nt, Human
augcuucuucagagacuccugc

SEQ ID NO: 2941102 - RNA, 23 nt, Human
augcuugcugcugauuuaaacac

SEQ ID NO: 2941103 - RNA, 16 nt, Human
augcuugcugcugauu

SEQ ID NO: 2941104 - RNA, 22 nt, Human
augcuugcugcugauuuaaaca

SEQ ID NO: 2941105 - RNA, 20 nt, Human
auggaaaugggcagagcaga

SEQ ID NO: 2941106 - RNA, 19 nt, Human
auggaaaugggcagagcag

SEQ ID NO: 2941107 - RNA, 21 nt, Human
augcacagcuaacauggaagu

SEQ ID NO: 2941108 - RNA, 14 nt, Human
augcacagcuaaca

SEQ ID NO: 2941109 - RNA, 23 nt, Human
augcacagaguuguuacauuuuu

SEQ ID NO: 2941110 - RNA, 17 nt, Human
augcacacauuuuuuaa

SEQ ID NO: 2941111 - RNA, 19 nt, Human
augcacacauuuuuuaaau

SEQ ID NO: 2941112 - RNA, 22 nt, Human
augcacacauuuuuuaaaugca

SEQ ID NO: 2941113 - RNA, 20 nt, Human
augcaugaaguaauaugcac

SEQ ID NO: 2941114 - RNA, 23 nt, Human
augcaugaaguaauaugcacaca

SEQ ID NO: 2941115 - RNA, 18 nt, Human
augcauuugaaaauuuug

SEQ ID NO: 2941116 - RNA, 10 nt, Human
augcauuuga

SEQ ID NO: 2941117 - RNA, 12 nt, Human
augcauuugaaa

SEQ ID NO: 2941118 - RNA, 15 nt, Human
augccugguggcagc

SEQ ID NO: 2941119 - RNA, 16 nt, Human
augccugguggcagcu

SEQ ID NO: 2941120 - RNA, 17 nt, Human
augccugguggcagcug

SEQ ID NO: 2941121 - RNA, 17 nt, Human
augccugggcagaagga

SEQ ID NO: 2941122 - RNA, 23 nt, Human
augccuggauggggcugcaccgg

SEQ ID NO: 2941123 - RNA, 21 nt, Human
augccuggauggggcugcacc

SEQ ID NO: 2941124 - RNA, 15 nt, Human
aggaaaaacugauuu

SEQ ID NO: 2941125 - RNA, 13 nt, Human
aggaaaaacugau

SEQ ID NO: 2941126 - RNA, 18 nt, Human
agcuucacuguaaaauaa

SEQ ID NO: 2941127 - RNA, 17 nt, Human
agcugggugucaagagg

SEQ ID NO: 2941128 - RNA, 22 nt, Human
agcugggugucaagagggucug

SEQ ID NO: 2941129 - RNA, 21 nt, Human
agcuggucccacucaguccau

SEQ ID NO: 2941130 - RNA, 19 nt, Human
agcuggucccacucagucc

SEQ ID NO: 2941131 - RNA, 17 nt, Human
aggaggggauagagaga

SEQ ID NO: 2941132 - RNA, 18 nt, Human
aggauguucugggacaca

SEQ ID NO: 2941133 - RNA, 20 nt, Human
aggauguucugggacacagu

SEQ ID NO: 2941134 - RNA, 14 nt, Human
aggauguugaaaaa

SEQ ID NO: 2941135 - RNA, 12 nt, Human
aggauucuuccu

SEQ ID NO: 2941136 - RNA, 18 nt, Human
aggagaggggcacagggu

SEQ ID NO: 2941137 - RNA, 16 nt, Human
aggagaggggcacagg

SEQ ID NO: 2941138 - RNA, 14 nt, Human
aggagaggggcaca

SEQ ID NO: 2941139 - RNA, 15 nt, Human
aggagagcuagcagc

SEQ ID NO: 2941140 - RNA, 20 nt, Human
aggaccucaggugagaagca

SEQ ID NO: 2941141 - RNA, 14 nt, Human
aggaccucagguga

SEQ ID NO: 2941142 - RNA, 20 nt, Human
aggaccccuccaugugggcu

SEQ ID NO: 2941143 - RNA, 15 nt, Human
agguucaaagauauu

SEQ ID NO: 2941144 - RNA, 17 nt, Human
agguucaaagauauuuu

SEQ ID NO: 2941145 - RNA, 14 nt, Human
agguuaauguucau

SEQ ID NO: 2941146 - RNA, 15 nt, Human
agguuaauaaaguaa

SEQ ID NO: 2941147 - RNA, 13 nt, Human
agguucagcuugu

SEQ ID NO: 2941148 - RNA, 17 nt, Human
aggugcugccauccagg

SEQ ID NO: 2941149 - RNA, 16 nt, Human
aggugcugccauccag

SEQ ID NO: 2941150 - RNA, 14 nt, Human
aggucgaggcagga

SEQ ID NO: 2941151 - RNA, 17 nt, Human
agguacacuugugaaua

SEQ ID NO: 2941152 - RNA, 16 nt, Human
agguacacuugugaau

SEQ ID NO: 2941153 - RNA, 17 nt, Human
agguaaggaauaccugu

SEQ ID NO: 2941154 - RNA, 17 nt, Human
agggcacaccgggcacu

SEQ ID NO: 2941155 - RNA, 20 nt, Human
agggcacaccgggcacucag

SEQ ID NO: 2941156 - RNA, 21 nt, Human
agggcacaccgggcacucaga

SEQ ID NO: 2941157 - RNA, 22 nt, Human
agggcacagaaaauggaagaca

SEQ ID NO: 2941158 - RNA, 17 nt, Human
agggccuggccugagcu

SEQ ID NO: 2941159 - RNA, 16 nt, Human
agggccuggccugagc

SEQ ID NO: 2941160 - RNA, 15 nt, Human
agggccuggccugag

SEQ ID NO: 2941161 - RNA, 19 nt, Human
agggcgggaggauguucug

SEQ ID NO: 2941162 - RNA, 16 nt, Human
aggggauagagagaga

SEQ ID NO: 2941163 - RNA, 21 nt, Human
aggggauagagagagaccacu

SEQ ID NO: 2941164 - RNA, 15 nt, Human
aggggcacagggucu

SEQ ID NO: 2941165 - RNA, 23 nt, Human
aggcuagugugguguuuccuggc

SEQ ID NO: 2941166 - RNA, 19 nt, Human
aggcugccagugccugggu

SEQ ID NO: 2941167 - RNA, 20 nt, Human
aggcugccagugccugggug

SEQ ID NO: 2941168 - RNA, 14 nt, Human
aggcugccagugcc

SEQ ID NO: 2941169 - RNA, 15 nt, Human
aggcugccagugccu

SEQ ID NO: 2941170 - RNA, 16 nt, Human
aggcugccagugccug

SEQ ID NO: 2941171 - RNA, 18 nt, Human
aggcugccucucccauca

SEQ ID NO: 2941172 - RNA, 17 nt, Human
agggacgcuacccggga

SEQ ID NO: 2941173 - RNA, 21 nt, Human
agggacgcuacccgggaaggg

SEQ ID NO: 2941174 - RNA, 20 nt, Human
agggacagaggggguggccu

SEQ ID NO: 2941175 - RNA, 13 nt, Human
agggacagagggg

SEQ ID NO: 2941176 - RNA, 12 nt, Human
agggacagaggg

SEQ ID NO: 2941177 - RNA, 21 nt, Human
agauaggucagugcaaauacu

SEQ ID NO: 2941178 - RNA, 16 nt, Human
agauagccaaggccaa

SEQ ID NO: 2941179 - RNA, 15 nt, Human
agauagccaaggcca

SEQ ID NO: 2941180 - RNA, 13 nt, Human
agaggagaggggc

SEQ ID NO: 2941181 - RNA, 22 nt, Human
agaggggaacagacuggaagca

SEQ ID NO: 2941182 - RNA, 16 nt, Human
agaggggaagagacuu

SEQ ID NO: 2941183 - RNA, 13 nt, Human
agauagccaaggc

SEQ ID NO: 2941184 - RNA, 22 nt, Human
agauacuuggggggcugaggug

SEQ ID NO: 2941185 - RNA, 23 nt, Human
agaggguggugaccucugccuga

SEQ ID NO: 2941186 - RNA, 18 nt, Human
agagguacacuugugaau

SEQ ID NO: 2941187 - RNA, 17 nt, Human
agagguacacuugugaa

SEQ ID NO: 2941188 - RNA, 16 nt, Human
agagguacacuuguga

SEQ ID NO: 2941189 - RNA, 13 nt, Human
agacaaugacuua

SEQ ID NO: 2941190 - RNA, 17 nt, Human
agacaaugacuuacugu

SEQ ID NO: 2941191 - RNA, 21 nt, Human
agacaauuuauuauggcacau

SEQ ID NO: 2941192 - RNA, 19 nt, Human
agacaaugacuuacuguac

SEQ ID NO: 2941193 - RNA, 15 nt, Human
agacaauuuauuaug

SEQ ID NO: 2941194 - RNA, 13 nt, Human
agaccaucccuga

SEQ ID NO: 2941195 - RNA, 21 nt, Human
agaccaucccugaaggccccg

SEQ ID NO: 2941196 - RNA, 18 nt, Human
agaccaucccugaaggcc

SEQ ID NO: 2941197 - RNA, 17 nt, Human
agaccaucccugaaggc

SEQ ID NO: 2941198 - RNA, 14 nt, Human
agaccaucccugaa

SEQ ID NO: 2941199 - RNA, 16 nt, Human
agacagcccgggcucu

SEQ ID NO: 2941200 - RNA, 17 nt, Human
agacagcccgggcucug

SEQ ID NO: 2941201 - RNA, 20 nt, Human
agacagcccgggcucugccu

SEQ ID NO: 2941202 - RNA, 18 nt, Human
agacagcccgggcucugc

SEQ ID NO: 2941203 - RNA, 18 nt, Human
agacgggggcagagaggg

SEQ ID NO: 2941204 - RNA, 19 nt, Human
agacggagucccaccuugg

SEQ ID NO: 2941205 - RNA, 23 nt, Human
agacugaguacguugugcauuug

SEQ ID NO: 2941206 - RNA, 13 nt, Human
agagccccacagc

SEQ ID NO: 2941207 - RNA, 15 nt, Human
agagccccacagccc

SEQ ID NO: 2941208 - RNA, 23 nt, Human
agagaggguggugaccucugccu

SEQ ID NO: 2941209 - RNA, 21 nt, Human
agagaagagauugugguuuca

SEQ ID NO: 2941210 - RNA, 10 nt, Human
agagaagaga

SEQ ID NO: 2941211 - RNA, 17 nt, Human
agacugcauuauauuua

SEQ ID NO: 2941212 - RNA, 18 nt, Human
agccauuugucccaagug

SEQ ID NO: 2941213 - RNA, 17 nt, Human
agccauuugucccaagu

SEQ ID NO: 2941214 - RNA, 14 nt, Human
agccauuuguccca

SEQ ID NO: 2941215 - RNA, 15 nt, Human
agccagauuuuccug

SEQ ID NO: 2941216 - RNA, 19 nt, Human
agccagauuuuccugaaaa

SEQ ID NO: 2941217 - RNA, 20 nt, Human
agccagaggagagaggaccc

SEQ ID NO: 2941218 - RNA, 20 nt, Human
agccaaggccaaaggaagca

SEQ ID NO: 2941219 - RNA, 22 nt, Human
agccaaggccaaaggaagcaca

SEQ ID NO: 2941220 - RNA, 23 nt, Human
agccaaggccaaaggaagcacau

SEQ ID NO: 2941221 - RNA, 18 nt, Human
agccaaagcuaggccugg

SEQ ID NO: 2941222 - RNA, 19 nt, Human
agccaaagcuaggccuggc

SEQ ID NO: 2941223 - RNA, 20 nt, Human
agccaaagcuaggccuggcc

SEQ ID NO: 2941224 - RNA, 23 nt, Human
agccaaagcuaggccuggccaga

SEQ ID NO: 2941225 - RNA, 12 nt, Human
agcaugaagaca

SEQ ID NO: 2941226 - RNA, 12 nt, Human
agcaugccugga

SEQ ID NO: 2941227 - RNA, 19 nt, Human
agcaguucagagcugcccu

SEQ ID NO: 2941228 - RNA, 21 nt, Human
agcagccacauuccugaugcu

SEQ ID NO: 2941229 - RNA, 19 nt, Human
agcacuaaggugugcucug

SEQ ID NO: 2941230 - RNA, 20 nt, Human
agcagcccucaauugugaaa

SEQ ID NO: 2941231 - RNA, 21 nt, Human
agcaguugaaaagacuccaaa

SEQ ID NO: 2941232 - RNA, 23 nt, Human
agcaguugaaaagacuccaaaga

SEQ ID NO: 2941233 - RNA, 16 nt, Human
agcaguucagagcugc

SEQ ID NO: 2941234 - RNA, 15 nt, Human
agcaguucagagcug

SEQ ID NO: 2941235 - RNA, 17 nt, Human
agcaguucagagcugcc

SEQ ID NO: 2941236 - RNA, 18 nt, Human
agcaguucagagcugccc

SEQ ID NO: 2941237 - RNA, 18 nt, Human
agauguacgacuugcaua

SEQ ID NO: 2941238 - RNA, 20 nt, Human
agauguagacaguuggguuu

SEQ ID NO: 2941239 - RNA, 21 nt, Human
agaugggagaaucacuugaac

SEQ ID NO: 2941240 - RNA, 14 nt, Human
agauguagaggaga

SEQ ID NO: 2941241 - RNA, 16 nt, Human
agccccagugcccaca

SEQ ID NO: 2941242 - RNA, 11 nt, Human
agccccauccu

SEQ ID NO: 2941243 - RNA, 20 nt, Human
agccccaucccaaacccuuc

SEQ ID NO: 2941244 - RNA, 18 nt, Human
agcccugaacauuucaug

SEQ ID NO: 2941245 - RNA, 15 nt, Human
agcccugagcuuucu

SEQ ID NO: 2941246 - RNA, 19 nt, Human
agccgagaucacgccacug

SEQ ID NO: 2941247 - RNA, 20 nt, Human
agccgagaucacgccacugc

SEQ ID NO: 2941248 - RNA, 19 nt, Human
agccccacccucagaugca

SEQ ID NO: 2941249 - RNA, 22 nt, Human
agccucccgaguagcugggacu

SEQ ID NO: 2941250 - RNA, 17 nt, Human
agccucccaaagugcug

SEQ ID NO: 2941251 - RNA, 20 nt, Human
agccucccaaagugcuggga

SEQ ID NO: 2941252 - RNA, 18 nt, Human
agccucccgaauagcugg

SEQ ID NO: 2941253 - RNA, 19 nt, Human
agccucccgaauagcuggg

SEQ ID NO: 2941254 - RNA, 20 nt, Human
agccucccgaauagcuggga

SEQ ID NO: 2941255 - RNA, 22 nt, Human
agccucccgaauagcugggacu

SEQ ID NO: 2941256 - RNA, 17 nt, Human
agccucccgaguagcug

SEQ ID NO: 2941257 - RNA, 21 nt, Human
agccgagaucacgccacugca

SEQ ID NO: 2941258 - RNA, 19 nt, Human
agccgagauugcaccacug

SEQ ID NO: 2941259 - RNA, 20 nt, Human
agccgagauugcaccacugc

SEQ ID NO: 2941260 - RNA, 22 nt, Human
agccgcuggggccaguuggucc

SEQ ID NO: 2941261 - RNA, 14 nt, Human
agccgcuggggcca

SEQ ID NO: 2941262 - RNA, 18 nt, Human
agccucccaaagugcugg

SEQ ID NO: 2941263 - RNA, 19 nt, Human
agccucccaaagugcuggg

SEQ ID NO: 2941264 - RNA, 21 nt, Human
agccgggcgugguggugagug

SEQ ID NO: 2941265 - RNA, 17 nt, Human
caauauucgcuguguca

SEQ ID NO: 2941266 - RNA, 16 nt, Human
caaucuggauucauau

SEQ ID NO: 2941267 - RNA, 20 nt, Human
caaucuggauucauauuuaa

SEQ ID NO: 2941268 - RNA, 23 nt, Human
caaugaccuuucaauaggaaaaa

SEQ ID NO: 2941269 - RNA, 23 nt, Human
caaucugugaugacauucccugc

SEQ ID NO: 2941270 - RNA, 17 nt, Human
caaugacuuacuguaca

SEQ ID NO: 2941271 - RNA, 18 nt, Human
caaugacuuacuguacau

SEQ ID NO: 2941272 - RNA, 15 nt, Human
caaugacuuacugua

SEQ ID NO: 2941273 - RNA, 21 nt, Human
caaugaccuuucaauaggaaa

SEQ ID NO: 2941274 - RNA, 16 nt, Human
caaguuaguucaaucu

SEQ ID NO: 2941275 - RNA, 13 nt, Human
caauaggaaaaac

SEQ ID NO: 2941276 - RNA, 12 nt, Human
caauaggaaaaa

SEQ ID NO: 2941277 - RNA, 23 nt, Human
caauacaucccuuaccugggaaa

SEQ ID NO: 2941278 - RNA, 17 nt, Human
caaugugauaaaacccc

SEQ ID NO: 2941279 - RNA, 15 nt, Human
caaugugauaaaacc

SEQ ID NO: 2941280 - RNA, 14 nt, Human
caauuugcacauua

SEQ ID NO: 2941281 - RNA, 15 nt, Human
caauuugcacauuaa

SEQ ID NO: 2941282 - RNA, 22 nt, Human
caauuugcacauuaaaugacuc

SEQ ID NO: 2941283 - RNA, 23 nt, Human
caauucucauuugucacacacuu

SEQ ID NO: 2941284 - RNA, 16 nt, Human
caauuacaggaaguac

SEQ ID NO: 2941285 - RNA, 19 nt, Human
caaugagaucauugugaag

SEQ ID NO: 2941286 - RNA, 17 nt, Human
caaugcacuuuguucug

SEQ ID NO: 2941287 - RNA, 22 nt, Human
caaugcacuuuguucuggcucu

SEQ ID NO: 2941288 - RNA, 21 nt, Human
caaugcacuuuguucuggcuc

SEQ ID NO: 2941289 - RNA, 20 nt, Human
caaugcacuuuguucuggcu

SEQ ID NO: 2941290 - RNA, 22 nt, Human
caaugugacuuaaugccacuaa

SEQ ID NO: 2941291 - RNA, 14 nt, Human
caauaggaaaaacu

SEQ ID NO: 2941292 - RNA, 18 nt, Human
caagacgcugugcugccc

SEQ ID NO: 2941293 - RNA, 18 nt, Human
caagacucccaugaggga

SEQ ID NO: 2941294 - RNA, 23 nt, Human
caagacgcugugcugcccugccc

SEQ ID NO: 2941295 - RNA, 14 nt, Human
caagacucccauga

SEQ ID NO: 2941296 - RNA, 15 nt, Human
caagagcccaggccu

SEQ ID NO: 2941297 - RNA, 14 nt, Human
caagagcccaggcc

SEQ ID NO: 2941298 - RNA, 13 nt, Human
caagagcccaggc

SEQ ID NO: 2941299 - RNA, 18 nt, Human
caagacucuuuggacacu

SEQ ID NO: 2941300 - RNA, 16 nt, Human
caagagcccaggccuc

SEQ ID NO: 2941301 - RNA, 15 nt, Human
caagcaccuccugcc

SEQ ID NO: 2941302 - RNA, 16 nt, Human
caagcaccuccugccu

SEQ ID NO: 2941303 - RNA, 17 nt, Human
caagcaccuccugccuc

SEQ ID NO: 2941304 - RNA, 20 nt, Human
caagaacuuuccaggaaggc

SEQ ID NO: 2941305 - RNA, 16 nt, Human
caagaccuucuccuuc

SEQ ID NO: 2941306 - RNA, 14 nt, Human
caagaccuucuccu

SEQ ID NO: 2941307 - RNA, 17 nt, Human
caagacgcugugcugcc

SEQ ID NO: 2941308 - RNA, 16 nt, Human
caagacgcugugcugc

SEQ ID NO: 2941309 - RNA, 18 nt, Human
caagaccuucuccuucac

SEQ ID NO: 2941310 - RNA, 17 nt, Human
caagaccuucuccuuca

SEQ ID NO: 2941311 - RNA, 14 nt, Human
caacgucugugcca

SEQ ID NO: 2941312 - RNA, 13 nt, Human
caacgucugugcc

SEQ ID NO: 2941313 - RNA, 15 nt, Human
caaccuccugggcua

SEQ ID NO: 2941314 - RNA, 14 nt, Human
caaccuccugggcu

SEQ ID NO: 2941315 - RNA, 22 nt, Human
caaccccuucgcuccugugucu

SEQ ID NO: 2941316 - RNA, 22 nt, Human
caacacucacauuuauucugcu

SEQ ID NO: 2941317 - RNA, 18 nt, Human
caacacucauugaccuga

SEQ ID NO: 2941318 - RNA, 22 nt, Human
caacacucauugaccugaggcc

SEQ ID NO: 2941319 - RNA, 20 nt, Human
caacacucauugaccugagg

SEQ ID NO: 2941320 - RNA, 14 nt, Human
caaguuaaauaaau

SEQ ID NO: 2941321 - RNA, 18 nt, Human
caagugagagcugggugu

SEQ ID NO: 2941322 - RNA, 21 nt, Human
caaguccucuuuucugagagg

SEQ ID NO: 2941323 - RNA, 14 nt, Human
caagugagagcugg

SEQ ID NO: 2941324 - RNA, 15 nt, Human
caagugagagcuggg

SEQ ID NO: 2941325 - RNA, 17 nt, Human
caagugagagcugggug

SEQ ID NO: 2941326 - RNA, 14 nt, Human
caaggucauuuuuu

SEQ ID NO: 2941327 - RNA, 20 nt, Human
caaggucauuuuuuuuaaga

SEQ ID NO: 2941328 - RNA, 14 nt, Human
caaguccucuuuuc

SEQ ID NO: 2941329 - RNA, 14 nt, Human
caaggcuuagaccc

SEQ ID NO: 2941330 - RNA, 17 nt, Human
caaggggcccaaauucu

SEQ ID NO: 2941331 - RNA, 15 nt, Human
caaggcuuagacccu

SEQ ID NO: 2941332 - RNA, 18 nt, Human
caaggggcccaaauucuu

SEQ ID NO: 2941333 - RNA, 23 nt, Human
caaggcugucaauuacaggaagu

SEQ ID NO: 2941334 - RNA, 21 nt, Human
caaggcugucaauuacaggaa

SEQ ID NO: 2941335 - RNA, 15 nt, Human
caaggcugugcaucu

SEQ ID NO: 2941336 - RNA, 15 nt, Human
caaggcugcagugag

SEQ ID NO: 2941337 - RNA, 12 nt, Human
caaggcugcagu

SEQ ID NO: 2941338 - RNA, 18 nt, Human
caaggcuuagacccucau

SEQ ID NO: 2941339 - RNA, 20 nt, Human
caagcgauucuucugcuuca

SEQ ID NO: 2941340 - RNA, 22 nt, Human
caagcgauucuucugcuucagc

SEQ ID NO: 2941341 - RNA, 19 nt, Human
caagcgauucuucugcuuc

SEQ ID NO: 2941342 - RNA, 18 nt, Human
caagcaggacauggacaa

SEQ ID NO: 2941343 - RNA, 14 nt, Human
caagcaggacaugg

SEQ ID NO: 2941344 - RNA, 22 nt, Human
caagccaccaacauacucccau

SEQ ID NO: 2941345 - RNA, 21 nt, Human
caagccagauuuuccugaaaa

SEQ ID NO: 2941346 - RNA, 17 nt, Human
caagcuggucccacuca

SEQ ID NO: 2941347 - RNA, 19 nt, Human
caagcuggucccacucagu

SEQ ID NO: 2941348 - RNA, 17 nt, Human
caaggcugauuaaacca

SEQ ID NO: 2941349 - RNA, 21 nt, Human
caaauacgugggcauucaaau

SEQ ID NO: 2941350 - RNA, 22 nt, Human
caaauacgugggcauucaaaug

SEQ ID NO: 2941351 - RNA, 20 nt, Human
caaauacgugggcauucaaa

SEQ ID NO: 2941352 - RNA, 23 nt, Human
caaagugcugggauuacaggugu

SEQ ID NO: 2941353 - RNA, 19 nt, Human
caaagugcugggauuacag

SEQ ID NO: 2941354 - RNA, 19 nt, Human
caaaggguaucaggugcug

SEQ ID NO: 2941355 - RNA, 21 nt, Human
caaauaugcaaagcacugacu

SEQ ID NO: 2941356 - RNA, 19 nt, Human
caaauaugcaaagcacuga

SEQ ID NO: 2941357 - RNA, 15 nt, Human
caaaugucuauaaac

SEQ ID NO: 2941358 - RNA, 14 nt, Human
caaaugucuauaaa

SEQ ID NO: 2941359 - RNA, 11 nt, Human
caaauuucuaa

SEQ ID NO: 2941360 - RNA, 12 nt, Human
caaauuucuaaa

SEQ ID NO: 2941361 - RNA, 14 nt, Human
caaauuucuaaauc

SEQ ID NO: 2941362 - RNA, 16 nt, Human
caaaauuuuuucucua

SEQ ID NO: 2941363 - RNA, 21 nt, Human
caaaauuuuuucucuaggaaa

SEQ ID NO: 2941364 - RNA, 22 nt, Human
caaaauuuuuucucuaggaaau

SEQ ID NO: 2941365 - RNA, 15 nt, Human
caaacacauacagga

SEQ ID NO: 2941366 - RNA, 14 nt, Human
caaacuaacaggcu

SEQ ID NO: 2941367 - RNA, 20 nt, Human
caaacccuucagugccaaaa

SEQ ID NO: 2941368 - RNA, 14 nt, Human
caaacccuucagug

SEQ ID NO: 2941369 - RNA, 12 nt, Human
caaaauaaaacu

SEQ ID NO: 2941370 - RNA, 15 nt, Human
caaaauguaggguua

SEQ ID NO: 2941371 - RNA, 22 nt, Human
caaagccaaagcuaggccuggc

SEQ ID NO: 2941372 - RNA, 18 nt, Human
caaagccuccuccagccg

SEQ ID NO: 2941373 - RNA, 17 nt, Human
caaagccuccuccagcc

SEQ ID NO: 2941374 - RNA, 16 nt, Human
caaacuaacaggcuua

SEQ ID NO: 2941375 - RNA, 20 nt, Human
caaacuaacaggcuuaguga

SEQ ID NO: 2941376 - RNA, 17 nt, Human
caaacucaccugccccu

SEQ ID NO: 2941377 - RNA, 13 nt, Human
caaaggaagcaca

SEQ ID NO: 2941378 - RNA, 12 nt, Human
caaaggaagcac

SEQ ID NO: 2941379 - RNA, 13 nt, Human
caaagcuaggccu

SEQ ID NO: 2941380 - RNA, 14 nt, Human
caaagcuaggccug

SEQ ID NO: 2941381 - RNA, 19 nt, Human
caaagcuaggccuggccag

SEQ ID NO: 2941382 - RNA, 14 nt, Human
caaaggaagcacau

SEQ ID NO: 2941383 - RNA, 16 nt, Human
caaaggguaucaggug

SEQ ID NO: 2941384 - RNA, 18 nt, Human
caaaggguaucaggugcu

SEQ ID NO: 2941385 - RNA, 13 nt, Human
caaaaaggcagga

SEQ ID NO: 2941386 - RNA, 14 nt, Human
caaaaacacagcaa

SEQ ID NO: 2941387 - RNA, 13 nt, Human
caaaaacacagca

SEQ ID NO: 2941388 - RNA, 20 nt, Human
caaaaacauggccuuugcuu

SEQ ID NO: 2941389 - RNA, 17 nt, Human
caaaaacacagcaaggg

SEQ ID NO: 2941390 - RNA, 15 nt, Human
caaaaacacagcaag

SEQ ID NO: 2941391 - RNA, 22 nt, Human
auuuugggguacccacugcucu

SEQ ID NO: 2941392 - RNA, 23 nt, Human
auuuugggguacccacugcucug

SEQ ID NO: 2941393 - RNA, 16 nt, Human
caaaaaaugcuugcuu

SEQ ID NO: 2941394 - RNA, 21 nt, Human
auuuugggguacccacugcuc

SEQ ID NO: 2941395 - RNA, 13 nt, Human
auuuuccugaaaa

SEQ ID NO: 2941396 - RNA, 19 nt, Human
caaaaaucucaauauuuca

SEQ ID NO: 2941397 - RNA, 22 nt, Human
caaaacucuccucugcugcugg

SEQ ID NO: 2941398 - RNA, 21 nt, Human
caaaacucuccucugcugcug

SEQ ID NO: 2941399 - RNA, 20 nt, Human
caaaacucuccucugcugcu

SEQ ID NO: 2941400 - RNA, 17 nt, Human
caaaauaaaaaugaggu

SEQ ID NO: 2941401 - RNA, 23 nt, Human
caaaacuucagacauagaauuaa

SEQ ID NO: 2941402 - RNA, 15 nt, Human
cacaguucucuccuu

SEQ ID NO: 2941403 - RNA, 14 nt, Human
cacaguucucuccu

SEQ ID NO: 2941404 - RNA, 23 nt, Human
cacaguguguggucaacauuucu

SEQ ID NO: 2941405 - RNA, 21 nt, Human
cacaguguguggucaacauuu

SEQ ID NO: 2941406 - RNA, 19 nt, Human
cacagugaucaaguuauuu

SEQ ID NO: 2941407 - RNA, 22 nt, Human
cacagugagucgaggacaggga

SEQ ID NO: 2941408 - RNA, 21 nt, Human
cacagugagucgaggacaggg

SEQ ID NO: 2941409 - RNA, 22 nt, Human
cacaguccuuaccagcagagca

SEQ ID NO: 2941410 - RNA, 21 nt, Human
cacaguccuuaccagcagagc

SEQ ID NO: 2941411 - RNA, 15 nt, Human
cacaguccuuaccag

SEQ ID NO: 2941412 - RNA, 13 nt, Human
cacaguccuuacc

SEQ ID NO: 2941413 - RNA, 11 nt, Human
cacaggcaggu

SEQ ID NO: 2941414 - RNA, 14 nt, Human
cacaggcaggucca

SEQ ID NO: 2941415 - RNA, 15 nt, Human
cacaggcagguccag

SEQ ID NO: 2941416 - RNA, 12 nt, Human
caauuuuaaaca

SEQ ID NO: 2941417 - RNA, 23 nt, Human
cacagcugggguggggaccucag

SEQ ID NO: 2941418 - RNA, 22 nt, Human
cacagcugggguggggaccuca

SEQ ID NO: 2941419 - RNA, 21 nt, Human
cacagcuucauuuccuguguc

SEQ ID NO: 2941420 - RNA, 22 nt, Human
cacagcuucauuuccugugucu

SEQ ID NO: 2941421 - RNA, 14 nt, Human
cacauaucugucau

SEQ ID NO: 2941422 - RNA, 15 nt, Human
cacaguuuucugaga

SEQ ID NO: 2941423 - RNA, 19 nt, Human
cacaguuuucugagaaaga

SEQ ID NO: 2941424 - RNA, 17 nt, Human
cacaguuuucugagaaa

SEQ ID NO: 2941425 - RNA, 16 nt, Human
cacaguuuucugagaa

SEQ ID NO: 2941426 - RNA, 22 nt, Human
cacuguggguagacacacauga

SEQ ID NO: 2941427 - RNA, 24 nt, Human
cacuguggguagacacacaugaag

SEQ ID NO: 2941428 - RNA, 22 nt, Human
cacuguucucugcccuccaaga

SEQ ID NO: 2941429 - RNA, 21 nt, Human
cacuguucucugcccuccaag

SEQ ID NO: 2941430 - RNA, 19 nt, Human
cacuguucucugcccucca

SEQ ID NO: 2941431 - RNA, 17 nt, Human
cacuguucucugcccuc

SEQ ID NO: 2941432 - RNA, 16 nt, Human
cacuguucucugcccu

SEQ ID NO: 2941433 - RNA, 15 nt, Human
cacuguucucugccc

SEQ ID NO: 2941434 - RNA, 14 nt, Human
cacuguucucugcc

SEQ ID NO: 2941435 - RNA, 13 nt, Human
cacuguucucugc

SEQ ID NO: 2941436 - RNA, 15 nt, Human
cacugugcugagucu

SEQ ID NO: 2941437 - RNA, 13 nt, Human
cacugugcugagu

SEQ ID NO: 2941438 - RNA, 18 nt, Human
cacugugccaugugccag

SEQ ID NO: 2941439 - RNA, 15 nt, Human
cacugugccaugugc

SEQ ID NO: 2941440 - RNA, 16 nt, Human
cacugugccaugugcc

SEQ ID NO: 2941441 - RNA, 19 nt, Human
cacuguggguagacacaca

SEQ ID NO: 2941442 - RNA, 22 nt, Human
cacugugcugagucugaaggcu

SEQ ID NO: 2941443 - RNA, 21 nt, Human
cacugugcugagucugaaggc

SEQ ID NO: 2941444 - RNA, 20 nt, Human
cacugugcugagucugaagg

SEQ ID NO: 2941445 - RNA, 17 nt, Human
cacugugcugagucuga

SEQ ID NO: 2941446 - RNA, 14 nt, Human
cacugucaagauga

SEQ ID NO: 2941447 - RNA, 16 nt, Human
cacuguccuauuauau

SEQ ID NO: 2941448 - RNA, 13 nt, Human
cacugugaagaga

SEQ ID NO: 2941449 - RNA, 14 nt, Human
cacugugccaugug

SEQ ID NO: 2941450 - RNA, 12 nt, Human
cacugguuuuaa

SEQ ID NO: 2941451 - RNA, 13 nt, Human
cacugguuuuaaa

SEQ ID NO: 2941452 - RNA, 15 nt, Human
cacugguuuuaaaua

SEQ ID NO: 2941453 - RNA, 16 nt, Human
cacugguuuuaaauau

SEQ ID NO: 2941454 - RNA, 18 nt, Human
cacugguuuguucccugu

SEQ ID NO: 2941455 - RNA, 13 nt, Human
cacuggcucaccc

SEQ ID NO: 2941456 - RNA, 14 nt, Human
cacuggcucaccca

SEQ ID NO: 2941457 - RNA, 15 nt, Human
cacuggcucacccag

SEQ ID NO: 2941458 - RNA, 17 nt, Human
cacuggcucacccaguc

SEQ ID NO: 2941459 - RNA, 18 nt, Human
cacuggcucacccagucc

SEQ ID NO: 2941460 - RNA, 14 nt, Human
cacuguacacauaa

SEQ ID NO: 2941461 - RNA, 16 nt, Human
cacuucccuacaugga

SEQ ID NO: 2941462 - RNA, 23 nt, Human
cacuucgggaggucgaggcagga

SEQ ID NO: 2941463 - RNA, 21 nt, Human
cacuucgggaggucgaggcag

SEQ ID NO: 2941464 - RNA, 22 nt, Human
cacuucugccauauucuguugg

SEQ ID NO: 2941465 - RNA, 22 nt, Human
cacuucuggauauagcuaggug

SEQ ID NO: 2941466 - RNA, 23 nt, Human
cacuucuggauauagcuagguga

SEQ ID NO: 2941467 - RNA, 21 nt, Human
cacuucagcugacuuuucugu

SEQ ID NO: 2941468 - RNA, 12 nt, Human
cacuucagcuga

SEQ ID NO: 2941469 - RNA, 20 nt, Human
cacuucacgcccuuggccau

SEQ ID NO: 2941470 - RNA, 21 nt, Human
cacuucacgcccuuggccaug

SEQ ID NO: 2941471 - RNA, 17 nt, Human
cacuucacgcccuuggc

SEQ ID NO: 2941472 - RNA, 19 nt, Human
cacuucacgcccuuggcca

SEQ ID NO: 2941473 - RNA, 24 nt, Human
cacuugcagacucuacagaggcca

SEQ ID NO: 2941474 - RNA, 14 nt, Human
cacuugcagacucu

SEQ ID NO: 2941475 - RNA, 18 nt, Human
cacuugcagacucuacag

SEQ ID NO: 2941476 - RNA, 19 nt, Human
cacuugcagacucuacaga

SEQ ID NO: 2941477 - RNA, 22 nt, Human
cacuugcagacucuacagaggc

SEQ ID NO: 2941478 - RNA, 15 nt, Human
cacuuggucugugag

SEQ ID NO: 2941479 - RNA, 18 nt, Human
cacuuucuagccagagga

SEQ ID NO: 2941480 - RNA, 20 nt, Human
cacuuucuagccagaggaga

SEQ ID NO: 2941481 - RNA, 19 nt, Human
cacuuucuagccagaggag

SEQ ID NO: 2941482 - RNA, 20 nt, Human
cacuugagaauuacccuuuu

SEQ ID NO: 2941483 - RNA, 19 nt, Human
cacuugacaucaacugcau

SEQ ID NO: 2941484 - RNA, 17 nt, Human
cacuugagaauuacccu

SEQ ID NO: 2941485 - RNA, 13 nt, Human
cacuugaguccag

SEQ ID NO: 2941486 - RNA, 13 nt, Human
cacuugcagacuc

SEQ ID NO: 2941487 - RNA, 20 nt, Human
cacuugaacccgggaggcag

SEQ ID NO: 2941488 - RNA, 21 nt, Human
cacuugaacccgggaggcaga

SEQ ID NO: 2941489 - RNA, 23 nt, Human
cacuugaacccgggaggcagagg

SEQ ID NO: 2941490 - RNA, 16 nt, Human
cacuugacaucaacug

SEQ ID NO: 2941491 - RNA, 22 nt, Human
cacuggcaaacagggccucugc

SEQ ID NO: 2941492 - RNA, 20 nt, Human
cacuggcaaacagggccucu

SEQ ID NO: 2941493 - RNA, 21 nt, Human
cacuggcaaacagggccucug

SEQ ID NO: 2941494 - RNA, 17 nt, Human
cacuggcaaacagggcc

SEQ ID NO: 2941495 - RNA, 18 nt, Human
cacuggcaaacagggccu

SEQ ID NO: 2941496 - RNA, 19 nt, Human
cacuggcaaacagggccuc

SEQ ID NO: 2941497 - RNA, 21 nt, Human
cacugcuuuuggucuguguga

SEQ ID NO: 2941498 - RNA, 17 nt, Human
cacuggaacacuaauga

SEQ ID NO: 2941499 - RNA, 16 nt, Human
cacugcuuccagugag

SEQ ID NO: 2941500 - RNA, 15 nt, Human
cacugcuuccaguga

SEQ ID NO: 2941501 - RNA, 14 nt, Human
cacugcuuccagug

SEQ ID NO: 2941502 - RNA, 13 nt, Human
cacugcuuaacuu

SEQ ID NO: 2941503 - RNA, 20 nt, Human
cacugcuuuuggucugugug

SEQ ID NO: 2941504 - RNA, 22 nt, Human
cacugcuuccagugaggcucug

SEQ ID NO: 2941505 - RNA, 21 nt, Human
cacugcuuccagugaggcucu

SEQ ID NO: 2941506 - RNA, 20 nt, Human
cacugcuuccagugaggcuc

SEQ ID NO: 2941507 - RNA, 19 nt, Human
cacugcuuccagugaggcu

SEQ ID NO: 2941508 - RNA, 18 nt, Human
cacugcuuccagugaggc

SEQ ID NO: 2941509 - RNA, 14 nt, Human
cacugcaccgggcc

SEQ ID NO: 2941510 - RNA, 15 nt, Human
cacugcaccgggcca

SEQ ID NO: 2941511 - RNA, 16 nt, Human
cacugcaccgggccac

SEQ ID NO: 2941512 - RNA, 18 nt, Human
cacugcaccgggccacag

SEQ ID NO: 2941513 - RNA, 19 nt, Human
cacugcaccgggccacaga

SEQ ID NO: 2941514 - RNA, 18 nt, Human
cacugcacuauagccuag

SEQ ID NO: 2941515 - RNA, 12 nt, Human
cacugcucuggu

SEQ ID NO: 2941516 - RNA, 20 nt, Human
cacugccuucucaacuccaa

SEQ ID NO: 2941517 - RNA, 23 nt, Human
cacugagacagcccgggcucugc

SEQ ID NO: 2941518 - RNA, 14 nt, Human
cacugaugggcaac

SEQ ID NO: 2941519 - RNA, 18 nt, Human
cacugaugggcaaccccc

SEQ ID NO: 2941520 - RNA, 24 nt, Human
cacugaugggcaacccccagccug

SEQ ID NO: 2941521 - RNA, 14 nt, Human
cacugcaaccuccg

SEQ ID NO: 2941522 - RNA, 16 nt, Human
cacugcaaccuccgcc

SEQ ID NO: 2941523 - RNA, 23 nt, Human
cacugcaaccuccgccucuuggg

SEQ ID NO: 2941524 - RNA, 13 nt, Human
cacugcaaccucc

SEQ ID NO: 2941525 - RNA, 23 nt, Human
cacucuggcagcucagagagggu

SEQ ID NO: 2941526 - RNA, 21 nt, Human
cacucuggcagcucagagagg

SEQ ID NO: 2941527 - RNA, 20 nt, Human
cacucuggcagcucagagag

SEQ ID NO: 2941528 - RNA, 19 nt, Human
cacucuggcagcucagaga

SEQ ID NO: 2941529 - RNA, 17 nt, Human
cacucuggcagcucaga

SEQ ID NO: 2941530 - RNA, 16 nt, Human
cacucuggcagcucag

SEQ ID NO: 2941531 - RNA, 15 nt, Human
cacucuggcagcuca

SEQ ID NO: 2941532 - RNA, 15 nt, Human
cacucugucgcccag

SEQ ID NO: 2941533 - RNA, 16 nt, Human
cacucugucgcccagu

SEQ ID NO: 2941534 - RNA, 19 nt, Human
cacucugucgcccagucug

SEQ ID NO: 2941535 - RNA, 23 nt, Human
cacugacauuguuggccaaagcc

SEQ ID NO: 2941536 - RNA, 20 nt, Human
cacugacuucuaaguaaaac

SEQ ID NO: 2941537 - RNA, 16 nt, Human
cacugacuucuaagua

SEQ ID NO: 2941538 - RNA, 15 nt, Human
cacugacuucuaagu

SEQ ID NO: 2941539 - RNA, 14 nt, Human
cacugacuucuaag

SEQ ID NO: 2941540 - RNA, 21 nt, Human
cacugacuucuaaguaaaacc

SEQ ID NO: 2941541 - RNA, 13 nt, Human
cacugagacagcc

SEQ ID NO: 2941542 - RNA, 12 nt, Human
cacugagacagc

SEQ ID NO: 2941543 - RNA, 22 nt, Human
cacugagacagcccgggcucug

SEQ ID NO: 2941544 - RNA, 19 nt, Human
cacugagacagcccgggcu

SEQ ID NO: 2941545 - RNA, 17 nt, Human
cacugagacagcccggg

SEQ ID NO: 2941546 - RNA, 14 nt, Human
cacugagacagccc

SEQ ID NO: 2941547 - RNA, 18 nt, Human
cacuccggcccuccagag

SEQ ID NO: 2941548 - RNA, 20 nt, Human
cacuccggcccuccagagcc

SEQ ID NO: 2941549 - RNA, 21 nt, Human
cacuccggcccuccagagccc

SEQ ID NO: 2941550 - RNA, 17 nt, Human
cacuccggcccuccaga

SEQ ID NO: 2941551 - RNA, 17 nt, Human
cacucccugcaaccuga

SEQ ID NO: 2941552 - RNA, 21 nt, Human
cacuccuucacagaugggugc

SEQ ID NO: 2941553 - RNA, 14 nt, Human
cacuccuucacaga

SEQ ID NO: 2941554 - RNA, 15 nt, Human
cacuccccugcuggg

SEQ ID NO: 2941555 - RNA, 12 nt, Human
cacucccugcaa

SEQ ID NO: 2941556 - RNA, 16 nt, Human
cacucccugcaaccug

SEQ ID NO: 2941557 - RNA, 13 nt, Human
cacucccugcaac

SEQ ID NO: 2941558 - RNA, 22 nt, Human
cacucauugaccugaggcccuu

SEQ ID NO: 2941559 - RNA, 20 nt, Human
cacucauugaccugaggccc

SEQ ID NO: 2941560 - RNA, 19 nt, Human
cacucauugaccugaggcc

SEQ ID NO: 2941561 - RNA, 18 nt, Human
cacucauugaccugaggc

SEQ ID NO: 2941562 - RNA, 15 nt, Human
cacucauugaccuga

SEQ ID NO: 2941563 - RNA, 16 nt, Human
cacucaguccauagca

SEQ ID NO: 2941564 - RNA, 14 nt, Human
cacucuggcagcuc

SEQ ID NO: 2941565 - RNA, 13 nt, Human
cacucuggcagcu

SEQ ID NO: 2941566 - RNA, 12 nt, Human
cacucuggcagc

SEQ ID NO: 2941567 - RNA, 12 nt, Human
cacucuccuugg

SEQ ID NO: 2941568 - RNA, 23 nt, Human
cacucugagacucgcgacaaugc

SEQ ID NO: 2941569 - RNA, 12 nt, Human
cacucugagacu

SEQ ID NO: 2941570 - RNA, 13 nt, Human
cacucuauaacaa

SEQ ID NO: 2941571 - RNA, 15 nt, Human
cacuauguugcccag

SEQ ID NO: 2941572 - RNA, 16 nt, Human
cacuauguugcccagg

SEQ ID NO: 2941573 - RNA, 17 nt, Human
cacuauguugcccaggc

SEQ ID NO: 2941574 - RNA, 18 nt, Human
cacuauguugcccaggca

SEQ ID NO: 2941575 - RNA, 19 nt, Human
cacuauguugcccaggcag

SEQ ID NO: 2941576 - RNA, 14 nt, Human
cacuauagccuagg

SEQ ID NO: 2941577 - RNA, 18 nt, Human
cacuauaauguaagcucu

SEQ ID NO: 2941578 - RNA, 21 nt, Human
cacuauagccuaggugacaga

SEQ ID NO: 2941579 - RNA, 14 nt, Human
cacuauaauguaag

SEQ ID NO: 2941580 - RNA, 14 nt, Human
cacuaguauuucua

SEQ ID NO: 2941581 - RNA, 19 nt, Human
cacuaguauuucuaugaaa

SEQ ID NO: 2941582 - RNA, 17 nt, Human
cacuaaggugugcucug

SEQ ID NO: 2941583 - RNA, 18 nt, Human
cacuaaggugugcucuga

SEQ ID NO: 2941584 - RNA, 18 nt, Human
cacuaaccacgcuggacc

SEQ ID NO: 2941585 - RNA, 17 nt, Human
cacuaagagagaaugag

SEQ ID NO: 2941586 - RNA, 14 nt, Human
cacuaaccacgcug

SEQ ID NO: 2941587 - RNA, 15 nt, Human
cacuaaccacgcugg

SEQ ID NO: 2941588 - RNA, 16 nt, Human
cacuaaccacgcugga

SEQ ID NO: 2941589 - RNA, 21 nt, Human
cacuaaauugacacuuaaaaa

SEQ ID NO: 2941590 - RNA, 12 nt, Human
cacucagaagac

SEQ ID NO: 2941591 - RNA, 16 nt, Human
cacucagaagacacug

SEQ ID NO: 2941592 - RNA, 17 nt, Human
cacucagaagacacuga

SEQ ID NO: 2941593 - RNA, 19 nt, Human
cacucacauuuauucugcu

SEQ ID NO: 2941594 - RNA, 20 nt, Human
cacucacauuuauucugcuc

SEQ ID NO: 2941595 - RNA, 22 nt, Human
cacucagaagacacugaugggc

SEQ ID NO: 2941596 - RNA, 18 nt, Human
cacucagaagacacugau

SEQ ID NO: 2941597 - RNA, 19 nt, Human
cacucagaagacacugaug

SEQ ID NO: 2941598 - RNA, 18 nt, Human
cacuauuuauuuacaaau

SEQ ID NO: 2941599 - RNA, 22 nt, Human
cacuauuuauuuacaaauguuu

SEQ ID NO: 2941600 - RNA, 20 nt, Human
cacuauguugcccaggcagg

SEQ ID NO: 2941601 - RNA, 21 nt, Human
cacuauguugcccaggcaggu

SEQ ID NO: 2941602 - RNA, 19 nt, Human
cacucaaaagcugggcagg

SEQ ID NO: 2941603 - RNA, 18 nt, Human
cacucaaaagcugggcag

SEQ ID NO: 2941604 - RNA, 17 nt, Human
cacucaaaagcugggca

SEQ ID NO: 2941605 - RNA, 15 nt, Human
cacucaaaagcuggg

SEQ ID NO: 2941606 - RNA, 16 nt, Human
cacucaaaucaagaaa

SEQ ID NO: 2941607 - RNA, 20 nt, Human
cacucaaaagcugggcaggu

SEQ ID NO: 2941608 - RNA, 18 nt, Human
caccuugacagggcacac

SEQ ID NO: 2941609 - RNA, 15 nt, Human
caccuugacagggca

SEQ ID NO: 2941610 - RNA, 16 nt, Human
caccuugacagggcac

SEQ ID NO: 2941611 - RNA, 13 nt, Human
caccuugacaggg

SEQ ID NO: 2941612 - RNA, 17 nt, Human
cacgacugcccggcagg

SEQ ID NO: 2941613 - RNA, 16 nt, Human
cacgacugcccggcag

SEQ ID NO: 2941614 - RNA, 22 nt, Human
cacgaauauugcugauggugca

SEQ ID NO: 2941615 - RNA, 19 nt, Human
cacgaauauugcugauggu

SEQ ID NO: 2941616 - RNA, 16 nt, Human
cacgaauauugcugau

SEQ ID NO: 2941617 - RNA, 23 nt, Human
caccuuagacagucccugccaau

SEQ ID NO: 2941618 - RNA, 21 nt, Human
caccuuagacagucccugcca

SEQ ID NO: 2941619 - RNA, 19 nt, Human
caccuuagacagucccugc

SEQ ID NO: 2941620 - RNA, 18 nt, Human
caccuuagacagucccug

SEQ ID NO: 2941621 - RNA, 16 nt, Human
caccuuagacaguccc

SEQ ID NO: 2941622 - RNA, 14 nt, Human
caccuuagacaguc

SEQ ID NO: 2941623 - RNA, 18 nt, Human
cacgcccccacuggugac

SEQ ID NO: 2941624 - RNA, 17 nt, Human
cacgcccccacugguga

SEQ ID NO: 2941625 - RNA, 23 nt, Human
cacgccagauucuuuccugaggc

SEQ ID NO: 2941626 - RNA, 15 nt, Human
cacgcccccacuggu

SEQ ID NO: 2941627 - RNA, 13 nt, Human
cacgcccccacug

SEQ ID NO: 2941628 - RNA, 13 nt, Human
cacgccacugcac

SEQ ID NO: 2941629 - RNA, 15 nt, Human
cacgccacugcacua

SEQ ID NO: 2941630 - RNA, 19 nt, Human
cacgccagauucuuuccug

SEQ ID NO: 2941631 - RNA, 22 nt, Human
cacgccagauucuuuccugagg

SEQ ID NO: 2941632 - RNA, 20 nt, Human
cacgccagauucuuuccuga

SEQ ID NO: 2941633 - RNA, 16 nt, Human
cacgauuucuguuuag

SEQ ID NO: 2941634 - RNA, 12 nt, Human
cacgauuucugu

SEQ ID NO: 2941635 - RNA, 14 nt, Human
cacgauuucuguuu

SEQ ID NO: 2941636 - RNA, 17 nt, Human
cacgcacuucgggaggu

SEQ ID NO: 2941637 - RNA, 15 nt, Human
cacgcacacugucug

SEQ ID NO: 2941638 - RNA, 22 nt, Human
cacgagcaggcuacugucagcu

SEQ ID NO: 2941639 - RNA, 17 nt, Human
cacgagcaggcuacugu

SEQ ID NO: 2941640 - RNA, 20 nt, Human
cacgagcaggcuacugucag

SEQ ID NO: 2941641 - RNA, 19 nt, Human
cacgagcaggcuacuguca

SEQ ID NO: 2941642 - RNA, 20 nt, Human
cacgccuguaauccuagcac

SEQ ID NO: 2941643 - RNA, 19 nt, Human
cacgccuguaauccuagca

SEQ ID NO: 2941644 - RNA, 15 nt, Human
cacgcgugcacacac

SEQ ID NO: 2941645 - RNA, 16 nt, Human
cacgcgugcacacacc

SEQ ID NO: 2941646 - RNA, 21 nt, Human
cacgcgugcacacaccagagc

SEQ ID NO: 2941647 - RNA, 23 nt, Human
cacgcgugcacacaccagagccc

SEQ ID NO: 2941648 - RNA, 15 nt, Human
cacggcucacugcag

SEQ ID NO: 2941649 - RNA, 20 nt, Human
cacgcuggaccuugaacugg

SEQ ID NO: 2941650 - RNA, 17 nt, Human
cacgcuggaccuugaac

SEQ ID NO: 2941651 - RNA, 16 nt, Human
cacggcucacugcagc

SEQ ID NO: 2941652 - RNA, 17 nt, Human
cacggcucacugcagcc

SEQ ID NO: 2941653 - RNA, 19 nt, Human
cacggcucacugcagccuc

SEQ ID NO: 2941654 - RNA, 20 nt, Human
cacggcucacugcagccuca

SEQ ID NO: 2941655 - RNA, 18 nt, Human
cacguacacacacauaca

SEQ ID NO: 2941656 - RNA, 19 nt, Human
cacguacacacacauacac

SEQ ID NO: 2941657 - RNA, 14 nt, Human
cacguacacacaca

SEQ ID NO: 2941658 - RNA, 23 nt, Human
cacguuucuaaaggcuaccuuug

SEQ ID NO: 2941659 - RNA, 12 nt, Human
cacguuucuaaa

SEQ ID NO: 2941660 - RNA, 14 nt, Human
cacguuucuaaagg

SEQ ID NO: 2941661 - RNA, 13 nt, Human
cacuaaacaaaga

SEQ ID NO: 2941662 - RNA, 19 nt, Human
cacgugguccuaaucuucu

SEQ ID NO: 2941663 - RNA, 16 nt, Human
cacgugguccuaaucu

SEQ ID NO: 2941664 - RNA, 22 nt, Human
cacguucuuacuaguuucccuu

SEQ ID NO: 2941665 - RNA, 20 nt, Human
caccugcggugcuaucuccc

SEQ ID NO: 2941666 - RNA, 23 nt, Human
caccugcggugcuaucuccccca

SEQ ID NO: 2941667 - RNA, 20 nt, Human
caccuggaauauauaaccag

SEQ ID NO: 2941668 - RNA, 19 nt, Human
caccucugcacaagcugca

SEQ ID NO: 2941669 - RNA, 18 nt, Human
caccucugcacaagcugc

SEQ ID NO: 2941670 - RNA, 19 nt, Human
caccucucucacuccuuga

SEQ ID NO: 2941671 - RNA, 18 nt, Human
caccucucucacuccuug

SEQ ID NO: 2941672 - RNA, 17 nt, Human
caccucucucacuccuu

SEQ ID NO: 2941673 - RNA, 15 nt, Human
caccucucucacucc

SEQ ID NO: 2941674 - RNA, 14 nt, Human
caccugaagacuca

SEQ ID NO: 2941675 - RNA, 15 nt, Human
caccugaagacucau

SEQ ID NO: 2941676 - RNA, 23 nt, Human
caccugaagacucauucuucugu

SEQ ID NO: 2941677 - RNA, 15 nt, Human
caccuguagucccag

SEQ ID NO: 2941678 - RNA, 13 nt, Human
caccuggcucugu

SEQ ID NO: 2941679 - RNA, 14 nt, Human
caccuggcucugug

SEQ ID NO: 2941680 - RNA, 15 nt, Human
caccuggcucugugg

SEQ ID NO: 2941681 - RNA, 23 nt, Human
caccuggcucuguggcgagccau

SEQ ID NO: 2941682 - RNA, 23 nt, Human
caccuggccucugcacuccccug

SEQ ID NO: 2941683 - RNA, 12 nt, Human
caccuggcucug

SEQ ID NO: 2941684 - RNA, 20 nt, Human
caccuggccucugcacuccc

SEQ ID NO: 2941685 - RNA, 19 nt, Human
caccuggccucugcacucc

SEQ ID NO: 2941686 - RNA, 18 nt, Human
caccuggccucugcacuc

SEQ ID NO: 2941687 - RNA, 17 nt, Human
caccuggccucugcacu

SEQ ID NO: 2941688 - RNA, 15 nt, Human
caccuggccucugca

SEQ ID NO: 2941689 - RNA, 14 nt, Human
caccuggccucugc

SEQ ID NO: 2941690 - RNA, 13 nt, Human
caccuggccucug

SEQ ID NO: 2941691 - RNA, 12 nt, Human
caccuggccucu

SEQ ID NO: 2941692 - RNA, 18 nt, Human
caccgccuugcccagccu

SEQ ID NO: 2941693 - RNA, 23 nt, Human
caccgccuugcccagccuggaug

SEQ ID NO: 2941694 - RNA, 15 nt, Human
caccgccuugcccag

SEQ ID NO: 2941695 - RNA, 17 nt, Human
caccgccuugcccagcc

SEQ ID NO: 2941696 - RNA, 21 nt, Human
caccgcagacaggaccaggga

SEQ ID NO: 2941697 - RNA, 14 nt, Human
caccgggcacucag

SEQ ID NO: 2941698 - RNA, 20 nt, Human
caccggcuggccuggccccu

SEQ ID NO: 2941699 - RNA, 18 nt, Human
caccggcuggccuggccc

SEQ ID NO: 2941700 - RNA, 17 nt, Human
caccggcuggccuggcc

SEQ ID NO: 2941701 - RNA, 14 nt, Human
caccggcuggccug

SEQ ID NO: 2941702 - RNA, 16 nt, Human
caccggcuggccuggc

SEQ ID NO: 2941703 - RNA, 15 nt, Human
caccggcuggccugg

SEQ ID NO: 2941704 - RNA, 15 nt, Human
caccgggcacucaga

SEQ ID NO: 2941705 - RNA, 22 nt, Human
caccgggcacucagaagacacu

SEQ ID NO: 2941706 - RNA, 15 nt, Human
caccgggccacagag

SEQ ID NO: 2941707 - RNA, 18 nt, Human
caccgggccacagagaaa

SEQ ID NO: 2941708 - RNA, 11 nt, Human
caccucaugga

SEQ ID NO: 2941709 - RNA, 12 nt, Human
caccucauggaa

SEQ ID NO: 2941710 - RNA, 14 nt, Human
caccucauggaauu

SEQ ID NO: 2941711 - RNA, 10 nt, Human
caccucccug

SEQ ID NO: 2941712 - RNA, 22 nt, Human
caccucuaucccggcuuuggug

SEQ ID NO: 2941713 - RNA, 17 nt, Human
caccucucccuuggauu

SEQ ID NO: 2941714 - RNA, 14 nt, Human
caccucucccuugg

SEQ ID NO: 2941715 - RNA, 13 nt, Human
caccucucccuug

SEQ ID NO: 2941716 - RNA, 14 nt, Human
caccuccugccucg

SEQ ID NO: 2941717 - RNA, 13 nt, Human
caccuccugccuc

SEQ ID NO: 2941718 - RNA, 11 nt, Human
caccuccugcc

SEQ ID NO: 2941719 - RNA, 16 nt, Human
caccuccuaaaacaac

SEQ ID NO: 2941720 - RNA, 14 nt, Human
caccucccugcaau

SEQ ID NO: 2941721 - RNA, 13 nt, Human
caccucccugcaa

SEQ ID NO: 2941722 - RNA, 13 nt, Human
caccgcagacagg

SEQ ID NO: 2941723 - RNA, 12 nt, Human
caccgcagacag

SEQ ID NO: 2941724 - RNA, 18 nt, Human
caccgcagacaggaccag

SEQ ID NO: 2941725 - RNA, 17 nt, Human
caccgcagacaggacca

SEQ ID NO: 2941726 - RNA, 15 nt, Human
caccgcagacaggac

SEQ ID NO: 2941727 - RNA, 14 nt, Human
caccgcagacagga

SEQ ID NO: 2941728 - RNA, 22 nt, Human
caccgaaaacguggcugcuuca

SEQ ID NO: 2941729 - RNA, 21 nt, Human
caccgaaaacguggcugcuuc

SEQ ID NO: 2941730 - RNA, 19 nt, Human
caccgaaaacguggcugcu

SEQ ID NO: 2941731 - RNA, 18 nt, Human
caccgaaaacguggcugc

SEQ ID NO: 2941732 - RNA, 15 nt, Human
caccgaaaacguggc

SEQ ID NO: 2941733 - RNA, 23 nt, Human
cacccugugauggggcccugccu

SEQ ID NO: 2941734 - RNA, 22 nt, Human
cacccugugauggggcccugcc

SEQ ID NO: 2941735 - RNA, 21 nt, Human
cacccugugauggggcccugc

SEQ ID NO: 2941736 - RNA, 20 nt, Human
cacccugugauggggcccug

SEQ ID NO: 2941737 - RNA, 18 nt, Human
cacccugugauggggccc

SEQ ID NO: 2941738 - RNA, 15 nt, Human
cacccugugaugggg

SEQ ID NO: 2941739 - RNA, 12 nt, Human
cacccugugaug

SEQ ID NO: 2941740 - RNA, 11 nt, Human
cacccugugau

SEQ ID NO: 2941741 - RNA, 13 nt, Human
cacauauugauuu

SEQ ID NO: 2941742 - RNA, 20 nt, Human
caccccucaacaccucugca

SEQ ID NO: 2941743 - RNA, 12 nt, Human
cacccggccccu

SEQ ID NO: 2941744 - RNA, 19 nt, Human
cacccgcuaagagggaggg

SEQ ID NO: 2941745 - RNA, 13 nt, Human
cacccggccccug

SEQ ID NO: 2941746 - RNA, 14 nt, Human
cacccggccccugc

SEQ ID NO: 2941747 - RNA, 16 nt, Human
cacccggccccugcug

SEQ ID NO: 2941748 - RNA, 17 nt, Human
cacccggccccugcugg

SEQ ID NO: 2941749 - RNA, 18 nt, Human
cacccggccccugcuggu

SEQ ID NO: 2941750 - RNA, 21 nt, Human
cacccggccccugcugguuca

SEQ ID NO: 2941751 - RNA, 20 nt, Human
cacccucagaugcacaugag

SEQ ID NO: 2941752 - RNA, 20 nt, Human
cacauauugauuuccguuaa

SEQ ID NO: 2941753 - RNA, 16 nt, Human
cacgccagauucuuuc

SEQ ID NO: 2941754 - RNA, 20 nt, Human
cagacaguuaagagaaauga

SEQ ID NO: 2941755 - RNA, 19 nt, Human
cagacaccuugacagggca

SEQ ID NO: 2941756 - RNA, 20 nt, Human
cagacaccuugacagggcac

SEQ ID NO: 2941757 - RNA, 22 nt, Human
cagacaccuugacagggcacac

SEQ ID NO: 2941758 - RNA, 19 nt, Human
cagacauacuaaccagcag

SEQ ID NO: 2941759 - RNA, 17 nt, Human
cagacauagaauuaaca

SEQ ID NO: 2941760 - RNA, 19 nt, Human
cagacauagaauuaacaca

SEQ ID NO: 2941761 - RNA, 13 nt, Human
cagacacaggccc

SEQ ID NO: 2941762 - RNA, 14 nt, Human
cagacacaggcccg

SEQ ID NO: 2941763 - RNA, 15 nt, Human
cagacacaggcccgg

SEQ ID NO: 2941764 - RNA, 17 nt, Human
cagacacaggcccggcu

SEQ ID NO: 2941765 - RNA, 18 nt, Human
cagacacaggcccggcuc

SEQ ID NO: 2941766 - RNA, 21 nt, Human
cagacacaggcccggcuccag

SEQ ID NO: 2941767 - RNA, 22 nt, Human
cagacacaggcccggcuccagg

SEQ ID NO: 2941768 - RNA, 23 nt, Human
cagacacaggcccggcuccaggc

SEQ ID NO: 2941769 - RNA, 23 nt, Human
cagacacauguccaagaagccca

SEQ ID NO: 2941770 - RNA, 22 nt, Human
cagacacauguccaagaagccc

SEQ ID NO: 2941771 - RNA, 21 nt, Human
cagacacauguccaagaagcc

SEQ ID NO: 2941772 - RNA, 17 nt, Human
cagacacauguccaaga

SEQ ID NO: 2941773 - RNA, 14 nt, Human
cagacacaugucca

SEQ ID NO: 2941774 - RNA, 22 nt, Human
cagacaaagcgugguggacaug

SEQ ID NO: 2941775 - RNA, 20 nt, Human
cagacaacaaaccuguuucu

SEQ ID NO: 2941776 - RNA, 12 nt, Human
cagacaaagcgu

SEQ ID NO: 2941777 - RNA, 24 nt, Human
cagaauuucccaaagcagugcaug

SEQ ID NO: 2941778 - RNA, 20 nt, Human
cagaauuucccaaagcagug

SEQ ID NO: 2941779 - RNA, 19 nt, Human
cagaauuucccaaagcagu

SEQ ID NO: 2941780 - RNA, 18 nt, Human
cagaauuucccaaagcag

SEQ ID NO: 2941781 - RNA, 17 nt, Human
cagaauuucccaaagca

SEQ ID NO: 2941782 - RNA, 11 nt, Human
cagaauucuca

SEQ ID NO: 2941783 - RNA, 15 nt, Human
cagaauucucuaguu

SEQ ID NO: 2941784 - RNA, 18 nt, Human
cagaauucucuaguuuga

SEQ ID NO: 2941785 - RNA, 14 nt, Human
cagaauuucccaaa

SEQ ID NO: 2941786 - RNA, 16 nt, Human
cagacccggcugcgug

SEQ ID NO: 2941787 - RNA, 12 nt, Human
cagacccugccc

SEQ ID NO: 2941788 - RNA, 14 nt, Human
cagacccugcccug

SEQ ID NO: 2941789 - RNA, 13 nt, Human
cagacccugcccu

SEQ ID NO: 2941790 - RNA, 12 nt, Human
cagacccggcug

SEQ ID NO: 2941791 - RNA, 14 nt, Human
cagacccggcugcg

SEQ ID NO: 2941792 - RNA, 21 nt, Human
cagacccugcccugugggccc

SEQ ID NO: 2941793 - RNA, 17 nt, Human
cagacccugcccugugg

SEQ ID NO: 2941794 - RNA, 16 nt, Human
cagacccugcccugug

SEQ ID NO: 2941795 - RNA, 15 nt, Human
cagacccugcccugu

SEQ ID NO: 2941796 - RNA, 22 nt, Human
cagacccugcccugugggcccc

SEQ ID NO: 2941797 - RNA, 22 nt, Human
cagaccauuggggcucccagcc

SEQ ID NO: 2941798 - RNA, 23 nt, Human
cagaccauuggggcucccagcca

SEQ ID NO: 2941799 - RNA, 20 nt, Human
cagaccauuggggcucccag

SEQ ID NO: 2941800 - RNA, 21 nt, Human
cagaccauuggggcucccagc

SEQ ID NO: 2941801 - RNA, 19 nt, Human
cagaccauuggggcuccca

SEQ ID NO: 2941802 - RNA, 20 nt, Human
cagaccacaaaacuuuucua

SEQ ID NO: 2941803 - RNA, 14 nt, Human
cagaccacaaaacu

SEQ ID NO: 2941804 - RNA, 19 nt, Human
cagagaaaguacuucucca

SEQ ID NO: 2941805 - RNA, 23 nt, Human
cagagaaaguacuucuccacccu

SEQ ID NO: 2941806 - RNA, 18 nt, Human
cagaaaccuuccugcuga

SEQ ID NO: 2941807 - RNA, 18 nt, Human
cagaaagcagaacaguga

SEQ ID NO: 2941808 - RNA, 19 nt, Human
cagaaagcagaacagugau

SEQ ID NO: 2941809 - RNA, 18 nt, Human
cagaacagugauuaccag

SEQ ID NO: 2941810 - RNA, 23 nt, Human
cagaacagugauuaccagggacu

SEQ ID NO: 2941811 - RNA, 23 nt, Human
cagaaaauggaagacagcucuua

SEQ ID NO: 2941812 - RNA, 22 nt, Human
cagaaaauggaagacagcucuu

SEQ ID NO: 2941813 - RNA, 21 nt, Human
cagaaaauggaagacagcucu

SEQ ID NO: 2941814 - RNA, 20 nt, Human
cagaaaauggaagacagcuc

SEQ ID NO: 2941815 - RNA, 16 nt, Human
cagaaaauggaagaca

SEQ ID NO: 2941816 - RNA, 17 nt, Human
cagaaaaguugaauuuu

SEQ ID NO: 2941817 - RNA, 20 nt, Human
cagaaaaguugaauuuuaca

SEQ ID NO: 2941818 - RNA, 22 nt, Human
cagaaaaguugaauuuuacaug

SEQ ID NO: 2941819 - RNA, 22 nt, Human
cacuuuuguucuugguuuguaa

SEQ ID NO: 2941820 - RNA, 14 nt, Human
cacuuuuguucuug

SEQ ID NO: 2941821 - RNA, 16 nt, Human
cacuuugggaggccaa

SEQ ID NO: 2941822 - RNA, 13 nt, Human
cacuuugggaggc

SEQ ID NO: 2941823 - RNA, 12 nt, Human
cacuuugggagg

SEQ ID NO: 2941824 - RNA, 23 nt, Human
cacuuuguucuggcucuuccagg

SEQ ID NO: 2941825 - RNA, 16 nt, Human
cacuuuguucuggcuc

SEQ ID NO: 2941826 - RNA, 14 nt, Human
cacuuuguucuggc

SEQ ID NO: 2941827 - RNA, 13 nt, Human
cacuuuguucugg

SEQ ID NO: 2941828 - RNA, 13 nt, Human
cacuuuggcccag

SEQ ID NO: 2941829 - RNA, 16 nt, Human
cacuuuggcccagggu

SEQ ID NO: 2941830 - RNA, 22 nt, Human
cacuuucuagccagaggagaga

SEQ ID NO: 2941831 - RNA, 19 nt, Human
cagaaggaagacuucaucc

SEQ ID NO: 2941832 - RNA, 18 nt, Human
cagaaggaagacuucauc

SEQ ID NO: 2941833 - RNA, 17 nt, Human
cagaaggaagacuucau

SEQ ID NO: 2941834 - RNA, 16 nt, Human
cagaaggaagacuuca

SEQ ID NO: 2941835 - RNA, 21 nt, Human
cagaaucgcuccaccuugcag

SEQ ID NO: 2941836 - RNA, 23 nt, Human
cagaaucgcuccaccuugcagcu

SEQ ID NO: 2941837 - RNA, 17 nt, Human
cagaaucucaaauaacu

SEQ ID NO: 2941838 - RNA, 18 nt, Human
cagaaucucaaauaacua

SEQ ID NO: 2941839 - RNA, 17 nt, Human
cagaagucaaggcuuag

SEQ ID NO: 2941840 - RNA, 16 nt, Human
cagaagucaaggcuua

SEQ ID NO: 2941841 - RNA, 18 nt, Human
cagaagucaaggcuuaga

SEQ ID NO: 2941842 - RNA, 17 nt, Human
cagaacuauguuuuugu

SEQ ID NO: 2941843 - RNA, 13 nt, Human
cagaagaaaauag

SEQ ID NO: 2941844 - RNA, 19 nt, Human
cagaagaaaauagaauuga

SEQ ID NO: 2941845 - RNA, 22 nt, Human
cagaagaaaauagaauugacau

SEQ ID NO: 2941846 - RNA, 21 nt, Human
cagaagacacugaugggcaac

SEQ ID NO: 2941847 - RNA, 19 nt, Human
cagaagcaacccaaauguu

SEQ ID NO: 2941848 - RNA, 20 nt, Human
cagaagcaacccaaauguuc

SEQ ID NO: 2941849 - RNA, 16 nt, Human
cagacaacaaaccugu

SEQ ID NO: 2941850 - RNA, 14 nt, Human
cagauaaacaguag

SEQ ID NO: 2941851 - RNA, 23 nt, Human
cagauaaauaguuuaugauucca

SEQ ID NO: 2941852 - RNA, 19 nt, Human
cagaguuguuacauuuuua

SEQ ID NO: 2941853 - RNA, 15 nt, Human
cagaguuguuacauu

SEQ ID NO: 2941854 - RNA, 18 nt, Human
cagaguuguuacauuuuu

SEQ ID NO: 2941855 - RNA, 14 nt, Human
cagauaaucacaau

SEQ ID NO: 2941856 - RNA, 22 nt, Human
cagaguugaagacagagcuaca

SEQ ID NO: 2941857 - RNA, 14 nt, Human
cagaguuguuacau

SEQ ID NO: 2941858 - RNA, 20 nt, Human
cagaguugaagacagagcua

SEQ ID NO: 2941859 - RNA, 19 nt, Human
cagaguugaagacagagcu

SEQ ID NO: 2941860 - RNA, 18 nt, Human
cagaguugaagacagagc

SEQ ID NO: 2941861 - RNA, 17 nt, Human
cagaguugaagacagag

SEQ ID NO: 2941862 - RNA, 14 nt, Human
cagaguugaagaca

SEQ ID NO: 2941863 - RNA, 16 nt, Human
cagaguugaagacaga

SEQ ID NO: 2941864 - RNA, 15 nt, Human
cagaguugaagacag

SEQ ID NO: 2941865 - RNA, 17 nt, Human
cagaugcaccagcccuu

SEQ ID NO: 2941866 - RNA, 22 nt, Human
cagaugcaccagcccuuagcag

SEQ ID NO: 2941867 - RNA, 14 nt, Human
cagaugcaccagcc

SEQ ID NO: 2941868 - RNA, 16 nt, Human
cagaugcaccagcccu

SEQ ID NO: 2941869 - RNA, 13 nt, Human
cagaugcaccagc

SEQ ID NO: 2941870 - RNA, 17 nt, Human
cagaugcacaugagcug

SEQ ID NO: 2941871 - RNA, 20 nt, Human
cagauacaggaaaagcugcu

SEQ ID NO: 2941872 - RNA, 21 nt, Human
cagauacaggaaaagcugcug

SEQ ID NO: 2941873 - RNA, 22 nt, Human
cagauacaggaaaagcugcuga

SEQ ID NO: 2941874 - RNA, 13 nt, Human
cagauccuggaaa

SEQ ID NO: 2941875 - RNA, 20 nt, Human
cagaucucuaacuucaccau

SEQ ID NO: 2941876 - RNA, 14 nt, Human
cagauccuggaaau

SEQ ID NO: 2941877 - RNA, 20 nt, Human
cagaggccaugggccuccug

SEQ ID NO: 2941878 - RNA, 21 nt, Human
cagaggccaugggccuccugu

SEQ ID NO: 2941879 - RNA, 23 nt, Human
cagaggcagccccauucugccug

SEQ ID NO: 2941880 - RNA, 19 nt, Human
cagaggccaugggccuccu

SEQ ID NO: 2941881 - RNA, 16 nt, Human
cagaggccaugggccu

SEQ ID NO: 2941882 - RNA, 12 nt, Human
cagaggcagccc

SEQ ID NO: 2941883 - RNA, 13 nt, Human
cagaggcagcccc

SEQ ID NO: 2941884 - RNA, 14 nt, Human
cagaggcagcccca

SEQ ID NO: 2941885 - RNA, 15 nt, Human
cagaggcagccccau

SEQ ID NO: 2941886 - RNA, 18 nt, Human
cagaggcagccccauucu

SEQ ID NO: 2941887 - RNA, 19 nt, Human
cagaggcagccccauucug

SEQ ID NO: 2941888 - RNA, 20 nt, Human
cagaggcagccccauucugc

SEQ ID NO: 2941889 - RNA, 22 nt, Human
cagaggcagccccauucugccu

SEQ ID NO: 2941890 - RNA, 23 nt, Human
cagaggcugccucucccaucacu

SEQ ID NO: 2941891 - RNA, 14 nt, Human
cagagggagugaca

SEQ ID NO: 2941892 - RNA, 16 nt, Human
cagagggagugacaga

SEQ ID NO: 2941893 - RNA, 18 nt, Human
cagagggagugacagagg

SEQ ID NO: 2941894 - RNA, 19 nt, Human
cagagggagugacagaggc

SEQ ID NO: 2941895 - RNA, 13 nt, Human
cagaggcugccuc

SEQ ID NO: 2941896 - RNA, 13 nt, Human
cagagucucacug

SEQ ID NO: 2941897 - RNA, 17 nt, Human
cagagucucacuguugc

SEQ ID NO: 2941898 - RNA, 19 nt, Human
cagagucucacuguugccc

SEQ ID NO: 2941899 - RNA, 20 nt, Human
cagagucucacuguugccca

SEQ ID NO: 2941900 - RNA, 21 nt, Human
cagagucucacuguugcccag

SEQ ID NO: 2941901 - RNA, 19 nt, Human
cagagggccugcaagggag

SEQ ID NO: 2941902 - RNA, 15 nt, Human
cagagggccugcaag

SEQ ID NO: 2941903 - RNA, 20 nt, Human
cagagggagugacagaggca

SEQ ID NO: 2941904 - RNA, 21 nt, Human
cagagggagugacagaggcag

SEQ ID NO: 2941905 - RNA, 22 nt, Human
cagagggagugacagaggcagc

SEQ ID NO: 2941906 - RNA, 23 nt, Human
cagagggagugacagaggcagcc

SEQ ID NO: 2941907 - RNA, 20 nt, Human
cagaguggaauaagacagag

SEQ ID NO: 2941908 - RNA, 12 nt, Human
cagaguggcagu

SEQ ID NO: 2941909 - RNA, 17 nt, Human
cagaguggaauaagaca

SEQ ID NO: 2941910 - RNA, 18 nt, Human
cagaguggaauaagacag

SEQ ID NO: 2941911 - RNA, 21 nt, Human
cagagugcuuuaccaauugaa

SEQ ID NO: 2941912 - RNA, 19 nt, Human
cagagugagacucugucuc

SEQ ID NO: 2941913 - RNA, 20 nt, Human
cagagugagacucugucuca

SEQ ID NO: 2941914 - RNA, 22 nt, Human
cagagucucacuguugcccagg

SEQ ID NO: 2941915 - RNA, 23 nt, Human
cagagucucacuguugcccaggc

SEQ ID NO: 2941916 - RNA, 16 nt, Human
cagagugagacucugu

SEQ ID NO: 2941917 - RNA, 17 nt, Human
cagagugagacucuguc

SEQ ID NO: 2941918 - RNA, 18 nt, Human
cagagugagacucugucu

SEQ ID NO: 2941919 - RNA, 19 nt, Human
cagagaaugaaagggccca

SEQ ID NO: 2941920 - RNA, 15 nt, Human
cagagaauucucuua

SEQ ID NO: 2941921 - RNA, 20 nt, Human
cagagaaugaaagggcccag

SEQ ID NO: 2941922 - RNA, 21 nt, Human
cagagaaugaaagggcccaga

SEQ ID NO: 2941923 - RNA, 21 nt, Human
cagagaagauucuuguauuua

SEQ ID NO: 2941924 - RNA, 13 nt, Human
cagagaccauccc

SEQ ID NO: 2941925 - RNA, 16 nt, Human
cagagaccaucccuga

SEQ ID NO: 2941926 - RNA, 14 nt, Human
cagagaccaucccu

SEQ ID NO: 2941927 - RNA, 15 nt, Human
cagagacacaagccu

SEQ ID NO: 2941928 - RNA, 14 nt, Human
cagagacacaagcc

SEQ ID NO: 2941929 - RNA, 17 nt, Human
cagagacacaagccuuc

SEQ ID NO: 2941930 - RNA, 16 nt, Human
cagagacacaagccuu

SEQ ID NO: 2941931 - RNA, 16 nt, Human
cagagcaccuuagaca

SEQ ID NO: 2941932 - RNA, 20 nt, Human
cagagcaagugagacccugu

SEQ ID NO: 2941933 - RNA, 14 nt, Human
cagagcaagugaga

SEQ ID NO: 2941934 - RNA, 21 nt, Human
cagagaccaucccugaaggcc

SEQ ID NO: 2941935 - RNA, 20 nt, Human
cagagaccaucccugaaggc

SEQ ID NO: 2941936 - RNA, 19 nt, Human
cagagaccaucccugaagg

SEQ ID NO: 2941937 - RNA, 18 nt, Human
cagagaccaucccugaag

SEQ ID NO: 2941938 - RNA, 17 nt, Human
cagagaccaucccugaa

SEQ ID NO: 2941939 - RNA, 13 nt, Human
cagagacuccugc

SEQ ID NO: 2941940 - RNA, 15 nt, Human
cagagacuccugcag

SEQ ID NO: 2941941 - RNA, 14 nt, Human
cagagacuccugca

SEQ ID NO: 2941942 - RNA, 19 nt, Human
cagagacuccugcaggcag

SEQ ID NO: 2941943 - RNA, 18 nt, Human
cagagacuccugcaggca

SEQ ID NO: 2941944 - RNA, 17 nt, Human
cagagacuccugcaggc

SEQ ID NO: 2941945 - RNA, 16 nt, Human
cagagacuccugcagg

SEQ ID NO: 2941946 - RNA, 23 nt, Human
cagagcaccuuagacagucccug

SEQ ID NO: 2941947 - RNA, 12 nt, Human
cagagcagagac

SEQ ID NO: 2941948 - RNA, 11 nt, Human
cagagcagaga

SEQ ID NO: 2941949 - RNA, 22 nt, Human
cagagcaccuuagacagucccu

SEQ ID NO: 2941950 - RNA, 21 nt, Human
cagagcaccuuagacaguccc

SEQ ID NO: 2941951 - RNA, 19 nt, Human
cagagcaccuuagacaguc

SEQ ID NO: 2941952 - RNA, 18 nt, Human
cagagcaccuuagacagu

SEQ ID NO: 2941953 - RNA, 21 nt, Human
cagagcagagaccaucccuga

SEQ ID NO: 2941954 - RNA, 19 nt, Human
cagagcagagaccaucccu

SEQ ID NO: 2941955 - RNA, 18 nt, Human
cagagcagagaccauccc

SEQ ID NO: 2941956 - RNA, 17 nt, Human
cagagcagagaccaucc

SEQ ID NO: 2941957 - RNA, 15 nt, Human
cagagcagagaccau

SEQ ID NO: 2941958 - RNA, 14 nt, Human
cagagcagagacca

SEQ ID NO: 2941959 - RNA, 13 nt, Human
cagagcagagacc

SEQ ID NO: 2941960 - RNA, 15 nt, Human
cagagcccaccuugg

SEQ ID NO: 2941961 - RNA, 17 nt, Human
cagagcccaccuuggcu

SEQ ID NO: 2941962 - RNA, 19 nt, Human
cagagcccaccuuggcuca

SEQ ID NO: 2941963 - RNA, 20 nt, Human
cagagcccaccuuggcucaa

SEQ ID NO: 2941964 - RNA, 16 nt, Human
cagagcccacgccccc

SEQ ID NO: 2941965 - RNA, 13 nt, Human
cagaggagagagg

SEQ ID NO: 2941966 - RNA, 19 nt, Human
cagaggagagaggaccccc

SEQ ID NO: 2941967 - RNA, 15 nt, Human
cagaggagagaggac

SEQ ID NO: 2941968 - RNA, 11 nt, Human
cagaggcagcc

SEQ ID NO: 2941969 - RNA, 20 nt, Human
cagaggagagaggacccccu

SEQ ID NO: 2941970 - RNA, 13 nt, Human
cagaggaaggaga

SEQ ID NO: 2941971 - RNA, 13 nt, Human
cagagccugcagu

SEQ ID NO: 2941972 - RNA, 20 nt, Human
cagaggaaagcaaaggagau

SEQ ID NO: 2941973 - RNA, 12 nt, Human
cagagccugcag

SEQ ID NO: 2941974 - RNA, 20 nt, Human
cagagccccacccucagaug

SEQ ID NO: 2941975 - RNA, 21 nt, Human
cagagcccacgcccccacugg

SEQ ID NO: 2941976 - RNA, 20 nt, Human
cagagcccacgcccccacug

SEQ ID NO: 2941977 - RNA, 19 nt, Human
cagagcccacgcccccacu

SEQ ID NO: 2941978 - RNA, 17 nt, Human
cagagcccacgccccca

SEQ ID NO: 2941979 - RNA, 23 nt, Human
cagagcccacgcccccacuggug

SEQ ID NO: 2941980 - RNA, 15 nt, Human
cagagccccacagcc

SEQ ID NO: 2941981 - RNA, 16 nt, Human
cagagccccacagccc

SEQ ID NO: 2941982 - RNA, 22 nt, Human
cagagccccacagccccaucug

SEQ ID NO: 2941983 - RNA, 13 nt, Human
cagagccccacag

SEQ ID NO: 2941984 - RNA, 16 nt, Human
caggaaguagaggagg

SEQ ID NO: 2941985 - RNA, 15 nt, Human
caggaaguagaggag

SEQ ID NO: 2941986 - RNA, 20 nt, Human
caggaaguacuggagaaaau

SEQ ID NO: 2941987 - RNA, 18 nt, Human
caggaaguacuggagaaa

SEQ ID NO: 2941988 - RNA, 17 nt, Human
caggaaguacuggagaa

SEQ ID NO: 2941989 - RNA, 12 nt, Human
caggaaguacug

SEQ ID NO: 2941990 - RNA, 16 nt, Human
caggaaguacuggaga

SEQ ID NO: 2941991 - RNA, 14 nt, Human
caggaaguacugga

SEQ ID NO: 2941992 - RNA, 15 nt, Human
caggaaggcuaaagg

SEQ ID NO: 2941993 - RNA, 14 nt, Human
caggacgagaugac

SEQ ID NO: 2941994 - RNA, 22 nt, Human
caggaagccagcaggcucucag

SEQ ID NO: 2941995 - RNA, 21 nt, Human
caggaagccagcaggcucuca

SEQ ID NO: 2941996 - RNA, 19 nt, Human
caggaagccagcaggcucu

SEQ ID NO: 2941997 - RNA, 18 nt, Human
caggaagccagcaggcuc

SEQ ID NO: 2941998 - RNA, 17 nt, Human
caggaagccagcaggcu

SEQ ID NO: 2941999 - RNA, 16 nt, Human
caggaagccagcaggc

SEQ ID NO: 2942000 - RNA, 14 nt, Human
caggaagccagcag

SEQ ID NO: 2942001 - RNA, 13 nt, Human
caggaagcucagg

SEQ ID NO: 2942002 - RNA, 15 nt, Human
caggaagcucagggc

SEQ ID NO: 2942003 - RNA, 14 nt, Human
caggaagcucaggg

SEQ ID NO: 2942004 - RNA, 19 nt, Human
caggaagcucagggccugg

SEQ ID NO: 2942005 - RNA, 18 nt, Human
caggaagcucagggccug

SEQ ID NO: 2942006 - RNA, 17 nt, Human
caggaagcucagggccu

SEQ ID NO: 2942007 - RNA, 16 nt, Human
caggaagcucagggcc

SEQ ID NO: 2942008 - RNA, 23 nt, Human
caggaagcucagggccuggcuca

SEQ ID NO: 2942009 - RNA, 21 nt, Human
caggaagcucagggccuggcu

SEQ ID NO: 2942010 - RNA, 20 nt, Human
caggaagcucagggccuggc

SEQ ID NO: 2942011 - RNA, 14 nt, Human
caggaagcugugag

SEQ ID NO: 2942012 - RNA, 13 nt, Human
caggaagcuguga

SEQ ID NO: 2942013 - RNA, 22 nt, Human
caggaagcugugagagcaguuu

SEQ ID NO: 2942014 - RNA, 23 nt, Human
cagcuuuguuuguugucagcuga

SEQ ID NO: 2942015 - RNA, 22 nt, Human
cagcuuuguuuguugucagcug

SEQ ID NO: 2942016 - RNA, 21 nt, Human
cagcuuuguuuguugucagcu

SEQ ID NO: 2942017 - RNA, 12 nt, Human
cagcuuuguuug

SEQ ID NO: 2942018 - RNA, 18 nt, Human
caggaaccacaagacugc

SEQ ID NO: 2942019 - RNA, 18 nt, Human
cagcuuguaaauagcuca

SEQ ID NO: 2942020 - RNA, 19 nt, Human
cagcuuguaaauagcucag

SEQ ID NO: 2942021 - RNA, 20 nt, Human
cagcuuguaaauagcucagg

SEQ ID NO: 2942022 - RNA, 21 nt, Human
cagcuuguaaauagcucaggu

SEQ ID NO: 2942023 - RNA, 22 nt, Human
cagcuuguaaauagcucaggug

SEQ ID NO: 2942024 - RNA, 23 nt, Human
cagcuuuccucaaaacuucagac

SEQ ID NO: 2942025 - RNA, 14 nt, Human
cagcuugaggguug

SEQ ID NO: 2942026 - RNA, 15 nt, Human
cagcuugaggguugg

SEQ ID NO: 2942027 - RNA, 21 nt, Human
cagcuugaccgugaggccaga

SEQ ID NO: 2942028 - RNA, 20 nt, Human
cagcuugaccgugaggccag

SEQ ID NO: 2942029 - RNA, 19 nt, Human
cagcuugaccgugaggcca

SEQ ID NO: 2942030 - RNA, 18 nt, Human
cagcuugaccgugaggcc

SEQ ID NO: 2942031 - RNA, 18 nt, Human
cagcuugaggguugggcu

SEQ ID NO: 2942032 - RNA, 19 nt, Human
cagcuugaggguugggcug

SEQ ID NO: 2942033 - RNA, 20 nt, Human
cagcuugaggguugggcugg

SEQ ID NO: 2942034 - RNA, 21 nt, Human
cagcuugaggguugggcuggu

SEQ ID NO: 2942035 - RNA, 19 nt, Human
cagcuucauuuccuguguc

SEQ ID NO: 2942036 - RNA, 20 nt, Human
cagcuucauuuccugugucu

SEQ ID NO: 2942037 - RNA, 21 nt, Human
cagcuucauuuccugugucuu

SEQ ID NO: 2942038 - RNA, 18 nt, Human
cagcuugaaacugagaug

SEQ ID NO: 2942039 - RNA, 13 nt, Human
cagcucuggucca

SEQ ID NO: 2942040 - RNA, 10 nt, Human
cagcucuggu

SEQ ID NO: 2942041 - RNA, 21 nt, Human
cagcucugguccauagagagc

SEQ ID NO: 2942042 - RNA, 18 nt, Human
cagcucugguccauagag

SEQ ID NO: 2942043 - RNA, 17 nt, Human
cagcucugguccauaga

SEQ ID NO: 2942044 - RNA, 16 nt, Human
cagcucugguccauag

SEQ ID NO: 2942045 - RNA, 12 nt, Human
cagcucuguccu

SEQ ID NO: 2942046 - RNA, 13 nt, Human
cagcucuguccug

SEQ ID NO: 2942047 - RNA, 23 nt, Human
cagcucugguccauagagagcaa

SEQ ID NO: 2942048 - RNA, 22 nt, Human
cagcucugguccauagagagca

SEQ ID NO: 2942049 - RNA, 14 nt, Human
cagcucuguccugg

SEQ ID NO: 2942050 - RNA, 16 nt, Human
cagcucuguccuggga

SEQ ID NO: 2942051 - RNA, 17 nt, Human
cagcucuguccugggag

SEQ ID NO: 2942052 - RNA, 18 nt, Human
cagcucuguccugggagu

SEQ ID NO: 2942053 - RNA, 23 nt, Human
cagcucuguccugggagugagcu

SEQ ID NO: 2942054 - RNA, 21 nt, Human
cagcucuuauauugccauuuc

SEQ ID NO: 2942055 - RNA, 10 nt, Human
cagcucuuau

SEQ ID NO: 2942056 - RNA, 13 nt, Human
cagcucuucucca

SEQ ID NO: 2942057 - RNA, 14 nt, Human
cagcucuucuccag

SEQ ID NO: 2942058 - RNA, 15 nt, Human
cagcucuucuccagg

SEQ ID NO: 2942059 - RNA, 16 nt, Human
cagcucuucuccaggc

SEQ ID NO: 2942060 - RNA, 17 nt, Human
cagcucuucuccaggcu

SEQ ID NO: 2942061 - RNA, 18 nt, Human
cagcucuucuccaggcug

SEQ ID NO: 2942062 - RNA, 19 nt, Human
cagcucuucuccaggcugu

SEQ ID NO: 2942063 - RNA, 23 nt, Human
cagcucuucuccaggcuguaucc

SEQ ID NO: 2942064 - RNA, 20 nt, Human
cagcucagagagggugggag

SEQ ID NO: 2942065 - RNA, 19 nt, Human
cagcucagagaggguggga

SEQ ID NO: 2942066 - RNA, 17 nt, Human
cagcucagagagggugg

SEQ ID NO: 2942067 - RNA, 13 nt, Human
cagcucagagagg

SEQ ID NO: 2942068 - RNA, 16 nt, Human
cagcuccuucuguccu

SEQ ID NO: 2942069 - RNA, 17 nt, Human
cagcuccuucuguccua

SEQ ID NO: 2942070 - RNA, 21 nt, Human
cagcuccuucuguccuacucu

SEQ ID NO: 2942071 - RNA, 23 nt, Human
cagcuccuucuguccuacucugu

SEQ ID NO: 2942072 - RNA, 16 nt, Human
cagcucuccccuucuc

SEQ ID NO: 2942073 - RNA, 16 nt, Human
cagcucugcaagaauu

SEQ ID NO: 2942074 - RNA, 15 nt, Human
cagcucugcaagaau

SEQ ID NO: 2942075 - RNA, 20 nt, Human
cagcucugcauacucauuag

SEQ ID NO: 2942076 - RNA, 21 nt, Human
cagcucugcaagaauugaagc

SEQ ID NO: 2942077 - RNA, 18 nt, Human
cagcugcgguccacccag

SEQ ID NO: 2942078 - RNA, 15 nt, Human
cagcugccugggauc

SEQ ID NO: 2942079 - RNA, 19 nt, Human
cagcugcgguccacccagg

SEQ ID NO: 2942080 - RNA, 20 nt, Human
cagcugcgguccacccagga

SEQ ID NO: 2942081 - RNA, 21 nt, Human
cagcugcgguccacccaggag

SEQ ID NO: 2942082 - RNA, 22 nt, Human
cagcugcgguccacccaggagc

SEQ ID NO: 2942083 - RNA, 23 nt, Human
cagcugcgguccacccaggagcc

SEQ ID NO: 2942084 - RNA, 24 nt, Human
cagcugcgguccacccaggagccc

SEQ ID NO: 2942085 - RNA, 23 nt, Human
cagcugccugggaucccucaucc

SEQ ID NO: 2942086 - RNA, 18 nt, Human
cagcugccugggaucccu

SEQ ID NO: 2942087 - RNA, 17 nt, Human
cagcugcuacuacuccu

SEQ ID NO: 2942088 - RNA, 21 nt, Human
cagcugcugagauccuggacu

SEQ ID NO: 2942089 - RNA, 12 nt, Human
cagcugcugaga

SEQ ID NO: 2942090 - RNA, 19 nt, Human
cagcugcugagauccugga

SEQ ID NO: 2942091 - RNA, 21 nt, Human
cagcugcugaaacaacaaaua

SEQ ID NO: 2942092 - RNA, 20 nt, Human
cagcugcugaaacaacaaau

SEQ ID NO: 2942093 - RNA, 22 nt, Human
cagcugcuugggcuucauccuc

SEQ ID NO: 2942094 - RNA, 21 nt, Human
cagcugcuugggcuucauccu

SEQ ID NO: 2942095 - RNA, 19 nt, Human
cagcugcuugggcuucauc

SEQ ID NO: 2942096 - RNA, 18 nt, Human
cagcugcuugggcuucau

SEQ ID NO: 2942097 - RNA, 16 nt, Human
cagcugcuugggcuuc

SEQ ID NO: 2942098 - RNA, 15 nt, Human
cagcugcuugggcuu

SEQ ID NO: 2942099 - RNA, 14 nt, Human
cagcugcuugggcu

SEQ ID NO: 2942100 - RNA, 13 nt, Human
cagcugcuugggc

SEQ ID NO: 2942101 - RNA, 23 nt, Human
cagcugcuuuugucuaugggacu

SEQ ID NO: 2942102 - RNA, 22 nt, Human
cagcugcuuuugucuaugggac

SEQ ID NO: 2942103 - RNA, 23 nt, Human
cagcugggguggggaccucaggc

SEQ ID NO: 2942104 - RNA, 22 nt, Human
cagcugggguggggaccucagg

SEQ ID NO: 2942105 - RNA, 21 nt, Human
cagcugggguggggaccucag

SEQ ID NO: 2942106 - RNA, 18 nt, Human
cagcuguaugauucccag

SEQ ID NO: 2942107 - RNA, 18 nt, Human
cagcugguugagguuuca

SEQ ID NO: 2942108 - RNA, 22 nt, Human
caggaagcucagggccuggcuc

SEQ ID NO: 2942109 - RNA, 20 nt, Human
cagccugcuccagcuguuca

SEQ ID NO: 2942110 - RNA, 23 nt, Human
cagccucccgaauagcugggacu

SEQ ID NO: 2942111 - RNA, 19 nt, Human
cagccucccgaguagcugg

SEQ ID NO: 2942112 - RNA, 20 nt, Human
cagccucccgaguagcuggg

SEQ ID NO: 2942113 - RNA, 21 nt, Human
cagccucccgaguagcuggga

SEQ ID NO: 2942114 - RNA, 22 nt, Human
cagccucccgaguagcugggac

SEQ ID NO: 2942115 - RNA, 23 nt, Human
cagccucccgaguagcugggacu

SEQ ID NO: 2942116 - RNA, 12 nt, Human
cagccuggaugc

SEQ ID NO: 2942117 - RNA, 15 nt, Human
cagccuggaugccau

SEQ ID NO: 2942118 - RNA, 16 nt, Human
cagccuggaugccauc

SEQ ID NO: 2942119 - RNA, 11 nt, Human
cagccuggaug

SEQ ID NO: 2942120 - RNA, 17 nt, Human
cagccuggaugccaucc

SEQ ID NO: 2942121 - RNA, 21 nt, Human
cagccuggaugccauccaagu

SEQ ID NO: 2942122 - RNA, 19 nt, Human
cagccuggacccuguggau

SEQ ID NO: 2942123 - RNA, 15 nt, Human
cagccuggacccugu

SEQ ID NO: 2942124 - RNA, 19 nt, Human
cagccugggcaacagagca

SEQ ID NO: 2942125 - RNA, 20 nt, Human
cagccugggcaacagagcaa

SEQ ID NO: 2942126 - RNA, 19 nt, Human
cagccugggcaaugugaua

SEQ ID NO: 2942127 - RNA, 16 nt, Human
cagccugggcaaugug

SEQ ID NO: 2942128 - RNA, 24 nt, Human
cagccuugaccauucuccaccugc

SEQ ID NO: 2942129 - RNA, 23 nt, Human
cagccuugaccauucuccaccug

SEQ ID NO: 2942130 - RNA, 22 nt, Human
cagccuugaccauucuccaccu

SEQ ID NO: 2942131 - RNA, 17 nt, Human
cagccuugaccauucuc

SEQ ID NO: 2942132 - RNA, 21 nt, Human
cagccuugaccauucuccacc

SEQ ID NO: 2942133 - RNA, 20 nt, Human
cagccuugaccauucuccac

SEQ ID NO: 2942134 - RNA, 12 nt, Human
cagcucagagag

SEQ ID NO: 2942135 - RNA, 20 nt, Human
cagcucaccucucccuugga

SEQ ID NO: 2942136 - RNA, 19 nt, Human
cagcucaccucucccuugg

SEQ ID NO: 2942137 - RNA, 22 nt, Human
cagcucaccagccccagugccc

SEQ ID NO: 2942138 - RNA, 20 nt, Human
cagcucaccagccccagugc

SEQ ID NO: 2942139 - RNA, 21 nt, Human
cagcucaccagccccagugcc

SEQ ID NO: 2942140 - RNA, 17 nt, Human
cagcucaccucucccuu

SEQ ID NO: 2942141 - RNA, 16 nt, Human
cagcucaccucucccu

SEQ ID NO: 2942142 - RNA, 15 nt, Human
cagcucaccucuccc

SEQ ID NO: 2942143 - RNA, 13 nt, Human
cagcucaccucuc

SEQ ID NO: 2942144 - RNA, 13 nt, Human
cagcucaccagcc

SEQ ID NO: 2942145 - RNA, 15 nt, Human
cagcucaccagcccc

SEQ ID NO: 2942146 - RNA, 16 nt, Human
cagcucaccagcccca

SEQ ID NO: 2942147 - RNA, 17 nt, Human
cagcucaccagccccag

SEQ ID NO: 2942148 - RNA, 19 nt, Human
cagcucaccagccccagug

SEQ ID NO: 2942149 - RNA, 21 nt, Human
cagcgagcccugguggcagug

SEQ ID NO: 2942150 - RNA, 18 nt, Human
cagcuaacauggaaguac

SEQ ID NO: 2942151 - RNA, 19 nt, Human
cagcuaacauggaaguacu

SEQ ID NO: 2942152 - RNA, 13 nt, Human
cagcgagcccugg

SEQ ID NO: 2942153 - RNA, 16 nt, Human
cagcgagcccuggugg

SEQ ID NO: 2942154 - RNA, 17 nt, Human
cagcgagcccugguggc

SEQ ID NO: 2942155 - RNA, 19 nt, Human
cagcgagcccugguggcag

SEQ ID NO: 2942156 - RNA, 20 nt, Human
cagcgagcccugguggcagu

SEQ ID NO: 2942157 - RNA, 20 nt, Human
cagcuaacauggaaguacua

SEQ ID NO: 2942158 - RNA, 15 nt, Human
cagcuaaugggacac

SEQ ID NO: 2942159 - RNA, 16 nt, Human
cagcuaaugggacacu

SEQ ID NO: 2942160 - RNA, 19 nt, Human
cagcuacucgggaggcuga

SEQ ID NO: 2942161 - RNA, 17 nt, Human
cagcuacucgggaggcu

SEQ ID NO: 2942162 - RNA, 23 nt, Human
cagcuacucgggaggcugaggca

SEQ ID NO: 2942163 - RNA, 24 nt, Human
cagcuacucgggaggcugaggcag

SEQ ID NO: 2942164 - RNA, 19 nt, Human
cagcuacuugggaggcuga

SEQ ID NO: 2942165 - RNA, 13 nt, Human
cagccccagugcc

SEQ ID NO: 2942166 - RNA, 14 nt, Human
cagccccagugccc

SEQ ID NO: 2942167 - RNA, 15 nt, Human
cagccccagugccca

SEQ ID NO: 2942168 - RNA, 16 nt, Human
cagccccagugcccac

SEQ ID NO: 2942169 - RNA, 17 nt, Human
cagccccagugcccaca

SEQ ID NO: 2942170 - RNA, 18 nt, Human
cagccccagugcccacag

SEQ ID NO: 2942171 - RNA, 21 nt, Human
cagccccaucccaaacccuuc

SEQ ID NO: 2942172 - RNA, 11 nt, Human
cagccccaucc

SEQ ID NO: 2942173 - RNA, 21 nt, Human
cagccccuguucuggcagagu

SEQ ID NO: 2942174 - RNA, 22 nt, Human
cagccccuggaugcagccucac

SEQ ID NO: 2942175 - RNA, 20 nt, Human
cagccccuguucuggcagag

SEQ ID NO: 2942176 - RNA, 16 nt, Human
cagccccauucugccu

SEQ ID NO: 2942177 - RNA, 17 nt, Human
cagccccauucugccug

SEQ ID NO: 2942178 - RNA, 18 nt, Human
cagccccauucugccugc

SEQ ID NO: 2942179 - RNA, 23 nt, Human
cagccccuggaugcagccucaca

SEQ ID NO: 2942180 - RNA, 13 nt, Human
cagccccauucug

SEQ ID NO: 2942181 - RNA, 14 nt, Human
cagccccauucugc

SEQ ID NO: 2942182 - RNA, 22 nt, Human
cagccccauccucuguacagag

SEQ ID NO: 2942183 - RNA, 16 nt, Human
cagccccauccucugu

SEQ ID NO: 2942184 - RNA, 14 nt, Human
cagccccauccucu

SEQ ID NO: 2942185 - RNA, 13 nt, Human
cagccccauccuc

SEQ ID NO: 2942186 - RNA, 12 nt, Human
cagccccauccu

SEQ ID NO: 2942187 - RNA, 22 nt, Human
cagccccaucccaaacccuuca

SEQ ID NO: 2942188 - RNA, 16 nt, Human
cagcccgggcucugcc

SEQ ID NO: 2942189 - RNA, 15 nt, Human
cagcccgggcucugc

SEQ ID NO: 2942190 - RNA, 14 nt, Human
cagcccgggcucug

SEQ ID NO: 2942191 - RNA, 13 nt, Human
cagcccgggcucu

SEQ ID NO: 2942192 - RNA, 24 nt, Human
cagccccuucugacccaugcugcc

SEQ ID NO: 2942193 - RNA, 23 nt, Human
cagccccuucugacccaugcugc

SEQ ID NO: 2942194 - RNA, 22 nt, Human
cagccccuucugacccaugcug

SEQ ID NO: 2942195 - RNA, 21 nt, Human
cagccccuucugacccaugcu

SEQ ID NO: 2942196 - RNA, 19 nt, Human
cagccccuucugacccaug

SEQ ID NO: 2942197 - RNA, 17 nt, Human
cagccccuucugaccca

SEQ ID NO: 2942198 - RNA, 16 nt, Human
cagccccuucugaccc

SEQ ID NO: 2942199 - RNA, 22 nt, Human
cagcccgggcucugccucccau

SEQ ID NO: 2942200 - RNA, 21 nt, Human
cagcccgggcucugccuccca

SEQ ID NO: 2942201 - RNA, 20 nt, Human
cagcccgggcucugccuccc

SEQ ID NO: 2942202 - RNA, 19 nt, Human
cagcccgggcucugccucc

SEQ ID NO: 2942203 - RNA, 18 nt, Human
cagcccgggcucugccuc

SEQ ID NO: 2942204 - RNA, 17 nt, Human
cagcccgggcucugccu

SEQ ID NO: 2942205 - RNA, 18 nt, Human
cagcccucaauugugaaa

SEQ ID NO: 2942206 - RNA, 13 nt, Human
cagcccucagaau

SEQ ID NO: 2942207 - RNA, 16 nt, Human
cagcccugcagagggc

SEQ ID NO: 2942208 - RNA, 15 nt, Human
cagcccugcagaggg

SEQ ID NO: 2942209 - RNA, 14 nt, Human
cagcccugcagagg

SEQ ID NO: 2942210 - RNA, 13 nt, Human
cagcccugcagag

SEQ ID NO: 2942211 - RNA, 20 nt, Human
cagcccugcagagggcacag

SEQ ID NO: 2942212 - RNA, 18 nt, Human
cagcccugcagagggcac

SEQ ID NO: 2942213 - RNA, 21 nt, Human
cagccguguaaccauggaccc

SEQ ID NO: 2942214 - RNA, 19 nt, Human
cagccucccaaagugcugg

SEQ ID NO: 2942215 - RNA, 20 nt, Human
cagccucccaaagugcuggg

SEQ ID NO: 2942216 - RNA, 21 nt, Human
cagccucccaaagugcuggga

SEQ ID NO: 2942217 - RNA, 23 nt, Human
cagccucccaaagugcugggauu

SEQ ID NO: 2942218 - RNA, 20 nt, Human
cagccucccgaauagcuggg

SEQ ID NO: 2942219 - RNA, 21 nt, Human
cagccucccgaauagcuggga

SEQ ID NO: 2942220 - RNA, 22 nt, Human
cagccucccgaauagcugggac

SEQ ID NO: 2942221 - RNA, 20 nt, Human
cagccucacaguccuuacca

SEQ ID NO: 2942222 - RNA, 15 nt, Human
cagccucacaguccu

SEQ ID NO: 2942223 - RNA, 14 nt, Human
cagccucacagucc

SEQ ID NO: 2942224 - RNA, 19 nt, Human
cagccucaaccuccugggc

SEQ ID NO: 2942225 - RNA, 20 nt, Human
cagccucaaccuccugggcu

SEQ ID NO: 2942226 - RNA, 21 nt, Human
cagccucaaccuccugggcua

SEQ ID NO: 2942227 - RNA, 17 nt, Human
cagccucaaccuccugg

SEQ ID NO: 2942228 - RNA, 18 nt, Human
cagccucaaccuccuggg

SEQ ID NO: 2942229 - RNA, 16 nt, Human
cagccuaguugaucag

SEQ ID NO: 2942230 - RNA, 14 nt, Human
cagauucuuuccug

SEQ ID NO: 2942231 - RNA, 14 nt, Human
cagauuuuccugaa

SEQ ID NO: 2942232 - RNA, 15 nt, Human
cagauuuuccugaaa

SEQ ID NO: 2942233 - RNA, 18 nt, Human
cagcaaaagaugcuucuc

SEQ ID NO: 2942234 - RNA, 23 nt, Human
cagcaacacaaagcuuuugcaua

SEQ ID NO: 2942235 - RNA, 15 nt, Human
cagcaacacaaagcu

SEQ ID NO: 2942236 - RNA, 23 nt, Human
cagcaacgcaggcccccaggugc

SEQ ID NO: 2942237 - RNA, 18 nt, Human
cagaugggugcuuggagg

SEQ ID NO: 2942238 - RNA, 23 nt, Human
cagaugggugcuuggaggaagga

SEQ ID NO: 2942239 - RNA, 20 nt, Human
cagcacuuugggaggcugag

SEQ ID NO: 2942240 - RNA, 18 nt, Human
cagcacuuugggaggcug

SEQ ID NO: 2942241 - RNA, 17 nt, Human
cagcacuuugggaggcu

SEQ ID NO: 2942242 - RNA, 15 nt, Human
cagcagaaaugccuu

SEQ ID NO: 2942243 - RNA, 17 nt, Human
cagcagaaaugccuuac

SEQ ID NO: 2942244 - RNA, 12 nt, Human
cagcagacacau

SEQ ID NO: 2942245 - RNA, 19 nt, Human
cagcagaaaugccuuaccc

SEQ ID NO: 2942246 - RNA, 22 nt, Human
cagcagaaaugccuuacccuca

SEQ ID NO: 2942247 - RNA, 13 nt, Human
cagcagagcaccu

SEQ ID NO: 2942248 - RNA, 11 nt, Human
cagcagagcac

SEQ ID NO: 2942249 - RNA, 11 nt, Human
cagcagagugc

SEQ ID NO: 2942250 - RNA, 15 nt, Human
cagcagagugcuuua

SEQ ID NO: 2942251 - RNA, 9 nt, Human
cagcagagu

SEQ ID NO: 2942252 - RNA, 10 nt, Human
cagcagagug

SEQ ID NO: 2942253 - RNA, 19 nt, Human
cagcacaaggaaauaaaau

SEQ ID NO: 2942254 - RNA, 19 nt, Human
cagcaauuaugaaaauaau

SEQ ID NO: 2942255 - RNA, 16 nt, Human
cagcaauuaugaaaau

SEQ ID NO: 2942256 - RNA, 22 nt, Human
cagcaauaaagcagcguuucua

SEQ ID NO: 2942257 - RNA, 19 nt, Human
cagcaagugagagcugggu

SEQ ID NO: 2942258 - RNA, 21 nt, Human
cagcaagugagagcugggugu

SEQ ID NO: 2942259 - RNA, 13 nt, Human
cagcaauaaagca

SEQ ID NO: 2942260 - RNA, 21 nt, Human
cagcaauaaagcagcguuucu

SEQ ID NO: 2942261 - RNA, 17 nt, Human
cagcaaggagauuuaca

SEQ ID NO: 2942262 - RNA, 18 nt, Human
cagcaaggagauuuacaa

SEQ ID NO: 2942263 - RNA, 19 nt, Human
cagcaagggugaugggaaa

SEQ ID NO: 2942264 - RNA, 14 nt, Human
cagcaagugagagc

SEQ ID NO: 2942265 - RNA, 15 nt, Human
cagcaagugagagcu

SEQ ID NO: 2942266 - RNA, 16 nt, Human
cagcaagugagagcug

SEQ ID NO: 2942267 - RNA, 17 nt, Human
cagcaagugagagcugg

SEQ ID NO: 2942268 - RNA, 12 nt, Human
cagcaagugaga

SEQ ID NO: 2942269 - RNA, 23 nt, Human
cagcaagggugaugggaaagcau

SEQ ID NO: 2942270 - RNA, 22 nt, Human
cagcaagggugaugggaaagca

SEQ ID NO: 2942271 - RNA, 21 nt, Human
cagccaaagccuccuccagcc

SEQ ID NO: 2942272 - RNA, 18 nt, Human
cagccaaagccuccucca

SEQ ID NO: 2942273 - RNA, 16 nt, Human
cagccaaagccuccuc

SEQ ID NO: 2942274 - RNA, 15 nt, Human
cagccaaagccuccu

SEQ ID NO: 2942275 - RNA, 21 nt, Human
cagcauccuggcacccggccc

SEQ ID NO: 2942276 - RNA, 19 nt, Human
cagcauccuggcacccggc

SEQ ID NO: 2942277 - RNA, 20 nt, Human
cagcauccuggcacccggcc

SEQ ID NO: 2942278 - RNA, 14 nt, Human
cagcauccuggcac

SEQ ID NO: 2942279 - RNA, 15 nt, Human
cagcauccuggcacc

SEQ ID NO: 2942280 - RNA, 16 nt, Human
cagcauccuggcaccc

SEQ ID NO: 2942281 - RNA, 17 nt, Human
cagcauccuggcacccg

SEQ ID NO: 2942282 - RNA, 20 nt, Human
cagcagggagggcuucugcc

SEQ ID NO: 2942283 - RNA, 20 nt, Human
cagcaggcugccagugccug

SEQ ID NO: 2942284 - RNA, 19 nt, Human
cagcaggcucucaggccag

SEQ ID NO: 2942285 - RNA, 18 nt, Human
cagcaggcucucaggcca

SEQ ID NO: 2942286 - RNA, 17 nt, Human
cagcaggcucucaggcc

SEQ ID NO: 2942287 - RNA, 16 nt, Human
cagcaggcucucaggc

SEQ ID NO: 2942288 - RNA, 22 nt, Human
cagcaggcucucaggccagcug

SEQ ID NO: 2942289 - RNA, 20 nt, Human
cagcaggcucucaggccagc

SEQ ID NO: 2942290 - RNA, 18 nt, Human
cagcagggagggcuucug

SEQ ID NO: 2942291 - RNA, 13 nt, Human
cagcaggcugcca

SEQ ID NO: 2942292 - RNA, 14 nt, Human
cagcaggcugccag

SEQ ID NO: 2942293 - RNA, 15 nt, Human
cagcaggcugccagu

SEQ ID NO: 2942294 - RNA, 18 nt, Human
cagcaggcugccagugcc

SEQ ID NO: 2942295 - RNA, 19 nt, Human
cagcaggcugccagugccu

SEQ ID NO: 2942296 - RNA, 12 nt, Human
cagcaggcucuc

SEQ ID NO: 2942297 - RNA, 15 nt, Human
cagcaggcucucagg

SEQ ID NO: 2942298 - RNA, 14 nt, Human
cagcaggcucucag

SEQ ID NO: 2942299 - RNA, 22 nt, Human
cagcagccuggacccuguggau

SEQ ID NO: 2942300 - RNA, 19 nt, Human
cagcagccuggacccugug

SEQ ID NO: 2942301 - RNA, 18 nt, Human
cagcagccuggacccugu

SEQ ID NO: 2942302 - RNA, 15 nt, Human
cagcagccuggaccc

SEQ ID NO: 2942303 - RNA, 14 nt, Human
cagcagccuggacc

SEQ ID NO: 2942304 - RNA, 12 nt, Human
cagcagccugga

SEQ ID NO: 2942305 - RNA, 14 nt, Human
cagccacauuccug

SEQ ID NO: 2942306 - RNA, 19 nt, Human
cagccacauuccugaugcu

SEQ ID NO: 2942307 - RNA, 17 nt, Human
cagccacauuccugaug

SEQ ID NO: 2942308 - RNA, 15 nt, Human
cagccacauuccuga

SEQ ID NO: 2942309 - RNA, 23 nt, Human
cagccacggccaggccagaggga

SEQ ID NO: 2942310 - RNA, 22 nt, Human
cagccaguaaaugggggugcau

SEQ ID NO: 2942311 - RNA, 13 nt, Human
cagccaguaaaug

SEQ ID NO: 2942312 - RNA, 14 nt, Human
cagccacggccagg

SEQ ID NO: 2942313 - RNA, 15 nt, Human
cagccacggccaggc

SEQ ID NO: 2942314 - RNA, 16 nt, Human
cagccacggccaggcc

SEQ ID NO: 2942315 - RNA, 17 nt, Human
cagccacggccaggcca

SEQ ID NO: 2942316 - RNA, 18 nt, Human
cagccacggccaggccag

SEQ ID NO: 2942317 - RNA, 19 nt, Human
cagccacggccaggccaga

SEQ ID NO: 2942318 - RNA, 21 nt, Human
cagccacggccaggccagagg

SEQ ID NO: 2942319 - RNA, 22 nt, Human
cagccacggccaggccagaggg

SEQ ID NO: 2942320 - RNA, 15 nt, Human
cagcccacuucugcc

SEQ ID NO: 2942321 - RNA, 15 nt, Human
cagcccaccccucaa

SEQ ID NO: 2942322 - RNA, 18 nt, Human
cagcccacuucugccaua

SEQ ID NO: 2942323 - RNA, 22 nt, Human
cagccccaaaacucuccucugc

SEQ ID NO: 2942324 - RNA, 21 nt, Human
cagccccaaaacucuccucug

SEQ ID NO: 2942325 - RNA, 20 nt, Human
cagccccaaaacucuccucu

SEQ ID NO: 2942326 - RNA, 14 nt, Human
cagcucaccagccc

SEQ ID NO: 2942327 - RNA, 12 nt, Human
cagggccucugc

SEQ ID NO: 2942328 - RNA, 13 nt, Human
cagggccucugcg

SEQ ID NO: 2942329 - RNA, 14 nt, Human
cagggccucugcgg

SEQ ID NO: 2942330 - RNA, 15 nt, Human
cagggccucugcgga

SEQ ID NO: 2942331 - RNA, 17 nt, Human
cagggccucugcggagc

SEQ ID NO: 2942332 - RNA, 20 nt, Human
cagggccaugucagacacag

SEQ ID NO: 2942333 - RNA, 21 nt, Human
cagggccaugucagacacaga

SEQ ID NO: 2942334 - RNA, 17 nt, Human
cagggccaugucagaca

SEQ ID NO: 2942335 - RNA, 14 nt, Human
cagggcaucuggga

SEQ ID NO: 2942336 - RNA, 17 nt, Human
cagggcauggcugggaa

SEQ ID NO: 2942337 - RNA, 22 nt, Human
cagggcacaccgggcacucaga

SEQ ID NO: 2942338 - RNA, 23 nt, Human
cagggcacaccgggcacucagaa

SEQ ID NO: 2942339 - RNA, 15 nt, Human
cagggcacaccgggc

SEQ ID NO: 2942340 - RNA, 17 nt, Human
cagggcacaccgggcac

SEQ ID NO: 2942341 - RNA, 19 nt, Human
cagggcacaccgggcacuc

SEQ ID NO: 2942342 - RNA, 21 nt, Human
cagggcacaccgggcacucag

SEQ ID NO: 2942343 - RNA, 14 nt, Human
cagggcacaccggg

SEQ ID NO: 2942344 - RNA, 23 nt, Human
cagggacagaggggguggccucc

SEQ ID NO: 2942345 - RNA, 18 nt, Human
cagggacaggauaagagg

SEQ ID NO: 2942346 - RNA, 19 nt, Human
caggggaggguagagcgga

SEQ ID NO: 2942347 - RNA, 19 nt, Human
cagggccuggcucaggugg

SEQ ID NO: 2942348 - RNA, 16 nt, Human
cagggccuggcucagg

SEQ ID NO: 2942349 - RNA, 21 nt, Human
cagggccucugcggagcacac

SEQ ID NO: 2942350 - RNA, 13 nt, Human
cagggccuggcuc

SEQ ID NO: 2942351 - RNA, 15 nt, Human
cagggccuggcucag

SEQ ID NO: 2942352 - RNA, 14 nt, Human
cagggccuggcuca

SEQ ID NO: 2942353 - RNA, 11 nt, Human
caggggacagg

SEQ ID NO: 2942354 - RNA, 16 nt, Human
caggggacaggauggu

SEQ ID NO: 2942355 - RNA, 13 nt, Human
cagggacagaggg

SEQ ID NO: 2942356 - RNA, 20 nt, Human
cagggacagaggggguggcc

SEQ ID NO: 2942357 - RNA, 14 nt, Human
cagggacagagggg

SEQ ID NO: 2942358 - RNA, 16 nt, Human
cagggaaacagcuaau

SEQ ID NO: 2942359 - RNA, 22 nt, Human
cagggaaacagcuaaugggaca

SEQ ID NO: 2942360 - RNA, 12 nt, Human
caggcugccagu

SEQ ID NO: 2942361 - RNA, 21 nt, Human
caggcugccagugccugggug

SEQ ID NO: 2942362 - RNA, 19 nt, Human
caggcugccagugccuggg

SEQ ID NO: 2942363 - RNA, 20 nt, Human
caggcugccagugccugggu

SEQ ID NO: 2942364 - RNA, 14 nt, Human
caggcugccagugc

SEQ ID NO: 2942365 - RNA, 16 nt, Human
caggcugccagugccu

SEQ ID NO: 2942366 - RNA, 17 nt, Human
caggcugccagugccug

SEQ ID NO: 2942367 - RNA, 16 nt, Human
caggcuggaguuauug

SEQ ID NO: 2942368 - RNA, 13 nt, Human
caggcuggaguua

SEQ ID NO: 2942369 - RNA, 23 nt, Human
caggcugggcuucaguggcagcu

SEQ ID NO: 2942370 - RNA, 23 nt, Human
caggcuuagucacugagacagcc

SEQ ID NO: 2942371 - RNA, 22 nt, Human
caggcuuagucacugagacagc

SEQ ID NO: 2942372 - RNA, 12 nt, Human
caggcuggucuc

SEQ ID NO: 2942373 - RNA, 19 nt, Human
caggcuggucucaaacucu

SEQ ID NO: 2942374 - RNA, 14 nt, Human
caggcuguauccca

SEQ ID NO: 2942375 - RNA, 20 nt, Human
caggcuguaucccaugagcc

SEQ ID NO: 2942376 - RNA, 21 nt, Human
caggcuguaucccaugagccu

SEQ ID NO: 2942377 - RNA, 22 nt, Human
caggcuguaucccaugagccuc

SEQ ID NO: 2942378 - RNA, 23 nt, Human
caggcuguaucccaugagccuca

SEQ ID NO: 2942379 - RNA, 21 nt, Human
caggcuuagucacugagacag

SEQ ID NO: 2942380 - RNA, 20 nt, Human
caggcuuagucacugagaca

SEQ ID NO: 2942381 - RNA, 17 nt, Human
caggcuuagucacugag

SEQ ID NO: 2942382 - RNA, 16 nt, Human
caggcuuagucacuga

SEQ ID NO: 2942383 - RNA, 20 nt, Human
caggcccuugucggccccac

SEQ ID NO: 2942384 - RNA, 22 nt, Human
caggcccucugcccacucccug

SEQ ID NO: 2942385 - RNA, 21 nt, Human
caggcccucugcccacucccu

SEQ ID NO: 2942386 - RNA, 20 nt, Human
caggcccucugcccacuccc

SEQ ID NO: 2942387 - RNA, 19 nt, Human
caggcccucugcccacucc

SEQ ID NO: 2942388 - RNA, 17 nt, Human
caggcccucugcccacu

SEQ ID NO: 2942389 - RNA, 16 nt, Human
caggcccucugcccac

SEQ ID NO: 2942390 - RNA, 22 nt, Human
caggcccggcuccaggcuccuu

SEQ ID NO: 2942391 - RNA, 20 nt, Human
caggcccggcuccaggcucc

SEQ ID NO: 2942392 - RNA, 21 nt, Human
caggcccggcuccaggcuccu

SEQ ID NO: 2942393 - RNA, 15 nt, Human
caggcccucugccca

SEQ ID NO: 2942394 - RNA, 14 nt, Human
caggcccucugccc

SEQ ID NO: 2942395 - RNA, 13 nt, Human
caggcccucugcc

SEQ ID NO: 2942396 - RNA, 17 nt, Human
caggcccggcuccaggc

SEQ ID NO: 2942397 - RNA, 16 nt, Human
caggcccggcuccagg

SEQ ID NO: 2942398 - RNA, 18 nt, Human
caggcccggcuccaggcu

SEQ ID NO: 2942399 - RNA, 19 nt, Human
caggcccggcuccaggcuc

SEQ ID NO: 2942400 - RNA, 23 nt, Human
caggcucucaggccagcugcuug

SEQ ID NO: 2942401 - RNA, 21 nt, Human
caggcucucaggccagcugcu

SEQ ID NO: 2942402 - RNA, 20 nt, Human
caggcucucaggccagcugc

SEQ ID NO: 2942403 - RNA, 19 nt, Human
caggcucucaggccagcug

SEQ ID NO: 2942404 - RNA, 18 nt, Human
caggcucucaggccagcu

SEQ ID NO: 2942405 - RNA, 17 nt, Human
caggcucucaggccagc

SEQ ID NO: 2942406 - RNA, 21 nt, Human
caggcuccuuuagcgcccagu

SEQ ID NO: 2942407 - RNA, 12 nt, Human
caggcucucagg

SEQ ID NO: 2942408 - RNA, 20 nt, Human
caggcucgggcuccccagcc

SEQ ID NO: 2942409 - RNA, 16 nt, Human
caggcucucaggccag

SEQ ID NO: 2942410 - RNA, 15 nt, Human
caggcucucaggcca

SEQ ID NO: 2942411 - RNA, 14 nt, Human
caggcucucaggcc

SEQ ID NO: 2942412 - RNA, 13 nt, Human
caggcucucaggc

SEQ ID NO: 2942413 - RNA, 14 nt, Human
caggcuccuuuagc

SEQ ID NO: 2942414 - RNA, 19 nt, Human
caggcuccuuuagcgccca

SEQ ID NO: 2942415 - RNA, 20 nt, Human
caggcuccuuuagcgcccag

SEQ ID NO: 2942416 - RNA, 14 nt, Human
caggcuacugucag

SEQ ID NO: 2942417 - RNA, 13 nt, Human
caggcuagaugua

SEQ ID NO: 2942418 - RNA, 19 nt, Human
caggcuagauguauguacu

SEQ ID NO: 2942419 - RNA, 23 nt, Human
caggagaucgagaccauccuggc

SEQ ID NO: 2942420 - RNA, 23 nt, Human
caggagacuggcgugaacccagg

SEQ ID NO: 2942421 - RNA, 22 nt, Human
caggagacuggcgugaacccag

SEQ ID NO: 2942422 - RNA, 23 nt, Human
caggagccccgaggccuucucug

SEQ ID NO: 2942423 - RNA, 20 nt, Human
caggagccccgaggccuucu

SEQ ID NO: 2942424 - RNA, 22 nt, Human
caggagccccgaggccuucucu

SEQ ID NO: 2942425 - RNA, 15 nt, Human
caggagccccgaggc

SEQ ID NO: 2942426 - RNA, 16 nt, Human
caggagccccgaggcc

SEQ ID NO: 2942427 - RNA, 18 nt, Human
caggagccccgaggccuu

SEQ ID NO: 2942428 - RNA, 19 nt, Human
caggagcagccacauuccu

SEQ ID NO: 2942429 - RNA, 14 nt, Human
caggagcagccaca

SEQ ID NO: 2942430 - RNA, 13 nt, Human
caggagcagccac

SEQ ID NO: 2942431 - RNA, 12 nt, Human
caggagcagcca

SEQ ID NO: 2942432 - RNA, 20 nt, Human
caggagccuccugcccuuac

SEQ ID NO: 2942433 - RNA, 17 nt, Human
caggagccuccugcccu

SEQ ID NO: 2942434 - RNA, 14 nt, Human
caggagccuccugc

SEQ ID NO: 2942435 - RNA, 12 nt, Human
caggagugagca

SEQ ID NO: 2942436 - RNA, 21 nt, Human
caggaguuugagaccaaccug

SEQ ID NO: 2942437 - RNA, 14 nt, Human
caggaguuuggcca

SEQ ID NO: 2942438 - RNA, 13 nt, Human
caggaguuuggcc

SEQ ID NO: 2942439 - RNA, 23 nt, Human
caggaguuugagaccaaccuggg

SEQ ID NO: 2942440 - RNA, 22 nt, Human
caggaguuugagaccaaccugg

SEQ ID NO: 2942441 - RNA, 17 nt, Human
caggaguuuggccagaa

SEQ ID NO: 2942442 - RNA, 16 nt, Human
caggaguuuggccaga

SEQ ID NO: 2942443 - RNA, 15 nt, Human
caggaguuuggccag

SEQ ID NO: 2942444 - RNA, 14 nt, Human
caggaucagucuga

SEQ ID NO: 2942445 - RNA, 13 nt, Human
caggaucagucug

SEQ ID NO: 2942446 - RNA, 21 nt, Human
caggauauucucacagcucca

SEQ ID NO: 2942447 - RNA, 23 nt, Human
caggauggccgggcgcgguggcu

SEQ ID NO: 2942448 - RNA, 17 nt, Human
caggauucuuccucccu

SEQ ID NO: 2942449 - RNA, 18 nt, Human
caggauucuuccucccuc

SEQ ID NO: 2942450 - RNA, 21 nt, Human
caggaugguucccuugaugaa

SEQ ID NO: 2942451 - RNA, 23 nt, Human
caggaugguucccuugaugaaga

SEQ ID NO: 2942452 - RNA, 17 nt, Human
caggcaugguggcccac

SEQ ID NO: 2942453 - RNA, 23 nt, Human
caggcaggucuugaacuccuggc

SEQ ID NO: 2942454 - RNA, 15 nt, Human
caggcaggugggaug

SEQ ID NO: 2942455 - RNA, 13 nt, Human
caggcaggucuug

SEQ ID NO: 2942456 - RNA, 22 nt, Human
caggcaggucuugaacuccugg

SEQ ID NO: 2942457 - RNA, 14 nt, Human
caggcagguccagg

SEQ ID NO: 2942458 - RNA, 15 nt, Human
caggcagguccaggg

SEQ ID NO: 2942459 - RNA, 19 nt, Human
caggcagguccaggguuug

SEQ ID NO: 2942460 - RNA, 12 nt, Human
caggcaggucuu

SEQ ID NO: 2942461 - RNA, 24 nt, Human
caggcauuccccaggaggccagcc

SEQ ID NO: 2942462 - RNA, 23 nt, Human
caggcauuccccaggaggccagc

SEQ ID NO: 2942463 - RNA, 22 nt, Human
caggcauuccccaggaggccag

SEQ ID NO: 2942464 - RNA, 21 nt, Human
caggcauuccccaggaggcca

SEQ ID NO: 2942465 - RNA, 20 nt, Human
caggcauuccccaggaggcc

SEQ ID NO: 2942466 - RNA, 19 nt, Human
caggcauuccccaggaggc

SEQ ID NO: 2942467 - RNA, 18 nt, Human
caggcauuccccaggagg

SEQ ID NO: 2942468 - RNA, 15 nt, Human
caggcauguucucug

SEQ ID NO: 2942469 - RNA, 18 nt, Human
caggcauguucucugagg

SEQ ID NO: 2942470 - RNA, 19 nt, Human
caggcauguucucugagga

SEQ ID NO: 2942471 - RNA, 20 nt, Human
caggcauguucucugaggac

SEQ ID NO: 2942472 - RNA, 17 nt, Human
caggcauuccccaggag

SEQ ID NO: 2942473 - RNA, 16 nt, Human
caggcauuccccagga

SEQ ID NO: 2942474 - RNA, 15 nt, Human
caggcauuccccagg

SEQ ID NO: 2942475 - RNA, 13 nt, Human
caggcauucccca

SEQ ID NO: 2942476 - RNA, 17 nt, Human
caggcagccaggccaca

SEQ ID NO: 2942477 - RNA, 16 nt, Human
caggcagccaggccac

SEQ ID NO: 2942478 - RNA, 13 nt, Human
caggcagguccag

SEQ ID NO: 2942479 - RNA, 14 nt, Human
caggcaagcaccuc

SEQ ID NO: 2942480 - RNA, 15 nt, Human
caggcaagcaccucc

SEQ ID NO: 2942481 - RNA, 16 nt, Human
caggcaagcaccuccu

SEQ ID NO: 2942482 - RNA, 21 nt, Human
caggcaagcaccuccugccuc

SEQ ID NO: 2942483 - RNA, 15 nt, Human
caggcagccaggcca

SEQ ID NO: 2942484 - RNA, 14 nt, Human
caggcagccaggcc

SEQ ID NO: 2942485 - RNA, 20 nt, Human
caggauucuuccucccuccc

SEQ ID NO: 2942486 - RNA, 16 nt, Human
caggauuuuaaucuuu

SEQ ID NO: 2942487 - RNA, 13 nt, Human
caggcccggcucc

SEQ ID NO: 2942488 - RNA, 14 nt, Human
caggcccggcucca

SEQ ID NO: 2942489 - RNA, 15 nt, Human
caggcccggcuccag

SEQ ID NO: 2942490 - RNA, 15 nt, Human
caggccccugccacc

SEQ ID NO: 2942491 - RNA, 17 nt, Human
caggccccugccacccu

SEQ ID NO: 2942492 - RNA, 19 nt, Human
caggccccugccacccugg

SEQ ID NO: 2942493 - RNA, 20 nt, Human
caggccccugccacccuggg

SEQ ID NO: 2942494 - RNA, 23 nt, Human
caggccaaacucaccugccccuc

SEQ ID NO: 2942495 - RNA, 18 nt, Human
caggccaaacucaccugc

SEQ ID NO: 2942496 - RNA, 13 nt, Human
caggccacaagac

SEQ ID NO: 2942497 - RNA, 18 nt, Human
caggccacaagacccuug

SEQ ID NO: 2942498 - RNA, 17 nt, Human
caggccacaagacccuu

SEQ ID NO: 2942499 - RNA, 20 nt, Human
caggccacaagacccuugug

SEQ ID NO: 2942500 - RNA, 22 nt, Human
caggccaggcccucugcccacu

SEQ ID NO: 2942501 - RNA, 21 nt, Human
caggccaggcccucugcccac

SEQ ID NO: 2942502 - RNA, 13 nt, Human
caggccccugcca

SEQ ID NO: 2942503 - RNA, 20 nt, Human
caggcccccaggugccaguu

SEQ ID NO: 2942504 - RNA, 19 nt, Human
caggcccccaggugccagu

SEQ ID NO: 2942505 - RNA, 14 nt, Human
caggcccccaggug

SEQ ID NO: 2942506 - RNA, 17 nt, Human
caguccucccaucucac

SEQ ID NO: 2942507 - RNA, 16 nt, Human
caguccucccaucuca

SEQ ID NO: 2942508 - RNA, 14 nt, Human
caguccugcccgcc

SEQ ID NO: 2942509 - RNA, 18 nt, Human
cagucuggaaugcagugg

SEQ ID NO: 2942510 - RNA, 21 nt, Human
caguccuuaccagcagagcac

SEQ ID NO: 2942511 - RNA, 20 nt, Human
caguccuuaccagcagagca

SEQ ID NO: 2942512 - RNA, 19 nt, Human
caguccuuaccagcagagc

SEQ ID NO: 2942513 - RNA, 15 nt, Human
caguccugcccgcca

SEQ ID NO: 2942514 - RNA, 18 nt, Human
caguccuuaccagcagag

SEQ ID NO: 2942515 - RNA, 15 nt, Human
caguccuuaccagca

SEQ ID NO: 2942516 - RNA, 19 nt, Human
cagucuggaaugcaguggu

SEQ ID NO: 2942517 - RNA, 20 nt, Human
cagugaaagaaaauaacaau

SEQ ID NO: 2942518 - RNA, 16 nt, Human
cagugaaagaaaauaa

SEQ ID NO: 2942519 - RNA, 24 nt, Human
cagugagccgagauugcaccacug

SEQ ID NO: 2942520 - RNA, 12 nt, Human
cagugaggcucu

SEQ ID NO: 2942521 - RNA, 16 nt, Human
cagugaggcucugccc

SEQ ID NO: 2942522 - RNA, 15 nt, Human
cagugaggcucugcc

SEQ ID NO: 2942523 - RNA, 14 nt, Human
cagugaggcucugc

SEQ ID NO: 2942524 - RNA, 13 nt, Human
cagugaggcucug

SEQ ID NO: 2942525 - RNA, 21 nt, Human
cagugaggcucugcccuuggu

SEQ ID NO: 2942526 - RNA, 17 nt, Human
cagugagucgaggacag

SEQ ID NO: 2942527 - RNA, 18 nt, Human
cagugagucgaggacagg

SEQ ID NO: 2942528 - RNA, 20 nt, Human
cagugaggcucugcccuugg

SEQ ID NO: 2942529 - RNA, 19 nt, Human
cagugaggcucugcccuug

SEQ ID NO: 2942530 - RNA, 18 nt, Human
cagugaggcucugcccuu

SEQ ID NO: 2942531 - RNA, 17 nt, Human
cagugaggcucugcccu

SEQ ID NO: 2942532 - RNA, 15 nt, Human
cagugagacagcucu

SEQ ID NO: 2942533 - RNA, 22 nt, Human
cagugccuggguggaugggcca

SEQ ID NO: 2942534 - RNA, 13 nt, Human
cagugccuuaugg

SEQ ID NO: 2942535 - RNA, 11 nt, Human
cagugccuuau

SEQ ID NO: 2942536 - RNA, 18 nt, Human
cagugccgagaaggaagc

SEQ ID NO: 2942537 - RNA, 15 nt, Human
cagugccgagaagga

SEQ ID NO: 2942538 - RNA, 12 nt, Human
cagugccucucc

SEQ ID NO: 2942539 - RNA, 20 nt, Human
cagugccucucccugcugcu

SEQ ID NO: 2942540 - RNA, 21 nt, Human
cagugccucucccugcugcuc

SEQ ID NO: 2942541 - RNA, 22 nt, Human
cagugccucucccugcugcucc

SEQ ID NO: 2942542 - RNA, 22 nt, Human
cagugccuuauggaacacucug

SEQ ID NO: 2942543 - RNA, 21 nt, Human
cagugccuuauggaacacucu

SEQ ID NO: 2942544 - RNA, 20 nt, Human
cagugccuuauggaacacuc

SEQ ID NO: 2942545 - RNA, 19 nt, Human
cagugccuuauggaacacu

SEQ ID NO: 2942546 - RNA, 18 nt, Human
cagugccuuauggaacac

SEQ ID NO: 2942547 - RNA, 17 nt, Human
cagugccuuauggaaca

SEQ ID NO: 2942548 - RNA, 16 nt, Human
cagugccuuauggaac

SEQ ID NO: 2942549 - RNA, 15 nt, Human
cagugccuuauggaa

SEQ ID NO: 2942550 - RNA, 19 nt, Human
cagugagucgaggacaggg

SEQ ID NO: 2942551 - RNA, 20 nt, Human
cagugagucgaggacaggga

SEQ ID NO: 2942552 - RNA, 22 nt, Human
cagugagucgaggacagggagg

SEQ ID NO: 2942553 - RNA, 23 nt, Human
cagugagucgaggacagggaggu

SEQ ID NO: 2942554 - RNA, 18 nt, Human
cagugauuaccagggacu

SEQ ID NO: 2942555 - RNA, 17 nt, Human
cagugauuaccagggac

SEQ ID NO: 2942556 - RNA, 13 nt, Human
cagugcucaccca

SEQ ID NO: 2942557 - RNA, 12 nt, Human
cagugcucaccc

SEQ ID NO: 2942558 - RNA, 17 nt, Human
cagugcucacccacacc

SEQ ID NO: 2942559 - RNA, 18 nt, Human
cagugcucacccacacca

SEQ ID NO: 2942560 - RNA, 23 nt, Human
cagugccuuauggaacacucuga

SEQ ID NO: 2942561 - RNA, 17 nt, Human
cagucauucagauauga

SEQ ID NO: 2942562 - RNA, 20 nt, Human
cagucauucagauaugauuc

SEQ ID NO: 2942563 - RNA, 19 nt, Human
cagucauuauguuaauauu

SEQ ID NO: 2942564 - RNA, 16 nt, Human
caguccauagcagaga

SEQ ID NO: 2942565 - RNA, 13 nt, Human
caguccaugaaga

SEQ ID NO: 2942566 - RNA, 14 nt, Human
caguccauugaaag

SEQ ID NO: 2942567 - RNA, 18 nt, Human
caguauuacuucugcuac

SEQ ID NO: 2942568 - RNA, 16 nt, Human
caguauuacuucugcu

SEQ ID NO: 2942569 - RNA, 23 nt, Human
cagucagggaaggugccucugga

SEQ ID NO: 2942570 - RNA, 22 nt, Human
cagucaggaaagagaacuucca

SEQ ID NO: 2942571 - RNA, 15 nt, Human
cagucaggaaagaga

SEQ ID NO: 2942572 - RNA, 18 nt, Human
cagucaggaaagagaacu

SEQ ID NO: 2942573 - RNA, 12 nt, Human
caguagugauag

SEQ ID NO: 2942574 - RNA, 22 nt, Human
caguauagaauaggcacuuuaa

SEQ ID NO: 2942575 - RNA, 12 nt, Human
caguauagaaua

SEQ ID NO: 2942576 - RNA, 18 nt, Human
caguauagaauaggcacu

SEQ ID NO: 2942577 - RNA, 13 nt, Human
caguaucucaggg

SEQ ID NO: 2942578 - RNA, 21 nt, Human
caguaucuugaagacuuuucu

SEQ ID NO: 2942579 - RNA, 12 nt, Human
caguauggcagc

SEQ ID NO: 2942580 - RNA, 18 nt, Human
caguaucuugaagacuuu

SEQ ID NO: 2942581 - RNA, 12 nt, Human
caguaucuugaa

SEQ ID NO: 2942582 - RNA, 15 nt, Human
caguaucucagggcc

SEQ ID NO: 2942583 - RNA, 17 nt, Human
cagucccugccaaugga

SEQ ID NO: 2942584 - RNA, 15 nt, Human
caguccucccaucuc

SEQ ID NO: 2942585 - RNA, 14 nt, Human
caguccucccaucu

SEQ ID NO: 2942586 - RNA, 13 nt, Human
caguccucccauc

SEQ ID NO: 2942587 - RNA, 12 nt, Human
caguccucccau

SEQ ID NO: 2942588 - RNA, 12 nt, Human
cagucccugcca

SEQ ID NO: 2942589 - RNA, 16 nt, Human
cagucccugccaaugg

SEQ ID NO: 2942590 - RNA, 15 nt, Human
cagucccugccaaug

SEQ ID NO: 2942591 - RNA, 14 nt, Human
cagucccugccaau

SEQ ID NO: 2942592 - RNA, 13 nt, Human
cagucccugccaa

SEQ ID NO: 2942593 - RNA, 13 nt, Human
cagguucagcuug

SEQ ID NO: 2942594 - RNA, 12 nt, Human
cagguucagcuu

SEQ ID NO: 2942595 - RNA, 20 nt, Human
caguaaaugggggugcauuu

SEQ ID NO: 2942596 - RNA, 21 nt, Human
caguaaaugggggugcauuug

SEQ ID NO: 2942597 - RNA, 13 nt, Human
caguaacauagcu

SEQ ID NO: 2942598 - RNA, 22 nt, Human
caguaaaugggggugcauuuga

SEQ ID NO: 2942599 - RNA, 21 nt, Human
caguaaugagcuuaagaaauu

SEQ ID NO: 2942600 - RNA, 12 nt, Human
caguaauaacuc

SEQ ID NO: 2942601 - RNA, 13 nt, Human
caguaauaacucu

SEQ ID NO: 2942602 - RNA, 21 nt, Human
caguaauaaaugaaugucacu

SEQ ID NO: 2942603 - RNA, 17 nt, Human
caguaauaaaugaaugu

SEQ ID NO: 2942604 - RNA, 18 nt, Human
caguacuaacauuuauuu

SEQ ID NO: 2942605 - RNA, 22 nt, Human
caggugugagucaccaagccca

SEQ ID NO: 2942606 - RNA, 23 nt, Human
caggugugagucaccaagcccag

SEQ ID NO: 2942607 - RNA, 16 nt, Human
caggugugaaccacca

SEQ ID NO: 2942608 - RNA, 19 nt, Human
caggugugaaccaccacac

SEQ ID NO: 2942609 - RNA, 22 nt, Human
caggugugaaccaccacaccca

SEQ ID NO: 2942610 - RNA, 23 nt, Human
caggugugaaccaccacacccag

SEQ ID NO: 2942611 - RNA, 20 nt, Human
caggugugagucaccaagcc

SEQ ID NO: 2942612 - RNA, 21 nt, Human
caggugugagucaccaagccc

SEQ ID NO: 2942613 - RNA, 16 nt, Human
caggugugagucacca

SEQ ID NO: 2942614 - RNA, 15 nt, Human
caggugucccugcac

SEQ ID NO: 2942615 - RNA, 16 nt, Human
caggugucccugcacu

SEQ ID NO: 2942616 - RNA, 18 nt, Human
caggugucccugcacuug

SEQ ID NO: 2942617 - RNA, 19 nt, Human
caggugucccugcacuugc

SEQ ID NO: 2942618 - RNA, 12 nt, Human
caggugugaacc

SEQ ID NO: 2942619 - RNA, 20 nt, Human
caggugguuauggagagggu

SEQ ID NO: 2942620 - RNA, 11 nt, Human
caggugucccu

SEQ ID NO: 2942621 - RNA, 14 nt, Human
caggugucccugca

SEQ ID NO: 2942622 - RNA, 18 nt, Human
caggugguuauggagagg

SEQ ID NO: 2942623 - RNA, 23 nt, Human
cagguggggucacucuggcagcu

SEQ ID NO: 2942624 - RNA, 22 nt, Human
cagguggggucacucuggcagc

SEQ ID NO: 2942625 - RNA, 21 nt, Human
cagguggggucacucuggcag

SEQ ID NO: 2942626 - RNA, 20 nt, Human
cagguggggucacucuggca

SEQ ID NO: 2942627 - RNA, 19 nt, Human
cagguggggucacucuggc

SEQ ID NO: 2942628 - RNA, 13 nt, Human
cagguggggcagc

SEQ ID NO: 2942629 - RNA, 14 nt, Human
cagguggggcagcu

SEQ ID NO: 2942630 - RNA, 15 nt, Human
cagguggggcagcuu

SEQ ID NO: 2942631 - RNA, 16 nt, Human
cagguggggcagcuug

SEQ ID NO: 2942632 - RNA, 17 nt, Human
cagguggggcagcuuga

SEQ ID NO: 2942633 - RNA, 18 nt, Human
cagguggggucacucugg

SEQ ID NO: 2942634 - RNA, 20 nt, Human
cagguaacaggcagauacag

SEQ ID NO: 2942635 - RNA, 21 nt, Human
cagguaacaggcagauacagg

SEQ ID NO: 2942636 - RNA, 21 nt, Human
caggugagaagcagaggaagg

SEQ ID NO: 2942637 - RNA, 20 nt, Human
caggugagaagcagaggaag

SEQ ID NO: 2942638 - RNA, 13 nt, Human
caggugagaagca

SEQ ID NO: 2942639 - RNA, 18 nt, Human
caggucuugaacuccugg

SEQ ID NO: 2942640 - RNA, 19 nt, Human
caggucuugaacuccuggc

SEQ ID NO: 2942641 - RNA, 20 nt, Human
caggucuugaacuccuggcc

SEQ ID NO: 2942642 - RNA, 21 nt, Human
caggucuugaacuccuggccu

SEQ ID NO: 2942643 - RNA, 22 nt, Human
caggucuugaacuccuggccuc

SEQ ID NO: 2942644 - RNA, 23 nt, Human
caggucuugaacuccuggccuca

SEQ ID NO: 2942645 - RNA, 21 nt, Human
caggggugggacacccuguga

SEQ ID NO: 2942646 - RNA, 20 nt, Human
caggggugggacacccugug

SEQ ID NO: 2942647 - RNA, 15 nt, Human
caggggugggacacc

SEQ ID NO: 2942648 - RNA, 14 nt, Human
caggggugggacac

SEQ ID NO: 2942649 - RNA, 21 nt, Human
caggguauuccagagugggga

SEQ ID NO: 2942650 - RNA, 20 nt, Human
caggguauuccagagugggg

SEQ ID NO: 2942651 - RNA, 12 nt, Human
cagggucccugg

SEQ ID NO: 2942652 - RNA, 14 nt, Human
cagggucccuggug

SEQ ID NO: 2942653 - RNA, 22 nt, Human
cagggucccugguggcagcuca

SEQ ID NO: 2942654 - RNA, 19 nt, Human
cagggucccugguggcagc

SEQ ID NO: 2942655 - RNA, 18 nt, Human
cagggucccugguggcag

SEQ ID NO: 2942656 - RNA, 15 nt, Human
cagggucccuggugg

SEQ ID NO: 2942657 - RNA, 14 nt, Human
cagguaacaggcag

SEQ ID NO: 2942658 - RNA, 15 nt, Human
cagguaacaggcaga

SEQ ID NO: 2942659 - RNA, 16 nt, Human
cagguaacaggcagau

SEQ ID NO: 2942660 - RNA, 17 nt, Human
cagguaacaggcagaua

SEQ ID NO: 2942661 - RNA, 16 nt, Human
caggguuuugccaugu

SEQ ID NO: 2942662 - RNA, 16 nt, Human
cagggucucacucugu

SEQ ID NO: 2942663 - RNA, 21 nt, Human
cagggucucacuauguugccc

SEQ ID NO: 2942664 - RNA, 22 nt, Human
cagggucucacuauguugccca

SEQ ID NO: 2942665 - RNA, 23 nt, Human
cagggucucacuauguugcccag

SEQ ID NO: 2942666 - RNA, 15 nt, Human
cagggucucacucug

SEQ ID NO: 2942667 - RNA, 18 nt, Human
caggguccuguagcccua

SEQ ID NO: 2942668 - RNA, 23 nt, Human
cagggucccugguggcagcucac

SEQ ID NO: 2942669 - RNA, 22 nt, Human
cauuccaacuaucucauuucca

SEQ ID NO: 2942670 - RNA, 21 nt, Human
cauucagauaugauucaaaug

SEQ ID NO: 2942671 - RNA, 13 nt, Human
cauuccccaggag

SEQ ID NO: 2942672 - RNA, 17 nt, Human
cauuccccaggaggcca

SEQ ID NO: 2942673 - RNA, 15 nt, Human
cauuccccaggaggc

SEQ ID NO: 2942674 - RNA, 20 nt, Human
cauuccccaggaggccagcc

SEQ ID NO: 2942675 - RNA, 19 nt, Human
cauuccccaggaggccagc

SEQ ID NO: 2942676 - RNA, 18 nt, Human
cauuccccaggaggccag

SEQ ID NO: 2942677 - RNA, 20 nt, Human
cauucaaauguauuacagug

SEQ ID NO: 2942678 - RNA, 13 nt, Human
cauucuggaauaa

SEQ ID NO: 2942679 - RNA, 17 nt, Human
cauucuguuaaucauua

SEQ ID NO: 2942680 - RNA, 12 nt, Human
cauucugccugc

SEQ ID NO: 2942681 - RNA, 13 nt, Human
cauucugccugcc

SEQ ID NO: 2942682 - RNA, 15 nt, Human
cauucugccugccca

SEQ ID NO: 2942683 - RNA, 16 nt, Human
cauucugccugcccag

SEQ ID NO: 2942684 - RNA, 17 nt, Human
cauucugccugcccagg

SEQ ID NO: 2942685 - RNA, 18 nt, Human
cauucugccugcccaggc

SEQ ID NO: 2942686 - RNA, 19 nt, Human
cauucugccugcccaggcc

SEQ ID NO: 2942687 - RNA, 20 nt, Human
cauucugccugcccaggccc

SEQ ID NO: 2942688 - RNA, 23 nt, Human
cauuccugaugcuucuucagaga

SEQ ID NO: 2942689 - RNA, 14 nt, Human
cauuccugaacagg

SEQ ID NO: 2942690 - RNA, 22 nt, Human
cauuccugaugcuucuucagag

SEQ ID NO: 2942691 - RNA, 19 nt, Human
cauuccugaugcuucuuca

SEQ ID NO: 2942692 - RNA, 16 nt, Human
cauuccugaugcuucu

SEQ ID NO: 2942693 - RNA, 14 nt, Human
cauuccugaugcuu

SEQ ID NO: 2942694 - RNA, 23 nt, Human
cauucuucuguacgucugacagg

SEQ ID NO: 2942695 - RNA, 16 nt, Human
cauucuuggcccagga

SEQ ID NO: 2942696 - RNA, 13 nt, Human
cauucuuggccca

SEQ ID NO: 2942697 - RNA, 13 nt, Human
cauuugcugaaua

SEQ ID NO: 2942698 - RNA, 22 nt, Human
cauuuuauuuuauuaugcauga

SEQ ID NO: 2942699 - RNA, 23 nt, Human
cauuuuauuuuauuaugcaugaa

SEQ ID NO: 2942700 - RNA, 19 nt, Human
cauuuuacacacuguacac

SEQ ID NO: 2942701 - RNA, 17 nt, Human
cauuuuuaguagagaca

SEQ ID NO: 2942702 - RNA, 21 nt, Human
cauuuuuaagugcugcauuua

SEQ ID NO: 2942703 - RNA, 16 nt, Human
ccaaacccuucagugc

SEQ ID NO: 2942704 - RNA, 17 nt, Human
cauuugaaaauuuugau

SEQ ID NO: 2942705 - RNA, 19 nt, Human
cauuugaaaauuuugaugu

SEQ ID NO: 2942706 - RNA, 13 nt, Human
cauucuuuuugaa

SEQ ID NO: 2942707 - RNA, 16 nt, Human
cauucuuuuugaaaug

SEQ ID NO: 2942708 - RNA, 14 nt, Human
cauucuuuuugaaa

SEQ ID NO: 2942709 - RNA, 18 nt, Human
cauugaccugaggcccuu

SEQ ID NO: 2942710 - RNA, 14 nt, Human
cauugaccugaggc

SEQ ID NO: 2942711 - RNA, 17 nt, Human
cauugaccugaggcccu

SEQ ID NO: 2942712 - RNA, 15 nt, Human
cauugaccugaggcc

SEQ ID NO: 2942713 - RNA, 15 nt, Human
cauuuaaaaaaaauc

SEQ ID NO: 2942714 - RNA, 13 nt, Human
cauugugggaagg

SEQ ID NO: 2942715 - RNA, 15 nt, Human
cauugugggaagggg

SEQ ID NO: 2942716 - RNA, 21 nt, Human
cauuguaaaugugcuuuuaaa

SEQ ID NO: 2942717 - RNA, 20 nt, Human
caugugcuaguaauuggaaa

SEQ ID NO: 2942718 - RNA, 22 nt, Human
caugugccagguuuuuggucug

SEQ ID NO: 2942719 - RNA, 14 nt, Human
caugugcacaugca

SEQ ID NO: 2942720 - RNA, 15 nt, Human
caugugaugagagga

SEQ ID NO: 2942721 - RNA, 17 nt, Human
caugugaugagaggaaa

SEQ ID NO: 2942722 - RNA, 16 nt, Human
caugugaugagaggaa

SEQ ID NO: 2942723 - RNA, 20 nt, Human
caugugaugagaggaaauca

SEQ ID NO: 2942724 - RNA, 18 nt, Human
caugugaugagaggaaau

SEQ ID NO: 2942725 - RNA, 21 nt, Human
caugugaugagaggaaaucac

SEQ ID NO: 2942726 - RNA, 12 nt, Human
caugucuggcua

SEQ ID NO: 2942727 - RNA, 18 nt, Human
caugguuuggagcugauc

SEQ ID NO: 2942728 - RNA, 14 nt, Human
caugguuuggagcu

SEQ ID NO: 2942729 - RNA, 15 nt, Human
caugguuuggagcug

SEQ ID NO: 2942730 - RNA, 16 nt, Human
caugguuuggagcuga

SEQ ID NO: 2942731 - RNA, 23 nt, Human
cauggucggaaaacaugcuacac

SEQ ID NO: 2942732 - RNA, 17 nt, Human
cauggucggaaaacaug

SEQ ID NO: 2942733 - RNA, 19 nt, Human
cauggucggaaaacaugcu

SEQ ID NO: 2942734 - RNA, 12 nt, Human
cauguuugugau

SEQ ID NO: 2942735 - RNA, 14 nt, Human
cauguuugugauug

SEQ ID NO: 2942736 - RNA, 19 nt, Human
cauguuuuucuucucccuc

SEQ ID NO: 2942737 - RNA, 20 nt, Human
cauguuuuucuucucccuca

SEQ ID NO: 2942738 - RNA, 19 nt, Human
cauggaauucacaaaguaa

SEQ ID NO: 2942739 - RNA, 20 nt, Human
cauggaauuggagcucgugg

SEQ ID NO: 2942740 - RNA, 16 nt, Human
caugcuguucaugaaa

SEQ ID NO: 2942741 - RNA, 18 nt, Human
caugcuguucaugaaaga

SEQ ID NO: 2942742 - RNA, 15 nt, Human
cauggacuuccacug

SEQ ID NO: 2942743 - RNA, 15 nt, Human
caugcugucccuuac

SEQ ID NO: 2942744 - RNA, 13 nt, Human
caugcugucccuu

SEQ ID NO: 2942745 - RNA, 15 nt, Human
caugcuguucaugaa

SEQ ID NO: 2942746 - RNA, 16 nt, Human
caugcuguacauacuu

SEQ ID NO: 2942747 - RNA, 19 nt, Human
caugcuguacauacuuuuu

SEQ ID NO: 2942748 - RNA, 21 nt, Human
caugcuguacauacuuuuugg

SEQ ID NO: 2942749 - RNA, 13 nt, Human
caugcuguacaua

SEQ ID NO: 2942750 - RNA, 18 nt, Human
caugggccuccugugugu

SEQ ID NO: 2942751 - RNA, 23 nt, Human
caugggacagggaggacgcucuc

SEQ ID NO: 2942752 - RNA, 12 nt, Human
caucacccgcua

SEQ ID NO: 2942753 - RNA, 20 nt, Human
caucaccaacgucugugcca

SEQ ID NO: 2942754 - RNA, 13 nt, Human
caucaugucuggc

SEQ ID NO: 2942755 - RNA, 14 nt, Human
caucaugucuggcu

SEQ ID NO: 2942756 - RNA, 15 nt, Human
caucaugucuggcua

SEQ ID NO: 2942757 - RNA, 16 nt, Human
caucauccuaagcuau

SEQ ID NO: 2942758 - RNA, 11 nt, Human
caucaucccuu

SEQ ID NO: 2942759 - RNA, 22 nt, Human
caucccugaaggccccgcccag

SEQ ID NO: 2942760 - RNA, 15 nt, Human
caucccucuggggcu

SEQ ID NO: 2942761 - RNA, 22 nt, Human
caucccucccuccaccucccug

SEQ ID NO: 2942762 - RNA, 23 nt, Human
caucccucccuccaccucccugc

SEQ ID NO: 2942763 - RNA, 17 nt, Human
caucccuuucccuuggu

SEQ ID NO: 2942764 - RNA, 14 nt, Human
caucccuuucccuu

SEQ ID NO: 2942765 - RNA, 18 nt, Human
caucccuuaccugggaaa

SEQ ID NO: 2942766 - RNA, 14 nt, Human
cauccacugugcca

SEQ ID NO: 2942767 - RNA, 17 nt, Human
cauccacugugccaugu

SEQ ID NO: 2942768 - RNA, 23 nt, Human
cauccacugugccaugugccagg

SEQ ID NO: 2942769 - RNA, 17 nt, Human
cauccagguucagcuug

SEQ ID NO: 2942770 - RNA, 20 nt, Human
caucccucccuccaccuccc

SEQ ID NO: 2942771 - RNA, 14 nt, Human
caucaacaucuugg

SEQ ID NO: 2942772 - RNA, 17 nt, Human
cauauuuaauuugaagg

SEQ ID NO: 2942773 - RNA, 23 nt, Human
cauaucucuuaucuuacgaaaaa

SEQ ID NO: 2942774 - RNA, 20 nt, Human
cauaucucuuaucuuacgaa

SEQ ID NO: 2942775 - RNA, 22 nt, Human
cauauucuguuggccaguguga

SEQ ID NO: 2942776 - RNA, 17 nt, Human
cauauugauuuccguua

SEQ ID NO: 2942777 - RNA, 22 nt, Human
cauauugcauacuauuaaacau

SEQ ID NO: 2942778 - RNA, 21 nt, Human
cauauugauuuccguuaaaau

SEQ ID NO: 2942779 - RNA, 19 nt, Human
cauauugcauacuauuaaa

SEQ ID NO: 2942780 - RNA, 21 nt, Human
cauauugcauacuauuaaaca

SEQ ID NO: 2942781 - RNA, 16 nt, Human
cauaguaugguggcug

SEQ ID NO: 2942782 - RNA, 15 nt, Human
cauaguaugguggcu

SEQ ID NO: 2942783 - RNA, 12 nt, Human
cagugcuuggcc

SEQ ID NO: 2942784 - RNA, 19 nt, Human
cagugcucacccacaccau

SEQ ID NO: 2942785 - RNA, 23 nt, Human
cauauauauguuuuaagaggcag

SEQ ID NO: 2942786 - RNA, 15 nt, Human
cauauauaacaaugc

SEQ ID NO: 2942787 - RNA, 13 nt, Human
cauauauaacaau

SEQ ID NO: 2942788 - RNA, 23 nt, Human
cauauaagauucauauuuacuuc

SEQ ID NO: 2942789 - RNA, 13 nt, Human
caugagcaucagg

SEQ ID NO: 2942790 - RNA, 18 nt, Human
caugaagauguagaggag

SEQ ID NO: 2942791 - RNA, 19 nt, Human
caugaagauguagaggaga

SEQ ID NO: 2942792 - RNA, 16 nt, Human
caugagccgcccaagg

SEQ ID NO: 2942793 - RNA, 17 nt, Human
caugagccgcccaaggc

SEQ ID NO: 2942794 - RNA, 19 nt, Human
caugagccgcccaaggccu

SEQ ID NO: 2942795 - RNA, 21 nt, Human
caugagccgcccaaggccuuc

SEQ ID NO: 2942796 - RNA, 22 nt, Human
caugagccgcccaaggccuucc

SEQ ID NO: 2942797 - RNA, 12 nt, Human
caugagccucag

SEQ ID NO: 2942798 - RNA, 15 nt, Human
caugagccucagcau

SEQ ID NO: 2942799 - RNA, 17 nt, Human
caugagccucagcaucc

SEQ ID NO: 2942800 - RNA, 18 nt, Human
caugagccucagcauccu

SEQ ID NO: 2942801 - RNA, 19 nt, Human
caugagccucagcauccug

SEQ ID NO: 2942802 - RNA, 20 nt, Human
caugagccucagcauccugg

SEQ ID NO: 2942803 - RNA, 21 nt, Human
caugagccucagcauccuggc

SEQ ID NO: 2942804 - RNA, 23 nt, Human
caugagcaucaggccaggcccuc

SEQ ID NO: 2942805 - RNA, 22 nt, Human
caugagcaucaggccaggcccu

SEQ ID NO: 2942806 - RNA, 21 nt, Human
caugagcaucaggccaggccc

SEQ ID NO: 2942807 - RNA, 20 nt, Human
caugagcaucaggccaggcc

SEQ ID NO: 2942808 - RNA, 18 nt, Human
caugagcaucaggccagg

SEQ ID NO: 2942809 - RNA, 17 nt, Human
caugagcaucaggccag

SEQ ID NO: 2942810 - RNA, 16 nt, Human
caugagcaucaggcca

SEQ ID NO: 2942811 - RNA, 15 nt, Human
caugagcaucaggcc

SEQ ID NO: 2942812 - RNA, 23 nt, Human
caugaguccccuguuuguuucug

SEQ ID NO: 2942813 - RNA, 15 nt, Human
caugaguccccuguu

SEQ ID NO: 2942814 - RNA, 14 nt, Human
caugaguccccugu

SEQ ID NO: 2942815 - RNA, 19 nt, Human
caugagguacugagaguga

SEQ ID NO: 2942816 - RNA, 13 nt, Human
caugaguccccug

SEQ ID NO: 2942817 - RNA, 22 nt, Human
caugagccucagcauccuggca

SEQ ID NO: 2942818 - RNA, 23 nt, Human
caugagccucagcauccuggcac

SEQ ID NO: 2942819 - RNA, 21 nt, Human
caugaggaacaaggcaaggcu

SEQ ID NO: 2942820 - RNA, 20 nt, Human
caugaggaacaaggcaaggc

SEQ ID NO: 2942821 - RNA, 17 nt, Human
caugaggaacaaggcaa

SEQ ID NO: 2942822 - RNA, 16 nt, Human
caugaggaacaaggca

SEQ ID NO: 2942823 - RNA, 23 nt, Human
caugaggaacaaggcaaggcugu

SEQ ID NO: 2942824 - RNA, 16 nt, Human
caugagguacugagag

SEQ ID NO: 2942825 - RNA, 18 nt, Human
caugagggagaugccaug

SEQ ID NO: 2942826 - RNA, 13 nt, Human
caugaaaacacau

SEQ ID NO: 2942827 - RNA, 14 nt, Human
caugaaaacacauu

SEQ ID NO: 2942828 - RNA, 15 nt, Human
caugaaaacacauuu

SEQ ID NO: 2942829 - RNA, 16 nt, Human
caugaaaacacauuuu

SEQ ID NO: 2942830 - RNA, 17 nt, Human
caugaaaacacauuuuu

SEQ ID NO: 2942831 - RNA, 12 nt, Human
caugaagacaga

SEQ ID NO: 2942832 - RNA, 17 nt, Human
caugaaagacuucucua

SEQ ID NO: 2942833 - RNA, 14 nt, Human
caugaaagauucaa

SEQ ID NO: 2942834 - RNA, 19 nt, Human
caugaaaacacauuuuucu

SEQ ID NO: 2942835 - RNA, 21 nt, Human
caugaaaacacauuuuucuua

SEQ ID NO: 2942836 - RNA, 16 nt, Human
caucucuacaaaaagc

SEQ ID NO: 2942837 - RNA, 15 nt, Human
caucucuccuccuuu

SEQ ID NO: 2942838 - RNA, 21 nt, Human
caucuugaauuguaaggaaug

SEQ ID NO: 2942839 - RNA, 16 nt, Human
caucuugaauuguaag

SEQ ID NO: 2942840 - RNA, 15 nt, Human
caucuugcucugcug

SEQ ID NO: 2942841 - RNA, 19 nt, Human
caucuugcucugcugacag

SEQ ID NO: 2942842 - RNA, 16 nt, Human
caucuugcucugcuga

SEQ ID NO: 2942843 - RNA, 17 nt, Human
caucuugcucugcugac

SEQ ID NO: 2942844 - RNA, 15 nt, Human
ccagguucagcuugu

SEQ ID NO: 2942845 - RNA, 24 nt, Human
ccaggugcacaagcuccaagcucc

SEQ ID NO: 2942846 - RNA, 17 nt, Human
ccagguuuuuggucuga

SEQ ID NO: 2942847 - RNA, 19 nt, Human
ccagucuggaaugcagugg

SEQ ID NO: 2942848 - RNA, 20 nt, Human
ccagucuggaaugcaguggu

SEQ ID NO: 2942849 - RNA, 13 nt, Human
ccagugaggcucu

SEQ ID NO: 2942850 - RNA, 18 nt, Human
ccagucuggaaugcagug

SEQ ID NO: 2942851 - RNA, 16 nt, Human
ccagggccaugucaga

SEQ ID NO: 2942852 - RNA, 18 nt, Human
ccaggugcacaagcucca

SEQ ID NO: 2942853 - RNA, 20 nt, Human
ccaggugcacaagcuccaag

SEQ ID NO: 2942854 - RNA, 19 nt, Human
ccaggugcacaagcuccaa

SEQ ID NO: 2942855 - RNA, 21 nt, Human
ccagggacagaggggguggcc

SEQ ID NO: 2942856 - RNA, 15 nt, Human
ccagggacagagggg

SEQ ID NO: 2942857 - RNA, 14 nt, Human
ccagggacagaggg

SEQ ID NO: 2942858 - RNA, 20 nt, Human
ccaggcuuagucacugagac

SEQ ID NO: 2942859 - RNA, 22 nt, Human
ccagggacagaggggguggccu

SEQ ID NO: 2942860 - RNA, 19 nt, Human
ccaggagccuccugcccuu

SEQ ID NO: 2942861 - RNA, 20 nt, Human
ccaggagccccgaggccuuc

SEQ ID NO: 2942862 - RNA, 12 nt, Human
ccaggagccucc

SEQ ID NO: 2942863 - RNA, 16 nt, Human
ccaggagccccgaggc

SEQ ID NO: 2942864 - RNA, 19 nt, Human
ccaggagccccgaggccuu

SEQ ID NO: 2942865 - RNA, 21 nt, Human
ccaggcauuccccaggaggcc

SEQ ID NO: 2942866 - RNA, 19 nt, Human
ccaggcauuccccaggagg

SEQ ID NO: 2942867 - RNA, 18 nt, Human
ccaggcauuccccaggag

SEQ ID NO: 2942868 - RNA, 17 nt, Human
ccaggcauuccccagga

SEQ ID NO: 2942869 - RNA, 23 nt, Human
ccaggcccucugcccacucccug

SEQ ID NO: 2942870 - RNA, 22 nt, Human
ccaggcccucugcccacucccu

SEQ ID NO: 2942871 - RNA, 21 nt, Human
ccaggcccucugcccacuccc

SEQ ID NO: 2942872 - RNA, 20 nt, Human
ccaggcccucugcccacucc

SEQ ID NO: 2942873 - RNA, 24 nt, Human
ccaggcuguaucccaugagccuca

SEQ ID NO: 2942874 - RNA, 17 nt, Human
ccaggcuuagucacuga

SEQ ID NO: 2942875 - RNA, 23 nt, Human
ccagugcccacaggaucagucug

SEQ ID NO: 2942876 - RNA, 16 nt, Human
ccagugaggcucugcc

SEQ ID NO: 2942877 - RNA, 15 nt, Human
ccagugaggcucugc

SEQ ID NO: 2942878 - RNA, 14 nt, Human
ccagugaggcucug

SEQ ID NO: 2942879 - RNA, 22 nt, Human
ccagugguuccuaauccucuag

SEQ ID NO: 2942880 - RNA, 20 nt, Human
ccagugccgagaaggaagcc

SEQ ID NO: 2942881 - RNA, 11 nt, Human
ccagugccucu

SEQ ID NO: 2942882 - RNA, 19 nt, Human
ccaguguuuuaggagcaug

SEQ ID NO: 2942883 - RNA, 22 nt, Human
ccaguguuguggauuuaacaga

SEQ ID NO: 2942884 - RNA, 23 nt, Human
ccauauucuguuggccaguguga

SEQ ID NO: 2942885 - RNA, 21 nt, Human
ccaguuauggcuauaggugcu

SEQ ID NO: 2942886 - RNA, 14 nt, Human
ccaguuauggcuau

SEQ ID NO: 2942887 - RNA, 13 nt, Human
ccaucuacccucc

SEQ ID NO: 2942888 - RNA, 13 nt, Human
cccaaagugcugg

SEQ ID NO: 2942889 - RNA, 15 nt, Human
cccaaagugcuggga

SEQ ID NO: 2942890 - RNA, 18 nt, Human
cccaaaacucuccucugc

SEQ ID NO: 2942891 - RNA, 16 nt, Human
cccaaaacucuccucu

SEQ ID NO: 2942892 - RNA, 13 nt, Human
ccauuugucccaa

SEQ ID NO: 2942893 - RNA, 15 nt, Human
ccauuugucccaagu

SEQ ID NO: 2942894 - RNA, 17 nt, Human
ccauuugucccaagugc

SEQ ID NO: 2942895 - RNA, 14 nt, Human
ccauuuguguuuau

SEQ ID NO: 2942896 - RNA, 20 nt, Human
ccauucuccaccugccaggg

SEQ ID NO: 2942897 - RNA, 19 nt, Human
ccauucuccaccugccagg

SEQ ID NO: 2942898 - RNA, 23 nt, Human
cccaaggccuuccccuggcacug

SEQ ID NO: 2942899 - RNA, 22 nt, Human
cccaaauggaaaugggcagagc

SEQ ID NO: 2942900 - RNA, 18 nt, Human
cccaaauggaaaugggca

SEQ ID NO: 2942901 - RNA, 16 nt, Human
cccaaagugcugggau

SEQ ID NO: 2942902 - RNA, 22 nt, Human
ccaucugcgggggcagugcuca

SEQ ID NO: 2942903 - RNA, 20 nt, Human
ccaucugcgggggcagugcu

SEQ ID NO: 2942904 - RNA, 21 nt, Human
ccaucugcgggggcagugcuc

SEQ ID NO: 2942905 - RNA, 19 nt, Human
ccauauucuguuggccagu

SEQ ID NO: 2942906 - RNA, 18 nt, Human
ccauucuccaccugccag

SEQ ID NO: 2942907 - RNA, 17 nt, Human
ccauguuggccaggcug

SEQ ID NO: 2942908 - RNA, 16 nt, Human
ccauguuggccaggcu

SEQ ID NO: 2942909 - RNA, 16 nt, Human
ccaugggacagggagg

SEQ ID NO: 2942910 - RNA, 19 nt, Human
ccaugggacagggaggacg

SEQ ID NO: 2942911 - RNA, 18 nt, Human
ccagauucuuuccugagg

SEQ ID NO: 2942912 - RNA, 22 nt, Human
ccagauucuuuccugaggcugg

SEQ ID NO: 2942913 - RNA, 21 nt, Human
ccagauucuuuccugaggcug

SEQ ID NO: 2942914 - RNA, 20 nt, Human
ccagauucuuuccugaggcu

SEQ ID NO: 2942915 - RNA, 19 nt, Human
ccagauucuuuccugaggc

SEQ ID NO: 2942916 - RNA, 13 nt, Human
ccagagggccugc

SEQ ID NO: 2942917 - RNA, 22 nt, Human
ccagagggagugacagaggcag

SEQ ID NO: 2942918 - RNA, 23 nt, Human
ccagagggagugacagaggcagc

SEQ ID NO: 2942919 - RNA, 23 nt, Human
ccagaugcaccagcccuuagcag

SEQ ID NO: 2942920 - RNA, 16 nt, Human
ccagagggccugcaag

SEQ ID NO: 2942921 - RNA, 15 nt, Human
ccagagggccugcaa

SEQ ID NO: 2942922 - RNA, 19 nt, Human
ccagauugcaacaggcugg

SEQ ID NO: 2942923 - RNA, 20 nt, Human
ccagauugcaacaggcuggg

SEQ ID NO: 2942924 - RNA, 23 nt, Human
ccagauucuuuccugaggcuggg

SEQ ID NO: 2942925 - RNA, 18 nt, Human
ccagauugcaacaggcug

SEQ ID NO: 2942926 - RNA, 21 nt, Human
ccagauugcaacaggcugggc

SEQ ID NO: 2942927 - RNA, 12 nt, Human
ccagauuucacu

SEQ ID NO: 2942928 - RNA, 17 nt, Human
ccagacaccuugacagg

SEQ ID NO: 2942929 - RNA, 19 nt, Human
ccagacaccuugacagggc

SEQ ID NO: 2942930 - RNA, 21 nt, Human
ccagagaggguggugaccucu

SEQ ID NO: 2942931 - RNA, 23 nt, Human
ccagagaggguggugaccucugc

SEQ ID NO: 2942932 - RNA, 14 nt, Human
ccagagaggguggu

SEQ ID NO: 2942933 - RNA, 11 nt, Human
ccagagcugcc

SEQ ID NO: 2942934 - RNA, 13 nt, Human
ccagagcugccac

SEQ ID NO: 2942935 - RNA, 12 nt, Human
ccagagcugcca

SEQ ID NO: 2942936 - RNA, 19 nt, Human
ccagagcugccaccugccu

SEQ ID NO: 2942937 - RNA, 16 nt, Human
ccagagcugccaccug

SEQ ID NO: 2942938 - RNA, 15 nt, Human
ccagagcugccaccu

SEQ ID NO: 2942939 - RNA, 14 nt, Human
ccagagcugccacc

SEQ ID NO: 2942940 - RNA, 16 nt, Human
ccagagggagugacag

SEQ ID NO: 2942941 - RNA, 17 nt, Human
ccagagggagugacaga

SEQ ID NO: 2942942 - RNA, 18 nt, Human
ccagagggagugacagag

SEQ ID NO: 2942943 - RNA, 19 nt, Human
ccagagggagugacagagg

SEQ ID NO: 2942944 - RNA, 20 nt, Human
ccagagggagugacagaggc

SEQ ID NO: 2942945 - RNA, 21 nt, Human
ccagagggagugacagaggca

SEQ ID NO: 2942946 - RNA, 21 nt, Human
ccagaggagagaggacccccu

SEQ ID NO: 2942947 - RNA, 22 nt, Human
ccagaggagagaggacccccug

SEQ ID NO: 2942948 - RNA, 15 nt, Human
ccagcaagugagagc

SEQ ID NO: 2942949 - RNA, 14 nt, Human
ccagauuucacucu

SEQ ID NO: 2942950 - RNA, 16 nt, Human
ccagcaagugagagcu

SEQ ID NO: 2942951 - RNA, 20 nt, Human
ccagcaagugagagcugggu

SEQ ID NO: 2942952 - RNA, 21 nt, Human
ccagcaagugagagcugggug

SEQ ID NO: 2942953 - RNA, 22 nt, Human
ccagcaagugagagcugggugu

SEQ ID NO: 2942954 - RNA, 15 nt, Human
ccagcaauuaugaaa

SEQ ID NO: 2942955 - RNA, 13 nt, Human
ccagccccagugc

SEQ ID NO: 2942956 - RNA, 15 nt, Human
ccagccccagugccc

SEQ ID NO: 2942957 - RNA, 23 nt, Human
ccagccccaaaacucuccucugc

SEQ ID NO: 2942958 - RNA, 16 nt, Human
ccagccccagugccca

SEQ ID NO: 2942959 - RNA, 16 nt, Human
ccagcccuuagcaggg

SEQ ID NO: 2942960 - RNA, 17 nt, Human
ccagcccuuagcaggga

SEQ ID NO: 2942961 - RNA, 23 nt, Human
ccagccgagauagccaaggccaa

SEQ ID NO: 2942962 - RNA, 14 nt, Human
ccagccgccaugcu

SEQ ID NO: 2942963 - RNA, 19 nt, Human
ccagccgccaugcuccugg

SEQ ID NO: 2942964 - RNA, 18 nt, Human
ccagccgccaugcuccug

SEQ ID NO: 2942965 - RNA, 15 nt, Human
ccagccaaagccucc

SEQ ID NO: 2942966 - RNA, 19 nt, Human
ccagccaaagccuccucca

SEQ ID NO: 2942967 - RNA, 18 nt, Human
ccagccaaagccuccucc

SEQ ID NO: 2942968 - RNA, 22 nt, Human
ccagccagcaguucagagcugc

SEQ ID NO: 2942969 - RNA, 13 nt, Human
ccagccaggcccu

SEQ ID NO: 2942970 - RNA, 23 nt, Human
ccagcaguucagagcugcccucu

SEQ ID NO: 2942971 - RNA, 13 nt, Human
ccagcaguucaga

SEQ ID NO: 2942972 - RNA, 18 nt, Human
ccagcaguucagagcugc

SEQ ID NO: 2942973 - RNA, 19 nt, Human
ccagcaguucagagcugcc

SEQ ID NO: 2942974 - RNA, 20 nt, Human
ccagcaguucagagcugccc

SEQ ID NO: 2942975 - RNA, 21 nt, Human
ccagcaguucagagcugcccu

SEQ ID NO: 2942976 - RNA, 22 nt, Human
ccagcaguucagagcugcccuc

SEQ ID NO: 2942977 - RNA, 13 nt, Human
ccacacccagccc

SEQ ID NO: 2942978 - RNA, 14 nt, Human
ccacacccagccca

SEQ ID NO: 2942979 - RNA, 12 nt, Human
ccacacccagcc

SEQ ID NO: 2942980 - RNA, 23 nt, Human
ccacaccauaagcuacugccauc

SEQ ID NO: 2942981 - RNA, 18 nt, Human
ccaccaacauacucccau

SEQ ID NO: 2942982 - RNA, 14 nt, Human
ccaccaacauacuc

SEQ ID NO: 2942983 - RNA, 16 nt, Human
ccacaucuugcucugc

SEQ ID NO: 2942984 - RNA, 20 nt, Human
ccacaucuugcucugcugac

SEQ ID NO: 2942985 - RNA, 22 nt, Human
ccacaucuugcucugcugacag

SEQ ID NO: 2942986 - RNA, 23 nt, Human
ccacaucuugcucugcugacaga

SEQ ID NO: 2942987 - RNA, 14 nt, Human
ccacaucuugcucu

SEQ ID NO: 2942988 - RNA, 14 nt, Human
ccaccacacccagc

SEQ ID NO: 2942989 - RNA, 16 nt, Human
ccaccacacccagccc

SEQ ID NO: 2942990 - RNA, 20 nt, Human
ccaccaacauacucccaucu

SEQ ID NO: 2942991 - RNA, 16 nt, Human
ccacccaagggccugg

SEQ ID NO: 2942992 - RNA, 19 nt, Human
ccacccaagggccuggccu

SEQ ID NO: 2942993 - RNA, 17 nt, Human
ccacccaagggccuggc

SEQ ID NO: 2942994 - RNA, 16 nt, Human
ccacccaccucagccu

SEQ ID NO: 2942995 - RNA, 14 nt, Human
ccacccaccucagc

SEQ ID NO: 2942996 - RNA, 15 nt, Human
ccacccaccucagcc

SEQ ID NO: 2942997 - RNA, 13 nt, Human
ccacccaccucag

SEQ ID NO: 2942998 - RNA, 22 nt, Human
ccacccaagggccuggccugag

SEQ ID NO: 2942999 - RNA, 21 nt, Human
ccacccaagggccuggccuga

SEQ ID NO: 2943000 - RNA, 20 nt, Human
ccacccaagggccuggccug

SEQ ID NO: 2943001 - RNA, 13 nt, Human
ccacguuucuaaa

SEQ ID NO: 2943002 - RNA, 18 nt, Human
ccacugcacuccagccug

SEQ ID NO: 2943003 - RNA, 15 nt, Human
ccacucccugcaacc

SEQ ID NO: 2943004 - RNA, 19 nt, Human
ccacugcacuccagccugg

SEQ ID NO: 2943005 - RNA, 20 nt, Human
ccacugcacuccagccuggg

SEQ ID NO: 2943006 - RNA, 16 nt, Human
ccacugcgaccacaag

SEQ ID NO: 2943007 - RNA, 18 nt, Human
ccacucaguccauagcag

SEQ ID NO: 2943008 - RNA, 13 nt, Human
ccacucccugcaa

SEQ ID NO: 2943009 - RNA, 12 nt, Human
ccacucccugca

SEQ ID NO: 2943010 - RNA, 23 nt, Human
ccacuacggaauaguuggcuagg

SEQ ID NO: 2943011 - RNA, 22 nt, Human
ccacuacggaauaguuggcuag

SEQ ID NO: 2943012 - RNA, 18 nt, Human
ccacuacauucuguuaau

SEQ ID NO: 2943013 - RNA, 12 nt, Human
ccaccucagccu

SEQ ID NO: 2943014 - RNA, 18 nt, Human
ccacccugaaagcccuga

SEQ ID NO: 2943015 - RNA, 17 nt, Human
ccacccugaaagcccug

SEQ ID NO: 2943016 - RNA, 16 nt, Human
ccacccugaaagcccu

SEQ ID NO: 2943017 - RNA, 13 nt, Human
ccaccucagccuc

SEQ ID NO: 2943018 - RNA, 14 nt, Human
ccaccucagccucc

SEQ ID NO: 2943019 - RNA, 15 nt, Human
ccaccucagccuccc

SEQ ID NO: 2943020 - RNA, 12 nt, Human
ccacccaggagc

SEQ ID NO: 2943021 - RNA, 14 nt, Human
ccacccaggagccc

SEQ ID NO: 2943022 - RNA, 15 nt, Human
ccacggccaggccag

SEQ ID NO: 2943023 - RNA, 12 nt, Human
ccacggccaggc

SEQ ID NO: 2943024 - RNA, 13 nt, Human
ccacggccaggcc

SEQ ID NO: 2943025 - RNA, 14 nt, Human
ccacggccaggcca

SEQ ID NO: 2943026 - RNA, 16 nt, Human
ccaccuggccucugca

SEQ ID NO: 2943027 - RNA, 15 nt, Human
ccaccuggccucugc

SEQ ID NO: 2943028 - RNA, 22 nt, Human
ccaccugcggugcuaucucccc

SEQ ID NO: 2943029 - RNA, 14 nt, Human
ccaccuggccucug

SEQ ID NO: 2943030 - RNA, 17 nt, Human
ccaccuggccucugcac

SEQ ID NO: 2943031 - RNA, 16 nt, Human
ccaccugccagggaca

SEQ ID NO: 2943032 - RNA, 20 nt, Human
ccaccugccuguugggccag

SEQ ID NO: 2943033 - RNA, 17 nt, Human
ccaccugccuguugggc

SEQ ID NO: 2943034 - RNA, 17 nt, Human
ccaccucccacaaagga

SEQ ID NO: 2943035 - RNA, 14 nt, Human
ccuuagacaguccc

SEQ ID NO: 2943036 - RNA, 17 nt, Human
ccuucacagaugggugc

SEQ ID NO: 2943037 - RNA, 20 nt, Human
ccuucaccuuuguccccacc

SEQ ID NO: 2943038 - RNA, 19 nt, Human
ccuucaccuuuguccccac

SEQ ID NO: 2943039 - RNA, 21 nt, Human
ccuucaccuuuguccccaccg

SEQ ID NO: 2943040 - RNA, 10 nt, Human
ccuucagugc

SEQ ID NO: 2943041 - RNA, 11 nt, Human
ccuucagugcc

SEQ ID NO: 2943042 - RNA, 14 nt, Human
ccuucagugccaaa

SEQ ID NO: 2943043 - RNA, 19 nt, Human
ccuucauuuggcauucccc

SEQ ID NO: 2943044 - RNA, 22 nt, Human
ccuucauuuggcauuccccacu

SEQ ID NO: 2943045 - RNA, 14 nt, Human
ccuucggccuccau

SEQ ID NO: 2943046 - RNA, 19 nt, Human
ccuucggccuccauccuga

SEQ ID NO: 2943047 - RNA, 20 nt, Human
ccuucggccuccauccugag

SEQ ID NO: 2943048 - RNA, 15 nt, Human
ccuucggcgccuuaa

SEQ ID NO: 2943049 - RNA, 19 nt, Human
ccuucuccuucaccuuugu

SEQ ID NO: 2943050 - RNA, 15 nt, Human
ccuucuccuucaccu

SEQ ID NO: 2943051 - RNA, 23 nt, Human
ccuucuucccaauagcaaggcug

SEQ ID NO: 2943052 - RNA, 20 nt, Human
ccuugaguugauucagcucu

SEQ ID NO: 2943053 - RNA, 23 nt, Human
ccuugaccauucuccaccugcca

SEQ ID NO: 2943054 - RNA, 22 nt, Human
ccuugaccauucuccaccugcc

SEQ ID NO: 2943055 - RNA, 13 nt, Human
ccuugacucuuuc

SEQ ID NO: 2943056 - RNA, 19 nt, Human
ccuugaacuuugaccucug

SEQ ID NO: 2943057 - RNA, 20 nt, Human
ccuugaaaacuuuaugcuaa

SEQ ID NO: 2943058 - RNA, 13 nt, Human
ccuuguuuaaugg

SEQ ID NO: 2943059 - RNA, 21 nt, Human
ccuugucggccccaccagugc

SEQ ID NO: 2943060 - RNA, 15 nt, Human
ccuugucggccccac

SEQ ID NO: 2943061 - RNA, 18 nt, Human
ccuuugacgccaucccag

SEQ ID NO: 2943062 - RNA, 17 nt, Human
ccuuugacgccauccca

SEQ ID NO: 2943063 - RNA, 16 nt, Human
ccuuugacgccauccc

SEQ ID NO: 2943064 - RNA, 14 nt, Human
ccuugaugaagaag

SEQ ID NO: 2943065 - RNA, 21 nt, Human
ccuuggugucgggcaugacac

SEQ ID NO: 2943066 - RNA, 22 nt, Human
ccuuggugucgggcaugacacg

SEQ ID NO: 2943067 - RNA, 22 nt, Human
ccuugguuaggcauugugggaa

SEQ ID NO: 2943068 - RNA, 21 nt, Human
ccuugguuaggcauuguggga

SEQ ID NO: 2943069 - RNA, 19 nt, Human
ccuuggggcugaugcaguu

SEQ ID NO: 2943070 - RNA, 23 nt, Human
ccuguugggccaggagccuccug

SEQ ID NO: 2943071 - RNA, 21 nt, Human
ccuguuaaaagaugaaaauau

SEQ ID NO: 2943072 - RNA, 20 nt, Human
ccuguuaaaagaugaaaaua

SEQ ID NO: 2943073 - RNA, 16 nt, Human
ccuguuucugcagcca

SEQ ID NO: 2943074 - RNA, 18 nt, Human
ccuguuuguuucugaaag

SEQ ID NO: 2943075 - RNA, 14 nt, Human
ccuguuuguuucug

SEQ ID NO: 2943076 - RNA, 17 nt, Human
ccugugucuugcaaugg

SEQ ID NO: 2943077 - RNA, 19 nt, Human
ccugugucuugcaauggca

SEQ ID NO: 2943078 - RNA, 21 nt, Human
ccugugucuugcaauggcagc

SEQ ID NO: 2943079 - RNA, 22 nt, Human
ccugugucuugcaauggcagcc

SEQ ID NO: 2943080 - RNA, 20 nt, Human
ccugugugugcgccuacagg

SEQ ID NO: 2943081 - RNA, 21 nt, Human
ccugugugugcgccuacagga

SEQ ID NO: 2943082 - RNA, 17 nt, Human
ccuuagaagucacacag

SEQ ID NO: 2943083 - RNA, 18 nt, Human
ccuuagaagucacacagu

SEQ ID NO: 2943084 - RNA, 19 nt, Human
ccuuaccugccaggaagcc

SEQ ID NO: 2943085 - RNA, 15 nt, Human
ccuuacccucauguu

SEQ ID NO: 2943086 - RNA, 20 nt, Human
ccuuaccagcagagcaccuu

SEQ ID NO: 2943087 - RNA, 13 nt, Human
ccuuaccagcaga

SEQ ID NO: 2943088 - RNA, 14 nt, Human
ccuguuuuuauuau

SEQ ID NO: 2943089 - RNA, 15 nt, Human
ccuguuuuuauuauu

SEQ ID NO: 2943090 - RNA, 20 nt, Human
ccuuacacaaugguuuucuu

SEQ ID NO: 2943091 - RNA, 14 nt, Human
ccuuacacaauggu

SEQ ID NO: 2943092 - RNA, 22 nt, Human
ccuuugacgccaucccagcccc

SEQ ID NO: 2943093 - RNA, 21 nt, Human
ccuuugacgccaucccagccc

SEQ ID NO: 2943094 - RNA, 20 nt, Human
ccuuugacgccaucccagcc

SEQ ID NO: 2943095 - RNA, 20 nt, Human
cgaaaacguggcugcuucaa

SEQ ID NO: 2943096 - RNA, 15 nt, Human
cgaaaacguggcugc

SEQ ID NO: 2943097 - RNA, 19 nt, Human
cgaaaacguggcugcuuca

SEQ ID NO: 2943098 - RNA, 18 nt, Human
cgaaaacguggcugcuuc

SEQ ID NO: 2943099 - RNA, 12 nt, Human
cgaaagaaggca

SEQ ID NO: 2943100 - RNA, 19 nt, Human
cgaaagaaggcauggacuu

SEQ ID NO: 2943101 - RNA, 23 nt, Human
cgaaagaaggcauggacuucugg

SEQ ID NO: 2943102 - RNA, 21 nt, Human
cgaaagaacaguccauugaaa

SEQ ID NO: 2943103 - RNA, 12 nt, Human
cgaaagaacagu

SEQ ID NO: 2943104 - RNA, 19 nt, Human
cgaaagggacuuggaagcu

SEQ ID NO: 2943105 - RNA, 20 nt, Human
cgaaaggaugaaagugacca

SEQ ID NO: 2943106 - RNA, 22 nt, Human
cgaaagggacuuggaagcuccg

SEQ ID NO: 2943107 - RNA, 12 nt, Human
cgaacuggcugc

SEQ ID NO: 2943108 - RNA, 14 nt, Human
cgaacuggcugcaa

SEQ ID NO: 2943109 - RNA, 17 nt, Human
cgacuugcauaccugcu

SEQ ID NO: 2943110 - RNA, 13 nt, Human
cgaauagcuggga

SEQ ID NO: 2943111 - RNA, 14 nt, Human
cgaauagcugggac

SEQ ID NO: 2943112 - RNA, 17 nt, Human
cgagaucacgccacugc

SEQ ID NO: 2943113 - RNA, 18 nt, Human
cgagauagccaaggccaa

SEQ ID NO: 2943114 - RNA, 20 nt, Human
cgagauugcaccacugcacu

SEQ ID NO: 2943115 - RNA, 18 nt, Human
cgagaucacgccacugca

SEQ ID NO: 2943116 - RNA, 20 nt, Human
cgagaucacgccacugcacu

SEQ ID NO: 2943117 - RNA, 18 nt, Human
cgagcaggcuacugucag

SEQ ID NO: 2943118 - RNA, 20 nt, Human
cgagcaggcuucuucccccc

SEQ ID NO: 2943119 - RNA, 17 nt, Human
cgagcaugccuggaugg

SEQ ID NO: 2943120 - RNA, 16 nt, Human
cgagcaugccuggaug

SEQ ID NO: 2943121 - RNA, 13 nt, Human
cgagcaugccugg

SEQ ID NO: 2943122 - RNA, 14 nt, Human
cgagcaugccugga

SEQ ID NO: 2943123 - RNA, 22 nt, Human
cgagccauuugucccaagugcc

SEQ ID NO: 2943124 - RNA, 23 nt, Human
cgagccauuugucccaagugcca

SEQ ID NO: 2943125 - RNA, 15 nt, Human
cgagcccugguggca

SEQ ID NO: 2943126 - RNA, 16 nt, Human
cgagcccugguggcag

SEQ ID NO: 2943127 - RNA, 18 nt, Human
cgagcaugccuggauggg

SEQ ID NO: 2943128 - RNA, 16 nt, Human
cgagccauuuguccca

SEQ ID NO: 2943129 - RNA, 19 nt, Human
cgagccauuugucccaagu

SEQ ID NO: 2943130 - RNA, 20 nt, Human
cgagccauuugucccaagug

SEQ ID NO: 2943131 - RNA, 21 nt, Human
cgagccauuugucccaagugc

SEQ ID NO: 2943132 - RNA, 20 nt, Human
cgauuucuguuuagauaaua

SEQ ID NO: 2943133 - RNA, 14 nt, Human
cgcagcccugcaga

SEQ ID NO: 2943134 - RNA, 16 nt, Human
cgcagacaggaccagg

SEQ ID NO: 2943135 - RNA, 15 nt, Human
cgcagacaggaccag

SEQ ID NO: 2943136 - RNA, 22 nt, Human
cgccaggggaaaaucagccugc

SEQ ID NO: 2943137 - RNA, 21 nt, Human
cgccagauucuuuccugaggc

SEQ ID NO: 2943138 - RNA, 20 nt, Human
cgccagauucuuuccugagg

SEQ ID NO: 2943139 - RNA, 19 nt, Human
cgccagauucuuuccugag

SEQ ID NO: 2943140 - RNA, 17 nt, Human
cgccagauucuuuccug

SEQ ID NO: 2943141 - RNA, 17 nt, Human
cgccaugcuccuggccc

SEQ ID NO: 2943142 - RNA, 22 nt, Human
ccuggcacccggccccugcugg

SEQ ID NO: 2943143 - RNA, 23 nt, Human
ccuggcacccggccccugcuggu

SEQ ID NO: 2943144 - RNA, 13 nt, Human
ccuggcagccccu

SEQ ID NO: 2943145 - RNA, 12 nt, Human
ccuggcagcccc

SEQ ID NO: 2943146 - RNA, 18 nt, Human
ccuggaauauauaaccag

SEQ ID NO: 2943147 - RNA, 15 nt, Human
ccuggccagaugcac

SEQ ID NO: 2943148 - RNA, 22 nt, Human
ccugggcagcugccuccccucc

SEQ ID NO: 2943149 - RNA, 17 nt, Human
ccugcggugcuaucucc

SEQ ID NO: 2943150 - RNA, 16 nt, Human
ccugcggugcuaucuc

SEQ ID NO: 2943151 - RNA, 22 nt, Human
ccugccccucaacucuccucca

SEQ ID NO: 2943152 - RNA, 23 nt, Human
ccugccuguugggccaggagccu

SEQ ID NO: 2943153 - RNA, 21 nt, Human
ccugcucuccgaccagacacc

SEQ ID NO: 2943154 - RNA, 22 nt, Human
ccugcggugcuaucucccccag

SEQ ID NO: 2943155 - RNA, 20 nt, Human
ccugcugagccucacagcag

SEQ ID NO: 2943156 - RNA, 22 nt, Human
ccugcucuccgaccagacaccu

SEQ ID NO: 2943157 - RNA, 14 nt, Human
ccugcuucaaauau

SEQ ID NO: 2943158 - RNA, 23 nt, Human
ccuggaaaucaggguuaguauug

SEQ ID NO: 2943159 - RNA, 23 nt, Human
ccugacaacacucauugaccuga

SEQ ID NO: 2943160 - RNA, 16 nt, Human
ccugagcuuucugcua

SEQ ID NO: 2943161 - RNA, 21 nt, Human
ccugaggcccagagggccugc

SEQ ID NO: 2943162 - RNA, 20 nt, Human
ccugagccagauuucacucu

SEQ ID NO: 2943163 - RNA, 11 nt, Human
ccugagcccca

SEQ ID NO: 2943164 - RNA, 14 nt, Human
ccugagcuuucugc

SEQ ID NO: 2943165 - RNA, 16 nt, Human
ccugccagggacagag

SEQ ID NO: 2943166 - RNA, 15 nt, Human
ccugccagggacaga

SEQ ID NO: 2943167 - RNA, 14 nt, Human
ccugccagggacag

SEQ ID NO: 2943168 - RNA, 13 nt, Human
ccugccagggaca

SEQ ID NO: 2943169 - RNA, 12 nt, Human
ccugccagggac

SEQ ID NO: 2943170 - RNA, 22 nt, Human
ccugccaggaagccagcaggcu

SEQ ID NO: 2943171 - RNA, 21 nt, Human
ccugccaggaagccagcaggc

SEQ ID NO: 2943172 - RNA, 19 nt, Human
ccugccaggaagccagcag

SEQ ID NO: 2943173 - RNA, 18 nt, Human
ccugccaggaagccagca

SEQ ID NO: 2943174 - RNA, 11 nt, Human
ccugccaggga

SEQ ID NO: 2943175 - RNA, 16 nt, Human
ccugccaggcauggug

SEQ ID NO: 2943176 - RNA, 23 nt, Human
ccugccaggaagccagcaggcuc

SEQ ID NO: 2943177 - RNA, 15 nt, Human
ccugccaggcauggu

SEQ ID NO: 2943178 - RNA, 17 nt, Human
ccugccaggaagccagc

SEQ ID NO: 2943179 - RNA, 15 nt, Human
ccugccaggaagcca

SEQ ID NO: 2943180 - RNA, 14 nt, Human
ccugccaggaagcc

SEQ ID NO: 2943181 - RNA, 13 nt, Human
ccugccaggaagc

SEQ ID NO: 2943182 - RNA, 14 nt, Human
ccugaggcccuucu

SEQ ID NO: 2943183 - RNA, 15 nt, Human
ccugauugugucucu

SEQ ID NO: 2943184 - RNA, 22 nt, Human
ccugaugcuucuucagagacuc

SEQ ID NO: 2943185 - RNA, 21 nt, Human
ccugaugcuucuucagagacu

SEQ ID NO: 2943186 - RNA, 20 nt, Human
ccugaugcuucuucagagac

SEQ ID NO: 2943187 - RNA, 19 nt, Human
ccugaugcuucuucagaga

SEQ ID NO: 2943188 - RNA, 12 nt, Human
ccugaggcccuu

SEQ ID NO: 2943189 - RNA, 11 nt, Human
ccugaggcccu

SEQ ID NO: 2943190 - RNA, 19 nt, Human
ccugauugugucucuuggu

SEQ ID NO: 2943191 - RNA, 17 nt, Human
ccugauugugucucuug

SEQ ID NO: 2943192 - RNA, 21 nt, Human
ccugcaaccugauugugucuc

SEQ ID NO: 2943193 - RNA, 22 nt, Human
ccugcaaccugauugugucucu

SEQ ID NO: 2943194 - RNA, 14 nt, Human
ccugcaagaacaag

SEQ ID NO: 2943195 - RNA, 16 nt, Human
ccugcaauaaaauggg

SEQ ID NO: 2943196 - RNA, 21 nt, Human
ccgcuaagagggagggagggc

SEQ ID NO: 2943197 - RNA, 23 nt, Human
ccgcuaagagggagggagggcuc

SEQ ID NO: 2943198 - RNA, 15 nt, Human
ccgccuugcccagcc

SEQ ID NO: 2943199 - RNA, 16 nt, Human
ccgccuugcccagccu

SEQ ID NO: 2943200 - RNA, 17 nt, Human
ccgccuugcccagccug

SEQ ID NO: 2943201 - RNA, 22 nt, Human
ccgccuugcccagccuggaugc

SEQ ID NO: 2943202 - RNA, 19 nt, Human
ccgcacugggcuuggggac

SEQ ID NO: 2943203 - RNA, 14 nt, Human
ccgcacugggcuug

SEQ ID NO: 2943204 - RNA, 20 nt, Human
ccgaguagcugggacuacag

SEQ ID NO: 2943205 - RNA, 17 nt, Human
ccgaguagcugggacua

SEQ ID NO: 2943206 - RNA, 20 nt, Human
cccugguggcagcucaccuc

SEQ ID NO: 2943207 - RNA, 14 nt, Human
ccgaggccuucucu

SEQ ID NO: 2943208 - RNA, 12 nt, Human
ccgcuuucuacc

SEQ ID NO: 2943209 - RNA, 20 nt, Human
ccgggaagggggcugggaca

SEQ ID NO: 2943210 - RNA, 19 nt, Human
ccgcuuucuacccagcgag

SEQ ID NO: 2943211 - RNA, 15 nt, Human
ccggcuggccuggcc

SEQ ID NO: 2943212 - RNA, 18 nt, Human
ccggcuggccuggccccu

SEQ ID NO: 2943213 - RNA, 17 nt, Human
ccggcuggccuggcccc

SEQ ID NO: 2943214 - RNA, 22 nt, Human
ccgggcucugccucccaucacc

SEQ ID NO: 2943215 - RNA, 16 nt, Human
ccgggcguggugguga

SEQ ID NO: 2943216 - RNA, 20 nt, Human
ccgggcgcgguggcucacgc

SEQ ID NO: 2943217 - RNA, 22 nt, Human
ccuauauuguuuucaguguaca

SEQ ID NO: 2943218 - RNA, 18 nt, Human
ccuauauuguuuucagug

SEQ ID NO: 2943219 - RNA, 23 nt, Human
ccuaguuccaccaucaagccacc

SEQ ID NO: 2943220 - RNA, 21 nt, Human
ccuaguuccaccaucaagcca

SEQ ID NO: 2943221 - RNA, 13 nt, Human
ccuaguuccacca

SEQ ID NO: 2943222 - RNA, 16 nt, Human
ccuaaaauuauggaaa

SEQ ID NO: 2943223 - RNA, 15 nt, Human
ccuaaaauucagugg

SEQ ID NO: 2943224 - RNA, 14 nt, Human
ccuaaaguguauuu

SEQ ID NO: 2943225 - RNA, 19 nt, Human
ccucagucuggcccuuccu

SEQ ID NO: 2943226 - RNA, 11 nt, Human
ccucagugcca

SEQ ID NO: 2943227 - RNA, 12 nt, Human
ccucauacccac

SEQ ID NO: 2943228 - RNA, 20 nt, Human
ccucagucuggcccuuccuu

SEQ ID NO: 2943229 - RNA, 20 nt, Human
ccucauaguaugguggcugg

SEQ ID NO: 2943230 - RNA, 13 nt, Human
ccucauacccacc

SEQ ID NO: 2943231 - RNA, 21 nt, Human
ccucauaguaugguggcuggg

SEQ ID NO: 2943232 - RNA, 22 nt, Human
ccucauaguaugguggcugggu

SEQ ID NO: 2943233 - RNA, 14 nt, Human
ccucaucaccaacg

SEQ ID NO: 2943234 - RNA, 13 nt, Human
ccucaucaccaac

SEQ ID NO: 2943235 - RNA, 15 nt, Human
ccuccacauuuguuu

SEQ ID NO: 2943236 - RNA, 20 nt, Human
ccucauccucauacccaccc

SEQ ID NO: 2943237 - RNA, 13 nt, Human
ccucauccucaua

SEQ ID NO: 2943238 - RNA, 16 nt, Human
ccucccaaagugcugg

SEQ ID NO: 2943239 - RNA, 23 nt, Human
ccuccaugugggcuaguugggcu

SEQ ID NO: 2943240 - RNA, 15 nt, Human
ccucccaaagugcug

SEQ ID NO: 2943241 - RNA, 14 nt, Human
ccuccauccugagg

SEQ ID NO: 2943242 - RNA, 22 nt, Human
ccuccaggugcacaagcuccaa

SEQ ID NO: 2943243 - RNA, 21 nt, Human
ccuccaggugcacaagcucca

SEQ ID NO: 2943244 - RNA, 19 nt, Human
ccuccaggugcacaagcuc

SEQ ID NO: 2943245 - RNA, 13 nt, Human
ccuccagagcccc

SEQ ID NO: 2943246 - RNA, 12 nt, Human
ccuccagagccc

SEQ ID NO: 2943247 - RNA, 15 nt, Human
ccuccagagccccac

SEQ ID NO: 2943248 - RNA, 18 nt, Human
ccuccagagccccacagc

SEQ ID NO: 2943249 - RNA, 19 nt, Human
ccuccagagccccacagcc

SEQ ID NO: 2943250 - RNA, 20 nt, Human
ccuccagagccccacagccc

SEQ ID NO: 2943251 - RNA, 17 nt, Human
ccuccaccucccugcaa

SEQ ID NO: 2943252 - RNA, 22 nt, Human
ccuccaccucccugcaauaaaa

SEQ ID NO: 2943253 - RNA, 13 nt, Human
ccuccaccucccu

SEQ ID NO: 2943254 - RNA, 14 nt, Human
ccuccaccucccug

SEQ ID NO: 2943255 - RNA, 15 nt, Human
ccuccaccucccugc

SEQ ID NO: 2943256 - RNA, 23 nt, Human
ccuccugccucgaacuggcugca

SEQ ID NO: 2943257 - RNA, 14 nt, Human
ccuccugggcuaag

SEQ ID NO: 2943258 - RNA, 18 nt, Human
ccuccucugcuugccauc

SEQ ID NO: 2943259 - RNA, 16 nt, Human
ccuccucugcuugcca

SEQ ID NO: 2943260 - RNA, 13 nt, Human
ccuccucugcuug

SEQ ID NO: 2943261 - RNA, 19 nt, Human
ccucccgaguagcugggac

SEQ ID NO: 2943262 - RNA, 20 nt, Human
ccucccgaguagcugggacu

SEQ ID NO: 2943263 - RNA, 21 nt, Human
ccucccgaguagcugggacua

SEQ ID NO: 2943264 - RNA, 14 nt, Human
ccuccucagaucuu

SEQ ID NO: 2943265 - RNA, 20 nt, Human
ccucccuccaccucccugca

SEQ ID NO: 2943266 - RNA, 17 nt, Human
ccucccuccaccucccu

SEQ ID NO: 2943267 - RNA, 10 nt, Human
ccucccuccc

SEQ ID NO: 2943268 - RNA, 18 nt, Human
ccucuaucccggcuuugg

SEQ ID NO: 2943269 - RNA, 21 nt, Human
ccucuagugaauguaggcugg

SEQ ID NO: 2943270 - RNA, 16 nt, Human
ccucuaggaggucucu

SEQ ID NO: 2943271 - RNA, 14 nt, Human
ccucgguguggaga

SEQ ID NO: 2943272 - RNA, 16 nt, Human
ccucggugccuuccuc

SEQ ID NO: 2943273 - RNA, 18 nt, Human
ccucgguguggagaagcg

SEQ ID NO: 2943274 - RNA, 17 nt, Human
ccucccgaauagcuggg

SEQ ID NO: 2943275 - RNA, 17 nt, Human
cccaccuggccucugca

SEQ ID NO: 2943276 - RNA, 21 nt, Human
cccaccuggccucugcacucc

SEQ ID NO: 2943277 - RNA, 19 nt, Human
cccaccuggccucugcacu

SEQ ID NO: 2943278 - RNA, 16 nt, Human
cccaccuggccucugc

SEQ ID NO: 2943279 - RNA, 14 nt, Human
cccaccuggcucug

SEQ ID NO: 2943280 - RNA, 21 nt, Human
cccacgacugcccggcagggu

SEQ ID NO: 2943281 - RNA, 20 nt, Human
cccacgacugcccggcaggg

SEQ ID NO: 2943282 - RNA, 12 nt, Human
cccacuucugcc

SEQ ID NO: 2943283 - RNA, 23 nt, Human
cccacuugagaauuacccuuuug

SEQ ID NO: 2943284 - RNA, 14 nt, Human
cccacgcuggagug

SEQ ID NO: 2943285 - RNA, 19 nt, Human
cccacgcuggagugcagug

SEQ ID NO: 2943286 - RNA, 20 nt, Human
cccacgcuggagugcaguga

SEQ ID NO: 2943287 - RNA, 21 nt, Human
cccacgcuggagugcagugag

SEQ ID NO: 2943288 - RNA, 13 nt, Human
cccaccagugccu

SEQ ID NO: 2943289 - RNA, 14 nt, Human
cccaccagugccuc

SEQ ID NO: 2943290 - RNA, 19 nt, Human
cccaccgcagacaggacca

SEQ ID NO: 2943291 - RNA, 20 nt, Human
cccaccgcagacaggaccag

SEQ ID NO: 2943292 - RNA, 23 nt, Human
cccaccagugccucucccugcug

SEQ ID NO: 2943293 - RNA, 15 nt, Human
cccaccagugccucu

SEQ ID NO: 2943294 - RNA, 16 nt, Human
cccaccagugccucuc

SEQ ID NO: 2943295 - RNA, 17 nt, Human
cccaccucagccucccg

SEQ ID NO: 2943296 - RNA, 22 nt, Human
cccaccucucucacuccuugaa

SEQ ID NO: 2943297 - RNA, 20 nt, Human
cccacaagaaaugaaagcag

SEQ ID NO: 2943298 - RNA, 13 nt, Human
cccacaagaaaug

SEQ ID NO: 2943299 - RNA, 21 nt, Human
cccacaaaggagagcuagcag

SEQ ID NO: 2943300 - RNA, 20 nt, Human
cccaaugcacuuuguucugg

SEQ ID NO: 2943301 - RNA, 16 nt, Human
cccaaugcacuuuguu

SEQ ID NO: 2943302 - RNA, 18 nt, Human
cccuccagagccccacag

SEQ ID NO: 2943303 - RNA, 15 nt, Human
cccugguggcagcuc

SEQ ID NO: 2943304 - RNA, 17 nt, Human
cccugguggcagcucac

SEQ ID NO: 2943305 - RNA, 16 nt, Human
cccugguggcagcuca

SEQ ID NO: 2943306 - RNA, 22 nt, Human
cccugcuggguguggcgcagca

SEQ ID NO: 2943307 - RNA, 17 nt, Human
cccugcccaccuggccu

SEQ ID NO: 2943308 - RNA, 14 nt, Human
cccugcccaccugg

SEQ ID NO: 2943309 - RNA, 13 nt, Human
cccugcccaccug

SEQ ID NO: 2943310 - RNA, 21 nt, Human
cccugcuggguguggcgcagc

SEQ ID NO: 2943311 - RNA, 16 nt, Human
cccugcuggguguggc

SEQ ID NO: 2943312 - RNA, 18 nt, Human
cccugcccaccuggccuc

SEQ ID NO: 2943313 - RNA, 13 nt, Human
cccugcacagcag

SEQ ID NO: 2943314 - RNA, 22 nt, Human
cccugcacagcaggcugccagu

SEQ ID NO: 2943315 - RNA, 14 nt, Human
cccugcacagcagg

SEQ ID NO: 2943316 - RNA, 15 nt, Human
cccugcacagcaggc

SEQ ID NO: 2943317 - RNA, 20 nt, Human
cccugcacagcaggcugcca

SEQ ID NO: 2943318 - RNA, 21 nt, Human
cccugcacagcaggcugccag

SEQ ID NO: 2943319 - RNA, 12 nt, Human
cccugcacuugc

SEQ ID NO: 2943320 - RNA, 19 nt, Human
cccugcacuugcagacucu

SEQ ID NO: 2943321 - RNA, 15 nt, Human
cccugaaagcccuga

SEQ ID NO: 2943322 - RNA, 13 nt, Human
cccugaggcccag

SEQ ID NO: 2943323 - RNA, 16 nt, Human
cccucuggggcuguuc

SEQ ID NO: 2943324 - RNA, 23 nt, Human
cccugaggcccagagggccugca

SEQ ID NO: 2943325 - RNA, 20 nt, Human
cccugaggcccagagggccu

SEQ ID NO: 2943326 - RNA, 19 nt, Human
cccugaggcccagagggcc

SEQ ID NO: 2943327 - RNA, 18 nt, Human
cccugaggcccagagggc

SEQ ID NO: 2943328 - RNA, 17 nt, Human
cccugaggcccagaggg

SEQ ID NO: 2943329 - RNA, 16 nt, Human
cccugaggcccagagg

SEQ ID NO: 2943330 - RNA, 15 nt, Human
cccugaggcccagag

SEQ ID NO: 2943331 - RNA, 14 nt, Human
cccugaggcccaga

SEQ ID NO: 2943332 - RNA, 14 nt, Human
cccuccaccucccu

SEQ ID NO: 2943333 - RNA, 12 nt, Human
cccuccaccucc

SEQ ID NO: 2943334 - RNA, 13 nt, Human
cccuccagagccc

SEQ ID NO: 2943335 - RNA, 19 nt, Human
cccuccaccucccugcaau

SEQ ID NO: 2943336 - RNA, 15 nt, Human
cccuccaccucccug

SEQ ID NO: 2943337 - RNA, 17 nt, Human
cccuccaccucccugca

SEQ ID NO: 2943338 - RNA, 12 nt, Human
cccucuggggcu

SEQ ID NO: 2943339 - RNA, 14 nt, Human
cccucuccugggca

SEQ ID NO: 2943340 - RNA, 11 nt, Human
cccucuccugg

SEQ ID NO: 2943341 - RNA, 12 nt, Human
cccucuccuggg

SEQ ID NO: 2943342 - RNA, 13 nt, Human
cccucuccugggc

SEQ ID NO: 2943343 - RNA, 12 nt, Human
cccgggcucugc

SEQ ID NO: 2943344 - RNA, 15 nt, Human
cccgggcucugccuc

SEQ ID NO: 2943345 - RNA, 14 nt, Human
cccgggcucugccu

SEQ ID NO: 2943346 - RNA, 22 nt, Human
cccgaguagcugggacuacagg

SEQ ID NO: 2943347 - RNA, 20 nt, Human
cccgcugucagccauuccug

SEQ ID NO: 2943348 - RNA, 19 nt, Human
cccgcugucagccauuccu

SEQ ID NO: 2943349 - RNA, 14 nt, Human
cccagagggccugc

SEQ ID NO: 2943350 - RNA, 21 nt, Human
cccgaggccuucucugaagga

SEQ ID NO: 2943351 - RNA, 15 nt, Human
cccagagggccugca

SEQ ID NO: 2943352 - RNA, 13 nt, Human
cccgaguagcugg

SEQ ID NO: 2943353 - RNA, 14 nt, Human
cccgaguagcuggg

SEQ ID NO: 2943354 - RNA, 15 nt, Human
cccgaguagcuggga

SEQ ID NO: 2943355 - RNA, 16 nt, Human
cccgaguagcugggac

SEQ ID NO: 2943356 - RNA, 17 nt, Human
cccgaguagcugggacu

SEQ ID NO: 2943357 - RNA, 18 nt, Human
cccgaguagcugggacua

SEQ ID NO: 2943358 - RNA, 21 nt, Human
cccgaguagcugggacuacag

SEQ ID NO: 2943359 - RNA, 12 nt, Human
cccuaaucuucc

SEQ ID NO: 2943360 - RNA, 20 nt, Human
cccuacaguugaaaaacagc

SEQ ID NO: 2943361 - RNA, 16 nt, Human
cccgggcucugccucc

SEQ ID NO: 2943362 - RNA, 13 nt, Human
cccgucuccagcu

SEQ ID NO: 2943363 - RNA, 16 nt, Human
cccgucuccagcugcu

SEQ ID NO: 2943364 - RNA, 17 nt, Human
cccgucuccagcugcug

SEQ ID NO: 2943365 - RNA, 15 nt, Human
cccgugggguuccuc

SEQ ID NO: 2943366 - RNA, 19 nt, Human
cuucggccuccauccugag

SEQ ID NO: 2943367 - RNA, 20 nt, Human
cuucggccuccauccugagg

SEQ ID NO: 2943368 - RNA, 19 nt, Human
cuucgggaggucgaggcag

SEQ ID NO: 2943369 - RNA, 16 nt, Human
cuucucacugccaugc

SEQ ID NO: 2943370 - RNA, 21 nt, Human
cuucucacugccaugccagcu

SEQ ID NO: 2943371 - RNA, 16 nt, Human
cuucgcuccugugucu

SEQ ID NO: 2943372 - RNA, 17 nt, Human
cuucgcuccugugucuu

SEQ ID NO: 2943373 - RNA, 20 nt, Human
cuuccuuggacucauuuuaa

SEQ ID NO: 2943374 - RNA, 16 nt, Human
cuuccacuugaguguc

SEQ ID NO: 2943375 - RNA, 24 nt, Human
cuucagagacuccugcaggcagcc

SEQ ID NO: 2943376 - RNA, 14 nt, Human
cuucacauauugau

SEQ ID NO: 2943377 - RNA, 23 nt, Human
cuucacauauugauuuccguuaa

SEQ ID NO: 2943378 - RNA, 23 nt, Human
cuucaaggauccugagccagauu

SEQ ID NO: 2943379 - RNA, 22 nt, Human
cuucaaggauccugagccagau

SEQ ID NO: 2943380 - RNA, 21 nt, Human
cuucaaggauccugagccaga

SEQ ID NO: 2943381 - RNA, 14 nt, Human
cuucacaacagauu

SEQ ID NO: 2943382 - RNA, 12 nt, Human
cuucacaacaga

SEQ ID NO: 2943383 - RNA, 14 nt, Human
cuucaagaaugcag

SEQ ID NO: 2943384 - RNA, 20 nt, Human
cuucaaggauccugagccag

SEQ ID NO: 2943385 - RNA, 19 nt, Human
cuucaaggauccugagcca

SEQ ID NO: 2943386 - RNA, 18 nt, Human
cuucaaggauccugagcc

SEQ ID NO: 2943387 - RNA, 17 nt, Human
cuucaaggauccugagc

SEQ ID NO: 2943388 - RNA, 17 nt, Human
cuucaaauccuugaaga

SEQ ID NO: 2943389 - RNA, 15 nt, Human
cuucaaauauuuccc

SEQ ID NO: 2943390 - RNA, 22 nt, Human
cuuagucacugagacagcccgg

SEQ ID NO: 2943391 - RNA, 20 nt, Human
cuuagucacugagacagccc

SEQ ID NO: 2943392 - RNA, 21 nt, Human
cuuagucacugagacagcccg

SEQ ID NO: 2943393 - RNA, 13 nt, Human
cuuccacaagagc

SEQ ID NO: 2943394 - RNA, 15 nt, Human
cuuccacaagagccc

SEQ ID NO: 2943395 - RNA, 14 nt, Human
cuuccacaagagcc

SEQ ID NO: 2943396 - RNA, 14 nt, Human
cuucagugccaaaa

SEQ ID NO: 2943397 - RNA, 19 nt, Human
cuucagcugacuuuucugu

SEQ ID NO: 2943398 - RNA, 15 nt, Human
cuucagcugacuuuu

SEQ ID NO: 2943399 - RNA, 14 nt, Human
cuucaguaagccgu

SEQ ID NO: 2943400 - RNA, 14 nt, Human
cuucagccucccga

SEQ ID NO: 2943401 - RNA, 16 nt, Human
cuucagccucccgagu

SEQ ID NO: 2943402 - RNA, 20 nt, Human
cuucagccucccgaguagcu

SEQ ID NO: 2943403 - RNA, 15 nt, Human
cuucagccugaaaga

SEQ ID NO: 2943404 - RNA, 14 nt, Human
cuguuuuauaauuu

SEQ ID NO: 2943405 - RNA, 15 nt, Human
cuguuuuauaauuuu

SEQ ID NO: 2943406 - RNA, 18 nt, Human
cuguuuuuauuauuaaca

SEQ ID NO: 2943407 - RNA, 17 nt, Human
cuuaaaaaguggaaaaa

SEQ ID NO: 2943408 - RNA, 16 nt, Human
cuuaaaaaguggaaaa

SEQ ID NO: 2943409 - RNA, 14 nt, Human
cuuaaaaacaacga

SEQ ID NO: 2943410 - RNA, 12 nt, Human
cuuaaaaacaac

SEQ ID NO: 2943411 - RNA, 20 nt, Human
cuguuuuuauuauuaacaaa

SEQ ID NO: 2943412 - RNA, 17 nt, Human
cuguugcccaggcuggc

SEQ ID NO: 2943413 - RNA, 14 nt, Human
cuguuuagauaaua

SEQ ID NO: 2943414 - RNA, 17 nt, Human
cuguuuagauaauacac

SEQ ID NO: 2943415 - RNA, 15 nt, Human
cuguuucaaacuuua

SEQ ID NO: 2943416 - RNA, 17 nt, Human
cuguuucaaacuuuacu

SEQ ID NO: 2943417 - RNA, 18 nt, Human
cuguuuagauaauacacc

SEQ ID NO: 2943418 - RNA, 19 nt, Human
cuguuugcuaagugaggau

SEQ ID NO: 2943419 - RNA, 17 nt, Human
cuguuugcuaagugagg

SEQ ID NO: 2943420 - RNA, 16 nt, Human
cuguuaauaguucagg

SEQ ID NO: 2943421 - RNA, 15 nt, Human
cuguucuuuccaaag

SEQ ID NO: 2943422 - RNA, 16 nt, Human
cuguucuuuccaaagu

SEQ ID NO: 2943423 - RNA, 19 nt, Human
cuguucuuuccaaaguaca

SEQ ID NO: 2943424 - RNA, 21 nt, Human
cuguucuuuccaaaguacacu

SEQ ID NO: 2943425 - RNA, 13 nt, Human
cuguucuuucugg

SEQ ID NO: 2943426 - RNA, 14 nt, Human
cuguucuuucuggc

SEQ ID NO: 2943427 - RNA, 21 nt, Human
cuguucuuucuggcuaugcau

SEQ ID NO: 2943428 - RNA, 12 nt, Human
cuguugcccagg

SEQ ID NO: 2943429 - RNA, 13 nt, Human
cuguugcccaggc

SEQ ID NO: 2943430 - RNA, 14 nt, Human
cuguugcccaggcu

SEQ ID NO: 2943431 - RNA, 15 nt, Human
cuguugcccaggcug

SEQ ID NO: 2943432 - RNA, 16 nt, Human
cuguugcccaggcugg

SEQ ID NO: 2943433 - RNA, 23 nt, Human
cuguucuuucuggcuaugcauuu

SEQ ID NO: 2943434 - RNA, 23 nt, Human
cuuaagaagacugcauuauauuu

SEQ ID NO: 2943435 - RNA, 21 nt, Human
cuuaagaagacugcauuauau

SEQ ID NO: 2943436 - RNA, 15 nt, Human
cuuaagacuuaauga

SEQ ID NO: 2943437 - RNA, 17 nt, Human
cuuaagacuuaaugaga

SEQ ID NO: 2943438 - RNA, 16 nt, Human
cuuaauuauugauguu

SEQ ID NO: 2943439 - RNA, 20 nt, Human
cuuaauucuuagcucauucu

SEQ ID NO: 2943440 - RNA, 10 nt, Human
cuuaauuauu

SEQ ID NO: 2943441 - RNA, 20 nt, Human
cuuaauuaaaagaauauuuu

SEQ ID NO: 2943442 - RNA, 19 nt, Human
cuuaauuaaaagaauauuu

SEQ ID NO: 2943443 - RNA, 15 nt, Human
cuuaaugaaaacaau

SEQ ID NO: 2943444 - RNA, 19 nt, Human
cuuaaugagacuuuaaaag

SEQ ID NO: 2943445 - RNA, 17 nt, Human
cuuaauuaaaagaauau

SEQ ID NO: 2943446 - RNA, 16 nt, Human
cuuaauuaaaagaaua

SEQ ID NO: 2943447 - RNA, 20 nt, Human
cuuaccugccaggaagccag

SEQ ID NO: 2943448 - RNA, 13 nt, Human
cuuaccugccagg

SEQ ID NO: 2943449 - RNA, 23 nt, Human
cuuagaaauaacagaagaaaaua

SEQ ID NO: 2943450 - RNA, 21 nt, Human
cuuagaaauaacagaagaaaa

SEQ ID NO: 2943451 - RNA, 20 nt, Human
cuuagaaaaaccaccaccau

SEQ ID NO: 2943452 - RNA, 17 nt, Human
cuuagaagucacacagu

SEQ ID NO: 2943453 - RNA, 20 nt, Human
cuuagaagucacacaguauu

SEQ ID NO: 2943454 - RNA, 21 nt, Human
cuuagguuggcaaaaaggcag

SEQ ID NO: 2943455 - RNA, 23 nt, Human
cuuagguuggcaaaaaggcagga

SEQ ID NO: 2943456 - RNA, 19 nt, Human
cuuagaauuaguggcacuu

SEQ ID NO: 2943457 - RNA, 22 nt, Human
cuuagacccucaugcugccaau

SEQ ID NO: 2943458 - RNA, 21 nt, Human
cuuagacccucaugcugccaa

SEQ ID NO: 2943459 - RNA, 20 nt, Human
cuuagacccucaugcugcca

SEQ ID NO: 2943460 - RNA, 19 nt, Human
cuuagacccucaugcugcc

SEQ ID NO: 2943461 - RNA, 23 nt, Human
cuuagacccucaugcugccaaua

SEQ ID NO: 2943462 - RNA, 15 nt, Human
cuguguuguacagcu

SEQ ID NO: 2943463 - RNA, 19 nt, Human
cuguuaaaagaugaaaaua

SEQ ID NO: 2943464 - RNA, 16 nt, Human
cuguuaaaagaugaaa

SEQ ID NO: 2943465 - RNA, 15 nt, Human
cuguuaaaagaugaa

SEQ ID NO: 2943466 - RNA, 20 nt, Human
cugugucuuuuuucacuaca

SEQ ID NO: 2943467 - RNA, 21 nt, Human
cuguggguuucuaaagcugcc

SEQ ID NO: 2943468 - RNA, 22 nt, Human
cuguggguuucuaaagcugcca

SEQ ID NO: 2943469 - RNA, 22 nt, Human
cugugaaaggaaagagggaggu

SEQ ID NO: 2943470 - RNA, 16 nt, Human
cugugaaaggaaagag

SEQ ID NO: 2943471 - RNA, 22 nt, Human
cugugauuuuugguauuugaaa

SEQ ID NO: 2943472 - RNA, 23 nt, Human
cugugauggggcccugccuccuu

SEQ ID NO: 2943473 - RNA, 21 nt, Human
cugugauggggcccugccucc

SEQ ID NO: 2943474 - RNA, 16 nt, Human
cugugauggggcccug

SEQ ID NO: 2943475 - RNA, 15 nt, Human
cugugauggggcccu

SEQ ID NO: 2943476 - RNA, 15 nt, Human
cugugccaugugcca

SEQ ID NO: 2943477 - RNA, 22 nt, Human
cugugccauuuuguauuuuacu

SEQ ID NO: 2943478 - RNA, 19 nt, Human
cugugcccuaaaguguauu

SEQ ID NO: 2943479 - RNA, 14 nt, Human
cugugccaugugcc

SEQ ID NO: 2943480 - RNA, 21 nt, Human
cugucauuugagcagggcuca

SEQ ID NO: 2943481 - RNA, 22 nt, Human
cugucauuugagcagggcucag

SEQ ID NO: 2943482 - RNA, 20 nt, Human
cugucauuugagcagggcuc

SEQ ID NO: 2943483 - RNA, 18 nt, Human
cugucaauuacaggaagu

SEQ ID NO: 2943484 - RNA, 23 nt, Human
cugucauuugagcagggcucagc

SEQ ID NO: 2943485 - RNA, 14 nt, Human
cugucuuuuaaacu

SEQ ID NO: 2943486 - RNA, 15 nt, Human
cugucuuuuaaacuc

SEQ ID NO: 2943487 - RNA, 15 nt, Human
cugugaaaggaaaga

SEQ ID NO: 2943488 - RNA, 18 nt, Human
cugucuucaguaagccgu

SEQ ID NO: 2943489 - RNA, 18 nt, Human
cugucuucacaacagauu

SEQ ID NO: 2943490 - RNA, 20 nt, Human
cuguauuuuguuuuugucuu

SEQ ID NO: 2943491 - RNA, 13 nt, Human
cugucaauuacag

SEQ ID NO: 2943492 - RNA, 16 nt, Human
cugucaauuacaggaa

SEQ ID NO: 2943493 - RNA, 15 nt, Human
cugucaauuacagga

SEQ ID NO: 2943494 - RNA, 21 nt, Human
cuguaucccaugagccucagc

SEQ ID NO: 2943495 - RNA, 22 nt, Human
cuguaucccaugagccucagca

SEQ ID NO: 2943496 - RNA, 20 nt, Human
cuguaucccaugagccucag

SEQ ID NO: 2943497 - RNA, 19 nt, Human
cuguaucccaugagccuca

SEQ ID NO: 2943498 - RNA, 19 nt, Human
cuguacgucugacaggcaa

SEQ ID NO: 2943499 - RNA, 20 nt, Human
cuguacgucugacaggcaau

SEQ ID NO: 2943500 - RNA, 17 nt, Human
cuguacaugaaaacaca

SEQ ID NO: 2943501 - RNA, 20 nt, Human
cuguacaugaaaacacauuu

SEQ ID NO: 2943502 - RNA, 21 nt, Human
cuguacaugaaaacacauuuu

SEQ ID NO: 2943503 - RNA, 14 nt, Human
cuguacgucugaca

SEQ ID NO: 2943504 - RNA, 15 nt, Human
cuguacgucugacag

SEQ ID NO: 2943505 - RNA, 16 nt, Human
cuguacgucugacagg

SEQ ID NO: 2943506 - RNA, 18 nt, Human
cuguacgucugacaggca

SEQ ID NO: 2943507 - RNA, 14 nt, Human
cuguaauuugugau

SEQ ID NO: 2943508 - RNA, 15 nt, Human
cuguaauuugugaua

SEQ ID NO: 2943509 - RNA, 22 nt, Human
cuguacagagcccacgccccca

SEQ ID NO: 2943510 - RNA, 18 nt, Human
cuguacagagcccacgcc

SEQ ID NO: 2943511 - RNA, 15 nt, Human
cuguacagagcccac

SEQ ID NO: 2943512 - RNA, 14 nt, Human
cuguacagagccca

SEQ ID NO: 2943513 - RNA, 19 nt, Human
cuguaauccuagcacuuug

SEQ ID NO: 2943514 - RNA, 22 nt, Human
cugguuagagguucccuuugac

SEQ ID NO: 2943515 - RNA, 21 nt, Human
cugguuagagguucccuuuga

SEQ ID NO: 2943516 - RNA, 16 nt, Human
cugguggcagcucacc

SEQ ID NO: 2943517 - RNA, 18 nt, Human
cugguggcagcucaccuc

SEQ ID NO: 2943518 - RNA, 17 nt, Human
cugguggcagcucaccu

SEQ ID NO: 2943519 - RNA, 15 nt, Human
cugguggcagcugcg

SEQ ID NO: 2943520 - RNA, 20 nt, Human
cugguggcagcucaccucuc

SEQ ID NO: 2943521 - RNA, 14 nt, Human
cugguggcaguggg

SEQ ID NO: 2943522 - RNA, 18 nt, Human
cugguggcagugggagcu

SEQ ID NO: 2943523 - RNA, 19 nt, Human
cugggccucggaccccacu

SEQ ID NO: 2943524 - RNA, 17 nt, Human
cugggccucggacccca

SEQ ID NO: 2943525 - RNA, 17 nt, Human
cugggauuggcugugaa

SEQ ID NO: 2943526 - RNA, 21 nt, Human
cugggauuggcugugaacuga

SEQ ID NO: 2943527 - RNA, 15 nt, Human
cugggcaacagagca

SEQ ID NO: 2943528 - RNA, 18 nt, Human
cugggcaacagagcaaga

SEQ ID NO: 2943529 - RNA, 14 nt, Human
cugggauuggcugu

SEQ ID NO: 2943530 - RNA, 19 nt, Human
cugggcaacagagcaagac

SEQ ID NO: 2943531 - RNA, 21 nt, Human
cugggauuacaagcgugagcc

SEQ ID NO: 2943532 - RNA, 14 nt, Human
cugggggcugggca

SEQ ID NO: 2943533 - RNA, 18 nt, Human
cugggggcugggcagagg

SEQ ID NO: 2943534 - RNA, 15 nt, Human
cugggcuucaguggc

SEQ ID NO: 2943535 - RNA, 22 nt, Human
cugggcuuggggaccagagcug

SEQ ID NO: 2943536 - RNA, 18 nt, Human
cugggcuugucuguagau

SEQ ID NO: 2943537 - RNA, 23 nt, Human
cugggguggguggggcagugcuu

SEQ ID NO: 2943538 - RNA, 21 nt, Human
gaacuagaguuuagcuggaaa

SEQ ID NO: 2943539 - RNA, 22 nt, Human
gaacuagaguuuagcuggaaaa

SEQ ID NO: 2943540 - RNA, 16 nt, Human
gaaccaccacacccag

SEQ ID NO: 2943541 - RNA, 17 nt, Human
gaaccaccacacccagc

SEQ ID NO: 2943542 - RNA, 15 nt, Human
gaacagacuggaagc

SEQ ID NO: 2943543 - RNA, 16 nt, Human
gaacagacuggaagca

SEQ ID NO: 2943544 - RNA, 20 nt, Human
gaaccacaucuugcucugcu

SEQ ID NO: 2943545 - RNA, 21 nt, Human
gaaccacaucuugcucugcug

SEQ ID NO: 2943546 - RNA, 15 nt, Human
gaagaaaauagaauu

SEQ ID NO: 2943547 - RNA, 21 nt, Human
gaagaaaauagaauugacauu

SEQ ID NO: 2943548 - RNA, 14 nt, Human
gaagaaaauaauua

SEQ ID NO: 2943549 - RNA, 21 nt, Human
gaagaagcaccaaucaugaau

SEQ ID NO: 2943550 - RNA, 13 nt, Human
gaacuuggcgcug

SEQ ID NO: 2943551 - RNA, 16 nt, Human
gaacuuggcgcugccc

SEQ ID NO: 2943552 - RNA, 15 nt, Human
gaacuuggcgcugcc

SEQ ID NO: 2943553 - RNA, 21 nt, Human
gaacuuguaaaggaauuuaaa

SEQ ID NO: 2943554 - RNA, 12 nt, Human
gaacuugguucc

SEQ ID NO: 2943555 - RNA, 23 nt, Human
gaacuugguucccauuugcuccu

SEQ ID NO: 2943556 - RNA, 22 nt, Human
gaacuuccagauccuggaaauc

SEQ ID NO: 2943557 - RNA, 22 nt, Human
gaacuggguacuuguggacaca

SEQ ID NO: 2943558 - RNA, 14 nt, Human
gaacucccuuucaa

SEQ ID NO: 2943559 - RNA, 17 nt, Human
gaaauuuguuauaauga

SEQ ID NO: 2943560 - RNA, 18 nt, Human
gaaauuguauuacaaauc

SEQ ID NO: 2943561 - RNA, 14 nt, Human
gaaaugggcagagc

SEQ ID NO: 2943562 - RNA, 20 nt, Human
gaaaugggcagagcagagac

SEQ ID NO: 2943563 - RNA, 13 nt, Human
gaaauauuauguu

SEQ ID NO: 2943564 - RNA, 16 nt, Human
gaaauauuauguuaaa

SEQ ID NO: 2943565 - RNA, 20 nt, Human
gaaauaacagaagaaaauag

SEQ ID NO: 2943566 - RNA, 22 nt, Human
gaaauaacagaagaaaauagaa

SEQ ID NO: 2943567 - RNA, 17 nt, Human
gaaauaacagaagaaaa

SEQ ID NO: 2943568 - RNA, 18 nt, Human
gaaauaacagaagaaaau

SEQ ID NO: 2943569 - RNA, 19 nt, Human
gaaauaacagaagaaaaua

SEQ ID NO: 2943570 - RNA, 20 nt, Human
gaaauaucugaaaauguaug

SEQ ID NO: 2943571 - RNA, 13 nt, Human
gaaauauaauuga

SEQ ID NO: 2943572 - RNA, 21 nt, Human
gaaauaucugaaaauguaugu

SEQ ID NO: 2943573 - RNA, 21 nt, Human
gaagccuuggggcugaugcag

SEQ ID NO: 2943574 - RNA, 21 nt, Human
gaagccgcuggggccaguugg

SEQ ID NO: 2943575 - RNA, 22 nt, Human
gaagcccaggaaaggcuccagg

SEQ ID NO: 2943576 - RNA, 21 nt, Human
gaagcccaggaaaggcuccag

SEQ ID NO: 2943577 - RNA, 20 nt, Human
gaagcccaggaaaggcucca

SEQ ID NO: 2943578 - RNA, 23 nt, Human
gaagccagcaggcucucaggcca

SEQ ID NO: 2943579 - RNA, 19 nt, Human
gaagacucauucuucugua

SEQ ID NO: 2943580 - RNA, 21 nt, Human
gaagacucauucuucuguacg

SEQ ID NO: 2943581 - RNA, 16 nt, Human
gaagccagcaggcucu

SEQ ID NO: 2943582 - RNA, 15 nt, Human
gaagccagcaggcuc

SEQ ID NO: 2943583 - RNA, 15 nt, Human
gaagguagaauguuu

SEQ ID NO: 2943584 - RNA, 17 nt, Human
gaagguagaauguuuuc

SEQ ID NO: 2943585 - RNA, 16 nt, Human
gaagguagaauguuuu

SEQ ID NO: 2943586 - RNA, 20 nt, Human
gaagguagaauguuuucaaa

SEQ ID NO: 2943587 - RNA, 16 nt, Human
gaaggccccgcccagg

SEQ ID NO: 2943588 - RNA, 15 nt, Human
gaaggccccgcccag

SEQ ID NO: 2943589 - RNA, 14 nt, Human
gaaggccccgccca

SEQ ID NO: 2943590 - RNA, 18 nt, Human
gaaggaaacccagcucug

SEQ ID NO: 2943591 - RNA, 17 nt, Human
gaaggaaacccagcucu

SEQ ID NO: 2943592 - RNA, 14 nt, Human
gaaggaaacccagc

SEQ ID NO: 2943593 - RNA, 12 nt, Human
gaaggauacaaa

SEQ ID NO: 2943594 - RNA, 19 nt, Human
gaaggauacaaaagcaugu

SEQ ID NO: 2943595 - RNA, 21 nt, Human
gaaggauacaaaagcauguga

SEQ ID NO: 2943596 - RNA, 14 nt, Human
gaauacuuuauaaa

SEQ ID NO: 2943597 - RNA, 14 nt, Human
gaauaacauguaau

SEQ ID NO: 2943598 - RNA, 20 nt, Human
gaauaauccuaaacauauga

SEQ ID NO: 2943599 - RNA, 17 nt, Human
gaaguaaaauguggcag

SEQ ID NO: 2943600 - RNA, 18 nt, Human
gaaguaaaauguggcagg

SEQ ID NO: 2943601 - RNA, 12 nt, Human
gaaguuucugcc

SEQ ID NO: 2943602 - RNA, 15 nt, Human
gaauagcugggacua

SEQ ID NO: 2943603 - RNA, 14 nt, Human
gaauagcugggacu

SEQ ID NO: 2943604 - RNA, 19 nt, Human
gaaugaaagggcccagaga

SEQ ID NO: 2943605 - RNA, 14 nt, Human
gaaugaaagggccc

SEQ ID NO: 2943606 - RNA, 16 nt, Human
gaaucucaaauaacua

SEQ ID NO: 2943607 - RNA, 20 nt, Human
cuuuguuuguugucagcuga

SEQ ID NO: 2943608 - RNA, 18 nt, Human
cuuuguuuguugucagcu

SEQ ID NO: 2943609 - RNA, 22 nt, Human
cuuuucauaaccuagccuuaga

SEQ ID NO: 2943610 - RNA, 20 nt, Human
cuuuucauaaccuagccuua

SEQ ID NO: 2943611 - RNA, 16 nt, Human
cuuuucuuucagccaa

SEQ ID NO: 2943612 - RNA, 23 nt, Human
cuuuucuugcaugaggcuagugu

SEQ ID NO: 2943613 - RNA, 18 nt, Human
cuuuucuugcaugaggcu

SEQ ID NO: 2943614 - RNA, 23 nt, Human
cuuuucuguccgagcuuugaaaa

SEQ ID NO: 2943615 - RNA, 18 nt, Human
cuuuucuguccgagcuuu

SEQ ID NO: 2943616 - RNA, 14 nt, Human
cuuugugauuuuug

SEQ ID NO: 2943617 - RNA, 22 nt, Human
cuuuguccccaccgcagacagg

SEQ ID NO: 2943618 - RNA, 18 nt, Human
cuuuguccccaccgcaga

SEQ ID NO: 2943619 - RNA, 13 nt, Human
cuuugggaggcca

SEQ ID NO: 2943620 - RNA, 15 nt, Human
cuuuguucuggcucu

SEQ ID NO: 2943621 - RNA, 14 nt, Human
cuuuguucuggcuc

SEQ ID NO: 2943622 - RNA, 19 nt, Human
cuuugugauuuuuguaauu

SEQ ID NO: 2943623 - RNA, 17 nt, Human
cuuugugauuuuuguaa

SEQ ID NO: 2943624 - RNA, 18 nt, Human
cuuugugauuuuuguaau

SEQ ID NO: 2943625 - RNA, 16 nt, Human
cuuucccaucuuccaa

SEQ ID NO: 2943626 - RNA, 16 nt, Human
cuuuggacccugaggc

SEQ ID NO: 2943627 - RNA, 15 nt, Human
cuuuggacccugagg

SEQ ID NO: 2943628 - RNA, 18 nt, Human
cuuuggacccugaggccc

SEQ ID NO: 2943629 - RNA, 17 nt, Human
cuuuggacccugaggcc

SEQ ID NO: 2943630 - RNA, 19 nt, Human
cuuuggacccugaggccca

SEQ ID NO: 2943631 - RNA, 23 nt, Human
gaaaaaggaugcacagaguuguu

SEQ ID NO: 2943632 - RNA, 17 nt, Human
gaaaaaggaugcacaga

SEQ ID NO: 2943633 - RNA, 22 nt, Human
cuuuuuucucugauacagaaaa

SEQ ID NO: 2943634 - RNA, 15 nt, Human
cuuuuuuggcugcug

SEQ ID NO: 2943635 - RNA, 14 nt, Human
cuuuuuuggcugcu

SEQ ID NO: 2943636 - RNA, 15 nt, Human
cuuuuuucacuacau

SEQ ID NO: 2943637 - RNA, 20 nt, Human
cuuuuuucucugauacagaa

SEQ ID NO: 2943638 - RNA, 21 nt, Human
cuuuugagugccuuacacaau

SEQ ID NO: 2943639 - RNA, 16 nt, Human
cuuuugagcauuuaga

SEQ ID NO: 2943640 - RNA, 14 nt, Human
gaaaacguggcugc

SEQ ID NO: 2943641 - RNA, 18 nt, Human
gaaaacguggcugcuuca

SEQ ID NO: 2943642 - RNA, 16 nt, Human
gaaaacguggcugcuu

SEQ ID NO: 2943643 - RNA, 15 nt, Human
gaaaacguggcugcu

SEQ ID NO: 2943644 - RNA, 12 nt, Human
gaaaacaugcua

SEQ ID NO: 2943645 - RNA, 14 nt, Human
gaaaacaugcuaca

SEQ ID NO: 2943646 - RNA, 15 nt, Human
gaaaacaugcuacac

SEQ ID NO: 2943647 - RNA, 12 nt, Human
gaaaacaaugca

SEQ ID NO: 2943648 - RNA, 13 nt, Human
gaaaacacauuuu

SEQ ID NO: 2943649 - RNA, 22 nt, Human
gaaaacaauaacgauaaaagac

SEQ ID NO: 2943650 - RNA, 14 nt, Human
gaaaaucagccugc

SEQ ID NO: 2943651 - RNA, 12 nt, Human
gaaaauaucacu

SEQ ID NO: 2943652 - RNA, 19 nt, Human
gaaaaucuuauaauuuaaa

SEQ ID NO: 2943653 - RNA, 18 nt, Human
gaaaaucagccugcucca

SEQ ID NO: 2943654 - RNA, 16 nt, Human
gaaaaucagccugcuc

SEQ ID NO: 2943655 - RNA, 13 nt, Human
gaaaagcugcuga

SEQ ID NO: 2943656 - RNA, 17 nt, Human
gaaaagcugcugacagu

SEQ ID NO: 2943657 - RNA, 19 nt, Human
gaaaauaacgauaaaagac

SEQ ID NO: 2943658 - RNA, 22 nt, Human
gaaacacugguuuuaaauauuu

SEQ ID NO: 2943659 - RNA, 18 nt, Human
gaaacagaugaaaagccu

SEQ ID NO: 2943660 - RNA, 18 nt, Human
gaaacagcuaaugggaca

SEQ ID NO: 2943661 - RNA, 13 nt, Human
gaaacacugguuu

SEQ ID NO: 2943662 - RNA, 20 nt, Human
gaaaaucuuauaauuuaaaa

SEQ ID NO: 2943663 - RNA, 18 nt, Human
cuuuaaagggauggcaag

SEQ ID NO: 2943664 - RNA, 19 nt, Human
cuuuaaacuacauuagguu

SEQ ID NO: 2943665 - RNA, 16 nt, Human
cuuguuuaaugguagu

SEQ ID NO: 2943666 - RNA, 21 nt, Human
cuuguguguuuauugucaaag

SEQ ID NO: 2943667 - RNA, 20 nt, Human
cuuguguguuuauugucaaa

SEQ ID NO: 2943668 - RNA, 13 nt, Human
cuuuccacagaag

SEQ ID NO: 2943669 - RNA, 22 nt, Human
cuuuccaaaugcccagcuuaaa

SEQ ID NO: 2943670 - RNA, 19 nt, Human
cuuuccaaaugcccagcuu

SEQ ID NO: 2943671 - RNA, 18 nt, Human
cuuuccaaaugcccagcu

SEQ ID NO: 2943672 - RNA, 21 nt, Human
cuuuauuuucuauaauuuaaa

SEQ ID NO: 2943673 - RNA, 20 nt, Human
cuugcuucaaccccaugaga

SEQ ID NO: 2943674 - RNA, 16 nt, Human
cuugcucugcugacag

SEQ ID NO: 2943675 - RNA, 17 nt, Human
cuugcucugcugacaga

SEQ ID NO: 2943676 - RNA, 13 nt, Human
cuuggaagcuccg

SEQ ID NO: 2943677 - RNA, 13 nt, Human
cuuggaggaagga

SEQ ID NO: 2943678 - RNA, 16 nt, Human
cuuggaaaugggagac

SEQ ID NO: 2943679 - RNA, 17 nt, Human
cuucuccacccugcucu

SEQ ID NO: 2943680 - RNA, 18 nt, Human
cuucuccacccugcucuc

SEQ ID NO: 2943681 - RNA, 16 nt, Human
cuucuccacccugcuc

SEQ ID NO: 2943682 - RNA, 21 nt, Human
cuucuccacccugcucuccga

SEQ ID NO: 2943683 - RNA, 21 nt, Human
cuugccaucccucccuccacc

SEQ ID NO: 2943684 - RNA, 13 nt, Human
cuugcucugcuga

SEQ ID NO: 2943685 - RNA, 14 nt, Human
cuugcucugcugac

SEQ ID NO: 2943686 - RNA, 15 nt, Human
cuugcccagccugga

SEQ ID NO: 2943687 - RNA, 13 nt, Human
cuugcccagccug

SEQ ID NO: 2943688 - RNA, 17 nt, Human
cuugcccagccuggaug

SEQ ID NO: 2943689 - RNA, 16 nt, Human
cuugcccagccuggau

SEQ ID NO: 2943690 - RNA, 22 nt, Human
cuugccaucccucccuccaccu

SEQ ID NO: 2943691 - RNA, 16 nt, Human
cuuggcugcagggagu

SEQ ID NO: 2943692 - RNA, 22 nt, Human
cuuggaggaaggaaacccagcu

SEQ ID NO: 2943693 - RNA, 23 nt, Human
cuuggagggcaugaagacagaua

SEQ ID NO: 2943694 - RNA, 12 nt, Human
cuuggagggcau

SEQ ID NO: 2943695 - RNA, 14 nt, Human
cuuggcugcaggga

SEQ ID NO: 2943696 - RNA, 17 nt, Human
cuuggcugcagggaguc

SEQ ID NO: 2943697 - RNA, 13 nt, Human
cuugggcuucauc

SEQ ID NO: 2943698 - RNA, 14 nt, Human
cuugggccacugug

SEQ ID NO: 2943699 - RNA, 21 nt, Human
cuuggggaccagagcugccac

SEQ ID NO: 2943700 - RNA, 20 nt, Human
cuuggggaccagagcugcca

SEQ ID NO: 2943701 - RNA, 22 nt, Human
cuugggcuucauccuccucaga

SEQ ID NO: 2943702 - RNA, 22 nt, Human
cuuggggaccagagcugccacc

SEQ ID NO: 2943703 - RNA, 15 nt, Human
cuuggggggcugagg

SEQ ID NO: 2943704 - RNA, 19 nt, Human
cuuguaaaggaauuuaaaa

SEQ ID NO: 2943705 - RNA, 16 nt, Human
cuuggggggcugaggu

SEQ ID NO: 2943706 - RNA, 18 nt, Human
cuuguaaaggaauuuaaa

SEQ ID NO: 2943707 - RNA, 18 nt, Human
cuccucagaucuucugug

SEQ ID NO: 2943708 - RNA, 20 nt, Human
cucccuuggauuguccccga

SEQ ID NO: 2943709 - RNA, 15 nt, Human
cuccuccagagucag

SEQ ID NO: 2943710 - RNA, 13 nt, Human
cuccuccagaguc

SEQ ID NO: 2943711 - RNA, 15 nt, Human
cuccuccagccgcca

SEQ ID NO: 2943712 - RNA, 18 nt, Human
cucccgaguagcugggac

SEQ ID NO: 2943713 - RNA, 19 nt, Human
cucccgaguagcugggacu

SEQ ID NO: 2943714 - RNA, 20 nt, Human
cucccgaguagcugggacua

SEQ ID NO: 2943715 - RNA, 13 nt, Human
cuccccuccucug

SEQ ID NO: 2943716 - RNA, 21 nt, Human
cuccccagcaagugagagcug

SEQ ID NO: 2943717 - RNA, 11 nt, Human
cuccccuccuc

SEQ ID NO: 2943718 - RNA, 22 nt, Human
cuccccagcaagugagagcugg

SEQ ID NO: 2943719 - RNA, 23 nt, Human
cuccccagcaagugagagcuggg

SEQ ID NO: 2943720 - RNA, 13 nt, Human
cuccauccugagg

SEQ ID NO: 2943721 - RNA, 20 nt, Human
cuccccuccucugcuugcca

SEQ ID NO: 2943722 - RNA, 22 nt, Human
cucgagcaugccuggauggggc

SEQ ID NO: 2943723 - RNA, 19 nt, Human
cucgagcaugccuggaugg

SEQ ID NO: 2943724 - RNA, 16 nt, Human
cucgagcaugccugga

SEQ ID NO: 2943725 - RNA, 15 nt, Human
cucgagcaugccugg

SEQ ID NO: 2943726 - RNA, 13 nt, Human
cucgagcaugccu

SEQ ID NO: 2943727 - RNA, 23 nt, Human
cuccuuggugucgggcaugacac

SEQ ID NO: 2943728 - RNA, 22 nt, Human
cuccugccucgaacuggcugca

SEQ ID NO: 2943729 - RNA, 18 nt, Human
cuccugccucgaacuggc

SEQ ID NO: 2943730 - RNA, 20 nt, Human
cuccugccucgaacuggcug

SEQ ID NO: 2943731 - RNA, 21 nt, Human
cuccugccucgaacuggcugc

SEQ ID NO: 2943732 - RNA, 17 nt, Human
cuccugccucagccucc

SEQ ID NO: 2943733 - RNA, 16 nt, Human
cuccugccucagccuc

SEQ ID NO: 2943734 - RNA, 12 nt, Human
cuccugccucag

SEQ ID NO: 2943735 - RNA, 11 nt, Human
cuccugccuca

SEQ ID NO: 2943736 - RNA, 13 nt, Human
cuccucuccccag

SEQ ID NO: 2943737 - RNA, 15 nt, Human
cuccucuccccagca

SEQ ID NO: 2943738 - RNA, 14 nt, Human
cuccuggaaauauu

SEQ ID NO: 2943739 - RNA, 21 nt, Human
cuccugugugugcgccuacag

SEQ ID NO: 2943740 - RNA, 23 nt, Human
cuccugugugugcgccuacagga

SEQ ID NO: 2943741 - RNA, 24 nt, Human
cuccugugugugcgccuacaggag

SEQ ID NO: 2943742 - RNA, 21 nt, Human
cucauaguaugguggcugggu

SEQ ID NO: 2943743 - RNA, 15 nt, Human
cucauacccaccccc

SEQ ID NO: 2943744 - RNA, 14 nt, Human
cucauacucaccuc

SEQ ID NO: 2943745 - RNA, 22 nt, Human
cucauacucaccucaccccacu

SEQ ID NO: 2943746 - RNA, 20 nt, Human
cucaggugauccacccaccu

SEQ ID NO: 2943747 - RNA, 18 nt, Human
cucaggugauccacccac

SEQ ID NO: 2943748 - RNA, 19 nt, Human
cucaggugauccacccacc

SEQ ID NO: 2943749 - RNA, 21 nt, Human
cucauacccacccccacccaa

SEQ ID NO: 2943750 - RNA, 19 nt, Human
cucauacccacccccaccc

SEQ ID NO: 2943751 - RNA, 18 nt, Human
cucauacccacccccacc

SEQ ID NO: 2943752 - RNA, 16 nt, Human
cucauacccaccccca

SEQ ID NO: 2943753 - RNA, 22 nt, Human
cucaucaccaacgucugugcca

SEQ ID NO: 2943754 - RNA, 23 nt, Human
cucauaguaugguggcuggguug

SEQ ID NO: 2943755 - RNA, 21 nt, Human
cucaucaccaacgucugugcc

SEQ ID NO: 2943756 - RNA, 15 nt, Human
cucauccucauaccc

SEQ ID NO: 2943757 - RNA, 15 nt, Human
cucagcauccuggca

SEQ ID NO: 2943758 - RNA, 18 nt, Human
cucagcauccuggcaccc

SEQ ID NO: 2943759 - RNA, 23 nt, Human
cucaggaguuugagaccaaccug

SEQ ID NO: 2943760 - RNA, 18 nt, Human
cucaggaguuugagacca

SEQ ID NO: 2943761 - RNA, 13 nt, Human
cucagggccuggc

SEQ ID NO: 2943762 - RNA, 15 nt, Human
cucagggccuggcuc

SEQ ID NO: 2943763 - RNA, 14 nt, Human
cucagggccuggcu

SEQ ID NO: 2943764 - RNA, 16 nt, Human
cucagggccuggcuca

SEQ ID NO: 2943765 - RNA, 15 nt, Human
cucagggccuggucg

SEQ ID NO: 2943766 - RNA, 17 nt, Human
cucagggucccuggugg

SEQ ID NO: 2943767 - RNA, 16 nt, Human
cucagggucccuggug

SEQ ID NO: 2943768 - RNA, 15 nt, Human
cucagggucccuggu

SEQ ID NO: 2943769 - RNA, 20 nt, Human
cucaggugagaagcagagga

SEQ ID NO: 2943770 - RNA, 19 nt, Human
cucaggugagaagcagagg

SEQ ID NO: 2943771 - RNA, 14 nt, Human
cucaggugagaagc

SEQ ID NO: 2943772 - RNA, 16 nt, Human
cucaggugagaagcag

SEQ ID NO: 2943773 - RNA, 17 nt, Human
cucauguugaaacuuua

SEQ ID NO: 2943774 - RNA, 17 nt, Human
cucauuugucacacacu

SEQ ID NO: 2943775 - RNA, 14 nt, Human
cucauuucuagcag

SEQ ID NO: 2943776 - RNA, 21 nt, Human
cucauuuccaagcaaguauua

SEQ ID NO: 2943777 - RNA, 15 nt, Human
cuccaaaauaaaacu

SEQ ID NO: 2943778 - RNA, 16 nt, Human
cuccaaaauaaaacuu

SEQ ID NO: 2943779 - RNA, 21 nt, Human
cuccaaacugacucuuaagaa

SEQ ID NO: 2943780 - RNA, 12 nt, Human
cuccaaagaaau

SEQ ID NO: 2943781 - RNA, 13 nt, Human
cuccaaagaaaug

SEQ ID NO: 2943782 - RNA, 13 nt, Human
cuccacccugcuc

SEQ ID NO: 2943783 - RNA, 15 nt, Human
cuccacauuuguuuu

SEQ ID NO: 2943784 - RNA, 13 nt, Human
cuccacauuuguu

SEQ ID NO: 2943785 - RNA, 15 nt, Human
cuccacccugcucuc

SEQ ID NO: 2943786 - RNA, 23 nt, Human
cuccaccucccugcaauaaaaug

SEQ ID NO: 2943787 - RNA, 12 nt, Human
cuccagccuggg

SEQ ID NO: 2943788 - RNA, 17 nt, Human
cuccagccccuggaugc

SEQ ID NO: 2943789 - RNA, 16 nt, Human
cuccagccccuggaug

SEQ ID NO: 2943790 - RNA, 20 nt, Human
cuccagccccuggaugcagc

SEQ ID NO: 2943791 - RNA, 14 nt, Human
cuccaccugccagg

SEQ ID NO: 2943792 - RNA, 13 nt, Human
cuccaccugccag

SEQ ID NO: 2943793 - RNA, 12 nt, Human
cuccaccugcca

SEQ ID NO: 2943794 - RNA, 17 nt, Human
cuccaccuugcagcucu

SEQ ID NO: 2943795 - RNA, 15 nt, Human
cuccagccccuggau

SEQ ID NO: 2943796 - RNA, 13 nt, Human
cuccaggagcagc

SEQ ID NO: 2943797 - RNA, 11 nt, Human
cuccaggagca

SEQ ID NO: 2943798 - RNA, 17 nt, Human
cuccaggagcagccaca

SEQ ID NO: 2943799 - RNA, 16 nt, Human
cuccaggagcagccac

SEQ ID NO: 2943800 - RNA, 15 nt, Human
cuccaggagcagcca

SEQ ID NO: 2943801 - RNA, 14 nt, Human
cuccaggagcagcc

SEQ ID NO: 2943802 - RNA, 19 nt, Human
cuccaggcagcagacacau

SEQ ID NO: 2943803 - RNA, 23 nt, Human
cuccaggagcagccacauuccug

SEQ ID NO: 2943804 - RNA, 18 nt, Human
cuccaggagcagccacau

SEQ ID NO: 2943805 - RNA, 12 nt, Human
cuccauccugag

SEQ ID NO: 2943806 - RNA, 11 nt, Human
cuccauccuga

SEQ ID NO: 2943807 - RNA, 23 nt, Human
cuauucaaacagucucaggaaau

SEQ ID NO: 2943808 - RNA, 16 nt, Human
cuauucaaacagucuc

SEQ ID NO: 2943809 - RNA, 18 nt, Human
cuauucaaacagucucag

SEQ ID NO: 2943810 - RNA, 15 nt, Human
cuauuagagaagaga

SEQ ID NO: 2943811 - RNA, 22 nt, Human
cuaugggguaaaagggguaggg

SEQ ID NO: 2943812 - RNA, 18 nt, Human
cuaugggacucaaugcac

SEQ ID NO: 2943813 - RNA, 22 nt, Human
cuaugggacucaaugcacugac

SEQ ID NO: 2943814 - RNA, 23 nt, Human
cuaugggacucaaugcacugaca

SEQ ID NO: 2943815 - RNA, 22 nt, Human
cuaugcuguucacuggacacuu

SEQ ID NO: 2943816 - RNA, 16 nt, Human
cuauaauguaagcucu

SEQ ID NO: 2943817 - RNA, 19 nt, Human
cuauaauuuccauuuacuu

SEQ ID NO: 2943818 - RNA, 22 nt, Human
cuauaauuuaccugaagucuuu

SEQ ID NO: 2943819 - RNA, 13 nt, Human
cuauaauuuaaau

SEQ ID NO: 2943820 - RNA, 21 nt, Human
cuauaauguaagcucuacuga

SEQ ID NO: 2943821 - RNA, 17 nt, Human
cuauauuuuacauaaau

SEQ ID NO: 2943822 - RNA, 17 nt, Human
cuauagccuaggugaca

SEQ ID NO: 2943823 - RNA, 20 nt, Human
cuauaggugcuacaaaaaca

SEQ ID NO: 2943824 - RNA, 22 nt, Human
cuauaggugcuacaaaaacaca

SEQ ID NO: 2943825 - RNA, 21 nt, Human
cuauaggugcuacaaaaacac

SEQ ID NO: 2943826 - RNA, 15 nt, Human
cuauaggugcuacaa

SEQ ID NO: 2943827 - RNA, 23 nt, Human
cgcccaguuggguggaugccugg

SEQ ID NO: 2943828 - RNA, 22 nt, Human
cgcccaguuggguggaugccug

SEQ ID NO: 2943829 - RNA, 17 nt, Human
cgccaucccagccccaa

SEQ ID NO: 2943830 - RNA, 20 nt, Human
cgccaucccagccccaauga

SEQ ID NO: 2943831 - RNA, 15 nt, Human
cgccaugcuccuggc

SEQ ID NO: 2943832 - RNA, 16 nt, Human
cuaggugacauauaca

SEQ ID NO: 2943833 - RNA, 15 nt, Human
cuaggugacauauac

SEQ ID NO: 2943834 - RNA, 24 nt, Human
cuaggugacagagugagacucugu

SEQ ID NO: 2943835 - RNA, 14 nt, Human
cuaggugacagagu

SEQ ID NO: 2943836 - RNA, 18 nt, Human
cuaggugacagagugaga

SEQ ID NO: 2943837 - RNA, 16 nt, Human
cuaguaauuggaaagg

SEQ ID NO: 2943838 - RNA, 20 nt, Human
cuagugaaacucguuaauuu

SEQ ID NO: 2943839 - RNA, 19 nt, Human
cuagugaaagaggcagcuu

SEQ ID NO: 2943840 - RNA, 18 nt, Human
cuagugaaagaggcagcu

SEQ ID NO: 2943841 - RNA, 21 nt, Human
cuagugaauguaggcuggcuu

SEQ ID NO: 2943842 - RNA, 19 nt, Human
cuagugaauguaggcuggc

SEQ ID NO: 2943843 - RNA, 21 nt, Human
cuagugagcagucaggaaaga

SEQ ID NO: 2943844 - RNA, 15 nt, Human
cucacaguccuuacc

SEQ ID NO: 2943845 - RNA, 24 nt, Human
cucacacaugagcaucaggccagg

SEQ ID NO: 2943846 - RNA, 22 nt, Human
cucacacaugagcaucaggcca

SEQ ID NO: 2943847 - RNA, 21 nt, Human
cucaaguccucuuuucugaga

SEQ ID NO: 2943848 - RNA, 14 nt, Human
cucaaguccucuuu

SEQ ID NO: 2943849 - RNA, 17 nt, Human
cucaagugauucuccug

SEQ ID NO: 2943850 - RNA, 15 nt, Human
cucaagucuggcaga

SEQ ID NO: 2943851 - RNA, 13 nt, Human
cucaccagcccca

SEQ ID NO: 2943852 - RNA, 14 nt, Human
cucaccagccccag

SEQ ID NO: 2943853 - RNA, 15 nt, Human
cucaccagccccagu

SEQ ID NO: 2943854 - RNA, 17 nt, Human
cucaccagccccagugc

SEQ ID NO: 2943855 - RNA, 18 nt, Human
cucaccagccccagugcc

SEQ ID NO: 2943856 - RNA, 15 nt, Human
cucacauuuauucug

SEQ ID NO: 2943857 - RNA, 19 nt, Human
cucacauuuauucugcuca

SEQ ID NO: 2943858 - RNA, 22 nt, Human
cucacauuuauucugcucacau

SEQ ID NO: 2943859 - RNA, 13 nt, Human
cucacauuuauau

SEQ ID NO: 2943860 - RNA, 22 nt, Human
cucacaguccuuaccagcagag

SEQ ID NO: 2943861 - RNA, 19 nt, Human
cucacaguccuuaccagca

SEQ ID NO: 2943862 - RNA, 17 nt, Human
cucacaguccuuaccag

SEQ ID NO: 2943863 - RNA, 17 nt, Human
cuauuccugagagcugc

SEQ ID NO: 2943864 - RNA, 13 nt, Human
cuauuccugagag

SEQ ID NO: 2943865 - RNA, 21 nt, Human
cucaacaccucugcacaagcu

SEQ ID NO: 2943866 - RNA, 13 nt, Human
cucaaccuccugg

SEQ ID NO: 2943867 - RNA, 15 nt, Human
cucaaccuccugggc

SEQ ID NO: 2943868 - RNA, 17 nt, Human
cucaaccuccugggcua

SEQ ID NO: 2943869 - RNA, 23 nt, Human
cucaaauacgugggcauucaaau

SEQ ID NO: 2943870 - RNA, 23 nt, Human
cucacuauguugcccaggcaggu

SEQ ID NO: 2943871 - RNA, 21 nt, Human
cucacuauguugcccaggcag

SEQ ID NO: 2943872 - RNA, 22 nt, Human
cucacuauguugcccaggcagg

SEQ ID NO: 2943873 - RNA, 13 nt, Human
cucacccacacca

SEQ ID NO: 2943874 - RNA, 12 nt, Human
cucacccagucc

SEQ ID NO: 2943875 - RNA, 15 nt, Human
cucaccccagcccca

SEQ ID NO: 2943876 - RNA, 15 nt, Human
cucacccaguccugc

SEQ ID NO: 2943877 - RNA, 19 nt, Human
cucacuauguugcccaggc

SEQ ID NO: 2943878 - RNA, 20 nt, Human
cucacuauguugcccaggca

SEQ ID NO: 2943879 - RNA, 11 nt, Human
cucacucuguc

SEQ ID NO: 2943880 - RNA, 12 nt, Human
cucacucugucg

SEQ ID NO: 2943881 - RNA, 13 nt, Human
cucacuccuugaa

SEQ ID NO: 2943882 - RNA, 13 nt, Human
cucacugcagccu

SEQ ID NO: 2943883 - RNA, 12 nt, Human
cucacugcagcc

SEQ ID NO: 2943884 - RNA, 22 nt, Human
cucacucugucgcccagucugg

SEQ ID NO: 2943885 - RNA, 13 nt, Human
cucacucugucgc

SEQ ID NO: 2943886 - RNA, 21 nt, Human
cucacucugucgcccagucug

SEQ ID NO: 2943887 - RNA, 20 nt, Human
cucacuguugcccaggcugg

SEQ ID NO: 2943888 - RNA, 22 nt, Human
cucacugccaugccagcuuauc

SEQ ID NO: 2943889 - RNA, 19 nt, Human
cucacugccaugccagcuu

SEQ ID NO: 2943890 - RNA, 21 nt, Human
cucacuguugcccaggcuggc

SEQ ID NO: 2943891 - RNA, 22 nt, Human
cucacuguugcccaggcuggcg

SEQ ID NO: 2943892 - RNA, 14 nt, Human
cucagagagggugg

SEQ ID NO: 2943893 - RNA, 16 nt, Human
cucagcagagugcuuu

SEQ ID NO: 2943894 - RNA, 16 nt, Human
cucagcauccuggcac

SEQ ID NO: 2943895 - RNA, 17 nt, Human
cucagcauccuggcacc

SEQ ID NO: 2943896 - RNA, 11 nt, Human
cucagcagagu

SEQ ID NO: 2943897 - RNA, 12 nt, Human
cucagcagagug

SEQ ID NO: 2943898 - RNA, 13 nt, Human
cucagcagagugc

SEQ ID NO: 2943899 - RNA, 15 nt, Human
cucagaucuucugug

SEQ ID NO: 2943900 - RNA, 21 nt, Human
cucagcaaaagaugcuucuca

SEQ ID NO: 2943901 - RNA, 22 nt, Human
cugauacagaaaaguugaauuu

SEQ ID NO: 2943902 - RNA, 16 nt, Human
cugauauggaagcacc

SEQ ID NO: 2943903 - RNA, 14 nt, Human
cugauggugcaaug

SEQ ID NO: 2943904 - RNA, 16 nt, Human
cugauggugcaaugac

SEQ ID NO: 2943905 - RNA, 15 nt, Human
cugauggugcaauga

SEQ ID NO: 2943906 - RNA, 21 nt, Human
cugauccuaguuccaccauca

SEQ ID NO: 2943907 - RNA, 20 nt, Human
cugauccuaguuccaccauc

SEQ ID NO: 2943908 - RNA, 17 nt, Human
cugagucugaaggcugg

SEQ ID NO: 2943909 - RNA, 19 nt, Human
cugagucugaaggcugggu

SEQ ID NO: 2943910 - RNA, 18 nt, Human
cugagucugaaggcuggg

SEQ ID NO: 2943911 - RNA, 17 nt, Human
cugaguguacagagugg

SEQ ID NO: 2943912 - RNA, 13 nt, Human
cugaggcugggcu

SEQ ID NO: 2943913 - RNA, 22 nt, Human
cugaggcugggcucccuuccca

SEQ ID NO: 2943914 - RNA, 17 nt, Human
cugaggcugggcucccu

SEQ ID NO: 2943915 - RNA, 16 nt, Human
cugaggcugggcuccc

SEQ ID NO: 2943916 - RNA, 15 nt, Human
cugaggcugggcucc

SEQ ID NO: 2943917 - RNA, 24 nt, Human
cugaggcccuucucuccagccccu

SEQ ID NO: 2943918 - RNA, 15 nt, Human
cugaggcuccacuug

SEQ ID NO: 2943919 - RNA, 21 nt, Human
cugaggcuccacuuggucugu

SEQ ID NO: 2943920 - RNA, 23 nt, Human
cugauuuuuuuuuccuucagugc

SEQ ID NO: 2943921 - RNA, 22 nt, Human
cugauuuuuuuuuccuucagug

SEQ ID NO: 2943922 - RNA, 21 nt, Human
cugauuuuuuuuuccuucagu

SEQ ID NO: 2943923 - RNA, 20 nt, Human
cugauuuuuuuuuccuucag

SEQ ID NO: 2943924 - RNA, 19 nt, Human
cugauuuuuuuuuccuuca

SEQ ID NO: 2943925 - RNA, 18 nt, Human
cugauuuuuuuuuccuuc

SEQ ID NO: 2943926 - RNA, 16 nt, Human
cugauuuuuuuuuccu

SEQ ID NO: 2943927 - RNA, 17 nt, Human
cugauugugucucuugg

SEQ ID NO: 2943928 - RNA, 21 nt, Human
cugauggugcaaugaccuuuc

SEQ ID NO: 2943929 - RNA, 20 nt, Human
cugauggugcaaugaccuuu

SEQ ID NO: 2943930 - RNA, 19 nt, Human
cugauggugcaaugaccuu

SEQ ID NO: 2943931 - RNA, 17 nt, Human
cugauggugcaaugacc

SEQ ID NO: 2943932 - RNA, 16 nt, Human
cugauuuaauaugcaa

SEQ ID NO: 2943933 - RNA, 22 nt, Human
cugauuuaaacacauuaaaggu

SEQ ID NO: 2943934 - RNA, 21 nt, Human
cugauugugucucuugguccu

SEQ ID NO: 2943935 - RNA, 12 nt, Human
cugcaccgggcc

SEQ ID NO: 2943936 - RNA, 23 nt, Human
cugcaccggcuggccuggccccu

SEQ ID NO: 2943937 - RNA, 15 nt, Human
cugcacuccccugcu

SEQ ID NO: 2943938 - RNA, 14 nt, Human
cugcacuccccugc

SEQ ID NO: 2943939 - RNA, 22 nt, Human
cugcaccggcuggccuggcccc

SEQ ID NO: 2943940 - RNA, 20 nt, Human
cugcaccggcuggccuggcc

SEQ ID NO: 2943941 - RNA, 14 nt, Human
cugcacccucaggc

SEQ ID NO: 2943942 - RNA, 13 nt, Human
cugcacccucagg

SEQ ID NO: 2943943 - RNA, 18 nt, Human
cugcacuugcagacucua

SEQ ID NO: 2943944 - RNA, 17 nt, Human
cugcacuccccugcugg

SEQ ID NO: 2943945 - RNA, 16 nt, Human
cugcacuccccugcug

SEQ ID NO: 2943946 - RNA, 19 nt, Human
cugcacagcaggcugccag

SEQ ID NO: 2943947 - RNA, 18 nt, Human
cugcacagcaggcugcca

SEQ ID NO: 2943948 - RNA, 18 nt, Human
cugcacaagcugcacccu

SEQ ID NO: 2943949 - RNA, 22 nt, Human
cugcacaagcugcacccucagg

SEQ ID NO: 2943950 - RNA, 22 nt, Human
cugcaauaaaauggguuuuacu

SEQ ID NO: 2943951 - RNA, 18 nt, Human
cugcaauaaggggagagu

SEQ ID NO: 2943952 - RNA, 15 nt, Human
cugcaauaaaauggg

SEQ ID NO: 2943953 - RNA, 19 nt, Human
cugcggagcacacuggcuc

SEQ ID NO: 2943954 - RNA, 20 nt, Human
cugcggagcacacuggcuca

SEQ ID NO: 2943955 - RNA, 19 nt, Human
cugcgguccacccaggagc

SEQ ID NO: 2943956 - RNA, 20 nt, Human
cugcgguccacccaggagcc

SEQ ID NO: 2943957 - RNA, 17 nt, Human
cugcgguccacccagga

SEQ ID NO: 2943958 - RNA, 18 nt, Human
cugcgguccacccaggag

SEQ ID NO: 2943959 - RNA, 21 nt, Human
cugccugcccaggccccugcc

SEQ ID NO: 2943960 - RNA, 22 nt, Human
cugccugcccaggccccugcca

SEQ ID NO: 2943961 - RNA, 17 nt, Human
cugccucugacacacag

SEQ ID NO: 2943962 - RNA, 15 nt, Human
cugccucugacacac

SEQ ID NO: 2943963 - RNA, 18 nt, Human
cugccucugacacacagc

SEQ ID NO: 2943964 - RNA, 21 nt, Human
cugccucugacacacagcucu

SEQ ID NO: 2943965 - RNA, 14 nt, Human
cugccccugcacag

SEQ ID NO: 2943966 - RNA, 15 nt, Human
cugccccugcacagc

SEQ ID NO: 2943967 - RNA, 19 nt, Human
cugccccugcacagcaggc

SEQ ID NO: 2943968 - RNA, 13 nt, Human
cugccgcagcccu

SEQ ID NO: 2943969 - RNA, 12 nt, Human
cugccgcagccc

SEQ ID NO: 2943970 - RNA, 23 nt, Human
cugccgcagcccugcagagggca

SEQ ID NO: 2943971 - RNA, 22 nt, Human
cugccgcagcccugcagagggc

SEQ ID NO: 2943972 - RNA, 21 nt, Human
cugccgcagcccugcagaggg

SEQ ID NO: 2943973 - RNA, 20 nt, Human
cugccgcagcccugcagagg

SEQ ID NO: 2943974 - RNA, 19 nt, Human
cugccgcagcccugcagag

SEQ ID NO: 2943975 - RNA, 19 nt, Human
cugccucagccucccaaag

SEQ ID NO: 2943976 - RNA, 15 nt, Human
cugccucagccuccc

SEQ ID NO: 2943977 - RNA, 13 nt, Human
cugccaggcaugg

SEQ ID NO: 2943978 - RNA, 11 nt, Human
cugccaggcau

SEQ ID NO: 2943979 - RNA, 14 nt, Human
cugccaugccagcu

SEQ ID NO: 2943980 - RNA, 13 nt, Human
cugcccaccuggc

SEQ ID NO: 2943981 - RNA, 15 nt, Human
cugcccaccuggccu

SEQ ID NO: 2943982 - RNA, 14 nt, Human
cugcccaccuggcc

SEQ ID NO: 2943983 - RNA, 18 nt, Human
cugcccacucccugcaac

SEQ ID NO: 2943984 - RNA, 16 nt, Human
cugcccacucccugca

SEQ ID NO: 2943985 - RNA, 15 nt, Human
cugcccacucccugc

SEQ ID NO: 2943986 - RNA, 14 nt, Human
cugcccacucccug

SEQ ID NO: 2943987 - RNA, 22 nt, Human
cugcccaccuggccucugcacu

SEQ ID NO: 2943988 - RNA, 20 nt, Human
cugcccaccuggccucugca

SEQ ID NO: 2943989 - RNA, 19 nt, Human
cugcccaccuggccucugc

SEQ ID NO: 2943990 - RNA, 18 nt, Human
cugcccaccuggccucug

SEQ ID NO: 2943991 - RNA, 17 nt, Human
cugcccaccuggccucu

SEQ ID NO: 2943992 - RNA, 22 nt, Human
cugcaugcgggcuuccuccugg

SEQ ID NO: 2943993 - RNA, 18 nt, Human
cugcaugcgggcuuccuc

SEQ ID NO: 2943994 - RNA, 19 nt, Human
cugccaaugggagcucaug

SEQ ID NO: 2943995 - RNA, 18 nt, Human
cugccaaugggagcucau

SEQ ID NO: 2943996 - RNA, 22 nt, Human
cugcaucguuucaucuuccaac

SEQ ID NO: 2943997 - RNA, 16 nt, Human
cugcaucguuucaucu

SEQ ID NO: 2943998 - RNA, 23 nt, Human
cugcacuugcagacucuacagag

SEQ ID NO: 2943999 - RNA, 19 nt, Human
cugcaguugccagucaccc

SEQ ID NO: 2944000 - RNA, 20 nt, Human
cugcaucagcugcugaaaca

SEQ ID NO: 2944001 - RNA, 17 nt, Human
cugcaguugccagucac

SEQ ID NO: 2944002 - RNA, 22 nt, Human
cugcaguugccagucaccccgg

SEQ ID NO: 2944003 - RNA, 21 nt, Human
cugcaguugccagucaccccg

SEQ ID NO: 2944004 - RNA, 17 nt, Human
cugaaguucagcugcau

SEQ ID NO: 2944005 - RNA, 20 nt, Human
cugaagucuuuguacagaca

SEQ ID NO: 2944006 - RNA, 17 nt, Human
cugaagucuuuguacag

SEQ ID NO: 2944007 - RNA, 22 nt, Human
cugaagucccagauacuugggg

SEQ ID NO: 2944008 - RNA, 16 nt, Human
cugaagucacacagug

SEQ ID NO: 2944009 - RNA, 21 nt, Human
cugaagucacacagugagucg

SEQ ID NO: 2944010 - RNA, 18 nt, Human
cugaagucacacagugag

SEQ ID NO: 2944011 - RNA, 19 nt, Human
cugaagucacacagugagu

SEQ ID NO: 2944012 - RNA, 17 nt, Human
cugaagucacacaguga

SEQ ID NO: 2944013 - RNA, 18 nt, Human
cugaauggacuuugcaca

SEQ ID NO: 2944014 - RNA, 19 nt, Human
cugaaugguuuucaaaaua

SEQ ID NO: 2944015 - RNA, 20 nt, Human
cugaaugguuuucaaaauaa

SEQ ID NO: 2944016 - RNA, 12 nt, Human
cugaauuucuuu

SEQ ID NO: 2944017 - RNA, 14 nt, Human
cugaauuaugaaac

SEQ ID NO: 2944018 - RNA, 15 nt, Human
cugaauuaugaaacu

SEQ ID NO: 2944019 - RNA, 13 nt, Human
cugaauuaugaaa

SEQ ID NO: 2944020 - RNA, 21 nt, Human
cugaacaaacuaucagaggaa

SEQ ID NO: 2944021 - RNA, 20 nt, Human
cugaaauaaacgucuuaaau

SEQ ID NO: 2944022 - RNA, 13 nt, Human
cugaaaugucagu

SEQ ID NO: 2944023 - RNA, 20 nt, Human
cugaaaugucaguucugaua

SEQ ID NO: 2944024 - RNA, 18 nt, Human
cugaaaugucaguucuga

SEQ ID NO: 2944025 - RNA, 19 nt, Human
cugaaaugucaguucugau

SEQ ID NO: 2944026 - RNA, 16 nt, Human
cucuucuccaggcugu

SEQ ID NO: 2944027 - RNA, 23 nt, Human
cucuuuggucuacacugugcuga

SEQ ID NO: 2944028 - RNA, 22 nt, Human
cucuuuggucuacacugugcug

SEQ ID NO: 2944029 - RNA, 14 nt, Human
cucuuuucaaaaca

SEQ ID NO: 2944030 - RNA, 23 nt, Human
cugaaagggacgcuacccgggaa

SEQ ID NO: 2944031 - RNA, 19 nt, Human
cugagcauaaguccucuag

SEQ ID NO: 2944032 - RNA, 14 nt, Human
cugagccagauuuc

SEQ ID NO: 2944033 - RNA, 13 nt, Human
cugagccagauuu

SEQ ID NO: 2944034 - RNA, 16 nt, Human
cugagcaggauuuuaa

SEQ ID NO: 2944035 - RNA, 21 nt, Human
cugagaugugaacacaucagc

SEQ ID NO: 2944036 - RNA, 20 nt, Human
cugagaaagacuauucaaac

SEQ ID NO: 2944037 - RNA, 19 nt, Human
cugagaaagacuauucaaa

SEQ ID NO: 2944038 - RNA, 19 nt, Human
cugagacagcccgggcucu

SEQ ID NO: 2944039 - RNA, 20 nt, Human
cugagacagcccgggcucug

SEQ ID NO: 2944040 - RNA, 20 nt, Human
cugagaugugaacacaucag

SEQ ID NO: 2944041 - RNA, 16 nt, Human
cugagaugugaacaca

SEQ ID NO: 2944042 - RNA, 22 nt, Human
cugagacagcccgggcucugcc

SEQ ID NO: 2944043 - RNA, 21 nt, Human
cugagacagcccgggcucugc

SEQ ID NO: 2944044 - RNA, 16 nt, Human
cugacagacacaggcc

SEQ ID NO: 2944045 - RNA, 16 nt, Human
cugaauuaugaaacuu

SEQ ID NO: 2944046 - RNA, 14 nt, Human
cugaauuucuuuug

SEQ ID NO: 2944047 - RNA, 17 nt, Human
cugacagacacaggccc

SEQ ID NO: 2944048 - RNA, 18 nt, Human
cugacagacacaggcccg

SEQ ID NO: 2944049 - RNA, 23 nt, Human
cugacgacuugagugcucaguag

SEQ ID NO: 2944050 - RNA, 18 nt, Human
cugagaaagacuauucaa

SEQ ID NO: 2944051 - RNA, 15 nt, Human
cugagaaagacuauu

SEQ ID NO: 2944052 - RNA, 13 nt, Human
cugagaaagacua

SEQ ID NO: 2944053 - RNA, 12 nt, Human
cugagaaagacu

SEQ ID NO: 2944054 - RNA, 14 nt, Human
cucuguccugggag

SEQ ID NO: 2944055 - RNA, 13 nt, Human
cucuguccuggga

SEQ ID NO: 2944056 - RNA, 15 nt, Human
cucuguccugggagu

SEQ ID NO: 2944057 - RNA, 22 nt, Human
cucuguccugggagugagcugg

SEQ ID NO: 2944058 - RNA, 18 nt, Human
cucugucgcccagucugg

SEQ ID NO: 2944059 - RNA, 19 nt, Human
cucugucgcccagucugga

SEQ ID NO: 2944060 - RNA, 17 nt, Human
cucugucgcccagucug

SEQ ID NO: 2944061 - RNA, 13 nt, Human
cucugucgcccag

SEQ ID NO: 2944062 - RNA, 16 nt, Human
cucugccucugacaca

SEQ ID NO: 2944063 - RNA, 21 nt, Human
cucugccucccaucacccgcu

SEQ ID NO: 2944064 - RNA, 19 nt, Human
cucugccucugacacacag

SEQ ID NO: 2944065 - RNA, 20 nt, Human
cucugccucugacacacagc

SEQ ID NO: 2944066 - RNA, 20 nt, Human
cucuggcagcucagagaggg

SEQ ID NO: 2944067 - RNA, 23 nt, Human
cucuggcagcucagagagggugg

SEQ ID NO: 2944068 - RNA, 21 nt, Human
cucuggccuucggccuccauc

SEQ ID NO: 2944069 - RNA, 22 nt, Human
cucuggccuucggccuccaucc

SEQ ID NO: 2944070 - RNA, 19 nt, Human
cucuuaagaagacugcauu

SEQ ID NO: 2944071 - RNA, 13 nt, Human
cucuuaagaagac

SEQ ID NO: 2944072 - RNA, 19 nt, Human
cucugugucagguggggca

SEQ ID NO: 2944073 - RNA, 20 nt, Human
cucugugucagguggggcag

SEQ ID NO: 2944074 - RNA, 21 nt, Human
cucugugucagguggggcagc

SEQ ID NO: 2944075 - RNA, 22 nt, Human
cucugugucagguggggcagcu

SEQ ID NO: 2944076 - RNA, 23 nt, Human
cucugugucagguggggcagcuu

SEQ ID NO: 2944077 - RNA, 15 nt, Human
cucuucuccaggcug

SEQ ID NO: 2944078 - RNA, 13 nt, Human
cucuucuccaggc

SEQ ID NO: 2944079 - RNA, 22 nt, Human
cucugaaggacauugcggacag

SEQ ID NO: 2944080 - RNA, 19 nt, Human
cucugaaggguaauuauau

SEQ ID NO: 2944081 - RNA, 14 nt, Human
cucugacacacagc

SEQ ID NO: 2944082 - RNA, 15 nt, Human
cucugacacacagcu

SEQ ID NO: 2944083 - RNA, 16 nt, Human
cucugacacacagcuc

SEQ ID NO: 2944084 - RNA, 17 nt, Human
cucugacacacagcucu

SEQ ID NO: 2944085 - RNA, 18 nt, Human
cucugacacacagcucug

SEQ ID NO: 2944086 - RNA, 19 nt, Human
cucugacacacagcucugu

SEQ ID NO: 2944087 - RNA, 23 nt, Human
cucugacagaagaaccccagggu

SEQ ID NO: 2944088 - RNA, 21 nt, Human
cucugagacucgcgacaaugc

SEQ ID NO: 2944089 - RNA, 23 nt, Human
cucugagacucgcgacaaugcaa

SEQ ID NO: 2944090 - RNA, 20 nt, Human
cucugagacucgcgacaaug

SEQ ID NO: 2944091 - RNA, 16 nt, Human
cucugaggacacuaac

SEQ ID NO: 2944092 - RNA, 12 nt, Human
cucugaggacac

SEQ ID NO: 2944093 - RNA, 14 nt, Human
cucugaggacacua

SEQ ID NO: 2944094 - RNA, 15 nt, Human
cucugauacagaaaa

SEQ ID NO: 2944095 - RNA, 13 nt, Human
cucugcacaagcu

SEQ ID NO: 2944096 - RNA, 10 nt, Human
cucugcacaa

SEQ ID NO: 2944097 - RNA, 15 nt, Human
cucugcacaagcugc

SEQ ID NO: 2944098 - RNA, 14 nt, Human
cucugcacaagcug

SEQ ID NO: 2944099 - RNA, 12 nt, Human
cucugcccuugg

SEQ ID NO: 2944100 - RNA, 17 nt, Human
cucugccucccaucacc

SEQ ID NO: 2944101 - RNA, 16 nt, Human
cucugccucccaucac

SEQ ID NO: 2944102 - RNA, 14 nt, Human
cucugccucccauc

SEQ ID NO: 2944103 - RNA, 13 nt, Human
cucugccucccau

SEQ ID NO: 2944104 - RNA, 20 nt, Human
cucugcccacucccugcaac

SEQ ID NO: 2944105 - RNA, 18 nt, Human
cucugcccacucccugca

SEQ ID NO: 2944106 - RNA, 17 nt, Human
cucugcccacucccugc

SEQ ID NO: 2944107 - RNA, 16 nt, Human
cucugcccacucccug

SEQ ID NO: 2944108 - RNA, 15 nt, Human
cucugcccacucccu

SEQ ID NO: 2944109 - RNA, 13 nt, Human
cucugcccacucc

SEQ ID NO: 2944110 - RNA, 22 nt, Human
gagccacugcaccgggccacag

SEQ ID NO: 2944111 - RNA, 15 nt, Human
gagccauuuguccca

SEQ ID NO: 2944112 - RNA, 16 nt, Human
gagccauuugucccaa

SEQ ID NO: 2944113 - RNA, 17 nt, Human
gagccauuugucccaag

SEQ ID NO: 2944114 - RNA, 23 nt, Human
gagccauuugucccaagugccaa

SEQ ID NO: 2944115 - RNA, 18 nt, Human
gagccauuugucccaagu

SEQ ID NO: 2944116 - RNA, 19 nt, Human
gagccauuugucccaagug

SEQ ID NO: 2944117 - RNA, 20 nt, Human
gagccauuugucccaagugc

SEQ ID NO: 2944118 - RNA, 22 nt, Human
gagccauuugucccaagugcca

SEQ ID NO: 2944119 - RNA, 11 nt, Human
gagcccacgcc

SEQ ID NO: 2944120 - RNA, 14 nt, Human
gagcccaggccucc

SEQ ID NO: 2944121 - RNA, 13 nt, Human
gagcccaggccuc

SEQ ID NO: 2944122 - RNA, 12 nt, Human
gagcccaggccu

SEQ ID NO: 2944123 - RNA, 16 nt, Human
gagcccacgcccccac

SEQ ID NO: 2944124 - RNA, 15 nt, Human
gagcccacgccccca

SEQ ID NO: 2944125 - RNA, 12 nt, Human
gagcccacgccc

SEQ ID NO: 2944126 - RNA, 18 nt, Human
gagcagccacauuccuga

SEQ ID NO: 2944127 - RNA, 21 nt, Human
gagcaggcuacugucagcucc

SEQ ID NO: 2944128 - RNA, 14 nt, Human
gagaucgagaccau

SEQ ID NO: 2944129 - RNA, 13 nt, Human
gagauccuggacu

SEQ ID NO: 2944130 - RNA, 13 nt, Human
gagaucagccugg

SEQ ID NO: 2944131 - RNA, 16 nt, Human
gagaucagccugggca

SEQ ID NO: 2944132 - RNA, 14 nt, Human
gagaucagccuggg

SEQ ID NO: 2944133 - RNA, 20 nt, Human
gagaucaaccccuucgcucc

SEQ ID NO: 2944134 - RNA, 19 nt, Human
gagcaaaaucgaugcagug

SEQ ID NO: 2944135 - RNA, 23 nt, Human
gagcaagacgcugugcugcccug

SEQ ID NO: 2944136 - RNA, 22 nt, Human
gagcaagacgcugugcugcccu

SEQ ID NO: 2944137 - RNA, 18 nt, Human
gagcaagacgcugugcug

SEQ ID NO: 2944138 - RNA, 21 nt, Human
gagcaagacgcugugcugccc

SEQ ID NO: 2944139 - RNA, 17 nt, Human
gagcaccuuagacaguc

SEQ ID NO: 2944140 - RNA, 19 nt, Human
gagcaccuuagacaguccc

SEQ ID NO: 2944141 - RNA, 15 nt, Human
gagcacacuggcuca

SEQ ID NO: 2944142 - RNA, 20 nt, Human
gagccucagcauccuggcac

SEQ ID NO: 2944143 - RNA, 21 nt, Human
gagccucagcauccuggcacc

SEQ ID NO: 2944144 - RNA, 14 nt, Human
gagccuccugcccu

SEQ ID NO: 2944145 - RNA, 15 nt, Human
gagcccugguggcag

SEQ ID NO: 2944146 - RNA, 16 nt, Human
gagcccugguggcagu

SEQ ID NO: 2944147 - RNA, 19 nt, Human
gagccucagcauccuggca

SEQ ID NO: 2944148 - RNA, 17 nt, Human
gagcccugguggcagug

SEQ ID NO: 2944149 - RNA, 22 nt, Human
gagccuccugcccuuaccugcc

SEQ ID NO: 2944150 - RNA, 20 nt, Human
gagccuccugcccuuaccug

SEQ ID NO: 2944151 - RNA, 15 nt, Human
gagccuggcaagaau

SEQ ID NO: 2944152 - RNA, 10 nt, Human
gagccuggca

SEQ ID NO: 2944153 - RNA, 21 nt, Human
gagccugggaggucaaggcug

SEQ ID NO: 2944154 - RNA, 13 nt, Human
gagccugggaggu

SEQ ID NO: 2944155 - RNA, 13 nt, Human
gagcuacaaaugc

SEQ ID NO: 2944156 - RNA, 12 nt, Human
gagcuacaaaug

SEQ ID NO: 2944157 - RNA, 23 nt, Human
gagcuacacaggggaaaagagga

SEQ ID NO: 2944158 - RNA, 14 nt, Human
gagcuacaaaugca

SEQ ID NO: 2944159 - RNA, 15 nt, Human
gagcugcccucuccu

SEQ ID NO: 2944160 - RNA, 16 nt, Human
gagcugcccucuccug

SEQ ID NO: 2944161 - RNA, 13 nt, Human
gagcugccaccug

SEQ ID NO: 2944162 - RNA, 14 nt, Human
gagcugcccucucc

SEQ ID NO: 2944163 - RNA, 16 nt, Human
gagcugccaccugccu

SEQ ID NO: 2944164 - RNA, 15 nt, Human
gagcugccaccugcc

SEQ ID NO: 2944165 - RNA, 12 nt, Human
gaggggccucuu

SEQ ID NO: 2944166 - RNA, 22 nt, Human
gaggggccucuuaugggcuggg

SEQ ID NO: 2944167 - RNA, 23 nt, Human
gagggcacagaaaauggaagaca

SEQ ID NO: 2944168 - RNA, 22 nt, Human
gagggcacagaaaauggaagac

SEQ ID NO: 2944169 - RNA, 14 nt, Human
gagggcacagaaaa

SEQ ID NO: 2944170 - RNA, 13 nt, Human
gagggagugacag

SEQ ID NO: 2944171 - RNA, 14 nt, Human
gagggagguaagga

SEQ ID NO: 2944172 - RNA, 14 nt, Human
gagggagugacaga

SEQ ID NO: 2944173 - RNA, 14 nt, Human
gagggagggagggc

SEQ ID NO: 2944174 - RNA, 15 nt, Human
gagggagggcuccag

SEQ ID NO: 2944175 - RNA, 15 nt, Human
gagggagggagggcu

SEQ ID NO: 2944176 - RNA, 15 nt, Human
gaggcugggcucccu

SEQ ID NO: 2944177 - RNA, 14 nt, Human
gaggcugggcuccc

SEQ ID NO: 2944178 - RNA, 13 nt, Human
gaggcugggcucc

SEQ ID NO: 2944179 - RNA, 14 nt, Human
gaggccuucucuga

SEQ ID NO: 2944180 - RNA, 22 nt, Human
gaggcccuucucuccagccccu

SEQ ID NO: 2944181 - RNA, 24 nt, Human
gaggcccuucucuccagccccugg

SEQ ID NO: 2944182 - RNA, 23 nt, Human
gaggcccuucucuccagccccug

SEQ ID NO: 2944183 - RNA, 14 nt, Human
gaggcccuucucuc

SEQ ID NO: 2944184 - RNA, 13 nt, Human
gaggacagggagg

SEQ ID NO: 2944185 - RNA, 22 nt, Human
gaggacagggaggugaccccag

SEQ ID NO: 2944186 - RNA, 23 nt, Human
gaggacagggaggugaccccagg

SEQ ID NO: 2944187 - RNA, 14 nt, Human
gaggaauccagacc

SEQ ID NO: 2944188 - RNA, 22 nt, Human
gaggaaggaaacccagcucugg

SEQ ID NO: 2944189 - RNA, 15 nt, Human
gaggaauccagaccc

SEQ ID NO: 2944190 - RNA, 16 nt, Human
gaggauugcuugagcu

SEQ ID NO: 2944191 - RNA, 17 nt, Human
gaggauguucugggaca

SEQ ID NO: 2944192 - RNA, 20 nt, Human
gaggauguucugggacacag

SEQ ID NO: 2944193 - RNA, 12 nt, Human
gaggauguucug

SEQ ID NO: 2944194 - RNA, 23 nt, Human
gaggaguuugggguaugggagag

SEQ ID NO: 2944195 - RNA, 12 nt, Human
gaggccagccuu

SEQ ID NO: 2944196 - RNA, 13 nt, Human
gaggccagccuug

SEQ ID NO: 2944197 - RNA, 23 nt, Human
gaggcagccccauucugccugcc

SEQ ID NO: 2944198 - RNA, 16 nt, Human
gaggcaggagacuggc

SEQ ID NO: 2944199 - RNA, 21 nt, Human
gaggcagccccauucugccug

SEQ ID NO: 2944200 - RNA, 22 nt, Human
gaggcagccccauucugccugc

SEQ ID NO: 2944201 - RNA, 13 nt, Human
gaggcagccccau

SEQ ID NO: 2944202 - RNA, 19 nt, Human
gaggcagagguugcaguga

SEQ ID NO: 2944203 - RNA, 22 nt, Human
gaugggcaacccccagccugcu

SEQ ID NO: 2944204 - RNA, 16 nt, Human
gaugggaaagcauugu

SEQ ID NO: 2944205 - RNA, 22 nt, Human
gaugcuagaacucccuuucaac

SEQ ID NO: 2944206 - RNA, 15 nt, Human
gaugacuguuuuuaa

SEQ ID NO: 2944207 - RNA, 22 nt, Human
gaugagaaagguugaagcacca

SEQ ID NO: 2944208 - RNA, 11 nt, Human
gaugagaaagg

SEQ ID NO: 2944209 - RNA, 18 nt, Human
gaugcaguucugaagaag

SEQ ID NO: 2944210 - RNA, 15 nt, Human
gaucacgaggucagg

SEQ ID NO: 2944211 - RNA, 23 nt, Human
gaucaaccccuucgcuccugugu

SEQ ID NO: 2944212 - RNA, 13 nt, Human
gaucacgccacug

SEQ ID NO: 2944213 - RNA, 14 nt, Human
gaucacgccacugc

SEQ ID NO: 2944214 - RNA, 15 nt, Human
gaucacgccacugca

SEQ ID NO: 2944215 - RNA, 18 nt, Human
gauccuaguuccaccauc

SEQ ID NO: 2944216 - RNA, 18 nt, Human
gauccuaggcauuugcug

SEQ ID NO: 2944217 - RNA, 11 nt, Human
gauccuccagg

SEQ ID NO: 2944218 - RNA, 19 nt, Human
gauccucccaccucagccu

SEQ ID NO: 2944219 - RNA, 12 nt, Human
gauccuccaggu

SEQ ID NO: 2944220 - RNA, 20 nt, Human
gauccucccaccucagccuc

SEQ ID NO: 2944221 - RNA, 21 nt, Human
gauccucccaccucagccucc

SEQ ID NO: 2944222 - RNA, 19 nt, Human
gauccugagccagauuuca

SEQ ID NO: 2944223 - RNA, 15 nt, Human
gauccugagccagau

SEQ ID NO: 2944224 - RNA, 14 nt, Human
gauccugagccaga

SEQ ID NO: 2944225 - RNA, 13 nt, Human
gauccugagccag

SEQ ID NO: 2944226 - RNA, 16 nt, Human
gaucgagaccauccug

SEQ ID NO: 2944227 - RNA, 19 nt, Human
gaucgagaccauccuggcu

SEQ ID NO: 2944228 - RNA, 18 nt, Human
gauccucccaccucagcc

SEQ ID NO: 2944229 - RNA, 15 nt, Human
gaugaaaaaauaaca

SEQ ID NO: 2944230 - RNA, 16 nt, Human
gaucuuugcagacagg

SEQ ID NO: 2944231 - RNA, 14 nt, Human
gaucuuuaaaauac

SEQ ID NO: 2944232 - RNA, 13 nt, Human
gaucuuuaaaaua

SEQ ID NO: 2944233 - RNA, 15 nt, Human
gauucccugauuuaa

SEQ ID NO: 2944234 - RNA, 22 nt, Human
gauucccaagcucugcuccucu

SEQ ID NO: 2944235 - RNA, 19 nt, Human
gauucaccuccuaaaacaa

SEQ ID NO: 2944236 - RNA, 12 nt, Human
gauucagacagc

SEQ ID NO: 2944237 - RNA, 17 nt, Human
gauucuauguuaauauu

SEQ ID NO: 2944238 - RNA, 20 nt, Human
gauucuauguuaauauuuua

SEQ ID NO: 2944239 - RNA, 18 nt, Human
gauugcuugagcucagga

SEQ ID NO: 2944240 - RNA, 23 nt, Human
gauugacgggacuguugguauug

SEQ ID NO: 2944241 - RNA, 15 nt, Human
gauuguccccgaccc

SEQ ID NO: 2944242 - RNA, 20 nt, Human
gauuguccccgacccuugcc

SEQ ID NO: 2944243 - RNA, 13 nt, Human
gauugugccccug

SEQ ID NO: 2944244 - RNA, 18 nt, Human
gauugugccuaauguguu

SEQ ID NO: 2944245 - RNA, 19 nt, Human
gauucaacagguuuuccug

SEQ ID NO: 2944246 - RNA, 18 nt, Human
gauuaaccacuucagcug

SEQ ID NO: 2944247 - RNA, 21 nt, Human
gauuaaccacuucagcugacu

SEQ ID NO: 2944248 - RNA, 19 nt, Human
gauuaaccacuucagcuga

SEQ ID NO: 2944249 - RNA, 21 nt, Human
gauguucuuucacccuuuucu

SEQ ID NO: 2944250 - RNA, 21 nt, Human
gauguuuuaaggaugcuugua

SEQ ID NO: 2944251 - RNA, 14 nt, Human
gauguuuuccauga

SEQ ID NO: 2944252 - RNA, 23 nt, Human
gauguuuuccaugaguccccugu

SEQ ID NO: 2944253 - RNA, 15 nt, Human
gauguuuuccaugag

SEQ ID NO: 2944254 - RNA, 12 nt, Human
gauuaaauucuu

SEQ ID NO: 2944255 - RNA, 19 nt, Human
gauuaaauucuugcaaagu

SEQ ID NO: 2944256 - RNA, 14 nt, Human
gauguucugggaca

SEQ ID NO: 2944257 - RNA, 16 nt, Human
gauguucugggacaca

SEQ ID NO: 2944258 - RNA, 18 nt, Human
gaugggccaccgccuugc

SEQ ID NO: 2944259 - RNA, 20 nt, Human
gauggugcaaugaccuuuca

SEQ ID NO: 2944260 - RNA, 23 nt, Human
gauggugcaaugaccuuucaaua

SEQ ID NO: 2944261 - RNA, 17 nt, Human
gaguuauugaagcagag

SEQ ID NO: 2944262 - RNA, 18 nt, Human
gaguuauugaagcagagu

SEQ ID NO: 2944263 - RNA, 23 nt, Human
gaguucaucuugaauuguaagga

SEQ ID NO: 2944264 - RNA, 17 nt, Human
gagugugccugaagucc

SEQ ID NO: 2944265 - RNA, 13 nt, Human
gaguucugguucc

SEQ ID NO: 2944266 - RNA, 14 nt, Human
gaguugaagacaga

SEQ ID NO: 2944267 - RNA, 21 nt, Human
gaguugaaaaucuuauaauuu

SEQ ID NO: 2944268 - RNA, 19 nt, Human
gagugucuuaauuaaaaga

SEQ ID NO: 2944269 - RNA, 12 nt, Human
gagugggcccaa

SEQ ID NO: 2944270 - RNA, 23 nt, Human
gagugggggaucacagccucuga

SEQ ID NO: 2944271 - RNA, 22 nt, Human
gagugaacaaauuuacagagac

SEQ ID NO: 2944272 - RNA, 19 nt, Human
gagugaacaaauuuacaga

SEQ ID NO: 2944273 - RNA, 23 nt, Human
gauauaugcucugcauguuacau

SEQ ID NO: 2944274 - RNA, 21 nt, Human
gaucaaccccuucgcuccugu

SEQ ID NO: 2944275 - RNA, 22 nt, Human
gaucaaccccuucgcuccugug

SEQ ID NO: 2944276 - RNA, 13 nt, Human
gauagccaaggcc

SEQ ID NO: 2944277 - RNA, 13 nt, Human
gauagcagggcau

SEQ ID NO: 2944278 - RNA, 19 nt, Human
gauagcacagacccugccc

SEQ ID NO: 2944279 - RNA, 12 nt, Human
gauagccaaggc

SEQ ID NO: 2944280 - RNA, 16 nt, Human
gauagcacagacccug

SEQ ID NO: 2944281 - RNA, 13 nt, Human
gauacaaugcugu

SEQ ID NO: 2944282 - RNA, 18 nt, Human
gauacaaugcugugcccu

SEQ ID NO: 2944283 - RNA, 18 nt, Human
gauagcacagacccugcc

SEQ ID NO: 2944284 - RNA, 17 nt, Human
gauagcacagacccugc

SEQ ID NO: 2944285 - RNA, 17 nt, Human
gauacaaaagcauguga

SEQ ID NO: 2944286 - RNA, 12 nt, Human
gaguagcuggga

SEQ ID NO: 2944287 - RNA, 14 nt, Human
gaguagcugggacu

SEQ ID NO: 2944288 - RNA, 23 nt, Human
gaguccccuguuuguuucugaaa

SEQ ID NO: 2944289 - RNA, 14 nt, Human
gaguccccuguuug

SEQ ID NO: 2944290 - RNA, 12 nt, Human
gaguccccuguu

SEQ ID NO: 2944291 - RNA, 17 nt, Human
gagucgaggacagggag

SEQ ID NO: 2944292 - RNA, 19 nt, Human
gagucucacuguugcccag

SEQ ID NO: 2944293 - RNA, 20 nt, Human
gagucucacuguugcccagg

SEQ ID NO: 2944294 - RNA, 21 nt, Human
gagucucacuguugcccaggc

SEQ ID NO: 2944295 - RNA, 21 nt, Human
gagucugaaggcuggguucug

SEQ ID NO: 2944296 - RNA, 22 nt, Human
gagucucacuguugcccaggcu

SEQ ID NO: 2944297 - RNA, 23 nt, Human
gagucucacuguugcccaggcug

SEQ ID NO: 2944298 - RNA, 22 nt, Human
gaggggggaggugggauccucc

SEQ ID NO: 2944299 - RNA, 15 nt, Human
gaggggguggccucc

SEQ ID NO: 2944300 - RNA, 15 nt, Human
gaggggggagguggg

SEQ ID NO: 2944301 - RNA, 18 nt, Human
gaggugggauccuccagg

SEQ ID NO: 2944302 - RNA, 22 nt, Human
gaggugggauccuccaggugca

SEQ ID NO: 2944303 - RNA, 21 nt, Human
gaggugggauccuccaggugc

SEQ ID NO: 2944304 - RNA, 19 nt, Human
gaguacuacaguccuccca

SEQ ID NO: 2944305 - RNA, 18 nt, Human
gaguacuacaguccuccc

SEQ ID NO: 2944306 - RNA, 17 nt, Human
gaguacguugugcauuu

SEQ ID NO: 2944307 - RNA, 18 nt, Human
gaguacguugugcauuug

SEQ ID NO: 2944308 - RNA, 15 nt, Human
gaguacuacaguccu

SEQ ID NO: 2944309 - RNA, 20 nt, Human
gaguacguugugcauuuggu

SEQ ID NO: 2944310 - RNA, 19 nt, Human
gagguuuuaaaaaaauccc

SEQ ID NO: 2944311 - RNA, 16 nt, Human
gaguacguugugcauu

SEQ ID NO: 2944312 - RNA, 16 nt, Human
gagguuaaaaagaaaa

SEQ ID NO: 2944313 - RNA, 19 nt, Human
gagguucaaagauauuuug

SEQ ID NO: 2944314 - RNA, 14 nt, Human
gagguucccuuuga

SEQ ID NO: 2944315 - RNA, 17 nt, Human
gccagguuuuuggucug

SEQ ID NO: 2944316 - RNA, 20 nt, Human
gccagucaccccggccaccu

SEQ ID NO: 2944317 - RNA, 18 nt, Human
gccagucaccccggccac

SEQ ID NO: 2944318 - RNA, 17 nt, Human
gccagucaccccggcca

SEQ ID NO: 2944319 - RNA, 21 nt, Human
gccagggccaugucagacaca

SEQ ID NO: 2944320 - RNA, 21 nt, Human
gccagauuucacucuccuugg

SEQ ID NO: 2944321 - RNA, 18 nt, Human
gccagauuucacucuccu

SEQ ID NO: 2944322 - RNA, 16 nt, Human
gccagauuucacucuc

SEQ ID NO: 2944323 - RNA, 13 nt, Human
gccagggacagag

SEQ ID NO: 2944324 - RNA, 18 nt, Human
gccagggacagagggggu

SEQ ID NO: 2944325 - RNA, 16 nt, Human
gccagggacagagggg

SEQ ID NO: 2944326 - RNA, 23 nt, Human
gccagggacagaggggguggccu

SEQ ID NO: 2944327 - RNA, 14 nt, Human
gccagugccugggu

SEQ ID NO: 2944328 - RNA, 13 nt, Human
gccagugccuggg

SEQ ID NO: 2944329 - RNA, 12 nt, Human
gccagugccugg

SEQ ID NO: 2944330 - RNA, 19 nt, Human
gccaugccagcuuaucuca

SEQ ID NO: 2944331 - RNA, 18 nt, Human
gccaugccagcuuaucuc

SEQ ID NO: 2944332 - RNA, 13 nt, Human
gccaugccagcuu

SEQ ID NO: 2944333 - RNA, 18 nt, Human
gccaugaggaacaaggca

SEQ ID NO: 2944334 - RNA, 19 nt, Human
gccaugagccgcccaaggc

SEQ ID NO: 2944335 - RNA, 21 nt, Human
gccaugagccgcccaaggccu

SEQ ID NO: 2944336 - RNA, 18 nt, Human
gccaugagccgcccaagg

SEQ ID NO: 2944337 - RNA, 16 nt, Human
gccauuuguguuuaua

SEQ ID NO: 2944338 - RNA, 23 nt, Human
gccaugggacagggaggacgcuc

SEQ ID NO: 2944339 - RNA, 22 nt, Human
gccaugggacagggaggacgcu

SEQ ID NO: 2944340 - RNA, 14 nt, Human
gcccagccuggaug

SEQ ID NO: 2944341 - RNA, 16 nt, Human
gcccagccuggaugcc

SEQ ID NO: 2944342 - RNA, 24 nt, Human
gcccagccccuucugacccaugcu

SEQ ID NO: 2944343 - RNA, 20 nt, Human
gcccagccccuucugaccca

SEQ ID NO: 2944344 - RNA, 17 nt, Human
gcccagccccuucugac

SEQ ID NO: 2944345 - RNA, 16 nt, Human
gcccagccccuucuga

SEQ ID NO: 2944346 - RNA, 14 nt, Human
gcccagccccuucu

SEQ ID NO: 2944347 - RNA, 13 nt, Human
gcccagccccuuc

SEQ ID NO: 2944348 - RNA, 15 nt, Human
gcccaguugggugga

SEQ ID NO: 2944349 - RNA, 19 nt, Human
gcccagucuggaaugcagu

SEQ ID NO: 2944350 - RNA, 23 nt, Human
gcccaggcuuagucacugagaca

SEQ ID NO: 2944351 - RNA, 21 nt, Human
gcccaggcuuagucacugaga

SEQ ID NO: 2944352 - RNA, 19 nt, Human
gcccaggcuuagucacuga

SEQ ID NO: 2944353 - RNA, 22 nt, Human
gcccaggcuggcgugcaguggu

SEQ ID NO: 2944354 - RNA, 19 nt, Human
gcccaggcuggcgugcagu

SEQ ID NO: 2944355 - RNA, 20 nt, Human
gcccaggcuggcgugcagug

SEQ ID NO: 2944356 - RNA, 21 nt, Human
gcccaggaaaggcuccaggag

SEQ ID NO: 2944357 - RNA, 20 nt, Human
gcccaggaaaggcuccagga

SEQ ID NO: 2944358 - RNA, 19 nt, Human
gcccaggaaaggcuccagg

SEQ ID NO: 2944359 - RNA, 18 nt, Human
gcccaggaaaggcuccag

SEQ ID NO: 2944360 - RNA, 21 nt, Human
gcccaaugcacuuuguucugg

SEQ ID NO: 2944361 - RNA, 12 nt, Human
gcccagagggcc

SEQ ID NO: 2944362 - RNA, 19 nt, Human
gcccagagggccugcaagg

SEQ ID NO: 2944363 - RNA, 18 nt, Human
gcccagagggccugcaag

SEQ ID NO: 2944364 - RNA, 15 nt, Human
gcccagagggccugc

SEQ ID NO: 2944365 - RNA, 14 nt, Human
gcccagagggccug

SEQ ID NO: 2944366 - RNA, 9 nt, Human
gcccagccc

SEQ ID NO: 2944367 - RNA, 12 nt, Human
gcccagccccuu

SEQ ID NO: 2944368 - RNA, 11 nt, Human
gcccagccccu

SEQ ID NO: 2944369 - RNA, 22 nt, Human
gcccagagggccugcaagggag

SEQ ID NO: 2944370 - RNA, 21 nt, Human
gcccagagggccugcaaggga

SEQ ID NO: 2944371 - RNA, 20 nt, Human
gcccagagggccugcaaggg

SEQ ID NO: 2944372 - RNA, 23 nt, Human
gccaauauccuaauaaaaaggug

SEQ ID NO: 2944373 - RNA, 22 nt, Human
gccaauauccuaauaaaaaggu

SEQ ID NO: 2944374 - RNA, 20 nt, Human
gccaauauccuaauaaaaag

SEQ ID NO: 2944375 - RNA, 19 nt, Human
gccaauauccuaauaaaaa

SEQ ID NO: 2944376 - RNA, 18 nt, Human
gccaauauccuaauaaaa

SEQ ID NO: 2944377 - RNA, 21 nt, Human
gccaaugcuacaguaauaaau

SEQ ID NO: 2944378 - RNA, 13 nt, Human
gccaauauccuaa

SEQ ID NO: 2944379 - RNA, 17 nt, Human
gccaauauccuaauaaa

SEQ ID NO: 2944380 - RNA, 16 nt, Human
gccaauauccuaauaa

SEQ ID NO: 2944381 - RNA, 15 nt, Human
gccaauauccuaaua

SEQ ID NO: 2944382 - RNA, 14 nt, Human
gccaauauccuaau

SEQ ID NO: 2944383 - RNA, 15 nt, Human
gccaaggugggagga

SEQ ID NO: 2944384 - RNA, 14 nt, Human
gccaaggugggagg

SEQ ID NO: 2944385 - RNA, 23 nt, Human
gccaaggugggaggauugcuuga

SEQ ID NO: 2944386 - RNA, 21 nt, Human
gccaaggcugggggaagaagc

SEQ ID NO: 2944387 - RNA, 19 nt, Human
gcauuugaggucuguucuu

SEQ ID NO: 2944388 - RNA, 20 nt, Human
gcauuugaggucuguucuuu

SEQ ID NO: 2944389 - RNA, 22 nt, Human
gcauuuggugguuucagaaaug

SEQ ID NO: 2944390 - RNA, 23 nt, Human
gcauuuggugguuucagaaaugu

SEQ ID NO: 2944391 - RNA, 12 nt, Human
gccaauuugcac

SEQ ID NO: 2944392 - RNA, 22 nt, Human
gccacaagacccuugugguccc

SEQ ID NO: 2944393 - RNA, 16 nt, Human
gccacaagacccuugu

SEQ ID NO: 2944394 - RNA, 23 nt, Human
gccacagagaaaguacuucucca

SEQ ID NO: 2944395 - RNA, 19 nt, Human
gccacaccucuaucccggc

SEQ ID NO: 2944396 - RNA, 13 nt, Human
gccacagagaaag

SEQ ID NO: 2944397 - RNA, 14 nt, Human
gccacagagaaagu

SEQ ID NO: 2944398 - RNA, 20 nt, Human
gccacagagaaaguacuucu

SEQ ID NO: 2944399 - RNA, 18 nt, Human
gccacggccaggccagag

SEQ ID NO: 2944400 - RNA, 17 nt, Human
gccacggccaggccaga

SEQ ID NO: 2944401 - RNA, 19 nt, Human
gccacggccaggccagagg

SEQ ID NO: 2944402 - RNA, 22 nt, Human
gccaccugcggugcuaucuccc

SEQ ID NO: 2944403 - RNA, 20 nt, Human
gccaccugcggugcuaucuc

SEQ ID NO: 2944404 - RNA, 14 nt, Human
gccaccugcggugc

SEQ ID NO: 2944405 - RNA, 16 nt, Human
gccaccgccuugccca

SEQ ID NO: 2944406 - RNA, 20 nt, Human
gccaccgccuugcccagccu

SEQ ID NO: 2944407 - RNA, 13 nt, Human
gccaccgccuugc

SEQ ID NO: 2944408 - RNA, 17 nt, Human
gccaccugccuguuggg

SEQ ID NO: 2944409 - RNA, 21 nt, Human
gccagagggagugacagaggc

SEQ ID NO: 2944410 - RNA, 22 nt, Human
gccagagggagugacagaggca

SEQ ID NO: 2944411 - RNA, 22 nt, Human
gccagaggagagaggacccccu

SEQ ID NO: 2944412 - RNA, 19 nt, Human
gccagaggagagaggaccc

SEQ ID NO: 2944413 - RNA, 17 nt, Human
gccagaggagagaggac

SEQ ID NO: 2944414 - RNA, 15 nt, Human
gccagaggagagagg

SEQ ID NO: 2944415 - RNA, 13 nt, Human
gccagaggagaga

SEQ ID NO: 2944416 - RNA, 12 nt, Human
gccagaggagag

SEQ ID NO: 2944417 - RNA, 23 nt, Human
gccagagggagugacagaggcag

SEQ ID NO: 2944418 - RNA, 16 nt, Human
gccagaugcaccagcc

SEQ ID NO: 2944419 - RNA, 17 nt, Human
gccagaugcaccagccc

SEQ ID NO: 2944420 - RNA, 18 nt, Human
gccagaugcaccagcccu

SEQ ID NO: 2944421 - RNA, 10 nt, Human
gccagaggag

SEQ ID NO: 2944422 - RNA, 20 nt, Human
gccagagacacaagccuucg

SEQ ID NO: 2944423 - RNA, 19 nt, Human
gccagacuggcacaguuuu

SEQ ID NO: 2944424 - RNA, 16 nt, Human
gccagagacacaagcc

SEQ ID NO: 2944425 - RNA, 19 nt, Human
gccagagacacaagccuuc

SEQ ID NO: 2944426 - RNA, 17 nt, Human
gccagagacacaagccu

SEQ ID NO: 2944427 - RNA, 23 nt, Human
gccacuacauuugcuccauccuc

SEQ ID NO: 2944428 - RNA, 18 nt, Human
gccagacuggcacaguuu

SEQ ID NO: 2944429 - RNA, 15 nt, Human
gccagacuggcacag

SEQ ID NO: 2944430 - RNA, 18 nt, Human
gcauuugaggucuguucu

SEQ ID NO: 2944431 - RNA, 22 nt, Human
gcauuccccaggaggccagccu

SEQ ID NO: 2944432 - RNA, 21 nt, Human
gcauuccccaggaggccagcc

SEQ ID NO: 2944433 - RNA, 20 nt, Human
gcauuccccaggaggccagc

SEQ ID NO: 2944434 - RNA, 19 nt, Human
gcauuccccaggaggccag

SEQ ID NO: 2944435 - RNA, 18 nt, Human
gcauuccccaggaggcca

SEQ ID NO: 2944436 - RNA, 17 nt, Human
gcauuccccaggaggcc

SEQ ID NO: 2944437 - RNA, 16 nt, Human
gcauuccccaggaggc

SEQ ID NO: 2944438 - RNA, 15 nt, Human
gcauuccccaggagg

SEQ ID NO: 2944439 - RNA, 14 nt, Human
gcauuccccaggag

SEQ ID NO: 2944440 - RNA, 12 nt, Human
gcauuccccagg

SEQ ID NO: 2944441 - RNA, 19 nt, Human
gcauuaucuagauacugua

SEQ ID NO: 2944442 - RNA, 22 nt, Human
gcauuaucuagauacuguauca

SEQ ID NO: 2944443 - RNA, 24 nt, Human
gcauuaucuagauacuguaucaug

SEQ ID NO: 2944444 - RNA, 14 nt, Human
gcaugccuggaugg

SEQ ID NO: 2944445 - RNA, 13 nt, Human
gcauguuacauaa

SEQ ID NO: 2944446 - RNA, 20 nt, Human
gcaugaaguaauaugcacac

SEQ ID NO: 2944447 - RNA, 21 nt, Human
gcaugaaguaauaugcacaca

SEQ ID NO: 2944448 - RNA, 22 nt, Human
gcaugaaguaauaugcacacau

SEQ ID NO: 2944449 - RNA, 22 nt, Human
gcaugacacgaauauugcugau

SEQ ID NO: 2944450 - RNA, 21 nt, Human
gcaugacacgaauauugcuga

SEQ ID NO: 2944451 - RNA, 20 nt, Human
gcaugacacgaauauugcug

SEQ ID NO: 2944452 - RNA, 20 nt, Human
gcaucuagcaugucgucaaa

SEQ ID NO: 2944453 - RNA, 23 nt, Human
gcaucaggccaggcccucugccc

SEQ ID NO: 2944454 - RNA, 18 nt, Human
gcaucaggccaggcccuc

SEQ ID NO: 2944455 - RNA, 22 nt, Human
gcauacugccuuguuuaauggu

SEQ ID NO: 2944456 - RNA, 22 nt, Human
gcaucagcugcugaaacaacaa

SEQ ID NO: 2944457 - RNA, 23 nt, Human
gcaucagcugcugaaacaacaaa

SEQ ID NO: 2944458 - RNA, 12 nt, Human
gcaucaggccag

SEQ ID NO: 2944459 - RNA, 17 nt, Human
gcaggcagccaggccac

SEQ ID NO: 2944460 - RNA, 18 nt, Human
gcaggcagccaggccaca

SEQ ID NO: 2944461 - RNA, 16 nt, Human
gcagggucucacucug

SEQ ID NO: 2944462 - RNA, 19 nt, Human
gcaggguccuagaaauucc

SEQ ID NO: 2944463 - RNA, 22 nt, Human
gcaggggaggguagagcggaga

SEQ ID NO: 2944464 - RNA, 11 nt, Human
gcagugggagc

SEQ ID NO: 2944465 - RNA, 18 nt, Human
gcaguggugcgaucuggg

SEQ ID NO: 2944466 - RNA, 19 nt, Human
gcaguggugcgaucugggu

SEQ ID NO: 2944467 - RNA, 22 nt, Human
gcaguggugcgaucuggguuca

SEQ ID NO: 2944468 - RNA, 19 nt, Human
gcaguggugguuuucuguu

SEQ ID NO: 2944469 - RNA, 20 nt, Human
gcaguggugcgaucuggguu

SEQ ID NO: 2944470 - RNA, 21 nt, Human
gcaguggugcgaucuggguuc

SEQ ID NO: 2944471 - RNA, 19 nt, Human
gcaguucagagcugcccuc

SEQ ID NO: 2944472 - RNA, 20 nt, Human
gcaguucagagcugcccucu

SEQ ID NO: 2944473 - RNA, 22 nt, Human
gcaguucagagcugcccucucc

SEQ ID NO: 2944474 - RNA, 23 nt, Human
gcaguucagagcugcccucuccu

SEQ ID NO: 2944475 - RNA, 20 nt, Human
gcaguggugguuuucuguuc

SEQ ID NO: 2944476 - RNA, 21 nt, Human
gcaguggugguuuucuguucu

SEQ ID NO: 2944477 - RNA, 15 nt, Human
gcaguugaaaagacu

SEQ ID NO: 2944478 - RNA, 19 nt, Human
gcaguugaaaagacuccaa

SEQ ID NO: 2944479 - RNA, 16 nt, Human
gcaguugaaaagacuc

SEQ ID NO: 2944480 - RNA, 21 nt, Human
gcaguugaaaagacuccaaag

SEQ ID NO: 2944481 - RNA, 19 nt, Human
gcauacguacacauuuuau

SEQ ID NO: 2944482 - RNA, 13 nt, Human
gcauacuauuaaa

SEQ ID NO: 2944483 - RNA, 18 nt, Human
gcauacguacacauuuua

SEQ ID NO: 2944484 - RNA, 14 nt, Human
gcauacuauuaaac

SEQ ID NO: 2944485 - RNA, 17 nt, Human
gcauacuauuaaacaug

SEQ ID NO: 2944486 - RNA, 21 nt, Human
gcauacuauuaaacaugcugu

SEQ ID NO: 2944487 - RNA, 19 nt, Human
gcacuaaggugugcucuga

SEQ ID NO: 2944488 - RNA, 20 nt, Human
gcacuaaggugugcucugau

SEQ ID NO: 2944489 - RNA, 14 nt, Human
gcacgugugugcac

SEQ ID NO: 2944490 - RNA, 16 nt, Human
gcacgcacacugucug

SEQ ID NO: 2944491 - RNA, 15 nt, Human
gcacgcacacugucu

SEQ ID NO: 2944492 - RNA, 19 nt, Human
gcacccucaggcagguggg

SEQ ID NO: 2944493 - RNA, 16 nt, Human
gcacccucaggcaggu

SEQ ID NO: 2944494 - RNA, 20 nt, Human
gcacuauaauguaagcucua

SEQ ID NO: 2944495 - RNA, 14 nt, Human
gcacuauaauguaa

SEQ ID NO: 2944496 - RNA, 15 nt, Human
gcacuauaauguaag

SEQ ID NO: 2944497 - RNA, 15 nt, Human
gcacugcuuccagug

SEQ ID NO: 2944498 - RNA, 14 nt, Human
gcacugcuuccagu

SEQ ID NO: 2944499 - RNA, 13 nt, Human
gcacugcuuccag

SEQ ID NO: 2944500 - RNA, 12 nt, Human
gcacugcuucca

SEQ ID NO: 2944501 - RNA, 12 nt, Human
gcacugggcuug

SEQ ID NO: 2944502 - RNA, 19 nt, Human
gcacuguuuuauuuuaauu

SEQ ID NO: 2944503 - RNA, 19 nt, Human
gcacuguggguagacacac

SEQ ID NO: 2944504 - RNA, 13 nt, Human
gcaccagcagccu

SEQ ID NO: 2944505 - RNA, 15 nt, Human
gcaccaucucuccuc

SEQ ID NO: 2944506 - RNA, 14 nt, Human
gcaccaucucuccu

SEQ ID NO: 2944507 - RNA, 17 nt, Human
gcaccaucucuccuccu

SEQ ID NO: 2944508 - RNA, 23 nt, Human
gcacagcuucauuuccugugucu

SEQ ID NO: 2944509 - RNA, 21 nt, Human
gcacagcuucauuuccugugu

SEQ ID NO: 2944510 - RNA, 12 nt, Human
gcacagcaggcu

SEQ ID NO: 2944511 - RNA, 20 nt, Human
gauugugucucuugguccug

SEQ ID NO: 2944512 - RNA, 15 nt, Human
gcacagccucuuaga

SEQ ID NO: 2944513 - RNA, 17 nt, Human
gcacagcaggcugccag

SEQ ID NO: 2944514 - RNA, 23 nt, Human
gcacagcaggcugccagugccug

SEQ ID NO: 2944515 - RNA, 18 nt, Human
gcacagcaggcugccagu

SEQ ID NO: 2944516 - RNA, 22 nt, Human
gcacagcaggcugccagugccu

SEQ ID NO: 2944517 - RNA, 17 nt, Human
gcagccucacaguccuu

SEQ ID NO: 2944518 - RNA, 15 nt, Human
gcagccucacagucc

SEQ ID NO: 2944519 - RNA, 19 nt, Human
gcagccucacaguccuuac

SEQ ID NO: 2944520 - RNA, 19 nt, Human
gcagcagggagggcuucug

SEQ ID NO: 2944521 - RNA, 18 nt, Human
gcagcagggagggcuucu

SEQ ID NO: 2944522 - RNA, 16 nt, Human
gcagcucaccucuccc

SEQ ID NO: 2944523 - RNA, 14 nt, Human
gcagcucagagagg

SEQ ID NO: 2944524 - RNA, 21 nt, Human
gcagcucaccucucccuugga

SEQ ID NO: 2944525 - RNA, 20 nt, Human
gcagcucaccucucccuugg

SEQ ID NO: 2944526 - RNA, 17 nt, Human
gcagcucaccucucccu

SEQ ID NO: 2944527 - RNA, 19 nt, Human
gcagcucagagaggguggg

SEQ ID NO: 2944528 - RNA, 18 nt, Human
gcagcucagagagggugg

SEQ ID NO: 2944529 - RNA, 16 nt, Human
gcaggaagcugugaga

SEQ ID NO: 2944530 - RNA, 22 nt, Human
gcacuucgggaggucgaggcag

SEQ ID NO: 2944531 - RNA, 14 nt, Human
gcacuugcagacuc

SEQ ID NO: 2944532 - RNA, 16 nt, Human
gcacuugcagacucua

SEQ ID NO: 2944533 - RNA, 17 nt, Human
gcagacucuacagaggc

SEQ ID NO: 2944534 - RNA, 18 nt, Human
gcagacucuacagaggcc

SEQ ID NO: 2944535 - RNA, 19 nt, Human
gcagacucuacagaggcca

SEQ ID NO: 2944536 - RNA, 22 nt, Human
gcagacucuacagaggccaugg

SEQ ID NO: 2944537 - RNA, 19 nt, Human
gcagagaccaucccugaag

SEQ ID NO: 2944538 - RNA, 21 nt, Human
gcagagaccaucccugaaggc

SEQ ID NO: 2944539 - RNA, 20 nt, Human
gcagagaccaucccugaagg

SEQ ID NO: 2944540 - RNA, 22 nt, Human
gcagagaccaucccugaaggcc

SEQ ID NO: 2944541 - RNA, 18 nt, Human
gcagauggagaccccuug

SEQ ID NO: 2944542 - RNA, 17 nt, Human
gcagcagacacaugcca

SEQ ID NO: 2944543 - RNA, 13 nt, Human
gcagcagacacau

SEQ ID NO: 2944544 - RNA, 22 nt, Human
gcagaguaggggucugucuuuu

SEQ ID NO: 2944545 - RNA, 23 nt, Human
gcagagguugcagugagccgaga

SEQ ID NO: 2944546 - RNA, 18 nt, Human
gcagagguugcagugagc

SEQ ID NO: 2944547 - RNA, 18 nt, Human
gcuugcccuguuaaaaga

SEQ ID NO: 2944548 - RNA, 21 nt, Human
gcuucauccuccucagaucuu

SEQ ID NO: 2944549 - RNA, 19 nt, Human
gcuucaguggcagcugcuu

SEQ ID NO: 2944550 - RNA, 20 nt, Human
gcuucaguggcagcugcuuu

SEQ ID NO: 2944551 - RNA, 20 nt, Human
gcuuauacacuuacacuuua

SEQ ID NO: 2944552 - RNA, 21 nt, Human
gcuuagacccucaugcugcca

SEQ ID NO: 2944553 - RNA, 16 nt, Human
gcuuagacccucaugc

SEQ ID NO: 2944554 - RNA, 12 nt, Human
gcuuagaaauaa

SEQ ID NO: 2944555 - RNA, 19 nt, Human
gcuuagaaauaacagaaga

SEQ ID NO: 2944556 - RNA, 17 nt, Human
gcuucucacugccaugc

SEQ ID NO: 2944557 - RNA, 22 nt, Human
gcuucucacugccaugccagcu

SEQ ID NO: 2944558 - RNA, 18 nt, Human
gcuucauuuccugugucu

SEQ ID NO: 2944559 - RNA, 19 nt, Human
gcuucuguuuuauaauuuu

SEQ ID NO: 2944560 - RNA, 15 nt, Human
gcugugucucccuuc

SEQ ID NO: 2944561 - RNA, 22 nt, Human
gcuuacaugccuaccaauauuu

SEQ ID NO: 2944562 - RNA, 16 nt, Human
gcugucccuuuuccuu

SEQ ID NO: 2944563 - RNA, 23 nt, Human
gcugucccuuacgugaguccugg

SEQ ID NO: 2944564 - RNA, 17 nt, Human
gcugucagccauuccug

SEQ ID NO: 2944565 - RNA, 14 nt, Human
gcuggugucaccug

SEQ ID NO: 2944566 - RNA, 15 nt, Human
gcuggugucaccuga

SEQ ID NO: 2944567 - RNA, 21 nt, Human
gcugggcucccuucccaccuc

SEQ ID NO: 2944568 - RNA, 19 nt, Human
gcugggaugauuggagggg

SEQ ID NO: 2944569 - RNA, 15 nt, Human
gcuggccuggccccu

SEQ ID NO: 2944570 - RNA, 14 nt, Human
gcuggccuggcccc

SEQ ID NO: 2944571 - RNA, 12 nt, Human
gcuggccuggcc

SEQ ID NO: 2944572 - RNA, 13 nt, Human
gcuggccuggccc

SEQ ID NO: 2944573 - RNA, 21 nt, Human
gcugggcuucaguggcagcug

SEQ ID NO: 2944574 - RNA, 22 nt, Human
gcugggcuucaguggcagcugc

SEQ ID NO: 2944575 - RNA, 20 nt, Human
gcugggcuucaguggcagcu

SEQ ID NO: 2944576 - RNA, 14 nt, Human
gcugggggccucag

SEQ ID NO: 2944577 - RNA, 15 nt, Human
gcugggggccucagu

SEQ ID NO: 2944578 - RNA, 18 nt, Human
gcugggggccucagugcc

SEQ ID NO: 2944579 - RNA, 13 nt, Human
gcugggggccuca

SEQ ID NO: 2944580 - RNA, 23 nt, Human
gcuggucccagccagcaguucag

SEQ ID NO: 2944581 - RNA, 19 nt, Human
gcugauuuaaacacauuaa

SEQ ID NO: 2944582 - RNA, 22 nt, Human
gcugcaaaggguaucaggugcu

SEQ ID NO: 2944583 - RNA, 23 nt, Human
gcugcaaaggguaucaggugcug

SEQ ID NO: 2944584 - RNA, 15 nt, Human
gcugaucgcuucucc

SEQ ID NO: 2944585 - RNA, 21 nt, Human
gcugauuaaaccaaggcuaga

SEQ ID NO: 2944586 - RNA, 14 nt, Human
gcugcaguugccag

SEQ ID NO: 2944587 - RNA, 13 nt, Human
gcugcaguugcca

SEQ ID NO: 2944588 - RNA, 19 nt, Human
gcugcauuuaaaagauaca

SEQ ID NO: 2944589 - RNA, 17 nt, Human
gcugcaguugccaguca

SEQ ID NO: 2944590 - RNA, 17 nt, Human
gcugcauuuaaaagaua

SEQ ID NO: 2944591 - RNA, 18 nt, Human
gcugcauuuaaaagauac

SEQ ID NO: 2944592 - RNA, 20 nt, Human
gcugccaaugggagcucaug

SEQ ID NO: 2944593 - RNA, 12 nt, Human
gcugccaccugc

SEQ ID NO: 2944594 - RNA, 13 nt, Human
gcugccaccugcc

SEQ ID NO: 2944595 - RNA, 12 nt, Human
gcugcccucucc

SEQ ID NO: 2944596 - RNA, 20 nt, Human
gcucucaggccagcugcuug

SEQ ID NO: 2944597 - RNA, 21 nt, Human
gcucucaggccagcugcuugg

SEQ ID NO: 2944598 - RNA, 17 nt, Human
gcugacagacacaggcc

SEQ ID NO: 2944599 - RNA, 18 nt, Human
gcugacagacacaggccc

SEQ ID NO: 2944600 - RNA, 19 nt, Human
gcugacagacacaggcccg

SEQ ID NO: 2944601 - RNA, 14 nt, Human
gcugaccuugcuga

SEQ ID NO: 2944602 - RNA, 22 nt, Human
gcugacuguuuucucuugagag

SEQ ID NO: 2944603 - RNA, 22 nt, Human
gcugcuuuugucuaugggacuc

SEQ ID NO: 2944604 - RNA, 23 nt, Human
gcuggaaaaguauguuagugcaa

SEQ ID NO: 2944605 - RNA, 21 nt, Human
gcuggaaaaguauguuagugc

SEQ ID NO: 2944606 - RNA, 15 nt, Human
gcuggaccuugaacu

SEQ ID NO: 2944607 - RNA, 22 nt, Human
gcugcgguccacccaggagccc

SEQ ID NO: 2944608 - RNA, 21 nt, Human
gcugcgguccacccaggagcc

SEQ ID NO: 2944609 - RNA, 14 nt, Human
gcugcgguccaccc

SEQ ID NO: 2944610 - RNA, 15 nt, Human
gcugcgguccaccca

SEQ ID NO: 2944611 - RNA, 20 nt, Human
gcugccuguucagcuccagc

SEQ ID NO: 2944612 - RNA, 22 nt, Human
gcugccuguucagcuccagcuc

SEQ ID NO: 2944613 - RNA, 18 nt, Human
gcugccuguucagcucca

SEQ ID NO: 2944614 - RNA, 19 nt, Human
gcugccuguucagcuccag

SEQ ID NO: 2944615 - RNA, 24 nt, Human
gcugcccugcccaccuggccucug

SEQ ID NO: 2944616 - RNA, 23 nt, Human
gcugcccugcccaccuggccucu

SEQ ID NO: 2944617 - RNA, 22 nt, Human
gcugcccugcccaccuggccuc

SEQ ID NO: 2944618 - RNA, 21 nt, Human
gcugcccugcccaccuggccu

SEQ ID NO: 2944619 - RNA, 20 nt, Human
gcugcccugcccaccuggcc

SEQ ID NO: 2944620 - RNA, 18 nt, Human
gcugcccugcccaccugg

SEQ ID NO: 2944621 - RNA, 16 nt, Human
gcugcccugcccaccu

SEQ ID NO: 2944622 - RNA, 23 nt, Human
gcugcccucuccugggcagcugc

SEQ ID NO: 2944623 - RNA, 12 nt, Human
gcugcccugccc

SEQ ID NO: 2944624 - RNA, 14 nt, Human
gcugcccugcccac

SEQ ID NO: 2944625 - RNA, 13 nt, Human
gcugcccugccca

SEQ ID NO: 2944626 - RNA, 13 nt, Human
gcugcccucuccu

SEQ ID NO: 2944627 - RNA, 14 nt, Human
gcugcccucuccug

SEQ ID NO: 2944628 - RNA, 15 nt, Human
gcugcccucuccugg

SEQ ID NO: 2944629 - RNA, 16 nt, Human
gcugcccucuccuggg

SEQ ID NO: 2944630 - RNA, 17 nt, Human
gcugcccucuccugggc

SEQ ID NO: 2944631 - RNA, 18 nt, Human
gcugcccucuccugggca

SEQ ID NO: 2944632 - RNA, 20 nt, Human
gcugcccucuccugggcagc

SEQ ID NO: 2944633 - RNA, 22 nt, Human
gcugcccucuccugggcagcug

SEQ ID NO: 2944634 - RNA, 15 nt, Human
gcggggacagcuccu

SEQ ID NO: 2944635 - RNA, 17 nt, Human
gcggggacagcuccuuc

SEQ ID NO: 2944636 - RNA, 19 nt, Human
gcggugagaggggaacaga

SEQ ID NO: 2944637 - RNA, 13 nt, Human
gcgguccacccag

SEQ ID NO: 2944638 - RNA, 14 nt, Human
gcgguccacccagg

SEQ ID NO: 2944639 - RNA, 21 nt, Human
gcgcugccccuggcagccccu

SEQ ID NO: 2944640 - RNA, 18 nt, Human
gcgcugccccuggcagcc

SEQ ID NO: 2944641 - RNA, 16 nt, Human
gcggagaaaggaaggg

SEQ ID NO: 2944642 - RNA, 19 nt, Human
gcggagacggagucccacc

SEQ ID NO: 2944643 - RNA, 14 nt, Human
gcggggacagcucc

SEQ ID NO: 2944644 - RNA, 21 nt, Human
gcgccuuaaggauguucuagc

SEQ ID NO: 2944645 - RNA, 23 nt, Human
gcgcccaguuggguggaugccug

SEQ ID NO: 2944646 - RNA, 21 nt, Human
gcgacaaugcaaaccaucauu

SEQ ID NO: 2944647 - RNA, 20 nt, Human
gcgacaaugcaaaccaucau

SEQ ID NO: 2944648 - RNA, 13 nt, Human
gcgacaaugcaaa

SEQ ID NO: 2944649 - RNA, 12 nt, Human
gcgacaaugcaa

SEQ ID NO: 2944650 - RNA, 15 nt, Human
gccuuacacaauggu

SEQ ID NO: 2944651 - RNA, 16 nt, Human
gccuuacacaaugguu

SEQ ID NO: 2944652 - RNA, 15 nt, Human
gccuuguuuaauggu

SEQ ID NO: 2944653 - RNA, 23 nt, Human
gccuuguuuaaugguaguuuuac

SEQ ID NO: 2944654 - RNA, 18 nt, Human
gccuuggggcugaugcag

SEQ ID NO: 2944655 - RNA, 14 nt, Human
gccuggccccucag

SEQ ID NO: 2944656 - RNA, 13 nt, Human
gccuggccccuca

SEQ ID NO: 2944657 - RNA, 20 nt, Human
gccuggccagaugcaccagc

SEQ ID NO: 2944658 - RNA, 16 nt, Human
gccuggccagaugcac

SEQ ID NO: 2944659 - RNA, 21 nt, Human
gccuggccagaugcaccagcc

SEQ ID NO: 2944660 - RNA, 20 nt, Human
gccuguaauccuagcacuuu

SEQ ID NO: 2944661 - RNA, 15 nt, Human
gccuguaauccuagc

SEQ ID NO: 2944662 - RNA, 18 nt, Human
gccuggauggggcugcac

SEQ ID NO: 2944663 - RNA, 16 nt, Human
gccuggauggggcugc

SEQ ID NO: 2944664 - RNA, 20 nt, Human
gccuggauggggcugcaccg

SEQ ID NO: 2944665 - RNA, 12 nt, Human
gccugagcuggg

SEQ ID NO: 2944666 - RNA, 19 nt, Human
gcccaguuggguggaugcc

SEQ ID NO: 2944667 - RNA, 21 nt, Human
gcccaguuggguggaugccug

SEQ ID NO: 2944668 - RNA, 15 nt, Human
gccugaagucacaca

SEQ ID NO: 2944669 - RNA, 16 nt, Human
gccugaagucacacag

SEQ ID NO: 2944670 - RNA, 17 nt, Human
gccugaagucacacagu

SEQ ID NO: 2944671 - RNA, 18 nt, Human
gccugaagucacacagug

SEQ ID NO: 2944672 - RNA, 17 nt, Human
gccugagcgacagugag

SEQ ID NO: 2944673 - RNA, 20 nt, Human
gccugagcgacagugagacu

SEQ ID NO: 2944674 - RNA, 16 nt, Human
gcucagcggggacagc

SEQ ID NO: 2944675 - RNA, 17 nt, Human
gcucagcggggacagcu

SEQ ID NO: 2944676 - RNA, 18 nt, Human
gcucagcggggacagcuc

SEQ ID NO: 2944677 - RNA, 23 nt, Human
gcucagcggggacagcuccuucu

SEQ ID NO: 2944678 - RNA, 18 nt, Human
gcucaccucucccuugga

SEQ ID NO: 2944679 - RNA, 17 nt, Human
gcucaccucucccuugg

SEQ ID NO: 2944680 - RNA, 16 nt, Human
gcucaccucucccuug

SEQ ID NO: 2944681 - RNA, 14 nt, Human
gcucaccucucccu

SEQ ID NO: 2944682 - RNA, 16 nt, Human
gcucacauaucuguca

SEQ ID NO: 2944683 - RNA, 12 nt, Human
gcucaccagccc

SEQ ID NO: 2944684 - RNA, 13 nt, Human
gcucaccagcccc

SEQ ID NO: 2944685 - RNA, 14 nt, Human
gcucaccagcccca

SEQ ID NO: 2944686 - RNA, 15 nt, Human
gcucaccagccccag

SEQ ID NO: 2944687 - RNA, 14 nt, Human
gcuaucucccccag

SEQ ID NO: 2944688 - RNA, 18 nt, Human
gcucaaguccucuuuucu

SEQ ID NO: 2944689 - RNA, 13 nt, Human
gcuaucuccccca

SEQ ID NO: 2944690 - RNA, 23 nt, Human
gcucaauagauugcucaaaucag

SEQ ID NO: 2944691 - RNA, 19 nt, Human
gcucaaguccucuuuucug

SEQ ID NO: 2944692 - RNA, 22 nt, Human
gcucaaguccucuuuucugaga

SEQ ID NO: 2944693 - RNA, 21 nt, Human
gcuaguugggcuuccucauag

SEQ ID NO: 2944694 - RNA, 14 nt, Human
gcuagauguaugua

SEQ ID NO: 2944695 - RNA, 13 nt, Human
gcuagauguaugu

SEQ ID NO: 2944696 - RNA, 22 nt, Human
gcggugcuaucucccccagccc

SEQ ID NO: 2944697 - RNA, 19 nt, Human
gcggugcuaucucccccag

SEQ ID NO: 2944698 - RNA, 19 nt, Human
gcuauaggugcuacaaaaa

SEQ ID NO: 2944699 - RNA, 21 nt, Human
gcuauaggugcuacaaaaaca

SEQ ID NO: 2944700 - RNA, 12 nt, Human
gcuccugugucu

SEQ ID NO: 2944701 - RNA, 13 nt, Human
gcuccugugucuu

SEQ ID NO: 2944702 - RNA, 13 nt, Human
gcuccuucugucc

SEQ ID NO: 2944703 - RNA, 17 nt, Human
gcuccuuuagcgcccag

SEQ ID NO: 2944704 - RNA, 17 nt, Human
gcucgagcaugccugga

SEQ ID NO: 2944705 - RNA, 21 nt, Human
gcucgagcaugccuggauggg

SEQ ID NO: 2944706 - RNA, 19 nt, Human
gcucgagcaugccuggaug

SEQ ID NO: 2944707 - RNA, 21 nt, Human
gcuccuaggacccgucuccag

SEQ ID NO: 2944708 - RNA, 22 nt, Human
gcuccuaggacccgucuccagc

SEQ ID NO: 2944709 - RNA, 24 nt, Human
gcuccgcuuucuacccagcgagcc

SEQ ID NO: 2944710 - RNA, 20 nt, Human
gcuccagcuguucagcuggu

SEQ ID NO: 2944711 - RNA, 21 nt, Human
gcuccagcuguucagcugguu

SEQ ID NO: 2944712 - RNA, 11 nt, Human
gcuccaggagc

SEQ ID NO: 2944713 - RNA, 14 nt, Human
gcuccaggagcagc

SEQ ID NO: 2944714 - RNA, 12 nt, Human
gcuccaggagca

SEQ ID NO: 2944715 - RNA, 12 nt, Human
gcuccaggcucc

SEQ ID NO: 2944716 - RNA, 24 nt, Human
gcuccaggcuccuuuagcgcccag

SEQ ID NO: 2944717 - RNA, 18 nt, Human
gcuccaggagcagccaca

SEQ ID NO: 2944718 - RNA, 17 nt, Human
gcuccaggagcagccac

SEQ ID NO: 2944719 - RNA, 16 nt, Human
gcuccaggagcagcca

SEQ ID NO: 2944720 - RNA, 15 nt, Human
gcuccaggagcagcc

SEQ ID NO: 2944721 - RNA, 20 nt, Human
gcucccuucccaccucucuc

SEQ ID NO: 2944722 - RNA, 18 nt, Human
gcuccgcuuucuacccag

SEQ ID NO: 2944723 - RNA, 21 nt, Human
gcuccgcuuucuacccagcga

SEQ ID NO: 2944724 - RNA, 22 nt, Human
gcuccgcuuucuacccagcgag

SEQ ID NO: 2944725 - RNA, 23 nt, Human
gcuccgcuuucuacccagcgagc

SEQ ID NO: 2944726 - RNA, 20 nt, Human
gcuccauuuuuagugaaaua

SEQ ID NO: 2944727 - RNA, 15 nt, Human
ggagccuccugcccu

SEQ ID NO: 2944728 - RNA, 14 nt, Human
ggagcuagaauuug

SEQ ID NO: 2944729 - RNA, 16 nt, Human
ggagcacacuggcuca

SEQ ID NO: 2944730 - RNA, 14 nt, Human
ggagccuccugccc

SEQ ID NO: 2944731 - RNA, 23 nt, Human
ggagcccugucuccucucucugu

SEQ ID NO: 2944732 - RNA, 18 nt, Human
ggagcccugucuccucuc

SEQ ID NO: 2944733 - RNA, 17 nt, Human
ggagggagggcuccaga

SEQ ID NO: 2944734 - RNA, 16 nt, Human
ggagggagggcuccag

SEQ ID NO: 2944735 - RNA, 13 nt, Human
ggagggagggcuc

SEQ ID NO: 2944736 - RNA, 18 nt, Human
ggaggauguucugggaca

SEQ ID NO: 2944737 - RNA, 21 nt, Human
ggaggauguucugggacacag

SEQ ID NO: 2944738 - RNA, 16 nt, Human
ggaggacgcucucugg

SEQ ID NO: 2944739 - RNA, 21 nt, Human
ggagucccaccuuggcugcag

SEQ ID NO: 2944740 - RNA, 22 nt, Human
ggagucccaccuuggcugcagg

SEQ ID NO: 2944741 - RNA, 19 nt, Human
ggaggggagcaugggaagu

SEQ ID NO: 2944742 - RNA, 18 nt, Human
ggaccuugaacuggguac

SEQ ID NO: 2944743 - RNA, 17 nt, Human
ggacugaauuaugaaac

SEQ ID NO: 2944744 - RNA, 19 nt, Human
ggacugaauuaugaaacuu

SEQ ID NO: 2944745 - RNA, 19 nt, Human
ggacgcucucuggccuucg

SEQ ID NO: 2944746 - RNA, 15 nt, Human
ggacgcucucuggcc

SEQ ID NO: 2944747 - RNA, 16 nt, Human
ggacgcucucuggccu

SEQ ID NO: 2944748 - RNA, 20 nt, Human
ggagaagucuucuauuuauu

SEQ ID NO: 2944749 - RNA, 19 nt, Human
ggagaagucuucuauuuau

SEQ ID NO: 2944750 - RNA, 23 nt, Human
ggagaagagcuguucacagccag

SEQ ID NO: 2944751 - RNA, 20 nt, Human
ggacugagggggccuggaug

SEQ ID NO: 2944752 - RNA, 15 nt, Human
ggagaagagcuguuc

SEQ ID NO: 2944753 - RNA, 11 nt, Human
ggagaagaacu

SEQ ID NO: 2944754 - RNA, 14 nt, Human
ggagaagaacugaa

SEQ ID NO: 2944755 - RNA, 22 nt, Human
ggacacucaaaagcugggcagg

SEQ ID NO: 2944756 - RNA, 16 nt, Human
ggacagaggggguggc

SEQ ID NO: 2944757 - RNA, 22 nt, Human
ggacagccacggccaggccaga

SEQ ID NO: 2944758 - RNA, 20 nt, Human
ggacagaggggguggccucc

SEQ ID NO: 2944759 - RNA, 11 nt, Human
ggacagcuccu

SEQ ID NO: 2944760 - RNA, 15 nt, Human
ggacagcuccuucug

SEQ ID NO: 2944761 - RNA, 16 nt, Human
ggacagcuccuucugu

SEQ ID NO: 2944762 - RNA, 16 nt, Human
ggacauuugcucaugg

SEQ ID NO: 2944763 - RNA, 17 nt, Human
ggacauuugcucaugga

SEQ ID NO: 2944764 - RNA, 20 nt, Human
ggacauuugcucauggaauu

SEQ ID NO: 2944765 - RNA, 14 nt, Human
ggaccagagcugcc

SEQ ID NO: 2944766 - RNA, 19 nt, Human
ggaccagagcugccaccug

SEQ ID NO: 2944767 - RNA, 15 nt, Human
ggacauuuuaugucu

SEQ ID NO: 2944768 - RNA, 20 nt, Human
ggccaccgccuugcccagcc

SEQ ID NO: 2944769 - RNA, 20 nt, Human
ggcauguucucugaggacac

SEQ ID NO: 2944770 - RNA, 22 nt, Human
ggccacagaaaauucuucucca

SEQ ID NO: 2944771 - RNA, 21 nt, Human
ggccagaaaccuuccugcuga

SEQ ID NO: 2944772 - RNA, 20 nt, Human
ggccacugugaagagaacca

SEQ ID NO: 2944773 - RNA, 11 nt, Human
ggccaggagcc

SEQ ID NO: 2944774 - RNA, 14 nt, Human
ggccaggcccucug

SEQ ID NO: 2944775 - RNA, 13 nt, Human
ggccaggagccuc

SEQ ID NO: 2944776 - RNA, 17 nt, Human
ggccaggcccucugccc

SEQ ID NO: 2944777 - RNA, 16 nt, Human
ggccaggcccucugcc

SEQ ID NO: 2944778 - RNA, 15 nt, Human
ggccaggcccucugc

SEQ ID NO: 2944779 - RNA, 12 nt, Human
ggcccagagagg

SEQ ID NO: 2944780 - RNA, 23 nt, Human
ggcaugugaugagaggaaaucac

SEQ ID NO: 2944781 - RNA, 18 nt, Human
ggcaugugaugagaggaa

SEQ ID NO: 2944782 - RNA, 22 nt, Human
ggcaugacacgaauauugcuga

SEQ ID NO: 2944783 - RNA, 23 nt, Human
ggcagugcuuggcccaggaguuu

SEQ ID NO: 2944784 - RNA, 22 nt, Human
ggcagugcuuggcccaggaguu

SEQ ID NO: 2944785 - RNA, 21 nt, Human
ggcagugcuuggcccaggagu

SEQ ID NO: 2944786 - RNA, 20 nt, Human
ggcagugcuuggcccaggag

SEQ ID NO: 2944787 - RNA, 19 nt, Human
ggcagugcuuggcccagga

SEQ ID NO: 2944788 - RNA, 18 nt, Human
ggcagugcuuggcccagg

SEQ ID NO: 2944789 - RNA, 17 nt, Human
ggcagugcuuggcccag

SEQ ID NO: 2944790 - RNA, 17 nt, Human
ggcagggucucacucug

SEQ ID NO: 2944791 - RNA, 18 nt, Human
ggcagggucucacucugu

SEQ ID NO: 2944792 - RNA, 17 nt, Human
ggcagguuggugggggc

SEQ ID NO: 2944793 - RNA, 23 nt, Human
ggcagcugcgguccacccaggag

SEQ ID NO: 2944794 - RNA, 24 nt, Human
ggcagcugcgguccacccaggagc

SEQ ID NO: 2944795 - RNA, 12 nt, Human
ggcaggguccua

SEQ ID NO: 2944796 - RNA, 21 nt, Human
ggcagcugcgguccacccagg

SEQ ID NO: 2944797 - RNA, 12 nt, Human
ggcagcugccuc

SEQ ID NO: 2944798 - RNA, 13 nt, Human
ggcagcugccucc

SEQ ID NO: 2944799 - RNA, 11 nt, Human
ggcagcugccu

SEQ ID NO: 2944800 - RNA, 17 nt, Human
ggcagaguugaagacag

SEQ ID NO: 2944801 - RNA, 21 nt, Human
ggcagaguugaagacagagcu

SEQ ID NO: 2944802 - RNA, 19 nt, Human
ggcagaguugaagacagag

SEQ ID NO: 2944803 - RNA, 15 nt, Human
ggaugccauccaagu

SEQ ID NO: 2944804 - RNA, 18 nt, Human
ggaugcccaaagaugcag

SEQ ID NO: 2944805 - RNA, 19 nt, Human
ggaugcccaaagaugcagc

SEQ ID NO: 2944806 - RNA, 13 nt, Human
ggaugccuggugg

SEQ ID NO: 2944807 - RNA, 17 nt, Human
ggaugccugguggcagc

SEQ ID NO: 2944808 - RNA, 16 nt, Human
ggaugaucuaggaaga

SEQ ID NO: 2944809 - RNA, 22 nt, Human
ggaugaucuaggaagacuuugg

SEQ ID NO: 2944810 - RNA, 18 nt, Human
ggaugaucuaggaagacu

SEQ ID NO: 2944811 - RNA, 23 nt, Human
ggagucccaccuuggcugcaggg

SEQ ID NO: 2944812 - RNA, 18 nt, Human
ggaugccugguggcagcu

SEQ ID NO: 2944813 - RNA, 19 nt, Human
ggaugccugguggcagcug

SEQ ID NO: 2944814 - RNA, 20 nt, Human
ggaugccugguggcagcugc

SEQ ID NO: 2944815 - RNA, 21 nt, Human
ggaugccugguggcagcugcg

SEQ ID NO: 2944816 - RNA, 17 nt, Human
ggauuagggagagaaga

SEQ ID NO: 2944817 - RNA, 18 nt, Human
ggcacccggccccugcug

SEQ ID NO: 2944818 - RNA, 19 nt, Human
ggcacccggccccugcugg

SEQ ID NO: 2944819 - RNA, 20 nt, Human
ggcacccggccccugcuggu

SEQ ID NO: 2944820 - RNA, 17 nt, Human
ggcacccggccccugcu

SEQ ID NO: 2944821 - RNA, 18 nt, Human
ggcacuauuuauuuacaa

SEQ ID NO: 2944822 - RNA, 19 nt, Human
ggcacuauuuauuuacaaa

SEQ ID NO: 2944823 - RNA, 18 nt, Human
ggcacucagaagacacug

SEQ ID NO: 2944824 - RNA, 19 nt, Human
ggcacucagaagacacuga

SEQ ID NO: 2944825 - RNA, 22 nt, Human
ggcagagcagagaccaucccug

SEQ ID NO: 2944826 - RNA, 21 nt, Human
ggcagagguugcagugagccg

SEQ ID NO: 2944827 - RNA, 18 nt, Human
ggcaagcaccuccugccu

SEQ ID NO: 2944828 - RNA, 19 nt, Human
ggcaagcaccuccugccuc

SEQ ID NO: 2944829 - RNA, 17 nt, Human
ggcaccagcagccugga

SEQ ID NO: 2944830 - RNA, 17 nt, Human
ggcaagcaccuccugcc

SEQ ID NO: 2944831 - RNA, 19 nt, Human
ggauugaaggaugcugucu

SEQ ID NO: 2944832 - RNA, 21 nt, Human
ggauucuuccucccucccucu

SEQ ID NO: 2944833 - RNA, 16 nt, Human
ggauucuuccucccuc

SEQ ID NO: 2944834 - RNA, 16 nt, Human
ggcugggggaagaagc

SEQ ID NO: 2944835 - RNA, 14 nt, Human
ggcugggggccuca

SEQ ID NO: 2944836 - RNA, 11 nt, Human
ggcugggcuuc

SEQ ID NO: 2944837 - RNA, 21 nt, Human
ggcugggcuucaguggcagcu

SEQ ID NO: 2944838 - RNA, 22 nt, Human
ggcugggcuucaguggcagcug

SEQ ID NO: 2944839 - RNA, 18 nt, Human
ggcugggcuucaguggca

SEQ ID NO: 2944840 - RNA, 23 nt, Human
ggcuggaguuauugaagcagagu

SEQ ID NO: 2944841 - RNA, 15 nt, Human
ggcuggaguuauuga

SEQ ID NO: 2944842 - RNA, 18 nt, Human
ggcugggcucccuuccca

SEQ ID NO: 2944843 - RNA, 21 nt, Human
ggcugggcucccuucccaccu

SEQ ID NO: 2944844 - RNA, 20 nt, Human
ggcugggcucccuucccacc

SEQ ID NO: 2944845 - RNA, 20 nt, Human
ggcugaggcaggagacuggc

SEQ ID NO: 2944846 - RNA, 19 nt, Human
ggcugcuucaaggauccug

SEQ ID NO: 2944847 - RNA, 15 nt, Human
ggcugcuucaaggau

SEQ ID NO: 2944848 - RNA, 21 nt, Human
ggcugcuucaaggauccugag

SEQ ID NO: 2944849 - RNA, 20 nt, Human
ggcugcuucaaggauccuga

SEQ ID NO: 2944850 - RNA, 18 nt, Human
ggcuggagcuagaauuug

SEQ ID NO: 2944851 - RNA, 14 nt, Human
ggcuguuggcuggg

SEQ ID NO: 2944852 - RNA, 15 nt, Human
ggcuguuggcugggg

SEQ ID NO: 2944853 - RNA, 16 nt, Human
ggcuguuggcuggggg

SEQ ID NO: 2944854 - RNA, 20 nt, Human
ggcuguuggcugggggccuc

SEQ ID NO: 2944855 - RNA, 20 nt, Human
ggcuuagacccucaugcugc

SEQ ID NO: 2944856 - RNA, 18 nt, Human
ggcuuggggaccagagcu

SEQ ID NO: 2944857 - RNA, 17 nt, Human
ggcuuggggaccagagc

SEQ ID NO: 2944858 - RNA, 21 nt, Human
ggcuucacggaagagccuugc

SEQ ID NO: 2944859 - RNA, 23 nt, Human
ggcuuagacccucaugcugccaa

SEQ ID NO: 2944860 - RNA, 22 nt, Human
ggcuuagacccucaugcugcca

SEQ ID NO: 2944861 - RNA, 14 nt, Human
ggcuuagucacuga

SEQ ID NO: 2944862 - RNA, 15 nt, Human
ggcuuagucacugag

SEQ ID NO: 2944863 - RNA, 20 nt, Human
ggcuucacggaagagccuug

SEQ ID NO: 2944864 - RNA, 13 nt, Human
gggagcugccugu

SEQ ID NO: 2944865 - RNA, 21 nt, Human
gggagcugccuguucagcucc

SEQ ID NO: 2944866 - RNA, 22 nt, Human
gggagcugccuguucagcucca

SEQ ID NO: 2944867 - RNA, 20 nt, Human
gggaggugggauccuccagg

SEQ ID NO: 2944868 - RNA, 23 nt, Human
gggaggauugcuugagcucagga

SEQ ID NO: 2944869 - RNA, 21 nt, Human
gggagugaguugauagcacag

SEQ ID NO: 2944870 - RNA, 17 nt, Human
gggagugacagaggcag

SEQ ID NO: 2944871 - RNA, 22 nt, Human
gggaggauguucugggacacag

SEQ ID NO: 2944872 - RNA, 21 nt, Human
gggaggauugcuugagcucag

SEQ ID NO: 2944873 - RNA, 23 nt, Human
gggaggaucucuugagccuggga

SEQ ID NO: 2944874 - RNA, 17 nt, Human
gggaggacgcucucugg

SEQ ID NO: 2944875 - RNA, 20 nt, Human
gggaggacgcucucuggccu

SEQ ID NO: 2944876 - RNA, 19 nt, Human
gggaauguuugccucugcc

SEQ ID NO: 2944877 - RNA, 21 nt, Human
gggaauguuugccucugccuc

SEQ ID NO: 2944878 - RNA, 14 nt, Human
gggacacccuguga

SEQ ID NO: 2944879 - RNA, 17 nt, Human
gggacucaaugcacuga

SEQ ID NO: 2944880 - RNA, 19 nt, Human
gggacucaaugcacugaca

SEQ ID NO: 2944881 - RNA, 23 nt, Human
gggacucaaugcacugacauugu

SEQ ID NO: 2944882 - RNA, 21 nt, Human
gggacugaggggaggggagca

SEQ ID NO: 2944883 - RNA, 23 nt, Human
ggccugggggcugggcagaggaa

SEQ ID NO: 2944884 - RNA, 16 nt, Human
ggccuggccugagcug

SEQ ID NO: 2944885 - RNA, 15 nt, Human
ggccuggccugagcu

SEQ ID NO: 2944886 - RNA, 24 nt, Human
ggcgcagcauauucaggaagcuca

SEQ ID NO: 2944887 - RNA, 23 nt, Human
ggcgcagcauauucaggaagcuc

SEQ ID NO: 2944888 - RNA, 19 nt, Human
ggccucugcggagcacacu

SEQ ID NO: 2944889 - RNA, 22 nt, Human
ggccucugcacuccccugcugg

SEQ ID NO: 2944890 - RNA, 19 nt, Human
ggccucugcacuccccugc

SEQ ID NO: 2944891 - RNA, 18 nt, Human
ggccucugcacuccccug

SEQ ID NO: 2944892 - RNA, 13 nt, Human
ggccuggccccuc

SEQ ID NO: 2944893 - RNA, 14 nt, Human
ggccuggccugagc

SEQ ID NO: 2944894 - RNA, 13 nt, Human
ggccuggccugag

SEQ ID NO: 2944895 - RNA, 10 nt, Human
ggccuggccu

SEQ ID NO: 2944896 - RNA, 23 nt, Human
ggccuggccccucagggucccug

SEQ ID NO: 2944897 - RNA, 18 nt, Human
ggccuggccccucagggu

SEQ ID NO: 2944898 - RNA, 17 nt, Human
ggccuggccccucaggg

SEQ ID NO: 2944899 - RNA, 15 nt, Human
ggccuggccccucag

SEQ ID NO: 2944900 - RNA, 14 nt, Human
ggccuggccccuca

SEQ ID NO: 2944901 - RNA, 20 nt, Human
ggcccagagggccugcaagg

SEQ ID NO: 2944902 - RNA, 19 nt, Human
ggcccagagggccugcaag

SEQ ID NO: 2944903 - RNA, 17 nt, Human
ggcccagagggccugca

SEQ ID NO: 2944904 - RNA, 14 nt, Human
ggcccagagggccu

SEQ ID NO: 2944905 - RNA, 14 nt, Human
ggccucaagugauu

SEQ ID NO: 2944906 - RNA, 22 nt, Human
ggccucaagugauucuccugcc

SEQ ID NO: 2944907 - RNA, 20 nt, Human
ggccuagcauacguacacau

SEQ ID NO: 2944908 - RNA, 22 nt, Human
ggccuagcauacguacacauuu

SEQ ID NO: 2944909 - RNA, 20 nt, Human
ggccucgguguggagaagcg

SEQ ID NO: 2944910 - RNA, 14 nt, Human
ggccuccugugugu

SEQ ID NO: 2944911 - RNA, 12 nt, Human
ggcucugcccuu

SEQ ID NO: 2944912 - RNA, 15 nt, Human
ggcucugccucccau

SEQ ID NO: 2944913 - RNA, 13 nt, Human
ggcucugccuccc

SEQ ID NO: 2944914 - RNA, 15 nt, Human
ggcucugcccuuggu

SEQ ID NO: 2944915 - RNA, 14 nt, Human
ggcucugcccuugg

SEQ ID NO: 2944916 - RNA, 16 nt, Human
ggcucugccucccauc

SEQ ID NO: 2944917 - RNA, 14 nt, Human
ggcuccaggcuccu

SEQ ID NO: 2944918 - RNA, 16 nt, Human
ggcucucaggccagcu

SEQ ID NO: 2944919 - RNA, 15 nt, Human
ggcucucaggccagc

SEQ ID NO: 2944920 - RNA, 20 nt, Human
ggcucucaggccagcugcuu

SEQ ID NO: 2944921 - RNA, 19 nt, Human
ggcucucaggccagcugcu

SEQ ID NO: 2944922 - RNA, 18 nt, Human
ggcucucaggccagcugc

SEQ ID NO: 2944923 - RNA, 17 nt, Human
ggcucucaggccagcug

SEQ ID NO: 2944924 - RNA, 14 nt, Human
ggcucucaggccag

SEQ ID NO: 2944925 - RNA, 15 nt, Human
ggcgcgguggcucac

SEQ ID NO: 2944926 - RNA, 17 nt, Human
ggcgcugccccuggcag

SEQ ID NO: 2944927 - RNA, 20 nt, Human
ggccucugcggagcacacug

SEQ ID NO: 2944928 - RNA, 11 nt, Human
ggcgcugcccc

SEQ ID NO: 2944929 - RNA, 20 nt, Human
ggcggguggaucacgagguc

SEQ ID NO: 2944930 - RNA, 23 nt, Human
ggcuauaggugcuacaaaaacac

SEQ ID NO: 2944931 - RNA, 20 nt, Human
ggcuaguaucaaaagaaaga

SEQ ID NO: 2944932 - RNA, 12 nt, Human
ggcuccaggcuc

SEQ ID NO: 2944933 - RNA, 13 nt, Human
ggcuccaggcucc

SEQ ID NO: 2944934 - RNA, 17 nt, Human
ggcuccaggagcagcca

SEQ ID NO: 2944935 - RNA, 16 nt, Human
ggcuccaggagcagcc

SEQ ID NO: 2944936 - RNA, 14 nt, Human
ggcuccaggagcag

SEQ ID NO: 2944937 - RNA, 10 nt, Human
ggcuccagac

SEQ ID NO: 2944938 - RNA, 13 nt, Human
ggcucacccaguc

SEQ ID NO: 2944939 - RNA, 12 nt, Human
ggcuaugcauuu

SEQ ID NO: 2944940 - RNA, 13 nt, Human
ggcuaugcauuug

SEQ ID NO: 2944941 - RNA, 16 nt, Human
ggcucacccaguccug

SEQ ID NO: 2944942 - RNA, 16 nt, Human
ggcuccacuuggucug

SEQ ID NO: 2944943 - RNA, 9 nt, Human
ggcuccaga

SEQ ID NO: 2944944 - RNA, 10 nt, Human
ucagaaaugu

SEQ ID NO: 2944945 - RNA, 20 nt, Human
ucacuuguuuuauuuaaccu

SEQ ID NO: 2944946 - RNA, 23 nt, Human
ucagaauucucuaguuugauuaa

SEQ ID NO: 2944947 - RNA, 15 nt, Human
ucagaaauguguuau

SEQ ID NO: 2944948 - RNA, 13 nt, Human
ucagacacagauu

SEQ ID NO: 2944949 - RNA, 16 nt, Human
ucagaauucucuaguu

SEQ ID NO: 2944950 - RNA, 13 nt, Human
ucagacagcugcc

SEQ ID NO: 2944951 - RNA, 14 nt, Human
ucagacagcugccu

SEQ ID NO: 2944952 - RNA, 22 nt, Human
ucagagcugcccucuccugggc

SEQ ID NO: 2944953 - RNA, 18 nt, Human
ucagagcugcccucuccu

SEQ ID NO: 2944954 - RNA, 19 nt, Human
ucagagcugcccucuccug

SEQ ID NO: 2944955 - RNA, 20 nt, Human
ucagagcugcccucuccugg

SEQ ID NO: 2944956 - RNA, 21 nt, Human
ucagagcugcccucuccuggg

SEQ ID NO: 2944957 - RNA, 13 nt, Human
ucaccagccccag

SEQ ID NO: 2944958 - RNA, 22 nt, Human
ucaccccggccaccugcggugc

SEQ ID NO: 2944959 - RNA, 17 nt, Human
ucacucuuauugcccac

SEQ ID NO: 2944960 - RNA, 22 nt, Human
ucacucugucgcccagucugga

SEQ ID NO: 2944961 - RNA, 18 nt, Human
ucacugccaugccagcuu

SEQ ID NO: 2944962 - RNA, 20 nt, Human
ucacucuuauugcccacgcu

SEQ ID NO: 2944963 - RNA, 14 nt, Human
ucacugcuuaacuu

SEQ ID NO: 2944964 - RNA, 17 nt, Human
ucacugguacucugcca

SEQ ID NO: 2944965 - RNA, 16 nt, Human
ucagggccuggcucag

SEQ ID NO: 2944966 - RNA, 14 nt, Human
ucagggccuggcuc

SEQ ID NO: 2944967 - RNA, 16 nt, Human
ucaggugagaagcaga

SEQ ID NO: 2944968 - RNA, 15 nt, Human
ucaggugagaagcag

SEQ ID NO: 2944969 - RNA, 13 nt, Human
ucaggcuagaugu

SEQ ID NO: 2944970 - RNA, 17 nt, Human
ucaggcuagauguaugu

SEQ ID NO: 2944971 - RNA, 15 nt, Human
ucagauaugauucaa

SEQ ID NO: 2944972 - RNA, 20 nt, Human
ucagccucccgaguagcugg

SEQ ID NO: 2944973 - RNA, 18 nt, Human
ucagccucccgaguagcu

SEQ ID NO: 2944974 - RNA, 21 nt, Human
ucagccucccgaauagcuggg

SEQ ID NO: 2944975 - RNA, 22 nt, Human
ucagccucccgaauagcuggga

SEQ ID NO: 2944976 - RNA, 14 nt, Human
ucagccucccaaag

SEQ ID NO: 2944977 - RNA, 19 nt, Human
ucagccucccaaagugcug

SEQ ID NO: 2944978 - RNA, 21 nt, Human
ucagccucccaaagugcuggg

SEQ ID NO: 2944979 - RNA, 19 nt, Human
ucagccugcuccagcuguu

SEQ ID NO: 2944980 - RNA, 18 nt, Human
ucagccugcuccagcugu

SEQ ID NO: 2944981 - RNA, 21 nt, Human
ucagccucccgaguagcuggg

SEQ ID NO: 2944982 - RNA, 22 nt, Human
ucagccucccgaguagcuggga

SEQ ID NO: 2944983 - RNA, 18 nt, Human
ucagcuccccucggagaa

SEQ ID NO: 2944984 - RNA, 16 nt, Human
ucagcugaaccugggu

SEQ ID NO: 2944985 - RNA, 15 nt, Human
ucagcugaaccuggg

SEQ ID NO: 2944986 - RNA, 17 nt, Human
ucagcuccccucggaga

SEQ ID NO: 2944987 - RNA, 20 nt, Human
ucaugcugccaauauccuaa

SEQ ID NO: 2944988 - RNA, 19 nt, Human
ucaugcugccaauauccua

SEQ ID NO: 2944989 - RNA, 17 nt, Human
ucaugcugccaauaucc

SEQ ID NO: 2944990 - RNA, 13 nt, Human
ucaugcugccaau

SEQ ID NO: 2944991 - RNA, 23 nt, Human
ucaucuuagguuggcaaaaaggc

SEQ ID NO: 2944992 - RNA, 21 nt, Human
ucaucaccaacgucugugcca

SEQ ID NO: 2944993 - RNA, 20 nt, Human
ucaucaccaacgucugugcc

SEQ ID NO: 2944994 - RNA, 19 nt, Human
ucaucaccaacgucugugc

SEQ ID NO: 2944995 - RNA, 13 nt, Human
ucaggugcugcca

SEQ ID NO: 2944996 - RNA, 14 nt, Human
ucaggugcugccau

SEQ ID NO: 2944997 - RNA, 23 nt, Human
ucaggugccucaagagaaggcaa

SEQ ID NO: 2944998 - RNA, 21 nt, Human
ucaggugagaagcagaggaag

SEQ ID NO: 2944999 - RNA, 15 nt, Human
ucaggugcugccauc

SEQ ID NO: 2945000 - RNA, 21 nt, Human
ucauacccacccccacccaag

SEQ ID NO: 2945001 - RNA, 18 nt, Human
ucauaccuaucaucuuaa

SEQ ID NO: 2945002 - RNA, 21 nt, Human
ucauucaacccaccugcgucu

SEQ ID NO: 2945003 - RNA, 17 nt, Human
ucauuauguuaauauuu

SEQ ID NO: 2945004 - RNA, 16 nt, Human
ucauuauguuaauauu

SEQ ID NO: 2945005 - RNA, 20 nt, Human
ucauuaucucaaaacugcac

SEQ ID NO: 2945006 - RNA, 19 nt, Human
ucauuaucucaaaacugca

SEQ ID NO: 2945007 - RNA, 23 nt, Human
ucaugcugccaauauccuaauaa

SEQ ID NO: 2945008 - RNA, 21 nt, Human
ucaugcugccaauauccuaau

SEQ ID NO: 2945009 - RNA, 13 nt, Human
ucauuaucucaaa

SEQ ID NO: 2945010 - RNA, 23 nt, Human
ucauuaguuuugaagauucuaug

SEQ ID NO: 2945011 - RNA, 14 nt, Human
ucauuaguuuugaa

SEQ ID NO: 2945012 - RNA, 13 nt, Human
ucauuuccugugu

SEQ ID NO: 2945013 - RNA, 16 nt, Human
ucauuuccugugucuu

SEQ ID NO: 2945014 - RNA, 16 nt, Human
ucauuuccaagcaagu

SEQ ID NO: 2945015 - RNA, 13 nt, Human
ucauuuccaagca

SEQ ID NO: 2945016 - RNA, 22 nt, Human
uccaggggugggacacccugug

SEQ ID NO: 2945017 - RNA, 22 nt, Human
uccaggagcagccacauuccug

SEQ ID NO: 2945018 - RNA, 18 nt, Human
uccaggagcagccacauu

SEQ ID NO: 2945019 - RNA, 17 nt, Human
uccaggagcagccacau

SEQ ID NO: 2945020 - RNA, 15 nt, Human
uccaggugcacaagc

SEQ ID NO: 2945021 - RNA, 23 nt, Human
uccaggggugggacacccuguga

SEQ ID NO: 2945022 - RNA, 15 nt, Human
uccagguucagcuug

SEQ ID NO: 2945023 - RNA, 16 nt, Human
uccagguucagcuugu

SEQ ID NO: 2945024 - RNA, 22 nt, Human
uccaggugcacaagcuccaagc

SEQ ID NO: 2945025 - RNA, 21 nt, Human
uccaggugcacaagcuccaag

SEQ ID NO: 2945026 - RNA, 20 nt, Human
uccaggugcacaagcuccaa

SEQ ID NO: 2945027 - RNA, 18 nt, Human
uccaggugcacaagcucc

SEQ ID NO: 2945028 - RNA, 16 nt, Human
uccaggagcagccaca

SEQ ID NO: 2945029 - RNA, 17 nt, Human
uccagcuguucagcugg

SEQ ID NO: 2945030 - RNA, 15 nt, Human
uccagcucaccagcc

SEQ ID NO: 2945031 - RNA, 18 nt, Human
uccagcucaccagcccca

SEQ ID NO: 2945032 - RNA, 16 nt, Human
uccagcucaccagccc

SEQ ID NO: 2945033 - RNA, 17 nt, Human
uccagcucaccagcccc

SEQ ID NO: 2945034 - RNA, 23 nt, Human
uccagccaaagccuccuccagcc

SEQ ID NO: 2945035 - RNA, 14 nt, Human
uccacuuggucugu

SEQ ID NO: 2945036 - RNA, 15 nt, Human
uccacuuggucugug

SEQ ID NO: 2945037 - RNA, 16 nt, Human
uccacuuggucuguga

SEQ ID NO: 2945038 - RNA, 17 nt, Human
uccacaaguuaaauaaa

SEQ ID NO: 2945039 - RNA, 18 nt, Human
uccacaaguuaaauaaau

SEQ ID NO: 2945040 - RNA, 15 nt, Human
uccacaagagcccag

SEQ ID NO: 2945041 - RNA, 18 nt, Human
uccacaagagcccaggcc

SEQ ID NO: 2945042 - RNA, 17 nt, Human
uccacaagagcccaggc

SEQ ID NO: 2945043 - RNA, 16 nt, Human
uccacaagagcccagg

SEQ ID NO: 2945044 - RNA, 17 nt, Human
uccaauuuacauacucu

SEQ ID NO: 2945045 - RNA, 18 nt, Human
uccaauuuacauacucug

SEQ ID NO: 2945046 - RNA, 20 nt, Human
uccaaaauaaaacuuuuuaa

SEQ ID NO: 2945047 - RNA, 18 nt, Human
uccaaaauaaaacuuuuu

SEQ ID NO: 2945048 - RNA, 21 nt, Human
uccaccugccagggacagagg

SEQ ID NO: 2945049 - RNA, 18 nt, Human
uccaccugccagggacag

SEQ ID NO: 2945050 - RNA, 15 nt, Human
uccaccucccugcaa

SEQ ID NO: 2945051 - RNA, 16 nt, Human
uccaccucccugcaau

SEQ ID NO: 2945052 - RNA, 17 nt, Human
uccaccucccugcaaua

SEQ ID NO: 2945053 - RNA, 15 nt, Human
uccaccugccaggga

SEQ ID NO: 2945054 - RNA, 17 nt, Human
uccaccugccagggaca

SEQ ID NO: 2945055 - RNA, 12 nt, Human
uccacccugcuc

SEQ ID NO: 2945056 - RNA, 12 nt, Human
uccaccucccug

SEQ ID NO: 2945057 - RNA, 13 nt, Human
uccaccucccugc

SEQ ID NO: 2945058 - RNA, 14 nt, Human
uccaccucccugca

SEQ ID NO: 2945059 - RNA, 19 nt, Human
uccacagaagcuccaggua

SEQ ID NO: 2945060 - RNA, 13 nt, Human
uauguacuucaug

SEQ ID NO: 2945061 - RNA, 17 nt, Human
uauguacuucaugcugu

SEQ ID NO: 2945062 - RNA, 20 nt, Human
uauguagauguaugcacaca

SEQ ID NO: 2945063 - RNA, 15 nt, Human
gggaguggccacaga

SEQ ID NO: 2945064 - RNA, 13 nt, Human
gggaguggccaca

SEQ ID NO: 2945065 - RNA, 20 nt, Human
uauguugcccaggcaggucu

SEQ ID NO: 2945066 - RNA, 13 nt, Human
uauguugcccagg

SEQ ID NO: 2945067 - RNA, 16 nt, Human
uauguugcccaggcag

SEQ ID NO: 2945068 - RNA, 19 nt, Human
uauguugcccaggcagguc

SEQ ID NO: 2945069 - RNA, 20 nt, Human
uauuaagagguaagacuuag

SEQ ID NO: 2945070 - RNA, 24 nt, Human
uauuaagaaagacuaucuaaaugu

SEQ ID NO: 2945071 - RNA, 13 nt, Human
uauuaacaaaaca

SEQ ID NO: 2945072 - RNA, 12 nt, Human
uauuaaauuaug

SEQ ID NO: 2945073 - RNA, 12 nt, Human
uauuguuuucag

SEQ ID NO: 2945074 - RNA, 22 nt, Human
uauuguuuucaguguacaugga

SEQ ID NO: 2945075 - RNA, 18 nt, Human
uauuguuuucaguguaca

SEQ ID NO: 2945076 - RNA, 20 nt, Human
uauuguuuucaguguacaug

SEQ ID NO: 2945077 - RNA, 23 nt, Human
uauugauucaccuccuaaaacaa

SEQ ID NO: 2945078 - RNA, 14 nt, Human
uauugauguuuuca

SEQ ID NO: 2945079 - RNA, 13 nt, Human
uauugauguuuuc

SEQ ID NO: 2945080 - RNA, 17 nt, Human
uauucucuccuguaccu

SEQ ID NO: 2945081 - RNA, 17 nt, Human
uauucucagcagagugc

SEQ ID NO: 2945082 - RNA, 21 nt, Human
uauucucagcagagugcuuua

SEQ ID NO: 2945083 - RNA, 21 nt, Human
uauugauaugcuuauacacuu

SEQ ID NO: 2945084 - RNA, 17 nt, Human
uauugcugauggugcaa

SEQ ID NO: 2945085 - RNA, 22 nt, Human
uauuggaaauuuguuauaauga

SEQ ID NO: 2945086 - RNA, 15 nt, Human
uauucucagcagagu

SEQ ID NO: 2945087 - RNA, 16 nt, Human
uauuauucccauucua

SEQ ID NO: 2945088 - RNA, 14 nt, Human
uauuuuauuaugca

SEQ ID NO: 2945089 - RNA, 17 nt, Human
uauuuuauuaugcauga

SEQ ID NO: 2945090 - RNA, 17 nt, Human
uauuuuuuucuuuucuu

SEQ ID NO: 2945091 - RNA, 14 nt, Human
uauuuuuuuacuaa

SEQ ID NO: 2945092 - RNA, 15 nt, Human
ucaaaaaaagaaaaa

SEQ ID NO: 2945093 - RNA, 14 nt, Human
ucaaaaaaagaaaa

SEQ ID NO: 2945094 - RNA, 17 nt, Human
uauuuucuccaaauguu

SEQ ID NO: 2945095 - RNA, 22 nt, Human
uauuuucccuauuagagaagag

SEQ ID NO: 2945096 - RNA, 22 nt, Human
ucaaaucagguuuucuuuuaag

SEQ ID NO: 2945097 - RNA, 16 nt, Human
ucaaaucagguuuucu

SEQ ID NO: 2945098 - RNA, 20 nt, Human
ucaaaucaagaaacuuaagg

SEQ ID NO: 2945099 - RNA, 14 nt, Human
ucaaauaugcaaag

SEQ ID NO: 2945100 - RNA, 23 nt, Human
ucaaccccuucgcuccugugucu

SEQ ID NO: 2945101 - RNA, 14 nt, Human
ucaaauugugugaa

SEQ ID NO: 2945102 - RNA, 14 nt, Human
ucaauaaaauccau

SEQ ID NO: 2945103 - RNA, 21 nt, Human
ucaauaaaauccauacauuug

SEQ ID NO: 2945104 - RNA, 21 nt, Human
ucaagugauucuccugccuca

SEQ ID NO: 2945105 - RNA, 18 nt, Human
ucaagugauucuccugcc

SEQ ID NO: 2945106 - RNA, 20 nt, Human
ucaagugauucuccugccuc

SEQ ID NO: 2945107 - RNA, 23 nt, Human
ucaauuacaggaaguacuggaga

SEQ ID NO: 2945108 - RNA, 21 nt, Human
ucaauuacaggaaguacugga

SEQ ID NO: 2945109 - RNA, 17 nt, Human
ucaaugccccugaauuu

SEQ ID NO: 2945110 - RNA, 18 nt, Human
ucaaugccccugaauuua

SEQ ID NO: 2945111 - RNA, 20 nt, Human
ucaaugccccugaauuuaaa

SEQ ID NO: 2945112 - RNA, 13 nt, Human
ucaaugcagcccc

SEQ ID NO: 2945113 - RNA, 18 nt, Human
ucacauuuauucugcuca

SEQ ID NO: 2945114 - RNA, 19 nt, Human
ucacauuuauucugcucac

SEQ ID NO: 2945115 - RNA, 17 nt, Human
ucacauuuauucugcuc

SEQ ID NO: 2945116 - RNA, 14 nt, Human
ucaccaaggcugau

SEQ ID NO: 2945117 - RNA, 19 nt, Human
ucaccaaaucagcugcuac

SEQ ID NO: 2945118 - RNA, 20 nt, Human
ucaccaaaucagcugcuacu

SEQ ID NO: 2945119 - RNA, 16 nt, Human
ucacaggcagguccag

SEQ ID NO: 2945120 - RNA, 17 nt, Human
ucacaggcagguccagg

SEQ ID NO: 2945121 - RNA, 18 nt, Human
ucacaggcagguccaggg

SEQ ID NO: 2945122 - RNA, 16 nt, Human
ucacagucacauucca

SEQ ID NO: 2945123 - RNA, 19 nt, Human
ucacaguccuuaccagcag

SEQ ID NO: 2945124 - RNA, 23 nt, Human
ucacaguccuuaccagcagagca

SEQ ID NO: 2945125 - RNA, 22 nt, Human
ucacaguccuuaccagcagagc

SEQ ID NO: 2945126 - RNA, 17 nt, Human
ucacaagacccaaaagg

SEQ ID NO: 2945127 - RNA, 13 nt, Human
ucacaagacccaa

SEQ ID NO: 2945128 - RNA, 20 nt, Human
ucaauuacaggaaguacugg

SEQ ID NO: 2945129 - RNA, 17 nt, Human
ucaauuaccagaaagau

SEQ ID NO: 2945130 - RNA, 21 nt, Human
ucaauuaccagaaagauaaca

SEQ ID NO: 2945131 - RNA, 19 nt, Human
uccuucacagaugggugcu

SEQ ID NO: 2945132 - RNA, 20 nt, Human
uccuucaccuuuguccccac

SEQ ID NO: 2945133 - RNA, 18 nt, Human
uccuucaccuuugucccc

SEQ ID NO: 2945134 - RNA, 18 nt, Human
uccuucacagaugggugc

SEQ ID NO: 2945135 - RNA, 18 nt, Human
uccuuaccagcagagcac

SEQ ID NO: 2945136 - RNA, 17 nt, Human
uccuuaccagcagagca

SEQ ID NO: 2945137 - RNA, 16 nt, Human
uccuuaccagcagagc

SEQ ID NO: 2945138 - RNA, 22 nt, Human
uccuucaccuuuguccccaccg

SEQ ID NO: 2945139 - RNA, 21 nt, Human
uccuucaccuuuguccccacc

SEQ ID NO: 2945140 - RNA, 23 nt, Human
uccuuuucacaguucucuccuuc

SEQ ID NO: 2945141 - RNA, 16 nt, Human
uccuuggacucauuuu

SEQ ID NO: 2945142 - RNA, 20 nt, Human
uccuguaccucuugagccuu

SEQ ID NO: 2945143 - RNA, 19 nt, Human
uccugucggagcccugucu

SEQ ID NO: 2945144 - RNA, 22 nt, Human
uccugucggagcccugucuccu

SEQ ID NO: 2945145 - RNA, 14 nt, Human
uccuuaccagcaga

SEQ ID NO: 2945146 - RNA, 20 nt, Human
uccuggcacccggccccugc

SEQ ID NO: 2945147 - RNA, 21 nt, Human
uccuggcacccggccccugcu

SEQ ID NO: 2945148 - RNA, 17 nt, Human
uccuggcacugcuucca

SEQ ID NO: 2945149 - RNA, 22 nt, Human
uccuggcacugcuuccagugag

SEQ ID NO: 2945150 - RNA, 18 nt, Human
uccuggcacugcuuccag

SEQ ID NO: 2945151 - RNA, 17 nt, Human
uccugccucagccuccc

SEQ ID NO: 2945152 - RNA, 16 nt, Human
uccugccucagccucc

SEQ ID NO: 2945153 - RNA, 13 nt, Human
uccugccucagcc

SEQ ID NO: 2945154 - RNA, 15 nt, Human
uccugccucagccuc

SEQ ID NO: 2945155 - RNA, 16 nt, Human
uccuggcacccggccc

SEQ ID NO: 2945156 - RNA, 19 nt, Human
uccuggcacccggccccug

SEQ ID NO: 2945157 - RNA, 14 nt, Human
uccuggcacccggc

SEQ ID NO: 2945158 - RNA, 17 nt, Human
uccuggcaauagucaaa

SEQ ID NO: 2945159 - RNA, 19 nt, Human
uccugagagcugcaugugu

SEQ ID NO: 2945160 - RNA, 18 nt, Human
uccugagagcugcaugug

SEQ ID NO: 2945161 - RNA, 13 nt, Human
uccugagagcugc

SEQ ID NO: 2945162 - RNA, 13 nt, Human
uccugagccagau

SEQ ID NO: 2945163 - RNA, 14 nt, Human
uccugccucagccu

SEQ ID NO: 2945164 - RNA, 20 nt, Human
uccugccuaagugcagcccc

SEQ ID NO: 2945165 - RNA, 14 nt, Human
uccugagccagauu

SEQ ID NO: 2945166 - RNA, 16 nt, Human
ucgugauugauaagaa

SEQ ID NO: 2945167 - RNA, 18 nt, Human
ucggccuccauccugagg

SEQ ID NO: 2945168 - RNA, 17 nt, Human
ucggccuccauccugag

SEQ ID NO: 2945169 - RNA, 21 nt, Human
ucguggaacaguuaccucugc

SEQ ID NO: 2945170 - RNA, 22 nt, Human
ucgugggacagucaccucaugg

SEQ ID NO: 2945171 - RNA, 22 nt, Human
ucuaaauaucccuuggacauuu

SEQ ID NO: 2945172 - RNA, 21 nt, Human
ucuaaaucuccaaaauaaaac

SEQ ID NO: 2945173 - RNA, 13 nt, Human
ucguuaauuugua

SEQ ID NO: 2945174 - RNA, 14 nt, Human
ucuaauauguaaca

SEQ ID NO: 2945175 - RNA, 16 nt, Human
ucuaggacugaauuau

SEQ ID NO: 2945176 - RNA, 23 nt, Human
ucuaggacugaauuaugaaacuu

SEQ ID NO: 2945177 - RNA, 21 nt, Human
ucuaggaagacuuuggaaaga

SEQ ID NO: 2945178 - RNA, 11 nt, Human
ucuagugaaug

SEQ ID NO: 2945179 - RNA, 22 nt, Human
ucuagugagcagucaggaaaga

SEQ ID NO: 2945180 - RNA, 19 nt, Human
ucuagugagcagucaggaa

SEQ ID NO: 2945181 - RNA, 15 nt, Human
ucucaacuccaaacu

SEQ ID NO: 2945182 - RNA, 17 nt, Human
ucucaaauaacuaaaag

SEQ ID NO: 2945183 - RNA, 17 nt, Human
ucuaugaaauauuaugu

SEQ ID NO: 2945184 - RNA, 13 nt, Human
ucuaugaaauauu

SEQ ID NO: 2945185 - RNA, 14 nt, Human
ucuaugaaauauua

SEQ ID NO: 2945186 - RNA, 15 nt, Human
ucuaucaaguauuau

SEQ ID NO: 2945187 - RNA, 21 nt, Human
ucuaucaaguauuauaccuuu

SEQ ID NO: 2945188 - RNA, 22 nt, Human
ucuaucaaguauuauaccuuuu

SEQ ID NO: 2945189 - RNA, 16 nt, Human
ucccuauuagagaaga

SEQ ID NO: 2945190 - RNA, 17 nt, Human
uccagguuuaagcuguu

SEQ ID NO: 2945191 - RNA, 20 nt, Human
uccccuguuuguuucugaaa

SEQ ID NO: 2945192 - RNA, 18 nt, Human
uccccuguuuguuucuga

SEQ ID NO: 2945193 - RNA, 21 nt, Human
uccccuguuuguuucugaaag

SEQ ID NO: 2945194 - RNA, 18 nt, Human
ucccugcugcuccuagga

SEQ ID NO: 2945195 - RNA, 14 nt, Human
ucccugcacuugca

SEQ ID NO: 2945196 - RNA, 13 nt, Human
ucccugcacuugc

SEQ ID NO: 2945197 - RNA, 16 nt, Human
ucccugcaauaaaaug

SEQ ID NO: 2945198 - RNA, 13 nt, Human
ucccuucccaccu

SEQ ID NO: 2945199 - RNA, 16 nt, Human
ucccuugaugaagaag

SEQ ID NO: 2945200 - RNA, 15 nt, Human
ucccuugaugaagaa

SEQ ID NO: 2945201 - RNA, 12 nt, Human
uccuauuauauu

SEQ ID NO: 2945202 - RNA, 17 nt, Human
uccucauuagcauuuug

SEQ ID NO: 2945203 - RNA, 22 nt, Human
uccuaguuccaccaucaagcca

SEQ ID NO: 2945204 - RNA, 18 nt, Human
uccuauauuguuuucagu

SEQ ID NO: 2945205 - RNA, 18 nt, Human
uccuacccacccuccuuu

SEQ ID NO: 2945206 - RNA, 13 nt, Human
uccgaccagacac

SEQ ID NO: 2945207 - RNA, 17 nt, Human
uccgaccagacaccuug

SEQ ID NO: 2945208 - RNA, 21 nt, Human
uccuaaguaucaaguauagaa

SEQ ID NO: 2945209 - RNA, 15 nt, Human
uccuaauaaaaaggu

SEQ ID NO: 2945210 - RNA, 14 nt, Human
uccuaauaaaaagg

SEQ ID NO: 2945211 - RNA, 13 nt, Human
uccuaauaaaaag

SEQ ID NO: 2945212 - RNA, 12 nt, Human
uccuaauaaaaa

SEQ ID NO: 2945213 - RNA, 17 nt, Human
uccuaauaaaaagguga

SEQ ID NO: 2945214 - RNA, 16 nt, Human
uccuaauaaaaaggug

SEQ ID NO: 2945215 - RNA, 18 nt, Human
uccuaauaaaaaggugac

SEQ ID NO: 2945216 - RNA, 16 nt, Human
uccuaaucuucugaac

SEQ ID NO: 2945217 - RNA, 19 nt, Human
uccuccuuuucacaguucu

SEQ ID NO: 2945218 - RNA, 14 nt, Human
uccucuaggagguc

SEQ ID NO: 2945219 - RNA, 15 nt, Human
uccucuguacagagc

SEQ ID NO: 2945220 - RNA, 18 nt, Human
uccucuguacagagccca

SEQ ID NO: 2945221 - RNA, 17 nt, Human
uccucuguacagagccc

SEQ ID NO: 2945222 - RNA, 16 nt, Human
uccucuguacagagcc

SEQ ID NO: 2945223 - RNA, 21 nt, Human
uccucugcuugccaucccucc

SEQ ID NO: 2945224 - RNA, 22 nt, Human
uccucugcuugccaucccuccc

SEQ ID NO: 2945225 - RNA, 20 nt, Human
uccucugcuugccaucccuc

SEQ ID NO: 2945226 - RNA, 19 nt, Human
uccucugcuugccaucccu

SEQ ID NO: 2945227 - RNA, 16 nt, Human
uccucugcugcuggcu

SEQ ID NO: 2945228 - RNA, 15 nt, Human
uccucugcugcuggc

SEQ ID NO: 2945229 - RNA, 14 nt, Human
uccucugcugcugg

SEQ ID NO: 2945230 - RNA, 12 nt, Human
uccucugcugcu

SEQ ID NO: 2945231 - RNA, 23 nt, Human
ucucuggccuucggccuccaucc

SEQ ID NO: 2945232 - RNA, 20 nt, Human
ucucugauucccugauuuaa

SEQ ID NO: 2945233 - RNA, 18 nt, Human
ucucuguaauaaacucau

SEQ ID NO: 2945234 - RNA, 22 nt, Human
ucucuguaauaaacucauuucu

SEQ ID NO: 2945235 - RNA, 15 nt, Human
ucucuaguuugauua

SEQ ID NO: 2945236 - RNA, 14 nt, Human
ucucugaggacacu

SEQ ID NO: 2945237 - RNA, 17 nt, Human
ucucugaggacacuaac

SEQ ID NO: 2945238 - RNA, 15 nt, Human
ucucugauacagaaa

SEQ ID NO: 2945239 - RNA, 19 nt, Human
ucucuaacuucaccauauu

SEQ ID NO: 2945240 - RNA, 19 nt, Human
ucucuaggaaauauuuauu

SEQ ID NO: 2945241 - RNA, 12 nt, Human
ucucuaacuuca

SEQ ID NO: 2945242 - RNA, 22 nt, Human
ucucgugauugauaagaaccuu

SEQ ID NO: 2945243 - RNA, 14 nt, Human
ucucgugauugaua

SEQ ID NO: 2945244 - RNA, 16 nt, Human
ucuccuguaccucuug

SEQ ID NO: 2945245 - RNA, 17 nt, Human
ucuccuguaccucuuga

SEQ ID NO: 2945246 - RNA, 17 nt, Human
ucuccugccucagccuc

SEQ ID NO: 2945247 - RNA, 15 nt, Human
ucuccugccucagcc

SEQ ID NO: 2945248 - RNA, 15 nt, Human
ucuccuguaccucuu

SEQ ID NO: 2945249 - RNA, 21 nt, Human
ucuccuggaaauauuaagaaa

SEQ ID NO: 2945250 - RNA, 14 nt, Human
ucugcaacucugaa

SEQ ID NO: 2945251 - RNA, 15 nt, Human
ucugcaacucugaag

SEQ ID NO: 2945252 - RNA, 21 nt, Human
ucugcaagaauugaagcagga

SEQ ID NO: 2945253 - RNA, 20 nt, Human
ucugcaagaauugaagcagg

SEQ ID NO: 2945254 - RNA, 14 nt, Human
ucugacccacugcu

SEQ ID NO: 2945255 - RNA, 15 nt, Human
ucugacccacugcuu

SEQ ID NO: 2945256 - RNA, 23 nt, Human
ucugaggaauccagacccggcug

SEQ ID NO: 2945257 - RNA, 14 nt, Human
ucugcaucagcugc

SEQ ID NO: 2945258 - RNA, 21 nt, Human
ucugcaucagcugcugaaaca

SEQ ID NO: 2945259 - RNA, 19 nt, Human
ucugcaucagcugcugaaa

SEQ ID NO: 2945260 - RNA, 21 nt, Human
ucucuuaucuuacgaaaaaau

SEQ ID NO: 2945261 - RNA, 16 nt, Human
ucucuuaucuuacgaa

SEQ ID NO: 2945262 - RNA, 13 nt, Human
ucugaaaauguau

SEQ ID NO: 2945263 - RNA, 17 nt, Human
ucugaaauuuccuggga

SEQ ID NO: 2945264 - RNA, 18 nt, Human
ucugaaauuuccugggag

SEQ ID NO: 2945265 - RNA, 20 nt, Human
ucugaaauuuccugggagcu

SEQ ID NO: 2945266 - RNA, 16 nt, Human
ucugacacacagcucu

SEQ ID NO: 2945267 - RNA, 17 nt, Human
ucugacacacagcucug

SEQ ID NO: 2945268 - RNA, 18 nt, Human
ucugacacacagcucugu

SEQ ID NO: 2945269 - RNA, 19 nt, Human
ucugacacacagcucuguc

SEQ ID NO: 2945270 - RNA, 12 nt, Human
ucugacaggcaa

SEQ ID NO: 2945271 - RNA, 21 nt, Human
ucugacaggcaaugcuggcug

SEQ ID NO: 2945272 - RNA, 22 nt, Human
ucugacaggcaaugcuggcugu

SEQ ID NO: 2945273 - RNA, 13 nt, Human
ucugacccacugc

SEQ ID NO: 2945274 - RNA, 18 nt, Human
ucuuaagaagacugcauu

SEQ ID NO: 2945275 - RNA, 12 nt, Human
ucuuaagaagac

SEQ ID NO: 2945276 - RNA, 22 nt, Human
ucuuaaauauguggaguucauc

SEQ ID NO: 2945277 - RNA, 22 nt, Human
ucuuaaaaacaacgaaagaagg

SEQ ID NO: 2945278 - RNA, 13 nt, Human
ucuguuuugugua

SEQ ID NO: 2945279 - RNA, 19 nt, Human
ucuguuuuguguacuuuua

SEQ ID NO: 2945280 - RNA, 13 nt, Human
ucuuaaaaacaac

SEQ ID NO: 2945281 - RNA, 15 nt, Human
ucugucuucacaaca

SEQ ID NO: 2945282 - RNA, 12 nt, Human
ucuugaacuccu

SEQ ID NO: 2945283 - RNA, 22 nt, Human
ucuucauggaauucacaaagua

SEQ ID NO: 2945284 - RNA, 18 nt, Human
ucuucauggaauucacaa

SEQ ID NO: 2945285 - RNA, 15 nt, Human
ucuucagaucucuaa

SEQ ID NO: 2945286 - RNA, 18 nt, Human
ucuucagaucucuaacuu

SEQ ID NO: 2945287 - RNA, 23 nt, Human
ucuucagaucucuaacuucacca

SEQ ID NO: 2945288 - RNA, 21 nt, Human
ucuggacaggcauguucucug

SEQ ID NO: 2945289 - RNA, 14 nt, Human
ucuggacaggcaug

SEQ ID NO: 2945290 - RNA, 15 nt, Human
ucuggaaugcagugg

SEQ ID NO: 2945291 - RNA, 19 nt, Human
ucuggaauaaggagaauga

SEQ ID NO: 2945292 - RNA, 19 nt, Human
ucugcugacagacacaggc

SEQ ID NO: 2945293 - RNA, 20 nt, Human
ucugcugacagacacaggcc

SEQ ID NO: 2945294 - RNA, 21 nt, Human
ucugcugacagacacaggccc

SEQ ID NO: 2945295 - RNA, 22 nt, Human
ucugcugacagacacaggcccg

SEQ ID NO: 2945296 - RNA, 15 nt, Human
ucugccugcccaggc

SEQ ID NO: 2945297 - RNA, 16 nt, Human
ucugccugcccaggcc

SEQ ID NO: 2945298 - RNA, 18 nt, Human
ucugcuccucuccccagc

SEQ ID NO: 2945299 - RNA, 18 nt, Human
ucugcugacagacacagg

SEQ ID NO: 2945300 - RNA, 17 nt, Human
ucugcugacagacacag

SEQ ID NO: 2945301 - RNA, 14 nt, Human
ucugccugcccagg

SEQ ID NO: 2945302 - RNA, 13 nt, Human
ucugccugcccag

SEQ ID NO: 2945303 - RNA, 14 nt, Human
ucugucgcccaguc

SEQ ID NO: 2945304 - RNA, 21 nt, Human
ucuguccugggagugagcugg

SEQ ID NO: 2945305 - RNA, 15 nt, Human
ucuguccuacucugu

SEQ ID NO: 2945306 - RNA, 19 nt, Human
ucuguccuacucuguguca

SEQ ID NO: 2945307 - RNA, 14 nt, Human
ucuguccuacucug

SEQ ID NO: 2945308 - RNA, 14 nt, Human
ucugggacacaguu

SEQ ID NO: 2945309 - RNA, 13 nt, Human
ucugggacacagu

SEQ ID NO: 2945310 - RNA, 23 nt, Human
ucuggugacuuuccucuuugguc

SEQ ID NO: 2945311 - RNA, 23 nt, Human
ucuggcucuuccaggcugggaga

SEQ ID NO: 2945312 - RNA, 18 nt, Human
ucuggcucuuccaggcug

SEQ ID NO: 2945313 - RNA, 10 nt, Human
ucuggccuuc

SEQ ID NO: 2945314 - RNA, 19 nt, Human
ucuggcuaugcauuugaaa

SEQ ID NO: 2945315 - RNA, 22 nt, Human
ucuggcuaugcauuugaaaauu

SEQ ID NO: 2945316 - RNA, 17 nt, Human
ucuggccuucggccucc

SEQ ID NO: 2945317 - RNA, 18 nt, Human
ucuggccuucggccucca

SEQ ID NO: 2945318 - RNA, 17 nt, Human
ucuggcuaugcauuuga

SEQ ID NO: 2945319 - RNA, 14 nt, Human
uguaauaaauaugu

SEQ ID NO: 2945320 - RNA, 22 nt, Human
uguaauaaauauguuucacaca

SEQ ID NO: 2945321 - RNA, 21 nt, Human
uguaauaaauauguuucacac

SEQ ID NO: 2945322 - RNA, 17 nt, Human
uguaacaagccacccca

SEQ ID NO: 2945323 - RNA, 14 nt, Human
uguaacaagccacc

SEQ ID NO: 2945324 - RNA, 11 nt, Human
uguacagagcc

SEQ ID NO: 2945325 - RNA, 14 nt, Human
uguacagacaacaa

SEQ ID NO: 2945326 - RNA, 16 nt, Human
ugguuuucuguucuuu

SEQ ID NO: 2945327 - RNA, 19 nt, Human
ugguuuucuuguguguuua

SEQ ID NO: 2945328 - RNA, 21 nt, Human
ugguuuuuaaaaaacugcuga

SEQ ID NO: 2945329 - RNA, 23 nt, Human
ugguuuuuaaaaaacugcugacu

SEQ ID NO: 2945330 - RNA, 12 nt, Human
uguaaaauggug

SEQ ID NO: 2945331 - RNA, 11 nt, Human
uguaaaauggu

SEQ ID NO: 2945332 - RNA, 16 nt, Human
uggugucaccugaaga

SEQ ID NO: 2945333 - RNA, 15 nt, Human
uggugucgggcauga

SEQ ID NO: 2945334 - RNA, 18 nt, Human
uggugucgggcaugacac

SEQ ID NO: 2945335 - RNA, 18 nt, Human
ugguugaugaucuuugca

SEQ ID NO: 2945336 - RNA, 16 nt, Human
ugguucccuugaugaa

SEQ ID NO: 2945337 - RNA, 17 nt, Human
ugguucccuugaugaag

SEQ ID NO: 2945338 - RNA, 20 nt, Human
ugguucccuugaugaagaag

SEQ ID NO: 2945339 - RNA, 19 nt, Human
uggugguuuucuguucuuu

SEQ ID NO: 2945340 - RNA, 17 nt, Human
uggugguuucagaaaug

SEQ ID NO: 2945341 - RNA, 18 nt, Human
uggugguuucagaaaugu

SEQ ID NO: 2945342 - RNA, 18 nt, Human
uggugggggccucggugu

SEQ ID NO: 2945343 - RNA, 16 nt, Human
uggugggggccucggu

SEQ ID NO: 2945344 - RNA, 13 nt, Human
ugguggcuggguu

SEQ ID NO: 2945345 - RNA, 12 nt, Human
ugguggcagugg

SEQ ID NO: 2945346 - RNA, 19 nt, Human
uggugcaaugaccuuucaa

SEQ ID NO: 2945347 - RNA, 14 nt, Human
uggugcaaugaccu

SEQ ID NO: 2945348 - RNA, 20 nt, Human
ugguggcagugggagcugcc

SEQ ID NO: 2945349 - RNA, 13 nt, Human
ugguggcaguggg

SEQ ID NO: 2945350 - RNA, 18 nt, Human
ugguggcagugggagcug

SEQ ID NO: 2945351 - RNA, 14 nt, Human
uggugagaggcauc

SEQ ID NO: 2945352 - RNA, 20 nt, Human
uggguacuuguggacacagc

SEQ ID NO: 2945353 - RNA, 23 nt, Human
uggguacuuguggacacagcucu

SEQ ID NO: 2945354 - RNA, 14 nt, Human
uggguagacacaca

SEQ ID NO: 2945355 - RNA, 19 nt, Human
uguccccgcacugggcuug

SEQ ID NO: 2945356 - RNA, 17 nt, Human
uguccccgcacugggcu

SEQ ID NO: 2945357 - RNA, 15 nt, Human
uguccuauuauauuc

SEQ ID NO: 2945358 - RNA, 12 nt, Human
uguccugggagu

SEQ ID NO: 2945359 - RNA, 19 nt, Human
uguccugggagugagcugg

SEQ ID NO: 2945360 - RNA, 20 nt, Human
uguccugggagugagcuggu

SEQ ID NO: 2945361 - RNA, 14 nt, Human
ugucuaaugaaacc

SEQ ID NO: 2945362 - RNA, 17 nt, Human
ugucuacacuaagagag

SEQ ID NO: 2945363 - RNA, 22 nt, Human
ugucuacacuaagagagaauga

SEQ ID NO: 2945364 - RNA, 14 nt, Human
ugucuuuuaaacuc

SEQ ID NO: 2945365 - RNA, 16 nt, Human
ugucuuuucuugcaug

SEQ ID NO: 2945366 - RNA, 23 nt, Human
ugucuuuggacccugaggcccag

SEQ ID NO: 2945367 - RNA, 14 nt, Human
ugucuaugggacuc

SEQ ID NO: 2945368 - RNA, 15 nt, Human
ugucuaugggacuca

SEQ ID NO: 2945369 - RNA, 16 nt, Human
ugucuaugggacucaa

SEQ ID NO: 2945370 - RNA, 23 nt, Human
ugucuaguuguuugauucagaca

SEQ ID NO: 2945371 - RNA, 15 nt, Human
ugucuaguuguuuga

SEQ ID NO: 2945372 - RNA, 21 nt, Human
ugucucaaaaaaagaaaaaga

SEQ ID NO: 2945373 - RNA, 13 nt, Human
uguaucugagcag

SEQ ID NO: 2945374 - RNA, 23 nt, Human
uguacagcaaggagauuuacaac

SEQ ID NO: 2945375 - RNA, 21 nt, Human
uguacagaguggaauaagaca

SEQ ID NO: 2945376 - RNA, 22 nt, Human
uguacagcaaggagauuuacaa

SEQ ID NO: 2945377 - RNA, 12 nt, Human
uguacagagccc

SEQ ID NO: 2945378 - RNA, 21 nt, Human
uguacagagcccacgccccca

SEQ ID NO: 2945379 - RNA, 13 nt, Human
uguauaaaauaau

SEQ ID NO: 2945380 - RNA, 14 nt, Human
uguauaaaauaauu

SEQ ID NO: 2945381 - RNA, 19 nt, Human
uguaguguuggagaagaac

SEQ ID NO: 2945382 - RNA, 20 nt, Human
uguaguguuggagaagaacu

SEQ ID NO: 2945383 - RNA, 21 nt, Human
uguaguguuggagaagaacug

SEQ ID NO: 2945384 - RNA, 16 nt, Human
ugucaauuaccagaaa

SEQ ID NO: 2945385 - RNA, 21 nt, Human
ugucaauuacaggaaguacug

SEQ ID NO: 2945386 - RNA, 14 nt, Human
ugucacaggcaggu

SEQ ID NO: 2945387 - RNA, 18 nt, Human
uguauuuuaaaagaauga

SEQ ID NO: 2945388 - RNA, 19 nt, Human
uguauuuuaaaagaaugau

SEQ ID NO: 2945389 - RNA, 19 nt, Human
ugucaauuacaggaaguac

SEQ ID NO: 2945390 - RNA, 12 nt, Human
ugucacuucugg

SEQ ID NO: 2945391 - RNA, 14 nt, Human
ugucagugugacug

SEQ ID NO: 2945392 - RNA, 15 nt, Human
ugucagugugacuga

SEQ ID NO: 2945393 - RNA, 19 nt, Human
ugucagugugacugaucuc

SEQ ID NO: 2945394 - RNA, 16 nt, Human
ugucagugugacugau

SEQ ID NO: 2945395 - RNA, 13 nt, Human
ugucacaggcagg

SEQ ID NO: 2945396 - RNA, 15 nt, Human
ugucacaggcagguc

SEQ ID NO: 2945397 - RNA, 16 nt, Human
ugucacaggcaggucc

SEQ ID NO: 2945398 - RNA, 17 nt, Human
ugucacaggcaggucca

SEQ ID NO: 2945399 - RNA, 21 nt, Human
ugucacaggcagguccagggu

SEQ ID NO: 2945400 - RNA, 17 nt, Human
ugcuucuguuuuauaau

SEQ ID NO: 2945401 - RNA, 12 nt, Human
ugcuucucacug

SEQ ID NO: 2945402 - RNA, 21 nt, Human
ugcuuccagugaggcucugcc

SEQ ID NO: 2945403 - RNA, 23 nt, Human
ugcuuccagugaggcucugcccu

SEQ ID NO: 2945404 - RNA, 22 nt, Human
ugcuuccagugaggcucugccc

SEQ ID NO: 2945405 - RNA, 19 nt, Human
ugcuuaacuucacauauug

SEQ ID NO: 2945406 - RNA, 13 nt, Human
ugcuuaacuucac

SEQ ID NO: 2945407 - RNA, 14 nt, Human
ugcuuaacuucaca

SEQ ID NO: 2945408 - RNA, 17 nt, Human
ugcuuaacuucacauau

SEQ ID NO: 2945409 - RNA, 18 nt, Human
ugcuuaacuucacauauu

SEQ ID NO: 2945410 - RNA, 18 nt, Human
ugcuugugaaaggaaaga

SEQ ID NO: 2945411 - RNA, 22 nt, Human
ugcuucuguuuuauaauuuugu

SEQ ID NO: 2945412 - RNA, 13 nt, Human
ugcuucuucagag

SEQ ID NO: 2945413 - RNA, 14 nt, Human
uggaaaagaauaaa

SEQ ID NO: 2945414 - RNA, 17 nt, Human
uggaacacucugagacu

SEQ ID NO: 2945415 - RNA, 15 nt, Human
uggaacacucugaga

SEQ ID NO: 2945416 - RNA, 21 nt, Human
uggauuguccccgacccuugc

SEQ ID NO: 2945417 - RNA, 22 nt, Human
uggaugcagccucacaguccuu

SEQ ID NO: 2945418 - RNA, 21 nt, Human
uggaugcagccucacaguccu

SEQ ID NO: 2945419 - RNA, 13 nt, Human
uggaugcagccuc

SEQ ID NO: 2945420 - RNA, 23 nt, Human
uggaggggggaggugggauccuc

SEQ ID NO: 2945421 - RNA, 22 nt, Human
uggcacuauaauguaagcucua

SEQ ID NO: 2945422 - RNA, 19 nt, Human
uggcacugcuuccagugag

SEQ ID NO: 2945423 - RNA, 22 nt, Human
uggcacugcuuccagugaggcu

SEQ ID NO: 2945424 - RNA, 13 nt, Human
uggcacuggcaaa

SEQ ID NO: 2945425 - RNA, 21 nt, Human
uggcacuggcaaacagggccu

SEQ ID NO: 2945426 - RNA, 22 nt, Human
uggcacuggcaaacagggccuc

SEQ ID NO: 2945427 - RNA, 18 nt, Human
uggcagcucagagagggu

SEQ ID NO: 2945428 - RNA, 17 nt, Human
uggauuuaacagaaaug

SEQ ID NO: 2945429 - RNA, 15 nt, Human
uggauuuaacagaaa

SEQ ID NO: 2945430 - RNA, 19 nt, Human
uggauugugccuaaugugu

SEQ ID NO: 2945431 - RNA, 23 nt, Human
uggauugugccuaauguguuuga

SEQ ID NO: 2945432 - RNA, 20 nt, Human
uggauugugccuaauguguu

SEQ ID NO: 2945433 - RNA, 21 nt, Human
uggcacuauaauguaagcucu

SEQ ID NO: 2945434 - RNA, 23 nt, Human
uggacguguuaugacuccagaau

SEQ ID NO: 2945435 - RNA, 19 nt, Human
uggacguguuaugacucca

SEQ ID NO: 2945436 - RNA, 20 nt, Human
uggacuaacuugucuuugga

SEQ ID NO: 2945437 - RNA, 19 nt, Human
uggacuaacuugucuuugg

SEQ ID NO: 2945438 - RNA, 18 nt, Human
uggacaggcauguucucu

SEQ ID NO: 2945439 - RNA, 22 nt, Human
uggacaggcauguucucugagg

SEQ ID NO: 2945440 - RNA, 17 nt, Human
uggacaggcauguucuc

SEQ ID NO: 2945441 - RNA, 13 nt, Human
uggacauuuuaug

SEQ ID NO: 2945442 - RNA, 11 nt, Human
uggacauuuua

SEQ ID NO: 2945443 - RNA, 17 nt, Human
uggacauuuuaugucuu

SEQ ID NO: 2945444 - RNA, 16 nt, Human
uggacauuuuaugucu

SEQ ID NO: 2945445 - RNA, 21 nt, Human
uggcuugaguuuaaauuguaa

SEQ ID NO: 2945446 - RNA, 16 nt, Human
uggcugcugaaggcuc

SEQ ID NO: 2945447 - RNA, 14 nt, Human
uggcugcugaaggc

SEQ ID NO: 2945448 - RNA, 13 nt, Human
uggcugcugaagg

SEQ ID NO: 2945449 - RNA, 11 nt, Human
uggcugcugaa

SEQ ID NO: 2945450 - RNA, 22 nt, Human
uggccuucggccuccauccuga

SEQ ID NO: 2945451 - RNA, 20 nt, Human
uggccuucggccuccauccu

SEQ ID NO: 2945452 - RNA, 23 nt, Human
uggccuucggccuccauccugag

SEQ ID NO: 2945453 - RNA, 22 nt, Human
uggccucccaacucaccccagc

SEQ ID NO: 2945454 - RNA, 21 nt, Human
uggccucccaacucaccccag

SEQ ID NO: 2945455 - RNA, 20 nt, Human
uggccucccaacucacccca

SEQ ID NO: 2945456 - RNA, 19 nt, Human
uggccucccaacucacccc

SEQ ID NO: 2945457 - RNA, 14 nt, Human
uggccucccaacuc

SEQ ID NO: 2945458 - RNA, 11 nt, Human
uggccucccaa

SEQ ID NO: 2945459 - RNA, 18 nt, Human
uggccucaagugauucuc

SEQ ID NO: 2945460 - RNA, 23 nt, Human
uggccucaagugauucuccugcc

SEQ ID NO: 2945461 - RNA, 23 nt, Human
uggccuagcauacguacacauuu

SEQ ID NO: 2945462 - RNA, 17 nt, Human
uggcagcugcgguccac

SEQ ID NO: 2945463 - RNA, 20 nt, Human
uggccccucagggucccugg

SEQ ID NO: 2945464 - RNA, 13 nt, Human
uggccccucaggg

SEQ ID NO: 2945465 - RNA, 22 nt, Human
uggccccucagggucccuggug

SEQ ID NO: 2945466 - RNA, 21 nt, Human
uggccccucagggucccuggu

SEQ ID NO: 2945467 - RNA, 20 nt, Human
uggccuagcauacguacaca

SEQ ID NO: 2945468 - RNA, 14 nt, Human
ugggacagggagga

SEQ ID NO: 2945469 - RNA, 16 nt, Human
ugggaggaucucuuga

SEQ ID NO: 2945470 - RNA, 15 nt, Human
ugggacacccuguga

SEQ ID NO: 2945471 - RNA, 14 nt, Human
ugggacacccugug

SEQ ID NO: 2945472 - RNA, 21 nt, Human
ugggaaugaaugucaguguga

SEQ ID NO: 2945473 - RNA, 16 nt, Human
ugggaaugaaugucag

SEQ ID NO: 2945474 - RNA, 18 nt, Human
ugggaugauuggaggggg

SEQ ID NO: 2945475 - RNA, 13 nt, Human
ugggcagagcaga

SEQ ID NO: 2945476 - RNA, 14 nt, Human
ugggcagagcagag

SEQ ID NO: 2945477 - RNA, 17 nt, Human
ugggcagagcagagacc

SEQ ID NO: 2945478 - RNA, 15 nt, Human
ugggcagagcagaga

SEQ ID NO: 2945479 - RNA, 23 nt, Human
ugggcagcugccuccccuccucu

SEQ ID NO: 2945480 - RNA, 20 nt, Human
ugggcagcugccuccccucc

SEQ ID NO: 2945481 - RNA, 22 nt, Human
ugggcagcugccuccccuccuc

SEQ ID NO: 2945482 - RNA, 22 nt, Human
ugggcuucaguggcagcugcuu

SEQ ID NO: 2945483 - RNA, 21 nt, Human
ugggcuucaguggcagcugcu

SEQ ID NO: 2945484 - RNA, 15 nt, Human
ugggcuucauccucc

SEQ ID NO: 2945485 - RNA, 22 nt, Human
ugggcuuggggaccagagcugc

SEQ ID NO: 2945486 - RNA, 21 nt, Human
ugggcuugucuguagauuuua

SEQ ID NO: 2945487 - RNA, 23 nt, Human
ugggcuuggggaccagagcugcc

SEQ ID NO: 2945488 - RNA, 17 nt, Human
ugggcuugucuguagau

SEQ ID NO: 2945489 - RNA, 16 nt, Human
ugggggccucagugcc

SEQ ID NO: 2945490 - RNA, 19 nt, Human
uggggggcugaggugggag

SEQ ID NO: 2945491 - RNA, 20 nt, Human
ugacgccaucccagccccaa

SEQ ID NO: 2945492 - RNA, 19 nt, Human
ugacgccaucccagcccca

SEQ ID NO: 2945493 - RNA, 18 nt, Human
ugacgccaucccagcccc

SEQ ID NO: 2945494 - RNA, 17 nt, Human
ugacgccaucccagccc

SEQ ID NO: 2945495 - RNA, 22 nt, Human
ugaccuuucaauaggaaaaacu

SEQ ID NO: 2945496 - RNA, 18 nt, Human
ugaccuuucaauaggaaa

SEQ ID NO: 2945497 - RNA, 16 nt, Human
ugacgccaucccagcc

SEQ ID NO: 2945498 - RNA, 15 nt, Human
ugacgccaucccagc

SEQ ID NO: 2945499 - RNA, 14 nt, Human
ugacgccaucccag

SEQ ID NO: 2945500 - RNA, 13 nt, Human
ugacgccauccca

SEQ ID NO: 2945501 - RNA, 14 nt, Human
ugacugaauuucuu

SEQ ID NO: 2945502 - RNA, 15 nt, Human
ugacugaauuucuuu

SEQ ID NO: 2945503 - RNA, 12 nt, Human
ugacucuuaaga

SEQ ID NO: 2945504 - RNA, 13 nt, Human
ugacugaauuucu

SEQ ID NO: 2945505 - RNA, 19 nt, Human
ugaccauucuccaccugcc

SEQ ID NO: 2945506 - RNA, 15 nt, Human
ucuugaacuccuggc

SEQ ID NO: 2945507 - RNA, 22 nt, Human
ugaccauucuccaccugccagg

SEQ ID NO: 2945508 - RNA, 21 nt, Human
ugaccauucuccaccugccag

SEQ ID NO: 2945509 - RNA, 20 nt, Human
ugaccauucuccaccugcca

SEQ ID NO: 2945510 - RNA, 17 nt, Human
ucuugaauuguaaggaa

SEQ ID NO: 2945511 - RNA, 13 nt, Human
ugaccucugcagc

SEQ ID NO: 2945512 - RNA, 16 nt, Human
ugaccucugcagcaau

SEQ ID NO: 2945513 - RNA, 22 nt, Human
ugaccucaggugauccacccac

SEQ ID NO: 2945514 - RNA, 13 nt, Human
ugaccuuucaaua

SEQ ID NO: 2945515 - RNA, 14 nt, Human
ugaccuuucaauag

SEQ ID NO: 2945516 - RNA, 16 nt, Human
ugaccuuucaauagga

SEQ ID NO: 2945517 - RNA, 15 nt, Human
ugaccuuucaauagg

SEQ ID NO: 2945518 - RNA, 12 nt, Human
ugaccucugccu

SEQ ID NO: 2945519 - RNA, 23 nt, Human
ugaccucugcagcaauaaagcag

SEQ ID NO: 2945520 - RNA, 18 nt, Human
ugaccucugcagcaauaa

SEQ ID NO: 2945521 - RNA, 21 nt, Human
ugaccucugcagcaauaaagc

SEQ ID NO: 2945522 - RNA, 14 nt, Human
ugagccucacagca

SEQ ID NO: 2945523 - RNA, 15 nt, Human
ugagccucacagcag

SEQ ID NO: 2945524 - RNA, 13 nt, Human
ugagccucagcau

SEQ ID NO: 2945525 - RNA, 15 nt, Human
ugagccucagcaucc

SEQ ID NO: 2945526 - RNA, 16 nt, Human
ugagccucacagcagu

SEQ ID NO: 2945527 - RNA, 15 nt, Human
ugagcaucaggccag

SEQ ID NO: 2945528 - RNA, 14 nt, Human
ugagcaucaggcca

SEQ ID NO: 2945529 - RNA, 14 nt, Human
ugagaugcuagaac

SEQ ID NO: 2945530 - RNA, 16 nt, Human
ugagaugcuagaacuc

SEQ ID NO: 2945531 - RNA, 20 nt, Human
ugagaugcuagaacucccuu

SEQ ID NO: 2945532 - RNA, 20 nt, Human
ugagcagucaggaaagagaa

SEQ ID NO: 2945533 - RNA, 13 nt, Human
ugagcaucaggcc

SEQ ID NO: 2945534 - RNA, 17 nt, Human
ugagcagucaggaaaga

SEQ ID NO: 2945535 - RNA, 15 nt, Human
ugagcagucaggaaa

SEQ ID NO: 2945536 - RNA, 12 nt, Human
ugagacucuguc

SEQ ID NO: 2945537 - RNA, 13 nt, Human
ugagacucugucu

SEQ ID NO: 2945538 - RNA, 14 nt, Human
ugagacucugucuc

SEQ ID NO: 2945539 - RNA, 22 nt, Human
ugagaggcauccaguaucuuga

SEQ ID NO: 2945540 - RNA, 23 nt, Human
ugagaggcauccaguaucuugaa

SEQ ID NO: 2945541 - RNA, 19 nt, Human
ugagaggggaacagacugg

SEQ ID NO: 2945542 - RNA, 17 nt, Human
ugagaguagagucacug

SEQ ID NO: 2945543 - RNA, 12 nt, Human
ugagacccuguc

SEQ ID NO: 2945544 - RNA, 14 nt, Human
ugagacagcucugc

SEQ ID NO: 2945545 - RNA, 16 nt, Human
ugagacagcucugcau

SEQ ID NO: 2945546 - RNA, 18 nt, Human
ugagaaagacuauucaaa

SEQ ID NO: 2945547 - RNA, 17 nt, Human
ugagaaagacuauucaa

SEQ ID NO: 2945548 - RNA, 16 nt, Human
ugagaaagacuauuca

SEQ ID NO: 2945549 - RNA, 24 nt, Human
ugauaguuguaccgcaaugugacu

SEQ ID NO: 2945550 - RNA, 22 nt, Human
ugaucacggcucacugcagccu

SEQ ID NO: 2945551 - RNA, 21 nt, Human
ugauccacccaccucagccuc

SEQ ID NO: 2945552 - RNA, 22 nt, Human
ugauccacccaccucagccucc

SEQ ID NO: 2945553 - RNA, 21 nt, Human
ugaucuaggaagacuuuggaa

SEQ ID NO: 2945554 - RNA, 19 nt, Human
ugaucuaggaagacuuugg

SEQ ID NO: 2945555 - RNA, 13 nt, Human
ugaucauccacug

SEQ ID NO: 2945556 - RNA, 24 nt, Human
ugaucauccacugugccaugugcc

SEQ ID NO: 2945557 - RNA, 17 nt, Human
ugauccaagcugguccc

SEQ ID NO: 2945558 - RNA, 21 nt, Human
ugauccaagcuggucccacuc

SEQ ID NO: 2945559 - RNA, 15 nt, Human
ugauccacccaccuc

SEQ ID NO: 2945560 - RNA, 20 nt, Human
ugauccacccaccucagccu

SEQ ID NO: 2945561 - RNA, 22 nt, Human
ugaugcuucuucagagacuccu

SEQ ID NO: 2945562 - RNA, 21 nt, Human
ugaugcuucuucagagacucc

SEQ ID NO: 2945563 - RNA, 19 nt, Human
ugaugcuucuucagagacu

SEQ ID NO: 2945564 - RNA, 18 nt, Human
ugaugcuucuucagagac

SEQ ID NO: 2945565 - RNA, 16 nt, Human
ugauguaauuaugguu

SEQ ID NO: 2945566 - RNA, 14 nt, Human
ugaugccaugagga

SEQ ID NO: 2945567 - RNA, 22 nt, Human
ugaugaucuuugcagacaggca

SEQ ID NO: 2945568 - RNA, 23 nt, Human
ugaugaucuuugcagacaggcaa

SEQ ID NO: 2945569 - RNA, 20 nt, Human
ugaugaugaaaugaggucag

SEQ ID NO: 2945570 - RNA, 18 nt, Human
ugaucuuugcagacaggc

SEQ ID NO: 2945571 - RNA, 21 nt, Human
ugaucuuugcagacaggcaag

SEQ ID NO: 2945572 - RNA, 23 nt, Human
ugaucuuugcagacaggcaagca

SEQ ID NO: 2945573 - RNA, 19 nt, Human
ugaucuuugcagacaggca

SEQ ID NO: 2945574 - RNA, 20 nt, Human
ugaucuuugcagacaggcaa

SEQ ID NO: 2945575 - RNA, 23 nt, Human
ugauagcacagacccugcccugu

SEQ ID NO: 2945576 - RNA, 22 nt, Human
ugauagcacagacccugcccug

SEQ ID NO: 2945577 - RNA, 16 nt, Human
ugauagcacagacccu

SEQ ID NO: 2945578 - RNA, 15 nt, Human
ugauagcacagaccc

SEQ ID NO: 2945579 - RNA, 21 nt, Human
ugauagcacagacccugcccu

SEQ ID NO: 2945580 - RNA, 20 nt, Human
ugauagcacagacccugccc

SEQ ID NO: 2945581 - RNA, 18 nt, Human
ugauagcacagacccugc

SEQ ID NO: 2945582 - RNA, 17 nt, Human
ugauagcacagacccug

SEQ ID NO: 2945583 - RNA, 19 nt, Human
ugaguugauucagcucugc

SEQ ID NO: 2945584 - RNA, 16 nt, Human
ugaguugauucagcuc

SEQ ID NO: 2945585 - RNA, 15 nt, Human
ugagucgaggacagg

SEQ ID NO: 2945586 - RNA, 16 nt, Human
ugagucgaggacaggg

SEQ ID NO: 2945587 - RNA, 23 nt, Human
ugaguugauagcacagacccugc

SEQ ID NO: 2945588 - RNA, 21 nt, Human
ugaguugauagcacagacccu

SEQ ID NO: 2945589 - RNA, 21 nt, Human
ugaguccccuguuuguuucug

SEQ ID NO: 2945590 - RNA, 19 nt, Human
ugagguuucaaaccucccu

SEQ ID NO: 2945591 - RNA, 16 nt, Human
ugaggugcuauguucu

SEQ ID NO: 2945592 - RNA, 15 nt, Human
ugaggugcuauguuc

SEQ ID NO: 2945593 - RNA, 20 nt, Human
ugaguccccuguuuguuucu

SEQ ID NO: 2945594 - RNA, 18 nt, Human
ugaguccuggcaugggaa

SEQ ID NO: 2945595 - RNA, 11 nt, Human
ugaguccuggc

SEQ ID NO: 2945596 - RNA, 14 nt, Human
ugagucgaggacag

SEQ ID NO: 2945597 - RNA, 22 nt, Human
ugaguccuggcaugggaaugaa

SEQ ID NO: 2945598 - RNA, 19 nt, Human
ugaguccuggcaugggaau

SEQ ID NO: 2945599 - RNA, 20 nt, Human
ugaggucuguucuuuccaaa

SEQ ID NO: 2945600 - RNA, 14 nt, Human
ugaggucuguucuu

SEQ ID NO: 2945601 - RNA, 15 nt, Human
ugaggucuguucuuu

SEQ ID NO: 2945602 - RNA, 11 nt, Human
ugaggcugggc

SEQ ID NO: 2945603 - RNA, 12 nt, Human
ugccauccaggu

SEQ ID NO: 2945604 - RNA, 12 nt, Human
ugccauccaagu

SEQ ID NO: 2945605 - RNA, 15 nt, Human
ugccauccagguuca

SEQ ID NO: 2945606 - RNA, 17 nt, Human
ugccagguuuuuggucu

SEQ ID NO: 2945607 - RNA, 23 nt, Human
ugccagggccaugucagacacag

SEQ ID NO: 2945608 - RNA, 19 nt, Human
ugccaggaagccagcaggc

SEQ ID NO: 2945609 - RNA, 18 nt, Human
ugccaggaagccagcagg

SEQ ID NO: 2945610 - RNA, 16 nt, Human
ugccaggaagccagca

SEQ ID NO: 2945611 - RNA, 12 nt, Human
ugccaggaagcc

SEQ ID NO: 2945612 - RNA, 15 nt, Human
ugccauguuggccag

SEQ ID NO: 2945613 - RNA, 12 nt, Human
ugccauguuggc

SEQ ID NO: 2945614 - RNA, 16 nt, Human
ugccauguuggccagg

SEQ ID NO: 2945615 - RNA, 20 nt, Human
ugcccaccuggccucugcac

SEQ ID NO: 2945616 - RNA, 18 nt, Human
ugcccacgcuggagugca

SEQ ID NO: 2945617 - RNA, 19 nt, Human
ugcccaccuggccucugca

SEQ ID NO: 2945618 - RNA, 21 nt, Human
ugcccacucccugcaaccuga

SEQ ID NO: 2945619 - RNA, 15 nt, Human
ugccaugugccaggu

SEQ ID NO: 2945620 - RNA, 14 nt, Human
ugccaugugccagg

SEQ ID NO: 2945621 - RNA, 23 nt, Human
ugccaugagccgcccaaggccuu

SEQ ID NO: 2945622 - RNA, 20 nt, Human
ugccaugagccgcccaaggc

SEQ ID NO: 2945623 - RNA, 21 nt, Human
ugccaugagccgcccaaggcc

SEQ ID NO: 2945624 - RNA, 23 nt, Human
ugccaugaggaacaaggcaaggc

SEQ ID NO: 2945625 - RNA, 20 nt, Human
ugccaugaggaacaaggcaa

SEQ ID NO: 2945626 - RNA, 19 nt, Human
ugccaugagccgcccaagg

SEQ ID NO: 2945627 - RNA, 18 nt, Human
ugccaugagccgcccaag

SEQ ID NO: 2945628 - RNA, 15 nt, Human
ugcauguuugugauu

SEQ ID NO: 2945629 - RNA, 17 nt, Human
ugcaugguuuggagcug

SEQ ID NO: 2945630 - RNA, 17 nt, Human
ugcaugguuuagaaagc

SEQ ID NO: 2945631 - RNA, 17 nt, Human
ugcagauaaacaguagu

SEQ ID NO: 2945632 - RNA, 19 nt, Human
ugcagauaaacaguaguga

SEQ ID NO: 2945633 - RNA, 22 nt, Human
ugcagaguaggggucugucuuu

SEQ ID NO: 2945634 - RNA, 21 nt, Human
ugcauuauauuuauuacugua

SEQ ID NO: 2945635 - RNA, 12 nt, Human
ugcauuaucuag

SEQ ID NO: 2945636 - RNA, 17 nt, Human
ugcauuaucuagauacu

SEQ ID NO: 2945637 - RNA, 17 nt, Human
ugccugguggcagcugc

SEQ ID NO: 2945638 - RNA, 18 nt, Human
ugccugguggcagcugcg

SEQ ID NO: 2945639 - RNA, 19 nt, Human
ugccugguggcagcugcgg

SEQ ID NO: 2945640 - RNA, 19 nt, Human
ugccuggguggaugggcca

SEQ ID NO: 2945641 - RNA, 21 nt, Human
ugccucuucucuacucuaggg

SEQ ID NO: 2945642 - RNA, 13 nt, Human
ugccucugggacu

SEQ ID NO: 2945643 - RNA, 22 nt, Human
ugccuccuuugugaggaagccg

SEQ ID NO: 2945644 - RNA, 20 nt, Human
ugccuccuuugugaggaagc

SEQ ID NO: 2945645 - RNA, 21 nt, Human
ugccuccuuugugaggaagcc

SEQ ID NO: 2945646 - RNA, 21 nt, Human
ugcccugcccaccuggccucu

SEQ ID NO: 2945647 - RNA, 23 nt, Human
ugcccugcccaccuggccucugc

SEQ ID NO: 2945648 - RNA, 22 nt, Human
ugcccugcccaccuggccucug

SEQ ID NO: 2945649 - RNA, 17 nt, Human
ugcccuaaaguguauuu

SEQ ID NO: 2945650 - RNA, 19 nt, Human
ugcccuaaaguguauuuuu

SEQ ID NO: 2945651 - RNA, 19 nt, Human
ugccgucuaccugaggggc

SEQ ID NO: 2945652 - RNA, 17 nt, Human
ugccgucuaccugaggg

SEQ ID NO: 2945653 - RNA, 16 nt, Human
ugccgucuaccugagg

SEQ ID NO: 2945654 - RNA, 15 nt, Human
ugccgucuaccugag

SEQ ID NO: 2945655 - RNA, 15 nt, Human
ugauuuucauugcug

SEQ ID NO: 2945656 - RNA, 13 nt, Human
ugauuuucauugc

SEQ ID NO: 2945657 - RNA, 20 nt, Human
ugcaaaaaaaauuagccggg

SEQ ID NO: 2945658 - RNA, 15 nt, Human
ugcaaaaaaaauuag

SEQ ID NO: 2945659 - RNA, 23 nt, Human
ugauuuuuuuuuccuucagugcc

SEQ ID NO: 2945660 - RNA, 22 nt, Human
ugauuuuuuuuuccuucagugc

SEQ ID NO: 2945661 - RNA, 20 nt, Human
ugauuuuuuuuuccuucagu

SEQ ID NO: 2945662 - RNA, 19 nt, Human
ugauuuuuuuuuccuucag

SEQ ID NO: 2945663 - RNA, 17 nt, Human
ugauuuuuuuuuccuuc

SEQ ID NO: 2945664 - RNA, 16 nt, Human
ugauuuuuuuuuccuu

SEQ ID NO: 2945665 - RNA, 22 nt, Human
ugcaacucugaaggguaauuau

SEQ ID NO: 2945666 - RNA, 22 nt, Human
ugcaaccugauugugucucuug

SEQ ID NO: 2945667 - RNA, 20 nt, Human
ugcaaccugauugugucucu

SEQ ID NO: 2945668 - RNA, 19 nt, Human
ugcaaccugauugugucuc

SEQ ID NO: 2945669 - RNA, 18 nt, Human
ugcaaccuccgccucuug

SEQ ID NO: 2945670 - RNA, 20 nt, Human
ugcaaccuccgccucuuggg

SEQ ID NO: 2945671 - RNA, 21 nt, Human
ugcaaccuccgccucuugggu

SEQ ID NO: 2945672 - RNA, 14 nt, Human
ugcaacaggcuggg

SEQ ID NO: 2945673 - RNA, 15 nt, Human
ugcaacaggcugggc

SEQ ID NO: 2945674 - RNA, 16 nt, Human
ugcaacaggcugggcu

SEQ ID NO: 2945675 - RNA, 17 nt, Human
ugcaacaggcugggcuu

SEQ ID NO: 2945676 - RNA, 19 nt, Human
ugcaacaggcugggcuuca

SEQ ID NO: 2945677 - RNA, 20 nt, Human
ugcaacaggcugggcuucag

SEQ ID NO: 2945678 - RNA, 13 nt, Human
ugcaaccuccgcc

SEQ ID NO: 2945679 - RNA, 14 nt, Human
ugcaaccuccgccu

SEQ ID NO: 2945680 - RNA, 13 nt, Human
ugcaauggcagcc

SEQ ID NO: 2945681 - RNA, 14 nt, Human
ugcaauggcagccu

SEQ ID NO: 2945682 - RNA, 15 nt, Human
ugcaauggcagccuu

SEQ ID NO: 2945683 - RNA, 16 nt, Human
ugcaauggcagccuug

SEQ ID NO: 2945684 - RNA, 16 nt, Human
ugcaaugaccuuucaa

SEQ ID NO: 2945685 - RNA, 13 nt, Human
ugcaaugaccuuu

SEQ ID NO: 2945686 - RNA, 23 nt, Human
ugcaaugaccuuucaauaggaaa

SEQ ID NO: 2945687 - RNA, 22 nt, Human
ugcaaugaccuuucaauaggaa

SEQ ID NO: 2945688 - RNA, 19 nt, Human
ugcaaugaccuuucaauag

SEQ ID NO: 2945689 - RNA, 17 nt, Human
ugcaaugaccuuucaau

SEQ ID NO: 2945690 - RNA, 17 nt, Human
ugcacagaguuguuaca

SEQ ID NO: 2945691 - RNA, 18 nt, Human
ugcacagaguuguuacau

SEQ ID NO: 2945692 - RNA, 19 nt, Human
ugcacagaguuguuacauu

SEQ ID NO: 2945693 - RNA, 20 nt, Human
ugcacaaacagaggccgcca

SEQ ID NO: 2945694 - RNA, 19 nt, Human
ugcacaaacagaggccgcc

SEQ ID NO: 2945695 - RNA, 17 nt, Human
ugcacaaacagaggccg

SEQ ID NO: 2945696 - RNA, 16 nt, Human
ugcacaaacagaggcc

SEQ ID NO: 2945697 - RNA, 15 nt, Human
ugcacaaacagaggc

SEQ ID NO: 2945698 - RNA, 18 nt, Human
ugcaccggcuggccuggc

SEQ ID NO: 2945699 - RNA, 20 nt, Human
ugcaccggcuggccuggccc

SEQ ID NO: 2945700 - RNA, 19 nt, Human
ugcaccggcuggccuggcc

SEQ ID NO: 2945701 - RNA, 16 nt, Human
ugcacgcacacugucu

SEQ ID NO: 2945702 - RNA, 21 nt, Human
ugcaccggcuggccuggcccc

SEQ ID NO: 2945703 - RNA, 17 nt, Human
ugcaccuggaauauaua

SEQ ID NO: 2945704 - RNA, 20 nt, Human
ugcaccuggaauauauaacc

SEQ ID NO: 2945705 - RNA, 22 nt, Human
ugcaccuggaauauauaaccag

SEQ ID NO: 2945706 - RNA, 18 nt, Human
ugcacugacauuguuggc

SEQ ID NO: 2945707 - RNA, 21 nt, Human
ugcacugacauuguuggccaa

SEQ ID NO: 2945708 - RNA, 17 nt, Human
ugcacgcacacugucug

SEQ ID NO: 2945709 - RNA, 16 nt, Human
ugcacugucaagauga

SEQ ID NO: 2945710 - RNA, 21 nt, Human
uuuuaaaguaacccuacaaaa

SEQ ID NO: 2945711 - RNA, 23 nt, Human
uuuuauaauuuugugaagcaaaa

SEQ ID NO: 2945712 - RNA, 21 nt, Human
uuuuauaauuuugugaagcaa

SEQ ID NO: 2945713 - RNA, 15 nt, Human
uuuuacuaauagaca

SEQ ID NO: 2945714 - RNA, 13 nt, Human
uuuuaucuucuau

SEQ ID NO: 2945715 - RNA, 19 nt, Human
uuuuaucgucacugcuuaa

SEQ ID NO: 2945716 - RNA, 17 nt, Human
uuuucaaaauaaaaaug

SEQ ID NO: 2945717 - RNA, 18 nt, Human
uuuuauuuuuagacagag

SEQ ID NO: 2945718 - RNA, 13 nt, Human
uuuuauacauaaa

SEQ ID NO: 2945719 - RNA, 21 nt, Human
uuuuauacauaaacaagacca

SEQ ID NO: 2945720 - RNA, 13 nt, Human
uuuuauauagcaa

SEQ ID NO: 2945721 - RNA, 13 nt, Human
uuuuauauuugaa

SEQ ID NO: 2945722 - RNA, 18 nt, Human
uuuuauauuugaaauauu

SEQ ID NO: 2945723 - RNA, 15 nt, Human
uuuucaaauguucuc

SEQ ID NO: 2945724 - RNA, 16 nt, Human
uuuucacauuggaaac

SEQ ID NO: 2945725 - RNA, 22 nt, Human
uuuucccuauuagagaagagau

SEQ ID NO: 2945726 - RNA, 18 nt, Human
uuuucccuauuagagaag

SEQ ID NO: 2945727 - RNA, 16 nt, Human
uuuucuuucagccaag

SEQ ID NO: 2945728 - RNA, 13 nt, Human
uuuucuucucccu

SEQ ID NO: 2945729 - RNA, 22 nt, Human
uuuucuuguguguuuauuguca

SEQ ID NO: 2945730 - RNA, 13 nt, Human
uuuucuacucgag

SEQ ID NO: 2945731 - RNA, 13 nt, Human
uuuucuuauuuca

SEQ ID NO: 2945732 - RNA, 23 nt, Human
uuuucuacucgaguuacagacaa

SEQ ID NO: 2945733 - RNA, 22 nt, Human
uuuucuacucgaguuacagaca

SEQ ID NO: 2945734 - RNA, 20 nt, Human
uuuucuacucgaguuacaga

SEQ ID NO: 2945735 - RNA, 15 nt, Human
uuuccacagaagcuc

SEQ ID NO: 2945736 - RNA, 17 nt, Human
uuuccguuaaaauacca

SEQ ID NO: 2945737 - RNA, 13 nt, Human
uuugagugccuua

SEQ ID NO: 2945738 - RNA, 15 nt, Human
uuuccguuaaaauac

SEQ ID NO: 2945739 - RNA, 21 nt, Human
uuugagugccuuacacaaugg

SEQ ID NO: 2945740 - RNA, 22 nt, Human
uuugaguggaguuacugaacag

SEQ ID NO: 2945741 - RNA, 15 nt, Human
uuugcaggaaauccu

SEQ ID NO: 2945742 - RNA, 19 nt, Human
uuugcagugcaguauagaa

SEQ ID NO: 2945743 - RNA, 19 nt, Human
uuuggacaaaauggaauac

SEQ ID NO: 2945744 - RNA, 13 nt, Human
uuuggacccugag

SEQ ID NO: 2945745 - RNA, 12 nt, Human
uuuggaaaauaa

SEQ ID NO: 2945746 - RNA, 19 nt, Human
uuuggaaaggaaugcaaag

SEQ ID NO: 2945747 - RNA, 16 nt, Human
uuuggaaaggaaugca

SEQ ID NO: 2945748 - RNA, 17 nt, Human
uuuggaaaggaaugcaa

SEQ ID NO: 2945749 - RNA, 18 nt, Human
uuuggaaaggaaugcaaa

SEQ ID NO: 2945750 - RNA, 15 nt, Human
uuuuaaaauaagucu

SEQ ID NO: 2945751 - RNA, 22 nt, Human
uuuuaaaauaagucugauuuaa

SEQ ID NO: 2945752 - RNA, 15 nt, Human
uuuguugucagcuga

SEQ ID NO: 2945753 - RNA, 22 nt, Human
uuuguuaguaugaggcauuugu

SEQ ID NO: 2945754 - RNA, 15 nt, Human
uuuguauucucuccu

SEQ ID NO: 2945755 - RNA, 13 nt, Human
uuugguauuugaa

SEQ ID NO: 2945756 - RNA, 17 nt, Human
uuuguauaaaauaauuu

SEQ ID NO: 2945757 - RNA, 17 nt, Human
uuuggucuacacugugc

SEQ ID NO: 2945758 - RNA, 18 nt, Human
uuuguauaaaauaauuuu

SEQ ID NO: 2945759 - RNA, 19 nt, Human
uuuguauaaaauaauuuuu

SEQ ID NO: 2945760 - RNA, 21 nt, Human
uuuugaagauucuauguuaau

SEQ ID NO: 2945761 - RNA, 11 nt, Human
uuuuuaaaugc

SEQ ID NO: 2945762 - RNA, 12 nt, Human
uuuuuaagaaaa

SEQ ID NO: 2945763 - RNA, 16 nt, Human
uuuuuaagugcugcau

SEQ ID NO: 2945764 - RNA, 17 nt, Human
uuuuuaagugcugcauu

SEQ ID NO: 2945765 - RNA, 18 nt, Human
uuuuuaagugcugcauuu

SEQ ID NO: 2945766 - RNA, 19 nt, Human
uuuuuaagugcugcauuua

SEQ ID NO: 2945767 - RNA, 22 nt, Human
uuuuuaagugcugcauuuaaaa

SEQ ID NO: 2945768 - RNA, 23 nt, Human
uuuuuaagugcugcauuuaaaag

SEQ ID NO: 2945769 - RNA, 11 nt, Human
uuuuuuuacua

SEQ ID NO: 2945770 - RNA, 12 nt, Human
uuuuuuuuaaga

SEQ ID NO: 2945771 - RNA, 18 nt, Human
uuuuuuaaaauaagucug

SEQ ID NO: 2945772 - RNA, 13 nt, Human
uuuuuuuugacaa

SEQ ID NO: 2945773 - RNA, 16 nt, Human
uuuaaguuauuaagag

SEQ ID NO: 2945774 - RNA, 13 nt, Human
uuuaauaauguuu

SEQ ID NO: 2945775 - RNA, 18 nt, Human
uuuaagaaaaaggaugca

SEQ ID NO: 2945776 - RNA, 16 nt, Human
uuuaagacccucucaa

SEQ ID NO: 2945777 - RNA, 17 nt, Human
uuuaagaacuaaaaugu

SEQ ID NO: 2945778 - RNA, 22 nt, Human
uuuaagaaaaaggaugcacaga

SEQ ID NO: 2945779 - RNA, 18 nt, Human
uuuaacagaaauguacag

SEQ ID NO: 2945780 - RNA, 19 nt, Human
uuuaacucuauaauguguu

SEQ ID NO: 2945781 - RNA, 12 nt, Human
uuuagacagagu

SEQ ID NO: 2945782 - RNA, 14 nt, Human
uuuacuuuaaacua

SEQ ID NO: 2945783 - RNA, 19 nt, Human
uuuacuucuuauacauuug

SEQ ID NO: 2945784 - RNA, 22 nt, Human
uuuacuucuuauacauuugaua

SEQ ID NO: 2945785 - RNA, 14 nt, Human
uuuagaaauauaau

SEQ ID NO: 2945786 - RNA, 18 nt, Human
uuuacacacuguacacau

SEQ ID NO: 2945787 - RNA, 19 nt, Human
uuuacacacuguacacaua

SEQ ID NO: 2945788 - RNA, 23 nt, Human
uuuacacacuguacacauaagcc

SEQ ID NO: 2945789 - RNA, 21 nt, Human
uuuacacacuguacacauaag

SEQ ID NO: 2945790 - RNA, 22 nt, Human
uuuacacacuguacacauaagc

SEQ ID NO: 2945791 - RNA, 21 nt, Human
uuuaauagguuuggacaaaau

SEQ ID NO: 2945792 - RNA, 13 nt, Human
uuuacauuuuaca

SEQ ID NO: 2945793 - RNA, 13 nt, Human
uuuaccacuugug

SEQ ID NO: 2945794 - RNA, 14 nt, Human
uuucauuuagguga

SEQ ID NO: 2945795 - RNA, 18 nt, Human
uuucauuuaggugaggaa

SEQ ID NO: 2945796 - RNA, 13 nt, Human
uuucaguguacau

SEQ ID NO: 2945797 - RNA, 14 nt, Human
uuucaguguacaug

SEQ ID NO: 2945798 - RNA, 14 nt, Human
uuucaauaggaaaa

SEQ ID NO: 2945799 - RNA, 12 nt, Human
uuucaauaggaa

SEQ ID NO: 2945800 - RNA, 17 nt, Human
uuucaauaggaaaaacu

SEQ ID NO: 2945801 - RNA, 15 nt, Human
uuucaauuuuaaaca

SEQ ID NO: 2945802 - RNA, 21 nt, Human
uuucagauaaucacaauacau

SEQ ID NO: 2945803 - RNA, 16 nt, Human
uuucaauuuuaaacau

SEQ ID NO: 2945804 - RNA, 18 nt, Human
uuucaauuuuaaacauau

SEQ ID NO: 2945805 - RNA, 14 nt, Human
uuuauuuacaaaug

SEQ ID NO: 2945806 - RNA, 16 nt, Human
uuuauuuacaaauguu

SEQ ID NO: 2945807 - RNA, 12 nt, Human
uuuauuuaaaag

SEQ ID NO: 2945808 - RNA, 22 nt, Human
uuuauuguuuaaaaucauuucu

SEQ ID NO: 2945809 - RNA, 16 nt, Human
uuuauaacuuuuuaua

SEQ ID NO: 2945810 - RNA, 13 nt, Human
uuuauaacuuuuu

SEQ ID NO: 2945811 - RNA, 22 nt, Human
uuuauaauuuugugaagcaaaa

SEQ ID NO: 2945812 - RNA, 13 nt, Human
uuuauuaugcaug

SEQ ID NO: 2945813 - RNA, 13 nt, Human
uuuauuauggcac

SEQ ID NO: 2945814 - RNA, 17 nt, Human
uuuauggcacuaguauu

SEQ ID NO: 2945815 - RNA, 14 nt, Human
uuuauggcuuuugu

SEQ ID NO: 2945816 - RNA, 16 nt, Human
uuuauggcuuuugugc

SEQ ID NO: 2945817 - RNA, 20 nt, Human
uuguuagugugucuuagugu

SEQ ID NO: 2945818 - RNA, 22 nt, Human
uuguuaguaugaggcauuuguu

SEQ ID NO: 2945819 - RNA, 14 nt, Human
uuguuuaaaaucau

SEQ ID NO: 2945820 - RNA, 14 nt, Human
uuguuacauuuuua

SEQ ID NO: 2945821 - RNA, 19 nt, Human
uuguuaguaugaggcauuu

SEQ ID NO: 2945822 - RNA, 21 nt, Human
uuguuaguaugaggcauuugu

SEQ ID NO: 2945823 - RNA, 18 nt, Human
uuguguuuugcaagccag

SEQ ID NO: 2945824 - RNA, 13 nt, Human
uuguguucaccuu

SEQ ID NO: 2945825 - RNA, 22 nt, Human
uuguggauuuaacagaaaugua

SEQ ID NO: 2945826 - RNA, 23 nt, Human
uuguggauuuaacagaaauguac

SEQ ID NO: 2945827 - RNA, 20 nt, Human
uuguguugaagagguuuuaa

SEQ ID NO: 2945828 - RNA, 21 nt, Human
uuguguuuauauauaagccaa

SEQ ID NO: 2945829 - RNA, 20 nt, Human
uuguggauuuaacagaaaug

SEQ ID NO: 2945830 - RNA, 21 nt, Human
uuguggauuuaacagaaaugu

SEQ ID NO: 2945831 - RNA, 17 nt, Human
uuguggacacagcucuu

SEQ ID NO: 2945832 - RNA, 16 nt, Human
uuguggacacagcucu

SEQ ID NO: 2945833 - RNA, 17 nt, Human
uugugcauuaucuagau

SEQ ID NO: 2945834 - RNA, 12 nt, Human
uugugcauuugg

SEQ ID NO: 2945835 - RNA, 22 nt, Human
uugugcauuaucuagauacugu

SEQ ID NO: 2945836 - RNA, 23 nt, Human
uugugcauuaucuagauacugua

SEQ ID NO: 2945837 - RNA, 12 nt, Human
uugugccccugc

SEQ ID NO: 2945838 - RNA, 18 nt, Human
uugugccuaauguguuug

SEQ ID NO: 2945839 - RNA, 15 nt, Human
uugugccuaaugugu

SEQ ID NO: 2945840 - RNA, 18 nt, Human
uuguacauaaugcgugca

SEQ ID NO: 2945841 - RNA, 14 nt, Human
uuguacauaaugcg

SEQ ID NO: 2945842 - RNA, 15 nt, Human
uuguaaauuaacuuu

SEQ ID NO: 2945843 - RNA, 16 nt, Human
uuguaaauuaacuuuu

SEQ ID NO: 2945844 - RNA, 18 nt, Human
uuguaaauuaacuuuuau

SEQ ID NO: 2945845 - RNA, 23 nt, Human
uuguaaauuaacuuuuauaaacu

SEQ ID NO: 2945846 - RNA, 17 nt, Human
uuguaaauagcucaggu

SEQ ID NO: 2945847 - RNA, 22 nt, Human
uuggguucaagcgauucuucug

SEQ ID NO: 2945848 - RNA, 18 nt, Human
uuggguuacuauuucuug

SEQ ID NO: 2945849 - RNA, 13 nt, Human
uuggucuguguga

SEQ ID NO: 2945850 - RNA, 16 nt, Human
uuggucugugagaugc

SEQ ID NO: 2945851 - RNA, 15 nt, Human
uugguauuugaaaca

SEQ ID NO: 2945852 - RNA, 15 nt, Human
uuggucugugagaug

SEQ ID NO: 2945853 - RNA, 15 nt, Human
uuguauucucuccug

SEQ ID NO: 2945854 - RNA, 16 nt, Human
uuguauucucuccugu

SEQ ID NO: 2945855 - RNA, 19 nt, Human
uuguauucucuccuguacc

SEQ ID NO: 2945856 - RNA, 12 nt, Human
uugugauuuuug

SEQ ID NO: 2945857 - RNA, 16 nt, Human
uugugauuuuuguaau

SEQ ID NO: 2945858 - RNA, 17 nt, Human
uugugauuuuuguaauu

SEQ ID NO: 2945859 - RNA, 20 nt, Human
uugugaaaaaauuuacuuua

SEQ ID NO: 2945860 - RNA, 20 nt, Human
uugugaaaggaaagaggcuc

SEQ ID NO: 2945861 - RNA, 15 nt, Human
uugucuuaaaaagug

SEQ ID NO: 2945862 - RNA, 15 nt, Human
uugucuagugaaacu

SEQ ID NO: 2945863 - RNA, 16 nt, Human
uuauuaacaaaacagu

SEQ ID NO: 2945864 - RNA, 19 nt, Human
uuauuaagagguaagacuu

SEQ ID NO: 2945865 - RNA, 18 nt, Human
uuauuaagagguaagacu

SEQ ID NO: 2945866 - RNA, 21 nt, Human
uuauuaaaugcccagccccuu

SEQ ID NO: 2945867 - RNA, 19 nt, Human
uuauuaaaugcccagcccc

SEQ ID NO: 2945868 - RNA, 23 nt, Human
uuauuaaaaaucucaaauuucua

SEQ ID NO: 2945869 - RNA, 21 nt, Human
uuaugauugccuuuuuauaac

SEQ ID NO: 2945870 - RNA, 17 nt, Human
uuauggaacacucugag

SEQ ID NO: 2945871 - RNA, 21 nt, Human
uuauggacaaugacccagugg

SEQ ID NO: 2945872 - RNA, 20 nt, Human
uuauggaacacucugagacu

SEQ ID NO: 2945873 - RNA, 18 nt, Human
uuauggaacacucugaga

SEQ ID NO: 2945874 - RNA, 17 nt, Human
uuauggcuuuugugcau

SEQ ID NO: 2945875 - RNA, 14 nt, Human
uuauggcacaucag

SEQ ID NO: 2945876 - RNA, 18 nt, Human
uuauggcuauaggugcua

SEQ ID NO: 2945877 - RNA, 16 nt, Human
uuauggcuuuugugca

SEQ ID NO: 2945878 - RNA, 11 nt, Human
uuauccucugu

SEQ ID NO: 2945879 - RNA, 13 nt, Human
uuauauuugaaau

SEQ ID NO: 2945880 - RNA, 12 nt, Human
uuauauuugaaa

SEQ ID NO: 2945881 - RNA, 20 nt, Human
uuauauuuauuacuguaaga

SEQ ID NO: 2945882 - RNA, 16 nt, Human
uuauauuuacaaaugg

SEQ ID NO: 2945883 - RNA, 13 nt, Human
uuaucuuacgaaa

SEQ ID NO: 2945884 - RNA, 11 nt, Human
uuaucucaaaa

SEQ ID NO: 2945885 - RNA, 22 nt, Human
uuaugauuaaguaaugauaacu

SEQ ID NO: 2945886 - RNA, 15 nt, Human
uuaugauugccuuuu

SEQ ID NO: 2945887 - RNA, 19 nt, Human
uuauaucuauauuuuacau

SEQ ID NO: 2945888 - RNA, 23 nt, Human
uuauaucuauauuuuacauaaau

SEQ ID NO: 2945889 - RNA, 13 nt, Human
uuauacauaaaca

SEQ ID NO: 2945890 - RNA, 11 nt, Human
uuauacauaaa

SEQ ID NO: 2945891 - RNA, 18 nt, Human
uuauaauuuugugaagca

SEQ ID NO: 2945892 - RNA, 16 nt, Human
uuauaauuuugugaag

SEQ ID NO: 2945893 - RNA, 17 nt, Human
uuauaauuuugugaagc

SEQ ID NO: 2945894 - RNA, 16 nt, Human
uuauauucucagcaga

SEQ ID NO: 2945895 - RNA, 18 nt, Human
uuauauucucagcagagu

SEQ ID NO: 2945896 - RNA, 19 nt, Human
uuauauucucagcagagug

SEQ ID NO: 2945897 - RNA, 20 nt, Human
uuauauucucagcagagugc

SEQ ID NO: 2945898 - RNA, 21 nt, Human
uuauauucucagcagagugcu

SEQ ID NO: 2945899 - RNA, 17 nt, Human
ugugaaaagaaaaauga

SEQ ID NO: 2945900 - RNA, 15 nt, Human
ugugaaaagaaaaau

SEQ ID NO: 2945901 - RNA, 13 nt, Human
ugugaaaagaaaa

SEQ ID NO: 2945902 - RNA, 14 nt, Human
uuagugauguaauu

SEQ ID NO: 2945903 - RNA, 18 nt, Human
uuauaauaauguuaacau

SEQ ID NO: 2945904 - RNA, 15 nt, Human
uuauaauaauguuaa

SEQ ID NO: 2945905 - RNA, 11 nt, Human
uuauaaucuuu

SEQ ID NO: 2945906 - RNA, 15 nt, Human
uuauaaugaaugaaa

SEQ ID NO: 2945907 - RNA, 14 nt, Human
uuauaauuuuguga

SEQ ID NO: 2945908 - RNA, 15 nt, Human
uuauaauuuugugaa

SEQ ID NO: 2945909 - RNA, 12 nt, Human
uuauaauuuaaa

SEQ ID NO: 2945910 - RNA, 16 nt, Human
uuccaaaguacacugu

SEQ ID NO: 2945911 - RNA, 13 nt, Human
uuccaaaguacac

SEQ ID NO: 2945912 - RNA, 15 nt, Human
uuccauggacuuugu

SEQ ID NO: 2945913 - RNA, 14 nt, Human
uuccauggacuuug

SEQ ID NO: 2945914 - RNA, 19 nt, Human
uuccaacccucaucaccaa

SEQ ID NO: 2945915 - RNA, 18 nt, Human
uuccagauccuggaaauc

SEQ ID NO: 2945916 - RNA, 21 nt, Human
uucagcugguugagguuucaa

SEQ ID NO: 2945917 - RNA, 12 nt, Human
uucagcuccagc

SEQ ID NO: 2945918 - RNA, 15 nt, Human
uucagcuccagcuca

SEQ ID NO: 2945919 - RNA, 22 nt, Human
uucagcuuguaaauagcucagg

SEQ ID NO: 2945920 - RNA, 14 nt, Human
uucaguggcagcug

SEQ ID NO: 2945921 - RNA, 13 nt, Human
uucaguggcagcu

SEQ ID NO: 2945922 - RNA, 13 nt, Human
uucaguguacaug

SEQ ID NO: 2945923 - RNA, 12 nt, Human
uucaguguacau

SEQ ID NO: 2945924 - RNA, 17 nt, Human
uucaguggcagcugcuu

SEQ ID NO: 2945925 - RNA, 15 nt, Human
uucaguggcagcugc

SEQ ID NO: 2945926 - RNA, 16 nt, Human
uucaguggcagcugcu

SEQ ID NO: 2945927 - RNA, 15 nt, Human
uucauaaccuagccu

SEQ ID NO: 2945928 - RNA, 19 nt, Human
uucauccuccucagaucuu

SEQ ID NO: 2945929 - RNA, 15 nt, Human
uucauccuccucaga

SEQ ID NO: 2945930 - RNA, 23 nt, Human
uucaguuauuauauuuacaaaug

SEQ ID NO: 2945931 - RNA, 12 nt, Human
uucaauaacugg

SEQ ID NO: 2945932 - RNA, 16 nt, Human
uucaauaacuggaaca

SEQ ID NO: 2945933 - RNA, 22 nt, Human
uucaauaacuggaacacucuau

SEQ ID NO: 2945934 - RNA, 18 nt, Human
uucaaauguauuacagug

SEQ ID NO: 2945935 - RNA, 21 nt, Human
uucaacagguuuuccugaaga

SEQ ID NO: 2945936 - RNA, 22 nt, Human
uuauuuuggaaaauaaauuauu

SEQ ID NO: 2945937 - RNA, 17 nt, Human
uucaaauccuugaagau

SEQ ID NO: 2945938 - RNA, 18 nt, Human
uucaaaugcuguaacuuu

SEQ ID NO: 2945939 - RNA, 20 nt, Human
uuauuuggaaaggaaugcaa

SEQ ID NO: 2945940 - RNA, 21 nt, Human
uuauuugcagugcaguauaga

SEQ ID NO: 2945941 - RNA, 22 nt, Human
uuauuugaguggaguuacugaa

SEQ ID NO: 2945942 - RNA, 16 nt, Human
uuauuuggaaaggaau

SEQ ID NO: 2945943 - RNA, 17 nt, Human
uuauuuuaauaauguuu

SEQ ID NO: 2945944 - RNA, 19 nt, Human
uuauuuuaauaauguuuca

SEQ ID NO: 2945945 - RNA, 20 nt, Human
uuauuuuaauaauguuucaa

SEQ ID NO: 2945946 - RNA, 18 nt, Human
uuauuuuauuaugcauga

SEQ ID NO: 2945947 - RNA, 13 nt, Human
uucacccuuuucu

SEQ ID NO: 2945948 - RNA, 14 nt, Human
uucaccuuuguccc

SEQ ID NO: 2945949 - RNA, 20 nt, Human
uucaccuuuguccccaccgc

SEQ ID NO: 2945950 - RNA, 19 nt, Human
uucaccuuuguccccaccg

SEQ ID NO: 2945951 - RNA, 16 nt, Human
uucacaaaguaauuug

SEQ ID NO: 2945952 - RNA, 18 nt, Human
uucacaaaguaauuugga

SEQ ID NO: 2945953 - RNA, 21 nt, Human
uucaauaggaaaaacugauuu

SEQ ID NO: 2945954 - RNA, 22 nt, Human
uucaauaggaaaaacugauuuu

SEQ ID NO: 2945955 - RNA, 17 nt, Human
uucaccuccuaaaacaa

SEQ ID NO: 2945956 - RNA, 22 nt, Human
uucaccuuuguccccaccgcag

SEQ ID NO: 2945957 - RNA, 14 nt, Human
uucacgcccuuggc

SEQ ID NO: 2945958 - RNA, 13 nt, Human
uucacggaagagc

SEQ ID NO: 2945959 - RNA, 16 nt, Human
uucagacagcugccug

SEQ ID NO: 2945960 - RNA, 15 nt, Human
uucagacagcugccu

SEQ ID NO: 2945961 - RNA, 14 nt, Human
uucagacagcugcc

SEQ ID NO: 2945962 - RNA, 17 nt, Human
uucacggaagagccuug

SEQ ID NO: 2945963 - RNA, 14 nt, Human
uucagagcugcccu

SEQ ID NO: 2945964 - RNA, 15 nt, Human
uucagagcugcccuc

SEQ ID NO: 2945965 - RNA, 17 nt, Human
uucagagcugcccucuc

SEQ ID NO: 2945966 - RNA, 17 nt, Human
uucagacagcugccugg

SEQ ID NO: 2945967 - RNA, 18 nt, Human
uucagagcugcccucucc

SEQ ID NO: 2945968 - RNA, 19 nt, Human
uucagagcugcccucuccu

SEQ ID NO: 2945969 - RNA, 20 nt, Human
uucagagcugcccucuccug

SEQ ID NO: 2945970 - RNA, 20 nt, Human
uucagauaaucacaauacau

SEQ ID NO: 2945971 - RNA, 12 nt, Human
uucuacccagcg

SEQ ID NO: 2945972 - RNA, 19 nt, Human
uucuacccagcgagcccug

SEQ ID NO: 2945973 - RNA, 15 nt, Human
uucuacauacuaugg

SEQ ID NO: 2945974 - RNA, 13 nt, Human
uucuacgccaggg

SEQ ID NO: 2945975 - RNA, 20 nt, Human
uucuacccagcgagcccugg

SEQ ID NO: 2945976 - RNA, 21 nt, Human
uucuacccagcgagcccuggu

SEQ ID NO: 2945977 - RNA, 14 nt, Human
uucuacccaggugc

SEQ ID NO: 2945978 - RNA, 21 nt, Human
uucuauauaauuccuguuuuu

SEQ ID NO: 2945979 - RNA, 22 nt, Human
uucuacucgaguuacagacaaa

SEQ ID NO: 2945980 - RNA, 21 nt, Human
uucuauaauuuccauuuacuu

SEQ ID NO: 2945981 - RNA, 16 nt, Human
uuccauggccucuuca

SEQ ID NO: 2945982 - RNA, 12 nt, Human
uuccauggccuc

SEQ ID NO: 2945983 - RNA, 15 nt, Human
uuccugaggcugggc

SEQ ID NO: 2945984 - RNA, 20 nt, Human
uuccugaggcugggcucccu

SEQ ID NO: 2945985 - RNA, 23 nt, Human
uuccugaugcuucuucagagacu

SEQ ID NO: 2945986 - RNA, 14 nt, Human
uuccugcugagccu

SEQ ID NO: 2945987 - RNA, 21 nt, Human
uuccuugaguugauucagcuc

SEQ ID NO: 2945988 - RNA, 18 nt, Human
uucggugagcuacaaaug

SEQ ID NO: 2945989 - RNA, 20 nt, Human
uucuccaccugccagggaca

SEQ ID NO: 2945990 - RNA, 18 nt, Human
uucuccaccugccaggga

SEQ ID NO: 2945991 - RNA, 16 nt, Human
uucuccaccugccagg

SEQ ID NO: 2945992 - RNA, 15 nt, Human
uucuccaccugccag

SEQ ID NO: 2945993 - RNA, 14 nt, Human
uucuccaccugcca

SEQ ID NO: 2945994 - RNA, 12 nt, Human
uucuccaccugc

SEQ ID NO: 2945995 - RNA, 21 nt, Human
uucuccaccucccacaaagga

SEQ ID NO: 2945996 - RNA, 16 nt, Human
uucuccacccugcucu

SEQ ID NO: 2945997 - RNA, 14 nt, Human
uucuaugaaauauu

SEQ ID NO: 2945998 - RNA, 22 nt, Human
uucucauguugaaacuuuaaga

SEQ ID NO: 2945999 - RNA, 21 nt, Human
uucuaugaaauauuauguuaa

SEQ ID NO: 2946000 - RNA, 14 nt, Human
uucucuccagcccc

SEQ ID NO: 2946001 - RNA, 13 nt, Human
uucucuccagccc

SEQ ID NO: 2946002 - RNA, 16 nt, Human
uucucuccagccccug

SEQ ID NO: 2946003 - RNA, 15 nt, Human
uucucuccagccccu

SEQ ID NO: 2946004 - RNA, 14 nt, Human
uucucuccuguacc

SEQ ID NO: 2946005 - RNA, 18 nt, Human
uucucuccuguaccucuu

SEQ ID NO: 2946006 - RNA, 14 nt, Human
uucucugaggacac

SEQ ID NO: 2946007 - RNA, 20 nt, Human
uucucugaggacacuaacca

SEQ ID NO: 2946008 - RNA, 12 nt, Human
uucucugcccuc

SEQ ID NO: 2946009 - RNA, 11 nt, Human
uucucugcccu

SEQ ID NO: 2946010 - RNA, 19 nt, Human
uucucuccuguaccucuug

SEQ ID NO: 2946011 - RNA, 23 nt, Human
uucucuccucuccccaugauguu

SEQ ID NO: 2946012 - RNA, 19 nt, Human
uucugauccuaguuccacc

SEQ ID NO: 2946013 - RNA, 19 nt, Human
uucugcucacauaucuguc

SEQ ID NO: 2946014 - RNA, 21 nt, Human
uucugagaaagacuauucaaa

SEQ ID NO: 2946015 - RNA, 16 nt, Human
uucugagaaagacuau

SEQ ID NO: 2946016 - RNA, 18 nt, Human
uucugacccugcuucaaa

SEQ ID NO: 2946017 - RNA, 21 nt, Human
uucugacccugcuucaaauau

SEQ ID NO: 2946018 - RNA, 22 nt, Human
uucugacccaugcugcccugug

SEQ ID NO: 2946019 - RNA, 23 nt, Human
uucugacccaugcugcccuguga

SEQ ID NO: 2946020 - RNA, 17 nt, Human
uucucugcccuccaaga

SEQ ID NO: 2946021 - RNA, 16 nt, Human
uucucugcccuccaag

SEQ ID NO: 2946022 - RNA, 18 nt, Human
uugaacuggguacuugug

SEQ ID NO: 2946023 - RNA, 13 nt, Human
uugaacuuugacc

SEQ ID NO: 2946024 - RNA, 14 nt, Human
uugaauuguaagga

SEQ ID NO: 2946025 - RNA, 12 nt, Human
uugaauuuuaca

SEQ ID NO: 2946026 - RNA, 21 nt, Human
uugacuauuuuuguuuuuauu

SEQ ID NO: 2946027 - RNA, 15 nt, Human
uugacgccaucccag

SEQ ID NO: 2946028 - RNA, 19 nt, Human
uugacgccaucccagcccc

SEQ ID NO: 2946029 - RNA, 18 nt, Human
uugacgccaucccagccc

SEQ ID NO: 2946030 - RNA, 17 nt, Human
uugacgccaucccagcc

SEQ ID NO: 2946031 - RNA, 16 nt, Human
uugaccucugcagcaa

SEQ ID NO: 2946032 - RNA, 21 nt, Human
uugaccucaggugauccaccc

SEQ ID NO: 2946033 - RNA, 14 nt, Human
uugaccucugcagc

SEQ ID NO: 2946034 - RNA, 15 nt, Human
uugaccucugcagca

SEQ ID NO: 2946035 - RNA, 14 nt, Human
uugacccacaagaa

SEQ ID NO: 2946036 - RNA, 17 nt, Human
uugacccacaagaaaug

SEQ ID NO: 2946037 - RNA, 17 nt, Human
uugaccgugaggccaga

SEQ ID NO: 2946038 - RNA, 16 nt, Human
uugauugggcacauca

SEQ ID NO: 2946039 - RNA, 17 nt, Human
uugauugggcacaucau

SEQ ID NO: 2946040 - RNA, 22 nt, Human
uugauugggcacaucauuucaa

SEQ ID NO: 2946041 - RNA, 16 nt, Human
uugaugaucuuugcag

SEQ ID NO: 2946042 - RNA, 22 nt, Human
uugcaaauaaguguauuuugaa

SEQ ID NO: 2946043 - RNA, 21 nt, Human
uugcaaaguaucccuacugua

SEQ ID NO: 2946044 - RNA, 11 nt, Human
uugagccuggg

SEQ ID NO: 2946045 - RNA, 13 nt, Human
uugaggguugggc

SEQ ID NO: 2946046 - RNA, 16 nt, Human
uugaggguugggcugg

SEQ ID NO: 2946047 - RNA, 23 nt, Human
uugauagcacagacccugcccug

SEQ ID NO: 2946048 - RNA, 23 nt, Human
uugauauccucuuugagugaagc

SEQ ID NO: 2946049 - RNA, 23 nt, Human
uugaugaagaaguugauaugccu

SEQ ID NO: 2946050 - RNA, 13 nt, Human
uugaugaagaagu

SEQ ID NO: 2946051 - RNA, 14 nt, Human
uugaugaagaaguu

SEQ ID NO: 2946052 - RNA, 17 nt, Human
uucugucuucacaacag

SEQ ID NO: 2946053 - RNA, 19 nt, Human
uucuguccuacucuguguc

SEQ ID NO: 2946054 - RNA, 15 nt, Human
uucuggauauagcua

SEQ ID NO: 2946055 - RNA, 18 nt, Human
uucuguauuuuguuuuug

SEQ ID NO: 2946056 - RNA, 15 nt, Human
uucuggacuaaaacu

SEQ ID NO: 2946057 - RNA, 19 nt, Human
uucugcuucagccucccga

SEQ ID NO: 2946058 - RNA, 15 nt, Human
uucugcuucagccuc

SEQ ID NO: 2946059 - RNA, 16 nt, Human
uucugcuucagccucc

SEQ ID NO: 2946060 - RNA, 14 nt, Human
uucugcuucagccu

SEQ ID NO: 2946061 - RNA, 20 nt, Human
uucuucccaauagcaaggcu

SEQ ID NO: 2946062 - RNA, 21 nt, Human
uucuuauacauuugauaaagu

SEQ ID NO: 2946063 - RNA, 21 nt, Human
uucuuccacaagagcccaggc

SEQ ID NO: 2946064 - RNA, 12 nt, Human
uucuuucagcca

SEQ ID NO: 2946065 - RNA, 14 nt, Human
uucuuuccaaagua

SEQ ID NO: 2946066 - RNA, 21 nt, Human
uucuuguguguuuauugucaa

SEQ ID NO: 2946067 - RNA, 13 nt, Human
uucuuccucccuc

SEQ ID NO: 2946068 - RNA, 14 nt, Human
uucuuguguguuua

SEQ ID NO: 2946069 - RNA, 15 nt, Human
uugaacuccuggccu

SEQ ID NO: 2946070 - RNA, 16 nt, Human
uugaacuccuggccuc

SEQ ID NO: 2946071 - RNA, 21 nt, Human
uucuuuccaaaguacacuguu

SEQ ID NO: 2946072 - RNA, 20 nt, Human
uugaaaaaccauuuugcugu

SEQ ID NO: 2946073 - RNA, 23 nt, Human
uugaaaacacuguucucugcccu

SEQ ID NO: 2946074 - RNA, 22 nt, Human
uugaaaacacuguucucugccc

SEQ ID NO: 2946075 - RNA, 19 nt, Human
cuccgcuuucuacccagcg

SEQ ID NO: 2946076 - RNA, 12 nt, Human
cucccaccucag

SEQ ID NO: 2946077 - RNA, 14 nt, Human
cucccugcaauaaa

SEQ ID NO: 2946078 - RNA, 16 nt, Human
cucccugcaauaaaau

SEQ ID NO: 2946079 - RNA, 22 nt, Human
cuccagucauuauguuaauauu

SEQ ID NO: 2946080 - RNA, 11 nt, Human
cuccaggugca

SEQ ID NO: 2946081 - RNA, 20 nt, Human
cuccacuuucuagccagagg

SEQ ID NO: 2946082 - RNA, 22 nt, Human
cuccacuuucuagccagaggag

SEQ ID NO: 2946083 - RNA, 15 nt, Human
cuccaagaccuucuc

SEQ ID NO: 2946084 - RNA, 16 nt, Human
cuccaagaccuucucc

SEQ ID NO: 2946085 - RNA, 18 nt, Human
cuccaagaccuucuccuu

SEQ ID NO: 2946086 - RNA, 17 nt, Human
cuccaagaccuucuccu

SEQ ID NO: 2946087 - RNA, 18 nt, Human
cuccagaauuucccaaag

SEQ ID NO: 2946088 - RNA, 15 nt, Human
cuccagaauuuccca

SEQ ID NO: 2946089 - RNA, 19 nt, Human
cuccagacacauguccaag

SEQ ID NO: 2946090 - RNA, 17 nt, Human
cuccagacacaugucca

SEQ ID NO: 2946091 - RNA, 13 nt, Human
cucaggccugggg

SEQ ID NO: 2946092 - RNA, 20 nt, Human
cucaggccugggggcugggc

SEQ ID NO: 2946093 - RNA, 14 nt, Human
cucaggccuggggg

SEQ ID NO: 2946094 - RNA, 21 nt, Human
cucaggccugggggcugggca

SEQ ID NO: 2946095 - RNA, 23 nt, Human
cucagccucccgaauagcuggga

SEQ ID NO: 2946096 - RNA, 22 nt, Human
cucagccucccaaagugcuggg

SEQ ID NO: 2946097 - RNA, 13 nt, Human
cucagccucccga

SEQ ID NO: 2946098 - RNA, 21 nt, Human
cucagccucccaaagugcugg

SEQ ID NO: 2946099 - RNA, 14 nt, Human
cucagccucccaaa

SEQ ID NO: 2946100 - RNA, 16 nt, Human
cucagccucccaaagu

SEQ ID NO: 2946101 - RNA, 13 nt, Human
cucagccucccaa

SEQ ID NO: 2946102 - RNA, 13 nt, Human
cucaggccagcug

SEQ ID NO: 2946103 - RNA, 22 nt, Human
cucaggccagcugcuugggcuu

SEQ ID NO: 2946104 - RNA, 21 nt, Human
cucaggccagcugcuugggcu

SEQ ID NO: 2946105 - RNA, 20 nt, Human
cucaggccagcugcuugggc

SEQ ID NO: 2946106 - RNA, 14 nt, Human
cucaggccagcugc

SEQ ID NO: 2946107 - RNA, 12 nt, Human
cucaugcugcca

SEQ ID NO: 2946108 - RNA, 22 nt, Human
cucaugcugccaauauccuaau

SEQ ID NO: 2946109 - RNA, 14 nt, Human
cucaugcugccaau

SEQ ID NO: 2946110 - RNA, 12 nt, Human
cucauguucuua

SEQ ID NO: 2946111 - RNA, 14 nt, Human
cucauguucuuaau

SEQ ID NO: 2946112 - RNA, 18 nt, Human
cucauguucuuaauucuu

SEQ ID NO: 2946113 - RNA, 19 nt, Human
cucauguucuuaauucuua

SEQ ID NO: 2946114 - RNA, 13 nt, Human
cucagugccacua

SEQ ID NO: 2946115 - RNA, 17 nt, Human
cucagucuggcccuucc

SEQ ID NO: 2946116 - RNA, 18 nt, Human
cucagucuggcccuuccu

SEQ ID NO: 2946117 - RNA, 15 nt, Human
cucugaaggacauug

SEQ ID NO: 2946118 - RNA, 11 nt, Human
cucucuggccu

SEQ ID NO: 2946119 - RNA, 12 nt, Human
cucucuggccuu

SEQ ID NO: 2946120 - RNA, 21 nt, Human
cucuccgaccagacaccuuga

SEQ ID NO: 2946121 - RNA, 13 nt, Human
cucuauuucugga

SEQ ID NO: 2946122 - RNA, 14 nt, Human
cucucacuccuuga

SEQ ID NO: 2946123 - RNA, 12 nt, Human
cucucacuccuu

SEQ ID NO: 2946124 - RNA, 15 nt, Human
cucucacuccuugaa

SEQ ID NO: 2946125 - RNA, 21 nt, Human
cucucacuuguuuuauuuaac

SEQ ID NO: 2946126 - RNA, 19 nt, Human
cucucagauuguaccauug

SEQ ID NO: 2946127 - RNA, 13 nt, Human
cucugcagcaaua

SEQ ID NO: 2946128 - RNA, 23 nt, Human
cucugcagcaauaaagcagcguu

SEQ ID NO: 2946129 - RNA, 18 nt, Human
cucugcagcaauaaagca

SEQ ID NO: 2946130 - RNA, 19 nt, Human
cucugcagcaauaaagcag

SEQ ID NO: 2946131 - RNA, 15 nt, Human
cucugguuaucuaau

SEQ ID NO: 2946132 - RNA, 19 nt, Human
cucugguccauagagagca

SEQ ID NO: 2946133 - RNA, 18 nt, Human
cucugguccauagagagc

SEQ ID NO: 2946134 - RNA, 16 nt, Human
cucugguccauagaga

SEQ ID NO: 2946135 - RNA, 17 nt, Human
cucugcugacagacaca

SEQ ID NO: 2946136 - RNA, 18 nt, Human
cucugcugacagacacag

SEQ ID NO: 2946137 - RNA, 19 nt, Human
cucugcugacagacacagg

SEQ ID NO: 2946138 - RNA, 15 nt, Human
cucugguccauagag

SEQ ID NO: 2946139 - RNA, 21 nt, Human
cucuguacagagcccacgccc

SEQ ID NO: 2946140 - RNA, 17 nt, Human
cucuguacagagcccac

SEQ ID NO: 2946141 - RNA, 15 nt, Human
cucuuagaugcaguu

SEQ ID NO: 2946142 - RNA, 15 nt, Human
cugacagacacaggc

SEQ ID NO: 2946143 - RNA, 12 nt, Human
cugacagacaca

SEQ ID NO: 2946144 - RNA, 14 nt, Human
cugacagacacagg

SEQ ID NO: 2946145 - RNA, 23 nt, Human
cugacccugcuucaaauauuucc

SEQ ID NO: 2946146 - RNA, 20 nt, Human
cugacccaugcugcccugug

SEQ ID NO: 2946147 - RNA, 19 nt, Human
cugacccaugcugcccugu

SEQ ID NO: 2946148 - RNA, 17 nt, Human
cugacccaugcugcccu

SEQ ID NO: 2946149 - RNA, 18 nt, Human
cugacccaugcugcccug

SEQ ID NO: 2946150 - RNA, 16 nt, Human
cugaaaauguaugugu

SEQ ID NO: 2946151 - RNA, 19 nt, Human
cugaaggacauugcggaca

SEQ ID NO: 2946152 - RNA, 20 nt, Human
cugaaggacauugcggacag

SEQ ID NO: 2946153 - RNA, 21 nt, Human
cugaaggacauugcggacagc

SEQ ID NO: 2946154 - RNA, 17 nt, Human
cugaaggccccgcccag

SEQ ID NO: 2946155 - RNA, 17 nt, Human
cugaaggcuggguucug

SEQ ID NO: 2946156 - RNA, 14 nt, Human
cugaaggccccgcc

SEQ ID NO: 2946157 - RNA, 13 nt, Human
cugaaggccccgc

SEQ ID NO: 2946158 - RNA, 20 nt, Human
cucuuagaugcaguucugaa

SEQ ID NO: 2946159 - RNA, 12 nt, Human
ccuuuuuuauac

SEQ ID NO: 2946160 - RNA, 23 nt, Human
cgaccagacaccuugacagggca

SEQ ID NO: 2946161 - RNA, 15 nt, Human
cgacagugagacucu

SEQ ID NO: 2946162 - RNA, 16 nt, Human
cgacagugagacucug

SEQ ID NO: 2946163 - RNA, 17 nt, Human
ccuuuuuuauacauaaa

SEQ ID NO: 2946164 - RNA, 18 nt, Human
ccuuuuuuauacauaaac

SEQ ID NO: 2946165 - RNA, 21 nt, Human
ccuuggacauuuuaugucuuu

SEQ ID NO: 2946166 - RNA, 18 nt, Human
ccuuggacauuuuauguc

SEQ ID NO: 2946167 - RNA, 16 nt, Human
ccuuggacauuuuaug

SEQ ID NO: 2946168 - RNA, 14 nt, Human
ccuuuagcgcccag

SEQ ID NO: 2946169 - RNA, 20 nt, Human
ccuuuagcgcccaguugggu

SEQ ID NO: 2946170 - RNA, 20 nt, Human
ccuuuucgcaggauucuucc

SEQ ID NO: 2946171 - RNA, 17 nt, Human
ccuugcccagccuggau

SEQ ID NO: 2946172 - RNA, 20 nt, Human
ccuugccgucuaccugaggg

SEQ ID NO: 2946173 - RNA, 14 nt, Human
ccuugcccagccug

SEQ ID NO: 2946174 - RNA, 16 nt, Human
ccuugcccagccugga

SEQ ID NO: 2946175 - RNA, 13 nt, Human
ccuugcccagccu

SEQ ID NO: 2946176 - RNA, 17 nt, Human
ccuugccgucuaccuga

SEQ ID NO: 2946177 - RNA, 20 nt, Human
ccuggccugagcugggauga

SEQ ID NO: 2946178 - RNA, 15 nt, Human
ccuggccugagcugg

SEQ ID NO: 2946179 - RNA, 14 nt, Human
ccuggccugagcug

SEQ ID NO: 2946180 - RNA, 20 nt, Human
ccuucugacccaugcugccc

SEQ ID NO: 2946181 - RNA, 17 nt, Human
ccuucugacccaugcug

SEQ ID NO: 2946182 - RNA, 16 nt, Human
ccuucugacccaugcu

SEQ ID NO: 2946183 - RNA, 12 nt, Human
ccuucugaccca

SEQ ID NO: 2946184 - RNA, 22 nt, Human
ccuucuggaauaaggagaauga

SEQ ID NO: 2946185 - RNA, 23 nt, Human
ccuucugacccaugcugcccugu

SEQ ID NO: 2946186 - RNA, 22 nt, Human
ccuucugacccaugcugcccug

SEQ ID NO: 2946187 - RNA, 21 nt, Human
ccuucugacccaugcugcccu

SEQ ID NO: 2946188 - RNA, 12 nt, Human
cgccaaggcugg

SEQ ID NO: 2946189 - RNA, 16 nt, Human
cgccaaggcuggggga

SEQ ID NO: 2946190 - RNA, 13 nt, Human
cgccaaggcuggg

SEQ ID NO: 2946191 - RNA, 18 nt, Human
cgaguuacagacaaagcg

SEQ ID NO: 2946192 - RNA, 17 nt, Human
cgaguuacagacaaagc

SEQ ID NO: 2946193 - RNA, 13 nt, Human
cgaguagcuggga

SEQ ID NO: 2946194 - RNA, 14 nt, Human
cgaguagcugggac

SEQ ID NO: 2946195 - RNA, 15 nt, Human
cgaguagcugggacu

SEQ ID NO: 2946196 - RNA, 17 nt, Human
cggagcacacuggcuca

SEQ ID NO: 2946197 - RNA, 17 nt, Human
cggcucacugcagccuc

SEQ ID NO: 2946198 - RNA, 19 nt, Human
cggcucacugcagccucaa

SEQ ID NO: 2946199 - RNA, 18 nt, Human
cggcucacugcagccuca

SEQ ID NO: 2946200 - RNA, 15 nt, Human
cggccuuuggcuuca

SEQ ID NO: 2946201 - RNA, 14 nt, Human
cggagucccaccuu

SEQ ID NO: 2946202 - RNA, 18 nt, Human
cuaagugaggaugaaaaa

SEQ ID NO: 2946203 - RNA, 20 nt, Human
cuaagugauccucccaccuc

SEQ ID NO: 2946204 - RNA, 22 nt, Human
cuaagugauccucccaccucag

SEQ ID NO: 2946205 - RNA, 13 nt, Human
cuacaguugaaaa

SEQ ID NO: 2946206 - RNA, 18 nt, Human
cuacaguccucccaucuc

SEQ ID NO: 2946207 - RNA, 17 nt, Human
cuacaguccucccaucu

SEQ ID NO: 2946208 - RNA, 16 nt, Human
cuacaguccucccauc

SEQ ID NO: 2946209 - RNA, 15 nt, Human
cuacaguccucccau

SEQ ID NO: 2946210 - RNA, 18 nt, Human
cuacauacaauuccaaac

SEQ ID NO: 2946211 - RNA, 15 nt, Human
cuacaugagguacug

SEQ ID NO: 2946212 - RNA, 20 nt, Human
cuaagugaaauaagccagac

SEQ ID NO: 2946213 - RNA, 23 nt, Human
cuaagugaaauaagccagacauc

SEQ ID NO: 2946214 - RNA, 16 nt, Human
cuaacuucaccauauu

SEQ ID NO: 2946215 - RNA, 16 nt, Human
cuaacuuuccuucauu

SEQ ID NO: 2946216 - RNA, 15 nt, Human
cuaacuucaccauau

SEQ ID NO: 2946217 - RNA, 14 nt, Human
cuaguuccaccauc

SEQ ID NO: 2946218 - RNA, 20 nt, Human
cuaguuccaccaucaagcca

SEQ ID NO: 2946219 - RNA, 18 nt, Human
cuaguuccaccaucaagc

SEQ ID NO: 2946220 - RNA, 21 nt, Human
cuagggaaaaaccagcgugug

SEQ ID NO: 2946221 - RNA, 19 nt, Human
cuagggaaaaaccagcgug

SEQ ID NO: 2946222 - RNA, 22 nt, Human
cuauaacaaaggauacuuauuu

SEQ ID NO: 2946223 - RNA, 18 nt, Human
cuauaacaaaggauacuu

SEQ ID NO: 2946224 - RNA, 23 nt, Human
cuaguugaucagcuuauugucua

SEQ ID NO: 2946225 - RNA, 22 nt, Human
cuaguuccaccaucaagccacc

SEQ ID NO: 2946226 - RNA, 14 nt, Human
cuaccugaggggcc

SEQ ID NO: 2946227 - RNA, 11 nt, Human
cuaccugaggg

SEQ ID NO: 2946228 - RNA, 19 nt, Human
cuagaaauuccccacccug

SEQ ID NO: 2946229 - RNA, 23 nt, Human
cuagcagcagggagggcuucugc

SEQ ID NO: 2946230 - RNA, 16 nt, Human
cuagcaugaagacaga

SEQ ID NO: 2946231 - RNA, 17 nt, Human
cuagcauggcugccaau

SEQ ID NO: 2946232 - RNA, 12 nt, Human
cuagcagcaggg

SEQ ID NO: 2946233 - RNA, 22 nt, Human
cuagcagcagggagggcuucug

SEQ ID NO: 2946234 - RNA, 16 nt, Human
cuagaacucccuuuca

SEQ ID NO: 2946235 - RNA, 17 nt, Human
cuagaacucccuuucaa

SEQ ID NO: 2946236 - RNA, 18 nt, Human
cuagaacucccuuucaac

SEQ ID NO: 2946237 - RNA, 19 nt, Human
cuagaacucccuuucaaca

SEQ ID NO: 2946238 - RNA, 13 nt, Human
cccugcccugugg

SEQ ID NO: 2946239 - RNA, 12 nt, Human
cccugcccugug

SEQ ID NO: 2946240 - RNA, 11 nt, Human
cccugcccugu

SEQ ID NO: 2946241 - RNA, 14 nt, Human
cccugcccuguggg

SEQ ID NO: 2946242 - RNA, 15 nt, Human
cccugcccugugggc

SEQ ID NO: 2946243 - RNA, 20 nt, Human
cccugcccugugggccccca

SEQ ID NO: 2946244 - RNA, 16 nt, Human
cccugcccugugggcc

SEQ ID NO: 2946245 - RNA, 13 nt, Human
cccuggcagcccc

SEQ ID NO: 2946246 - RNA, 12 nt, Human
cccuggcagccc

SEQ ID NO: 2946247 - RNA, 21 nt, Human
cccugcccugugggcccccaa

SEQ ID NO: 2946248 - RNA, 16 nt, Human
cccuggcagccccugu

SEQ ID NO: 2946249 - RNA, 14 nt, Human
cccuggcagccccu

SEQ ID NO: 2946250 - RNA, 16 nt, Human
ccgccaugcuccuggc

SEQ ID NO: 2946251 - RNA, 20 nt, Human
ccgcccaggcuuagucacug

SEQ ID NO: 2946252 - RNA, 18 nt, Human
ccgaccagacaccuugac

SEQ ID NO: 2946253 - RNA, 20 nt, Human
ccgaauagcugggacuacag

SEQ ID NO: 2946254 - RNA, 16 nt, Human
ccgacccuugccgucu

SEQ ID NO: 2946255 - RNA, 17 nt, Human
ccgccaaggcuggggga

SEQ ID NO: 2946256 - RNA, 16 nt, Human
cccuucgcuccugugu

SEQ ID NO: 2946257 - RNA, 18 nt, Human
cccuucgcuccugugucu

SEQ ID NO: 2946258 - RNA, 16 nt, Human
cccuucuaccuuccug

SEQ ID NO: 2946259 - RNA, 13 nt, Human
cccuucucuguau

SEQ ID NO: 2946260 - RNA, 21 nt, Human
cccuucugacccaugcugccc

SEQ ID NO: 2946261 - RNA, 23 nt, Human
cccuucugacccaugcugcccug

SEQ ID NO: 2946262 - RNA, 22 nt, Human
cccuucugacccaugcugcccu

SEQ ID NO: 2946263 - RNA, 19 nt, Human
ccuaggacccgucuccagc

SEQ ID NO: 2946264 - RNA, 20 nt, Human
ccuaggacccgucuccagcu

SEQ ID NO: 2946265 - RNA, 21 nt, Human
ccuaggacccgucuccagcug

SEQ ID NO: 2946266 - RNA, 22 nt, Human
ccuaggacccgucuccagcugc

SEQ ID NO: 2946267 - RNA, 18 nt, Human
ccuaggacccgucuccag

SEQ ID NO: 2946268 - RNA, 20 nt, Human
ccuaaguaucaaguauagaa

SEQ ID NO: 2946269 - RNA, 15 nt, Human
ccgucuccagcugcu

SEQ ID NO: 2946270 - RNA, 24 nt, Human
ccguagacgugcacgcacacuguc

SEQ ID NO: 2946271 - RNA, 16 nt, Human
ccguagguuauuuuca

SEQ ID NO: 2946272 - RNA, 16 nt, Human
ccucaaccuccugggc

SEQ ID NO: 2946273 - RNA, 11 nt, Human
ccucagccucc

SEQ ID NO: 2946274 - RNA, 22 nt, Human
ccucagccucccaaagugcugg

SEQ ID NO: 2946275 - RNA, 15 nt, Human
ccucaagagaaggca

SEQ ID NO: 2946276 - RNA, 15 nt, Human
ccucaacucuccucc

SEQ ID NO: 2946277 - RNA, 19 nt, Human
ccucauguucuuaauucuu

SEQ ID NO: 2946278 - RNA, 22 nt, Human
ccucccaaggggcccaaauucu

SEQ ID NO: 2946279 - RNA, 20 nt, Human
ccucauguccacugguucuu

SEQ ID NO: 2946280 - RNA, 13 nt, Human
ccucauguucuua

SEQ ID NO: 2946281 - RNA, 23 nt, Human
ccucagccucccaaagugcuggg

SEQ ID NO: 2946282 - RNA, 22 nt, Human
ccucagccucccgaauagcugg

SEQ ID NO: 2946283 - RNA, 15 nt, Human
ccucauguccacugg

SEQ ID NO: 2946284 - RNA, 15 nt, Human
ccuggaguucugguu

SEQ ID NO: 2946285 - RNA, 17 nt, Human
ccuggaguucugguucc

SEQ ID NO: 2946286 - RNA, 16 nt, Human
ccuggaguucugguuc

SEQ ID NO: 2946287 - RNA, 13 nt, Human
ccuggaugcagcc

SEQ ID NO: 2946288 - RNA, 19 nt, Human
ccuggaugcagccucacag

SEQ ID NO: 2946289 - RNA, 17 nt, Human
ccuggaugcagccucac

SEQ ID NO: 2946290 - RNA, 14 nt, Human
ccuggaugcagccu

SEQ ID NO: 2946291 - RNA, 20 nt, Human
ccugcuggguguggcgcagc

SEQ ID NO: 2946292 - RNA, 14 nt, Human
ccugcugggugugg

SEQ ID NO: 2946293 - RNA, 12 nt, Human
ccugcugggugu

SEQ ID NO: 2946294 - RNA, 14 nt, Human
ccugcccaggcccc

SEQ ID NO: 2946295 - RNA, 15 nt, Human
ccugcccaggccccu

SEQ ID NO: 2946296 - RNA, 22 nt, Human
ccugcccaggccccugccaccc

SEQ ID NO: 2946297 - RNA, 16 nt, Human
ccugcccaggccccug

SEQ ID NO: 2946298 - RNA, 12 nt, Human
ccuggccucugc

SEQ ID NO: 2946299 - RNA, 13 nt, Human
ccuggccugagcu

SEQ ID NO: 2946300 - RNA, 15 nt, Human
ccuggccucugcacu

SEQ ID NO: 2946301 - RNA, 14 nt, Human
ccuggccucugcac

SEQ ID NO: 2946302 - RNA, 18 nt, Human
ccugagagcugcaugugu

SEQ ID NO: 2946303 - RNA, 12 nt, Human
ccugagagcugc

SEQ ID NO: 2946304 - RNA, 19 nt, Human
ccugcacuugcagacucua

SEQ ID NO: 2946305 - RNA, 22 nt, Human
ccugcacuugcagacucuacag

SEQ ID NO: 2946306 - RNA, 13 nt, Human
ccucuuggguuca

SEQ ID NO: 2946307 - RNA, 13 nt, Human
ccucuugagccuu

SEQ ID NO: 2946308 - RNA, 19 nt, Human
ccucuugagccuugaacuu

SEQ ID NO: 2946309 - RNA, 21 nt, Human
ccucugccugaagucacacag

SEQ ID NO: 2946310 - RNA, 22 nt, Human
ccucugccugaagucacacagu

SEQ ID NO: 2946311 - RNA, 14 nt, Human
ccucugcugcuggc

SEQ ID NO: 2946312 - RNA, 13 nt, Human
ccucugcugcugg

SEQ ID NO: 2946313 - RNA, 18 nt, Human
ccucugcugcuggcuggu

SEQ ID NO: 2946314 - RNA, 17 nt, Human
ccucugcugcuggcugg

SEQ ID NO: 2946315 - RNA, 16 nt, Human
ccucugcugcuggcug

SEQ ID NO: 2946316 - RNA, 15 nt, Human
ccucugcugcuggcu

SEQ ID NO: 2946317 - RNA, 14 nt, Human
ccucucucaggcca

SEQ ID NO: 2946318 - RNA, 12 nt, Human
ccucucucaggc

SEQ ID NO: 2946319 - RNA, 17 nt, Human
ccucucucacuccuuga

SEQ ID NO: 2946320 - RNA, 15 nt, Human
ccucucucacuccuu

SEQ ID NO: 2946321 - RNA, 14 nt, Human
ccucucucacuccu

SEQ ID NO: 2946322 - RNA, 13 nt, Human
ccucucucacucc

SEQ ID NO: 2946323 - RNA, 12 nt, Human
ccucucucacuc

SEQ ID NO: 2946324 - RNA, 13 nt, Human
ccucugcuugcca

SEQ ID NO: 2946325 - RNA, 19 nt, Human
ccaggcuggcgugcagugg

SEQ ID NO: 2946326 - RNA, 17 nt, Human
ccaggcuggcgugcagu

SEQ ID NO: 2946327 - RNA, 18 nt, Human
ccaggcuggcgugcagug

SEQ ID NO: 2946328 - RNA, 16 nt, Human
ccaggcuggcgugcag

SEQ ID NO: 2946329 - RNA, 20 nt, Human
ccaggcuccuuuagcgccca

SEQ ID NO: 2946330 - RNA, 21 nt, Human
ccaggcuccuuuagcgcccag

SEQ ID NO: 2946331 - RNA, 19 nt, Human
ccaggggaaaaucagccug

SEQ ID NO: 2946332 - RNA, 13 nt, Human
ccaggggugggac

SEQ ID NO: 2946333 - RNA, 20 nt, Human
ccaggggaaaaucagccugc

SEQ ID NO: 2946334 - RNA, 17 nt, Human
ccaggggugggacaccc

SEQ ID NO: 2946335 - RNA, 14 nt, Human
ccaggggugggaca

SEQ ID NO: 2946336 - RNA, 23 nt, Human
ccaggggugggacacccugugau

SEQ ID NO: 2946337 - RNA, 17 nt, Human
ccaguuggguggaugcc

SEQ ID NO: 2946338 - RNA, 19 nt, Human
ccaguuggguggaugccug

SEQ ID NO: 2946339 - RNA, 20 nt, Human
ccaguuggguggaugccugg

SEQ ID NO: 2946340 - RNA, 21 nt, Human
ccaugucagacacagauuggc

SEQ ID NO: 2946341 - RNA, 13 nt, Human
ccaugucagacac

SEQ ID NO: 2946342 - RNA, 15 nt, Human
ccaugucagacacag

SEQ ID NO: 2946343 - RNA, 20 nt, Human
ccauggucggaaaacaugcu

SEQ ID NO: 2946344 - RNA, 21 nt, Human
ccaugagccucagcauccugg

SEQ ID NO: 2946345 - RNA, 23 nt, Human
ccaugagccucagcauccuggca

SEQ ID NO: 2946346 - RNA, 20 nt, Human
ccaucccugaaggccccgcc

SEQ ID NO: 2946347 - RNA, 17 nt, Human
ccaucccugaaggcccc

SEQ ID NO: 2946348 - RNA, 15 nt, Human
ccaucccugaaggcc

SEQ ID NO: 2946349 - RNA, 14 nt, Human
ccaucccugaaggc

SEQ ID NO: 2946350 - RNA, 23 nt, Human
ccaguuggucccccuuccaugga

SEQ ID NO: 2946351 - RNA, 15 nt, Human
ccaucccagccccaa

SEQ ID NO: 2946352 - RNA, 13 nt, Human
ccaucccagcccc

SEQ ID NO: 2946353 - RNA, 14 nt, Human
ccaucccagcccca

SEQ ID NO: 2946354 - RNA, 16 nt, Human
ccaggaaaggcuccag

SEQ ID NO: 2946355 - RNA, 15 nt, Human
ccaggaaaggcucca

SEQ ID NO: 2946356 - RNA, 14 nt, Human
ccaggaaaggcucc

SEQ ID NO: 2946357 - RNA, 12 nt, Human
ccaggaagccag

SEQ ID NO: 2946358 - RNA, 13 nt, Human
ccaggaagccagc

SEQ ID NO: 2946359 - RNA, 19 nt, Human
ccagcuuaaaggggcuaga

SEQ ID NO: 2946360 - RNA, 17 nt, Human
ccagcuguucagcuggu

SEQ ID NO: 2946361 - RNA, 22 nt, Human
ccagcucaccagccccagugcc

SEQ ID NO: 2946362 - RNA, 16 nt, Human
ccagcuguucagcugg

SEQ ID NO: 2946363 - RNA, 15 nt, Human
ccagcucaccagccc

SEQ ID NO: 2946364 - RNA, 16 nt, Human
ccagcucaccagcccc

SEQ ID NO: 2946365 - RNA, 12 nt, Human
ccagccccugga

SEQ ID NO: 2946366 - RNA, 11 nt, Human
ccagccccugg

SEQ ID NO: 2946367 - RNA, 15 nt, Human
ccagcaggcucucag

SEQ ID NO: 2946368 - RNA, 13 nt, Human
ccagcaggcucuc

SEQ ID NO: 2946369 - RNA, 18 nt, Human
ccagaugcaccagcccuu

SEQ ID NO: 2946370 - RNA, 17 nt, Human
ccagaugcaccagcccu

SEQ ID NO: 2946371 - RNA, 15 nt, Human
ccagaugcaccagcc

SEQ ID NO: 2946372 - RNA, 20 nt, Human
ccagagggccugcaagggag

SEQ ID NO: 2946373 - RNA, 16 nt, Human
ccaccuuggcucaagu

SEQ ID NO: 2946374 - RNA, 17 nt, Human
ccagagggccugcaagg

SEQ ID NO: 2946375 - RNA, 19 nt, Human
ccagagggccugcaaggga

SEQ ID NO: 2946376 - RNA, 18 nt, Human
ccagagggccugcaaggg

SEQ ID NO: 2946377 - RNA, 15 nt, Human
ccagauccuggaaau

SEQ ID NO: 2946378 - RNA, 14 nt, Human
cccgaauagcuggg

SEQ ID NO: 2946379 - RNA, 11 nt, Human
cccggcuccag

SEQ ID NO: 2946380 - RNA, 12 nt, Human
cccggcuccagg

SEQ ID NO: 2946381 - RNA, 14 nt, Human
cccggccaccugcg

SEQ ID NO: 2946382 - RNA, 13 nt, Human
cccggccaccugc

SEQ ID NO: 2946383 - RNA, 13 nt, Human
cccggcuccaggc

SEQ ID NO: 2946384 - RNA, 14 nt, Human
cccggcuccaggcu

SEQ ID NO: 2946385 - RNA, 15 nt, Human
cccggcuccaggcuc

SEQ ID NO: 2946386 - RNA, 16 nt, Human
cccggcuccaggcucc

SEQ ID NO: 2946387 - RNA, 17 nt, Human
cccggccaccugcggug

SEQ ID NO: 2946388 - RNA, 22 nt, Human
cccgggaagggggcugggacau

SEQ ID NO: 2946389 - RNA, 18 nt, Human
cccuauuagagaagagau

SEQ ID NO: 2946390 - RNA, 23 nt, Human
cccgggaggcagagguugcagug

SEQ ID NO: 2946391 - RNA, 23 nt, Human
ccccgaggccuucucugaaggac

SEQ ID NO: 2946392 - RNA, 14 nt, Human
ccccaucugcgggg

SEQ ID NO: 2946393 - RNA, 23 nt, Human
ccccgacccuugccgucuaccug

SEQ ID NO: 2946394 - RNA, 22 nt, Human
cccccaaauggaaaugggcaga

SEQ ID NO: 2946395 - RNA, 21 nt, Human
ccccagcaagugagagcuggg

SEQ ID NO: 2946396 - RNA, 22 nt, Human
ccccagcaauuaugaaaauaau

SEQ ID NO: 2946397 - RNA, 22 nt, Human
ccccagcaagugagagcugggu

SEQ ID NO: 2946398 - RNA, 23 nt, Human
ccccaaaacucuccucugcugcu

SEQ ID NO: 2946399 - RNA, 21 nt, Human
ccccaaaacucuccucugcug

SEQ ID NO: 2946400 - RNA, 22 nt, Human
cccauuguggucacaggaagua

SEQ ID NO: 2946401 - RNA, 23 nt, Human
cccauuguggucacaggaaguag

SEQ ID NO: 2946402 - RNA, 22 nt, Human
ccccaaaacucuccucugcugc

SEQ ID NO: 2946403 - RNA, 17 nt, Human
cccacccccacccaagg

SEQ ID NO: 2946404 - RNA, 15 nt, Human
cccacccccacccaa

SEQ ID NO: 2946405 - RNA, 12 nt, Human
cccacccccacc

SEQ ID NO: 2946406 - RNA, 18 nt, Human
cccacccaagggccuggc

SEQ ID NO: 2946407 - RNA, 18 nt, Human
cccacccugaaagcccug

SEQ ID NO: 2946408 - RNA, 22 nt, Human
cccacccaagggccuggccuga

SEQ ID NO: 2946409 - RNA, 21 nt, Human
cccacccaagggccuggccug

SEQ ID NO: 2946410 - RNA, 20 nt, Human
cccacccaagggccuggccu

SEQ ID NO: 2946411 - RNA, 19 nt, Human
cccacugcuuuuggucugu

SEQ ID NO: 2946412 - RNA, 12 nt, Human
cccacugcucug

SEQ ID NO: 2946413 - RNA, 13 nt, Human
cccacugcucugg

SEQ ID NO: 2946414 - RNA, 13 nt, Human
cccaggcuggcgu

SEQ ID NO: 2946415 - RNA, 17 nt, Human
cccaggcuggcgugcag

SEQ ID NO: 2946416 - RNA, 13 nt, Human
cccauccucugua

SEQ ID NO: 2946417 - RNA, 22 nt, Human
cccagcuuaaaggggcuagagu

SEQ ID NO: 2946418 - RNA, 16 nt, Human
cccagccagcaguuca

SEQ ID NO: 2946419 - RNA, 17 nt, Human
cccagccagcaguucag

SEQ ID NO: 2946420 - RNA, 20 nt, Human
cccagccagcaguucagagc

SEQ ID NO: 2946421 - RNA, 23 nt, Human
cccagcucugguccauagagagc

SEQ ID NO: 2946422 - RNA, 20 nt, Human
caaauggaaaugggcagagc

SEQ ID NO: 2946423 - RNA, 21 nt, Human
caaauggaaaugggcagagca

SEQ ID NO: 2946424 - RNA, 23 nt, Human
caacacgagcaggcuacugucag

SEQ ID NO: 2946425 - RNA, 15 nt, Human
caacacgagcaggcu

SEQ ID NO: 2946426 - RNA, 20 nt, Human
caacaccucugcacaagcug

SEQ ID NO: 2946427 - RNA, 15 nt, Human
caaagucuagguugg

SEQ ID NO: 2946428 - RNA, 14 nt, Human
caaaguagaagucu

SEQ ID NO: 2946429 - RNA, 21 nt, Human
caaaguagaagucuuagaugu

SEQ ID NO: 2946430 - RNA, 17 nt, Human
caaagcagugcaugcug

SEQ ID NO: 2946431 - RNA, 15 nt, Human
caaagcagugcaugc

SEQ ID NO: 2946432 - RNA, 22 nt, Human
caaaguacacuguuucaaacuu

SEQ ID NO: 2946433 - RNA, 22 nt, Human
caaagauauuuugcuuugugau

SEQ ID NO: 2946434 - RNA, 23 nt, Human
caaagauauuuugcuuugugauu

SEQ ID NO: 2946435 - RNA, 22 nt, Human
caaagcacugacuucuaaguaa

SEQ ID NO: 2946436 - RNA, 20 nt, Human
caaagcacugacuucuaagu

SEQ ID NO: 2946437 - RNA, 12 nt, Human
caaacagggccu

SEQ ID NO: 2946438 - RNA, 14 nt, Human
caaacagggccucu

SEQ ID NO: 2946439 - RNA, 15 nt, Human
caaacagaggccgcc

SEQ ID NO: 2946440 - RNA, 15 nt, Human
caaacagggccucug

SEQ ID NO: 2946441 - RNA, 19 nt, Human
caaacagggccucugcgga

SEQ ID NO: 2946442 - RNA, 13 nt, Human
caaacccaguguu

SEQ ID NO: 2946443 - RNA, 19 nt, Human
caaaccaucauugaaaucu

SEQ ID NO: 2946444 - RNA, 21 nt, Human
caaaccaucauugaaaucuuu

SEQ ID NO: 2946445 - RNA, 23 nt, Human
auuuuuuuuuccuucagugccuu

SEQ ID NO: 2946446 - RNA, 18 nt, Human
caaaagaugcuucucacu

SEQ ID NO: 2946447 - RNA, 15 nt, Human
caaaaggcagaagca

SEQ ID NO: 2946448 - RNA, 16 nt, Human
caaaagaugcuucuca

SEQ ID NO: 2946449 - RNA, 20 nt, Human
caaaaaaaaaaaaaaauuag

SEQ ID NO: 2946450 - RNA, 18 nt, Human
caaagauauuuugcuuug

SEQ ID NO: 2946451 - RNA, 20 nt, Human
caaagauauuuugcuuugug

SEQ ID NO: 2946452 - RNA, 21 nt, Human
auuugccuaauaugaugacug

SEQ ID NO: 2946453 - RNA, 22 nt, Human
auuuguuugaacugauaaagau

SEQ ID NO: 2946454 - RNA, 23 nt, Human
auuuguuugaacugauaaagaug

SEQ ID NO: 2946455 - RNA, 17 nt, Human
auuuuauagcuacuaau

SEQ ID NO: 2946456 - RNA, 20 nt, Human
auuuguuugaacugauaaag

SEQ ID NO: 2946457 - RNA, 19 nt, Human
auuuuauagcuacuaauuu

SEQ ID NO: 2946458 - RNA, 18 nt, Human
auuuguggaaaauaacuc

SEQ ID NO: 2946459 - RNA, 20 nt, Human
auuugugauacaaugcugug

SEQ ID NO: 2946460 - RNA, 18 nt, Human
auuuggaaaggaaugcaa

SEQ ID NO: 2946461 - RNA, 15 nt, Human
auuugugauacaaug

SEQ ID NO: 2946462 - RNA, 17 nt, Human
auuugugauacaaugcu

SEQ ID NO: 2946463 - RNA, 15 nt, Human
auuuggaaaggaaug

SEQ ID NO: 2946464 - RNA, 13 nt, Human
auuugcuccuuuc

SEQ ID NO: 2946465 - RNA, 14 nt, Human
auuugcucauggaa

SEQ ID NO: 2946466 - RNA, 17 nt, Human
auuugcucauggaauug

SEQ ID NO: 2946467 - RNA, 16 nt, Human
auuagggagagaagau

SEQ ID NO: 2946468 - RNA, 16 nt, Human
auuaggugugacugaa

SEQ ID NO: 2946469 - RNA, 18 nt, Human
auuaggugugacugaauu

SEQ ID NO: 2946470 - RNA, 14 nt, Human
auuaugaauuacau

SEQ ID NO: 2946471 - RNA, 17 nt, Human
auuaugaauuacauuug

SEQ ID NO: 2946472 - RNA, 18 nt, Human
auuaugaaacuuuuggaa

SEQ ID NO: 2946473 - RNA, 13 nt, Human
auuaugaaaauaa

SEQ ID NO: 2946474 - RNA, 14 nt, Human
auuagguugugaau

SEQ ID NO: 2946475 - RNA, 15 nt, Human
auuagguugugaaug

SEQ ID NO: 2946476 - RNA, 21 nt, Human
auuaggugugacugaauuucu

SEQ ID NO: 2946477 - RNA, 16 nt, Human
auuagguugaaacaua

SEQ ID NO: 2946478 - RNA, 17 nt, Human
auuagguugaaacauau

SEQ ID NO: 2946479 - RNA, 19 nt, Human
auuagguugaaacauaucu

SEQ ID NO: 2946480 - RNA, 23 nt, Human
auuagguugaaacauaucucuua

SEQ ID NO: 2946481 - RNA, 13 nt, Human
auuagguugugaa

SEQ ID NO: 2946482 - RNA, 18 nt, Human
auuaugaauuacauuugu

SEQ ID NO: 2946483 - RNA, 23 nt, Human
auuaugcaugaaguaauaugcac

SEQ ID NO: 2946484 - RNA, 18 nt, Human
auucaaugccccugaauu

SEQ ID NO: 2946485 - RNA, 20 nt, Human
auucaaugccccugaauuua

SEQ ID NO: 2946486 - RNA, 16 nt, Human
auucaaauguauuaca

SEQ ID NO: 2946487 - RNA, 19 nt, Human
auucacaagacccaaaagg

SEQ ID NO: 2946488 - RNA, 19 nt, Human
auucauagcagcuuauuca

SEQ ID NO: 2946489 - RNA, 22 nt, Human
auucauagcagcuuauucacaa

SEQ ID NO: 2946490 - RNA, 19 nt, Human
auucauaaugacuuaagca

SEQ ID NO: 2946491 - RNA, 15 nt, Human
auucauaaugacuua

SEQ ID NO: 2946492 - RNA, 14 nt, Human
auucauaaugacuu

SEQ ID NO: 2946493 - RNA, 17 nt, Human
auuacaggaaguacugg

SEQ ID NO: 2946494 - RNA, 16 nt, Human
auuacaggugugaacc

SEQ ID NO: 2946495 - RNA, 19 nt, Human
auuacaguggggaaugaag

SEQ ID NO: 2946496 - RNA, 17 nt, Human
auuacaacucuauuuaa

SEQ ID NO: 2946497 - RNA, 23 nt, Human
auugcugauggugcaaugaccuu

SEQ ID NO: 2946498 - RNA, 12 nt, Human
auugcugcuuga

SEQ ID NO: 2946499 - RNA, 17 nt, Human
auugcugcuuguacacu

SEQ ID NO: 2946500 - RNA, 14 nt, Human
auugcuugagcuca

SEQ ID NO: 2946501 - RNA, 19 nt, Human
auugcugauggugcaauga

SEQ ID NO: 2946502 - RNA, 18 nt, Human
auugcugauggugcaaug

SEQ ID NO: 2946503 - RNA, 16 nt, Human
auugcugauggugcaa

SEQ ID NO: 2946504 - RNA, 15 nt, Human
auugcugauggugca

SEQ ID NO: 2946505 - RNA, 16 nt, Human
auuguuagucucuuga

SEQ ID NO: 2946506 - RNA, 23 nt, Human
auugugucucuugguccugcugc

SEQ ID NO: 2946507 - RNA, 21 nt, Human
auugugucucuugguccugcu

SEQ ID NO: 2946508 - RNA, 13 nt, Human
auuguaaaauggu

SEQ ID NO: 2946509 - RNA, 14 nt, Human
auuguaaaauggug

SEQ ID NO: 2946510 - RNA, 18 nt, Human
auugcuugagcucaggag

SEQ ID NO: 2946511 - RNA, 23 nt, Human
auuguaauaggcguaacuaauuu

SEQ ID NO: 2946512 - RNA, 11 nt, Human
auucuucugcu

SEQ ID NO: 2946513 - RNA, 12 nt, Human
auucuucugcuu

SEQ ID NO: 2946514 - RNA, 14 nt, Human
auucuucugcuuca

SEQ ID NO: 2946515 - RNA, 11 nt, Human
auucuuuccug

SEQ ID NO: 2946516 - RNA, 13 nt, Human
auucuuuccugag

SEQ ID NO: 2946517 - RNA, 14 nt, Human
auugcuacuguccu

SEQ ID NO: 2946518 - RNA, 15 nt, Human
auugcuacuguccua

SEQ ID NO: 2946519 - RNA, 17 nt, Human
auugauaugcuuauaca

SEQ ID NO: 2946520 - RNA, 20 nt, Human
auugcuacuguccuacccac

SEQ ID NO: 2946521 - RNA, 22 nt, Human
auugcuacuguccuacccaccc

SEQ ID NO: 2946522 - RNA, 21 nt, Human
auugauaagaaccuuuugagu

SEQ ID NO: 2946523 - RNA, 13 nt, Human
cacuccccugcug

SEQ ID NO: 2946524 - RNA, 12 nt, Human
cacuccccugcu

SEQ ID NO: 2946525 - RNA, 14 nt, Human
cacuccccugcugg

SEQ ID NO: 2946526 - RNA, 23 nt, Human
cacuccaauaggugcugagugua

SEQ ID NO: 2946527 - RNA, 16 nt, Human
cacuccagccugggug

SEQ ID NO: 2946528 - RNA, 21 nt, Human
cacuagggcagggacaggaua

SEQ ID NO: 2946529 - RNA, 20 nt, Human
cacuagggcagggacaggau

SEQ ID NO: 2946530 - RNA, 16 nt, Human
cacuuacacuuuaugc

SEQ ID NO: 2946531 - RNA, 18 nt, Human
cacuuacacuuuaugcac

SEQ ID NO: 2946532 - RNA, 14 nt, Human
cacugguuugguuc

SEQ ID NO: 2946533 - RNA, 22 nt, Human
cacugguucuucuuggucucag

SEQ ID NO: 2946534 - RNA, 16 nt, Human
cacuugucaauaaaau

SEQ ID NO: 2946535 - RNA, 19 nt, Human
cacuuguguuuugcaagcc

SEQ ID NO: 2946536 - RNA, 17 nt, Human
cacuuguguuuugcaag

SEQ ID NO: 2946537 - RNA, 22 nt, Human
cacuuguguuuugcaagccaga

SEQ ID NO: 2946538 - RNA, 13 nt, Human
cacugcagccuca

SEQ ID NO: 2946539 - RNA, 16 nt, Human
cacugcauguuuguga

SEQ ID NO: 2946540 - RNA, 19 nt, Human
cacugcacuauagccuagg

SEQ ID NO: 2946541 - RNA, 16 nt, Human
cacugcacuccagccu

SEQ ID NO: 2946542 - RNA, 15 nt, Human
cacugcacuccagcc

SEQ ID NO: 2946543 - RNA, 18 nt, Human
cacugcacuccagccugg

SEQ ID NO: 2946544 - RNA, 19 nt, Human
cacugcacuccagccuggg

SEQ ID NO: 2946545 - RNA, 20 nt, Human
cacugcacuccagccugggu

SEQ ID NO: 2946546 - RNA, 12 nt, Human
cacugcagccuc

SEQ ID NO: 2946547 - RNA, 21 nt, Human
cacugcagaagacaguauggc

SEQ ID NO: 2946548 - RNA, 17 nt, Human
caccugccuguugggcc

SEQ ID NO: 2946549 - RNA, 24 nt, Human
caccugccuguugggccaggagcc

SEQ ID NO: 2946550 - RNA, 19 nt, Human
caccugccuguugggccag

SEQ ID NO: 2946551 - RNA, 14 nt, Human
caccuuggcugcag

SEQ ID NO: 2946552 - RNA, 14 nt, Human
caccuuggcucaag

SEQ ID NO: 2946553 - RNA, 15 nt, Human
caccuuggcucaagu

SEQ ID NO: 2946554 - RNA, 13 nt, Human
caccuuggcugca

SEQ ID NO: 2946555 - RNA, 14 nt, Human
caccucagccuccc

SEQ ID NO: 2946556 - RNA, 13 nt, Human
caccucagccucc

SEQ ID NO: 2946557 - RNA, 14 nt, Human
caccugccccucaa

SEQ ID NO: 2946558 - RNA, 16 nt, Human
caccugccccucaacu

SEQ ID NO: 2946559 - RNA, 15 nt, Human
caccugccccucaac

SEQ ID NO: 2946560 - RNA, 17 nt, Human
cacccugaaagcccuga

SEQ ID NO: 2946561 - RNA, 15 nt, Human
cacccuggggagaaa

SEQ ID NO: 2946562 - RNA, 16 nt, Human
cacccuggggagaaag

SEQ ID NO: 2946563 - RNA, 14 nt, Human
cacccucaggcagg

SEQ ID NO: 2946564 - RNA, 16 nt, Human
caccccagcaauuaug

SEQ ID NO: 2946565 - RNA, 11 nt, Human
caccccagccc

SEQ ID NO: 2946566 - RNA, 19 nt, Human
caauaaagcagcguuucua

SEQ ID NO: 2946567 - RNA, 13 nt, Human
caagcucugcucc

SEQ ID NO: 2946568 - RNA, 12 nt, Human
caagcuccaagc

SEQ ID NO: 2946569 - RNA, 14 nt, Human
caagcucugcuccu

SEQ ID NO: 2946570 - RNA, 13 nt, Human
caagcugcacccu

SEQ ID NO: 2946571 - RNA, 18 nt, Human
caagcugcacccucaggc

SEQ ID NO: 2946572 - RNA, 14 nt, Human
caagcugcacccuc

SEQ ID NO: 2946573 - RNA, 20 nt, Human
caagcugcacccucaggcag

SEQ ID NO: 2946574 - RNA, 14 nt, Human
caaguauagaaaau

SEQ ID NO: 2946575 - RNA, 13 nt, Human
caaguauagaaaa

SEQ ID NO: 2946576 - RNA, 18 nt, Human
caaggccaaaggaagcac

SEQ ID NO: 2946577 - RNA, 17 nt, Human
caaggccaaaggaagca

SEQ ID NO: 2946578 - RNA, 16 nt, Human
caaggccaaaggaagc

SEQ ID NO: 2946579 - RNA, 15 nt, Human
caaggccaaaggaag

SEQ ID NO: 2946580 - RNA, 15 nt, Human
caaguauagaaaauc

SEQ ID NO: 2946581 - RNA, 19 nt, Human
caaguauagaaaaucuuca

SEQ ID NO: 2946582 - RNA, 17 nt, Human
caagucaagugaaaaag

SEQ ID NO: 2946583 - RNA, 13 nt, Human
caagucaagugaa

SEQ ID NO: 2946584 - RNA, 14 nt, Human
caaguccaagcaua

SEQ ID NO: 2946585 - RNA, 17 nt, Human
cacacagcucuguccug

SEQ ID NO: 2946586 - RNA, 20 nt, Human
cacacagcucuguccuggga

SEQ ID NO: 2946587 - RNA, 11 nt, Human
caauggcagcc

SEQ ID NO: 2946588 - RNA, 12 nt, Human
caauggcagccu

SEQ ID NO: 2946589 - RNA, 15 nt, Human
caauucuugccaaau

SEQ ID NO: 2946590 - RNA, 16 nt, Human
caaugcuguauuuuaa

SEQ ID NO: 2946591 - RNA, 17 nt, Human
caaugcuguauuuuaaa

SEQ ID NO: 2946592 - RNA, 15 nt, Human
caaugcuguauuuua

SEQ ID NO: 2946593 - RNA, 14 nt, Human
cacaagagcccagg

SEQ ID NO: 2946594 - RNA, 18 nt, Human
cacaagacugcacaucaa

SEQ ID NO: 2946595 - RNA, 15 nt, Human
cacaagcuccaagcu

SEQ ID NO: 2946596 - RNA, 14 nt, Human
cacaagcuccaagc

SEQ ID NO: 2946597 - RNA, 13 nt, Human
cacaagcuccaag

SEQ ID NO: 2946598 - RNA, 16 nt, Human
cacaagagcccaggcc

SEQ ID NO: 2946599 - RNA, 23 nt, Human
cacaagcuccaagcucccaggca

SEQ ID NO: 2946600 - RNA, 17 nt, Human
cacaagcuccaagcucc

SEQ ID NO: 2946601 - RNA, 23 nt, Human
cacaagcugcacccucaggcagg

SEQ ID NO: 2946602 - RNA, 17 nt, Human
cacaagcugcacccuca

SEQ ID NO: 2946603 - RNA, 11 nt, Human
cacagccucug

SEQ ID NO: 2946604 - RNA, 13 nt, Human
cacagacccugcc

SEQ ID NO: 2946605 - RNA, 19 nt, Human
cacagacauacuaaccagc

SEQ ID NO: 2946606 - RNA, 21 nt, Human
cacagacauacuaaccagcag

SEQ ID NO: 2946607 - RNA, 18 nt, Human
cacagacauacuaaccag

SEQ ID NO: 2946608 - RNA, 19 nt, Human
cacagaaaauucuucucca

SEQ ID NO: 2946609 - RNA, 23 nt, Human
cacagaaaauggaagacagcucu

SEQ ID NO: 2946610 - RNA, 22 nt, Human
cacacaugagcaucaggccagg

SEQ ID NO: 2946611 - RNA, 21 nt, Human
cacacaugagcaucaggccag

SEQ ID NO: 2946612 - RNA, 22 nt, Human
cacagaaaauggaagacagcuc

SEQ ID NO: 2946613 - RNA, 20 nt, Human
cacagaaaauggaagacagc

SEQ ID NO: 2946614 - RNA, 19 nt, Human
cacagaaaauggaagacag

SEQ ID NO: 2946615 - RNA, 18 nt, Human
cacagaaaauggaagaca

SEQ ID NO: 2946616 - RNA, 18 nt, Human
cacacagugagucgagga

SEQ ID NO: 2946617 - RNA, 20 nt, Human
cacacaguauuacuucugcu

SEQ ID NO: 2946618 - RNA, 23 nt, Human
cacacaguauuacuucugcuaca

SEQ ID NO: 2946619 - RNA, 16 nt, Human
cacacagcucuguccu

SEQ ID NO: 2946620 - RNA, 15 nt, Human
cacacauacacacac

SEQ ID NO: 2946621 - RNA, 21 nt, Human
cacacagugagucgaggacag

SEQ ID NO: 2946622 - RNA, 23 nt, Human
cacacagugagucgaggacaggg

SEQ ID NO: 2946623 - RNA, 17 nt, Human
cacacaugaaguccaag

SEQ ID NO: 2946624 - RNA, 22 nt, Human
cacacaugaaguccaagcauuu

SEQ ID NO: 2946625 - RNA, 20 nt, Human
cacacaugagcaucaggcca

SEQ ID NO: 2946626 - RNA, 20 nt, Human
cacaguauuacuucugcuac

SEQ ID NO: 2946627 - RNA, 21 nt, Human
cacaguauuacuucugcuaca

SEQ ID NO: 2946628 - RNA, 19 nt, Human
cacaggggaaaagaggagu

SEQ ID NO: 2946629 - RNA, 18 nt, Human
cacaggggaaaagaggag

SEQ ID NO: 2946630 - RNA, 17 nt, Human
cacaggggaaaagagga

SEQ ID NO: 2946631 - RNA, 21 nt, Human
cacagccucuuagaugcaguu

SEQ ID NO: 2946632 - RNA, 17 nt, Human
cacagccucuuagaugc

SEQ ID NO: 2946633 - RNA, 22 nt, Human
caucuuagguuggcaaaaaggc

SEQ ID NO: 2946634 - RNA, 15 nt, Human
caucuuaaaaacaac

SEQ ID NO: 2946635 - RNA, 21 nt, Human
caucuuagguuggcaaaaagg

SEQ ID NO: 2946636 - RNA, 19 nt, Human
caucugugaaaggaaagag

SEQ ID NO: 2946637 - RNA, 18 nt, Human
caucugugaaaggaaaga

SEQ ID NO: 2946638 - RNA, 23 nt, Human
cauccuggcacccggccccugcu

SEQ ID NO: 2946639 - RNA, 15 nt, Human
cauccuggcccaggg

SEQ ID NO: 2946640 - RNA, 16 nt, Human
cauccuggcccagggc

SEQ ID NO: 2946641 - RNA, 18 nt, Human
cauccuggcccagggcau

SEQ ID NO: 2946642 - RNA, 19 nt, Human
cauccuggcccagggcauc

SEQ ID NO: 2946643 - RNA, 13 nt, Human
caucccagcccca

SEQ ID NO: 2946644 - RNA, 14 nt, Human
caucccagccccaa

SEQ ID NO: 2946645 - RNA, 16 nt, Human
caucccagccccaaug

SEQ ID NO: 2946646 - RNA, 12 nt, Human
caucccagcccc

SEQ ID NO: 2946647 - RNA, 23 nt, Human
caucaggccaggcccucugccca

SEQ ID NO: 2946648 - RNA, 22 nt, Human
caucaggccaggcccucugccc

SEQ ID NO: 2946649 - RNA, 21 nt, Human
caucaggccaggcccucugcc

SEQ ID NO: 2946650 - RNA, 20 nt, Human
caucaggccaggcccucugc

SEQ ID NO: 2946651 - RNA, 17 nt, Human
caucagcacgauuucug

SEQ ID NO: 2946652 - RNA, 18 nt, Human
caucagcacgauuucugu

SEQ ID NO: 2946653 - RNA, 13 nt, Human
caucaggccaggc

SEQ ID NO: 2946654 - RNA, 20 nt, Human
caucagcuugcccuguuaaa

SEQ ID NO: 2946655 - RNA, 13 nt, Human
caucagcugcuga

SEQ ID NO: 2946656 - RNA, 15 nt, Human
caucagcugcugaaa

SEQ ID NO: 2946657 - RNA, 18 nt, Human
caucagcugcugaaacaa

SEQ ID NO: 2946658 - RNA, 17 nt, Human
caucagcugcugaaaca

SEQ ID NO: 2946659 - RNA, 22 nt, Human
caugcaaggucauuuuuuuuaa

SEQ ID NO: 2946660 - RNA, 17 nt, Human
caugcaaggucauuuuu

SEQ ID NO: 2946661 - RNA, 18 nt, Human
caugcaaggucauuuuuu

SEQ ID NO: 2946662 - RNA, 22 nt, Human
caugcugccaauauccuaauaa

SEQ ID NO: 2946663 - RNA, 22 nt, Human
cauggccuuugcuugaaagaaa

SEQ ID NO: 2946664 - RNA, 19 nt, Human
cauggccuuugcuugaaag

SEQ ID NO: 2946665 - RNA, 21 nt, Human
caugcugccaauauccuaaua

SEQ ID NO: 2946666 - RNA, 19 nt, Human
caugcugccaauauccuaa

SEQ ID NO: 2946667 - RNA, 17 nt, Human
caugcugccaauauccu

SEQ ID NO: 2946668 - RNA, 15 nt, Human
caugcugccaauauc

SEQ ID NO: 2946669 - RNA, 18 nt, Human
caugcugcccugugagua

SEQ ID NO: 2946670 - RNA, 16 nt, Human
caugcugcccugugag

SEQ ID NO: 2946671 - RNA, 18 nt, Human
caugacacgaauauugcu

SEQ ID NO: 2946672 - RNA, 17 nt, Human
caugacacgaauauugc

SEQ ID NO: 2946673 - RNA, 14 nt, Human
caugacacgaauau

SEQ ID NO: 2946674 - RNA, 16 nt, Human
caugaauuaguuuuau

SEQ ID NO: 2946675 - RNA, 18 nt, Human
cagucaccccggccaccu

SEQ ID NO: 2946676 - RNA, 11 nt, Human
caguuugguug

SEQ ID NO: 2946677 - RNA, 21 nt, Human
caguuugguugguaacucugu

SEQ ID NO: 2946678 - RNA, 14 nt, Human
caguuugcagagua

SEQ ID NO: 2946679 - RNA, 14 nt, Human
cauaaugcgugcau

SEQ ID NO: 2946680 - RNA, 17 nt, Human
cauaaugcgugcauacc

SEQ ID NO: 2946681 - RNA, 20 nt, Human
cauauuaccacagacauacu

SEQ ID NO: 2946682 - RNA, 21 nt, Human
cauauuaccacagacauacua

SEQ ID NO: 2946683 - RNA, 17 nt, Human
cauauuaccacagacau

SEQ ID NO: 2946684 - RNA, 16 nt, Human
cauauuaccacagaca

SEQ ID NO: 2946685 - RNA, 21 nt, Human
cauaaugcgugcauaccacuu

SEQ ID NO: 2946686 - RNA, 13 nt, Human
cauacaaggccca

SEQ ID NO: 2946687 - RNA, 15 nt, Human
cauacaauuccaaac

SEQ ID NO: 2946688 - RNA, 18 nt, Human
cauagauucccugagcag

SEQ ID NO: 2946689 - RNA, 17 nt, Human
cauagauucccugagca

SEQ ID NO: 2946690 - RNA, 20 nt, Human
cauagcagcuuauucacaag

SEQ ID NO: 2946691 - RNA, 21 nt, Human
cauuuggugguuucagaaaug

SEQ ID NO: 2946692 - RNA, 22 nt, Human
cauuuggugguuucagaaaugu

SEQ ID NO: 2946693 - RNA, 23 nt, Human
cauuuggugguuucagaaaugug

SEQ ID NO: 2946694 - RNA, 23 nt, Human
cauuuuucuuagggaaggauaca

SEQ ID NO: 2946695 - RNA, 17 nt, Human
ccaaaacucuccucugc

SEQ ID NO: 2946696 - RNA, 17 nt, Human
ccaaaaaaugcuugcuu

SEQ ID NO: 2946697 - RNA, 14 nt, Human
cauuucaagaaguc

SEQ ID NO: 2946698 - RNA, 15 nt, Human
cauuggggcucccag

SEQ ID NO: 2946699 - RNA, 16 nt, Human
cauuuauucugcucac

SEQ ID NO: 2946700 - RNA, 18 nt, Human
cauugcugggcuugucug

SEQ ID NO: 2946701 - RNA, 14 nt, Human
cauugcggacagcc

SEQ ID NO: 2946702 - RNA, 15 nt, Human
cauugcggacagcca

SEQ ID NO: 2946703 - RNA, 17 nt, Human
cauugcggacagccacg

SEQ ID NO: 2946704 - RNA, 21 nt, Human
cauugcggacagccacggcca

SEQ ID NO: 2946705 - RNA, 18 nt, Human
cauuaucuagauacugua

SEQ ID NO: 2946706 - RNA, 16 nt, Human
cauucuccuuguguua

SEQ ID NO: 2946707 - RNA, 22 nt, Human
cauggccucuucagaucucuaa

SEQ ID NO: 2946708 - RNA, 22 nt, Human
cauggcugccaaugggagcuca

SEQ ID NO: 2946709 - RNA, 22 nt, Human
cauggcuggagcuagaauuuga

SEQ ID NO: 2946710 - RNA, 17 nt, Human
cauggcugccaauggga

SEQ ID NO: 2946711 - RNA, 15 nt, Human
cauguucucugagga

SEQ ID NO: 2946712 - RNA, 15 nt, Human
cauuaggauggcuag

SEQ ID NO: 2946713 - RNA, 12 nt, Human
cauuaucuagau

SEQ ID NO: 2946714 - RNA, 16 nt, Human
cauuaucuagauacug

SEQ ID NO: 2946715 - RNA, 17 nt, Human
cauuaucuagauacugu

SEQ ID NO: 2946716 - RNA, 17 nt, Human
ccaccaucaagccacca

SEQ ID NO: 2946717 - RNA, 16 nt, Human
ccaccaucaagccacc

SEQ ID NO: 2946718 - RNA, 13 nt, Human
ccaccuuggcuca

SEQ ID NO: 2946719 - RNA, 14 nt, Human
ccaccuuggcucaa

SEQ ID NO: 2946720 - RNA, 15 nt, Human
ccaccuuggcucaag

SEQ ID NO: 2946721 - RNA, 13 nt, Human
ccaccgcagacag

SEQ ID NO: 2946722 - RNA, 18 nt, Human
ccaccgcagacaggacca

SEQ ID NO: 2946723 - RNA, 13 nt, Human
ccacccugcucuc

SEQ ID NO: 2946724 - RNA, 20 nt, Human
ccaccaucaagccaccaaca

SEQ ID NO: 2946725 - RNA, 17 nt, Human
ccaccgcagacaggacc

SEQ ID NO: 2946726 - RNA, 14 nt, Human
ccaccgcagacagg

SEQ ID NO: 2946727 - RNA, 20 nt, Human
ccaauguucucucuucucca

SEQ ID NO: 2946728 - RNA, 20 nt, Human
ccaagcuggucccacucagu

SEQ ID NO: 2946729 - RNA, 23 nt, Human
ccaaugcacuuuguucuggcucu

SEQ ID NO: 2946730 - RNA, 22 nt, Human
ccaaugcacuuuguucuggcuc

SEQ ID NO: 2946731 - RNA, 20 nt, Human
ccaaugcacuuuguucuggc

SEQ ID NO: 2946732 - RNA, 16 nt, Human
ccaacgucugugccau

SEQ ID NO: 2946733 - RNA, 16 nt, Human
ccaaaucauaguggcu

SEQ ID NO: 2946734 - RNA, 12 nt, Human
ccaaauuaagag

SEQ ID NO: 2946735 - RNA, 18 nt, Human
ccaaauguucaucaauga

SEQ ID NO: 2946736 - RNA, 14 nt, Human
caggguggccacac

SEQ ID NO: 2946737 - RNA, 15 nt, Human
caggguuggccccug

SEQ ID NO: 2946738 - RNA, 16 nt, Human
caggguuggccccugc

SEQ ID NO: 2946739 - RNA, 21 nt, Human
cagggucucuaccauccccug

SEQ ID NO: 2946740 - RNA, 22 nt, Human
cagggucucacucugucgccca

SEQ ID NO: 2946741 - RNA, 23 nt, Human
cagggucucacucugucgcccag

SEQ ID NO: 2946742 - RNA, 23 nt, Human
cagguuuuuggucugacccacug

SEQ ID NO: 2946743 - RNA, 20 nt, Human
caguaaaaaaugguguuuua

SEQ ID NO: 2946744 - RNA, 13 nt, Human
caggugcugccau

SEQ ID NO: 2946745 - RNA, 14 nt, Human
caggugcugccauc

SEQ ID NO: 2946746 - RNA, 22 nt, Human
caggguggccacaccucuaucc

SEQ ID NO: 2946747 - RNA, 14 nt, Human
caggguuggccccu

SEQ ID NO: 2946748 - RNA, 17 nt, Human
caggguuggccccugcc

SEQ ID NO: 2946749 - RNA, 21 nt, Human
caggguuggccccugcccggc

SEQ ID NO: 2946750 - RNA, 19 nt, Human
caguauuacuucugcuaca

SEQ ID NO: 2946751 - RNA, 19 nt, Human
caguaaaugggggugcauu

SEQ ID NO: 2946752 - RNA, 21 nt, Human
caguaaaaaaugguguuuuau

SEQ ID NO: 2946753 - RNA, 18 nt, Human
caguaaaugggggugcau

SEQ ID NO: 2946754 - RNA, 14 nt, Human
cagucaccccggcc

SEQ ID NO: 2946755 - RNA, 17 nt, Human
cagucaccccggccacc

SEQ ID NO: 2946756 - RNA, 16 nt, Human
cagucaccccggccac

SEQ ID NO: 2946757 - RNA, 15 nt, Human
caggcuggcgugcag

SEQ ID NO: 2946758 - RNA, 19 nt, Human
caggcugggagagccuucc

SEQ ID NO: 2946759 - RNA, 18 nt, Human
caggcugggagagccuuc

SEQ ID NO: 2946760 - RNA, 16 nt, Human
caggcugggagagccu

SEQ ID NO: 2946761 - RNA, 17 nt, Human
caggcuggcgugcagug

SEQ ID NO: 2946762 - RNA, 23 nt, Human
caggccugggggcugggcagagg

SEQ ID NO: 2946763 - RNA, 18 nt, Human
caggcuggcgugcagugg

SEQ ID NO: 2946764 - RNA, 19 nt, Human
caggcuggcgugcaguggu

SEQ ID NO: 2946765 - RNA, 22 nt, Human
caggccugggggcugggcagag

SEQ ID NO: 2946766 - RNA, 20 nt, Human
caggccugggggcugggcag

SEQ ID NO: 2946767 - RNA, 12 nt, Human
cagggcucagcg

SEQ ID NO: 2946768 - RNA, 15 nt, Human
cagggcucagcgggg

SEQ ID NO: 2946769 - RNA, 20 nt, Human
cagggcucagcggggacagc

SEQ ID NO: 2946770 - RNA, 16 nt, Human
cagggagggcuucugc

SEQ ID NO: 2946771 - RNA, 14 nt, Human
caggcugggcuuca

SEQ ID NO: 2946772 - RNA, 22 nt, Human
cagggaggacgcucucuggccu

SEQ ID NO: 2946773 - RNA, 19 nt, Human
cagggaggacgcucucugg

SEQ ID NO: 2946774 - RNA, 23 nt, Human
caggaaaggcuccaggagcagcc

SEQ ID NO: 2946775 - RNA, 22 nt, Human
caggaaaggcuccaggagcagc

SEQ ID NO: 2946776 - RNA, 21 nt, Human
caggaaaggcuccaggagcag

SEQ ID NO: 2946777 - RNA, 19 nt, Human
caggaaaagcugcugacag

SEQ ID NO: 2946778 - RNA, 20 nt, Human
caggaaaagcugcugacagu

SEQ ID NO: 2946779 - RNA, 16 nt, Human
cagcuuauucacaaga

SEQ ID NO: 2946780 - RNA, 15 nt, Human
cagcuguucagcugg

SEQ ID NO: 2946781 - RNA, 16 nt, Human
cagcuguucagcuggu

SEQ ID NO: 2946782 - RNA, 19 nt, Human
caggaaaucaaauaugcaa

SEQ ID NO: 2946783 - RNA, 21 nt, Human
caggaaaucaaauaugcaaag

SEQ ID NO: 2946784 - RNA, 15 nt, Human
caggccagcugcuug

SEQ ID NO: 2946785 - RNA, 13 nt, Human
caggccagcugcu

SEQ ID NO: 2946786 - RNA, 21 nt, Human
caggcaaugcuggcuguuggc

SEQ ID NO: 2946787 - RNA, 19 nt, Human
caggcaaugcuggcuguug

SEQ ID NO: 2946788 - RNA, 20 nt, Human
caggcaaugcuggcuguugg

SEQ ID NO: 2946789 - RNA, 13 nt, Human
caggaggccagcc

SEQ ID NO: 2946790 - RNA, 12 nt, Human
caggaggccagc

SEQ ID NO: 2946791 - RNA, 16 nt, Human
caggccaggcccucug

SEQ ID NO: 2946792 - RNA, 15 nt, Human
caggccaggcccucu

SEQ ID NO: 2946793 - RNA, 14 nt, Human
caggccaggcccuc

SEQ ID NO: 2946794 - RNA, 13 nt, Human
caggccaggcccu

SEQ ID NO: 2946795 - RNA, 13 nt, Human
caggaccucaggu

SEQ ID NO: 2946796 - RNA, 13 nt, Human
caggaccagggau

SEQ ID NO: 2946797 - RNA, 23 nt, Human
caggacagcccuucuuuccacag

SEQ ID NO: 2946798 - RNA, 24 nt, Human
caggacagcccuucuuuccacaga

SEQ ID NO: 2946799 - RNA, 23 nt, Human
cagauacaggaaaagcugcugac

SEQ ID NO: 2946800 - RNA, 22 nt, Human
cagagacuccugcaggcagcca

SEQ ID NO: 2946801 - RNA, 21 nt, Human
cagagacuccugcaggcagcc

SEQ ID NO: 2946802 - RNA, 20 nt, Human
cagagacuccugcaggcagc

SEQ ID NO: 2946803 - RNA, 13 nt, Human
cagagaggguggg

SEQ ID NO: 2946804 - RNA, 16 nt, Human
cagagagggugggagu

SEQ ID NO: 2946805 - RNA, 14 nt, Human
cagagccugcaguu

SEQ ID NO: 2946806 - RNA, 22 nt, Human
cagagagggugggagugggccc

SEQ ID NO: 2946807 - RNA, 20 nt, Human
cagagagggugggagugggc

SEQ ID NO: 2946808 - RNA, 22 nt, Human
cagagcuacacaggggaaaaga

SEQ ID NO: 2946809 - RNA, 17 nt, Human
cagagcuacacagggga

SEQ ID NO: 2946810 - RNA, 21 nt, Human
cagauugcaacaggcugggcu

SEQ ID NO: 2946811 - RNA, 13 nt, Human
cagauuucacucu

SEQ ID NO: 2946812 - RNA, 18 nt, Human
cagauuucacucuccuug

SEQ ID NO: 2946813 - RNA, 19 nt, Human
cagauuugaacucuucaau

SEQ ID NO: 2946814 - RNA, 16 nt, Human
cagauuucacucuccu

SEQ ID NO: 2946815 - RNA, 15 nt, Human
cagauuucacucucc

SEQ ID NO: 2946816 - RNA, 20 nt, Human
cagccagacuggcacaguuu

SEQ ID NO: 2946817 - RNA, 18 nt, Human
cagcauauucaggaagcu

SEQ ID NO: 2946818 - RNA, 17 nt, Human
cagcauauucaggaagc

SEQ ID NO: 2946819 - RNA, 16 nt, Human
cagcauauucaggaag

SEQ ID NO: 2946820 - RNA, 17 nt, Human
cagcauagaaguaacuu

SEQ ID NO: 2946821 - RNA, 21 nt, Human
cagcaguucagagcugcccuc

SEQ ID NO: 2946822 - RNA, 22 nt, Human
cagcaguucagagcugcccucu

SEQ ID NO: 2946823 - RNA, 18 nt, Human
cagcaguucagagcugcc

SEQ ID NO: 2946824 - RNA, 19 nt, Human
cagcaguucagagcugccc

SEQ ID NO: 2946825 - RNA, 20 nt, Human
cagcaguucagagcugcccu

SEQ ID NO: 2946826 - RNA, 23 nt, Human
cagccccauucugccugcccagg

SEQ ID NO: 2946827 - RNA, 24 nt, Human
cagccccauucugccugcccaggc

SEQ ID NO: 2946828 - RNA, 19 nt, Human
cagccccauucugccugcc

SEQ ID NO: 2946829 - RNA, 20 nt, Human
cagccccauucugccugccc

SEQ ID NO: 2946830 - RNA, 22 nt, Human
cagccccauucugccugcccag

SEQ ID NO: 2946831 - RNA, 19 nt, Human
cagccccgugggguuccuc

SEQ ID NO: 2946832 - RNA, 16 nt, Human
cagcguuucuaugaca

SEQ ID NO: 2946833 - RNA, 14 nt, Human
cagcguuucuauga

SEQ ID NO: 2946834 - RNA, 23 nt, Human
cagccgccaugcuccuggcccac

SEQ ID NO: 2946835 - RNA, 13 nt, Human
cagcccuuagcag

SEQ ID NO: 2946836 - RNA, 22 nt, Human
cagccugagcgacagugagacu

SEQ ID NO: 2946837 - RNA, 23 nt, Human
cagccugagcgacagugagacuc

SEQ ID NO: 2946838 - RNA, 18 nt, Human
ggcagugggagcugccug

SEQ ID NO: 2946839 - RNA, 19 nt, Human
ggcagugggagcugccugu

SEQ ID NO: 2946840 - RNA, 18 nt, Human
ggcauccaguaucuugaa

SEQ ID NO: 2946841 - RNA, 17 nt, Human
ggcagugggagcugccu

SEQ ID NO: 2946842 - RNA, 22 nt, Human
ggcacuggcaaacagggccucu

SEQ ID NO: 2946843 - RNA, 23 nt, Human
ggcacuggcaaacagggccucug

SEQ ID NO: 2946844 - RNA, 24 nt, Human
ggcacugcuuccagugaggcucug

SEQ ID NO: 2946845 - RNA, 22 nt, Human
ggcacugcuuccagugaggcuc

SEQ ID NO: 2946846 - RNA, 16 nt, Human
ggcaccagcagccugg

SEQ ID NO: 2946847 - RNA, 15 nt, Human
ggcaccagcagccug

SEQ ID NO: 2946848 - RNA, 16 nt, Human
ggccagugugacaagg

SEQ ID NO: 2946849 - RNA, 17 nt, Human
ggccaaacucaccugcc

SEQ ID NO: 2946850 - RNA, 16 nt, Human
ggccaggcuggucuca

SEQ ID NO: 2946851 - RNA, 18 nt, Human
ggccaggcuggucucaaa

SEQ ID NO: 2946852 - RNA, 12 nt, Human
ggccaggcuggu

SEQ ID NO: 2946853 - RNA, 14 nt, Human
ggccaggcuggucu

SEQ ID NO: 2946854 - RNA, 20 nt, Human
ggcccaggaguuuggccaga

SEQ ID NO: 2946855 - RNA, 19 nt, Human
ggcccaggaguuuggccag

SEQ ID NO: 2946856 - RNA, 18 nt, Human
ggcccaggaguuuggcca

SEQ ID NO: 2946857 - RNA, 13 nt, Human
ggcccaggaguuu

SEQ ID NO: 2946858 - RNA, 11 nt, Human
ggcccaggagu

SEQ ID NO: 2946859 - RNA, 19 nt, Human
ggcccaggguggccacacc

SEQ ID NO: 2946860 - RNA, 17 nt, Human
ggccccaccagugccuc

SEQ ID NO: 2946861 - RNA, 18 nt, Human
ggccccaccagugccucu

SEQ ID NO: 2946862 - RNA, 18 nt, Human
ggcccuucucuccagccc

SEQ ID NO: 2946863 - RNA, 14 nt, Human
ggcccuuccuuuuc

SEQ ID NO: 2946864 - RNA, 17 nt, Human
ggcccuucucuccagcc

SEQ ID NO: 2946865 - RNA, 16 nt, Human
ggcccuucucuccagc

SEQ ID NO: 2946866 - RNA, 19 nt, Human
ggcgugcaguggugcgauc

SEQ ID NO: 2946867 - RNA, 14 nt, Human
ggcgugcaguggug

SEQ ID NO: 2946868 - RNA, 16 nt, Human
ggcucacugcagccuc

SEQ ID NO: 2946869 - RNA, 17 nt, Human
ggcucacugcagccuca

SEQ ID NO: 2946870 - RNA, 21 nt, Human
ggcucagcggggacagcuccu

SEQ ID NO: 2946871 - RNA, 22 nt, Human
ggcucagcggggacagcuccuu

SEQ ID NO: 2946872 - RNA, 23 nt, Human
ggcucagcggggacagcuccuuc

SEQ ID NO: 2946873 - RNA, 19 nt, Human
ggcucagcaaaagaugcuu

SEQ ID NO: 2946874 - RNA, 23 nt, Human
ggcucagcaaaagaugcuucuca

SEQ ID NO: 2946875 - RNA, 12 nt, Human
ggccugagcugg

SEQ ID NO: 2946876 - RNA, 15 nt, Human
ggccugagcugggau

SEQ ID NO: 2946877 - RNA, 14 nt, Human
ggccuuuggcuuca

SEQ ID NO: 2946878 - RNA, 15 nt, Human
ggccuucucugaagg

SEQ ID NO: 2946879 - RNA, 16 nt, Human
ggccuucucugaagga

SEQ ID NO: 2946880 - RNA, 13 nt, Human
ggccuuuggcuuc

SEQ ID NO: 2946881 - RNA, 21 nt, Human
ggccuggccagaugcaccagc

SEQ ID NO: 2946882 - RNA, 21 nt, Human
ggccugugucuaguuguuuga

SEQ ID NO: 2946883 - RNA, 12 nt, Human
ggccuucucuga

SEQ ID NO: 2946884 - RNA, 23 nt, Human
ggccuucggccuccauccugagg

SEQ ID NO: 2946885 - RNA, 22 nt, Human
ggccuucggccuccauccugag

SEQ ID NO: 2946886 - RNA, 14 nt, Human
ggaggugaccccag

SEQ ID NO: 2946887 - RNA, 20 nt, Human
ggaggucaaggcugcaguga

SEQ ID NO: 2946888 - RNA, 14 nt, Human
ggagguaaugacca

SEQ ID NO: 2946889 - RNA, 16 nt, Human
ggaggggggagguggg

SEQ ID NO: 2946890 - RNA, 19 nt, Human
ggaggaaggaaacccagcu

SEQ ID NO: 2946891 - RNA, 23 nt, Human
ggaggaaggaaacccagcucugg

SEQ ID NO: 2946892 - RNA, 20 nt, Human
ggaggaaggaaacccagcuc

SEQ ID NO: 2946893 - RNA, 11 nt, Human
ggaggccagcc

SEQ ID NO: 2946894 - RNA, 20 nt, Human
ggaggccaaggugggaggau

SEQ ID NO: 2946895 - RNA, 21 nt, Human
ggagcugccuguucagcucca

SEQ ID NO: 2946896 - RNA, 22 nt, Human
ggagcugaucgcuucuccccca

SEQ ID NO: 2946897 - RNA, 12 nt, Human
ggagcugccugu

SEQ ID NO: 2946898 - RNA, 16 nt, Human
ggagccccgaggccuu

SEQ ID NO: 2946899 - RNA, 22 nt, Human
ggagccccgaggccuucucuga

SEQ ID NO: 2946900 - RNA, 15 nt, Human
ggagugcagugagcc

SEQ ID NO: 2946901 - RNA, 18 nt, Human
ggaucuguauguguucua

SEQ ID NO: 2946902 - RNA, 19 nt, Human
ggaucuguauguguucuau

SEQ ID NO: 2946903 - RNA, 14 nt, Human
ggauccugagccag

SEQ ID NO: 2946904 - RNA, 13 nt, Human
ggauccugagcca

SEQ ID NO: 2946905 - RNA, 14 nt, Human
ggauccuccaggug

SEQ ID NO: 2946906 - RNA, 15 nt, Human
ggauccuccaggugc

SEQ ID NO: 2946907 - RNA, 16 nt, Human
ggauggggcugcaccg

SEQ ID NO: 2946908 - RNA, 12 nt, Human
ggauggcaagau

SEQ ID NO: 2946909 - RNA, 18 nt, Human
ggauggauuuccagccaa

SEQ ID NO: 2946910 - RNA, 15 nt, Human
ggaguucugguuccu

SEQ ID NO: 2946911 - RNA, 14 nt, Human
ggaguggccacaga

SEQ ID NO: 2946912 - RNA, 13 nt, Human
ggaguuuggccag

SEQ ID NO: 2946913 - RNA, 15 nt, Human
ggaguuuggccagaa

SEQ ID NO: 2946914 - RNA, 14 nt, Human
ggaguuuggccaga

SEQ ID NO: 2946915 - RNA, 24 nt, Human
ggcacagaaaauggaagacagcuc

SEQ ID NO: 2946916 - RNA, 15 nt, Human
ggauguucugggaca

SEQ ID NO: 2946917 - RNA, 16 nt, Human
ggauguucugggacac

SEQ ID NO: 2946918 - RNA, 13 nt, Human
ggauguucuggga

SEQ ID NO: 2946919 - RNA, 13 nt, Human
gggaaggauacaa

SEQ ID NO: 2946920 - RNA, 16 nt, Human
gggacagcuccuucug

SEQ ID NO: 2946921 - RNA, 23 nt, Human
gggacagaggggguggccuccca

SEQ ID NO: 2946922 - RNA, 22 nt, Human
gggacagaggggguggccuccc

SEQ ID NO: 2946923 - RNA, 13 nt, Human
gggacagaggggg

SEQ ID NO: 2946924 - RNA, 21 nt, Human
gggacagcuccuucuguccua

SEQ ID NO: 2946925 - RNA, 19 nt, Human
gggacauuugcucauggaa

SEQ ID NO: 2946926 - RNA, 20 nt, Human
gggacauuugcucauggaau

SEQ ID NO: 2946927 - RNA, 21 nt, Human
gggacauuugcucauggaauu

SEQ ID NO: 2946928 - RNA, 13 nt, Human
aaaacucauuuuu

SEQ ID NO: 2946929 - RNA, 22 nt, Human
aaaacugcugacuguuuucucu

SEQ ID NO: 2946930 - RNA, 20 nt, Human
aaaacugcugacuguuuucu

SEQ ID NO: 2946931 - RNA, 23 nt, Human
aaaacugcugacuguuuucucuu

SEQ ID NO: 2946932 - RNA, 17 nt, Human
aaaagaugaaaauauuu

SEQ ID NO: 2946933 - RNA, 13 nt, Human
aaaagaugcuucu

SEQ ID NO: 2946934 - RNA, 13 nt, Human
aaaaccacagcag

SEQ ID NO: 2946935 - RNA, 14 nt, Human
aaaaaucucaaauu

SEQ ID NO: 2946936 - RNA, 22 nt, Human
aaaaauggaacauaaaauacaa

SEQ ID NO: 2946937 - RNA, 15 nt, Human
aaaacaugcuacaca

SEQ ID NO: 2946938 - RNA, 12 nt, Human
aaaaccacagca

SEQ ID NO: 2946939 - RNA, 21 nt, Human
aaaaccaauguucucucuucu

SEQ ID NO: 2946940 - RNA, 15 nt, Human
gggauuacaggugug

SEQ ID NO: 2946941 - RNA, 13 nt, Human
gggauuggcugug

SEQ ID NO: 2946942 - RNA, 17 nt, Human
gggauuguaaaauggug

SEQ ID NO: 2946943 - RNA, 16 nt, Human
gggauuguaaaauggu

SEQ ID NO: 2946944 - RNA, 16 nt, Human
gggcaacccccagccu

SEQ ID NO: 2946945 - RNA, 18 nt, Human
gggcaacccccagccugc

SEQ ID NO: 2946946 - RNA, 12 nt, Human
gggcagagcaga

SEQ ID NO: 2946947 - RNA, 16 nt, Human
gggcagagcagagacc

SEQ ID NO: 2946948 - RNA, 14 nt, Human
gggcagaggaaagc

SEQ ID NO: 2946949 - RNA, 22 nt, Human
gggcagagcagagaccaucccu

SEQ ID NO: 2946950 - RNA, 17 nt, Human
gggcagagcagagacca

SEQ ID NO: 2946951 - RNA, 22 nt, Human
aaaagggguaggguuuaaagau

SEQ ID NO: 2946952 - RNA, 19 nt, Human
aaaagguaugcaaucaaau

SEQ ID NO: 2946953 - RNA, 15 nt, Human
gggaggucgaggcag

SEQ ID NO: 2946954 - RNA, 17 nt, Human
gggagggcuccagacac

SEQ ID NO: 2946955 - RNA, 15 nt, Human
gggagggcuccagac

SEQ ID NO: 2946956 - RNA, 14 nt, Human
gggagggcuccaga

SEQ ID NO: 2946957 - RNA, 19 nt, Human
gggaggucgaggcaggagg

SEQ ID NO: 2946958 - RNA, 18 nt, Human
gggaggucgaggcaggag

SEQ ID NO: 2946959 - RNA, 18 nt, Human
gggagggcuccagacaca

SEQ ID NO: 2946960 - RNA, 17 nt, Human
gggaggucgaggcagga

SEQ ID NO: 2946961 - RNA, 19 nt, Human
gggaggccaaggugggagg

SEQ ID NO: 2946962 - RNA, 19 nt, Human
gggcccuuuuucaauaacu

SEQ ID NO: 2946963 - RNA, 23 nt, Human
gggccaguuggucccccuuccau

SEQ ID NO: 2946964 - RNA, 22 nt, Human
gggccaguuggucccccuucca

SEQ ID NO: 2946965 - RNA, 18 nt, Human
gggccaguuggucccccu

SEQ ID NO: 2946966 - RNA, 14 nt, Human
gggccaguuggucc

SEQ ID NO: 2946967 - RNA, 19 nt, Human
gggccucuuaugggcuggg

SEQ ID NO: 2946968 - RNA, 20 nt, Human
gggccucuuaugggcugggu

SEQ ID NO: 2946969 - RNA, 23 nt, Human
gggccucggaccccacuccggcc

SEQ ID NO: 2946970 - RNA, 15 nt, Human
gggccuccugugugu

SEQ ID NO: 2946971 - RNA, 13 nt, Human
gggccuccugugu

SEQ ID NO: 2946972 - RNA, 15 nt, Human
gggcgggaggauguu

SEQ ID NO: 2946973 - RNA, 15 nt, Human
gggcgugguggugag

SEQ ID NO: 2946974 - RNA, 15 nt, Human
gggcuacaaggaccc

SEQ ID NO: 2946975 - RNA, 18 nt, Human
gggcuaguugggcuuccu

SEQ ID NO: 2946976 - RNA, 11 nt, Human
gggccaggagc

SEQ ID NO: 2946977 - RNA, 21 nt, Human
aaaaugagccuggcaagaaug

SEQ ID NO: 2946978 - RNA, 14 nt, Human
aaaaugagccuggc

SEQ ID NO: 2946979 - RNA, 17 nt, Human
aaaaucuucauggaauu

SEQ ID NO: 2946980 - RNA, 23 nt, Human
aaaaucuucauggaauucacaaa

SEQ ID NO: 2946981 - RNA, 15 nt, Human
aaaaucuucauggaa

SEQ ID NO: 2946982 - RNA, 16 nt, Human
aaaaucuucauggaau

SEQ ID NO: 2946983 - RNA, 19 nt, Human
aaaaguauguuagugcaaa

SEQ ID NO: 2946984 - RNA, 23 nt, Human
aaacauaucucuuaucuuacgaa

SEQ ID NO: 2946985 - RNA, 16 nt, Human
aaacagucucccuucc

SEQ ID NO: 2946986 - RNA, 20 nt, Human
aaacagucucaggaaaucaa

SEQ ID NO: 2946987 - RNA, 18 nt, Human
aaacaagaccacguuucu

SEQ ID NO: 2946988 - RNA, 20 nt, Human
aaacaagaccacguuucuaa

SEQ ID NO: 2946989 - RNA, 12 nt, Human
aaacacauuuuu

SEQ ID NO: 2946990 - RNA, 16 nt, Human
aaacacauuuuucuua

SEQ ID NO: 2946991 - RNA, 20 nt, Human
aaacaagcacuaaacaaaga

SEQ ID NO: 2946992 - RNA, 12 nt, Human
ggggacagcucc

SEQ ID NO: 2946993 - RNA, 14 nt, Human
ggggacagcuccuu

SEQ ID NO: 2946994 - RNA, 20 nt, Human
ggggacagcuccuucugucc

SEQ ID NO: 2946995 - RNA, 12 nt, Human
ggggccuggaug

SEQ ID NO: 2946996 - RNA, 21 nt, Human
gggcugcaugcgggcuuccuc

SEQ ID NO: 2946997 - RNA, 18 nt, Human
gggcugcaugcgggcuuc

SEQ ID NO: 2946998 - RNA, 10 nt, Human
gggcucagca

SEQ ID NO: 2946999 - RNA, 22 nt, Human
gggcugcaccggcuggccuggc

SEQ ID NO: 2947000 - RNA, 18 nt, Human
gggcucagcaaaagaugc

SEQ ID NO: 2947001 - RNA, 20 nt, Human
gggcuggguucuacccaggu

SEQ ID NO: 2947002 - RNA, 22 nt, Human
gggcuggguucuacccaggugc

SEQ ID NO: 2947003 - RNA, 15 nt, Human
aaaaugugauaugua

SEQ ID NO: 2947004 - RNA, 22 nt, Human
aaaauuuuuucucuaggaaaua

SEQ ID NO: 2947005 - RNA, 22 nt, Human
aaauaaggaaugauauaagguu

SEQ ID NO: 2947006 - RNA, 15 nt, Human
aaauaaucucugauu

SEQ ID NO: 2947007 - RNA, 12 nt, Human
aaauaagucuga

SEQ ID NO: 2947008 - RNA, 14 nt, Human
aaauaagucugauu

SEQ ID NO: 2947009 - RNA, 16 nt, Human
aaauaagucugauuua

SEQ ID NO: 2947010 - RNA, 17 nt, Human
aaauaagucugauuuaa

SEQ ID NO: 2947011 - RNA, 12 nt, Human
aaauaaugugaa

SEQ ID NO: 2947012 - RNA, 15 nt, Human
aaauaauuuuuauau

SEQ ID NO: 2947013 - RNA, 13 nt, Human
aaauaaugugaaa

SEQ ID NO: 2947014 - RNA, 18 nt, Human
aaauaauuuuuauauuug

SEQ ID NO: 2947015 - RNA, 20 nt, Human
aaauaauuuuuauauuugaa

SEQ ID NO: 2947016 - RNA, 15 nt, Human
gguuuggagcugauc

SEQ ID NO: 2947017 - RNA, 12 nt, Human
aaaguggugaga

SEQ ID NO: 2947018 - RNA, 20 nt, Human
gguuuggacaaaauggaaua

SEQ ID NO: 2947019 - RNA, 13 nt, Human
gguuuggagcuga

SEQ ID NO: 2947020 - RNA, 18 nt, Human
aaaguuuauaaaagugaa

SEQ ID NO: 2947021 - RNA, 21 nt, Human
aaaguuucucuuuucaaaaca

SEQ ID NO: 2947022 - RNA, 23 nt, Human
aaaguuucucuuuucaaaacauu

SEQ ID NO: 2947023 - RNA, 16 nt, Human
aaaguugaauuuuaca

SEQ ID NO: 2947024 - RNA, 14 nt, Human
aaaguugcaaggca

SEQ ID NO: 2947025 - RNA, 21 nt, Human
aaaguugcaaggcaaauguuu

SEQ ID NO: 2947026 - RNA, 15 nt, Human
aaaguugcaaggcaa

SEQ ID NO: 2947027 - RNA, 20 nt, Human
ggugggaggauugcuugagc

SEQ ID NO: 2947028 - RNA, 15 nt, Human
ggugggauccuccag

SEQ ID NO: 2947029 - RNA, 14 nt, Human
ggugggauccucca

SEQ ID NO: 2947030 - RNA, 19 nt, Human
ggugggauccuccaggugc

SEQ ID NO: 2947031 - RNA, 13 nt, Human
gguggggcagcuu

SEQ ID NO: 2947032 - RNA, 17 nt, Human
gguggggcagcuugagg

SEQ ID NO: 2947033 - RNA, 18 nt, Human
gguggggcagugcuuggc

SEQ ID NO: 2947034 - RNA, 23 nt, Human
gguggggucacucuggcagcuca

SEQ ID NO: 2947035 - RNA, 15 nt, Human
gguggggucacucug

SEQ ID NO: 2947036 - RNA, 16 nt, Human
ggugucgggcaugaca

SEQ ID NO: 2947037 - RNA, 13 nt, Human
ggugucgggcaug

SEQ ID NO: 2947038 - RNA, 18 nt, Human
ggugugagucaccaagcc

SEQ ID NO: 2947039 - RNA, 16 nt, Human
ggugugacugaauuuc

SEQ ID NO: 2947040 - RNA, 16 nt, Human
ggugugaccacugcag

SEQ ID NO: 2947041 - RNA, 21 nt, Human
gguucccuuugacgccauccc

SEQ ID NO: 2947042 - RNA, 22 nt, Human
gguucccuuugacgccauccca

SEQ ID NO: 2947043 - RNA, 22 nt, Human
gguucaggguuggccccugccc

SEQ ID NO: 2947044 - RNA, 18 nt, Human
gguucaggguuggccccu

SEQ ID NO: 2947045 - RNA, 21 nt, Human
gguucaggguuggccccugcc

SEQ ID NO: 2947046 - RNA, 12 nt, Human
gguucagcuugu

SEQ ID NO: 2947047 - RNA, 12 nt, Human
gguguggaagag

SEQ ID NO: 2947048 - RNA, 13 nt, Human
ggugugcucugau

SEQ ID NO: 2947049 - RNA, 21 nt, Human
ggugugcggccuuuggcuuca

SEQ ID NO: 2947050 - RNA, 12 nt, Human
gguuucagaaau

SEQ ID NO: 2947051 - RNA, 13 nt, Human
gguuucagaaaug

SEQ ID NO: 2947052 - RNA, 12 nt, Human
gguuucuagcau

SEQ ID NO: 2947053 - RNA, 14 nt, Human
gguuucagaaaugu

SEQ ID NO: 2947054 - RNA, 16 nt, Human
gguuuagaaagcuugc

SEQ ID NO: 2947055 - RNA, 11 nt, Human
gguuuauuugg

SEQ ID NO: 2947056 - RNA, 13 nt, Human
aaagcaaaggaga

SEQ ID NO: 2947057 - RNA, 15 nt, Human
aaagacuauucaaac

SEQ ID NO: 2947058 - RNA, 23 nt, Human
gguccugcugcaguugccaguca

SEQ ID NO: 2947059 - RNA, 21 nt, Human
gguccugcugcaguugccagu

SEQ ID NO: 2947060 - RNA, 14 nt, Human
ggucggaaaacaug

SEQ ID NO: 2947061 - RNA, 17 nt, Human
ggucuacacugugcuga

SEQ ID NO: 2947062 - RNA, 13 nt, Human
ggucggaaaacau

SEQ ID NO: 2947063 - RNA, 14 nt, Human
gguccugcugcagu

SEQ ID NO: 2947064 - RNA, 21 nt, Human
ggugcauuugaggucuguucu

SEQ ID NO: 2947065 - RNA, 21 nt, Human
ggucuguuuuguguacuuuua

SEQ ID NO: 2947066 - RNA, 18 nt, Human
ggugcaaugaccuuucaa

SEQ ID NO: 2947067 - RNA, 20 nt, Human
ggugcaaugaccuuucaaua

SEQ ID NO: 2947068 - RNA, 19 nt, Human
ggugcaaugaccuuucaau

SEQ ID NO: 2947069 - RNA, 21 nt, Human
gguggaugccugguggcagcu

SEQ ID NO: 2947070 - RNA, 14 nt, Human
gguggaugccuggu

SEQ ID NO: 2947071 - RNA, 16 nt, Human
aaagcagcguuucuau

SEQ ID NO: 2947072 - RNA, 18 nt, Human
aaagcagcguuucuauga

SEQ ID NO: 2947073 - RNA, 22 nt, Human
aaagcagcguuucuaugacaca

SEQ ID NO: 2947074 - RNA, 15 nt, Human
aaagcagcguuucua

SEQ ID NO: 2947075 - RNA, 17 nt, Human
aaagcagggacuugaac

SEQ ID NO: 2947076 - RNA, 14 nt, Human
aaagacuauucaaa

SEQ ID NO: 2947077 - RNA, 17 nt, Human
aaagacuaucuaaaugu

SEQ ID NO: 2947078 - RNA, 17 nt, Human
aaagaaguuugaacauu

SEQ ID NO: 2947079 - RNA, 12 nt, Human
aaacuuuacuau

SEQ ID NO: 2947080 - RNA, 15 nt, Human
gguccauagagagca

SEQ ID NO: 2947081 - RNA, 17 nt, Human
aaacuuuaccuuuuuua

SEQ ID NO: 2947082 - RNA, 22 nt, Human
aaacuuuaccuuuuuuauacau

SEQ ID NO: 2947083 - RNA, 22 nt, Human
gguaugaucacggcucacugca

SEQ ID NO: 2947084 - RNA, 14 nt, Human
gguaugcaaucaaa

SEQ ID NO: 2947085 - RNA, 17 nt, Human
gguccacccaggagccc

SEQ ID NO: 2947086 - RNA, 12 nt, Human
gguccacccagg

SEQ ID NO: 2947087 - RNA, 13 nt, Human
gguccacccagga

SEQ ID NO: 2947088 - RNA, 15 nt, Human
gguccacccaggagc

SEQ ID NO: 2947089 - RNA, 16 nt, Human
gguccacccaggagcc

SEQ ID NO: 2947090 - RNA, 17 nt, Human
ggguuucuaaagcugcc

SEQ ID NO: 2947091 - RNA, 14 nt, Human
gguaacaggcagau

SEQ ID NO: 2947092 - RNA, 20 nt, Human
gguaacaggcagauacagga

SEQ ID NO: 2947093 - RNA, 13 nt, Human
gguaacaggcaga

SEQ ID NO: 2947094 - RNA, 15 nt, Human
gguacacuugugaau

SEQ ID NO: 2947095 - RNA, 17 nt, Human
ggguguggcgcagcaua

SEQ ID NO: 2947096 - RNA, 12 nt, Human
ggguggugaccu

SEQ ID NO: 2947097 - RNA, 17 nt, Human
ggguggaugccuggugg

SEQ ID NO: 2947098 - RNA, 15 nt, Human
ggguggcaccagcag

SEQ ID NO: 2947099 - RNA, 13 nt, Human
ggguggaugccug

SEQ ID NO: 2947100 - RNA, 19 nt, Human
gggugggacacccugugau

SEQ ID NO: 2947101 - RNA, 20 nt, Human
ggguggggaccucaggccug

SEQ ID NO: 2947102 - RNA, 15 nt, Human
gccccuggaugcagc

SEQ ID NO: 2947103 - RNA, 15 nt, Human
gccccugcccggcug

SEQ ID NO: 2947104 - RNA, 21 nt, Human
gccccugcugguucaggguug

SEQ ID NO: 2947105 - RNA, 22 nt, Human
gccccugcugguucaggguugg

SEQ ID NO: 2947106 - RNA, 18 nt, Human
gccccacccucagaugca

SEQ ID NO: 2947107 - RNA, 15 nt, Human
gccccacccucagau

SEQ ID NO: 2947108 - RNA, 18 nt, Human
gcccaggaguuuggccag

SEQ ID NO: 2947109 - RNA, 17 nt, Human
gcccaggccccugccac

SEQ ID NO: 2947110 - RNA, 17 nt, Human
gcccaggaguuuggcca

SEQ ID NO: 2947111 - RNA, 14 nt, Human
gcccaggcaggucu

SEQ ID NO: 2947112 - RNA, 16 nt, Human
gcccaggcaggucuug

SEQ ID NO: 2947113 - RNA, 15 nt, Human
gcccaggccccugcc

SEQ ID NO: 2947114 - RNA, 13 nt, Human
gcccaggccccug

SEQ ID NO: 2947115 - RNA, 13 nt, Human
gcccaggcagguc

SEQ ID NO: 2947116 - RNA, 12 nt, Human
gcccaggcaggu

SEQ ID NO: 2947117 - RNA, 13 nt, Human
gcccaggaguuug

SEQ ID NO: 2947118 - RNA, 16 nt, Human
gcccaggaguuuggcc

SEQ ID NO: 2947119 - RNA, 15 nt, Human
gcccaggaguuuggc

SEQ ID NO: 2947120 - RNA, 14 nt, Human
gccaugugccaggu

SEQ ID NO: 2947121 - RNA, 22 nt, Human
gccaugugcuaguaauuggaaa

SEQ ID NO: 2947122 - RNA, 13 nt, Human
gccagugugacaa

SEQ ID NO: 2947123 - RNA, 22 nt, Human
gccaguuauggcuauaggugcu

SEQ ID NO: 2947124 - RNA, 13 nt, Human
gccaguugguccc

SEQ ID NO: 2947125 - RNA, 23 nt, Human
gccaguuggucccccuuccaugg

SEQ ID NO: 2947126 - RNA, 22 nt, Human
gccaguuggucccccuuccaug

SEQ ID NO: 2947127 - RNA, 21 nt, Human
gccaguuggucccccuuccau

SEQ ID NO: 2947128 - RNA, 20 nt, Human
gccaguuggucccccuucca

SEQ ID NO: 2947129 - RNA, 18 nt, Human
gccaguuggucccccuuc

SEQ ID NO: 2947130 - RNA, 16 nt, Human
gccaguuggucccccu

SEQ ID NO: 2947131 - RNA, 14 nt, Human
gccaggcccucugc

SEQ ID NO: 2947132 - RNA, 13 nt, Human
gccaggcccucug

SEQ ID NO: 2947133 - RNA, 18 nt, Human
gccaggccacaagacccu

SEQ ID NO: 2947134 - RNA, 13 nt, Human
gccaggccacaag

SEQ ID NO: 2947135 - RNA, 22 nt, Human
gccaggccagagggagugacag

SEQ ID NO: 2947136 - RNA, 15 nt, Human
gccaggccagaggga

SEQ ID NO: 2947137 - RNA, 21 nt, Human
gccaggccacaagacccuugu

SEQ ID NO: 2947138 - RNA, 13 nt, Human
gccagcaguucag

SEQ ID NO: 2947139 - RNA, 14 nt, Human
gccagcaguucaga

SEQ ID NO: 2947140 - RNA, 19 nt, Human
gccagcaguucagagcugc

SEQ ID NO: 2947141 - RNA, 20 nt, Human
gccagcaguucagagcugcc

SEQ ID NO: 2947142 - RNA, 21 nt, Human
gccagcaguucagagcugccc

SEQ ID NO: 2947143 - RNA, 13 nt, Human
gccugcuccagcu

SEQ ID NO: 2947144 - RNA, 17 nt, Human
gccugcuaauuccccag

SEQ ID NO: 2947145 - RNA, 23 nt, Human
gccugcuaauuccccagauugca

SEQ ID NO: 2947146 - RNA, 19 nt, Human
gccuccuuugugaggaagc

SEQ ID NO: 2947147 - RNA, 21 nt, Human
gccuccuuugugaggaagccg

SEQ ID NO: 2947148 - RNA, 20 nt, Human
gccuccuuugugaggaagcc

SEQ ID NO: 2947149 - RNA, 15 nt, Human
gccuccauccugagg

SEQ ID NO: 2947150 - RNA, 16 nt, Human
gccuccauccugaggc

SEQ ID NO: 2947151 - RNA, 20 nt, Human
gccuccauccugaggcucca

SEQ ID NO: 2947152 - RNA, 17 nt, Human
gcggagcacacuggcuc

SEQ ID NO: 2947153 - RNA, 14 nt, Human
gcgugcacacacca

SEQ ID NO: 2947154 - RNA, 18 nt, Human
gcgugcacacaccagagc

SEQ ID NO: 2947155 - RNA, 20 nt, Human
gcgugguggacaugcacagc

SEQ ID NO: 2947156 - RNA, 17 nt, Human
gcuacuugggaggcuga

SEQ ID NO: 2947157 - RNA, 19 nt, Human
gcuacuguccuacccaccc

SEQ ID NO: 2947158 - RNA, 20 nt, Human
gcuacuguccuacccacccu

SEQ ID NO: 2947159 - RNA, 15 nt, Human
gcuacugucagcucc

SEQ ID NO: 2947160 - RNA, 17 nt, Human
gcuacugccauccuggc

SEQ ID NO: 2947161 - RNA, 21 nt, Human
gcuacugccauccuggcccag

SEQ ID NO: 2947162 - RNA, 18 nt, Human
gcuacugccauccuggcc

SEQ ID NO: 2947163 - RNA, 20 nt, Human
gcuacugccauccuggccca

SEQ ID NO: 2947164 - RNA, 17 nt, Human
gcuacaaaaacacagca

SEQ ID NO: 2947165 - RNA, 19 nt, Human
gcuacaaaaacacagcaag

SEQ ID NO: 2947166 - RNA, 18 nt, Human
gcuacaaaaacacagcaa

SEQ ID NO: 2947167 - RNA, 16 nt, Human
gcuaauuuuucauuuu

SEQ ID NO: 2947168 - RNA, 17 nt, Human
gcguuucuaugacacau

SEQ ID NO: 2947169 - RNA, 13 nt, Human
gcgauucuucugc

SEQ ID NO: 2947170 - RNA, 24 nt, Human
gcgagccauuugucccaagugcca

SEQ ID NO: 2947171 - RNA, 20 nt, Human
gcgagccauuugucccaagu

SEQ ID NO: 2947172 - RNA, 14 nt, Human
gcgauucuucugcu

SEQ ID NO: 2947173 - RNA, 20 nt, Human
ggaagacuucaucccucugg

SEQ ID NO: 2947174 - RNA, 17 nt, Human
ggaagacuucaucccuc

SEQ ID NO: 2947175 - RNA, 14 nt, Human
ggaaaugggcagag

SEQ ID NO: 2947176 - RNA, 22 nt, Human
ggaaaugggcagagcagagacc

SEQ ID NO: 2947177 - RNA, 18 nt, Human
ggaaaugggcagagcaga

SEQ ID NO: 2947178 - RNA, 17 nt, Human
ggaaaugggcagagcag

SEQ ID NO: 2947179 - RNA, 16 nt, Human
ggaaaugggcagagca

SEQ ID NO: 2947180 - RNA, 20 nt, Human
ggaaauuagguugaaacaua

SEQ ID NO: 2947181 - RNA, 15 nt, Human
ggaacaaggcaaggc

SEQ ID NO: 2947182 - RNA, 21 nt, Human
ggaacaaggcaaggcugucaa

SEQ ID NO: 2947183 - RNA, 17 nt, Human
ggaacaaggcaaggcug

SEQ ID NO: 2947184 - RNA, 13 nt, Human
ggaacaccuccuc

SEQ ID NO: 2947185 - RNA, 23 nt, Human
ggaacaaggcaaggcugucaauu

SEQ ID NO: 2947186 - RNA, 15 nt, Human
ggaacacuccuucac

SEQ ID NO: 2947187 - RNA, 19 nt, Human
ggaacacuccuucacagau

SEQ ID NO: 2947188 - RNA, 16 nt, Human
ggaagacaaugugaaa

SEQ ID NO: 2947189 - RNA, 14 nt, Human
ggaagacaauguga

SEQ ID NO: 2947190 - RNA, 17 nt, Human
gcuuugaucccuucuua

SEQ ID NO: 2947191 - RNA, 14 nt, Human
gcuuugaucccuuc

SEQ ID NO: 2947192 - RNA, 15 nt, Human
gcuuuuggucugugu

SEQ ID NO: 2947193 - RNA, 18 nt, Human
gcuuuugucuaugggacu

SEQ ID NO: 2947194 - RNA, 22 nt, Human
gcuuuuuucucugauacagaaa

SEQ ID NO: 2947195 - RNA, 18 nt, Human
ggaaaauuuuaaaaauac

SEQ ID NO: 2947196 - RNA, 16 nt, Human
ggaaacccagcucugg

SEQ ID NO: 2947197 - RNA, 12 nt, Human
gcuuuugugcau

SEQ ID NO: 2947198 - RNA, 22 nt, Human
gcuuccagugaggcucugcccu

SEQ ID NO: 2947199 - RNA, 23 nt, Human
gcuuccagugaggcucugcccuu

SEQ ID NO: 2947200 - RNA, 19 nt, Human
gcuuccuggcaauagucaa

SEQ ID NO: 2947201 - RNA, 20 nt, Human
gcuugaccgugaggccagag

SEQ ID NO: 2947202 - RNA, 15 nt, Human
gcuucuucagagacu

SEQ ID NO: 2947203 - RNA, 12 nt, Human
gcuucuucagag

SEQ ID NO: 2947204 - RNA, 18 nt, Human
gcuuguaaauagcucagg

SEQ ID NO: 2947205 - RNA, 19 nt, Human
gcuuguaaauagcucaggu

SEQ ID NO: 2947206 - RNA, 17 nt, Human
gcuuguaaauagcucag

SEQ ID NO: 2947207 - RNA, 22 nt, Human
gcuugaccuuuaagagaaauga

SEQ ID NO: 2947208 - RNA, 18 nt, Human
gcuugaccuuuaagagaa

SEQ ID NO: 2947209 - RNA, 23 nt, Human
gcuugaccgugaggccagagaca

SEQ ID NO: 2947210 - RNA, 22 nt, Human
gcuggaguuauugaagcagagu

SEQ ID NO: 2947211 - RNA, 12 nt, Human
gcuguauuuuaa

SEQ ID NO: 2947212 - RNA, 13 nt, Human
gcuguauuuuaaa

SEQ ID NO: 2947213 - RNA, 22 nt, Human
gcuguacauacuuuuuggguuu

SEQ ID NO: 2947214 - RNA, 23 nt, Human
gcugguucaggguuggccccugc

SEQ ID NO: 2947215 - RNA, 14 nt, Human
gcuucaguggcagc

SEQ ID NO: 2947216 - RNA, 14 nt, Human
gcuucaaggauccu

SEQ ID NO: 2947217 - RNA, 22 nt, Human
gcuuaauuauugauguuuucau

SEQ ID NO: 2947218 - RNA, 17 nt, Human
gcuuauuuccucauuuu

SEQ ID NO: 2947219 - RNA, 13 nt, Human
gcuguuggcuggg

SEQ ID NO: 2947220 - RNA, 18 nt, Human
gcugcugaaggcucgagc

SEQ ID NO: 2947221 - RNA, 12 nt, Human
gcugcugacagu

SEQ ID NO: 2947222 - RNA, 20 nt, Human
gcugcugagauccuggacug

SEQ ID NO: 2947223 - RNA, 18 nt, Human
gcugcugagauccuggac

SEQ ID NO: 2947224 - RNA, 17 nt, Human
gcugccauccagguuca

SEQ ID NO: 2947225 - RNA, 13 nt, Human
gcugccccuggca

SEQ ID NO: 2947226 - RNA, 16 nt, Human
gcugccccuggcagcc

SEQ ID NO: 2947227 - RNA, 15 nt, Human
gcugccccuggcagc

SEQ ID NO: 2947228 - RNA, 24 nt, Human
gcugcucccaccuggcucuguggc

SEQ ID NO: 2947229 - RNA, 20 nt, Human
gcugcucccaccuggcucug

SEQ ID NO: 2947230 - RNA, 22 nt, Human
gcugcucccaccuggcucugug

SEQ ID NO: 2947231 - RNA, 15 nt, Human
gcugcucccaccugg

SEQ ID NO: 2947232 - RNA, 20 nt, Human
gcugccccugcacagcaggc

SEQ ID NO: 2947233 - RNA, 15 nt, Human
gcugcacccucaggc

SEQ ID NO: 2947234 - RNA, 13 nt, Human
gcugcacccucag

SEQ ID NO: 2947235 - RNA, 16 nt, Human
gcugcacccucaggca

SEQ ID NO: 2947236 - RNA, 13 nt, Human
gcugccagugccu

SEQ ID NO: 2947237 - RNA, 14 nt, Human
gcugccagugccug

SEQ ID NO: 2947238 - RNA, 12 nt, Human
gcugccauccag

SEQ ID NO: 2947239 - RNA, 13 nt, Human
gcugccauccagg

SEQ ID NO: 2947240 - RNA, 15 nt, Human
gcugaggugggagga

SEQ ID NO: 2947241 - RNA, 19 nt, Human
gcucucaggccagcugcuu

SEQ ID NO: 2947242 - RNA, 18 nt, Human
gcucucaggccagcugcu

SEQ ID NO: 2947243 - RNA, 17 nt, Human
gcucucaggccagcugc

SEQ ID NO: 2947244 - RNA, 19 nt, Human
gcucuacugaggugcuaug

SEQ ID NO: 2947245 - RNA, 16 nt, Human
gcuccucuccccagca

SEQ ID NO: 2947246 - RNA, 19 nt, Human
gcuccucuccccagcaagu

SEQ ID NO: 2947247 - RNA, 18 nt, Human
gcucucaaguuaucaggg

SEQ ID NO: 2947248 - RNA, 20 nt, Human
gcuccacuuggucugugaga

SEQ ID NO: 2947249 - RNA, 9 nt, Human
gcuccagac

SEQ ID NO: 2947250 - RNA, 23 nt, Human
gcuccagacacauguccaagaag

SEQ ID NO: 2947251 - RNA, 21 nt, Human
gcuccagacacauguccaaga

SEQ ID NO: 2947252 - RNA, 18 nt, Human
gcuccagacacaugucca

SEQ ID NO: 2947253 - RNA, 13 nt, Human
gcuccagcucacc

SEQ ID NO: 2947254 - RNA, 14 nt, Human
gcuccagcucacca

SEQ ID NO: 2947255 - RNA, 23 nt, Human
gcucccaggcauuccccaggagg

SEQ ID NO: 2947256 - RNA, 15 nt, Human
gcuccucuccccagc

SEQ ID NO: 2947257 - RNA, 20 nt, Human
gcucugaucauccacugugc

SEQ ID NO: 2947258 - RNA, 21 nt, Human
gcucugaucauccacugugcc

SEQ ID NO: 2947259 - RNA, 22 nt, Human
gcucugaucauccacugugcca

SEQ ID NO: 2947260 - RNA, 15 nt, Human
gcucugcccauccug

SEQ ID NO: 2947261 - RNA, 21 nt, Human
gcucugcccauccugccccug

SEQ ID NO: 2947262 - RNA, 17 nt, Human
gcugaauacagaggcaa

SEQ ID NO: 2947263 - RNA, 23 nt, Human
gcugaaggcucgagcaugccugg

SEQ ID NO: 2947264 - RNA, 22 nt, Human
gcugagccucacagcagugaga

SEQ ID NO: 2947265 - RNA, 19 nt, Human
gcugagccucacagcagug

SEQ ID NO: 2947266 - RNA, 21 nt, Human
gcugagccucacagcagugag

SEQ ID NO: 2947267 - RNA, 17 nt, Human
gcugagccucacagcag

SEQ ID NO: 2947268 - RNA, 13 nt, Human
gcugacagacaca

SEQ ID NO: 2947269 - RNA, 23 nt, Human
gcucugguccauagagagcaaga

SEQ ID NO: 2947270 - RNA, 20 nt, Human
gcucuguggcgagccauuug

SEQ ID NO: 2947271 - RNA, 16 nt, Human
gcugaaacaacaaaua

SEQ ID NO: 2947272 - RNA, 12 nt, Human
gcugaacaucac

SEQ ID NO: 2947273 - RNA, 14 nt, Human
gauacccaucccau

SEQ ID NO: 2947274 - RNA, 13 nt, Human
gauacccauccca

SEQ ID NO: 2947275 - RNA, 16 nt, Human
gauacuacaguuuguu

SEQ ID NO: 2947276 - RNA, 11 nt, Human
gauacuacagu

SEQ ID NO: 2947277 - RNA, 13 nt, Human
gauacuuauuuaa

SEQ ID NO: 2947278 - RNA, 19 nt, Human
gauacuuauuuaaauagau

SEQ ID NO: 2947279 - RNA, 16 nt, Human
gauacuuauuuaaaua

SEQ ID NO: 2947280 - RNA, 17 nt, Human
gauauggguaguauuuu

SEQ ID NO: 2947281 - RNA, 18 nt, Human
gauauggguaguauuuuu

SEQ ID NO: 2947282 - RNA, 20 nt, Human
gauauguaccuaacgaagua

SEQ ID NO: 2947283 - RNA, 13 nt, Human
gauaugugaacag

SEQ ID NO: 2947284 - RNA, 14 nt, Human
gauaugugaacagu

SEQ ID NO: 2947285 - RNA, 13 nt, Human
gaggucuguucuu

SEQ ID NO: 2947286 - RNA, 14 nt, Human
gaggucuguucuuu

SEQ ID NO: 2947287 - RNA, 11 nt, Human
gaggugggagg

SEQ ID NO: 2947288 - RNA, 12 nt, Human
gaggugggaucc

SEQ ID NO: 2947289 - RNA, 13 nt, Human
gagucaccaagcc

SEQ ID NO: 2947290 - RNA, 14 nt, Human
gagucaccaagccc

SEQ ID NO: 2947291 - RNA, 16 nt, Human
gagucccaccuuggcu

SEQ ID NO: 2947292 - RNA, 20 nt, Human
gagucccaccuuggcugcag

SEQ ID NO: 2947293 - RNA, 11 nt, Human
gagugcaguga

SEQ ID NO: 2947294 - RNA, 12 nt, Human
gagugcagugag

SEQ ID NO: 2947295 - RNA, 24 nt, Human
gagugagcacuaaggugugcucug

SEQ ID NO: 2947296 - RNA, 21 nt, Human
gagucccaccuuggcugcagg

SEQ ID NO: 2947297 - RNA, 13 nt, Human
gagucccaccuug

SEQ ID NO: 2947298 - RNA, 12 nt, Human
gagugagcuggu

SEQ ID NO: 2947299 - RNA, 14 nt, Human
gaguuuggccagaa

SEQ ID NO: 2947300 - RNA, 13 nt, Human
gaguuuggccaga

SEQ ID NO: 2947301 - RNA, 12 nt, Human
gaguuuggccag

SEQ ID NO: 2947302 - RNA, 20 nt, Human
gaguuugggguaugggagag

SEQ ID NO: 2947303 - RNA, 16 nt, Human
gaguuguuacauuuuu

SEQ ID NO: 2947304 - RNA, 20 nt, Human
gaguuguuacauuuuuaagu

SEQ ID NO: 2947305 - RNA, 18 nt, Human
gagugccuuacacaaugg

SEQ ID NO: 2947306 - RNA, 21 nt, Human
gagugcucaguagucagacug

SEQ ID NO: 2947307 - RNA, 16 nt, Human
gaguuuaaauuguaau

SEQ ID NO: 2947308 - RNA, 16 nt, Human
gaguuuagcuggaaaa

SEQ ID NO: 2947309 - RNA, 18 nt, Human
gaguuuagcccugaacau

SEQ ID NO: 2947310 - RNA, 23 nt, Human
gaguugugugaauaccccaagac

SEQ ID NO: 2947311 - RNA, 16 nt, Human
gaugagaggaaaucac

SEQ ID NO: 2947312 - RNA, 20 nt, Human
gaugaucuuugcagacaggc

SEQ ID NO: 2947313 - RNA, 21 nt, Human
gaugaucuuugcagacaggca

SEQ ID NO: 2947314 - RNA, 14 nt, Human
gaugaucuuugcag

SEQ ID NO: 2947315 - RNA, 17 nt, Human
gaucucuugagccuggg

SEQ ID NO: 2947316 - RNA, 16 nt, Human
gaucucuugagccugg

SEQ ID NO: 2947317 - RNA, 12 nt, Human
gaucucuugagc

SEQ ID NO: 2947318 - RNA, 15 nt, Human
gauauuuugcuuugu

SEQ ID NO: 2947319 - RNA, 16 nt, Human
gauauuuugcuuugug

SEQ ID NO: 2947320 - RNA, 15 nt, Human
gauauuuuuuucuuu

SEQ ID NO: 2947321 - RNA, 14 nt, Human
gauuaccagggacu

SEQ ID NO: 2947322 - RNA, 20 nt, Human
gauuacaggugugaaccacc

SEQ ID NO: 2947323 - RNA, 16 nt, Human
gaugugaacacaucag

SEQ ID NO: 2947324 - RNA, 14 nt, Human
gaugugaacacauc

SEQ ID NO: 2947325 - RNA, 17 nt, Human
gauuagggagagaagau

SEQ ID NO: 2947326 - RNA, 16 nt, Human
gcagccaggccacaag

SEQ ID NO: 2947327 - RNA, 14 nt, Human
gcagccaggccaca

SEQ ID NO: 2947328 - RNA, 13 nt, Human
gcagccaggccac

SEQ ID NO: 2947329 - RNA, 16 nt, Human
gcagccacauuccuga

SEQ ID NO: 2947330 - RNA, 14 nt, Human
gcagccacuauugu

SEQ ID NO: 2947331 - RNA, 12 nt, Human
gcagccaggcca

SEQ ID NO: 2947332 - RNA, 18 nt, Human
gcaggcucucaggccagc

SEQ ID NO: 2947333 - RNA, 23 nt, Human
gcaggcucucaggccagcugcuu

SEQ ID NO: 2947334 - RNA, 17 nt, Human
gcagcugcgguccaccc

SEQ ID NO: 2947335 - RNA, 19 nt, Human
gcagcugcgguccacccag

SEQ ID NO: 2947336 - RNA, 22 nt, Human
gcaggcucucaggccagcugcu

SEQ ID NO: 2947337 - RNA, 20 nt, Human
gcaggcucucaggccagcug

SEQ ID NO: 2947338 - RNA, 11 nt, Human
gcagcugccuc

SEQ ID NO: 2947339 - RNA, 12 nt, Human
gcagcugccucc

SEQ ID NO: 2947340 - RNA, 13 nt, Human
gcagcugccuccc

SEQ ID NO: 2947341 - RNA, 15 nt, Human
gcagcugccuccccu

SEQ ID NO: 2947342 - RNA, 16 nt, Human
gcagcugccuccccuc

SEQ ID NO: 2947343 - RNA, 17 nt, Human
gcagcugccuccccucc

SEQ ID NO: 2947344 - RNA, 18 nt, Human
gcagcugccuccccuccu

SEQ ID NO: 2947345 - RNA, 22 nt, Human
gcagcugccuccccuccucugc

SEQ ID NO: 2947346 - RNA, 15 nt, Human
gcaguacuaacauuu

SEQ ID NO: 2947347 - RNA, 21 nt, Human
gcaguacuaacauuuauuuga

SEQ ID NO: 2947348 - RNA, 22 nt, Human
gcaguaaaaaaugguguuuuau

SEQ ID NO: 2947349 - RNA, 19 nt, Human
gcaguaaaaaaugguguuu

SEQ ID NO: 2947350 - RNA, 19 nt, Human
gcagggacuugaacccaua

SEQ ID NO: 2947351 - RNA, 14 nt, Human
gcauacguacacau

SEQ ID NO: 2947352 - RNA, 15 nt, Human
gcauaaguccucuag

SEQ ID NO: 2947353 - RNA, 22 nt, Human
gcauaaguccucuagugaaugu

SEQ ID NO: 2947354 - RNA, 17 nt, Human
gcauaccacuuuuguuc

SEQ ID NO: 2947355 - RNA, 20 nt, Human
gcauaccacuuuuguucuug

SEQ ID NO: 2947356 - RNA, 12 nt, Human
gcacugacauug

SEQ ID NO: 2947357 - RNA, 13 nt, Human
gcacuuuaaaaca

SEQ ID NO: 2947358 - RNA, 20 nt, Human
gcagagcagagaccaucccu

SEQ ID NO: 2947359 - RNA, 19 nt, Human
gcagagcagagaccauccc

SEQ ID NO: 2947360 - RNA, 15 nt, Human
gcagagcagagacca

SEQ ID NO: 2947361 - RNA, 14 nt, Human
gcagagcagagacc

SEQ ID NO: 2947362 - RNA, 12 nt, Human
gcagagcagaga

SEQ ID NO: 2947363 - RNA, 24 nt, Human
gcagagcaccuuagacagucccug

SEQ ID NO: 2947364 - RNA, 19 nt, Human
gcagagcaccuuagacagu

SEQ ID NO: 2947365 - RNA, 23 nt, Human
gcagagcaccuuagacagucccu

SEQ ID NO: 2947366 - RNA, 22 nt, Human
gcagagcaccuuagacaguccc

SEQ ID NO: 2947367 - RNA, 21 nt, Human
gcaauaaagcagcguuucuau

SEQ ID NO: 2947368 - RNA, 22 nt, Human
gcacaagcuccaagcucccagg

SEQ ID NO: 2947369 - RNA, 21 nt, Human
gcacaagcuccaagcucccag

SEQ ID NO: 2947370 - RNA, 23 nt, Human
gcacaagcuccaagcucccaggc

SEQ ID NO: 2947371 - RNA, 14 nt, Human
gcacaagcugcacc

SEQ ID NO: 2947372 - RNA, 13 nt, Human
gcaagugagagcu

SEQ ID NO: 2947373 - RNA, 18 nt, Human
gcaccggcuggccuggcc

SEQ ID NO: 2947374 - RNA, 23 nt, Human
gcaccggcuggccuggccccuca

SEQ ID NO: 2947375 - RNA, 21 nt, Human
gcaccggcuggccuggccccu

SEQ ID NO: 2947376 - RNA, 19 nt, Human
gcaccggcuggccuggccc

SEQ ID NO: 2947377 - RNA, 21 nt, Human
gcacaugccucucucaggcca

SEQ ID NO: 2947378 - RNA, 20 nt, Human
gcacaugccucucucaggcc

SEQ ID NO: 2947379 - RNA, 19 nt, Human
gcacaugccucucucaggc

SEQ ID NO: 2947380 - RNA, 18 nt, Human
gcacaugccucucucagg

SEQ ID NO: 2947381 - RNA, 17 nt, Human
gcacaugccucucucag

SEQ ID NO: 2947382 - RNA, 14 nt, Human
gcacaugccucucu

SEQ ID NO: 2947383 - RNA, 21 nt, Human
gcacaucagcacgauuucugu

SEQ ID NO: 2947384 - RNA, 19 nt, Human
gcacaucagcacgauuucu

SEQ ID NO: 2947385 - RNA, 20 nt, Human
gcacaucagcacgauuucug

SEQ ID NO: 2947386 - RNA, 21 nt, Human
gcacaugagcuggcgggauug

SEQ ID NO: 2947387 - RNA, 15 nt, Human
gcacaucuguuuugu

SEQ ID NO: 2947388 - RNA, 13 nt, Human
gcacaugccucuc

SEQ ID NO: 2947389 - RNA, 18 nt, Human
gcacaguuuucugagaaa

SEQ ID NO: 2947390 - RNA, 17 nt, Human
gcacaguuuucugagaa

SEQ ID NO: 2947391 - RNA, 14 nt, Human
gcacaguuuucuga

SEQ ID NO: 2947392 - RNA, 13 nt, Human
gagauuuacaacu

SEQ ID NO: 2947393 - RNA, 18 nt, Human
gagauugcaccacugcac

SEQ ID NO: 2947394 - RNA, 21 nt, Human
gagaugaugccaugggcccuc

SEQ ID NO: 2947395 - RNA, 22 nt, Human
gagaggcauccaguaucuugaa

SEQ ID NO: 2947396 - RNA, 14 nt, Human
gagaggcauccagu

SEQ ID NO: 2947397 - RNA, 17 nt, Human
gagacuccugcaggcag

SEQ ID NO: 2947398 - RNA, 16 nt, Human
gagacuccugcaggca

SEQ ID NO: 2947399 - RNA, 15 nt, Human
gagacuccugcaggc

SEQ ID NO: 2947400 - RNA, 18 nt, Human
gagcugggugucaagagg

SEQ ID NO: 2947401 - RNA, 21 nt, Human
gagcggagaaaggaagggcug

SEQ ID NO: 2947402 - RNA, 18 nt, Human
gagcggagaaaggaaggg

SEQ ID NO: 2947403 - RNA, 20 nt, Human
gagcugccuguucagcucca

SEQ ID NO: 2947404 - RNA, 21 nt, Human
gagcugccuguucagcuccag

SEQ ID NO: 2947405 - RNA, 22 nt, Human
gagcugccuguucagcuccagc

SEQ ID NO: 2947406 - RNA, 22 nt, Human
gagccuugaacuuugaccucug

SEQ ID NO: 2947407 - RNA, 19 nt, Human
gagccuugaacuuugaccu

SEQ ID NO: 2947408 - RNA, 17 nt, Human
gagccuuccaggggugg

SEQ ID NO: 2947409 - RNA, 16 nt, Human
gagccuuccaggggug

SEQ ID NO: 2947410 - RNA, 15 nt, Human
gagccuuccaggggu

SEQ ID NO: 2947411 - RNA, 14 nt, Human
gagccuuccagggg

SEQ ID NO: 2947412 - RNA, 14 nt, Human
gagcagggcucagc

SEQ ID NO: 2947413 - RNA, 12 nt, Human
gagcaucaggcc

SEQ ID NO: 2947414 - RNA, 22 nt, Human
gagcaugccuggauggggcugc

SEQ ID NO: 2947415 - RNA, 22 nt, Human
gacuaucuaaauguugaaagau

SEQ ID NO: 2947416 - RNA, 13 nt, Human
gacuauuuuuguu

SEQ ID NO: 2947417 - RNA, 17 nt, Human
gacuauuuuuguuuuua

SEQ ID NO: 2947418 - RNA, 18 nt, Human
gacuauuuuuguuuuuau

SEQ ID NO: 2947419 - RNA, 22 nt, Human
gacuauucaaacagucucagga

SEQ ID NO: 2947420 - RNA, 21 nt, Human
gacuauuuuuguuuuuauuaa

SEQ ID NO: 2947421 - RNA, 22 nt, Human
gacuauuuuuguuuuuauuaaa

SEQ ID NO: 2947422 - RNA, 12 nt, Human
gacucugucuca

SEQ ID NO: 2947423 - RNA, 17 nt, Human
gacucuuaagaagacug

SEQ ID NO: 2947424 - RNA, 15 nt, Human
gacucuuaagaagac

SEQ ID NO: 2947425 - RNA, 16 nt, Human
gacucuuaagaagacu

SEQ ID NO: 2947426 - RNA, 23 nt, Human
gacuuuucuguccgagcuuugaa

SEQ ID NO: 2947427 - RNA, 21 nt, Human
gacuuuucuuuguggcuuccu

SEQ ID NO: 2947428 - RNA, 23 nt, Human
gacuuuucuuucagccaagaauu

SEQ ID NO: 2947429 - RNA, 16 nt, Human
gagaagcggcuggcag

SEQ ID NO: 2947430 - RNA, 15 nt, Human
gagaagcggcuggca

SEQ ID NO: 2947431 - RNA, 13 nt, Human
gagaagcggcugg

SEQ ID NO: 2947432 - RNA, 12 nt, Human
gagaaggaagcc

SEQ ID NO: 2947433 - RNA, 14 nt, Human
gagaaucacuugaa

SEQ ID NO: 2947434 - RNA, 21 nt, Human
gagaagucuucuauuuauuua

SEQ ID NO: 2947435 - RNA, 20 nt, Human
gagaagucuucuauuuauuu

SEQ ID NO: 2947436 - RNA, 15 nt, Human
gagaaucacuugaac

SEQ ID NO: 2947437 - RNA, 20 nt, Human
gacaggguuuugccauguug

SEQ ID NO: 2947438 - RNA, 22 nt, Human
gacaggguuuugccauguuggc

SEQ ID NO: 2947439 - RNA, 11 nt, Human
gacagcuccuu

SEQ ID NO: 2947440 - RNA, 17 nt, Human
gacagucaccucaugga

SEQ ID NO: 2947441 - RNA, 20 nt, Human
gacaguauggcagcuuuccu

SEQ ID NO: 2947442 - RNA, 19 nt, Human
gacacuucacgcccuuggc

SEQ ID NO: 2947443 - RNA, 23 nt, Human
gacagcccgggcucugccuccca

SEQ ID NO: 2947444 - RNA, 22 nt, Human
gacagcccgggcucugccuccc

SEQ ID NO: 2947445 - RNA, 21 nt, Human
gacagcccgggcucugccucc

SEQ ID NO: 2947446 - RNA, 13 nt, Human
gacacugaugggc

SEQ ID NO: 2947447 - RNA, 15 nt, Human
gacacugaugggcaa

SEQ ID NO: 2947448 - RNA, 16 nt, Human
gacacuuaaaaauggu

SEQ ID NO: 2947449 - RNA, 21 nt, Human
gacacacagcucuguccuggg

SEQ ID NO: 2947450 - RNA, 12 nt, Human
gacacacaugaa

SEQ ID NO: 2947451 - RNA, 13 nt, Human
gacacacugaaga

SEQ ID NO: 2947452 - RNA, 14 nt, Human
gacaaaaagcuacu

SEQ ID NO: 2947453 - RNA, 21 nt, Human
gaauuuugugcccccauguaa

SEQ ID NO: 2947454 - RNA, 23 nt, Human
gaauuuuggcugugucucccuuc

SEQ ID NO: 2947455 - RNA, 20 nt, Human
gaauuuugugcccccaugua

SEQ ID NO: 2947456 - RNA, 15 nt, Human
gacaaaauggaauac

SEQ ID NO: 2947457 - RNA, 14 nt, Human
gacacacagcucug

SEQ ID NO: 2947458 - RNA, 13 nt, Human
gacacacagcucu

SEQ ID NO: 2947459 - RNA, 15 nt, Human
gacacacagcucugu

SEQ ID NO: 2947460 - RNA, 17 nt, Human
gacacacagcucugucc

SEQ ID NO: 2947461 - RNA, 18 nt, Human
gacacacagcucuguccu

SEQ ID NO: 2947462 - RNA, 19 nt, Human
gacacacagcucuguccug

SEQ ID NO: 2947463 - RNA, 19 nt, Human
gaauuuuggcugugucucc

SEQ ID NO: 2947464 - RNA, 12 nt, Human
gaauuaugaaac

SEQ ID NO: 2947465 - RNA, 11 nt, Human
gaauuaguuuu

SEQ ID NO: 2947466 - RNA, 22 nt, Human
gaaugaaugucagugugacuga

SEQ ID NO: 2947467 - RNA, 18 nt, Human
gaaugaaugucaguguga

SEQ ID NO: 2947468 - RNA, 14 nt, Human
gaaugaaugucagu

SEQ ID NO: 2947469 - RNA, 11 nt, Human
gaaugaauguc

SEQ ID NO: 2947470 - RNA, 20 nt, Human
gaaugagagacacacugaag

SEQ ID NO: 2947471 - RNA, 22 nt, Human
gaaugagagacacacugaagaa

SEQ ID NO: 2947472 - RNA, 23 nt, Human
gaaugagagacacacugaagaag

SEQ ID NO: 2947473 - RNA, 15 nt, Human
gaagcucagggccug

SEQ ID NO: 2947474 - RNA, 14 nt, Human
gaagcucagggccu

SEQ ID NO: 2947475 - RNA, 23 nt, Human
gaagcucagggccuggcucaggu

SEQ ID NO: 2947476 - RNA, 21 nt, Human
gaagcucagggccuggcucag

SEQ ID NO: 2947477 - RNA, 20 nt, Human
gaagcucagggccuggcuca

SEQ ID NO: 2947478 - RNA, 19 nt, Human
gaagcucagggccuggcuc

SEQ ID NO: 2947479 - RNA, 18 nt, Human
gaagcucagggccuggcu

SEQ ID NO: 2947480 - RNA, 17 nt, Human
gaagcucagggccuggc

SEQ ID NO: 2947481 - RNA, 16 nt, Human
gaagcucagggccugg

SEQ ID NO: 2947482 - RNA, 18 nt, Human
gaagucuuuguacagaca

SEQ ID NO: 2947483 - RNA, 20 nt, Human
gaagucuuuguacagacaac

SEQ ID NO: 2947484 - RNA, 19 nt, Human
gaagucuuuguacagacaa

SEQ ID NO: 2947485 - RNA, 17 nt, Human
gaaggcucgagcaugcc

SEQ ID NO: 2947486 - RNA, 16 nt, Human
gaaggcucgagcaugc

SEQ ID NO: 2947487 - RNA, 22 nt, Human
cuuuccugaggcugggcucccu

SEQ ID NO: 2947488 - RNA, 20 nt, Human
cuuucagccaagaauucuua

SEQ ID NO: 2947489 - RNA, 23 nt, Human
cuuucagccaagaauucuuaaau

SEQ ID NO: 2947490 - RNA, 23 nt, Human
cuuucaauaggaaaaacugauuu

SEQ ID NO: 2947491 - RNA, 17 nt, Human
cuuugggccuggcuccc

SEQ ID NO: 2947492 - RNA, 17 nt, Human
cuuucuacccagcgagc

SEQ ID NO: 2947493 - RNA, 15 nt, Human
cuuucuagccagagg

SEQ ID NO: 2947494 - RNA, 16 nt, Human
cuuucuagccagagga

SEQ ID NO: 2947495 - RNA, 22 nt, Human
cuuuuaugauugccuuuuuaua

SEQ ID NO: 2947496 - RNA, 13 nt, Human
cuuuuauaaacuu

SEQ ID NO: 2947497 - RNA, 18 nt, Human
gaaaagaaaaaugagccu

SEQ ID NO: 2947498 - RNA, 21 nt, Human
gaaaauggaagacagcucuua

SEQ ID NO: 2947499 - RNA, 14 nt, Human
gaaaaacugauuuu

SEQ ID NO: 2947500 - RNA, 23 nt, Human
gaaaauggacguguuaugacucc

SEQ ID NO: 2947501 - RNA, 19 nt, Human
gaaaauggacguguuauga

SEQ ID NO: 2947502 - RNA, 15 nt, Human
gaaaauguaugugua

SEQ ID NO: 2947503 - RNA, 23 nt, Human
cuuuuuuggcugcugaaggcucg

SEQ ID NO: 2947504 - RNA, 12 nt, Human
cuuuugugcauu

SEQ ID NO: 2947505 - RNA, 13 nt, Human
cuuuugugcauua

SEQ ID NO: 2947506 - RNA, 18 nt, Human
cuuuugucuaugggacuc

SEQ ID NO: 2947507 - RNA, 18 nt, Human
cuuuuggaagguauuuaa

SEQ ID NO: 2947508 - RNA, 23 nt, Human
cuuuugcccacacuugggagcaa

SEQ ID NO: 2947509 - RNA, 13 nt, Human
gaaacuuuuggaa

SEQ ID NO: 2947510 - RNA, 15 nt, Human
gaaacuuuuggaagg

SEQ ID NO: 2947511 - RNA, 21 nt, Human
gaaagaaaauaccaaggaaca

SEQ ID NO: 2947512 - RNA, 20 nt, Human
gaaagacuaucuaaauguug

SEQ ID NO: 2947513 - RNA, 15 nt, Human
gaaagacuauucaaa

SEQ ID NO: 2947514 - RNA, 14 nt, Human
gaaagacuauucaa

SEQ ID NO: 2947515 - RNA, 17 nt, Human
gaaagacuauucaaaca

SEQ ID NO: 2947516 - RNA, 21 nt, Human
gaaaggcuccaggagcagcca

SEQ ID NO: 2947517 - RNA, 22 nt, Human
gaaaggcuccaggagcagccac

SEQ ID NO: 2947518 - RNA, 20 nt, Human
gaaaggcuccaggagcagcc

SEQ ID NO: 2947519 - RNA, 19 nt, Human
gaaaucaccgaaaacgugg

SEQ ID NO: 2947520 - RNA, 20 nt, Human
gaaaucaaauaugcaaagca

SEQ ID NO: 2947521 - RNA, 19 nt, Human
gaaaucaaauaugcaaagc

SEQ ID NO: 2947522 - RNA, 17 nt, Human
gaaaucaaauaugcaaa

SEQ ID NO: 2947523 - RNA, 18 nt, Human
gaaaucaaauaugcaaag

SEQ ID NO: 2947524 - RNA, 18 nt, Human
gaaauauuuauuuuaaua

SEQ ID NO: 2947525 - RNA, 22 nt, Human
gaaauauuuauuuuaauaaugu

SEQ ID NO: 2947526 - RNA, 19 nt, Human
gaaagggacuuggaagcuc

SEQ ID NO: 2947527 - RNA, 20 nt, Human
gaaagggacgcuacccggga

SEQ ID NO: 2947528 - RNA, 22 nt, Human
gaaagggacuuggaagcuccgc

SEQ ID NO: 2947529 - RNA, 17 nt, Human
gaaauauuuauuuuaau

SEQ ID NO: 2947530 - RNA, 16 nt, Human
cuuauggaacacucug

SEQ ID NO: 2947531 - RNA, 13 nt, Human
cuuauggaacacu

SEQ ID NO: 2947532 - RNA, 20 nt, Human
cuuauggaacacucugagac

SEQ ID NO: 2947533 - RNA, 19 nt, Human
cuuauggaacacucugaga

SEQ ID NO: 2947534 - RNA, 17 nt, Human
cuuauggaacacucuga

SEQ ID NO: 2947535 - RNA, 23 nt, Human
cuuauuguagcauccuggaauau

SEQ ID NO: 2947536 - RNA, 21 nt, Human
cuucaccuuuguccccaccgc

SEQ ID NO: 2947537 - RNA, 22 nt, Human
cuucaccuuuguccccaccgca

SEQ ID NO: 2947538 - RNA, 20 nt, Human
cuuauuguagcauccuggaa

SEQ ID NO: 2947539 - RNA, 19 nt, Human
cuucacggaagagccuugc

SEQ ID NO: 2947540 - RNA, 15 nt, Human
cuucacggaagagcc

SEQ ID NO: 2947541 - RNA, 12 nt, Human
cugugcugaguc

SEQ ID NO: 2947542 - RNA, 19 nt, Human
cugugcugagucugaaggc

SEQ ID NO: 2947543 - RNA, 14 nt, Human
cugugcugagucug

SEQ ID NO: 2947544 - RNA, 23 nt, Human
cuucccaccucucucacuccuug

SEQ ID NO: 2947545 - RNA, 21 nt, Human
cuucccaccucucucacuccu

SEQ ID NO: 2947546 - RNA, 11 nt, Human
cuucccaccuc

SEQ ID NO: 2947547 - RNA, 21 nt, Human
cuuccagugaggcucugcccu

SEQ ID NO: 2947548 - RNA, 23 nt, Human
cuuccagugaggcucugcccuug

SEQ ID NO: 2947549 - RNA, 22 nt, Human
cuuccagugaggcucugcccuu

SEQ ID NO: 2947550 - RNA, 17 nt, Human
cuucaguuugcagagua

SEQ ID NO: 2947551 - RNA, 16 nt, Human
cuucaguuugcagagu

SEQ ID NO: 2947552 - RNA, 20 nt, Human
cuucagagacuccugcaggc

SEQ ID NO: 2947553 - RNA, 19 nt, Human
cuucagagacuccugcagg

SEQ ID NO: 2947554 - RNA, 18 nt, Human
cuucagagacuccugcag

SEQ ID NO: 2947555 - RNA, 17 nt, Human
cuucacgcccuuggcca

SEQ ID NO: 2947556 - RNA, 15 nt, Human
cuucacgcccuuggc

SEQ ID NO: 2947557 - RNA, 17 nt, Human
cuucagagacuccugca

SEQ ID NO: 2947558 - RNA, 15 nt, Human
cuucacuguaaaaua

SEQ ID NO: 2947559 - RNA, 23 nt, Human
cuucugacccaugcugcccugug

SEQ ID NO: 2947560 - RNA, 20 nt, Human
cuucugacccaugcugcccu

SEQ ID NO: 2947561 - RNA, 22 nt, Human
cuucugacccaugcugcccugu

SEQ ID NO: 2947562 - RNA, 21 nt, Human
cuucugacccaugcugcccug

SEQ ID NO: 2947563 - RNA, 23 nt, Human
cuucuucagagacuccugcaggc

SEQ ID NO: 2947564 - RNA, 18 nt, Human
cuuccucccucccucuuu

SEQ ID NO: 2947565 - RNA, 17 nt, Human
cuuccugcaacaccuug

SEQ ID NO: 2947566 - RNA, 23 nt, Human
cuucuaaguaaaaccacagcagu

SEQ ID NO: 2947567 - RNA, 22 nt, Human
cuucuaaguaaaaccacagcag

SEQ ID NO: 2947568 - RNA, 16 nt, Human
cuugaagacuuuucuu

SEQ ID NO: 2947569 - RNA, 18 nt, Human
cuugaauuguaaggaaug

SEQ ID NO: 2947570 - RNA, 19 nt, Human
cuugaauuguaaggaauga

SEQ ID NO: 2947571 - RNA, 14 nt, Human
cuugacagggcaca

SEQ ID NO: 2947572 - RNA, 15 nt, Human
cuugacagggcacac

SEQ ID NO: 2947573 - RNA, 13 nt, Human
cuugacagggcac

SEQ ID NO: 2947574 - RNA, 12 nt, Human
cuugaugaagaa

SEQ ID NO: 2947575 - RNA, 20 nt, Human
cuuggcgcugccccuggcag

SEQ ID NO: 2947576 - RNA, 12 nt, Human
cuuggcgcugcc

SEQ ID NO: 2947577 - RNA, 17 nt, Human
cuuggcgcugccccugg

SEQ ID NO: 2947578 - RNA, 14 nt, Human
cuuggcgcugcccc

SEQ ID NO: 2947579 - RNA, 13 nt, Human
cuugaugaagaag

SEQ ID NO: 2947580 - RNA, 13 nt, Human
cuggccccucagg

SEQ ID NO: 2947581 - RNA, 15 nt, Human
cuggcagcucagaga

SEQ ID NO: 2947582 - RNA, 12 nt, Human
cuggcagcucag

SEQ ID NO: 2947583 - RNA, 14 nt, Human
cuggcagcucagag

SEQ ID NO: 2947584 - RNA, 13 nt, Human
cuggcagcucaga

SEQ ID NO: 2947585 - RNA, 21 nt, Human
cuggccccucagggucccugg

SEQ ID NO: 2947586 - RNA, 20 nt, Human
cuggccccucagggucccug

SEQ ID NO: 2947587 - RNA, 18 nt, Human
cuggccccucaggguccc

SEQ ID NO: 2947588 - RNA, 17 nt, Human
cuggccccucagggucc

SEQ ID NO: 2947589 - RNA, 12 nt, Human
cugggacacagu

SEQ ID NO: 2947590 - RNA, 13 nt, Human
cugggacacaguu

SEQ ID NO: 2947591 - RNA, 10 nt, Human
cugggacagg

SEQ ID NO: 2947592 - RNA, 23 nt, Human
cuggugacuuuccucuuuggucu

SEQ ID NO: 2947593 - RNA, 16 nt, Human
cuggguguggcgcagc

SEQ ID NO: 2947594 - RNA, 17 nt, Human
cuggguguggcgcagca

SEQ ID NO: 2947595 - RNA, 22 nt, Human
cuggguggcaccagcagccugg

SEQ ID NO: 2947596 - RNA, 23 nt, Human
cuggguggcaccagcagccugga

SEQ ID NO: 2947597 - RNA, 14 nt, Human
cuggguucacugca

SEQ ID NO: 2947598 - RNA, 15 nt, Human
cuggugacuuuccuc

SEQ ID NO: 2947599 - RNA, 21 nt, Human
cuggugacuuuccucuuuggu

SEQ ID NO: 2947600 - RNA, 20 nt, Human
cuggugacuuuccucuuugg

SEQ ID NO: 2947601 - RNA, 17 nt, Human
cugggcagaaggaagac

SEQ ID NO: 2947602 - RNA, 16 nt, Human
cuggggccgaaagaac

SEQ ID NO: 2947603 - RNA, 22 nt, Human
cugggcagcugccuccccuccu

SEQ ID NO: 2947604 - RNA, 20 nt, Human
cugggcagcugccuccccuc

SEQ ID NO: 2947605 - RNA, 21 nt, Human
cugggcagcugccuccccucc

SEQ ID NO: 2947606 - RNA, 16 nt, Human
cugggcagcugccucc

SEQ ID NO: 2947607 - RNA, 19 nt, Human
cugggcagcugccuccccu

SEQ ID NO: 2947608 - RNA, 18 nt, Human
cugggcagaaggaagacu

SEQ ID NO: 2947609 - RNA, 16 nt, Human
cugggcagaaggaaga

SEQ ID NO: 2947610 - RNA, 13 nt, Human
cugucgcccaguc

SEQ ID NO: 2947611 - RNA, 15 nt, Human
cugugaagagaacca

SEQ ID NO: 2947612 - RNA, 14 nt, Human
cugugcucuggaca

SEQ ID NO: 2947613 - RNA, 16 nt, Human
cugugagaugcuagaa

SEQ ID NO: 2947614 - RNA, 16 nt, Human
cugguuuguucccugu

SEQ ID NO: 2947615 - RNA, 21 nt, Human
cugucagcuccccucggagaa

SEQ ID NO: 2947616 - RNA, 18 nt, Human
cugucagccauuccuguu

SEQ ID NO: 2947617 - RNA, 22 nt, Human
cugucagcuaaagaaguuugaa

SEQ ID NO: 2947618 - RNA, 17 nt, Human
cugucauuugagcaggg

SEQ ID NO: 2947619 - RNA, 18 nt, Human
cugucauuugagcagggc

SEQ ID NO: 2947620 - RNA, 16 nt, Human
cugucauuugagcagg

SEQ ID NO: 2947621 - RNA, 23 nt, Human
cugucagcuccccucggagaaga

SEQ ID NO: 2947622 - RNA, 22 nt, Human
cugguuuuaaauauuuugacuu

SEQ ID NO: 2947623 - RNA, 18 nt, Human
cuguaggaagguuaaugu

SEQ ID NO: 2947624 - RNA, 21 nt, Human
cuguaggaagguuaauguuca

SEQ ID NO: 2947625 - RNA, 21 nt, Human
cugcugacagacacaggcccg

SEQ ID NO: 2947626 - RNA, 23 nt, Human
cugcugacagacacaggcccggc

SEQ ID NO: 2947627 - RNA, 15 nt, Human
cugcugacagacaca

SEQ ID NO: 2947628 - RNA, 18 nt, Human
cugcugacagacacaggc

SEQ ID NO: 2947629 - RNA, 19 nt, Human
cugcugacagacacaggcc

SEQ ID NO: 2947630 - RNA, 20 nt, Human
cugcugacagacacaggccc

SEQ ID NO: 2947631 - RNA, 13 nt, Human
cugcuuaacuuca

SEQ ID NO: 2947632 - RNA, 13 nt, Human
cugcuucagccuc

SEQ ID NO: 2947633 - RNA, 15 nt, Human
cugcuuaacuucaca

SEQ ID NO: 2947634 - RNA, 17 nt, Human
cugcuuaacuucacaua

SEQ ID NO: 2947635 - RNA, 14 nt, Human
cugcuucagccucc

SEQ ID NO: 2947636 - RNA, 16 nt, Human
cugcuucagccucccg

SEQ ID NO: 2947637 - RNA, 22 nt, Human
cugcuuuuuaaagaaugcucuu

SEQ ID NO: 2947638 - RNA, 17 nt, Human
cuggaacacuaaugagg

SEQ ID NO: 2947639 - RNA, 21 nt, Human
cuggaaaucaggguuaguauu

SEQ ID NO: 2947640 - RNA, 16 nt, Human
cuggaaauauuaagaa

SEQ ID NO: 2947641 - RNA, 14 nt, Human
cugcccugugggcc

SEQ ID NO: 2947642 - RNA, 16 nt, Human
cugcuaauuccccaga

SEQ ID NO: 2947643 - RNA, 19 nt, Human
cugccuguugggccaggag

SEQ ID NO: 2947644 - RNA, 18 nt, Human
cugccuguugggccagga

SEQ ID NO: 2947645 - RNA, 14 nt, Human
cugccuguugggcc

SEQ ID NO: 2947646 - RNA, 16 nt, Human
cugccuguugggccag

SEQ ID NO: 2947647 - RNA, 15 nt, Human
cugcuacagagcaga

SEQ ID NO: 2947648 - RNA, 23 nt, Human
cugccugggaucccucauccuca

SEQ ID NO: 2947649 - RNA, 14 nt, Human
cugccuguucagcu

SEQ ID NO: 2947650 - RNA, 15 nt, Human
cugccuguucagcuc

SEQ ID NO: 2947651 - RNA, 15 nt, Human
cugccucgaacuggc

SEQ ID NO: 2947652 - RNA, 17 nt, Human
cugccucgaacuggcug

SEQ ID NO: 2947653 - RNA, 18 nt, Human
cugccucgaacuggcugc

SEQ ID NO: 2947654 - RNA, 22 nt, Human
cugccugggaucccucauccuc

SEQ ID NO: 2947655 - RNA, 19 nt, Human
cugagacucgcgacaaugc

SEQ ID NO: 2947656 - RNA, 17 nt, Human
cugagacucgcgacaau

SEQ ID NO: 2947657 - RNA, 15 nt, Human
cugcauguuugugau

SEQ ID NO: 2947658 - RNA, 13 nt, Human
cugcauguuacau

SEQ ID NO: 2947659 - RNA, 20 nt, Human
cugcauuuaaaagauacagu

SEQ ID NO: 2947660 - RNA, 22 nt, Human
cugcauuuaaaagauacaguua

SEQ ID NO: 2947661 - RNA, 17 nt, Human
cugccaauauccuaaua

SEQ ID NO: 2947662 - RNA, 16 nt, Human
cugccaauauccuaau

SEQ ID NO: 2947663 - RNA, 14 nt, Human
cugccaauauccua

SEQ ID NO: 2947664 - RNA, 13 nt, Human
cugccaauauccu

SEQ ID NO: 2947665 - RNA, 22 nt, Human
cugccaauauccuaauaaaaag

SEQ ID NO: 2947666 - RNA, 20 nt, Human
cugccaauauccuaauaaaa

SEQ ID NO: 2947667 - RNA, 19 nt, Human
cugccaauauccuaauaaa

SEQ ID NO: 2947668 - RNA, 18 nt, Human
cugccaauauccuaauaa

SEQ ID NO: 2947669 - RNA, 17 nt, Human
cugccaaugggagcuca

SEQ ID NO: 2947670 - RNA, 15 nt, Human
cugccaaugggagcu

SEQ ID NO: 2947671 - RNA, 12 nt, Human
cugccauccagg

SEQ ID NO: 2947672 - RNA, 11 nt, Human
cugccagggac

SEQ ID NO: 2947673 - RNA, 15 nt, Human
cugccagggacagag

SEQ ID NO: 2947674 - RNA, 12 nt, Human
cugccagggaca

SEQ ID NO: 2947675 - RNA, 20 nt, Human
cugccauauucuguuggcca

SEQ ID NO: 2947676 - RNA, 21 nt, Human
cugccauauucuguuggccag

SEQ ID NO: 2947677 - RNA, 22 nt, Human
cugccauauucuguuggccagu

SEQ ID NO: 2947678 - RNA, 23 nt, Human
cugccauauucuguuggccagug

SEQ ID NO: 2947679 - RNA, 12 nt, Human
cugcccugugag

SEQ ID NO: 2947680 - RNA, 18 nt, Human
cugcccugugggccccca

SEQ ID NO: 2947681 - RNA, 16 nt, Human
cugcccugugggcccc

SEQ ID NO: 2947682 - RNA, 15 nt, Human
cugcccugugggccc

SEQ ID NO: 2947683 - RNA, 13 nt, Human
cugcccugugagu

SEQ ID NO: 2947684 - RNA, 22 nt, Human
cugccccucaacucuccuccag

SEQ ID NO: 2947685 - RNA, 14 nt, Human
cugccccucaacuc

SEQ ID NO: 2947686 - RNA, 20 nt, Human
aacuacauuagguugugaau

SEQ ID NO: 2947687 - RNA, 18 nt, Human
aaccuugaaaacuuuaug

SEQ ID NO: 2947688 - RNA, 12 nt, Human
aaccugugucuc

SEQ ID NO: 2947689 - RNA, 23 nt, Human
aacuaucucauuuccaagcaagu

SEQ ID NO: 2947690 - RNA, 21 nt, Human
aacuagaguuuagcuggaaaa

SEQ ID NO: 2947691 - RNA, 12 nt, Human
aacucauuucua

SEQ ID NO: 2947692 - RNA, 12 nt, Human
aacuccuggccu

SEQ ID NO: 2947693 - RNA, 22 nt, Human
gugaaccaccacacccagccca

SEQ ID NO: 2947694 - RNA, 23 nt, Human
gugaaccaccacacccagcccac

SEQ ID NO: 2947695 - RNA, 16 nt, Human
aacucuccucugcugc

SEQ ID NO: 2947696 - RNA, 18 nt, Human
aacucuccuccagaguca

SEQ ID NO: 2947697 - RNA, 15 nt, Human
aacucuccuccagag

SEQ ID NO: 2947698 - RNA, 14 nt, Human
gucuggcccuuccu

SEQ ID NO: 2947699 - RNA, 20 nt, Human
aaccugagccccaaaaggua

SEQ ID NO: 2947700 - RNA, 17 nt, Human
aaccugaggauucuauu

SEQ ID NO: 2947701 - RNA, 14 nt, Human
gucuucuauuuauu

SEQ ID NO: 2947702 - RNA, 12 nt, Human
gucuucuauuua

SEQ ID NO: 2947703 - RNA, 17 nt, Human
gucuucuauuuauuuau

SEQ ID NO: 2947704 - RNA, 18 nt, Human
gucuuuggacccugaggc

SEQ ID NO: 2947705 - RNA, 16 nt, Human
gucuuucacauuuaaa

SEQ ID NO: 2947706 - RNA, 15 nt, Human
aaccaagucaaguga

SEQ ID NO: 2947707 - RNA, 19 nt, Human
aaccaccacacccagccca

SEQ ID NO: 2947708 - RNA, 12 nt, Human
aaccaucauuga

SEQ ID NO: 2947709 - RNA, 21 nt, Human
aaccaccacacccagcccacu

SEQ ID NO: 2947710 - RNA, 18 nt, Human
aaccaucauugaaaucuu

SEQ ID NO: 2947711 - RNA, 17 nt, Human
aaccaucauugaaaucu

SEQ ID NO: 2947712 - RNA, 18 nt, Human
aacccaaguccaagcaua

SEQ ID NO: 2947713 - RNA, 23 nt, Human
aacccaaauguucaucaaugaau

SEQ ID NO: 2947714 - RNA, 10 nt, Human
aacccagcuc

SEQ ID NO: 2947715 - RNA, 12 nt, Human
aaccucuaaauu

SEQ ID NO: 2947716 - RNA, 18 nt, Human
aaccugagccccaaaagg

SEQ ID NO: 2947717 - RNA, 16 nt, Human
gugaugagaggaaauc

SEQ ID NO: 2947718 - RNA, 14 nt, Human
gugaugagaggaaa

SEQ ID NO: 2947719 - RNA, 22 nt, Human
gugaugcgcaugucacggaggg

SEQ ID NO: 2947720 - RNA, 17 nt, Human
gugaugggaaagcauug

SEQ ID NO: 2947721 - RNA, 18 nt, Human
gugauggggcccugccuc

SEQ ID NO: 2947722 - RNA, 17 nt, Human
gugauggggcccugccu

SEQ ID NO: 2947723 - RNA, 16 nt, Human
gugauggggcccugcc

SEQ ID NO: 2947724 - RNA, 14 nt, Human
gugauggggcccug

SEQ ID NO: 2947725 - RNA, 13 nt, Human
aacuuccaauuua

SEQ ID NO: 2947726 - RNA, 18 nt, Human
aacuuccagauccuggaa

SEQ ID NO: 2947727 - RNA, 21 nt, Human
aacuucagcgguuuauauaag

SEQ ID NO: 2947728 - RNA, 17 nt, Human
gugcacaucuguuuugu

SEQ ID NO: 2947729 - RNA, 22 nt, Human
gugcaugcugucccuuacguga

SEQ ID NO: 2947730 - RNA, 21 nt, Human
gugcacacaccagagcccacc

SEQ ID NO: 2947731 - RNA, 19 nt, Human
gugauggggcccugccucc

SEQ ID NO: 2947732 - RNA, 22 nt, Human
gugcaaugaccuuucaauagga

SEQ ID NO: 2947733 - RNA, 23 nt, Human
gugcauuaucuagauacuguauc

SEQ ID NO: 2947734 - RNA, 19 nt, Human
gugcauguguguucaugca

SEQ ID NO: 2947735 - RNA, 15 nt, Human
gugcauuaucuagau

SEQ ID NO: 2947736 - RNA, 19 nt, Human
gugcauuaucuagauacug

SEQ ID NO: 2947737 - RNA, 23 nt, Human
gugccucucccugcugcuccuag

SEQ ID NO: 2947738 - RNA, 12 nt, Human
gugccucucccu

SEQ ID NO: 2947739 - RNA, 14 nt, Human
gugccucucccugc

SEQ ID NO: 2947740 - RNA, 16 nt, Human
gugccucucccugcug

SEQ ID NO: 2947741 - RNA, 22 nt, Human
gugccucucccugcugcuccua

SEQ ID NO: 2947742 - RNA, 13 nt, Human
aacuggcaaagca

SEQ ID NO: 2947743 - RNA, 22 nt, Human
aacuggcaaagcagaaugugau

SEQ ID NO: 2947744 - RNA, 16 nt, Human
aacuggauuaaacuua

SEQ ID NO: 2947745 - RNA, 11 nt, Human
aacuggcugca

SEQ ID NO: 2947746 - RNA, 19 nt, Human
aacuggacugguucaaaug

SEQ ID NO: 2947747 - RNA, 15 nt, Human
aacuggauuaaacuu

SEQ ID NO: 2947748 - RNA, 16 nt, Human
aacuggguacuugugg

SEQ ID NO: 2947749 - RNA, 21 nt, Human
aacuggguacuuguggacaca

SEQ ID NO: 2947750 - RNA, 21 nt, Human
aacugggggagggugaaguga

SEQ ID NO: 2947751 - RNA, 22 nt, Human
aacugggggagggugaagugaa

SEQ ID NO: 2947752 - RNA, 17 nt, Human
aacugggacaggggaga

SEQ ID NO: 2947753 - RNA, 20 nt, Human
aacugggaugaggugacuau

SEQ ID NO: 2947754 - RNA, 23 nt, Human
aacugcugacuguuuucucuuga

SEQ ID NO: 2947755 - RNA, 21 nt, Human
aacugcugacuguuuucucuu

SEQ ID NO: 2947756 - RNA, 20 nt, Human
aacugcugacuguuuucucu

SEQ ID NO: 2947757 - RNA, 15 nt, Human
aacugcugacuguuu

SEQ ID NO: 2947758 - RNA, 19 nt, Human
aacugcacugucaagauga

SEQ ID NO: 2947759 - RNA, 17 nt, Human
gugaacugaucauguuu

SEQ ID NO: 2947760 - RNA, 21 nt, Human
gugagaugcuagaacucccuu

SEQ ID NO: 2947761 - RNA, 19 nt, Human
gugaacuugggccacugug

SEQ ID NO: 2947762 - RNA, 17 nt, Human
gugaacuugggccacug

SEQ ID NO: 2947763 - RNA, 22 nt, Human
gugaggccagagacacaagccu

SEQ ID NO: 2947764 - RNA, 17 nt, Human
gugaggccagagacaca

SEQ ID NO: 2947765 - RNA, 19 nt, Human
aacucugagugcaaacuuc

SEQ ID NO: 2947766 - RNA, 18 nt, Human
aacucugagugcaaacuu

SEQ ID NO: 2947767 - RNA, 15 nt, Human
gugagucgaggacag

SEQ ID NO: 2947768 - RNA, 22 nt, Human
gugagucgaggacagggaggug

SEQ ID NO: 2947769 - RNA, 20 nt, Human
aacucugagugcaaacuuca

SEQ ID NO: 2947770 - RNA, 22 nt, Human
aacucugagugcaaacuucaga

SEQ ID NO: 2947771 - RNA, 21 nt, Human
aacucuucaaucucuugcacu

SEQ ID NO: 2947772 - RNA, 12 nt, Human
aacugaaaucau

SEQ ID NO: 2947773 - RNA, 20 nt, Human
aaauuuuuucucuaggaaau

SEQ ID NO: 2947774 - RNA, 18 nt, Human
aaauuuugauguuuuaag

SEQ ID NO: 2947775 - RNA, 23 nt, Human
aaauuuugauguuuuaaggaugc

SEQ ID NO: 2947776 - RNA, 20 nt, Human
aacaagaccacguuucuaaa

SEQ ID NO: 2947777 - RNA, 16 nt, Human
aacaaggcaaggcugu

SEQ ID NO: 2947778 - RNA, 15 nt, Human
aacaaggcaaggcug

SEQ ID NO: 2947779 - RNA, 17 nt, Human
aacaaugcuguauuuua

SEQ ID NO: 2947780 - RNA, 22 nt, Human
aacaaugcuguauuuuaaaaga

SEQ ID NO: 2947781 - RNA, 15 nt, Human
aacacaacuauauug

SEQ ID NO: 2947782 - RNA, 16 nt, Human
aacacaacuauauugu

SEQ ID NO: 2947783 - RNA, 21 nt, Human
aacaaggcaaggcugucaauu

SEQ ID NO: 2947784 - RNA, 18 nt, Human
aacaaggcaaggcuguca

SEQ ID NO: 2947785 - RNA, 12 nt, Human
aacaauaaaaga

SEQ ID NO: 2947786 - RNA, 14 nt, Human
aacaaugcuguauu

SEQ ID NO: 2947787 - RNA, 15 nt, Human
aacaaugcuguauuu

SEQ ID NO: 2947788 - RNA, 21 nt, Human
gucaguuguuauuuauugaaa

SEQ ID NO: 2947789 - RNA, 18 nt, Human
gucaguuguuauuuauug

SEQ ID NO: 2947790 - RNA, 17 nt, Human
gucaguuguuauuuauu

SEQ ID NO: 2947791 - RNA, 16 nt, Human
gucaguuguuauuuau

SEQ ID NO: 2947792 - RNA, 15 nt, Human
gucagugugacugau

SEQ ID NO: 2947793 - RNA, 12 nt, Human
aaauuuguggaa

SEQ ID NO: 2947794 - RNA, 18 nt, Human
aaauuuguuauaaugaau

SEQ ID NO: 2947795 - RNA, 22 nt, Human
gucacacaguauuacuucugcu

SEQ ID NO: 2947796 - RNA, 21 nt, Human
gucacacaguauuacuucugc

SEQ ID NO: 2947797 - RNA, 18 nt, Human
gucagacacagauuggcc

SEQ ID NO: 2947798 - RNA, 13 nt, Human
gucagacacagau

SEQ ID NO: 2947799 - RNA, 23 nt, Human
gucagaaguuucugccgcagccc

SEQ ID NO: 2947800 - RNA, 18 nt, Human
gucccccugacaacacuc

SEQ ID NO: 2947801 - RNA, 14 nt, Human
gucccccuuccaug

SEQ ID NO: 2947802 - RNA, 18 nt, Human
gucccccuuccauggacu

SEQ ID NO: 2947803 - RNA, 16 nt, Human
gucccccuuccaugga

SEQ ID NO: 2947804 - RNA, 16 nt, Human
guccuacccacccucc

SEQ ID NO: 2947805 - RNA, 15 nt, Human
guccuacccacccuc

SEQ ID NO: 2947806 - RNA, 12 nt, Human
guccuacucugu

SEQ ID NO: 2947807 - RNA, 14 nt, Human
aacagaaauguaca

SEQ ID NO: 2947808 - RNA, 12 nt, Human
aacagaaaugua

SEQ ID NO: 2947809 - RNA, 13 nt, Human
aacagaaauguac

SEQ ID NO: 2947810 - RNA, 20 nt, Human
aacagaagaaaauagaauug

SEQ ID NO: 2947811 - RNA, 13 nt, Human
aacagaagaaaau

SEQ ID NO: 2947812 - RNA, 11 nt, Human
aacagaaaugu

SEQ ID NO: 2947813 - RNA, 13 nt, Human
aacagaugaaaag

SEQ ID NO: 2947814 - RNA, 14 nt, Human
aacagaugaaaagc

SEQ ID NO: 2947815 - RNA, 16 nt, Human
aacagauaaauaguuu

SEQ ID NO: 2947816 - RNA, 20 nt, Human
aacagaugaaaagccucugu

SEQ ID NO: 2947817 - RNA, 14 nt, Human
aacagggccucugc

SEQ ID NO: 2947818 - RNA, 15 nt, Human
aacagugauuaccag

SEQ ID NO: 2947819 - RNA, 22 nt, Human
aacagugauuaccagggacuga

SEQ ID NO: 2947820 - RNA, 14 nt, Human
guccauagagagca

SEQ ID NO: 2947821 - RNA, 13 nt, Human
guccauagagagc

SEQ ID NO: 2947822 - RNA, 21 nt, Human
gucccaccccacacacgccag

SEQ ID NO: 2947823 - RNA, 20 nt, Human
gucccaccccacacacgcca

SEQ ID NO: 2947824 - RNA, 14 nt, Human
gucccaccuuggcu

SEQ ID NO: 2947825 - RNA, 15 nt, Human
gucccaccuuggcug

SEQ ID NO: 2947826 - RNA, 16 nt, Human
gucccaccuuggcugc

SEQ ID NO: 2947827 - RNA, 13 nt, Human
guccaagaagccc

SEQ ID NO: 2947828 - RNA, 16 nt, Human
guccaagaagcccagg

SEQ ID NO: 2947829 - RNA, 15 nt, Human
guccaagaagcccag

SEQ ID NO: 2947830 - RNA, 20 nt, Human
guccaagaagcccaggaaag

SEQ ID NO: 2947831 - RNA, 18 nt, Human
guccaagaagcccaggaa

SEQ ID NO: 2947832 - RNA, 17 nt, Human
guccaagaagcccagga

SEQ ID NO: 2947833 - RNA, 19 nt, Human
gucauuuuuuuuaagaaaa

SEQ ID NO: 2947834 - RNA, 21 nt, Human
gucauuuuuuuuaagaaaaag

SEQ ID NO: 2947835 - RNA, 15 nt, Human
aacacagcaagggug

SEQ ID NO: 2947836 - RNA, 16 nt, Human
aaaugucaguucugau

SEQ ID NO: 2947837 - RNA, 15 nt, Human
aaaugucaguucuga

SEQ ID NO: 2947838 - RNA, 19 nt, Human
aaaugucuaguuguaacac

SEQ ID NO: 2947839 - RNA, 15 nt, Human
aaauguauuacagug

SEQ ID NO: 2947840 - RNA, 18 nt, Human
guauguacuucaugcugu

SEQ ID NO: 2947841 - RNA, 20 nt, Human
aaauuauucuauaauuucca

SEQ ID NO: 2947842 - RNA, 19 nt, Human
aaauuagguugaaacauau

SEQ ID NO: 2947843 - RNA, 16 nt, Human
aaauuagguugaaaca

SEQ ID NO: 2947844 - RNA, 17 nt, Human
aaauuagguugaaacau

SEQ ID NO: 2947845 - RNA, 18 nt, Human
aaauuagguugaaacaua

SEQ ID NO: 2947846 - RNA, 14 nt, Human
aaauuagguugaaa

SEQ ID NO: 2947847 - RNA, 22 nt, Human
guauuuuguuuuugucuuaaaa

SEQ ID NO: 2947848 - RNA, 16 nt, Human
gucaaauugugugaaa

SEQ ID NO: 2947849 - RNA, 19 nt, Human
aaaugggggugcauuugag

SEQ ID NO: 2947850 - RNA, 12 nt, Human
guaacaggcaga

SEQ ID NO: 2947851 - RNA, 22 nt, Human
guaacaggaaaauuuuaaaaau

SEQ ID NO: 2947852 - RNA, 17 nt, Human
aaaugguguuuuaucuu

SEQ ID NO: 2947853 - RNA, 18 nt, Human
aaaugguguuuuaucuuc

SEQ ID NO: 2947854 - RNA, 22 nt, Human
aaaugguagcauuuuaaacaaa

SEQ ID NO: 2947855 - RNA, 18 nt, Human
aaaugguagcauuuuaaa

SEQ ID NO: 2947856 - RNA, 20 nt, Human
aaaugguagcauuuuaaaca

SEQ ID NO: 2947857 - RNA, 16 nt, Human
aaaugguagcauuuua

SEQ ID NO: 2947858 - RNA, 15 nt, Human
aaauggguuuuacug

SEQ ID NO: 2947859 - RNA, 14 nt, Human
aaauggguuuuacu

SEQ ID NO: 2947860 - RNA, 17 nt, Human
guaguguuggagaagaa

SEQ ID NO: 2947861 - RNA, 16 nt, Human
aaauguaagggaaacu

SEQ ID NO: 2947862 - RNA, 20 nt, Human
guaguguuggagaagaacug

SEQ ID NO: 2947863 - RNA, 19 nt, Human
guaucccaugagccucagc

SEQ ID NO: 2947864 - RNA, 22 nt, Human
guaucaggugcugccauccagg

SEQ ID NO: 2947865 - RNA, 15 nt, Human
guaugguggcugggu

SEQ ID NO: 2947866 - RNA, 16 nt, Human
guaugguggcuggguu

SEQ ID NO: 2947867 - RNA, 14 nt, Human
guaugguggcuggg

SEQ ID NO: 2947868 - RNA, 13 nt, Human
guaugguggcugg

SEQ ID NO: 2947869 - RNA, 15 nt, Human
guauaaaauaauuuu

SEQ ID NO: 2947870 - RNA, 21 nt, Human
guauaaaauaauuuuuauauu

SEQ ID NO: 2947871 - RNA, 16 nt, Human
guaucaggugcugcca

SEQ ID NO: 2947872 - RNA, 18 nt, Human
guaucaggugcugccauc

SEQ ID NO: 2947873 - RNA, 16 nt, Human
guauauuuuauaucaa

SEQ ID NO: 2947874 - RNA, 19 nt, Human
guuucuauguguagggcgg

SEQ ID NO: 2947875 - RNA, 18 nt, Human
guuucugaaagggacgcu

SEQ ID NO: 2947876 - RNA, 12 nt, Human
aaggucauuuuu

SEQ ID NO: 2947877 - RNA, 18 nt, Human
aagguauuuaauagguuu

SEQ ID NO: 2947878 - RNA, 22 nt, Human
guuucuaugacacaugcaaggu

SEQ ID NO: 2947879 - RNA, 22 nt, Human
aaggggcccaaauucuuucagu

SEQ ID NO: 2947880 - RNA, 17 nt, Human
aaggggcaguggugguu

SEQ ID NO: 2947881 - RNA, 20 nt, Human
aagguagaaauaucugaaaa

SEQ ID NO: 2947882 - RNA, 14 nt, Human
aagguacuucaaau

SEQ ID NO: 2947883 - RNA, 13 nt, Human
aagguacuucaaa

SEQ ID NO: 2947884 - RNA, 19 nt, Human
aagggugaugggaaagcau

SEQ ID NO: 2947885 - RNA, 22 nt, Human
aaggcucgagcaugccuggaug

SEQ ID NO: 2947886 - RNA, 20 nt, Human
aaggcucgagcaugccugga

SEQ ID NO: 2947887 - RNA, 19 nt, Human
aaggcucgagcaugccugg

SEQ ID NO: 2947888 - RNA, 18 nt, Human
aaggcucgagcaugccug

SEQ ID NO: 2947889 - RNA, 16 nt, Human
aaggcucgagcaugcc

SEQ ID NO: 2947890 - RNA, 22 nt, Human
aaggcuccaggagcagccacau

SEQ ID NO: 2947891 - RNA, 19 nt, Human
aaggcuccaggagcagcca

SEQ ID NO: 2947892 - RNA, 22 nt, Human
guuuauuuggaaaggaaugcaa

SEQ ID NO: 2947893 - RNA, 13 nt, Human
guuucaaacuuua

SEQ ID NO: 2947894 - RNA, 14 nt, Human
guuucaaacuuuac

SEQ ID NO: 2947895 - RNA, 16 nt, Human
guuucaaacuuuacua

SEQ ID NO: 2947896 - RNA, 15 nt, Human
aaggcuccaggagca

SEQ ID NO: 2947897 - RNA, 18 nt, Human
aaggcuccaggagcagcc

SEQ ID NO: 2947898 - RNA, 16 nt, Human
aaggcuccaggagcag

SEQ ID NO: 2947899 - RNA, 20 nt, Human
guuuaaugguaguuuuacag

SEQ ID NO: 2947900 - RNA, 17 nt, Human
guuuaaugguaguuuua

SEQ ID NO: 2947901 - RNA, 12 nt, Human
guuuaaugguag

SEQ ID NO: 2947902 - RNA, 13 nt, Human
guuuauugucaaa

SEQ ID NO: 2947903 - RNA, 13 nt, Human
guugggcuggugu

SEQ ID NO: 2947904 - RNA, 17 nt, Human
guugggccaggagccuc

SEQ ID NO: 2947905 - RNA, 15 nt, Human
guugggccaggagcc

SEQ ID NO: 2947906 - RNA, 16 nt, Human
aaggccaaaggaagca

SEQ ID NO: 2947907 - RNA, 17 nt, Human
aaggcauggacuucugg

SEQ ID NO: 2947908 - RNA, 16 nt, Human
aaggauacuuauuuaa

SEQ ID NO: 2947909 - RNA, 13 nt, Human
aaggauacuuauu

SEQ ID NO: 2947910 - RNA, 13 nt, Human
aaggauaaugaau

SEQ ID NO: 2947911 - RNA, 13 nt, Human
aaggauacaaaag

SEQ ID NO: 2947912 - RNA, 21 nt, Human
aaggauacaaaagcaugugag

SEQ ID NO: 2947913 - RNA, 14 nt, Human
guugcuaacagcaa

SEQ ID NO: 2947914 - RNA, 23 nt, Human
guugcccaggcaggucuugaacu

SEQ ID NO: 2947915 - RNA, 12 nt, Human
guugcccaggcu

SEQ ID NO: 2947916 - RNA, 13 nt, Human
guugcccaggcug

SEQ ID NO: 2947917 - RNA, 20 nt, Human
aaggaggggauagagagaga

SEQ ID NO: 2947918 - RNA, 18 nt, Human
aaggaggaagagaaaaaa

SEQ ID NO: 2947919 - RNA, 18 nt, Human
aaggaauaccuguccccc

SEQ ID NO: 2947920 - RNA, 11 nt, Human
aaggagagcua

SEQ ID NO: 2947921 - RNA, 14 nt, Human
aaggagauuuacaa

SEQ ID NO: 2947922 - RNA, 15 nt, Human
aaggaaagagggagg

SEQ ID NO: 2947923 - RNA, 16 nt, Human
aaggaagcacaugccu

SEQ ID NO: 2947924 - RNA, 17 nt, Human
aaggaauaccugucccc

SEQ ID NO: 2947925 - RNA, 14 nt, Human
aaggaagacuucau

SEQ ID NO: 2947926 - RNA, 13 nt, Human
aaggaagcacaug

SEQ ID NO: 2947927 - RNA, 15 nt, Human
aaggaagacuucauc

SEQ ID NO: 2947928 - RNA, 17 nt, Human
aagucuucuauuuauuu

SEQ ID NO: 2947929 - RNA, 13 nt, Human
aagucuucuauuu

SEQ ID NO: 2947930 - RNA, 16 nt, Human
aagucuuucacauuua

SEQ ID NO: 2947931 - RNA, 22 nt, Human
aagucuuauauauuguagauaa

SEQ ID NO: 2947932 - RNA, 14 nt, Human
aagugagagcuggg

SEQ ID NO: 2947933 - RNA, 12 nt, Human
aagugagagagg

SEQ ID NO: 2947934 - RNA, 21 nt, Human
aagugaaaaaggaggaagaga

SEQ ID NO: 2947935 - RNA, 17 nt, Human
aagugaagacaaugacu

SEQ ID NO: 2947936 - RNA, 19 nt, Human
aagugaagacaaugacuua

SEQ ID NO: 2947937 - RNA, 14 nt, Human
guuucugccgcagc

SEQ ID NO: 2947938 - RNA, 15 nt, Human
guuucugccgcagcc

SEQ ID NO: 2947939 - RNA, 16 nt, Human
guuuugccauguuggc

SEQ ID NO: 2947940 - RNA, 20 nt, Human
guuuugccauguuggccagg

SEQ ID NO: 2947941 - RNA, 21 nt, Human
guuuugccauguuggccaggc

SEQ ID NO: 2947942 - RNA, 22 nt, Human
guuuugccauguuggccaggcu

SEQ ID NO: 2947943 - RNA, 14 nt, Human
aaguaaugauaacu

SEQ ID NO: 2947944 - RNA, 13 nt, Human
aaguacacuguuu

SEQ ID NO: 2947945 - RNA, 18 nt, Human
aaguacacuguuucaaac

SEQ ID NO: 2947946 - RNA, 23 nt, Human
aaguacacuguuucaaacuuuac

SEQ ID NO: 2947947 - RNA, 19 nt, Human
aaguacacuguuucaaacu

SEQ ID NO: 2947948 - RNA, 20 nt, Human
aaguacacuguuucaaacuu

SEQ ID NO: 2947949 - RNA, 13 nt, Human
aaguauuagaaua

SEQ ID NO: 2947950 - RNA, 15 nt, Human
aagugagagcugggu

SEQ ID NO: 2947951 - RNA, 16 nt, Human
aagugaggaugaaaaa

SEQ ID NO: 2947952 - RNA, 19 nt, Human
aagugauucuccugccuca

SEQ ID NO: 2947953 - RNA, 15 nt, Human
aagugauucuccugc

SEQ ID NO: 2947954 - RNA, 16 nt, Human
aagugauucuccugcc

SEQ ID NO: 2947955 - RNA, 17 nt, Human
aagugauucuccugccu

SEQ ID NO: 2947956 - RNA, 18 nt, Human
aagugauucuccugccuc

SEQ ID NO: 2947957 - RNA, 21 nt, Human
uaaaauaccagccaguaaaug

SEQ ID NO: 2947958 - RNA, 22 nt, Human
uaaaauaccagccaguaaaugg

SEQ ID NO: 2947959 - RNA, 20 nt, Human
uaaaagacagugaaagaaaa

SEQ ID NO: 2947960 - RNA, 15 nt, Human
uaaaaaucucaaauu

SEQ ID NO: 2947961 - RNA, 16 nt, Human
uaaaaaucucaaauuu

SEQ ID NO: 2947962 - RNA, 17 nt, Human
uaaaaaucucaaauuuc

SEQ ID NO: 2947963 - RNA, 15 nt, Human
guuuuucuugcaugg

SEQ ID NO: 2947964 - RNA, 15 nt, Human
guuuuucuucucccu

SEQ ID NO: 2947965 - RNA, 15 nt, Human
uaaaaaguggaaaaa

SEQ ID NO: 2947966 - RNA, 19 nt, Human
uaaaaaucucaaauuucua

SEQ ID NO: 2947967 - RNA, 20 nt, Human
uaaaaaucucaaauuucuaa

SEQ ID NO: 2947968 - RNA, 21 nt, Human
uaaaaaucucaaauuucuaaa

SEQ ID NO: 2947969 - RNA, 16 nt, Human
uaaaagaauauuuuaa

SEQ ID NO: 2947970 - RNA, 20 nt, Human
uaaaacuugauguguuaucu

SEQ ID NO: 2947971 - RNA, 22 nt, Human
uaaaacuugauguguuaucucu

SEQ ID NO: 2947972 - RNA, 12 nt, Human
uaaaagaaugau

SEQ ID NO: 2947973 - RNA, 23 nt, Human
uaaaagaauauuuuaacuuccuu

SEQ ID NO: 2947974 - RNA, 18 nt, Human
guuaagagaaaugagcuu

SEQ ID NO: 2947975 - RNA, 12 nt, Human
guuaagagaaau

SEQ ID NO: 2947976 - RNA, 11 nt, Human
guuaagagaaa

SEQ ID NO: 2947977 - RNA, 20 nt, Human
guuaggcauugugggaaggg

SEQ ID NO: 2947978 - RNA, 19 nt, Human
guuaggcauugugggaagg

SEQ ID NO: 2947979 - RNA, 18 nt, Human
guucaagcgauucuucug

SEQ ID NO: 2947980 - RNA, 20 nt, Human
guucaaagauauuuugcuuu

SEQ ID NO: 2947981 - RNA, 21 nt, Human
guucaaagauauuuugcuuug

SEQ ID NO: 2947982 - RNA, 22 nt, Human
guucaaagauauuuugcuuugu

SEQ ID NO: 2947983 - RNA, 16 nt, Human
guuauugaagcagagu

SEQ ID NO: 2947984 - RNA, 17 nt, Human
guuauugaagcagagug

SEQ ID NO: 2947985 - RNA, 18 nt, Human
guuauugaagcagagugg

SEQ ID NO: 2947986 - RNA, 20 nt, Human
guuauuauauuuacaaaugg

SEQ ID NO: 2947987 - RNA, 23 nt, Human
guuauuuuuauuuauuuaaauuu

SEQ ID NO: 2947988 - RNA, 13 nt, Human
guucagcuccagc

SEQ ID NO: 2947989 - RNA, 20 nt, Human
aagccugaguuugcuuucaa

SEQ ID NO: 2947990 - RNA, 22 nt, Human
aagcuagacgagcaggcuucuu

SEQ ID NO: 2947991 - RNA, 12 nt, Human
aagcuaggccug

SEQ ID NO: 2947992 - RNA, 20 nt, Human
aagcucacagaccuuugaac

SEQ ID NO: 2947993 - RNA, 17 nt, Human
aagcucagggccuggcu

SEQ ID NO: 2947994 - RNA, 16 nt, Human
aagcucagggccuggc

SEQ ID NO: 2947995 - RNA, 13 nt, Human
aagcucagggccu

SEQ ID NO: 2947996 - RNA, 12 nt, Human
aagcucagggcc

SEQ ID NO: 2947997 - RNA, 20 nt, Human
aagcucagggccuggcucag

SEQ ID NO: 2947998 - RNA, 19 nt, Human
aagcucagggccuggcuca

SEQ ID NO: 2947999 - RNA, 18 nt, Human
aagcucagggccuggcuc

SEQ ID NO: 2948000 - RNA, 13 nt, Human
aagcuccagguag

SEQ ID NO: 2948001 - RNA, 14 nt, Human
aagcuccagguaga

SEQ ID NO: 2948002 - RNA, 18 nt, Human
aagcuccaagcucccagg

SEQ ID NO: 2948003 - RNA, 17 nt, Human
aagcuccaagcucccag

SEQ ID NO: 2948004 - RNA, 19 nt, Human
aagccaaaacugagcauaa

SEQ ID NO: 2948005 - RNA, 16 nt, Human
aagccaaaacugagca

SEQ ID NO: 2948006 - RNA, 13 nt, Human
aagcauuguaaau

SEQ ID NO: 2948007 - RNA, 16 nt, Human
aagcauuuacuuugug

SEQ ID NO: 2948008 - RNA, 16 nt, Human
aagcauuuagauguau

SEQ ID NO: 2948009 - RNA, 12 nt, Human
aagcagugcaug

SEQ ID NO: 2948010 - RNA, 21 nt, Human
gugugugcgccuacaggagug

SEQ ID NO: 2948011 - RNA, 15 nt, Human
aagcagugcaugcug

SEQ ID NO: 2948012 - RNA, 14 nt, Human
aagcagugcaugcu

SEQ ID NO: 2948013 - RNA, 20 nt, Human
aagcagugcaugcugucccu

SEQ ID NO: 2948014 - RNA, 20 nt, Human
aagccaaagcuaggccuggc

SEQ ID NO: 2948015 - RNA, 22 nt, Human
aagccaaagcuaggccuggcca

SEQ ID NO: 2948016 - RNA, 17 nt, Human
aagcccaggaaaggcuc

SEQ ID NO: 2948017 - RNA, 14 nt, Human
aagcccaggaaagg

SEQ ID NO: 2948018 - RNA, 22 nt, Human
aagcccaggaaaggcuccagga

SEQ ID NO: 2948019 - RNA, 19 nt, Human
aagcccaggaaaggcucca

SEQ ID NO: 2948020 - RNA, 19 nt, Human
aagcccugagcuuucugcu

SEQ ID NO: 2948021 - RNA, 18 nt, Human
guuaagacaaacugcaua

SEQ ID NO: 2948022 - RNA, 20 nt, Human
aagccgcuggggccaguugg

SEQ ID NO: 2948023 - RNA, 15 nt, Human
gugggagcugccugu

SEQ ID NO: 2948024 - RNA, 18 nt, Human
gugggagcugccuguuca

SEQ ID NO: 2948025 - RNA, 15 nt, Human
guggggucacucugg

SEQ ID NO: 2948026 - RNA, 20 nt, Human
guggcgagccauuuguccca

SEQ ID NO: 2948027 - RNA, 23 nt, Human
guggcgagccauuugucccaagu

SEQ ID NO: 2948028 - RNA, 14 nt, Human
gugggagcugccug

SEQ ID NO: 2948029 - RNA, 15 nt, Human
gugggacacccugug

SEQ ID NO: 2948030 - RNA, 13 nt, Human
gugggacacccug

SEQ ID NO: 2948031 - RNA, 22 nt, Human
guggccucccaacucaccccag

SEQ ID NO: 2948032 - RNA, 21 nt, Human
guggccucccaacucacccca

SEQ ID NO: 2948033 - RNA, 23 nt, Human
aagaggaaugaaguacucauaca

SEQ ID NO: 2948034 - RNA, 13 nt, Human
aagacgcugugcu

SEQ ID NO: 2948035 - RNA, 19 nt, Human
aagacgcugugcugcccug

SEQ ID NO: 2948036 - RNA, 18 nt, Human
aagacgcugugcugcccu

SEQ ID NO: 2948037 - RNA, 17 nt, Human
aagacgcugugcugccc

SEQ ID NO: 2948038 - RNA, 15 nt, Human
aagacgcugugcugc

SEQ ID NO: 2948039 - RNA, 19 nt, Human
aagaccuucuccuucaccu

SEQ ID NO: 2948040 - RNA, 18 nt, Human
aagaccuucuccuucacc

SEQ ID NO: 2948041 - RNA, 15 nt, Human
aagaccuucuccuuc

SEQ ID NO: 2948042 - RNA, 13 nt, Human
aagagcaggccag

SEQ ID NO: 2948043 - RNA, 16 nt, Human
aagacuuuggaaagac

SEQ ID NO: 2948044 - RNA, 16 nt, Human
aagacugcacaucaaa

SEQ ID NO: 2948045 - RNA, 23 nt, Human
aagacugaguacguugugcauuu

SEQ ID NO: 2948046 - RNA, 22 nt, Human
aagacugaguacguugugcauu

SEQ ID NO: 2948047 - RNA, 22 nt, Human
guggggucacucuggcagcuca

SEQ ID NO: 2948048 - RNA, 21 nt, Human
guggggucacucuggcagcuc

SEQ ID NO: 2948049 - RNA, 20 nt, Human
guggggucacucuggcagcu

SEQ ID NO: 2948050 - RNA, 17 nt, Human
guggggucacucuggca

SEQ ID NO: 2948051 - RNA, 12 nt, Human
aagaguaggaag

SEQ ID NO: 2948052 - RNA, 23 nt, Human
aagagggagggagggcuccagac

SEQ ID NO: 2948053 - RNA, 19 nt, Human
aagaugcuucucacugcca

SEQ ID NO: 2948054 - RNA, 18 nt, Human
aagaugaaggucuguuuu

SEQ ID NO: 2948055 - RNA, 16 nt, Human
aagaugcuucucacug

SEQ ID NO: 2948056 - RNA, 17 nt, Human
aagaugcuucucacugc

SEQ ID NO: 2948057 - RNA, 14 nt, Human
aagaguaggaagac

SEQ ID NO: 2948058 - RNA, 13 nt, Human
aagaguaggaaga

SEQ ID NO: 2948059 - RNA, 14 nt, Human
aagaugaaaauauu

SEQ ID NO: 2948060 - RNA, 13 nt, Human
aagaugaaaauau

SEQ ID NO: 2948061 - RNA, 22 nt, Human
gugugacaaggauugcuacugu

SEQ ID NO: 2948062 - RNA, 13 nt, Human
gugucauuucaaa

SEQ ID NO: 2948063 - RNA, 20 nt, Human
gugucagguggggcagcuug

SEQ ID NO: 2948064 - RNA, 16 nt, Human
gugugguagagugugc

SEQ ID NO: 2948065 - RNA, 16 nt, Human
gugucagcauagaagu

SEQ ID NO: 2948066 - RNA, 20 nt, Human
gugucaagagggucugagga

SEQ ID NO: 2948067 - RNA, 17 nt, Human
guguauuuuuuuacuaa

SEQ ID NO: 2948068 - RNA, 23 nt, Human
guguauuuuuuuacuaauagaca

SEQ ID NO: 2948069 - RNA, 13 nt, Human
aagauguagagga

SEQ ID NO: 2948070 - RNA, 23 nt, Human
aauacaucccuuaccugggaaag

SEQ ID NO: 2948071 - RNA, 17 nt, Human
aauaccagccaguaaau

SEQ ID NO: 2948072 - RNA, 18 nt, Human
aauaccaugccauuuaaa

SEQ ID NO: 2948073 - RNA, 19 nt, Human
aauaccagccaguaaaugg

SEQ ID NO: 2948074 - RNA, 23 nt, Human
aauaccacaggaaccacaagacu

SEQ ID NO: 2948075 - RNA, 12 nt, Human
aauaccaaggaa

SEQ ID NO: 2948076 - RNA, 20 nt, Human
aauaccccaagacucccaug

SEQ ID NO: 2948077 - RNA, 19 nt, Human
aauaccugucccccugaca

SEQ ID NO: 2948078 - RNA, 18 nt, Human
aauaccugucccccugac

SEQ ID NO: 2948079 - RNA, 15 nt, Human
aauaccugucccccu

SEQ ID NO: 2948080 - RNA, 23 nt, Human
aauagcagcccucaauugugaaa

SEQ ID NO: 2948081 - RNA, 20 nt, Human
aauagccugccucuucucua

SEQ ID NO: 2948082 - RNA, 22 nt, Human
aauagcagcccucaauugugaa

SEQ ID NO: 2948083 - RNA, 21 nt, Human
aauagcaaggcugugcaucua

SEQ ID NO: 2948084 - RNA, 21 nt, Human
aauacaccacuacauucuguu

SEQ ID NO: 2948085 - RNA, 13 nt, Human
aauacagaggcaa

SEQ ID NO: 2948086 - RNA, 21 nt, Human
uaacaaaggauacuuauuuaa

SEQ ID NO: 2948087 - RNA, 19 nt, Human
uaacaaaggauacuuauuu

SEQ ID NO: 2948088 - RNA, 20 nt, Human
uaacaaaggauacuuauuua

SEQ ID NO: 2948089 - RNA, 15 nt, Human
uaacaaaggauacuu

SEQ ID NO: 2948090 - RNA, 16 nt, Human
uaacaaaggauacuua

SEQ ID NO: 2948091 - RNA, 17 nt, Human
uaacaaaggauacuuau

SEQ ID NO: 2948092 - RNA, 18 nt, Human
uaacaaaggauacuuauu

SEQ ID NO: 2948093 - RNA, 21 nt, Human
uaaauuaacuuuuauaaacuu

SEQ ID NO: 2948094 - RNA, 18 nt, Human
uaaaugaaaaucgugaca

SEQ ID NO: 2948095 - RNA, 18 nt, Human
aaguguauuuuuuuacua

SEQ ID NO: 2948096 - RNA, 21 nt, Human
aaguguauuuuuuuacuaaua

SEQ ID NO: 2948097 - RNA, 17 nt, Human
aaguguauuuugaaauu

SEQ ID NO: 2948098 - RNA, 21 nt, Human
aaguguauuuugaaauuguuu

SEQ ID NO: 2948099 - RNA, 18 nt, Human
uaaauuaacuuuuauaaa

SEQ ID NO: 2948100 - RNA, 19 nt, Human
uaaauuaacuuuuauaaac

SEQ ID NO: 2948101 - RNA, 20 nt, Human
uaaauuaacuuuuauaaacu

SEQ ID NO: 2948102 - RNA, 16 nt, Human
uaaaugugcuuuuaaa

SEQ ID NO: 2948103 - RNA, 19 nt, Human
aauagucaaauugugugaa

SEQ ID NO: 2948104 - RNA, 19 nt, Human
uaacauguaauuaaguacu

SEQ ID NO: 2948105 - RNA, 17 nt, Human
uaacauguaauuaagua

SEQ ID NO: 2948106 - RNA, 21 nt, Human
uaacuaucacugguuugguuc

SEQ ID NO: 2948107 - RNA, 15 nt, Human
uaacuuaaugaaaac

SEQ ID NO: 2948108 - RNA, 16 nt, Human
uaacuuaaugaaaaca

SEQ ID NO: 2948109 - RNA, 18 nt, Human
uaacuuaaugaaaacaau

SEQ ID NO: 2948110 - RNA, 16 nt, Human
uaacuaucacugguuu

SEQ ID NO: 2948111 - RNA, 23 nt, Human
uaagacaaaaagcuacuuauugu

SEQ ID NO: 2948112 - RNA, 13 nt, Human
uaagaagugaaaa

SEQ ID NO: 2948113 - RNA, 20 nt, Human
uaacuugucuuuggacccug

SEQ ID NO: 2948114 - RNA, 16 nt, Human
uaacuugucuuuggac

SEQ ID NO: 2948115 - RNA, 21 nt, Human
uaacuuccuuggacucauuuu

SEQ ID NO: 2948116 - RNA, 20 nt, Human
uaaguuauuaagagguaaga

SEQ ID NO: 2948117 - RNA, 12 nt, Human
uaauaaaaaggu

SEQ ID NO: 2948118 - RNA, 15 nt, Human
uaauaaaaaggugac

SEQ ID NO: 2948119 - RNA, 14 nt, Human
uaauaaaaagguga

SEQ ID NO: 2948120 - RNA, 18 nt, Human
uaaguuuuuuuuuaaaaa

SEQ ID NO: 2948121 - RNA, 21 nt, Human
uaaguauucuuauuuaaugaa

SEQ ID NO: 2948122 - RNA, 18 nt, Human
uaagguuaccuuuguucc

SEQ ID NO: 2948123 - RNA, 15 nt, Human
uaaguaaaaccacag

SEQ ID NO: 2948124 - RNA, 13 nt, Human
uaaguaaaaccac

SEQ ID NO: 2948125 - RNA, 20 nt, Human
uaaguaaugauaacuggaaa

SEQ ID NO: 2948126 - RNA, 19 nt, Human
uaaguaaaaccacagcagu

SEQ ID NO: 2948127 - RNA, 18 nt, Human
uaaguaaaaccacagcag

SEQ ID NO: 2948128 - RNA, 17 nt, Human
uaaguaaaaccacagca

SEQ ID NO: 2948129 - RNA, 16 nt, Human
uaaguaaaaccacagc

SEQ ID NO: 2948130 - RNA, 17 nt, Human
aaucccauuuaaaaaaa

SEQ ID NO: 2948131 - RNA, 20 nt, Human
aauccucaguuuuugugaaa

SEQ ID NO: 2948132 - RNA, 16 nt, Human
uaagacuuaaugagac

SEQ ID NO: 2948133 - RNA, 15 nt, Human
uaagacuuaaugaga

SEQ ID NO: 2948134 - RNA, 23 nt, Human
aauauuuugacuuguugagggua

SEQ ID NO: 2948135 - RNA, 18 nt, Human
aaucagguuuucuuuuaa

SEQ ID NO: 2948136 - RNA, 21 nt, Human
aaucagguuuucuuuuaagaa

SEQ ID NO: 2948137 - RNA, 19 nt, Human
aaucagccugcuccagcug

SEQ ID NO: 2948138 - RNA, 18 nt, Human
aaucagccugcuccagcu

SEQ ID NO: 2948139 - RNA, 13 nt, Human
aaucagccugcuc

SEQ ID NO: 2948140 - RNA, 11 nt, Human
aaucagccugc

SEQ ID NO: 2948141 - RNA, 16 nt, Human
aaucagccuaguugau

SEQ ID NO: 2948142 - RNA, 18 nt, Human
uaaggaauaccugucccc

SEQ ID NO: 2948143 - RNA, 17 nt, Human
uaaggaauaccuguccc

SEQ ID NO: 2948144 - RNA, 9 nt, Human
uaaggaaua

SEQ ID NO: 2948145 - RNA, 13 nt, Human
uaaggaagacaau

SEQ ID NO: 2948146 - RNA, 14 nt, Human
uaagcuauucagua

SEQ ID NO: 2948147 - RNA, 21 nt, Human
uaagcuauucaguaauaacuc

SEQ ID NO: 2948148 - RNA, 15 nt, Human
uaagcaaaaugugau

SEQ ID NO: 2948149 - RNA, 21 nt, Human
uaagcaaaaugugauauguac

SEQ ID NO: 2948150 - RNA, 14 nt, Human
uaagcaaaauguga

SEQ ID NO: 2948151 - RNA, 14 nt, Human
uaagauucauauuu

SEQ ID NO: 2948152 - RNA, 13 nt, Human
uacaaugcugugc

SEQ ID NO: 2948153 - RNA, 14 nt, Human
uacaaugcugugcc

SEQ ID NO: 2948154 - RNA, 16 nt, Human
uacaaugcugugcccu

SEQ ID NO: 2948155 - RNA, 17 nt, Human
uaauuuuuauauuugaa

SEQ ID NO: 2948156 - RNA, 18 nt, Human
uaauuuuuuugagacaga

SEQ ID NO: 2948157 - RNA, 21 nt, Human
uacaaaaaaaaaaaaaaauua

SEQ ID NO: 2948158 - RNA, 21 nt, Human
aaugcuggcuguuggcugggg

SEQ ID NO: 2948159 - RNA, 22 nt, Human
aaugcuggcuguuggcuggggg

SEQ ID NO: 2948160 - RNA, 20 nt, Human
aaugcuguauuuuaaaagaa

SEQ ID NO: 2948161 - RNA, 21 nt, Human
aaugcuguauuuuaaaagaau

SEQ ID NO: 2948162 - RNA, 13 nt, Human
aauggaagacagc

SEQ ID NO: 2948163 - RNA, 22 nt, Human
aaugcuugcugcugauuuaaac

SEQ ID NO: 2948164 - RNA, 23 nt, Human
aaugcuugcugcugauuuaaaca

SEQ ID NO: 2948165 - RNA, 22 nt, Human
aaugcuguauuuuaaaagaaug

SEQ ID NO: 2948166 - RNA, 18 nt, Human
aaugcuugcugcugauuu

SEQ ID NO: 2948167 - RNA, 20 nt, Human
aaugcuugcugcugauuuaa

SEQ ID NO: 2948168 - RNA, 13 nt, Human
uacagacaaagcg

SEQ ID NO: 2948169 - RNA, 15 nt, Human
uacagacaaagcgug

SEQ ID NO: 2948170 - RNA, 14 nt, Human
uacagacaaagcgu

SEQ ID NO: 2948171 - RNA, 13 nt, Human
uacagaauuuuau

SEQ ID NO: 2948172 - RNA, 17 nt, Human
uacagagacagaaagca

SEQ ID NO: 2948173 - RNA, 22 nt, Human
uacagagcccacgcccccacug

SEQ ID NO: 2948174 - RNA, 19 nt, Human
uacagagcccacgccccca

SEQ ID NO: 2948175 - RNA, 23 nt, Human
uacagagcagacaguuaagagaa

SEQ ID NO: 2948176 - RNA, 14 nt, Human
aaugguuuucaaaa

SEQ ID NO: 2948177 - RNA, 16 nt, Human
aauggaagacagcucu

SEQ ID NO: 2948178 - RNA, 16 nt, Human
aaugguuuucuugugu

SEQ ID NO: 2948179 - RNA, 16 nt, Human
aaugguuuucaaaaua

SEQ ID NO: 2948180 - RNA, 20 nt, Human
aauguaagggaaacugccag

SEQ ID NO: 2948181 - RNA, 20 nt, Human
aaugaccuuucaauaggaaa

SEQ ID NO: 2948182 - RNA, 21 nt, Human
aaugaccuuucaauaggaaaa

SEQ ID NO: 2948183 - RNA, 11 nt, Human
aaugagccugg

SEQ ID NO: 2948184 - RNA, 22 nt, Human
aaugagagacacacugaagaag

SEQ ID NO: 2948185 - RNA, 13 nt, Human
aaugagccuggca

SEQ ID NO: 2948186 - RNA, 12 nt, Human
aaugagccuggc

SEQ ID NO: 2948187 - RNA, 16 nt, Human
aaugaggucagagccu

SEQ ID NO: 2948188 - RNA, 18 nt, Human
aaugaggucagagccugc

SEQ ID NO: 2948189 - RNA, 23 nt, Human
aaugauuaugaauuacauuugua

SEQ ID NO: 2948190 - RNA, 13 nt, Human
aaugcaccuggaa

SEQ ID NO: 2948191 - RNA, 12 nt, Human
aaugcaaaccau

SEQ ID NO: 2948192 - RNA, 16 nt, Human
aaugauuucauucaau

SEQ ID NO: 2948193 - RNA, 11 nt, Human
aaugcaaacca

SEQ ID NO: 2948194 - RNA, 12 nt, Human
aaugcaaaaaaa

SEQ ID NO: 2948195 - RNA, 16 nt, Human
aaugcaaaaaaaauua

SEQ ID NO: 2948196 - RNA, 17 nt, Human
aaugcaaaaaaaauuag

SEQ ID NO: 2948197 - RNA, 18 nt, Human
uaauuuuuauauuugaaa

SEQ ID NO: 2948198 - RNA, 19 nt, Human
uaauuuuuauauuugaaau

SEQ ID NO: 2948199 - RNA, 21 nt, Human
uaauuuuuauauuugaaauau

SEQ ID NO: 2948200 - RNA, 16 nt, Human
uaauuauugauguuuu

SEQ ID NO: 2948201 - RNA, 22 nt, Human
uaauuccguagguuauuuucag

SEQ ID NO: 2948202 - RNA, 21 nt, Human
aaugugcugaaugguuuucaa

SEQ ID NO: 2948203 - RNA, 22 nt, Human
aauguucacugguacucugcca

SEQ ID NO: 2948204 - RNA, 13 nt, Human
aauguucaucaau

SEQ ID NO: 2948205 - RNA, 12 nt, Human
aauuaacuuuua

SEQ ID NO: 2948206 - RNA, 13 nt, Human
aauuaacuuuuau

SEQ ID NO: 2948207 - RNA, 15 nt, Human
aauuaacuuuuauaa

SEQ ID NO: 2948208 - RNA, 16 nt, Human
aauuaacuuuuauaaa

SEQ ID NO: 2948209 - RNA, 16 nt, Human
aauuaaguacuaugua

SEQ ID NO: 2948210 - RNA, 17 nt, Human
aauuaaguacuauguau

SEQ ID NO: 2948211 - RNA, 16 nt, Human
aauguucaucaaugaa

SEQ ID NO: 2948212 - RNA, 20 nt, Human
aauguucaucaaugaaugaa

SEQ ID NO: 2948213 - RNA, 12 nt, Human
uaccagcagagc

SEQ ID NO: 2948214 - RNA, 14 nt, Human
uaccagcagagcac

SEQ ID NO: 2948215 - RNA, 13 nt, Human
uaccagcagagca

SEQ ID NO: 2948216 - RNA, 22 nt, Human
uaccagcagagcaccuuagaca

SEQ ID NO: 2948217 - RNA, 18 nt, Human
uaccagccaguaaauggg

SEQ ID NO: 2948218 - RNA, 17 nt, Human
uacauuagguugugaau

SEQ ID NO: 2948219 - RNA, 12 nt, Human
uacauucuguua

SEQ ID NO: 2948220 - RNA, 16 nt, Human
uaccaugccauuuaaa

SEQ ID NO: 2948221 - RNA, 19 nt, Human
uaccagggacugaggggag

SEQ ID NO: 2948222 - RNA, 16 nt, Human
uaccugccaggaagcc

SEQ ID NO: 2948223 - RNA, 16 nt, Human
uaccugaggggccucu

SEQ ID NO: 2948224 - RNA, 13 nt, Human
aauuacauuugua

SEQ ID NO: 2948225 - RNA, 14 nt, Human
aauuacauuuguau

SEQ ID NO: 2948226 - RNA, 20 nt, Human
aauuacaggaaguacuggag

SEQ ID NO: 2948227 - RNA, 19 nt, Human
aauuacaggaaguacugga

SEQ ID NO: 2948228 - RNA, 17 nt, Human
aauuacaggaaguacug

SEQ ID NO: 2948229 - RNA, 23 nt, Human
uacccgggaagggggcugggaca

SEQ ID NO: 2948230 - RNA, 22 nt, Human
uaccucuugagccuugaacuuu

SEQ ID NO: 2948231 - RNA, 23 nt, Human
uaccucuugagccuugaacuuug

SEQ ID NO: 2948232 - RNA, 16 nt, Human
uaccugaagucuuugu

SEQ ID NO: 2948233 - RNA, 15 nt, Human
uaccugaggggccuc

SEQ ID NO: 2948234 - RNA, 13 nt, Human
uaccugaggggcc

SEQ ID NO: 2948235 - RNA, 14 nt, Human
uaccugaagucuuu

SEQ ID NO: 2948236 - RNA, 13 nt, Human
uaccugaagucuu

SEQ ID NO: 2948237 - RNA, 22 nt, Human
aauucaguuguuagugugucuu

SEQ ID NO: 2948238 - RNA, 17 nt, Human
aauucaguuguuagugu

SEQ ID NO: 2948239 - RNA, 11 nt, Human
aauucaguugu

SEQ ID NO: 2948240 - RNA, 22 nt, Human
aauuauuuauuaaaugcccagc

SEQ ID NO: 2948241 - RNA, 21 nt, Human
aauuauuuauuaaaugcccag

SEQ ID NO: 2948242 - RNA, 16 nt, Human
aauuaccagaaagaua

SEQ ID NO: 2948243 - RNA, 19 nt, Human
uauacauacuuacaugugu

SEQ ID NO: 2948244 - RNA, 18 nt, Human
uauaauuuaccugaaguc

SEQ ID NO: 2948245 - RNA, 21 nt, Human
uauacacuuacacuuuaugca

SEQ ID NO: 2948246 - RNA, 22 nt, Human
uauacacuuacacuuuaugcac

SEQ ID NO: 2948247 - RNA, 19 nt, Human
acacuaagagagaaugaga

SEQ ID NO: 2948248 - RNA, 20 nt, Human
uagucacugagacagcccgg

SEQ ID NO: 2948249 - RNA, 17 nt, Human
uagucacugagacagcc

SEQ ID NO: 2948250 - RNA, 13 nt, Human
acacucaaaucaa

SEQ ID NO: 2948251 - RNA, 21 nt, Human
acacucaaaagcugggcaggu

SEQ ID NO: 2948252 - RNA, 22 nt, Human
acacuaaugaggaaacugcacu

SEQ ID NO: 2948253 - RNA, 15 nt, Human
acacuaaugaggaaa

SEQ ID NO: 2948254 - RNA, 17 nt, Human
acacucaaaucaagaaa

SEQ ID NO: 2948255 - RNA, 16 nt, Human
acacucauugaccuga

SEQ ID NO: 2948256 - RNA, 19 nt, Human
uauauauuuuuuucugaaa

SEQ ID NO: 2948257 - RNA, 23 nt, Human
uauauagcaguaaaaaauggugu

SEQ ID NO: 2948258 - RNA, 18 nt, Human
uauagccuaggugacaga

SEQ ID NO: 2948259 - RNA, 10 nt, Human
uauagauguu

SEQ ID NO: 2948260 - RNA, 21 nt, Human
uauagauguugcuaacagcaa

SEQ ID NO: 2948261 - RNA, 15 nt, Human
uauagauguugcuaa

SEQ ID NO: 2948262 - RNA, 20 nt, Human
uauagauguugcuaacagca

SEQ ID NO: 2948263 - RNA, 18 nt, Human
uauagcaguaaaaaaugg

SEQ ID NO: 2948264 - RNA, 19 nt, Human
uauaggaauugacccacaa

SEQ ID NO: 2948265 - RNA, 23 nt, Human
uauaggaacuuaaauaaugugaa

SEQ ID NO: 2948266 - RNA, 15 nt, Human
uauauagcaguaaaa

SEQ ID NO: 2948267 - RNA, 20 nt, Human
uauauagcaagacauuauau

SEQ ID NO: 2948268 - RNA, 16 nt, Human
uauauagcaguaaaaa

SEQ ID NO: 2948269 - RNA, 18 nt, Human
uauauagcaagacauuau

SEQ ID NO: 2948270 - RNA, 16 nt, Human
uauaggugcuacaaaa

SEQ ID NO: 2948271 - RNA, 15 nt, Human
uauccaauugcugcu

SEQ ID NO: 2948272 - RNA, 23 nt, Human
uauccaauugcugcuuguacacu

SEQ ID NO: 2948273 - RNA, 14 nt, Human
uauccaaucuguga

SEQ ID NO: 2948274 - RNA, 19 nt, Human
uauccaacaucaacaucuu

SEQ ID NO: 2948275 - RNA, 10 nt, Human
uaucagaauu

SEQ ID NO: 2948276 - RNA, 17 nt, Human
uaucagaauucucagaa

SEQ ID NO: 2948277 - RNA, 19 nt, Human
uaucacccagaagaaaaua

SEQ ID NO: 2948278 - RNA, 22 nt, Human
uaucacccagaagaaaauagug

SEQ ID NO: 2948279 - RNA, 20 nt, Human
uaucacaaaucuuaacuuga

SEQ ID NO: 2948280 - RNA, 16 nt, Human
uaucacaaaucuuaac

SEQ ID NO: 2948281 - RNA, 14 nt, Human
uaucacaaaucuua

SEQ ID NO: 2948282 - RNA, 14 nt, Human
acagaccuuugaac

SEQ ID NO: 2948283 - RNA, 18 nt, Human
acacuuacacuuuaugca

SEQ ID NO: 2948284 - RNA, 21 nt, Human
acacuuacacuuuaugcacaa

SEQ ID NO: 2948285 - RNA, 16 nt, Human
acacuuacacuuuaug

SEQ ID NO: 2948286 - RNA, 20 nt, Human
acacuguuucaaacuuuacu

SEQ ID NO: 2948287 - RNA, 16 nt, Human
acacucauucauuacu

SEQ ID NO: 2948288 - RNA, 17 nt, Human
acacucauugaccugag

SEQ ID NO: 2948289 - RNA, 16 nt, Human
acacuguuucaaacuu

SEQ ID NO: 2948290 - RNA, 17 nt, Human
acacuguuucaaacuuu

SEQ ID NO: 2948291 - RNA, 18 nt, Human
acacuguuucaaacuuua

SEQ ID NO: 2948292 - RNA, 18 nt, Human
acagacauacuaaccagc

SEQ ID NO: 2948293 - RNA, 19 nt, Human
acagacauacuaaccagca

SEQ ID NO: 2948294 - RNA, 19 nt, Human
acagaaagcagaacaguga

SEQ ID NO: 2948295 - RNA, 18 nt, Human
acagcaagggugauggga

SEQ ID NO: 2948296 - RNA, 15 nt, Human
acagcccgggcucug

SEQ ID NO: 2948297 - RNA, 16 nt, Human
acagcccgggcucugc

SEQ ID NO: 2948298 - RNA, 21 nt, Human
uaugaggcauuuguuugaacu

SEQ ID NO: 2948299 - RNA, 14 nt, Human
uaugaggcauuugu

SEQ ID NO: 2948300 - RNA, 15 nt, Human
uaugaggcauuuguu

SEQ ID NO: 2948301 - RNA, 16 nt, Human
uaugggacucaaugca

SEQ ID NO: 2948302 - RNA, 23 nt, Human
uaugggacucaaugcacugacau

SEQ ID NO: 2948303 - RNA, 20 nt, Human
uauggcccuggccuagcaua

SEQ ID NO: 2948304 - RNA, 23 nt, Human
uauggcuuuugugcauuaucuag

SEQ ID NO: 2948305 - RNA, 21 nt, Human
uauggcccuggccuagcauac

SEQ ID NO: 2948306 - RNA, 22 nt, Human
uaugcaugaaguaauaugcaca

SEQ ID NO: 2948307 - RNA, 20 nt, Human
acaggaaaauuuuaaaaaua

SEQ ID NO: 2948308 - RNA, 15 nt, Human
acaggcagauacagg

SEQ ID NO: 2948309 - RNA, 16 nt, Human
acaggcccggcuccag

SEQ ID NO: 2948310 - RNA, 17 nt, Human
acaggcccggcuccagg

SEQ ID NO: 2948311 - RNA, 20 nt, Human
uaugugcacaucuguuuugu

SEQ ID NO: 2948312 - RNA, 18 nt, Human
acaggcccggcuccaggc

SEQ ID NO: 2948313 - RNA, 20 nt, Human
acaggcccggcuccaggcuc

SEQ ID NO: 2948314 - RNA, 21 nt, Human
acaggcccggcuccaggcucc

SEQ ID NO: 2948315 - RNA, 22 nt, Human
acaggcccggcuccaggcuccu

SEQ ID NO: 2948316 - RNA, 23 nt, Human
acagcuugaccgugaggccagag

SEQ ID NO: 2948317 - RNA, 22 nt, Human
acagcuugaccgugaggccaga

SEQ ID NO: 2948318 - RNA, 18 nt, Human
acaggaaaagcugcugac

SEQ ID NO: 2948319 - RNA, 19 nt, Human
acaggaaaagcugcugaca

SEQ ID NO: 2948320 - RNA, 20 nt, Human
acaggaaaagcugcugacag

SEQ ID NO: 2948321 - RNA, 21 nt, Human
acaggaaaagcugcugacagu

SEQ ID NO: 2948322 - RNA, 17 nt, Human
acagcuugaccgugagg

SEQ ID NO: 2948323 - RNA, 21 nt, Human
acagcuugaccgugaggccag

SEQ ID NO: 2948324 - RNA, 20 nt, Human
acagcuugaccgugaggcca

SEQ ID NO: 2948325 - RNA, 17 nt, Human
acagcuucauuuccugu

SEQ ID NO: 2948326 - RNA, 19 nt, Human
acagcuucauuuccugugu

SEQ ID NO: 2948327 - RNA, 21 nt, Human
acagcuucauuuccugugucu

SEQ ID NO: 2948328 - RNA, 15 nt, Human
acagcuaaugggaca

SEQ ID NO: 2948329 - RNA, 16 nt, Human
acagcuaaugggacac

SEQ ID NO: 2948330 - RNA, 17 nt, Human
acagcuaaugggacacu

SEQ ID NO: 2948331 - RNA, 19 nt, Human
acagcuaaugggacacuaa

SEQ ID NO: 2948332 - RNA, 14 nt, Human
acagcuguaugauu

SEQ ID NO: 2948333 - RNA, 19 nt, Human
acagcuguaugauucccag

SEQ ID NO: 2948334 - RNA, 20 nt, Human
acagcuguaugauucccagc

SEQ ID NO: 2948335 - RNA, 23 nt, Human
acagcuguaugauucccagccag

SEQ ID NO: 2948336 - RNA, 14 nt, Human
uagaaaaucuucau

SEQ ID NO: 2948337 - RNA, 15 nt, Human
uagaaacacaacuau

SEQ ID NO: 2948338 - RNA, 16 nt, Human
uagaacucccuuucaa

SEQ ID NO: 2948339 - RNA, 17 nt, Human
uagaacucccuuucaac

SEQ ID NO: 2948340 - RNA, 20 nt, Human
uagaauuugauaugugaaca

SEQ ID NO: 2948341 - RNA, 19 nt, Human
uagaauuugauaugugaac

SEQ ID NO: 2948342 - RNA, 22 nt, Human
uagaauuugauaugugaacagu

SEQ ID NO: 2948343 - RNA, 10 nt, Human
uagacagagu

SEQ ID NO: 2948344 - RNA, 16 nt, Human
uagacagucccugcca

SEQ ID NO: 2948345 - RNA, 13 nt, Human
uagacacacauga

SEQ ID NO: 2948346 - RNA, 18 nt, Human
uagacaauuuauuauggc

SEQ ID NO: 2948347 - RNA, 17 nt, Human
aauuugugauacaaugc

SEQ ID NO: 2948348 - RNA, 18 nt, Human
aauuugugauacaaugcu

SEQ ID NO: 2948349 - RNA, 14 nt, Human
aauuugugauacaa

SEQ ID NO: 2948350 - RNA, 18 nt, Human
aauuugggggaaaauuua

SEQ ID NO: 2948351 - RNA, 21 nt, Human
uagacagucccugccaaugga

SEQ ID NO: 2948352 - RNA, 17 nt, Human
uagacagucccugccaa

SEQ ID NO: 2948353 - RNA, 16 nt, Human
acaaaguaauuuggaa

SEQ ID NO: 2948354 - RNA, 14 nt, Human
acaaaauagaaagu

SEQ ID NO: 2948355 - RNA, 14 nt, Human
uagagccagggucu

SEQ ID NO: 2948356 - RNA, 22 nt, Human
uagagcggagaaaggaagggcu

SEQ ID NO: 2948357 - RNA, 16 nt, Human
acaaaaagcuacuuau

SEQ ID NO: 2948358 - RNA, 16 nt, Human
acaaaaagcauaaaaa

SEQ ID NO: 2948359 - RNA, 15 nt, Human
acaaaaacacagcaa

SEQ ID NO: 2948360 - RNA, 14 nt, Human
acaaaaacacagca

SEQ ID NO: 2948361 - RNA, 20 nt, Human
aauuuuacauggcuggagcu

SEQ ID NO: 2948362 - RNA, 13 nt, Human
acaaaaacacagc

SEQ ID NO: 2948363 - RNA, 12 nt, Human
uagccaaggcca

SEQ ID NO: 2948364 - RNA, 22 nt, Human
uagcacagacccugcccugugg

SEQ ID NO: 2948365 - RNA, 13 nt, Human
uagccaaggccaa

SEQ ID NO: 2948366 - RNA, 14 nt, Human
uagcacagacccug

SEQ ID NO: 2948367 - RNA, 21 nt, Human
uagcacagacccugcccugug

SEQ ID NO: 2948368 - RNA, 20 nt, Human
uagcacagacccugcccugu

SEQ ID NO: 2948369 - RNA, 15 nt, Human
uagcacagacccugc

SEQ ID NO: 2948370 - RNA, 19 nt, Human
uagagguacacuugugaau

SEQ ID NO: 2948371 - RNA, 18 nt, Human
uagagguacacuugugaa

SEQ ID NO: 2948372 - RNA, 13 nt, Human
uagagguacacuu

SEQ ID NO: 2948373 - RNA, 14 nt, Human
uagaggguguguaa

SEQ ID NO: 2948374 - RNA, 12 nt, Human
uaggaaaauuau

SEQ ID NO: 2948375 - RNA, 17 nt, Human
uaggaaaaacugauuuu

SEQ ID NO: 2948376 - RNA, 16 nt, Human
uaggaaaaacugauuu

SEQ ID NO: 2948377 - RNA, 13 nt, Human
uaggauguugaaa

SEQ ID NO: 2948378 - RNA, 13 nt, Human
uagggaagauaau

SEQ ID NO: 2948379 - RNA, 22 nt, Human
uaggggucugucuuuuaaacuc

SEQ ID NO: 2948380 - RNA, 20 nt, Human
uagccuuagaagucacacag

SEQ ID NO: 2948381 - RNA, 17 nt, Human
uagcgcccaguugggug

SEQ ID NO: 2948382 - RNA, 14 nt, Human
uagcgcccaguugg

SEQ ID NO: 2948383 - RNA, 21 nt, Human
uagccuuagaagucacacagu

SEQ ID NO: 2948384 - RNA, 13 nt, Human
uagcuuuuuucuc

SEQ ID NO: 2948385 - RNA, 23 nt, Human
uagcuuuuuucucugauacagaa

SEQ ID NO: 2948386 - RNA, 14 nt, Human
uaggaaaaacugau

SEQ ID NO: 2948387 - RNA, 13 nt, Human
uaggaaaaacuga

SEQ ID NO: 2948388 - RNA, 17 nt, Human
uaguagagguacacuug

SEQ ID NO: 2948389 - RNA, 14 nt, Human
uagucacugagaca

SEQ ID NO: 2948390 - RNA, 15 nt, Human
uaguagagacagggu

SEQ ID NO: 2948391 - RNA, 22 nt, Human
uaguagagacaggguuuugcca

SEQ ID NO: 2948392 - RNA, 14 nt, Human
uaguagagacaggg

SEQ ID NO: 2948393 - RNA, 22 nt, Human
uagguuuggacaaaauggaaua

SEQ ID NO: 2948394 - RNA, 23 nt, Human
acacaggcccggcuccaggcucc

SEQ ID NO: 2948395 - RNA, 24 nt, Human
acacaggcccggcuccaggcuccu

SEQ ID NO: 2948396 - RNA, 19 nt, Human
acacaggcccggcuccagg

SEQ ID NO: 2948397 - RNA, 20 nt, Human
acacaggcccggcuccaggc

SEQ ID NO: 2948398 - RNA, 21 nt, Human
acacaggcccggcuccaggcu

SEQ ID NO: 2948399 - RNA, 22 nt, Human
acacaggcccggcuccaggcuc

SEQ ID NO: 2948400 - RNA, 17 nt, Human
acacaggcccggcucca

SEQ ID NO: 2948401 - RNA, 18 nt, Human
acacaggcccggcuccag

SEQ ID NO: 2948402 - RNA, 16 nt, Human
acacaggcccggcucc

SEQ ID NO: 2948403 - RNA, 19 nt, Human
acaaugacuuacuguacau

SEQ ID NO: 2948404 - RNA, 20 nt, Human
acaaugacuuacuguacaug

SEQ ID NO: 2948405 - RNA, 22 nt, Human
acaaugacuuacuguacaugaa

SEQ ID NO: 2948406 - RNA, 18 nt, Human
acaaugcaaaccaucauu

SEQ ID NO: 2948407 - RNA, 17 nt, Human
acaaugcaaaccaucau

SEQ ID NO: 2948408 - RNA, 16 nt, Human
acaaugcaaaccauca

SEQ ID NO: 2948409 - RNA, 11 nt, Human
acaaugcaaac

SEQ ID NO: 2948410 - RNA, 19 nt, Human
uaggguaagugagagaggg

SEQ ID NO: 2948411 - RNA, 17 nt, Human
uaggguuauaauaaugu

SEQ ID NO: 2948412 - RNA, 15 nt, Human
uaggguuauaauaau

SEQ ID NO: 2948413 - RNA, 23 nt, Human
acaaugcaaaccaucauugaaau

SEQ ID NO: 2948414 - RNA, 21 nt, Human
acaaugcaaaccaucauugaa

SEQ ID NO: 2948415 - RNA, 19 nt, Human
acaaugcaaaccaucauug

SEQ ID NO: 2948416 - RNA, 20 nt, Human
acacaaagcuuuugcauauu

SEQ ID NO: 2948417 - RNA, 19 nt, Human
acacaaagcuuuugcauau

SEQ ID NO: 2948418 - RNA, 13 nt, Human
acacaacuauauu

SEQ ID NO: 2948419 - RNA, 21 nt, Human
acucaccugccccucaacucu

SEQ ID NO: 2948420 - RNA, 19 nt, Human
acucaccugccccucaacu

SEQ ID NO: 2948421 - RNA, 14 nt, Human
acucaccugccccu

SEQ ID NO: 2948422 - RNA, 14 nt, Human
acucagaagacacu

SEQ ID NO: 2948423 - RNA, 15 nt, Human
acucagaagacacug

SEQ ID NO: 2948424 - RNA, 16 nt, Human
acucagaagacacuga

SEQ ID NO: 2948425 - RNA, 17 nt, Human
acucagaagacacugau

SEQ ID NO: 2948426 - RNA, 14 nt, Human
acucagaauucucu

SEQ ID NO: 2948427 - RNA, 21 nt, Human
acucagaauucucuaguuuga

SEQ ID NO: 2948428 - RNA, 22 nt, Human
acucagaauucucuaguuugau

SEQ ID NO: 2948429 - RNA, 18 nt, Human
acucagaagacacugaug

SEQ ID NO: 2948430 - RNA, 17 nt, Human
acucauugaccugaggc

SEQ ID NO: 2948431 - RNA, 16 nt, Human
acucauugaccugagg

SEQ ID NO: 2948432 - RNA, 12 nt, Human
acucaucuuagg

SEQ ID NO: 2948433 - RNA, 20 nt, Human
acucauuuuaaaaaauggaa

SEQ ID NO: 2948434 - RNA, 22 nt, Human
acucauugaccugaggcccuuc

SEQ ID NO: 2948435 - RNA, 18 nt, Human
acucauugaccugaggcc

SEQ ID NO: 2948436 - RNA, 21 nt, Human
acuccaaacugacucuuaaga

SEQ ID NO: 2948437 - RNA, 23 nt, Human
ucccugaaggccccgcccaggcu

SEQ ID NO: 2948438 - RNA, 17 nt, Human
acucaccccagccccaa

SEQ ID NO: 2948439 - RNA, 17 nt, Human
ucccugaaggccccgcc

SEQ ID NO: 2948440 - RNA, 18 nt, Human
ucccugaaggccccgccc

SEQ ID NO: 2948441 - RNA, 22 nt, Human
ucccugaaggccccgcccaggc

SEQ ID NO: 2948442 - RNA, 21 nt, Human
ucccugaaggccccgcccagg

SEQ ID NO: 2948443 - RNA, 18 nt, Human
ucccucagucuggcccuu

SEQ ID NO: 2948444 - RNA, 20 nt, Human
ucccucagucuggcccuucc

SEQ ID NO: 2948445 - RNA, 14 nt, Human
ucccuccaccuccc

SEQ ID NO: 2948446 - RNA, 15 nt, Human
ucccuccaccucccu

SEQ ID NO: 2948447 - RNA, 17 nt, Human
ucccuccaccucccugc

SEQ ID NO: 2948448 - RNA, 11 nt, Human
ucccucuuucc

SEQ ID NO: 2948449 - RNA, 13 nt, Human
ucccucuuucccu

SEQ ID NO: 2948450 - RNA, 19 nt, Human
ucccuccaccucccugcaa

SEQ ID NO: 2948451 - RNA, 13 nt, Human
acguacacacaca

SEQ ID NO: 2948452 - RNA, 12 nt, Human
acguacacauuu

SEQ ID NO: 2948453 - RNA, 13 nt, Human
acguacacauuuu

SEQ ID NO: 2948454 - RNA, 14 nt, Human
acguacacauuuua

SEQ ID NO: 2948455 - RNA, 18 nt, Human
acuacggaauaguuggcu

SEQ ID NO: 2948456 - RNA, 20 nt, Human
acuagaguuuagcuggaaaa

SEQ ID NO: 2948457 - RNA, 19 nt, Human
acucacauuuauucugcuc

SEQ ID NO: 2948458 - RNA, 20 nt, Human
acucacauuuauucugcuca

SEQ ID NO: 2948459 - RNA, 14 nt, Human
acucaaugcacuga

SEQ ID NO: 2948460 - RNA, 24 nt, Human
uccccuccucugcuugccaucccu

SEQ ID NO: 2948461 - RNA, 14 nt, Human
uccccuccucugcu

SEQ ID NO: 2948462 - RNA, 15 nt, Human
uccccuccucugcuu

SEQ ID NO: 2948463 - RNA, 18 nt, Human
uccccuccucugcuugcc

SEQ ID NO: 2948464 - RNA, 12 nt, Human
acuauaauguaa

SEQ ID NO: 2948465 - RNA, 13 nt, Human
acuauaauguaag

SEQ ID NO: 2948466 - RNA, 14 nt, Human
acuauaauguaagc

SEQ ID NO: 2948467 - RNA, 12 nt, Human
acuauguaucaa

SEQ ID NO: 2948468 - RNA, 18 nt, Human
acuauucaaacagucuca

SEQ ID NO: 2948469 - RNA, 16 nt, Human
acuauucaaacagucu

SEQ ID NO: 2948470 - RNA, 14 nt, Human
acuauucaaacagu

SEQ ID NO: 2948471 - RNA, 13 nt, Human
acuauucaaacag

SEQ ID NO: 2948472 - RNA, 16 nt, Human
acucgaguuacagaca

SEQ ID NO: 2948473 - RNA, 20 nt, Human
uccuagcacuuugggaggcc

SEQ ID NO: 2948474 - RNA, 21 nt, Human
uccuagccugugccucuggga

SEQ ID NO: 2948475 - RNA, 15 nt, Human
uccguuaaaauacca

SEQ ID NO: 2948476 - RNA, 13 nt, Human
uccguuaaaauac

SEQ ID NO: 2948477 - RNA, 18 nt, Human
uccggcccuccagagccc

SEQ ID NO: 2948478 - RNA, 14 nt, Human
uccggcccuccaga

SEQ ID NO: 2948479 - RNA, 14 nt, Human
acuccagaaaguga

SEQ ID NO: 2948480 - RNA, 15 nt, Human
acucuucccucaaau

SEQ ID NO: 2948481 - RNA, 17 nt, Human
acucuggcagcucagag

SEQ ID NO: 2948482 - RNA, 16 nt, Human
acucuggcagcucaga

SEQ ID NO: 2948483 - RNA, 21 nt, Human
acucuuauugcccacgcugga

SEQ ID NO: 2948484 - RNA, 20 nt, Human
acucuggcagcucagagagg

SEQ ID NO: 2948485 - RNA, 19 nt, Human
acucuggcagcucagagag

SEQ ID NO: 2948486 - RNA, 16 nt, Human
acucgcgacaaugcaa

SEQ ID NO: 2948487 - RNA, 15 nt, Human
acucgcgacaaugca

SEQ ID NO: 2948488 - RNA, 17 nt, Human
uccucuccccaugaugu

SEQ ID NO: 2948489 - RNA, 21 nt, Human
uccucccaccucagccucccg

SEQ ID NO: 2948490 - RNA, 13 nt, Human
uccucccaccuca

SEQ ID NO: 2948491 - RNA, 14 nt, Human
uccucccaccucag

SEQ ID NO: 2948492 - RNA, 15 nt, Human
uccucccaccucagc

SEQ ID NO: 2948493 - RNA, 16 nt, Human
uccucccaccucagcc

SEQ ID NO: 2948494 - RNA, 18 nt, Human
uccucccaccucagccuc

SEQ ID NO: 2948495 - RNA, 20 nt, Human
uccucccaccucagccuccc

SEQ ID NO: 2948496 - RNA, 15 nt, Human
uccugaagaauugaa

SEQ ID NO: 2948497 - RNA, 19 nt, Human
acucuuucuauuguuucuu

SEQ ID NO: 2948498 - RNA, 23 nt, Human
uccucuuuggucuacacugugcu

SEQ ID NO: 2948499 - RNA, 21 nt, Human
uccugaaaacccuugccaugu

SEQ ID NO: 2948500 - RNA, 23 nt, Human
accugaggcccuucucuccagcc

SEQ ID NO: 2948501 - RNA, 12 nt, Human
accugagcccca

SEQ ID NO: 2948502 - RNA, 17 nt, Human
accugagccccaaaagg

SEQ ID NO: 2948503 - RNA, 23 nt, Human
accugaagaguggucagaacaga

SEQ ID NO: 2948504 - RNA, 18 nt, Human
accugaagacucauucuu

SEQ ID NO: 2948505 - RNA, 19 nt, Human
accugaauuuuggcugugu

SEQ ID NO: 2948506 - RNA, 12 nt, Human
ucauaaugacuu

SEQ ID NO: 2948507 - RNA, 16 nt, Human
ucauaauaaguugcau

SEQ ID NO: 2948508 - RNA, 14 nt, Human
accugaggggccuc

SEQ ID NO: 2948509 - RNA, 16 nt, Human
accugaggggccucuu

SEQ ID NO: 2948510 - RNA, 20 nt, Human
accugcacacuguccuauua

SEQ ID NO: 2948511 - RNA, 17 nt, Human
accugccaggaagccag

SEQ ID NO: 2948512 - RNA, 16 nt, Human
accugccaggaagcca

SEQ ID NO: 2948513 - RNA, 18 nt, Human
accugccaggaagccagc

SEQ ID NO: 2948514 - RNA, 20 nt, Human
accuggaauauauaaccagu

SEQ ID NO: 2948515 - RNA, 16 nt, Human
accugcggugcuaucu

SEQ ID NO: 2948516 - RNA, 21 nt, Human
accugcgucucauacucaccu

SEQ ID NO: 2948517 - RNA, 23 nt, Human
accugccuguugggccaggagcc

SEQ ID NO: 2948518 - RNA, 16 nt, Human
ucauuugucacacacu

SEQ ID NO: 2948519 - RNA, 14 nt, Human
ucauuugucacaca

SEQ ID NO: 2948520 - RNA, 19 nt, Human
ucauuuuuaguagagacag

SEQ ID NO: 2948521 - RNA, 18 nt, Human
ucauuuuuuuuaagaaaa

SEQ ID NO: 2948522 - RNA, 17 nt, Human
ucauuuuuuuuaagaaa

SEQ ID NO: 2948523 - RNA, 20 nt, Human
uccacccaggagccccgagg

SEQ ID NO: 2948524 - RNA, 12 nt, Human
uccacccaccuc

SEQ ID NO: 2948525 - RNA, 18 nt, Human
uccaccaucaagccacca

SEQ ID NO: 2948526 - RNA, 13 nt, Human
uccacccaccuca

SEQ ID NO: 2948527 - RNA, 17 nt, Human
uccacccaggagccccg

SEQ ID NO: 2948528 - RNA, 13 nt, Human
accuggccucugc

SEQ ID NO: 2948529 - RNA, 12 nt, Human
accuggccucug

SEQ ID NO: 2948530 - RNA, 12 nt, Human
accuuccugcug

SEQ ID NO: 2948531 - RNA, 21 nt, Human
accuggguaacuagggaagau

SEQ ID NO: 2948532 - RNA, 14 nt, Human
accuucuccuucac

SEQ ID NO: 2948533 - RNA, 22 nt, Human
accuucuccuucaccuuugucc

SEQ ID NO: 2948534 - RNA, 16 nt, Human
accuugacagggcaca

SEQ ID NO: 2948535 - RNA, 13 nt, Human
accuuugucccca

SEQ ID NO: 2948536 - RNA, 14 nt, Human
accuuuuuuauaca

SEQ ID NO: 2948537 - RNA, 16 nt, Human
accuuuguccccaccg

SEQ ID NO: 2948538 - RNA, 15 nt, Human
accuuuguccccacc

SEQ ID NO: 2948539 - RNA, 14 nt, Human
accuuuguccccac

SEQ ID NO: 2948540 - RNA, 16 nt, Human
accuuuuuuauacaua

SEQ ID NO: 2948541 - RNA, 17 nt, Human
accuuuuuuauacauaa

SEQ ID NO: 2948542 - RNA, 18 nt, Human
accuuuuuuauacauaaa

SEQ ID NO: 2948543 - RNA, 17 nt, Human
acgcucucuggccuucg

SEQ ID NO: 2948544 - RNA, 19 nt, Human
acggagucccaccuuggcu

SEQ ID NO: 2948545 - RNA, 13 nt, Human
acggccaggccag

SEQ ID NO: 2948546 - RNA, 16 nt, Human
acggccaggccagagg

SEQ ID NO: 2948547 - RNA, 21 nt, Human
acggagucccaccuuggcugc

SEQ ID NO: 2948548 - RNA, 14 nt, Human
acgcccccacuggu

SEQ ID NO: 2948549 - RNA, 17 nt, Human
acgcccuuggccauggg

SEQ ID NO: 2948550 - RNA, 20 nt, Human
acgcgugcacacaccagagc

SEQ ID NO: 2948551 - RNA, 23 nt, Human
acgcgugcacacaccagagccca

SEQ ID NO: 2948552 - RNA, 15 nt, Human
acgcucucuggccuu

SEQ ID NO: 2948553 - RNA, 16 nt, Human
acgcucucuggccuuc

SEQ ID NO: 2948554 - RNA, 14 nt, Human
acgcucucuggccu

SEQ ID NO: 2948555 - RNA, 18 nt, Human
acgcuacccgggaagggg

SEQ ID NO: 2948556 - RNA, 17 nt, Human
acgcuacccgggaaggg

SEQ ID NO: 2948557 - RNA, 13 nt, Human
acgcuacccggga

SEQ ID NO: 2948558 - RNA, 18 nt, Human
uccaggcugggagagccu

SEQ ID NO: 2948559 - RNA, 17 nt, Human
uccaggcugggagagcc

SEQ ID NO: 2948560 - RNA, 14 nt, Human
uccaggcugggaga

SEQ ID NO: 2948561 - RNA, 18 nt, Human
acgccaucccagccccaa

SEQ ID NO: 2948562 - RNA, 17 nt, Human
acgccaucccagcccca

SEQ ID NO: 2948563 - RNA, 16 nt, Human
acgccaucccagcccc

SEQ ID NO: 2948564 - RNA, 15 nt, Human
acgccaucccagccc

SEQ ID NO: 2948565 - RNA, 14 nt, Human
acgccaucccagcc

SEQ ID NO: 2948566 - RNA, 11 nt, Human
acgccauccca

SEQ ID NO: 2948567 - RNA, 23 nt, Human
acgccaggggaaaaucagccugc

SEQ ID NO: 2948568 - RNA, 15 nt, Human
acgacugcccggcag

SEQ ID NO: 2948569 - RNA, 18 nt, Human
acgccaggggaaaaucag

SEQ ID NO: 2948570 - RNA, 20 nt, Human
acgaggucaggagaucgaga

SEQ ID NO: 2948571 - RNA, 17 nt, Human
uccaugaguccccuguu

SEQ ID NO: 2948572 - RNA, 16 nt, Human
uccaugaguccccugu

SEQ ID NO: 2948573 - RNA, 15 nt, Human
uccaugaguccccug

SEQ ID NO: 2948574 - RNA, 22 nt, Human
uccaugaagauguagaggagaa

SEQ ID NO: 2948575 - RNA, 14 nt, Human
acggcucacugcag

SEQ ID NO: 2948576 - RNA, 20 nt, Human
uccagugaggcucugcccuu

SEQ ID NO: 2948577 - RNA, 14 nt, Human
uccagugagacagc

SEQ ID NO: 2948578 - RNA, 17 nt, Human
uccagugaggcucugcc

SEQ ID NO: 2948579 - RNA, 19 nt, Human
uccagugaggcucugcccu

SEQ ID NO: 2948580 - RNA, 18 nt, Human
uccagugaggcucugccc

SEQ ID NO: 2948581 - RNA, 14 nt, Human
ucccaccccacaca

SEQ ID NO: 2948582 - RNA, 11 nt, Human
ucccaccccac

SEQ ID NO: 2948583 - RNA, 14 nt, Human
ucccacaaaggaga

SEQ ID NO: 2948584 - RNA, 15 nt, Human
ucccaaagugcuggg

SEQ ID NO: 2948585 - RNA, 16 nt, Human
ucccaaagugcuggga

SEQ ID NO: 2948586 - RNA, 14 nt, Human
acaucuugcucugc

SEQ ID NO: 2948587 - RNA, 19 nt, Human
acaucuuggucagauuuga

SEQ ID NO: 2948588 - RNA, 22 nt, Human
acaucuugcucugcugacagac

SEQ ID NO: 2948589 - RNA, 17 nt, Human
acaucuugcucugcuga

SEQ ID NO: 2948590 - RNA, 15 nt, Human
acaucuugcucugcu

SEQ ID NO: 2948591 - RNA, 16 nt, Human
acaucuugcucugcug

SEQ ID NO: 2948592 - RNA, 15 nt, Human
acaugaaaacacauu

SEQ ID NO: 2948593 - RNA, 14 nt, Human
uauuuuaaaagaau

SEQ ID NO: 2948594 - RNA, 18 nt, Human
uauuuuaaaagaaugauu

SEQ ID NO: 2948595 - RNA, 17 nt, Human
uauuuuuguagagccag

SEQ ID NO: 2948596 - RNA, 12 nt, Human
uauuuuacuuuu

SEQ ID NO: 2948597 - RNA, 20 nt, Human
uauuuugacuuguugagggu

SEQ ID NO: 2948598 - RNA, 20 nt, Human
uauuuugcuuugugauuuuu

SEQ ID NO: 2948599 - RNA, 13 nt, Human
uauuuugcuuugu

SEQ ID NO: 2948600 - RNA, 15 nt, Human
uauuuugcuuuguga

SEQ ID NO: 2948601 - RNA, 13 nt, Human
uauuuuacauaaa

SEQ ID NO: 2948602 - RNA, 22 nt, Human
uauuuuaauaauguuucaaaca

SEQ ID NO: 2948603 - RNA, 19 nt, Human
uauuuuaauaauguuucaa

SEQ ID NO: 2948604 - RNA, 20 nt, Human
ucaaauacgugggcauucaa

SEQ ID NO: 2948605 - RNA, 21 nt, Human
ucaaauacgugggcauucaaa

SEQ ID NO: 2948606 - RNA, 22 nt, Human
ucaaauacgugggcauucaaau

SEQ ID NO: 2948607 - RNA, 23 nt, Human
ucaaauacgugggcauucaaaug

SEQ ID NO: 2948608 - RNA, 13 nt, Human
acaugagcaucag

SEQ ID NO: 2948609 - RNA, 23 nt, Human
acaugaaaacacauuuuucuuag

SEQ ID NO: 2948610 - RNA, 22 nt, Human
acaugaaaacacauuuuucuua

SEQ ID NO: 2948611 - RNA, 22 nt, Human
ucaaagauauuuugcuuuguga

SEQ ID NO: 2948612 - RNA, 13 nt, Human
ucaaagauauuuu

SEQ ID NO: 2948613 - RNA, 20 nt, Human
ucaaagauauuuugcuuugu

SEQ ID NO: 2948614 - RNA, 16 nt, Human
ucaaaagcugggcagg

SEQ ID NO: 2948615 - RNA, 13 nt, Human
ucaaacagucuca

SEQ ID NO: 2948616 - RNA, 21 nt, Human
ucaaacagucucaggaaauca

SEQ ID NO: 2948617 - RNA, 20 nt, Human
ucaaacagucucaggaaauc

SEQ ID NO: 2948618 - RNA, 14 nt, Human
acauggccuuugcu

SEQ ID NO: 2948619 - RNA, 15 nt, Human
acauggaguauaugu

SEQ ID NO: 2948620 - RNA, 19 nt, Human
acauggaguauaugucaag

SEQ ID NO: 2948621 - RNA, 23 nt, Human
acaugagcaucaggccaggcccu

SEQ ID NO: 2948622 - RNA, 20 nt, Human
acauggaauaacauguaauu

SEQ ID NO: 2948623 - RNA, 14 nt, Human
acauggaaguacua

SEQ ID NO: 2948624 - RNA, 18 nt, Human
acauggaauaacauguaa

SEQ ID NO: 2948625 - RNA, 21 nt, Human
acaugucuuuucuugcaugag

SEQ ID NO: 2948626 - RNA, 16 nt, Human
accaaaucagcugcua

SEQ ID NO: 2948627 - RNA, 19 nt, Human
accaaaucagcugcuacua

SEQ ID NO: 2948628 - RNA, 16 nt, Human
accaacauacucccau

SEQ ID NO: 2948629 - RNA, 20 nt, Human
accaaccacugcgaccacaa

SEQ ID NO: 2948630 - RNA, 19 nt, Human
accaacacgagcaggcuac

SEQ ID NO: 2948631 - RNA, 14 nt, Human
accaacacgagcag

SEQ ID NO: 2948632 - RNA, 17 nt, Human
accacacagaggcugcc

SEQ ID NO: 2948633 - RNA, 15 nt, Human
accacacccagccca

SEQ ID NO: 2948634 - RNA, 16 nt, Human
accacacccagcccac

SEQ ID NO: 2948635 - RNA, 20 nt, Human
accacacccagcccacuucu

SEQ ID NO: 2948636 - RNA, 21 nt, Human
accacacccagcccacuucug

SEQ ID NO: 2948637 - RNA, 23 nt, Human
accacacccagcccacuucugcc

SEQ ID NO: 2948638 - RNA, 16 nt, Human
accacaagacugcaca

SEQ ID NO: 2948639 - RNA, 13 nt, Human
ucacauuccugaa

SEQ ID NO: 2948640 - RNA, 17 nt, Human
ucacauuccugaacagg

SEQ ID NO: 2948641 - RNA, 17 nt, Human
ucaccagccccagugcc

SEQ ID NO: 2948642 - RNA, 16 nt, Human
ucaccagccccagugc

SEQ ID NO: 2948643 - RNA, 18 nt, Human
ucacauauugauuuccgu

SEQ ID NO: 2948644 - RNA, 20 nt, Human
ucacauauugauuuccguua

SEQ ID NO: 2948645 - RNA, 22 nt, Human
ucacagcuuauuuccucauuuu

SEQ ID NO: 2948646 - RNA, 16 nt, Human
ucacauauugauuucc

SEQ ID NO: 2948647 - RNA, 18 nt, Human
ucacagcagugagacugg

SEQ ID NO: 2948648 - RNA, 15 nt, Human
ucacagaugggugcu

SEQ ID NO: 2948649 - RNA, 14 nt, Human
ucacagaugggugc

SEQ ID NO: 2948650 - RNA, 23 nt, Human
ucacagccagacuggcacaguuu

SEQ ID NO: 2948651 - RNA, 17 nt, Human
ucacagccagacuggca

SEQ ID NO: 2948652 - RNA, 19 nt, Human
ucacagcuccaagaauuuc

SEQ ID NO: 2948653 - RNA, 23 nt, Human
ucacagcagugagacuggggcca

SEQ ID NO: 2948654 - RNA, 13 nt, Human
ucaauuuaaaaaa

SEQ ID NO: 2948655 - RNA, 20 nt, Human
ucaauugugaaaaaauuuac

SEQ ID NO: 2948656 - RNA, 12 nt, Human
ucaauuuaaaaa

SEQ ID NO: 2948657 - RNA, 16 nt, Human
ucacagaccuuugaac

SEQ ID NO: 2948658 - RNA, 14 nt, Human
ucacagaagaugaa

SEQ ID NO: 2948659 - RNA, 15 nt, Human
acauuuuaugucuuu

SEQ ID NO: 2948660 - RNA, 13 nt, Human
acauuuuaugucu

SEQ ID NO: 2948661 - RNA, 16 nt, Human
acauuuuacacacugu

SEQ ID NO: 2948662 - RNA, 13 nt, Human
acauuuuucuuag

SEQ ID NO: 2948663 - RNA, 23 nt, Human
acauuuuucuuagggaaggauac

SEQ ID NO: 2948664 - RNA, 15 nt, Human
acauuuuuaagugcu

SEQ ID NO: 2948665 - RNA, 18 nt, Human
acauuuuuaagugcugca

SEQ ID NO: 2948666 - RNA, 21 nt, Human
acauugcggacagccacggcc

SEQ ID NO: 2948667 - RNA, 22 nt, Human
acauugcggacagccacggcca

SEQ ID NO: 2948668 - RNA, 16 nt, Human
acauuggaaacaaguc

SEQ ID NO: 2948669 - RNA, 23 nt, Human
ucaaggauccugagccagauuuc

SEQ ID NO: 2948670 - RNA, 17 nt, Human
ucaagagggucugagga

SEQ ID NO: 2948671 - RNA, 16 nt, Human
ucaagugauucuccug

SEQ ID NO: 2948672 - RNA, 17 nt, Human
ucaagugauucuccugc

SEQ ID NO: 2948673 - RNA, 17 nt, Human
ucaauaggaaaaacuga

SEQ ID NO: 2948674 - RNA, 19 nt, Human
ucaauaggaaaaacugauu

SEQ ID NO: 2948675 - RNA, 18 nt, Human
ucaauaggaaaaacugau

SEQ ID NO: 2948676 - RNA, 14 nt, Human
ucaaucaugucagu

SEQ ID NO: 2948677 - RNA, 23 nt, Human
ucaauauuucagauaaucacaau

SEQ ID NO: 2948678 - RNA, 22 nt, Human
ucaauaggaaaaacugauuuuu

SEQ ID NO: 2948679 - RNA, 22 nt, Human
ucagagacuccugcaggcagcc

SEQ ID NO: 2948680 - RNA, 20 nt, Human
ucagaauucucagaaucuca

SEQ ID NO: 2948681 - RNA, 10 nt, Human
ucagaauucu

SEQ ID NO: 2948682 - RNA, 12 nt, Human
ucagaauucuca

SEQ ID NO: 2948683 - RNA, 15 nt, Human
acccagcccacuucu

SEQ ID NO: 2948684 - RNA, 23 nt, Human
ucagaaguuucugccgcagcccu

SEQ ID NO: 2948685 - RNA, 23 nt, Human
ucagagacuccugcaggcagcca

SEQ ID NO: 2948686 - RNA, 13 nt, Human
ucagagcugcccu

SEQ ID NO: 2948687 - RNA, 14 nt, Human
ucagagcugcccuc

SEQ ID NO: 2948688 - RNA, 17 nt, Human
ucagagcugcccucucc

SEQ ID NO: 2948689 - RNA, 15 nt, Human
ucagagcugcccucu

SEQ ID NO: 2948690 - RNA, 16 nt, Human
ucagagcugcccucuc

SEQ ID NO: 2948691 - RNA, 15 nt, Human
ucagaucucuaacuu

SEQ ID NO: 2948692 - RNA, 16 nt, Human
ucagaucucuaacuuc

SEQ ID NO: 2948693 - RNA, 23 nt, Human
acccaggugcuaggaacacuccu

SEQ ID NO: 2948694 - RNA, 11 nt, Human
acccaggugcu

SEQ ID NO: 2948695 - RNA, 13 nt, Human
accccagguuucu

SEQ ID NO: 2948696 - RNA, 13 nt, Human
acccaggagcccc

SEQ ID NO: 2948697 - RNA, 15 nt, Human
acccaggagccccga

SEQ ID NO: 2948698 - RNA, 16 nt, Human
acccagcgagcccugg

SEQ ID NO: 2948699 - RNA, 17 nt, Human
acccagcgagcccuggu

SEQ ID NO: 2948700 - RNA, 13 nt, Human
acccagcgagccc

SEQ ID NO: 2948701 - RNA, 13 nt, Human
ucagcccucagaa

SEQ ID NO: 2948702 - RNA, 12 nt, Human
ucagcccucaga

SEQ ID NO: 2948703 - RNA, 15 nt, Human
ucacuguugcccagg

SEQ ID NO: 2948704 - RNA, 18 nt, Human
ucacugcaaccuccgccu

SEQ ID NO: 2948705 - RNA, 14 nt, Human
ucacuguugcccag

SEQ ID NO: 2948706 - RNA, 22 nt, Human
ucaccagccccagugcccacag

SEQ ID NO: 2948707 - RNA, 19 nt, Human
ucacauuccugaacaggau

SEQ ID NO: 2948708 - RNA, 20 nt, Human
ucacuauguugcccaggcag

SEQ ID NO: 2948709 - RNA, 21 nt, Human
ucacuauguugcccaggcagg

SEQ ID NO: 2948710 - RNA, 23 nt, Human
ucacugagacagcccgggcucug

SEQ ID NO: 2948711 - RNA, 21 nt, Human
accauuuugggguacccacug

SEQ ID NO: 2948712 - RNA, 23 nt, Human
accauuuugcugucccuuuuccu

SEQ ID NO: 2948713 - RNA, 22 nt, Human
accauuuugcugucccuuuucc

SEQ ID NO: 2948714 - RNA, 19 nt, Human
accauucuccaccugccag

SEQ ID NO: 2948715 - RNA, 21 nt, Human
accauucuccaccugccaggg

SEQ ID NO: 2948716 - RNA, 20 nt, Human
accauucuccaccugccagg

SEQ ID NO: 2948717 - RNA, 20 nt, Human
acccacugcuuuuggucugu

SEQ ID NO: 2948718 - RNA, 16 nt, Human
acccaaauguucauca

SEQ ID NO: 2948719 - RNA, 20 nt, Human
acccaaauguucaucaauga

SEQ ID NO: 2948720 - RNA, 19 nt, Human
acccgcuaagagggaggga

SEQ ID NO: 2948721 - RNA, 18 nt, Human
ucaggguuggccccugcc

SEQ ID NO: 2948722 - RNA, 19 nt, Human
ucaggguuggccccugccc

SEQ ID NO: 2948723 - RNA, 17 nt, Human
ucaggguuggccccugc

SEQ ID NO: 2948724 - RNA, 23 nt, Human
ucaggggugugcggccuuuggcu

SEQ ID NO: 2948725 - RNA, 19 nt, Human
ucaggggugugcggccuuu

SEQ ID NO: 2948726 - RNA, 12 nt, Human
ucaggggugugc

SEQ ID NO: 2948727 - RNA, 19 nt, Human
ucaggccaggcccucugcc

SEQ ID NO: 2948728 - RNA, 18 nt, Human
ucaggccaggcccucugc

SEQ ID NO: 2948729 - RNA, 17 nt, Human
ucaggccaggcccucug

SEQ ID NO: 2948730 - RNA, 17 nt, Human
ucaggcaggugggaugg

SEQ ID NO: 2948731 - RNA, 18 nt, Human
ucaggcaggugggaugga

SEQ ID NO: 2948732 - RNA, 13 nt, Human
acccccagccugc

SEQ ID NO: 2948733 - RNA, 12 nt, Human
acccccagccug

SEQ ID NO: 2948734 - RNA, 12 nt, Human
ucaggccaggcc

SEQ ID NO: 2948735 - RNA, 13 nt, Human
ucaggccagcugc

SEQ ID NO: 2948736 - RNA, 16 nt, Human
ucaggccaggcccucu

SEQ ID NO: 2948737 - RNA, 15 nt, Human
ucaggccaggcccuc

SEQ ID NO: 2948738 - RNA, 14 nt, Human
ucaggccaggcccu

SEQ ID NO: 2948739 - RNA, 13 nt, Human
ucaggccaggccc

SEQ ID NO: 2948740 - RNA, 21 nt, Human
acccuccuuucaccacaugug

SEQ ID NO: 2948741 - RNA, 22 nt, Human
acccgggaagggggcugggaca

SEQ ID NO: 2948742 - RNA, 14 nt, Human
acccucauguucuu

SEQ ID NO: 2948743 - RNA, 15 nt, Human
acccucauguucuua

SEQ ID NO: 2948744 - RNA, 17 nt, Human
acccucauguucuuaau

SEQ ID NO: 2948745 - RNA, 20 nt, Human
acccgggaagggggcuggga

SEQ ID NO: 2948746 - RNA, 19 nt, Human
acccgggaagggggcuggg

SEQ ID NO: 2948747 - RNA, 21 nt, Human
acccugaggcccagagggccu

SEQ ID NO: 2948748 - RNA, 19 nt, Human
acccugaggcccagagggc

SEQ ID NO: 2948749 - RNA, 17 nt, Human
acccugaggcccagagg

SEQ ID NO: 2948750 - RNA, 11 nt, Human
acccugaggcc

SEQ ID NO: 2948751 - RNA, 23 nt, Human
acccugaggcccagagggccugc

SEQ ID NO: 2948752 - RNA, 19 nt, Human
ucagguuuucuuuuaagaa

SEQ ID NO: 2948753 - RNA, 20 nt, Human
ucagguuuucuuuuaagaau

SEQ ID NO: 2948754 - RNA, 23 nt, Human
ucagguuuucuuuuaagaaucaa

SEQ ID NO: 2948755 - RNA, 22 nt, Human
ucaggugucccugcacuugcag

SEQ ID NO: 2948756 - RNA, 13 nt, Human
ucaguaagccgug

SEQ ID NO: 2948757 - RNA, 13 nt, Human
ucaguaauaacuc

SEQ ID NO: 2948758 - RNA, 20 nt, Human
acccuugccgucuaccugag

SEQ ID NO: 2948759 - RNA, 20 nt, Human
accgaaaacguggcugcuuc

SEQ ID NO: 2948760 - RNA, 15 nt, Human
ucaggugucccugca

SEQ ID NO: 2948761 - RNA, 23 nt, Human
ucagguggggucacucuggcagc

SEQ ID NO: 2948762 - RNA, 17 nt, Human
ucaggugucccugcacu

SEQ ID NO: 2948763 - RNA, 18 nt, Human
ucaggugucccugcacuu

SEQ ID NO: 2948764 - RNA, 22 nt, Human
accgaaaacguggcugcuucaa

SEQ ID NO: 2948765 - RNA, 21 nt, Human
accgaaaacguggcugcuuca

SEQ ID NO: 2948766 - RNA, 22 nt, Human
ucagguggggucacucuggcag

SEQ ID NO: 2948767 - RNA, 15 nt, Human
ucaguuugcagagua

SEQ ID NO: 2948768 - RNA, 16 nt, Human
ucaguuugcagaguag

SEQ ID NO: 2948769 - RNA, 12 nt, Human
ucaguuugguug

SEQ ID NO: 2948770 - RNA, 16 nt, Human
ucaguuuaucuguuca

SEQ ID NO: 2948771 - RNA, 14 nt, Human
ucaguuuaucuguu

SEQ ID NO: 2948772 - RNA, 20 nt, Human
ucaguuguuauuuauugaaa

SEQ ID NO: 2948773 - RNA, 15 nt, Human
ucaguuguuauuuau

SEQ ID NO: 2948774 - RNA, 19 nt, Human
ucaguuguuagugugucuu

SEQ ID NO: 2948775 - RNA, 14 nt, Human
ucaguggcagcugc

SEQ ID NO: 2948776 - RNA, 15 nt, Human
ucaguggcagcugcu

SEQ ID NO: 2948777 - RNA, 17 nt, Human
ucaguuguuaguguguc

SEQ ID NO: 2948778 - RNA, 16 nt, Human
ucaguggcagcugcuu

SEQ ID NO: 2948779 - RNA, 13 nt, Human
ucaguggcagcug

SEQ ID NO: 2948780 - RNA, 13 nt, Human
ucaguagucagac

SEQ ID NO: 2948781 - RNA, 23 nt, Human
ucagugccuuauggaacacucug

SEQ ID NO: 2948782 - RNA, 22 nt, Human
ucagugccuuauggaacacucu

SEQ ID NO: 2948783 - RNA, 20 nt, Human
ucagugccuuauggaacacu

SEQ ID NO: 2948784 - RNA, 19 nt, Human
ucagugccuuauggaacac

SEQ ID NO: 2948785 - RNA, 16 nt, Human
acuguaucaugacaaa

SEQ ID NO: 2948786 - RNA, 20 nt, Human
acuguaucaugacaaagacu

SEQ ID NO: 2948787 - RNA, 18 nt, Human
acuguccuauuauauuca

SEQ ID NO: 2948788 - RNA, 23 nt, Human
acuguccuacccacccuccuuuc

SEQ ID NO: 2948789 - RNA, 16 nt, Human
acuguccuauuauauu

SEQ ID NO: 2948790 - RNA, 15 nt, Human
acuguccuauuauau

SEQ ID NO: 2948791 - RNA, 23 nt, Human
acugucagcuccccucggagaag

SEQ ID NO: 2948792 - RNA, 22 nt, Human
acugucagcuccccucggagaa

SEQ ID NO: 2948793 - RNA, 15 nt, Human
acuguacacauaagc

SEQ ID NO: 2948794 - RNA, 19 nt, Human
acuguacaugaaaacacau

SEQ ID NO: 2948795 - RNA, 16 nt, Human
acuguacaugaaaaca

SEQ ID NO: 2948796 - RNA, 17 nt, Human
acuggguacuuguggac

SEQ ID NO: 2948797 - RNA, 18 nt, Human
acuggguacuuguggaca

SEQ ID NO: 2948798 - RNA, 16 nt, Human
acuguacaaaguagaa

SEQ ID NO: 2948799 - RNA, 22 nt, Human
acuguacaaaguagaagucuua

SEQ ID NO: 2948800 - RNA, 14 nt, Human
acuguaucaugaca

SEQ ID NO: 2948801 - RNA, 20 nt, Human
acuguacaugaaaacacauu

SEQ ID NO: 2948802 - RNA, 21 nt, Human
acuguacaugaaaacacauuu

SEQ ID NO: 2948803 - RNA, 23 nt, Human
ucgcugugucagcauagaaguaa

SEQ ID NO: 2948804 - RNA, 21 nt, Human
acugggcuuggggaccagagc

SEQ ID NO: 2948805 - RNA, 15 nt, Human
acuggguacuugugg

SEQ ID NO: 2948806 - RNA, 14 nt, Human
ucgcuccugugucu

SEQ ID NO: 2948807 - RNA, 22 nt, Human
acugaacaaacuaucagaggaa

SEQ ID NO: 2948808 - RNA, 12 nt, Human
acugaagaagca

SEQ ID NO: 2948809 - RNA, 22 nt, Human
acugaagaagcaccaaucauga

SEQ ID NO: 2948810 - RNA, 23 nt, Human
ucgggaggcugaggcaggagacu

SEQ ID NO: 2948811 - RNA, 23 nt, Human
ucgucacugcuuaacuucacaua

SEQ ID NO: 2948812 - RNA, 21 nt, Human
acuguuaauaguucagguaac

SEQ ID NO: 2948813 - RNA, 17 nt, Human
acuguuaauaguucagg

SEQ ID NO: 2948814 - RNA, 17 nt, Human
ucuaaagcugccagccg

SEQ ID NO: 2948815 - RNA, 13 nt, Human
ucuaaaggcuacc

SEQ ID NO: 2948816 - RNA, 16 nt, Human
ucuaaaggcuaccuuu

SEQ ID NO: 2948817 - RNA, 21 nt, Human
ucuacccucuuagaaaaacca

SEQ ID NO: 2948818 - RNA, 21 nt, Human
ucuacccaucuuaaaaacaac

SEQ ID NO: 2948819 - RNA, 19 nt, Human
ucuacccaucuuaaaaaca

SEQ ID NO: 2948820 - RNA, 17 nt, Human
ucuaccaaaaaucucaa

SEQ ID NO: 2948821 - RNA, 12 nt, Human
ucuagcaugaag

SEQ ID NO: 2948822 - RNA, 24 nt, Human
ucuagauacuguaucaugacaaag

SEQ ID NO: 2948823 - RNA, 14 nt, Human
ucuaguguuuucaa

SEQ ID NO: 2948824 - RNA, 14 nt, Human
ucuaggaaaauuau

SEQ ID NO: 2948825 - RNA, 22 nt, Human
ucuaguuugauuaaauucuugc

SEQ ID NO: 2948826 - RNA, 23 nt, Human
ucuaguuugauuaaauucuugca

SEQ ID NO: 2948827 - RNA, 18 nt, Human
ucuaguguuuucaauuuu

SEQ ID NO: 2948828 - RNA, 13 nt, Human
ucuauaauuucca

SEQ ID NO: 2948829 - RNA, 19 nt, Human
ucuauaauuuccauuuacu

SEQ ID NO: 2948830 - RNA, 22 nt, Human
ucuauaauuuccauuuacuuaa

SEQ ID NO: 2948831 - RNA, 13 nt, Human
ucuauaauuuaaa

SEQ ID NO: 2948832 - RNA, 19 nt, Human
ucuaccugaggggccucuu

SEQ ID NO: 2948833 - RNA, 12 nt, Human
ucuaccugaggg

SEQ ID NO: 2948834 - RNA, 13 nt, Human
acuuacuguacau

SEQ ID NO: 2948835 - RNA, 14 nt, Human
acuuacuguacaug

SEQ ID NO: 2948836 - RNA, 15 nt, Human
acuuacuguacauga

SEQ ID NO: 2948837 - RNA, 20 nt, Human
acuuagagguggggagcaga

SEQ ID NO: 2948838 - RNA, 18 nt, Human
acuuccaauuuacauacu

SEQ ID NO: 2948839 - RNA, 17 nt, Human
acuuccacugccauccu

SEQ ID NO: 2948840 - RNA, 20 nt, Human
acuuccagauccuggaaauc

SEQ ID NO: 2948841 - RNA, 20 nt, Human
acuucgggaggucgaggcag

SEQ ID NO: 2948842 - RNA, 17 nt, Human
acuucgggaggucgagg

SEQ ID NO: 2948843 - RNA, 21 nt, Human
acuucucuacccaucuuaaaa

SEQ ID NO: 2948844 - RNA, 18 nt, Human
acuucuccacccugcucu

SEQ ID NO: 2948845 - RNA, 13 nt, Human
acuucuaaguaaa

SEQ ID NO: 2948846 - RNA, 19 nt, Human
acuucuaaguaaaaccaca

SEQ ID NO: 2948847 - RNA, 18 nt, Human
acuucuaaguaaaaccac

SEQ ID NO: 2948848 - RNA, 16 nt, Human
ucuauuguuucuuuca

SEQ ID NO: 2948849 - RNA, 16 nt, Human
ucucaaaaaaagaaaa

SEQ ID NO: 2948850 - RNA, 21 nt, Human
ucucacagcuccaagaauuuc

SEQ ID NO: 2948851 - RNA, 17 nt, Human
ucucaaaacugcacugu

SEQ ID NO: 2948852 - RNA, 14 nt, Human
acuuggaagcuccg

SEQ ID NO: 2948853 - RNA, 14 nt, Human
acuugucuuuggac

SEQ ID NO: 2948854 - RNA, 19 nt, Human
acuugagaauuacccuuuu

SEQ ID NO: 2948855 - RNA, 21 nt, Human
acuugaacccgggaggcagag

SEQ ID NO: 2948856 - RNA, 23 nt, Human
acuugaacccgggaggcagaggu

SEQ ID NO: 2948857 - RNA, 15 nt, Human
agaaacuggaacucu

SEQ ID NO: 2948858 - RNA, 15 nt, Human
agaaacuggcaaagc

SEQ ID NO: 2948859 - RNA, 16 nt, Human
agaaacuggcaaagca

SEQ ID NO: 2948860 - RNA, 17 nt, Human
agaaacuggcaaagcag

SEQ ID NO: 2948861 - RNA, 22 nt, Human
agaaacuggcaaagcagaaugu

SEQ ID NO: 2948862 - RNA, 16 nt, Human
agaaacacaacuauau

SEQ ID NO: 2948863 - RNA, 19 nt, Human
agaaaaaauauuuucccua

SEQ ID NO: 2948864 - RNA, 23 nt, Human
agaaaaaauauuuuccugccagg

SEQ ID NO: 2948865 - RNA, 17 nt, Human
agaaaaaauauuuuccu

SEQ ID NO: 2948866 - RNA, 18 nt, Human
agaaaaaugagccuggca

SEQ ID NO: 2948867 - RNA, 18 nt, Human
ucucuugguccugcugca

SEQ ID NO: 2948868 - RNA, 17 nt, Human
ucucuugguccugcugc

SEQ ID NO: 2948869 - RNA, 16 nt, Human
ucucuugguccugcug

SEQ ID NO: 2948870 - RNA, 22 nt, Human
ucugaaggacauugcggacagc

SEQ ID NO: 2948871 - RNA, 18 nt, Human
ucugaaggcuggguucug

SEQ ID NO: 2948872 - RNA, 20 nt, Human
ucugaaggguaauuauauag

SEQ ID NO: 2948873 - RNA, 15 nt, Human
agaaaugccuuaccc

SEQ ID NO: 2948874 - RNA, 16 nt, Human
agaaagacuauucaaa

SEQ ID NO: 2948875 - RNA, 20 nt, Human
agaaagacuaucuaaauguu

SEQ ID NO: 2948876 - RNA, 22 nt, Human
agaaagacuaucuaaauguuga

SEQ ID NO: 2948877 - RNA, 17 nt, Human
agaaagcagaacaguga

SEQ ID NO: 2948878 - RNA, 18 nt, Human
agaaagcagaacagugau

SEQ ID NO: 2948879 - RNA, 20 nt, Human
agaaagcagaacagugauua

SEQ ID NO: 2948880 - RNA, 22 nt, Human
acuuugcacacuuuggcccagg

SEQ ID NO: 2948881 - RNA, 21 nt, Human
acuuugcacacuuuggcccag

SEQ ID NO: 2948882 - RNA, 23 nt, Human
acuuuggaaagaguaggaagacu

SEQ ID NO: 2948883 - RNA, 23 nt, Human
acuuuggaaagacuuuuccaacc

SEQ ID NO: 2948884 - RNA, 14 nt, Human
acuuuggaaagagu

SEQ ID NO: 2948885 - RNA, 13 nt, Human
acuuuggaaagag

SEQ ID NO: 2948886 - RNA, 14 nt, Human
acuuguggacacag

SEQ ID NO: 2948887 - RNA, 16 nt, Human
acuuuaaaaggagcca

SEQ ID NO: 2948888 - RNA, 22 nt, Human
acuuguuuuauuuaaccucuaa

SEQ ID NO: 2948889 - RNA, 14 nt, Human
acuuuaaaagcauu

SEQ ID NO: 2948890 - RNA, 12 nt, Human
acuuuaaaacac

SEQ ID NO: 2948891 - RNA, 12 nt, Human
acuuuaaaagca

SEQ ID NO: 2948892 - RNA, 23 nt, Human
acuuuaccuuuuuuauacauaaa

SEQ ID NO: 2948893 - RNA, 21 nt, Human
ucucucacuuguuuuauuuaa

SEQ ID NO: 2948894 - RNA, 22 nt, Human
ucucucacuuguuuuauuuaac

SEQ ID NO: 2948895 - RNA, 12 nt, Human
ucucucaggcca

SEQ ID NO: 2948896 - RNA, 19 nt, Human
ucuccuguaccucuugagc

SEQ ID NO: 2948897 - RNA, 23 nt, Human
ucuccuuggugucgggcaugaca

SEQ ID NO: 2948898 - RNA, 21 nt, Human
ucuccuuggugucgggcauga

SEQ ID NO: 2948899 - RNA, 16 nt, Human
acuuuguguucaccuu

SEQ ID NO: 2948900 - RNA, 19 nt, Human
agaagcaacccaaauguuc

SEQ ID NO: 2948901 - RNA, 19 nt, Human
agaagcaccaaucaugaau

SEQ ID NO: 2948902 - RNA, 16 nt, Human
agaagcagaggaagga

SEQ ID NO: 2948903 - RNA, 23 nt, Human
agaagcccaggaaaggcuccagg

SEQ ID NO: 2948904 - RNA, 20 nt, Human
ucugcccauccugccccuga

SEQ ID NO: 2948905 - RNA, 23 nt, Human
ucugcccacucccugcaaccuga

SEQ ID NO: 2948906 - RNA, 23 nt, Human
ucugcccuugguuaggcauugug

SEQ ID NO: 2948907 - RNA, 12 nt, Human
ucugcccuuggu

SEQ ID NO: 2948908 - RNA, 17 nt, Human
agaacucccuuucaaca

SEQ ID NO: 2948909 - RNA, 15 nt, Human
agaacucccuuucaa

SEQ ID NO: 2948910 - RNA, 16 nt, Human
agaacucccuuucaac

SEQ ID NO: 2948911 - RNA, 17 nt, Human
agaacuauguuuuuguu

SEQ ID NO: 2948912 - RNA, 23 nt, Human
agaaccuuuugagugccuuacac

SEQ ID NO: 2948913 - RNA, 19 nt, Human
agaaccuuuugagugccuu

SEQ ID NO: 2948914 - RNA, 22 nt, Human
agaaguuugagaucagccuggg

SEQ ID NO: 2948915 - RNA, 15 nt, Human
agaaguuugaacauu

SEQ ID NO: 2948916 - RNA, 13 nt, Human
agaaguugauaug

SEQ ID NO: 2948917 - RNA, 15 nt, Human
agaaguucuaguguu

SEQ ID NO: 2948918 - RNA, 16 nt, Human
agaaguucuaguguuu

SEQ ID NO: 2948919 - RNA, 17 nt, Human
agaaguucuaguguuuu

SEQ ID NO: 2948920 - RNA, 20 nt, Human
agaauaggcacuuuaaaaca

SEQ ID NO: 2948921 - RNA, 22 nt, Human
agaauaggcacuuuaaaacacu

SEQ ID NO: 2948922 - RNA, 17 nt, Human
agaauaggcacuuuaaa

SEQ ID NO: 2948923 - RNA, 18 nt, Human
agaauaggcacuuuaaaa

SEQ ID NO: 2948924 - RNA, 16 nt, Human
agaauaaaccaagaau

SEQ ID NO: 2948925 - RNA, 16 nt, Human
ucuggauucauauuua

SEQ ID NO: 2948926 - RNA, 19 nt, Human
ucuggauucauauuuaauu

SEQ ID NO: 2948927 - RNA, 22 nt, Human
ucugcuuugggguuuaucagaa

SEQ ID NO: 2948928 - RNA, 21 nt, Human
ucuggcagcucagagagggug

SEQ ID NO: 2948929 - RNA, 18 nt, Human
ucuggcagcucagagagg

SEQ ID NO: 2948930 - RNA, 23 nt, Human
ucuggcagaguugaagacagagc

SEQ ID NO: 2948931 - RNA, 20 nt, Human
ucuggcagaguugaagacag

SEQ ID NO: 2948932 - RNA, 17 nt, Human
ucuggcagcucagagag

SEQ ID NO: 2948933 - RNA, 16 nt, Human
ucuggcagcucagaga

SEQ ID NO: 2948934 - RNA, 14 nt, Human
agaagcuccaggua

SEQ ID NO: 2948935 - RNA, 14 nt, Human
ugaauaccccaaga

SEQ ID NO: 2948936 - RNA, 22 nt, Human
ugaauaccccaagacucccaug

SEQ ID NO: 2948937 - RNA, 15 nt, Human
ugaauacuuuauaaa

SEQ ID NO: 2948938 - RNA, 22 nt, Human
ugaaggguaauuauauaguuac

SEQ ID NO: 2948939 - RNA, 19 nt, Human
ugaagguagaauguuuuca

SEQ ID NO: 2948940 - RNA, 18 nt, Human
ugaagguagaauguuuuc

SEQ ID NO: 2948941 - RNA, 14 nt, Human
ugaagucacacagu

SEQ ID NO: 2948942 - RNA, 23 nt, Human
ugaauguaggcuggcuuucagag

SEQ ID NO: 2948943 - RNA, 16 nt, Human
agagggagggagggcu

SEQ ID NO: 2948944 - RNA, 15 nt, Human
agagguuaagguggg

SEQ ID NO: 2948945 - RNA, 16 nt, Human
agagguggggagcaga

SEQ ID NO: 2948946 - RNA, 21 nt, Human
agaguaggcuauuccugagag

SEQ ID NO: 2948947 - RNA, 14 nt, Human
ugaauuugccuaau

SEQ ID NO: 2948948 - RNA, 23 nt, Human
ugaauuucuuuugccguuauuaa

SEQ ID NO: 2948949 - RNA, 19 nt, Human
ugacacacagcucuguccu

SEQ ID NO: 2948950 - RNA, 19 nt, Human
ugacaaagacugaguacgu

SEQ ID NO: 2948951 - RNA, 16 nt, Human
ugacacacagcucugu

SEQ ID NO: 2948952 - RNA, 18 nt, Human
ugacacacagcucugucc

SEQ ID NO: 2948953 - RNA, 12 nt, Human
ugacacaugcaa

SEQ ID NO: 2948954 - RNA, 20 nt, Human
ugacacaugcaaggucauuu

SEQ ID NO: 2948955 - RNA, 22 nt, Human
agauacaguuacucagaauucu

SEQ ID NO: 2948956 - RNA, 11 nt, Human
agauacuguau

SEQ ID NO: 2948957 - RNA, 20 nt, Human
agauacaggaaaagcugcug

SEQ ID NO: 2948958 - RNA, 13 nt, Human
agauacaguuacu

SEQ ID NO: 2948959 - RNA, 22 nt, Human
agauaauauuaaggaagacaau

SEQ ID NO: 2948960 - RNA, 18 nt, Human
agauaauauuaaggaaga

SEQ ID NO: 2948961 - RNA, 18 nt, Human
agaucaaaagguuaauaa

SEQ ID NO: 2948962 - RNA, 20 nt, Human
agauauuuugcuuugugauu

SEQ ID NO: 2948963 - RNA, 21 nt, Human
agauauuuugcuuugugauuu

SEQ ID NO: 2948964 - RNA, 15 nt, Human
agauacuguaucaug

SEQ ID NO: 2948965 - RNA, 16 nt, Human
agauacuguaucauga

SEQ ID NO: 2948966 - RNA, 18 nt, Human
agauaauacaccacuaca

SEQ ID NO: 2948967 - RNA, 19 nt, Human
agaguuguuacauuuuuaa

SEQ ID NO: 2948968 - RNA, 20 nt, Human
agaguuguuacauuuuuaag

SEQ ID NO: 2948969 - RNA, 15 nt, Human
agagucacuggaaca

SEQ ID NO: 2948970 - RNA, 16 nt, Human
agaguuguuacauuuu

SEQ ID NO: 2948971 - RNA, 17 nt, Human
agaguuguuacauuuuu

SEQ ID NO: 2948972 - RNA, 23 nt, Human
agcaagacgcugugcugcccugc

SEQ ID NO: 2948973 - RNA, 22 nt, Human
agcaagacgcugugcugcccug

SEQ ID NO: 2948974 - RNA, 21 nt, Human
agcaagacgcugugcugcccu

SEQ ID NO: 2948975 - RNA, 20 nt, Human
agcaagacgcugugcugccc

SEQ ID NO: 2948976 - RNA, 17 nt, Human
agcaagacgcugugcug

SEQ ID NO: 2948977 - RNA, 14 nt, Human
agcaagacauuaua

SEQ ID NO: 2948978 - RNA, 16 nt, Human
agcaagacgcugugcu

SEQ ID NO: 2948979 - RNA, 13 nt, Human
agcaagacgcugu

SEQ ID NO: 2948980 - RNA, 23 nt, Human
agcaacgcaggcccccaggugcc

SEQ ID NO: 2948981 - RNA, 17 nt, Human
agauuugaacucuucaa

SEQ ID NO: 2948982 - RNA, 21 nt, Human
agauuuugaaauuuuuauuaa

SEQ ID NO: 2948983 - RNA, 19 nt, Human
agauucauauuuacuucuu

SEQ ID NO: 2948984 - RNA, 22 nt, Human
agauucauauuuacuucuuaua

SEQ ID NO: 2948985 - RNA, 15 nt, Human
ugacuucuaaguaaa

SEQ ID NO: 2948986 - RNA, 19 nt, Human
ugacuuacuguacaugaaa

SEQ ID NO: 2948987 - RNA, 23 nt, Human
ugacuucuaaguaaaaccacagc

SEQ ID NO: 2948988 - RNA, 22 nt, Human
ugacuucuaaguaaaaccacag

SEQ ID NO: 2948989 - RNA, 13 nt, Human
agauuggaaggaa

SEQ ID NO: 2948990 - RNA, 15 nt, Human
agauucccugagcag

SEQ ID NO: 2948991 - RNA, 16 nt, Human
agaugccgcauuugga

SEQ ID NO: 2948992 - RNA, 16 nt, Human
agaugcaguucugaag

SEQ ID NO: 2948993 - RNA, 17 nt, Human
ugacacuuaaaaauggu

SEQ ID NO: 2948994 - RNA, 16 nt, Human
ugacacuuaaaaaugg

SEQ ID NO: 2948995 - RNA, 21 nt, Human
ugacccaugcugcccugugag

SEQ ID NO: 2948996 - RNA, 16 nt, Human
ugacccaugcugcccu

SEQ ID NO: 2948997 - RNA, 12 nt, Human
ugacccaugcug

SEQ ID NO: 2948998 - RNA, 15 nt, Human
ugacccaugcugccc

SEQ ID NO: 2948999 - RNA, 14 nt, Human
ugacccaugcugcc

SEQ ID NO: 2949000 - RNA, 12 nt, Human
agauguugcuaa

SEQ ID NO: 2949001 - RNA, 19 nt, Human
ugaccugaggcccuucucu

SEQ ID NO: 2949002 - RNA, 18 nt, Human
ugaccugaggcccuucuc

SEQ ID NO: 2949003 - RNA, 15 nt, Human
ugacuuacuguacau

SEQ ID NO: 2949004 - RNA, 16 nt, Human
ugacuuacuguacaug

SEQ ID NO: 2949005 - RNA, 13 nt, Human
ugacuuacuguac

SEQ ID NO: 2949006 - RNA, 19 nt, Human
ucuugguccugcugcaguu

SEQ ID NO: 2949007 - RNA, 17 nt, Human
ucuugguccugcugcag

SEQ ID NO: 2949008 - RNA, 15 nt, Human
ucuugguccugcugc

SEQ ID NO: 2949009 - RNA, 16 nt, Human
ucuuuccugaggcugg

SEQ ID NO: 2949010 - RNA, 17 nt, Human
ucuuuccugaggcuggg

SEQ ID NO: 2949011 - RNA, 19 nt, Human
ucuugcaauggcagccuug

SEQ ID NO: 2949012 - RNA, 18 nt, Human
ucuugcaauggcagccuu

SEQ ID NO: 2949013 - RNA, 22 nt, Human
ucuugcaauggcagccuuggca

SEQ ID NO: 2949014 - RNA, 14 nt, Human
ucuugguccugcug

SEQ ID NO: 2949015 - RNA, 17 nt, Human
ucuuggucagauuugaa

SEQ ID NO: 2949016 - RNA, 13 nt, Human
ucuugauucauaa

SEQ ID NO: 2949017 - RNA, 16 nt, Human
ucuugagccuugaacu

SEQ ID NO: 2949018 - RNA, 20 nt, Human
ucuugagccuugaacuuuga

SEQ ID NO: 2949019 - RNA, 16 nt, Human
ucuugagccugggagg

SEQ ID NO: 2949020 - RNA, 13 nt, Human
ucuugagccuggg

SEQ ID NO: 2949021 - RNA, 11 nt, Human
agaccuucucc

SEQ ID NO: 2949022 - RNA, 18 nt, Human
agaccuucuccuucaccu

SEQ ID NO: 2949023 - RNA, 15 nt, Human
agaccuucuccuuca

SEQ ID NO: 2949024 - RNA, 23 nt, Human
agaccuucuccuucaccuuuguc

SEQ ID NO: 2949025 - RNA, 21 nt, Human
agaccuucuccuucaccuuug

SEQ ID NO: 2949026 - RNA, 15 nt, Human
agacuauucaaacag

SEQ ID NO: 2949027 - RNA, 14 nt, Human
agacuauucaaaca

SEQ ID NO: 2949028 - RNA, 12 nt, Human
agacuauucaaa

SEQ ID NO: 2949029 - RNA, 15 nt, Human
ucuuccucccucccu

SEQ ID NO: 2949030 - RNA, 14 nt, Human
ucuuccucccuccc

SEQ ID NO: 2949031 - RNA, 22 nt, Human
ucuucccuacaguugaaaaaca

SEQ ID NO: 2949032 - RNA, 19 nt, Human
ucuucccuacaguugaaaa

SEQ ID NO: 2949033 - RNA, 21 nt, Human
ucuuccaggcugggagagccu

SEQ ID NO: 2949034 - RNA, 20 nt, Human
ucuuccaggcugggagagcc

SEQ ID NO: 2949035 - RNA, 17 nt, Human
ucuuccaggcugggaga

SEQ ID NO: 2949036 - RNA, 15 nt, Human
ucuuccaggcuggga

SEQ ID NO: 2949037 - RNA, 20 nt, Human
ucuucagagacuccugcagg

SEQ ID NO: 2949038 - RNA, 14 nt, Human
agaaucacuugaac

SEQ ID NO: 2949039 - RNA, 15 nt, Human
ucuucacaacagauu

SEQ ID NO: 2949040 - RNA, 12 nt, Human
ucuucagagacu

SEQ ID NO: 2949041 - RNA, 18 nt, Human
ucuucagagacuccugca

SEQ ID NO: 2949042 - RNA, 17 nt, Human
ucuucagagacuccugc

SEQ ID NO: 2949043 - RNA, 20 nt, Human
ucuucuguggguuucuaaag

SEQ ID NO: 2949044 - RNA, 15 nt, Human
ucuucuguacgucug

SEQ ID NO: 2949045 - RNA, 23 nt, Human
ucuucuguacgucugacaggcaa

SEQ ID NO: 2949046 - RNA, 12 nt, Human
ucuucugcuuca

SEQ ID NO: 2949047 - RNA, 21 nt, Human
ucuucugaacuuggcgcugcc

SEQ ID NO: 2949048 - RNA, 19 nt, Human
agacauacuaaccagcaga

SEQ ID NO: 2949049 - RNA, 14 nt, Human
agacauagaauuaa

SEQ ID NO: 2949050 - RNA, 21 nt, Human
agacauagaauuaacacauga

SEQ ID NO: 2949051 - RNA, 17 nt, Human
agacaucaacagauaaa

SEQ ID NO: 2949052 - RNA, 18 nt, Human
agacaucaacagauaaau

SEQ ID NO: 2949053 - RNA, 23 nt, Human
agagcaguuugguuucuagcaug

SEQ ID NO: 2949054 - RNA, 21 nt, Human
agagcaguuugguuucuagca

SEQ ID NO: 2949055 - RNA, 23 nt, Human
agagcaccuuagacagucccugc

SEQ ID NO: 2949056 - RNA, 21 nt, Human
agagcaccuuagacagucccu

SEQ ID NO: 2949057 - RNA, 22 nt, Human
agagcaccuuagacagucccug

SEQ ID NO: 2949058 - RNA, 20 nt, Human
agagcuagcagcagggaggg

SEQ ID NO: 2949059 - RNA, 22 nt, Human
agagccuuccaggggugggaca

SEQ ID NO: 2949060 - RNA, 17 nt, Human
agagccuuccaggggug

SEQ ID NO: 2949061 - RNA, 15 nt, Human
agagccuuccagggg

SEQ ID NO: 2949062 - RNA, 13 nt, Human
agagccuuccagg

SEQ ID NO: 2949063 - RNA, 14 nt, Human
agagcugccaccug

SEQ ID NO: 2949064 - RNA, 23 nt, Human
agagcaagacgcugugcugcccu

SEQ ID NO: 2949065 - RNA, 19 nt, Human
agagcaagacgcugugcug

SEQ ID NO: 2949066 - RNA, 22 nt, Human
agagaucaaccccuucgcuccu

SEQ ID NO: 2949067 - RNA, 23 nt, Human
agagacuccugcaggcagccagg

SEQ ID NO: 2949068 - RNA, 13 nt, Human
ugaaagacuguac

SEQ ID NO: 2949069 - RNA, 15 nt, Human
ugaaagacuguacaa

SEQ ID NO: 2949070 - RNA, 15 nt, Human
agagacuccugcagg

SEQ ID NO: 2949071 - RNA, 18 nt, Human
agagacuccugcaggcag

SEQ ID NO: 2949072 - RNA, 17 nt, Human
agagacuccugcaggca

SEQ ID NO: 2949073 - RNA, 22 nt, Human
agagacuccugcaggcagccag

SEQ ID NO: 2949074 - RNA, 21 nt, Human
agagacuccugcaggcagcca

SEQ ID NO: 2949075 - RNA, 20 nt, Human
agagacuccugcaggcagcc

SEQ ID NO: 2949076 - RNA, 19 nt, Human
agagacuccugcaggcagc

SEQ ID NO: 2949077 - RNA, 12 nt, Human
ucuuuuaagaau

SEQ ID NO: 2949078 - RNA, 14 nt, Human
ucuuuuaagaauca

SEQ ID NO: 2949079 - RNA, 11 nt, Human
ucuuuuaaacu

SEQ ID NO: 2949080 - RNA, 12 nt, Human
ucuuuuaaacuc

SEQ ID NO: 2949081 - RNA, 21 nt, Human
ugaaaaaauuuacuuuaaacu

SEQ ID NO: 2949082 - RNA, 16 nt, Human
ugaaaaaggaggaaga

SEQ ID NO: 2949083 - RNA, 22 nt, Human
ucuuuggucuacacugugcuga

SEQ ID NO: 2949084 - RNA, 20 nt, Human
ucuuucuggcuaugcauuug

SEQ ID NO: 2949085 - RNA, 19 nt, Human
ucuuucuggcuaugcauuu

SEQ ID NO: 2949086 - RNA, 21 nt, Human
ucuuucuggcuaugcauuuga

SEQ ID NO: 2949087 - RNA, 17 nt, Human
ugaaaauguauguguaa

SEQ ID NO: 2949088 - RNA, 19 nt, Human
ugaaaaucgugacaacacu

SEQ ID NO: 2949089 - RNA, 16 nt, Human
ugaaacgcaaccacca

SEQ ID NO: 2949090 - RNA, 19 nt, Human
ugaaacucguuaauuugua

SEQ ID NO: 2949091 - RNA, 16 nt, Human
ugaaaaucgugacaac

SEQ ID NO: 2949092 - RNA, 22 nt, Human
ugaaaaaguucugcagauaaac

SEQ ID NO: 2949093 - RNA, 22 nt, Human
ugaaaaaggaggaagagaaaaa

SEQ ID NO: 2949094 - RNA, 20 nt, Human
ugaaaaaggaggaagagaaa

SEQ ID NO: 2949095 - RNA, 20 nt, Human
ugaaaagcuccauuuuuagu

SEQ ID NO: 2949096 - RNA, 17 nt, Human
ugaugaagaaguugaua

SEQ ID NO: 2949097 - RNA, 15 nt, Human
agccacggccaggcc

SEQ ID NO: 2949098 - RNA, 14 nt, Human
agccacggccaggc

SEQ ID NO: 2949099 - RNA, 19 nt, Human
agccaccaacauacuccca

SEQ ID NO: 2949100 - RNA, 23 nt, Human
agccaccaacauacucccaucug

SEQ ID NO: 2949101 - RNA, 20 nt, Human
agccaccaacauacucccau

SEQ ID NO: 2949102 - RNA, 18 nt, Human
agccacauuccugaugcu

SEQ ID NO: 2949103 - RNA, 14 nt, Human
agccacauuccuga

SEQ ID NO: 2949104 - RNA, 22 nt, Human
ugauguuuagaaacacaacuau

SEQ ID NO: 2949105 - RNA, 23 nt, Human
ugauguuuuccaugaguccccug

SEQ ID NO: 2949106 - RNA, 17 nt, Human
ugauguuuuaaggaugc

SEQ ID NO: 2949107 - RNA, 18 nt, Human
ugauguuuuaaggaugcu

SEQ ID NO: 2949108 - RNA, 17 nt, Human
ugaugaucuuuaaaaua

SEQ ID NO: 2949109 - RNA, 16 nt, Human
ugauggugcaaugacc

SEQ ID NO: 2949110 - RNA, 23 nt, Human
ugauggugcaaugaccuuucaau

SEQ ID NO: 2949111 - RNA, 17 nt, Human
ugauggugcaaugaccu

SEQ ID NO: 2949112 - RNA, 14 nt, Human
ugaugaucuuuaaa

SEQ ID NO: 2949113 - RNA, 20 nt, Human
ugaugauccuaggcauuugc

SEQ ID NO: 2949114 - RNA, 14 nt, Human
ugaugauccuaggc

SEQ ID NO: 2949115 - RNA, 20 nt, Human
agccacugcaccgggccaca

SEQ ID NO: 2949116 - RNA, 13 nt, Human
agccacugcaccg

SEQ ID NO: 2949117 - RNA, 21 nt, Human
agccacugcaccgggccacag

SEQ ID NO: 2949118 - RNA, 22 nt, Human
agccacugcaccgggccacaga

SEQ ID NO: 2949119 - RNA, 12 nt, Human
ugauuaaaccaa

SEQ ID NO: 2949120 - RNA, 15 nt, Human
ugauuaauuaaaaca

SEQ ID NO: 2949121 - RNA, 14 nt, Human
ugauuaccagggac

SEQ ID NO: 2949122 - RNA, 14 nt, Human
ugauucagcucugc

SEQ ID NO: 2949123 - RNA, 13 nt, Human
ugauucagcucug

SEQ ID NO: 2949124 - RNA, 18 nt, Human
agcccaggaaaggcucca

SEQ ID NO: 2949125 - RNA, 24 nt, Human
agcccaggaaaggcuccaggagca

SEQ ID NO: 2949126 - RNA, 23 nt, Human
agcccaggaaaggcuccaggagc

SEQ ID NO: 2949127 - RNA, 22 nt, Human
agcccaggaaaggcuccaggag

SEQ ID NO: 2949128 - RNA, 15 nt, Human
ugauucccaagcucu

SEQ ID NO: 2949129 - RNA, 16 nt, Human
ugauucccaagcucug

SEQ ID NO: 2949130 - RNA, 18 nt, Human
ugauucccaagcucugcu

SEQ ID NO: 2949131 - RNA, 19 nt, Human
ugauucccaagcucugcuc

SEQ ID NO: 2949132 - RNA, 21 nt, Human
ugauucccaagcucugcuccu

SEQ ID NO: 2949133 - RNA, 21 nt, Human
agcccaggaaaggcuccagga

SEQ ID NO: 2949134 - RNA, 20 nt, Human
agcccaggaaaggcuccagg

SEQ ID NO: 2949135 - RNA, 19 nt, Human
agcccaggaaaggcuccag

SEQ ID NO: 2949136 - RNA, 22 nt, Human
agcccacuucugccauauucug

SEQ ID NO: 2949137 - RNA, 23 nt, Human
agccaguaaaugggggugcauuu

SEQ ID NO: 2949138 - RNA, 22 nt, Human
agccaguaaaugggggugcauu

SEQ ID NO: 2949139 - RNA, 12 nt, Human
agccagggucuc

SEQ ID NO: 2949140 - RNA, 22 nt, Human
agccaggcccuugucggcccca

SEQ ID NO: 2949141 - RNA, 22 nt, Human
agccaggccacaagacccuugu

SEQ ID NO: 2949142 - RNA, 21 nt, Human
agccaggccacaagacccuug

SEQ ID NO: 2949143 - RNA, 14 nt, Human
agccaggccacaag

SEQ ID NO: 2949144 - RNA, 12 nt, Human
agccaggccaca

SEQ ID NO: 2949145 - RNA, 19 nt, Human
agccagacuggcacaguuu

SEQ ID NO: 2949146 - RNA, 14 nt, Human
agccagacuggcac

SEQ ID NO: 2949147 - RNA, 14 nt, Human
ugaguggaguuacu

SEQ ID NO: 2949148 - RNA, 16 nt, Human
ugagugccuuacacaa

SEQ ID NO: 2949149 - RNA, 21 nt, Human
ugagugggugaauaauacagu

SEQ ID NO: 2949150 - RNA, 23 nt, Human
ugagugggggaucacagccucug

SEQ ID NO: 2949151 - RNA, 14 nt, Human
ugagucaccaagcc

SEQ ID NO: 2949152 - RNA, 16 nt, Human
ugagucaccaagccca

SEQ ID NO: 2949153 - RNA, 17 nt, Human
ugagucaccaagcccag

SEQ ID NO: 2949154 - RNA, 20 nt, Human
ugagugccuuacacaauggu

SEQ ID NO: 2949155 - RNA, 17 nt, Human
ugagugccuuacacaau

SEQ ID NO: 2949156 - RNA, 14 nt, Human
ugauacuacaguuu

SEQ ID NO: 2949157 - RNA, 17 nt, Human
ugauacuacaguuuguu

SEQ ID NO: 2949158 - RNA, 18 nt, Human
ugauacaaugcugugccc

SEQ ID NO: 2949159 - RNA, 20 nt, Human
ugauacaaugcugugcccua

SEQ ID NO: 2949160 - RNA, 12 nt, Human
ugauacagaaaa

SEQ ID NO: 2949161 - RNA, 21 nt, Human
ugauacaaugcugugcccuaa

SEQ ID NO: 2949162 - RNA, 17 nt, Human
ugaguucauacccuguu

SEQ ID NO: 2949163 - RNA, 20 nt, Human
ugauaagaaccuuuugagug

SEQ ID NO: 2949164 - RNA, 20 nt, Human
agcauacguacacauuuuau

SEQ ID NO: 2949165 - RNA, 21 nt, Human
agcauacguacacauuuuauu

SEQ ID NO: 2949166 - RNA, 16 nt, Human
agcauacguacacauu

SEQ ID NO: 2949167 - RNA, 17 nt, Human
agcauacguacacauuu

SEQ ID NO: 2949168 - RNA, 18 nt, Human
agcauacguacacauuuu

SEQ ID NO: 2949169 - RNA, 19 nt, Human
agcauacguacacauuuua

SEQ ID NO: 2949170 - RNA, 12 nt, Human
ugagaauuaccc

SEQ ID NO: 2949171 - RNA, 23 nt, Human
agcauaaauguugacaugggaca

SEQ ID NO: 2949172 - RNA, 15 nt, Human
agcauacguacacau

SEQ ID NO: 2949173 - RNA, 14 nt, Human
ugaguacuacaguc

SEQ ID NO: 2949174 - RNA, 23 nt, Human
ugaguacuacaguccucccaucu

SEQ ID NO: 2949175 - RNA, 22 nt, Human
ugaguacuacaguccucccauc

SEQ ID NO: 2949176 - RNA, 21 nt, Human
ugaguacuacaguccucccau

SEQ ID NO: 2949177 - RNA, 17 nt, Human
ugaguacuacaguccuc

SEQ ID NO: 2949178 - RNA, 14 nt, Human
agcauauucaggaa

SEQ ID NO: 2949179 - RNA, 15 nt, Human
ugaguacuacagucc

SEQ ID NO: 2949180 - RNA, 22 nt, Human
ugaguaacugauuuguaacaag

SEQ ID NO: 2949181 - RNA, 18 nt, Human
agcauuguaaaugugcuu

SEQ ID NO: 2949182 - RNA, 17 nt, Human
agcauuguaaaugugcu

SEQ ID NO: 2949183 - RNA, 20 nt, Human
agcauguauuuuugucaauu

SEQ ID NO: 2949184 - RNA, 23 nt, Human
agcauguccuaaugcuugcugcu

SEQ ID NO: 2949185 - RNA, 12 nt, Human
agcauggcugcc

SEQ ID NO: 2949186 - RNA, 20 nt, Human
agcaugucgucaaagcugaa

SEQ ID NO: 2949187 - RNA, 17 nt, Human
agcaugucgucaaagcu

SEQ ID NO: 2949188 - RNA, 20 nt, Human
agcaucaggccaggcccucu

SEQ ID NO: 2949189 - RNA, 19 nt, Human
agcaucaggccaggcccuc

SEQ ID NO: 2949190 - RNA, 18 nt, Human
agcaucaggccaggcccu

SEQ ID NO: 2949191 - RNA, 17 nt, Human
agcaucaggccaggccc

SEQ ID NO: 2949192 - RNA, 16 nt, Human
agcaucaggccaggcc

SEQ ID NO: 2949193 - RNA, 14 nt, Human
agcaucaggccagg

SEQ ID NO: 2949194 - RNA, 22 nt, Human
agcauauucaggaagcucaggg

SEQ ID NO: 2949195 - RNA, 20 nt, Human
ugaucacggcucacugcagc

SEQ ID NO: 2949196 - RNA, 21 nt, Human
ugaucacggcucacugcagcc

SEQ ID NO: 2949197 - RNA, 12 nt, Human
agcaucaggcca

SEQ ID NO: 2949198 - RNA, 13 nt, Human
agcaucaggccag

SEQ ID NO: 2949199 - RNA, 18 nt, Human
ugaucacggcucacugca

SEQ ID NO: 2949200 - RNA, 19 nt, Human
ugaucacggcucacugcag

SEQ ID NO: 2949201 - RNA, 18 nt, Human
ugauauggguaguauuuu

SEQ ID NO: 2949202 - RNA, 15 nt, Human
ugauaugugaacagu

SEQ ID NO: 2949203 - RNA, 16 nt, Human
ugauaugugaacaguu

SEQ ID NO: 2949204 - RNA, 12 nt, Human
ugauaugggucu

SEQ ID NO: 2949205 - RNA, 10 nt, Human
ugcacacauu

SEQ ID NO: 2949206 - RNA, 20 nt, Human
ugcacacauuuuuuaaaugc

SEQ ID NO: 2949207 - RNA, 21 nt, Human
ugcacacuguccuauuauauu

SEQ ID NO: 2949208 - RNA, 14 nt, Human
ugcacacuguccua

SEQ ID NO: 2949209 - RNA, 17 nt, Human
ugcacccucaggcaggu

SEQ ID NO: 2949210 - RNA, 16 nt, Human
ugcacccucaggcagg

SEQ ID NO: 2949211 - RNA, 14 nt, Human
ugcacgugugugca

SEQ ID NO: 2949212 - RNA, 15 nt, Human
ugcacgugugugcac

SEQ ID NO: 2949213 - RNA, 22 nt, Human
agcccugguggcagugggagcu

SEQ ID NO: 2949214 - RNA, 23 nt, Human
agcccugguggcagugggagcug

SEQ ID NO: 2949215 - RNA, 15 nt, Human
ugcacaagcugcacc

SEQ ID NO: 2949216 - RNA, 14 nt, Human
ugcacaagcugcac

SEQ ID NO: 2949217 - RNA, 22 nt, Human
ugcacacaccagagcccaccuu

SEQ ID NO: 2949218 - RNA, 21 nt, Human
ugcacaagcugcacccucagg

SEQ ID NO: 2949219 - RNA, 18 nt, Human
ugcacaagcugcacccuc

SEQ ID NO: 2949220 - RNA, 24 nt, Human
agccccuucugacccaugcugccc

SEQ ID NO: 2949221 - RNA, 20 nt, Human
agccccuucugacccaugcu

SEQ ID NO: 2949222 - RNA, 21 nt, Human
agcccugguggcagugggagc

SEQ ID NO: 2949223 - RNA, 17 nt, Human
agccccgaggccuucuc

SEQ ID NO: 2949224 - RNA, 22 nt, Human
agccccgaggccuucucugaag

SEQ ID NO: 2949225 - RNA, 16 nt, Human
agccccgaggccuucu

SEQ ID NO: 2949226 - RNA, 23 nt, Human
agccccauucugccugcccaggc

SEQ ID NO: 2949227 - RNA, 24 nt, Human
agccccaaaacucuccucugcugc

SEQ ID NO: 2949228 - RNA, 18 nt, Human
agccccgugggguuccuc

SEQ ID NO: 2949229 - RNA, 18 nt, Human
agccccuggaugcagccu

SEQ ID NO: 2949230 - RNA, 17 nt, Human
agccccuggaugcagcc

SEQ ID NO: 2949231 - RNA, 19 nt, Human
agccccuggaugcagccuc

SEQ ID NO: 2949232 - RNA, 13 nt, Human
ugauucuccugcc

SEQ ID NO: 2949233 - RNA, 20 nt, Human
ugauucuccugccucagccu

SEQ ID NO: 2949234 - RNA, 19 nt, Human
ugauucuccugccucagcc

SEQ ID NO: 2949235 - RNA, 15 nt, Human
ugauucuccugccuc

SEQ ID NO: 2949236 - RNA, 18 nt, Human
agcccauggcacucuaug

SEQ ID NO: 2949237 - RNA, 20 nt, Human
agccccaaaacucuccucug

SEQ ID NO: 2949238 - RNA, 22 nt, Human
agccccaaaacucuccucugcu

SEQ ID NO: 2949239 - RNA, 21 nt, Human
agccccaaaacucuccucugc

SEQ ID NO: 2949240 - RNA, 22 nt, Human
ugcacuauagccuaggugacag

SEQ ID NO: 2949241 - RNA, 23 nt, Human
ugcacuauagccuaggugacaga

SEQ ID NO: 2949242 - RNA, 23 nt, Human
agcccuucuaccuuccugcaaca

SEQ ID NO: 2949243 - RNA, 17 nt, Human
agccucagcauccuggc

SEQ ID NO: 2949244 - RNA, 19 nt, Human
agccucagcauccuggcac

SEQ ID NO: 2949245 - RNA, 20 nt, Human
agccucagcauccuggcacc

SEQ ID NO: 2949246 - RNA, 21 nt, Human
agccucagcauccuggcaccc

SEQ ID NO: 2949247 - RNA, 16 nt, Human
agccucagcauccugg

SEQ ID NO: 2949248 - RNA, 16 nt, Human
agccucccaaagugcu

SEQ ID NO: 2949249 - RNA, 20 nt, Human
agccucauguccacugguuc

SEQ ID NO: 2949250 - RNA, 22 nt, Human
agccucagcauccuggcacccg

SEQ ID NO: 2949251 - RNA, 23 nt, Human
agccucagcauccuggcacccgg

SEQ ID NO: 2949252 - RNA, 15 nt, Human
agccucauguccacu

SEQ ID NO: 2949253 - RNA, 16 nt, Human
ugcaguacaggacaua

SEQ ID NO: 2949254 - RNA, 18 nt, Human
ugcaguacaggacauaua

SEQ ID NO: 2949255 - RNA, 14 nt, Human
ugcaguacuaacau

SEQ ID NO: 2949256 - RNA, 14 nt, Human
ugcauaaguuaacu

SEQ ID NO: 2949257 - RNA, 17 nt, Human
ugcauaaguuaacuucc

SEQ ID NO: 2949258 - RNA, 15 nt, Human
ugcagccucacaguc

SEQ ID NO: 2949259 - RNA, 13 nt, Human
ugcagccucacag

SEQ ID NO: 2949260 - RNA, 16 nt, Human
ugcagccucacagucc

SEQ ID NO: 2949261 - RNA, 23 nt, Human
ugcagccucaaccuccugggcua

SEQ ID NO: 2949262 - RNA, 22 nt, Human
agccugaaagaggaaugaagua

SEQ ID NO: 2949263 - RNA, 20 nt, Human
agcucauucuccuuguguua

SEQ ID NO: 2949264 - RNA, 21 nt, Human
agcucauucuccuuguguuac

SEQ ID NO: 2949265 - RNA, 20 nt, Human
ugcccacaggaucagucuga

SEQ ID NO: 2949266 - RNA, 19 nt, Human
ugcccacaggaucagucug

SEQ ID NO: 2949267 - RNA, 16 nt, Human
ugcccacaggaucagu

SEQ ID NO: 2949268 - RNA, 21 nt, Human
ugcccagccuggaugccaucc

SEQ ID NO: 2949269 - RNA, 18 nt, Human
ugcccagccuggaugcca

SEQ ID NO: 2949270 - RNA, 20 nt, Human
ugcccagccuggaugccauc

SEQ ID NO: 2949271 - RNA, 14 nt, Human
ugcccagccuggau

SEQ ID NO: 2949272 - RNA, 16 nt, Human
ugcccagccuggaugc

SEQ ID NO: 2949273 - RNA, 17 nt, Human
ugcccagccuggaugcc

SEQ ID NO: 2949274 - RNA, 20 nt, Human
ugcccagccccuucugaccc

SEQ ID NO: 2949275 - RNA, 21 nt, Human
ugcccagccccuucugaccca

SEQ ID NO: 2949276 - RNA, 12 nt, Human
agcuaggccugg

SEQ ID NO: 2949277 - RNA, 16 nt, Human
agcuaggccuggccag

SEQ ID NO: 2949278 - RNA, 14 nt, Human
agcuaggccuggcc

SEQ ID NO: 2949279 - RNA, 15 nt, Human
agcuaggccuggcca

SEQ ID NO: 2949280 - RNA, 18 nt, Human
agcucaggugucccugca

SEQ ID NO: 2949281 - RNA, 17 nt, Human
agcucaggugucccugc

SEQ ID NO: 2949282 - RNA, 22 nt, Human
agcucaggugucccugcacuug

SEQ ID NO: 2949283 - RNA, 20 nt, Human
agcucaggugucccugcacu

SEQ ID NO: 2949284 - RNA, 21 nt, Human
agcucaggugucccugcacuu

SEQ ID NO: 2949285 - RNA, 19 nt, Human
agcgugagccacugcaccg

SEQ ID NO: 2949286 - RNA, 22 nt, Human
agcgugagccacugcaccgggc

SEQ ID NO: 2949287 - RNA, 15 nt, Human
agcgugcauaaguua

SEQ ID NO: 2949288 - RNA, 18 nt, Human
agcuagacgagcaggcuu

SEQ ID NO: 2949289 - RNA, 13 nt, Human
agcuagaauuuga

SEQ ID NO: 2949290 - RNA, 16 nt, Human
agcuagaauuugauau

SEQ ID NO: 2949291 - RNA, 17 nt, Human
agcuacuugggaggcug

SEQ ID NO: 2949292 - RNA, 18 nt, Human
agcuacuugggaggcuga

SEQ ID NO: 2949293 - RNA, 18 nt, Human
ugcauuaucuagauacug

SEQ ID NO: 2949294 - RNA, 21 nt, Human
ugcauuaucuagauacuguau

SEQ ID NO: 2949295 - RNA, 22 nt, Human
ugcauuaucuagauacuguauc

SEQ ID NO: 2949296 - RNA, 17 nt, Human
ugccaauuugcacauua

SEQ ID NO: 2949297 - RNA, 21 nt, Human
ugccaauuugcacauuaaaug

SEQ ID NO: 2949298 - RNA, 15 nt, Human
ugccaauuugcacau

SEQ ID NO: 2949299 - RNA, 13 nt, Human
ugccaauuugcac

SEQ ID NO: 2949300 - RNA, 14 nt, Human
ugccaauauccuaa

SEQ ID NO: 2949301 - RNA, 18 nt, Human
ugccaaugggagcucaug

SEQ ID NO: 2949302 - RNA, 20 nt, Human
ugcauuaucuagauacugua

SEQ ID NO: 2949303 - RNA, 18 nt, Human
agcggagacggaguccca

SEQ ID NO: 2949304 - RNA, 20 nt, Human
agcggagaaaggaagggcug

SEQ ID NO: 2949305 - RNA, 16 nt, Human
agcggagaaaggaagg

SEQ ID NO: 2949306 - RNA, 20 nt, Human
agccuuggggcugaugcagu

SEQ ID NO: 2949307 - RNA, 17 nt, Human
agccuuccagggguggg

SEQ ID NO: 2949308 - RNA, 16 nt, Human
agccuuccaggggugg

SEQ ID NO: 2949309 - RNA, 14 nt, Human
agccuuccaggggu

SEQ ID NO: 2949310 - RNA, 11 nt, Human
agccuuccagg

SEQ ID NO: 2949311 - RNA, 22 nt, Human
agccugggugacagagcaagug

SEQ ID NO: 2949312 - RNA, 22 nt, Human
agccugcuccagcuguucagcu

SEQ ID NO: 2949313 - RNA, 19 nt, Human
agccugcuccagcuguuca

SEQ ID NO: 2949314 - RNA, 12 nt, Human
ugcauaccacuu

SEQ ID NO: 2949315 - RNA, 17 nt, Human
agccugcuccagcuguu

SEQ ID NO: 2949316 - RNA, 16 nt, Human
agccugcuccagcugu

SEQ ID NO: 2949317 - RNA, 15 nt, Human
agccugcuccagcug

SEQ ID NO: 2949318 - RNA, 14 nt, Human
agccugcuccagcu

SEQ ID NO: 2949319 - RNA, 22 nt, Human
agccuuagaagucacacaguau

SEQ ID NO: 2949320 - RNA, 21 nt, Human
agccugugccucugggacugg

SEQ ID NO: 2949321 - RNA, 22 nt, Human
uggagaagcggcuggcagccca

SEQ ID NO: 2949322 - RNA, 13 nt, Human
uggagaagcggcu

SEQ ID NO: 2949323 - RNA, 17 nt, Human
uggacuuugcacacuuu

SEQ ID NO: 2949324 - RNA, 13 nt, Human
uggagaagaacug

SEQ ID NO: 2949325 - RNA, 15 nt, Human
aggcacccaccauca

SEQ ID NO: 2949326 - RNA, 14 nt, Human
aggcaaugcuggcu

SEQ ID NO: 2949327 - RNA, 20 nt, Human
aggcacccaccaucaugucu

SEQ ID NO: 2949328 - RNA, 21 nt, Human
aggcacccaccaucaugucug

SEQ ID NO: 2949329 - RNA, 22 nt, Human
aggcacccaccaucaugucugg

SEQ ID NO: 2949330 - RNA, 14 nt, Human
uggaauucacaaag

SEQ ID NO: 2949331 - RNA, 12 nt, Human
aggaucucuuga

SEQ ID NO: 2949332 - RNA, 19 nt, Human
aggaucucuugagccuggg

SEQ ID NO: 2949333 - RNA, 18 nt, Human
aggaucucuugagccugg

SEQ ID NO: 2949334 - RNA, 17 nt, Human
aggaucucuugagccug

SEQ ID NO: 2949335 - RNA, 16 nt, Human
uggaauucacaaagua

SEQ ID NO: 2949336 - RNA, 21 nt, Human
uggacacagcucuucuccagg

SEQ ID NO: 2949337 - RNA, 22 nt, Human
uggacacagcucuucuccaggc

SEQ ID NO: 2949338 - RNA, 13 nt, Human
uggacacagcucu

SEQ ID NO: 2949339 - RNA, 14 nt, Human
uggacacagcucuu

SEQ ID NO: 2949340 - RNA, 23 nt, Human
uggacacagcucuucuccaggcu

SEQ ID NO: 2949341 - RNA, 18 nt, Human
uggacccugaggcccaga

SEQ ID NO: 2949342 - RNA, 16 nt, Human
uggacccugaggccca

SEQ ID NO: 2949343 - RNA, 20 nt, Human
uggacccugaggcccagagg

SEQ ID NO: 2949344 - RNA, 19 nt, Human
uggacccugaggcccagag

SEQ ID NO: 2949345 - RNA, 21 nt, Human
uggacccugaggcccagaggg

SEQ ID NO: 2949346 - RNA, 23 nt, Human
uggacccuguggaugauaaaaca

SEQ ID NO: 2949347 - RNA, 15 nt, Human
uggacccugaggccc

SEQ ID NO: 2949348 - RNA, 20 nt, Human
uggaccuugaacuggguacu

SEQ ID NO: 2949349 - RNA, 12 nt, Human
ugcuuugugauu

SEQ ID NO: 2949350 - RNA, 14 nt, Human
ugcuuugugauuuu

SEQ ID NO: 2949351 - RNA, 16 nt, Human
ugcuuugugauuuuug

SEQ ID NO: 2949352 - RNA, 19 nt, Human
ugcuuguacacucauucau

SEQ ID NO: 2949353 - RNA, 22 nt, Human
ugcuuguacacucauucauuac

SEQ ID NO: 2949354 - RNA, 22 nt, Human
ugcuuguacauaaugcgugcau

SEQ ID NO: 2949355 - RNA, 14 nt, Human
ugcuuguacauaau

SEQ ID NO: 2949356 - RNA, 16 nt, Human
ugcuuguacauaaugc

SEQ ID NO: 2949357 - RNA, 14 nt, Human
ugcuuuuggucugu

SEQ ID NO: 2949358 - RNA, 17 nt, Human
ugcuuuuggucugugug

SEQ ID NO: 2949359 - RNA, 13 nt, Human
uggaaaggcagcu

SEQ ID NO: 2949360 - RNA, 16 nt, Human
ugcuuguacacucauu

SEQ ID NO: 2949361 - RNA, 12 nt, Human
ugcuuguacaua

SEQ ID NO: 2949362 - RNA, 13 nt, Human
ugcuuguacauaa

SEQ ID NO: 2949363 - RNA, 14 nt, Human
ugcuuggaggaagg

SEQ ID NO: 2949364 - RNA, 16 nt, Human
ugcuuggaggaaggaa

SEQ ID NO: 2949365 - RNA, 15 nt, Human
ugcuuggaggaagga

SEQ ID NO: 2949366 - RNA, 21 nt, Human
ugcuugaggcaacucaucuua

SEQ ID NO: 2949367 - RNA, 14 nt, Human
aggauccugagcca

SEQ ID NO: 2949368 - RNA, 13 nt, Human
aggauccugagcc

SEQ ID NO: 2949369 - RNA, 15 nt, Human
aggauacuuauuuaa

SEQ ID NO: 2949370 - RNA, 16 nt, Human
aggauacuuauuuaaa

SEQ ID NO: 2949371 - RNA, 13 nt, Human
aggauacuuauuu

SEQ ID NO: 2949372 - RNA, 13 nt, Human
uggaagguauuua

SEQ ID NO: 2949373 - RNA, 17 nt, Human
uggaagguauuuaauag

SEQ ID NO: 2949374 - RNA, 16 nt, Human
uggaagcacagcuuca

SEQ ID NO: 2949375 - RNA, 18 nt, Human
uggaaaugggcagagcag

SEQ ID NO: 2949376 - RNA, 17 nt, Human
uggaaaugggcagagca

SEQ ID NO: 2949377 - RNA, 20 nt, Human
aggccugggggcugggcaga

SEQ ID NO: 2949378 - RNA, 18 nt, Human
aggccugggggcugggca

SEQ ID NO: 2949379 - RNA, 12 nt, Human
aggccuggggac

SEQ ID NO: 2949380 - RNA, 12 nt, Human
uggccuggcccc

SEQ ID NO: 2949381 - RNA, 21 nt, Human
uggccuggccccucagggucc

SEQ ID NO: 2949382 - RNA, 18 nt, Human
uggccuggccccucaggg

SEQ ID NO: 2949383 - RNA, 13 nt, Human
uggcccacgcacu

SEQ ID NO: 2949384 - RNA, 23 nt, Human
uggccgggcgcgguggcucacgc

SEQ ID NO: 2949385 - RNA, 13 nt, Human
uggccucuucaga

SEQ ID NO: 2949386 - RNA, 21 nt, Human
uggccaaagccaaagcuaggc

SEQ ID NO: 2949387 - RNA, 23 nt, Human
uggccaaagccaaagcuaggccu

SEQ ID NO: 2949388 - RNA, 23 nt, Human
uggccagugugacaaggauugcu

SEQ ID NO: 2949389 - RNA, 17 nt, Human
aggccccgcccaggcuu

SEQ ID NO: 2949390 - RNA, 16 nt, Human
uggcaucuuacaucug

SEQ ID NO: 2949391 - RNA, 14 nt, Human
uggaguauauguca

SEQ ID NO: 2949392 - RNA, 13 nt, Human
uggauuguccccg

SEQ ID NO: 2949393 - RNA, 16 nt, Human
aggccaaggugggagg

SEQ ID NO: 2949394 - RNA, 18 nt, Human
aggcagccaggccacaag

SEQ ID NO: 2949395 - RNA, 16 nt, Human
aggcagccccauucug

SEQ ID NO: 2949396 - RNA, 17 nt, Human
aggcagccccauucugc

SEQ ID NO: 2949397 - RNA, 15 nt, Human
aggccaaaggaagca

SEQ ID NO: 2949398 - RNA, 19 nt, Human
aggccaaaggaagcacaug

SEQ ID NO: 2949399 - RNA, 18 nt, Human
aggccaaaggaagcacau

SEQ ID NO: 2949400 - RNA, 16 nt, Human
aggccaaaggaagcac

SEQ ID NO: 2949401 - RNA, 16 nt, Human
aggccccgcccaggcu

SEQ ID NO: 2949402 - RNA, 21 nt, Human
aggcccagagggccugcaagg

SEQ ID NO: 2949403 - RNA, 20 nt, Human
aggccagagggagugacaga

SEQ ID NO: 2949404 - RNA, 17 nt, Human
uggcagccuuggcaaac

SEQ ID NO: 2949405 - RNA, 15 nt, Human
uggcagcucaccucu

SEQ ID NO: 2949406 - RNA, 19 nt, Human
uggcagcucaccucucccu

SEQ ID NO: 2949407 - RNA, 16 nt, Human
aggccacaagacccuu

SEQ ID NO: 2949408 - RNA, 14 nt, Human
aggccagagggagu

SEQ ID NO: 2949409 - RNA, 19 nt, Human
aggccacaagacccuugug

SEQ ID NO: 2949410 - RNA, 18 nt, Human
aggccacaagacccuugu

SEQ ID NO: 2949411 - RNA, 17 nt, Human
aggccacaagacccuug

SEQ ID NO: 2949412 - RNA, 13 nt, Human
uggcagccuuggc

SEQ ID NO: 2949413 - RNA, 19 nt, Human
uggcacaguuuucugagaa

SEQ ID NO: 2949414 - RNA, 18 nt, Human
uggcacaguuuucugaga

SEQ ID NO: 2949415 - RNA, 20 nt, Human
ugcuacaaaaacacagcaag

SEQ ID NO: 2949416 - RNA, 14 nt, Human
agcuguucagcugg

SEQ ID NO: 2949417 - RNA, 15 nt, Human
ugcuacaaaaacaca

SEQ ID NO: 2949418 - RNA, 19 nt, Human
ugcuacaaaaacacagcaa

SEQ ID NO: 2949419 - RNA, 18 nt, Human
ugcuacaaaaacacagca

SEQ ID NO: 2949420 - RNA, 17 nt, Human
ugcuacaaaaacacagc

SEQ ID NO: 2949421 - RNA, 16 nt, Human
ugcuacaaaaacacag

SEQ ID NO: 2949422 - RNA, 18 nt, Human
agcuugaggguugggcug

SEQ ID NO: 2949423 - RNA, 14 nt, Human
agcuugaggguugg

SEQ ID NO: 2949424 - RNA, 19 nt, Human
agcuugaccgugaggccag

SEQ ID NO: 2949425 - RNA, 17 nt, Human
agcuugaaacugagaug

SEQ ID NO: 2949426 - RNA, 13 nt, Human
ugcggagcacacu

SEQ ID NO: 2949427 - RNA, 15 nt, Human
ugcggagcacacugg

SEQ ID NO: 2949428 - RNA, 23 nt, Human
ugcggacagccacggccaggcca

SEQ ID NO: 2949429 - RNA, 22 nt, Human
ugcggacagccacggccaggcc

SEQ ID NO: 2949430 - RNA, 20 nt, Human
ugcgggcuuccuccuggugu

SEQ ID NO: 2949431 - RNA, 19 nt, Human
ugcggccuuuggcuucacg

SEQ ID NO: 2949432 - RNA, 17 nt, Human
ugcggccuuuggcuuca

SEQ ID NO: 2949433 - RNA, 17 nt, Human
ugcgguccacccaggag

SEQ ID NO: 2949434 - RNA, 18 nt, Human
ugcgguccacccaggagc

SEQ ID NO: 2949435 - RNA, 21 nt, Human
ugcggugcuaucucccccagc

SEQ ID NO: 2949436 - RNA, 17 nt, Human
ugcggugcuaucucccc

SEQ ID NO: 2949437 - RNA, 14 nt, Human
ugccugcccaggcc

SEQ ID NO: 2949438 - RNA, 15 nt, Human
ugccugcccaggccc

SEQ ID NO: 2949439 - RNA, 12 nt, Human
ugccucugccuc

SEQ ID NO: 2949440 - RNA, 24 nt, Human
ugccugcccaggccccugccaccc

SEQ ID NO: 2949441 - RNA, 16 nt, Human
ugccugcccaggcccc

SEQ ID NO: 2949442 - RNA, 12 nt, Human
ugcccaggcagg

SEQ ID NO: 2949443 - RNA, 13 nt, Human
ugcccaggcaggu

SEQ ID NO: 2949444 - RNA, 14 nt, Human
ugcccaggcagguc

SEQ ID NO: 2949445 - RNA, 13 nt, Human
ugccucugccucu

SEQ ID NO: 2949446 - RNA, 14 nt, Human
ugccucugccucug

SEQ ID NO: 2949447 - RNA, 13 nt, Human
ugccugcccaggc

SEQ ID NO: 2949448 - RNA, 15 nt, Human
ugccucugccucuga

SEQ ID NO: 2949449 - RNA, 21 nt, Human
agcugcuuuugucuaugggac

SEQ ID NO: 2949450 - RNA, 19 nt, Human
agcugccuguucagcucca

SEQ ID NO: 2949451 - RNA, 21 nt, Human
agcugcuugggcuucauccuc

SEQ ID NO: 2949452 - RNA, 21 nt, Human
agcugccuguucagcuccagc

SEQ ID NO: 2949453 - RNA, 15 nt, Human
ugccuggauggggcu

SEQ ID NO: 2949454 - RNA, 14 nt, Human
ugccuggauggggc

SEQ ID NO: 2949455 - RNA, 20 nt, Human
agcugccuguucagcuccag

SEQ ID NO: 2949456 - RNA, 16 nt, Human
agcugccuccccuccu

SEQ ID NO: 2949457 - RNA, 15 nt, Human
agcugccuccccucc

SEQ ID NO: 2949458 - RNA, 22 nt, Human
agcugcccucuccugggcagcu

SEQ ID NO: 2949459 - RNA, 19 nt, Human
agcugugcucuggacaggc

SEQ ID NO: 2949460 - RNA, 20 nt, Human
agcugugcucuggacaggca

SEQ ID NO: 2949461 - RNA, 21 nt, Human
agcugugcucuggacaggcau

SEQ ID NO: 2949462 - RNA, 21 nt, Human
ugccuguucagcuccagcuca

SEQ ID NO: 2949463 - RNA, 19 nt, Human
ugccuguugggccaggagc

SEQ ID NO: 2949464 - RNA, 20 nt, Human
ugccuguugggccaggagcc

SEQ ID NO: 2949465 - RNA, 16 nt, Human
ugccuuauggaacacu

SEQ ID NO: 2949466 - RNA, 15 nt, Human
ugccuuauggaacac

SEQ ID NO: 2949467 - RNA, 17 nt, Human
ugccuguucagcuccag

SEQ ID NO: 2949468 - RNA, 13 nt, Human
agcuguucagcug

SEQ ID NO: 2949469 - RNA, 18 nt, Human
ugccuguucagcuccagc

SEQ ID NO: 2949470 - RNA, 20 nt, Human
ugccuguucagcuccagcuc

SEQ ID NO: 2949471 - RNA, 19 nt, Human
agcuguucacagccagacu

SEQ ID NO: 2949472 - RNA, 16 nt, Human
agcuguucacagccag

SEQ ID NO: 2949473 - RNA, 19 nt, Human
ugcuaucucccccagcccc

SEQ ID NO: 2949474 - RNA, 18 nt, Human
ugcuaucucccccagccc

SEQ ID NO: 2949475 - RNA, 20 nt, Human
ugcuaucucccccagcccca

SEQ ID NO: 2949476 - RNA, 11 nt, Human
ugcucauggaa

SEQ ID NO: 2949477 - RNA, 22 nt, Human
ugcuccuaggacccgucuccag

SEQ ID NO: 2949478 - RNA, 14 nt, Human
ugcucuggacaggc

SEQ ID NO: 2949479 - RNA, 15 nt, Human
ugcucuggacaggca

SEQ ID NO: 2949480 - RNA, 16 nt, Human
ugcucuggacaggcau

SEQ ID NO: 2949481 - RNA, 14 nt, Human
ugcucauggaauug

SEQ ID NO: 2949482 - RNA, 21 nt, Human
aggaagccagcaggcucucag

SEQ ID NO: 2949483 - RNA, 23 nt, Human
aggaagccagcaggcucucaggc

SEQ ID NO: 2949484 - RNA, 22 nt, Human
aggaagccagcaggcucucagg

SEQ ID NO: 2949485 - RNA, 20 nt, Human
aggaagccgcuggggccagu

SEQ ID NO: 2949486 - RNA, 19 nt, Human
aggaagccgcuggggccag

SEQ ID NO: 2949487 - RNA, 18 nt, Human
aggaagccgcuggggcca

SEQ ID NO: 2949488 - RNA, 18 nt, Human
aggaagccagcaggcucu

SEQ ID NO: 2949489 - RNA, 23 nt, Human
aggaaggaaacccagcucugguc

SEQ ID NO: 2949490 - RNA, 22 nt, Human
aggaaggaaacccagcucuggu

SEQ ID NO: 2949491 - RNA, 20 nt, Human
aggaaggaaacccagcucug

SEQ ID NO: 2949492 - RNA, 12 nt, Human
aggaagcucagg

SEQ ID NO: 2949493 - RNA, 14 nt, Human
aggaaaggcuccag

SEQ ID NO: 2949494 - RNA, 13 nt, Human
aggaaaggcucca

SEQ ID NO: 2949495 - RNA, 16 nt, Human
aggaaaggcuccagga

SEQ ID NO: 2949496 - RNA, 15 nt, Human
aggaaaggcuccagg

SEQ ID NO: 2949497 - RNA, 12 nt, Human
aggaaauauuua

SEQ ID NO: 2949498 - RNA, 11 nt, Human
aggaagcacau

SEQ ID NO: 2949499 - RNA, 17 nt, Human
aggaagcacaugccucu

SEQ ID NO: 2949500 - RNA, 16 nt, Human
aggaagcacaugccuc

SEQ ID NO: 2949501 - RNA, 23 nt, Human
aggaaaucaaauaugcaaagcac

SEQ ID NO: 2949502 - RNA, 19 nt, Human
aggaaaucaccgaaaacgu

SEQ ID NO: 2949503 - RNA, 15 nt, Human
aggaaaucaccgaaa

SEQ ID NO: 2949504 - RNA, 17 nt, Human
ugcugucccuuacguga

SEQ ID NO: 2949505 - RNA, 15 nt, Human
ugcugucccuuuucc

SEQ ID NO: 2949506 - RNA, 19 nt, Human
ugcugucccuuacgugagu

SEQ ID NO: 2949507 - RNA, 17 nt, Human
ugcugucccuuuuccuu

SEQ ID NO: 2949508 - RNA, 23 nt, Human
ugcuucaaggauccugagccaga

SEQ ID NO: 2949509 - RNA, 21 nt, Human
ugcuucaaggauccugagcca

SEQ ID NO: 2949510 - RNA, 20 nt, Human
ugcuucaaggauccugagcc

SEQ ID NO: 2949511 - RNA, 18 nt, Human
aggacacuaaccacgcug

SEQ ID NO: 2949512 - RNA, 16 nt, Human
ugcuuccagugaggcu

SEQ ID NO: 2949513 - RNA, 17 nt, Human
aggacacugauaugggu

SEQ ID NO: 2949514 - RNA, 21 nt, Human
ugcugcccugcccaccuggcc

SEQ ID NO: 2949515 - RNA, 19 nt, Human
ugcugcccugcccaccugg

SEQ ID NO: 2949516 - RNA, 11 nt, Human
ugcugcccugu

SEQ ID NO: 2949517 - RNA, 17 nt, Human
aggaaugcaaagaugaa

SEQ ID NO: 2949518 - RNA, 18 nt, Human
ugcugcccugcccaccug

SEQ ID NO: 2949519 - RNA, 17 nt, Human
ugcugcccugcccaccu

SEQ ID NO: 2949520 - RNA, 16 nt, Human
ugcugcccugcccacc

SEQ ID NO: 2949521 - RNA, 13 nt, Human
ugcugcccugccc

SEQ ID NO: 2949522 - RNA, 18 nt, Human
ugcuggcuguuggcuggg

SEQ ID NO: 2949523 - RNA, 19 nt, Human
ugcugggauuacaagcgug

SEQ ID NO: 2949524 - RNA, 19 nt, Human
ugcuggcuguuggcugggg

SEQ ID NO: 2949525 - RNA, 21 nt, Human
ugcuggcuguuggcugggggc

SEQ ID NO: 2949526 - RNA, 21 nt, Human
ugcugggauuacaagcgugag

SEQ ID NO: 2949527 - RNA, 17 nt, Human
ugcugggauuacaggug

SEQ ID NO: 2949528 - RNA, 13 nt, Human
ugcuguauuuuaa

SEQ ID NO: 2949529 - RNA, 21 nt, Human
ugcuguauuuuaaaagaauga

SEQ ID NO: 2949530 - RNA, 22 nt, Human
ugcuguauuuuaaaagaaugau

SEQ ID NO: 2949531 - RNA, 18 nt, Human
uguacuuuuaagacuuug

SEQ ID NO: 2949532 - RNA, 15 nt, Human
uguacuuuuaagacu

SEQ ID NO: 2949533 - RNA, 18 nt, Human
uguagaggagaaacugga

SEQ ID NO: 2949534 - RNA, 16 nt, Human
uguagaggagaaacug

SEQ ID NO: 2949535 - RNA, 14 nt, Human
uguagagugggagc

SEQ ID NO: 2949536 - RNA, 13 nt, Human
uguagagugggag

SEQ ID NO: 2949537 - RNA, 14 nt, Human
uguaauuugugaua

SEQ ID NO: 2949538 - RNA, 16 nt, Human
uguaccacuuuugcaa

SEQ ID NO: 2949539 - RNA, 17 nt, Human
uguaccacuuuugcaaa

SEQ ID NO: 2949540 - RNA, 17 nt, Human
aguaauaugcacacauu

SEQ ID NO: 2949541 - RNA, 20 nt, Human
aguaauaugcacacauuuuu

SEQ ID NO: 2949542 - RNA, 18 nt, Human
aguaauaugcacacauuu

SEQ ID NO: 2949543 - RNA, 19 nt, Human
aguaauaugcacacauuuu

SEQ ID NO: 2949544 - RNA, 17 nt, Human
agguuuucuuuuaagaa

SEQ ID NO: 2949545 - RNA, 11 nt, Human
agguuuuccug

SEQ ID NO: 2949546 - RNA, 15 nt, Human
aguaaaaccacagca

SEQ ID NO: 2949547 - RNA, 20 nt, Human
aguaagccgugauuuucauu

SEQ ID NO: 2949548 - RNA, 14 nt, Human
aguaauuuggaaau

SEQ ID NO: 2949549 - RNA, 22 nt, Human
aguaauuuggaaauuagguuga

SEQ ID NO: 2949550 - RNA, 16 nt, Human
aguacacuguuucaaa

SEQ ID NO: 2949551 - RNA, 20 nt, Human
aguacacuguuucaaacuuu

SEQ ID NO: 2949552 - RNA, 14 nt, Human
aguacacuguuuca

SEQ ID NO: 2949553 - RNA, 14 nt, Human
aguagagguacacu

SEQ ID NO: 2949554 - RNA, 22 nt, Human
aguagagguacacuugugaaua

SEQ ID NO: 2949555 - RNA, 20 nt, Human
aguagagguacacuugugaa

SEQ ID NO: 2949556 - RNA, 21 nt, Human
aguagagguacacuugugaau

SEQ ID NO: 2949557 - RNA, 12 nt, Human
aguagagacagg

SEQ ID NO: 2949558 - RNA, 20 nt, Human
uguaggaagguuaauguuca

SEQ ID NO: 2949559 - RNA, 18 nt, Human
aguagaucaugcauagag

SEQ ID NO: 2949560 - RNA, 18 nt, Human
uguaggaagguuaauguu

SEQ ID NO: 2949561 - RNA, 15 nt, Human
aguagaucaugcaua

SEQ ID NO: 2949562 - RNA, 19 nt, Human
aguagauaggccaugggca

SEQ ID NO: 2949563 - RNA, 21 nt, Human
aggugcacaagcuccaagcuc

SEQ ID NO: 2949564 - RNA, 20 nt, Human
aggugggauccuccaggugc

SEQ ID NO: 2949565 - RNA, 15 nt, Human
aggugcacaagcucc

SEQ ID NO: 2949566 - RNA, 20 nt, Human
aggugcacaagcuccaagcu

SEQ ID NO: 2949567 - RNA, 18 nt, Human
aggugcacaagcuccaag

SEQ ID NO: 2949568 - RNA, 17 nt, Human
aggugcacaagcuccaa

SEQ ID NO: 2949569 - RNA, 16 nt, Human
aggugcacaagcucca

SEQ ID NO: 2949570 - RNA, 23 nt, Human
aggucuugaacuccuggccucaa

SEQ ID NO: 2949571 - RNA, 17 nt, Human
aggugguuauggagagg

SEQ ID NO: 2949572 - RNA, 17 nt, Human
uguaacuuucugaaaua

SEQ ID NO: 2949573 - RNA, 14 nt, Human
agguuggugggggc

SEQ ID NO: 2949574 - RNA, 15 nt, Human
uguaaguaaacgguc

SEQ ID NO: 2949575 - RNA, 23 nt, Human
uguaauuaugguuaguagaggua

SEQ ID NO: 2949576 - RNA, 23 nt, Human
uguaauuaaguacuauguaucaa

SEQ ID NO: 2949577 - RNA, 22 nt, Human
uguccuaaugcuugcugcugau

SEQ ID NO: 2949578 - RNA, 16 nt, Human
uguccuacccacccuc

SEQ ID NO: 2949579 - RNA, 14 nt, Human
uguccgagcuuuga

SEQ ID NO: 2949580 - RNA, 13 nt, Human
uguccgagcuuug

SEQ ID NO: 2949581 - RNA, 17 nt, Human
ugucccuuuuccuuuuu

SEQ ID NO: 2949582 - RNA, 15 nt, Human
ugucgggcaugacac

SEQ ID NO: 2949583 - RNA, 14 nt, Human
ugucgggcaugaca

SEQ ID NO: 2949584 - RNA, 14 nt, Human
ugucgcccagucug

SEQ ID NO: 2949585 - RNA, 15 nt, Human
ugucgcccagucugg

SEQ ID NO: 2949586 - RNA, 12 nt, Human
ugucgggcauga

SEQ ID NO: 2949587 - RNA, 22 nt, Human
agucagaaguuucugccgcagc

SEQ ID NO: 2949588 - RNA, 23 nt, Human
agucagacuggauaguccgucuc

SEQ ID NO: 2949589 - RNA, 16 nt, Human
agucaggaaagagaac

SEQ ID NO: 2949590 - RNA, 15 nt, Human
agucaggaaagagaa

SEQ ID NO: 2949591 - RNA, 16 nt, Human
agucucacuguugccc

SEQ ID NO: 2949592 - RNA, 17 nt, Human
agucucacuguugccca

SEQ ID NO: 2949593 - RNA, 23 nt, Human
aguccgaaagggacuuggaagcu

SEQ ID NO: 2949594 - RNA, 12 nt, Human
agucccugccaa

SEQ ID NO: 2949595 - RNA, 16 nt, Human
ugucagcugaaccugg

SEQ ID NO: 2949596 - RNA, 18 nt, Human
agucacugagacagcccg

SEQ ID NO: 2949597 - RNA, 19 nt, Human
agucacugagacagcccgg

SEQ ID NO: 2949598 - RNA, 19 nt, Human
ugucagcugaaccugggua

SEQ ID NO: 2949599 - RNA, 16 nt, Human
ugucagguggggcagc

SEQ ID NO: 2949600 - RNA, 15 nt, Human
ugucaguauuucaac

SEQ ID NO: 2949601 - RNA, 23 nt, Human
ugucauuugcuggagcucugccc

SEQ ID NO: 2949602 - RNA, 13 nt, Human
aguauuucuauga

SEQ ID NO: 2949603 - RNA, 15 nt, Human
aguauuucuaugaaa

SEQ ID NO: 2949604 - RNA, 13 nt, Human
agucaccaagccc

SEQ ID NO: 2949605 - RNA, 14 nt, Human
agucaccaagccca

SEQ ID NO: 2949606 - RNA, 19 nt, Human
agucacauuccugaacagg

SEQ ID NO: 2949607 - RNA, 18 nt, Human
agucacauuccugaacag

SEQ ID NO: 2949608 - RNA, 20 nt, Human
agucacauuccugaacagga

SEQ ID NO: 2949609 - RNA, 22 nt, Human
aguauuucuaugaaauauuaug

SEQ ID NO: 2949610 - RNA, 16 nt, Human
aguaggaagacuuugg

SEQ ID NO: 2949611 - RNA, 20 nt, Human
ugucaaucagccuaguugau

SEQ ID NO: 2949612 - RNA, 22 nt, Human
aguaggaagacuuuggaaagac

SEQ ID NO: 2949613 - RNA, 19 nt, Human
aguaggaagacuuuggaaa

SEQ ID NO: 2949614 - RNA, 18 nt, Human
aguaggaagacuuuggaa

SEQ ID NO: 2949615 - RNA, 17 nt, Human
aguaggaagacuuugga

SEQ ID NO: 2949616 - RNA, 14 nt, Human
uguauuuuugucaa

SEQ ID NO: 2949617 - RNA, 16 nt, Human
uguauuuuugucaauu

SEQ ID NO: 2949618 - RNA, 20 nt, Human
uguauuuuugucaauuacca

SEQ ID NO: 2949619 - RNA, 14 nt, Human
uguauuuuuuuacu

SEQ ID NO: 2949620 - RNA, 19 nt, Human
ugucaagagggucugagga

SEQ ID NO: 2949621 - RNA, 15 nt, Human
ugucaagccauaauu

SEQ ID NO: 2949622 - RNA, 21 nt, Human
ugucaauaaaauccauacauu

SEQ ID NO: 2949623 - RNA, 23 nt, Human
agggcuucugccauuucugagau

SEQ ID NO: 2949624 - RNA, 19 nt, Human
ugggcucccuucccaccuc

SEQ ID NO: 2949625 - RNA, 18 nt, Human
ugggcucccuucccaccu

SEQ ID NO: 2949626 - RNA, 20 nt, Human
ugggcucccuucccaccucu

SEQ ID NO: 2949627 - RNA, 15 nt, Human
uggggaccagagcug

SEQ ID NO: 2949628 - RNA, 14 nt, Human
uggggaccagagcu

SEQ ID NO: 2949629 - RNA, 13 nt, Human
uggggaccucagg

SEQ ID NO: 2949630 - RNA, 18 nt, Human
uggggaccagagcugcca

SEQ ID NO: 2949631 - RNA, 17 nt, Human
uggggaccagagcugcc

SEQ ID NO: 2949632 - RNA, 19 nt, Human
ugggcuggguucuacccag

SEQ ID NO: 2949633 - RNA, 18 nt, Human
ugggcuggguucuaccca

SEQ ID NO: 2949634 - RNA, 14 nt, Human
uggggaaugaagau

SEQ ID NO: 2949635 - RNA, 15 nt, Human
uggggaaugaagaua

SEQ ID NO: 2949636 - RNA, 20 nt, Human
uggggcugcaccggcuggcc

SEQ ID NO: 2949637 - RNA, 14 nt, Human
ugggguacccacug

SEQ ID NO: 2949638 - RNA, 18 nt, Human
uggggucacucuggcagc

SEQ ID NO: 2949639 - RNA, 17 nt, Human
uggggucacucuggcag

SEQ ID NO: 2949640 - RNA, 15 nt, Human
ugggguacccacugc

SEQ ID NO: 2949641 - RNA, 16 nt, Human
ugggguacccacugcu

SEQ ID NO: 2949642 - RNA, 20 nt, Human
ugggguacccacugcucugg

SEQ ID NO: 2949643 - RNA, 16 nt, Human
uggggcccugccuccu

SEQ ID NO: 2949644 - RNA, 15 nt, Human
uggggcccugccucc

SEQ ID NO: 2949645 - RNA, 18 nt, Human
uggggcggugagagggga

SEQ ID NO: 2949646 - RNA, 23 nt, Human
uggggaccucaggccugggggcu

SEQ ID NO: 2949647 - RNA, 12 nt, Human
uggggagaaagu

SEQ ID NO: 2949648 - RNA, 14 nt, Human
uggggcccugccuc

SEQ ID NO: 2949649 - RNA, 20 nt, Human
ugggcccaaugcacuuuguu

SEQ ID NO: 2949650 - RNA, 16 nt, Human
ugggccaggagccucc

SEQ ID NO: 2949651 - RNA, 14 nt, Human
ugggccaggagccu

SEQ ID NO: 2949652 - RNA, 13 nt, Human
ugggccaggagcc

SEQ ID NO: 2949653 - RNA, 16 nt, Human
ugggccaccgccuugc

SEQ ID NO: 2949654 - RNA, 17 nt, Human
ugggccaccgccuugcc

SEQ ID NO: 2949655 - RNA, 23 nt, Human
ugggccaccgccuugcccagccu

SEQ ID NO: 2949656 - RNA, 20 nt, Human
ugggcacaucauuucaagaa

SEQ ID NO: 2949657 - RNA, 15 nt, Human
ugggcacaucauuuc

SEQ ID NO: 2949658 - RNA, 17 nt, Human
ugggcaacccccagccu

SEQ ID NO: 2949659 - RNA, 20 nt, Human
ugggcaacccccagccugcu

SEQ ID NO: 2949660 - RNA, 19 nt, Human
aggccuuccccuggcacug

SEQ ID NO: 2949661 - RNA, 17 nt, Human
aggccuuccccuggcac

SEQ ID NO: 2949662 - RNA, 17 nt, Human
ugggaggucaaggcugc

SEQ ID NO: 2949663 - RNA, 23 nt, Human
ugggaggucaaggcugcagugag

SEQ ID NO: 2949664 - RNA, 20 nt, Human
ugggaggucaaggcugcagu

SEQ ID NO: 2949665 - RNA, 19 nt, Human
ugggaggucaaggcugcag

SEQ ID NO: 2949666 - RNA, 18 nt, Human
ugggaggucaaggcugca

SEQ ID NO: 2949667 - RNA, 15 nt, Human
ugggagguuaaaaag

SEQ ID NO: 2949668 - RNA, 16 nt, Human
ugggcaacccccagcc

SEQ ID NO: 2949669 - RNA, 17 nt, Human
agggaggugaccccagg

SEQ ID NO: 2949670 - RNA, 17 nt, Human
agggagugacagaggca

SEQ ID NO: 2949671 - RNA, 18 nt, Human
agggagugacagaggcag

SEQ ID NO: 2949672 - RNA, 19 nt, Human
agggagugacagaggcagc

SEQ ID NO: 2949673 - RNA, 15 nt, Human
agggagggcuucugc

SEQ ID NO: 2949674 - RNA, 23 nt, Human
agggcccagagaggguggugacc

SEQ ID NO: 2949675 - RNA, 18 nt, Human
agggcccagagagggugg

SEQ ID NO: 2949676 - RNA, 17 nt, Human
agggcagggacaggaua

SEQ ID NO: 2949677 - RNA, 15 nt, Human
uggucccaccccaca

SEQ ID NO: 2949678 - RNA, 14 nt, Human
uggucccaccccac

SEQ ID NO: 2949679 - RNA, 18 nt, Human
uggucaccaaaucagcug

SEQ ID NO: 2949680 - RNA, 22 nt, Human
uggucagauuugaacucuucaa

SEQ ID NO: 2949681 - RNA, 17 nt, Human
uggucucaaacucuuga

SEQ ID NO: 2949682 - RNA, 23 nt, Human
uggucucaaacucuugaccucag

SEQ ID NO: 2949683 - RNA, 13 nt, Human
uggucccacccca

SEQ ID NO: 2949684 - RNA, 16 nt, Human
uggucucaaacucuug

SEQ ID NO: 2949685 - RNA, 16 nt, Human
uggucccaccccacac

SEQ ID NO: 2949686 - RNA, 16 nt, Human
uggucugacccacugc

SEQ ID NO: 2949687 - RNA, 17 nt, Human
uggucugacccacugcu

SEQ ID NO: 2949688 - RNA, 21 nt, Human
aggguggugaccucugccuga

SEQ ID NO: 2949689 - RNA, 22 nt, Human
aggguguccggucccuguccca

SEQ ID NO: 2949690 - RNA, 13 nt, Human
aggguuauaauaa

SEQ ID NO: 2949691 - RNA, 12 nt, Human
aggucagagccu

SEQ ID NO: 2949692 - RNA, 17 nt, Human
aggucauuuuuuuuaag

SEQ ID NO: 2949693 - RNA, 20 nt, Human
aggucauuuuuuuuaagaaa

SEQ ID NO: 2949694 - RNA, 23 nt, Human
agguagaaauaucugaaaaugua

SEQ ID NO: 2949695 - RNA, 17 nt, Human
agguagaauguuuucaa

SEQ ID NO: 2949696 - RNA, 21 nt, Human
agguaugcaaucaaaucugcu

SEQ ID NO: 2949697 - RNA, 18 nt, Human
aggguuggccccugcccg

SEQ ID NO: 2949698 - RNA, 23 nt, Human
aggguuggccccugcccggcugc

SEQ ID NO: 2949699 - RNA, 17 nt, Human
aggguuggccccugccc

SEQ ID NO: 2949700 - RNA, 23 nt, Human
agguacuucaaauccuugaagau

SEQ ID NO: 2949701 - RNA, 17 nt, Human
agguagaaauaucugaa

SEQ ID NO: 2949702 - RNA, 19 nt, Human
agguagaaauaucugaaaa

SEQ ID NO: 2949703 - RNA, 24 nt, Human
agggguucccuuuuuuggcugcug

SEQ ID NO: 2949704 - RNA, 21 nt, Human
agggucucacuauguugccca

SEQ ID NO: 2949705 - RNA, 22 nt, Human
agggucucacuauguugcccag

SEQ ID NO: 2949706 - RNA, 23 nt, Human
agggucucacuauguugcccagg

SEQ ID NO: 2949707 - RNA, 15 nt, Human
aggggguggccuccc

SEQ ID NO: 2949708 - RNA, 18 nt, Human
aggggguggccucccaac

SEQ ID NO: 2949709 - RNA, 17 nt, Human
aggggguggccucccaa

SEQ ID NO: 2949710 - RNA, 22 nt, Human
aggggugggacacccugugaug

SEQ ID NO: 2949711 - RNA, 20 nt, Human
aggggugggacacccuguga

SEQ ID NO: 2949712 - RNA, 19 nt, Human
uggggucacucuggcagcu

SEQ ID NO: 2949713 - RNA, 20 nt, Human
uggggucacucuggcagcuc

SEQ ID NO: 2949714 - RNA, 23 nt, Human
aggggagcaaaaucgaugcagug

SEQ ID NO: 2949715 - RNA, 22 nt, Human
aggguggccacaccucuauccc

SEQ ID NO: 2949716 - RNA, 22 nt, Human
agggucucacucugucgcccag

SEQ ID NO: 2949717 - RNA, 21 nt, Human
agggucucacucugucgccca

SEQ ID NO: 2949718 - RNA, 22 nt, Human
uggguggcaccagcagccugga

SEQ ID NO: 2949719 - RNA, 22 nt, Human
ugggugcuuggaggaaggaaac

SEQ ID NO: 2949720 - RNA, 19 nt, Human
ugggugcuuggaggaagga

SEQ ID NO: 2949721 - RNA, 15 nt, Human
ugggugcuuggagga

SEQ ID NO: 2949722 - RNA, 16 nt, Human
ugguacuaacuuuccu

SEQ ID NO: 2949723 - RNA, 20 nt, Human
ugguaaggggaauugaggac

SEQ ID NO: 2949724 - RNA, 14 nt, Human
agugcaaauuguca

SEQ ID NO: 2949725 - RNA, 18 nt, Human
agugcaaauugucacagg

SEQ ID NO: 2949726 - RNA, 21 nt, Human
agugcaaauugucacaggaca

SEQ ID NO: 2949727 - RNA, 16 nt, Human
agugagucgaggacag

SEQ ID NO: 2949728 - RNA, 22 nt, Human
agugauucuccugccucagccu

SEQ ID NO: 2949729 - RNA, 24 nt, Human
agugauucuccugccucagccucc

SEQ ID NO: 2949730 - RNA, 21 nt, Human
agugccaaagaagcagaccau

SEQ ID NO: 2949731 - RNA, 16 nt, Human
agugccaaaaacaaca

SEQ ID NO: 2949732 - RNA, 14 nt, Human
agugcccacaggau

SEQ ID NO: 2949733 - RNA, 15 nt, Human
agugcaguauagaau

SEQ ID NO: 2949734 - RNA, 14 nt, Human
agugcaguauagaa

SEQ ID NO: 2949735 - RNA, 22 nt, Human
ugugcucugaucauccacugug

SEQ ID NO: 2949736 - RNA, 12 nt, Human
ugugcucugauc

SEQ ID NO: 2949737 - RNA, 23 nt, Human
ugugcucugaucauccacugugc

SEQ ID NO: 2949738 - RNA, 15 nt, Human
ugugcucuggacagg

SEQ ID NO: 2949739 - RNA, 20 nt, Human
agucucacuguugcccaggc

SEQ ID NO: 2949740 - RNA, 18 nt, Human
agucucacuguugcccag

SEQ ID NO: 2949741 - RNA, 19 nt, Human
agucucacuguugcccagg

SEQ ID NO: 2949742 - RNA, 20 nt, Human
ugugcccuaaaguguauuuu

SEQ ID NO: 2949743 - RNA, 21 nt, Human
ugugcccuaaaguguauuuuu

SEQ ID NO: 2949744 - RNA, 15 nt, Human
ugugcugcccugccc

SEQ ID NO: 2949745 - RNA, 14 nt, Human
ugugcugcccugcc

SEQ ID NO: 2949746 - RNA, 13 nt, Human
ugugcugcccugc

SEQ ID NO: 2949747 - RNA, 12 nt, Human
ugugcugcccug

SEQ ID NO: 2949748 - RNA, 19 nt, Human
ugugcucuggacaggcaug

SEQ ID NO: 2949749 - RNA, 16 nt, Human
ugugcucuggacaggc

SEQ ID NO: 2949750 - RNA, 18 nt, Human
ugugcucuggacaggcau

SEQ ID NO: 2949751 - RNA, 21 nt, Human
uguuaacauggacaugaucuu

SEQ ID NO: 2949752 - RNA, 11 nt, Human
aguggaaaaau

SEQ ID NO: 2949753 - RNA, 19 nt, Human
aguggaaaaauagccugcc

SEQ ID NO: 2949754 - RNA, 18 nt, Human
aguggaaaaauagccugc

SEQ ID NO: 2949755 - RNA, 22 nt, Human
agugcuuuaccaauugaaguaa

SEQ ID NO: 2949756 - RNA, 19 nt, Human
uguuaaugauagcuacugu

SEQ ID NO: 2949757 - RNA, 16 nt, Human
ugugucucuugguccu

SEQ ID NO: 2949758 - RNA, 13 nt, Human
ugugucucuuggu

SEQ ID NO: 2949759 - RNA, 17 nt, Human
ugugucagguggggcag

SEQ ID NO: 2949760 - RNA, 19 nt, Human
ugugucagguggggcagcu

SEQ ID NO: 2949761 - RNA, 23 nt, Human
uguguuaucacccagaagaaaau

SEQ ID NO: 2949762 - RNA, 14 nt, Human
uguguuaugaagca

SEQ ID NO: 2949763 - RNA, 16 nt, Human
agugcuuccaaggaug

SEQ ID NO: 2949764 - RNA, 20 nt, Human
agugcuuggcccaggaguuu

SEQ ID NO: 2949765 - RNA, 16 nt, Human
uguggucccaccccac

SEQ ID NO: 2949766 - RNA, 19 nt, Human
agugcuuggcccaggaguu

SEQ ID NO: 2949767 - RNA, 18 nt, Human
agugcuuggcccaggagu

SEQ ID NO: 2949768 - RNA, 16 nt, Human
agugcuuggcccagga

SEQ ID NO: 2949769 - RNA, 15 nt, Human
agugcuuggcccagg

SEQ ID NO: 2949770 - RNA, 14 nt, Human
agugcuuggcccag

SEQ ID NO: 2949771 - RNA, 12 nt, Human
agugcuuggccc

SEQ ID NO: 2949772 - RNA, 20 nt, Human
ugugguuauaacuuaaugaa

SEQ ID NO: 2949773 - RNA, 23 nt, Human
ugugguuauaacuuaaugaaaac

SEQ ID NO: 2949774 - RNA, 12 nt, Human
ugugguuucauu

SEQ ID NO: 2949775 - RNA, 19 nt, Human
ugugucagcauagaaguaa

SEQ ID NO: 2949776 - RNA, 20 nt, Human
ugugguguuuccuggcacug

SEQ ID NO: 2949777 - RNA, 20 nt, Human
agugcugggauuacaagcgu

SEQ ID NO: 2949778 - RNA, 22 nt, Human
agugcugcauuuaaaagauaca

SEQ ID NO: 2949779 - RNA, 19 nt, Human
agugcugggauuacaggug

SEQ ID NO: 2949780 - RNA, 22 nt, Human
agugccucucccugcugcuccu

SEQ ID NO: 2949781 - RNA, 23 nt, Human
agugccucucccugcugcuccua

SEQ ID NO: 2949782 - RNA, 19 nt, Human
agugccucucccugcugcu

SEQ ID NO: 2949783 - RNA, 20 nt, Human
agugccucucccugcugcuc

SEQ ID NO: 2949784 - RNA, 21 nt, Human
agugccuguaaucacagcuac

SEQ ID NO: 2949785 - RNA, 15 nt, Human
agugccuuacacaau

SEQ ID NO: 2949786 - RNA, 17 nt, Human
agugccuuacacaaugg

SEQ ID NO: 2949787 - RNA, 20 nt, Human
agugcugcauuuaaaagaua

SEQ ID NO: 2949788 - RNA, 17 nt, Human
aguguuggagaagaacu

SEQ ID NO: 2949789 - RNA, 18 nt, Human
aguguuggagaagaacug

SEQ ID NO: 2949790 - RNA, 14 nt, Human
aguguuggagaaga

SEQ ID NO: 2949791 - RNA, 16 nt, Human
aguguuggagaagaac

SEQ ID NO: 2949792 - RNA, 16 nt, Human
aguuacugaacaguaa

SEQ ID NO: 2949793 - RNA, 15 nt, Human
uguugcccaggcugg

SEQ ID NO: 2949794 - RNA, 13 nt, Human
uguugcccaggcu

SEQ ID NO: 2949795 - RNA, 19 nt, Human
uguucuuucacccuuuucu

SEQ ID NO: 2949796 - RNA, 20 nt, Human
uguucuugguuuguaaauua

SEQ ID NO: 2949797 - RNA, 22 nt, Human
uguucuugguuuguaaauuaac

SEQ ID NO: 2949798 - RNA, 15 nt, Human
aguggaguuacugaa

SEQ ID NO: 2949799 - RNA, 18 nt, Human
uguucuuaguuugcaguu

SEQ ID NO: 2949800 - RNA, 18 nt, Human
uguucuagcauggcugcc

SEQ ID NO: 2949801 - RNA, 19 nt, Human
uguuauuuauugaaaugau

SEQ ID NO: 2949802 - RNA, 18 nt, Human
uguuauuuauugaaauga

SEQ ID NO: 2949803 - RNA, 17 nt, Human
uguuauuuauugaaaug

SEQ ID NO: 2949804 - RNA, 15 nt, Human
uguuauuuauugaaa

SEQ ID NO: 2949805 - RNA, 13 nt, Human
uguuauuuauuga

SEQ ID NO: 2949806 - RNA, 23 nt, Human
aguuccucauuagcauuuugcua

SEQ ID NO: 2949807 - RNA, 24 nt, Human
aguucaaucuggauucauauuuaa

SEQ ID NO: 2949808 - RNA, 16 nt, Human
aguucaauucucauuu

SEQ ID NO: 2949809 - RNA, 23 nt, Human
aguucuauuuauuugugagacug

SEQ ID NO: 2949810 - RNA, 13 nt, Human
aguucuaguguuu

SEQ ID NO: 2949811 - RNA, 19 nt, Human
aguucggugagcuacaaau

SEQ ID NO: 2949812 - RNA, 13 nt, Human
uguugucugcaac

SEQ ID NO: 2949813 - RNA, 16 nt, Human
uguugucugcaacucu

SEQ ID NO: 2949814 - RNA, 20 nt, Human
uguuuagauaauacaccacu

SEQ ID NO: 2949815 - RNA, 20 nt, Human
uguuuagaugaaugucaguu

SEQ ID NO: 2949816 - RNA, 15 nt, Human
uguuuagaugaaugu

SEQ ID NO: 2949817 - RNA, 14 nt, Human
uguuuauugucaaa

SEQ ID NO: 2949818 - RNA, 15 nt, Human
uguuuaugagaaacu

SEQ ID NO: 2949819 - RNA, 18 nt, Human
uuagccaagugugguaga

SEQ ID NO: 2949820 - RNA, 14 nt, Human
uuagcggagacgga

SEQ ID NO: 2949821 - RNA, 18 nt, Human
uuagcaaauucuguuuuu

SEQ ID NO: 2949822 - RNA, 15 nt, Human
uuaguuucuccaagc

SEQ ID NO: 2949823 - RNA, 22 nt, Human
uuaguuugcaguuacacuaaaa

SEQ ID NO: 2949824 - RNA, 12 nt, Human
uuagguugugaa

SEQ ID NO: 2949825 - RNA, 13 nt, Human
uuagguugugaau

SEQ ID NO: 2949826 - RNA, 17 nt, Human
uuagguugugaaugcag

SEQ ID NO: 2949827 - RNA, 18 nt, Human
uuagguuggcaaaaaggc

SEQ ID NO: 2949828 - RNA, 21 nt, Human
uuaggugugacugaauuucuu

SEQ ID NO: 2949829 - RNA, 16 nt, Human
uuaggugaggaagcaa

SEQ ID NO: 2949830 - RNA, 16 nt, Human
uuaggugugacugaau

SEQ ID NO: 2949831 - RNA, 20 nt, Human
uuagggaaggauacaaaagc

SEQ ID NO: 2949832 - RNA, 15 nt, Human
uuaggugaggaagca

SEQ ID NO: 2949833 - RNA, 12 nt, Human
auaauacaccac

SEQ ID NO: 2949834 - RNA, 18 nt, Human
auaauacaccacuacauu

SEQ ID NO: 2949835 - RNA, 20 nt, Human
auaauacaccacuacauucu

SEQ ID NO: 2949836 - RNA, 15 nt, Human
auaaugcgugcauac

SEQ ID NO: 2949837 - RNA, 15 nt, Human
auaaugaaugaaaca

SEQ ID NO: 2949838 - RNA, 22 nt, Human
auaauugacaggauuauuggaa

SEQ ID NO: 2949839 - RNA, 19 nt, Human
auaaucucugauucccuga

SEQ ID NO: 2949840 - RNA, 23 nt, Human
auaaucucugauucccugauuua

SEQ ID NO: 2949841 - RNA, 14 nt, Human
auaaucucugauuc

SEQ ID NO: 2949842 - RNA, 18 nt, Human
auaauccuaaacauauga

SEQ ID NO: 2949843 - RNA, 23 nt, Human
uuacugaacaguaacauagcugu

SEQ ID NO: 2949844 - RNA, 15 nt, Human
uuacugaacaguaac

SEQ ID NO: 2949845 - RNA, 13 nt, Human
uuagacagagucu

SEQ ID NO: 2949846 - RNA, 20 nt, Human
uuagacagagucucacuguu

SEQ ID NO: 2949847 - RNA, 13 nt, Human
uuagacagucccu

SEQ ID NO: 2949848 - RNA, 15 nt, Human
auaacuuaaugaaaa

SEQ ID NO: 2949849 - RNA, 16 nt, Human
auaacuuaaugaaaac

SEQ ID NO: 2949850 - RNA, 18 nt, Human
auaacuuaaugaaaacaa

SEQ ID NO: 2949851 - RNA, 19 nt, Human
auaacuuaaugaaaacaau

SEQ ID NO: 2949852 - RNA, 23 nt, Human
auaacuuaaugaaaacaaugcag

SEQ ID NO: 2949853 - RNA, 19 nt, Human
uuacccucauguucuuaau

SEQ ID NO: 2949854 - RNA, 15 nt, Human
auaaauaguuuauga

SEQ ID NO: 2949855 - RNA, 14 nt, Human
auaaauaaaaauaa

SEQ ID NO: 2949856 - RNA, 13 nt, Human
uuaauugggcacu

SEQ ID NO: 2949857 - RNA, 18 nt, Human
uuaauugggcacuauuua

SEQ ID NO: 2949858 - RNA, 13 nt, Human
auaaauaaaaaua

SEQ ID NO: 2949859 - RNA, 11 nt, Human
auaaauuauuu

SEQ ID NO: 2949860 - RNA, 22 nt, Human
auaacgauaaaagacagugaaa

SEQ ID NO: 2949861 - RNA, 16 nt, Human
uuaaauagaugacauu

SEQ ID NO: 2949862 - RNA, 14 nt, Human
uuaaauagaugaca

SEQ ID NO: 2949863 - RNA, 13 nt, Human
uuaaauagaugac

SEQ ID NO: 2949864 - RNA, 13 nt, Human
uuaaauaauguga

SEQ ID NO: 2949865 - RNA, 16 nt, Human
uuaaauaaugugaaac

SEQ ID NO: 2949866 - RNA, 18 nt, Human
uuaaauaaugugaaacug

SEQ ID NO: 2949867 - RNA, 20 nt, Human
uuaacagaaauguacagcaa

SEQ ID NO: 2949868 - RNA, 19 nt, Human
uuaacagaaauguacagca

SEQ ID NO: 2949869 - RNA, 16 nt, Human
uuaacagaaauguaca

SEQ ID NO: 2949870 - RNA, 22 nt, Human
uuaaacauauccaaguuugaau

SEQ ID NO: 2949871 - RNA, 21 nt, Human
uuaaacaugcuguacauacuu

SEQ ID NO: 2949872 - RNA, 22 nt, Human
uuaaacaugcuguacauacuuu

SEQ ID NO: 2949873 - RNA, 23 nt, Human
uuaaacaugcuguacauacuuuu

SEQ ID NO: 2949874 - RNA, 19 nt, Human
uuaaacaugcuguacauac

SEQ ID NO: 2949875 - RNA, 15 nt, Human
uuaaauaaugugaaa

SEQ ID NO: 2949876 - RNA, 14 nt, Human
uuaaacacauuaaa

SEQ ID NO: 2949877 - RNA, 16 nt, Human
uuaaaaaucucaaauu

SEQ ID NO: 2949878 - RNA, 14 nt, Human
uuaaaaaucucaaa

SEQ ID NO: 2949879 - RNA, 15 nt, Human
uuaaaaaucucaaau

SEQ ID NO: 2949880 - RNA, 13 nt, Human
uuaaaaaaaaucc

SEQ ID NO: 2949881 - RNA, 17 nt, Human
aguuggucccccuucca

SEQ ID NO: 2949882 - RNA, 13 nt, Human
aguuggucccccu

SEQ ID NO: 2949883 - RNA, 11 nt, Human
aguuggucccc

SEQ ID NO: 2949884 - RNA, 14 nt, Human
aguuuaaauuguaa

SEQ ID NO: 2949885 - RNA, 13 nt, Human
aguugggcuuccu

SEQ ID NO: 2949886 - RNA, 19 nt, Human
aguugggcuuccucauagu

SEQ ID NO: 2949887 - RNA, 23 nt, Human
aguugccagucaccccggccacc

SEQ ID NO: 2949888 - RNA, 13 nt, Human
uguuucaaacaua

SEQ ID NO: 2949889 - RNA, 13 nt, Human
uuaaggguaugau

SEQ ID NO: 2949890 - RNA, 9 nt, Human
uuaaggugg

SEQ ID NO: 2949891 - RNA, 19 nt, Human
uuaagaacuaaaauguucu

SEQ ID NO: 2949892 - RNA, 16 nt, Human
uuaagaacuaaaaugu

SEQ ID NO: 2949893 - RNA, 20 nt, Human
uuaagaacuaaaauguucua

SEQ ID NO: 2949894 - RNA, 22 nt, Human
uuaagaaagacuaucuaaaugu

SEQ ID NO: 2949895 - RNA, 14 nt, Human
uuaagugcugcauu

SEQ ID NO: 2949896 - RNA, 19 nt, Human
uuaagugcugcauuuaaaa

SEQ ID NO: 2949897 - RNA, 15 nt, Human
uuaagugcugcauuu

SEQ ID NO: 2949898 - RNA, 16 nt, Human
uuaagugcugcauuua

SEQ ID NO: 2949899 - RNA, 22 nt, Human
uuaaucauuaggugugacugaa

SEQ ID NO: 2949900 - RNA, 23 nt, Human
uuaaucauuaggugugacugaau

SEQ ID NO: 2949901 - RNA, 13 nt, Human
uuaaucauuaggu

SEQ ID NO: 2949902 - RNA, 19 nt, Human
uuaaugaaagacuguacaa

SEQ ID NO: 2949903 - RNA, 22 nt, Human
uuaaucugguuuauuuuuguuc

SEQ ID NO: 2949904 - RNA, 18 nt, Human
uuaaugaaagacuguaca

SEQ ID NO: 2949905 - RNA, 12 nt, Human
auaaaauaauuu

SEQ ID NO: 2949906 - RNA, 21 nt, Human
uuaagaaaaaggaugcacaga

SEQ ID NO: 2949907 - RNA, 19 nt, Human
uuaagaaaaaggaugcaca

SEQ ID NO: 2949908 - RNA, 20 nt, Human
uuaagaaaaaggaugcacag

SEQ ID NO: 2949909 - RNA, 22 nt, Human
auaaaauaauuuuuauauuuga

SEQ ID NO: 2949910 - RNA, 23 nt, Human
aguuuuuauggcuuuugugcauu

SEQ ID NO: 2949911 - RNA, 18 nt, Human
aguuuucugagaaagacu

SEQ ID NO: 2949912 - RNA, 19 nt, Human
aguuuucugagaaagacua

SEQ ID NO: 2949913 - RNA, 18 nt, Human
aguuuugaagauucuaug

SEQ ID NO: 2949914 - RNA, 17 nt, Human
aguuuugaagauucuau

SEQ ID NO: 2949915 - RNA, 23 nt, Human
aguuuucugagaaagacuauuca

SEQ ID NO: 2949916 - RNA, 16 nt, Human
auuaaaagaauauuuu

SEQ ID NO: 2949917 - RNA, 15 nt, Human
auuaaaagaauauuu

SEQ ID NO: 2949918 - RNA, 17 nt, Human
auguuuuucuucucccu

SEQ ID NO: 2949919 - RNA, 18 nt, Human
auguuuuucuucucccuc

SEQ ID NO: 2949920 - RNA, 19 nt, Human
uuuucucacagaagaugaa

SEQ ID NO: 2949921 - RNA, 20 nt, Human
auguuuauuuaaaagagcag

SEQ ID NO: 2949922 - RNA, 18 nt, Human
auguuucaaacauauaua

SEQ ID NO: 2949923 - RNA, 14 nt, Human
auguuuuccaugag

SEQ ID NO: 2949924 - RNA, 13 nt, Human
auuaaagugccca

SEQ ID NO: 2949925 - RNA, 17 nt, Human
auuaaacuuaaucuaaa

SEQ ID NO: 2949926 - RNA, 16 nt, Human
auuaaacuuaaucuaa

SEQ ID NO: 2949927 - RNA, 19 nt, Human
auuaaacuuaaucuaaaug

SEQ ID NO: 2949928 - RNA, 21 nt, Human
auuaaacuuaaucuaaaugga

SEQ ID NO: 2949929 - RNA, 20 nt, Human
auuaaccacuucagcugacu

SEQ ID NO: 2949930 - RNA, 18 nt, Human
auuaaccacuucagcuga

SEQ ID NO: 2949931 - RNA, 17 nt, Human
auuaaccacuucagcug

SEQ ID NO: 2949932 - RNA, 13 nt, Human
auuaagaaagacu

SEQ ID NO: 2949933 - RNA, 14 nt, Human
auuaagaaagacua

SEQ ID NO: 2949934 - RNA, 23 nt, Human
auuaacuuuuauaaacuuuaccu

SEQ ID NO: 2949935 - RNA, 12 nt, Human
auuaacuuuuau

SEQ ID NO: 2949936 - RNA, 16 nt, Human
auuaacuuuuauaaac

SEQ ID NO: 2949937 - RNA, 17 nt, Human
auuaacuuuuauaaacu

SEQ ID NO: 2949938 - RNA, 19 nt, Human
auuaacuuuuauaaacuuu

SEQ ID NO: 2949939 - RNA, 20 nt, Human
auuaacuuuuauaaacuuua

SEQ ID NO: 2949940 - RNA, 12 nt, Human
uuuuauaaacuu

SEQ ID NO: 2949941 - RNA, 13 nt, Human
uuuuauaaacuuu

SEQ ID NO: 2949942 - RNA, 23 nt, Human
uuuuagaguugauacuacaguuu

SEQ ID NO: 2949943 - RNA, 16 nt, Human
auguuggccaggcugg

SEQ ID NO: 2949944 - RNA, 13 nt, Human
auguuggccaggc

SEQ ID NO: 2949945 - RNA, 14 nt, Human
auguuggccaggcu

SEQ ID NO: 2949946 - RNA, 21 nt, Human
uuuuaagugcugcauuuaaaa

SEQ ID NO: 2949947 - RNA, 16 nt, Human
uuuuaagugcugcauu

SEQ ID NO: 2949948 - RNA, 17 nt, Human
uuuuaagugcugcauuu

SEQ ID NO: 2949949 - RNA, 21 nt, Human
auguucaucauccuaagcuau

SEQ ID NO: 2949950 - RNA, 19 nt, Human
auguucaucaaugaaugaa

SEQ ID NO: 2949951 - RNA, 15 nt, Human
auguugacaugggac

SEQ ID NO: 2949952 - RNA, 23 nt, Human
uuuuccaguaaugagcuuaagaa

SEQ ID NO: 2949953 - RNA, 19 nt, Human
uuuuccagguuuaagcugu

SEQ ID NO: 2949954 - RNA, 16 nt, Human
uuuucuauaauuuaaa

SEQ ID NO: 2949955 - RNA, 15 nt, Human
uuuuauuauuaacaa

SEQ ID NO: 2949956 - RNA, 19 nt, Human
uuuuauaaacuuuaccuuu

SEQ ID NO: 2949957 - RNA, 14 nt, Human
uuuuauaaacuuua

SEQ ID NO: 2949958 - RNA, 17 nt, Human
uuuuauaaacuuuaccu

SEQ ID NO: 2949959 - RNA, 14 nt, Human
uuuuauaauuuugu

SEQ ID NO: 2949960 - RNA, 19 nt, Human
uuuuauggcacuaguauuu

SEQ ID NO: 2949961 - RNA, 23 nt, Human
uuuuauggaggcuuugcauagau

SEQ ID NO: 2949962 - RNA, 23 nt, Human
uuuguaacuguuuagaugaaugu

SEQ ID NO: 2949963 - RNA, 22 nt, Human
uuuguaacuguuuagaugaaug

SEQ ID NO: 2949964 - RNA, 13 nt, Human
uuuguagagccag

SEQ ID NO: 2949965 - RNA, 19 nt, Human
uuugugaggaagccgcugg

SEQ ID NO: 2949966 - RNA, 18 nt, Human
uuugugaggaagccgcug

SEQ ID NO: 2949967 - RNA, 12 nt, Human
uuuguuugaacu

SEQ ID NO: 2949968 - RNA, 13 nt, Human
uuuguuugaacug

SEQ ID NO: 2949969 - RNA, 14 nt, Human
uuuguuugaacuga

SEQ ID NO: 2949970 - RNA, 17 nt, Human
uuuguagaagucacauu

SEQ ID NO: 2949971 - RNA, 22 nt, Human
uuuuaagggcccuuuuucaaua

SEQ ID NO: 2949972 - RNA, 15 nt, Human
uuuuaagugcugcau

SEQ ID NO: 2949973 - RNA, 17 nt, Human
uuuuaagacuuugguua

SEQ ID NO: 2949974 - RNA, 16 nt, Human
uuuuaagaggcagggu

SEQ ID NO: 2949975 - RNA, 15 nt, Human
uuuuaagaggcaggg

SEQ ID NO: 2949976 - RNA, 21 nt, Human
uuuuaaaaaacugcugacugu

SEQ ID NO: 2949977 - RNA, 18 nt, Human
uuuguuugaacugauaaa

SEQ ID NO: 2949978 - RNA, 13 nt, Human
uuuuaaaaaagaa

SEQ ID NO: 2949979 - RNA, 14 nt, Human
uuuuaaaagaauga

SEQ ID NO: 2949980 - RNA, 12 nt, Human
auguauguguaa

SEQ ID NO: 2949981 - RNA, 15 nt, Human
auguaucugagcagg

SEQ ID NO: 2949982 - RNA, 15 nt, Human
auguaucaaugagua

SEQ ID NO: 2949983 - RNA, 22 nt, Human
uuugggggaaaauuuagaaaua

SEQ ID NO: 2949984 - RNA, 14 nt, Human
augucaguucugau

SEQ ID NO: 2949985 - RNA, 21 nt, Human
augucagugugacugaucucu

SEQ ID NO: 2949986 - RNA, 16 nt, Human
augucagugugacuga

SEQ ID NO: 2949987 - RNA, 15 nt, Human
augucagugugacug

SEQ ID NO: 2949988 - RNA, 18 nt, Human
auguccaagaagcccagg

SEQ ID NO: 2949989 - RNA, 19 nt, Human
auguccaagaagcccagga

SEQ ID NO: 2949990 - RNA, 23 nt, Human
auguccaagaagcccaggaaagg

SEQ ID NO: 2949991 - RNA, 17 nt, Human
augucaguuguuauuua

SEQ ID NO: 2949992 - RNA, 15 nt, Human
augucaguuguuauu

SEQ ID NO: 2949993 - RNA, 16 nt, Human
augucaguucugauau

SEQ ID NO: 2949994 - RNA, 21 nt, Human
augucaguucugauauggaag

SEQ ID NO: 2949995 - RNA, 23 nt, Human
augucucuuuaaugucacaggca

SEQ ID NO: 2949996 - RNA, 22 nt, Human
augucuauaaaccgaacugaug

SEQ ID NO: 2949997 - RNA, 23 nt, Human
augucuagaccaggaccucccuc

SEQ ID NO: 2949998 - RNA, 13 nt, Human
uuuggggaagaac

SEQ ID NO: 2949999 - RNA, 22 nt, Human
uuugggaggccaaggugggagg

SEQ ID NO: 2950000 - RNA, 14 nt, Human
uuuggggauauuuu

SEQ ID NO: 2950001 - RNA, 12 nt, Human
uuuggcccaggg

SEQ ID NO: 2950002 - RNA, 14 nt, Human
uuuggccagaaguc

SEQ ID NO: 2950003 - RNA, 12 nt, Human
uuuggccagaag

SEQ ID NO: 2950004 - RNA, 10 nt, Human
uuuggccaga

SEQ ID NO: 2950005 - RNA, 19 nt, Human
uuugcuaagcauuccaacu

SEQ ID NO: 2950006 - RNA, 11 nt, Human
uuugcucaugg

SEQ ID NO: 2950007 - RNA, 12 nt, Human
uuugcucaugga

SEQ ID NO: 2950008 - RNA, 22 nt, Human
uuugcacacuuuggcccagggu

SEQ ID NO: 2950009 - RNA, 13 nt, Human
uuugcacauuaaa

SEQ ID NO: 2950010 - RNA, 16 nt, Human
uuugcacauuaaauga

SEQ ID NO: 2950011 - RNA, 12 nt, Human
uuugcacauuaa

SEQ ID NO: 2950012 - RNA, 22 nt, Human
uuugccauguuggccaggcugg

SEQ ID NO: 2950013 - RNA, 15 nt, Human
auggcuauaggugcu

SEQ ID NO: 2950014 - RNA, 15 nt, Human
auuauauuuacaaau

SEQ ID NO: 2950015 - RNA, 17 nt, Human
auuauauuuacaaaugg

SEQ ID NO: 2950016 - RNA, 23 nt, Human
auuaucucaaaacugcacuguca

SEQ ID NO: 2950017 - RNA, 18 nt, Human
auuaucucaaaacugcac

SEQ ID NO: 2950018 - RNA, 11 nt, Human
auuauuaacaa

SEQ ID NO: 2950019 - RNA, 23 nt, Human
auuauuuauuaaaugcccagccc

SEQ ID NO: 2950020 - RNA, 16 nt, Human
auuauauuuacaaaug

SEQ ID NO: 2950021 - RNA, 22 nt, Human
auuaccugaauuuuggcugugu

SEQ ID NO: 2950022 - RNA, 15 nt, Human
auuacauuuguauaa

SEQ ID NO: 2950023 - RNA, 20 nt, Human
auuacauuuguauaaaauaa

SEQ ID NO: 2950024 - RNA, 19 nt, Human
auuaccacagacauacuaa

SEQ ID NO: 2950025 - RNA, 13 nt, Human
auuacauuuguau

SEQ ID NO: 2950026 - RNA, 18 nt, Human
auuaagagguaagacuua

SEQ ID NO: 2950027 - RNA, 20 nt, Human
auuaagagagucuauuuacg

SEQ ID NO: 2950028 - RNA, 22 nt, Human
uuuuuguuccacaaguuaaaua

SEQ ID NO: 2950029 - RNA, 23 nt, Human
uuuuuuaaaaaagaaacauuugg

SEQ ID NO: 2950030 - RNA, 13 nt, Human
auuaaguaaugau

SEQ ID NO: 2950031 - RNA, 15 nt, Human
auuaaguaaugauaa

SEQ ID NO: 2950032 - RNA, 15 nt, Human
auucaaacagucuca

SEQ ID NO: 2950033 - RNA, 14 nt, Human
auucaaacagucuc

SEQ ID NO: 2950034 - RNA, 21 nt, Human
auucaguuguuagugugucuu

SEQ ID NO: 2950035 - RNA, 16 nt, Human
auucaguuguuagugu

SEQ ID NO: 2950036 - RNA, 23 nt, Human
auucaggaagcucagggccuggc

SEQ ID NO: 2950037 - RNA, 22 nt, Human
auucaggaagcucagggccugg

SEQ ID NO: 2950038 - RNA, 21 nt, Human
auucaggaagcucagggccug

SEQ ID NO: 2950039 - RNA, 18 nt, Human
auucagcucugcaagaau

SEQ ID NO: 2950040 - RNA, 14 nt, Human
auucagcucugcaa

SEQ ID NO: 2950041 - RNA, 20 nt, Human
auuccccagauugcaacagg

SEQ ID NO: 2950042 - RNA, 22 nt, Human
auuccccacccugaaagcccug

SEQ ID NO: 2950043 - RNA, 16 nt, Human
auuccccaggaggcca

SEQ ID NO: 2950044 - RNA, 19 nt, Human
auuccccaggaggccagcc

SEQ ID NO: 2950045 - RNA, 20 nt, Human
auuccacuuauaggaauuga

SEQ ID NO: 2950046 - RNA, 17 nt, Human
auucucagcagagugcu

SEQ ID NO: 2950047 - RNA, 13 nt, Human
auugugccccugc

SEQ ID NO: 2950048 - RNA, 14 nt, Human
auuguauuacaaau

SEQ ID NO: 2950049 - RNA, 23 nt, Human
auuggcuuuggguugcaggaccu

SEQ ID NO: 2950050 - RNA, 17 nt, Human
auuuaaacacauuaaag

SEQ ID NO: 2950051 - RNA, 14 nt, Human
auuuaaaagagcag

SEQ ID NO: 2950052 - RNA, 17 nt, Human
auuuaaaagagcaggcc

SEQ ID NO: 2950053 - RNA, 18 nt, Human
auuuaaacacauuaaagg

SEQ ID NO: 2950054 - RNA, 19 nt, Human
auuuaaagcuuauuaaaac

SEQ ID NO: 2950055 - RNA, 15 nt, Human
auuuaacagaaaugu

SEQ ID NO: 2950056 - RNA, 16 nt, Human
auuuaacagaaaugua

SEQ ID NO: 2950057 - RNA, 17 nt, Human
auuuaacagaaauguac

SEQ ID NO: 2950058 - RNA, 19 nt, Human
auuuaacagaaauguacag

SEQ ID NO: 2950059 - RNA, 20 nt, Human
auuuaacagaaauguacagc

SEQ ID NO: 2950060 - RNA, 18 nt, Human
auuuaaccucuaaauucu

SEQ ID NO: 2950061 - RNA, 16 nt, Human
auuuaaccucuaaauu

SEQ ID NO: 2950062 - RNA, 19 nt, Human
auuuaauuuuuuugagaca

SEQ ID NO: 2950063 - RNA, 23 nt, Human
auuuaauuuuuuugagacagagu

SEQ ID NO: 2950064 - RNA, 15 nt, Human
auuuacaaauguuuu

SEQ ID NO: 2950065 - RNA, 16 nt, Human
auuuacaaaugggaaa

SEQ ID NO: 2950066 - RNA, 23 nt, Human
auugccauuucuuccacaagagc

SEQ ID NO: 2950067 - RNA, 17 nt, Human
auugcccacgcuggagu

SEQ ID NO: 2950068 - RNA, 21 nt, Human
auugcccacgcuggagugcag

SEQ ID NO: 2950069 - RNA, 16 nt, Human
auugcggacagccacg

SEQ ID NO: 2950070 - RNA, 18 nt, Human
auugcggacagccacggc

SEQ ID NO: 2950071 - RNA, 19 nt, Human
auugcggacagccacggcc

SEQ ID NO: 2950072 - RNA, 21 nt, Human
auugcaacaggcugggcuuca

SEQ ID NO: 2950073 - RNA, 13 nt, Human
auugaccugaggc

SEQ ID NO: 2950074 - RNA, 15 nt, Human
auugcaacaggcugg

SEQ ID NO: 2950075 - RNA, 21 nt, Human
auugacccacaagaaaugaaa

SEQ ID NO: 2950076 - RNA, 18 nt, Human
auugacaggauuauugga

SEQ ID NO: 2950077 - RNA, 19 nt, Human
auucucacagcuccaagaa

SEQ ID NO: 2950078 - RNA, 21 nt, Human
auucucacagcuccaagaauu

SEQ ID NO: 2950079 - RNA, 22 nt, Human
auucucacagcuccaagaauuu

SEQ ID NO: 2950080 - RNA, 14 nt, Human
auucucagaaucuc

SEQ ID NO: 2950081 - RNA, 19 nt, Human
auuccuaaaauuauggaaa

SEQ ID NO: 2950082 - RNA, 14 nt, Human
auuccuaaaauuau

SEQ ID NO: 2950083 - RNA, 13 nt, Human
auucuacuuugag

SEQ ID NO: 2950084 - RNA, 16 nt, Human
auucuacuuugagugc

SEQ ID NO: 2950085 - RNA, 16 nt, Human
auucucagcagagugc

SEQ ID NO: 2950086 - RNA, 16 nt, Human
auugacagauugaauu

SEQ ID NO: 2950087 - RNA, 20 nt, Human
auugacacuuaaaaaugguu

SEQ ID NO: 2950088 - RNA, 17 nt, Human
auucuccaccugccagg

SEQ ID NO: 2950089 - RNA, 16 nt, Human
auucuccaccugccag

SEQ ID NO: 2950090 - RNA, 18 nt, Human
auucucagaaucucaaau

SEQ ID NO: 2950091 - RNA, 20 nt, Human
auucucagaaucucaaauaa

SEQ ID NO: 2950092 - RNA, 13 nt, Human
auucuccaccugc

SEQ ID NO: 2950093 - RNA, 15 nt, Human
auucucagcagagug

SEQ ID NO: 2950094 - RNA, 14 nt, Human
auucucagcagagu

SEQ ID NO: 2950095 - RNA, 18 nt, Human
auucuccaccugccaggg

SEQ ID NO: 2950096 - RNA, 15 nt, Human
auuuuaauaauguuu

SEQ ID NO: 2950097 - RNA, 12 nt, Human
auuuuaauaaug

SEQ ID NO: 2950098 - RNA, 14 nt, Human
auuuuaauaauguu

SEQ ID NO: 2950099 - RNA, 15 nt, Human
auuuguaucacaaau

SEQ ID NO: 2950100 - RNA, 21 nt, Human
auuuguauaaaauaauuuuua

SEQ ID NO: 2950101 - RNA, 13 nt, Human
auuuuauuaugca

SEQ ID NO: 2950102 - RNA, 17 nt, Human
auuuuauuaugcaugaa

SEQ ID NO: 2950103 - RNA, 14 nt, Human
auuuuauuaugcau

SEQ ID NO: 2950104 - RNA, 15 nt, Human
auuuuauuaugcaug

SEQ ID NO: 2950105 - RNA, 13 nt, Human
auuuauuauggca

SEQ ID NO: 2950106 - RNA, 22 nt, Human
auuuauuacuguaagaaaauau

SEQ ID NO: 2950107 - RNA, 20 nt, Human
auuuauuaaaugcccagccc

SEQ ID NO: 2950108 - RNA, 21 nt, Human
auuucuaaaucuccaaaauaa

SEQ ID NO: 2950109 - RNA, 12 nt, Human
auuucuaaaucu

SEQ ID NO: 2950110 - RNA, 13 nt, Human
auuucuaaaucuc

SEQ ID NO: 2950111 - RNA, 14 nt, Human
auuuccugugucuu

SEQ ID NO: 2950112 - RNA, 23 nt, Human
auuuccugggagcuuuuguagaa

SEQ ID NO: 2950113 - RNA, 22 nt, Human
auuuccugggagcuuuuguaga

SEQ ID NO: 2950114 - RNA, 16 nt, Human
auuuauuauggcacau

SEQ ID NO: 2950115 - RNA, 17 nt, Human
auuuggugguuucagaa

SEQ ID NO: 2950116 - RNA, 23 nt, Human
auuugguaaggggaauugaggac

SEQ ID NO: 2950117 - RNA, 17 nt, Human
auuuggguuacuauuuc

SEQ ID NO: 2950118 - RNA, 18 nt, Human
auuuguaguguuggagaa

SEQ ID NO: 2950119 - RNA, 21 nt, Human
auuugguuuucacauuggaaa

SEQ ID NO: 2950120 - RNA, 22 nt, Human
auuugguuuucacauuggaaac

SEQ ID NO: 2950121 - RNA, 15 nt, Human
auuugguuuucacau

SEQ ID NO: 2950122 - RNA, 17 nt, Human
auuugguuuucacauug

SEQ ID NO: 2950123 - RNA, 18 nt, Human
auuuggugguuucagaaa

SEQ ID NO: 2950124 - RNA, 20 nt, Human
auuuggugguuucagaaaug

SEQ ID NO: 2950125 - RNA, 20 nt, Human
auuucuuuugccguuauuaa

SEQ ID NO: 2950126 - RNA, 16 nt, Human
auuugagcagggcuca

SEQ ID NO: 2950127 - RNA, 23 nt, Human
auuugaggucuguucuuuccaaa

SEQ ID NO: 2950128 - RNA, 17 nt, Human
auuugagcagggcucag

SEQ ID NO: 2950129 - RNA, 22 nt, Human
auuugaggucuguucuuuccaa

SEQ ID NO: 2950130 - RNA, 18 nt, Human
auuugagguuaagacaaa

SEQ ID NO: 2950131 - RNA, 23 nt, Human
auuucuuuugccguuauuaaaaa

SEQ ID NO: 2950132 - RNA, 21 nt, Human
auauauauuuuuuucugaaau

SEQ ID NO: 2950133 - RNA, 17 nt, Human
auauaacaaugcuguau

SEQ ID NO: 2950134 - RNA, 12 nt, Human
auauauaaccag

SEQ ID NO: 2950135 - RNA, 13 nt, Human
auauauaaccagu

SEQ ID NO: 2950136 - RNA, 19 nt, Human
auauauaacaaugcuguau

SEQ ID NO: 2950137 - RNA, 22 nt, Human
auaguuaagcgugcauaaguua

SEQ ID NO: 2950138 - RNA, 22 nt, Human
auaguuggcuaggaccccucca

SEQ ID NO: 2950139 - RNA, 20 nt, Human
auaguuguaccgcaauguga

SEQ ID NO: 2950140 - RNA, 15 nt, Human
auaguggugugauuu

SEQ ID NO: 2950141 - RNA, 17 nt, Human
auaguggcuuaaaacaa

SEQ ID NO: 2950142 - RNA, 13 nt, Human
uucacaguucucu

SEQ ID NO: 2950143 - RNA, 20 nt, Human
uucacaguucucuccuucuu

SEQ ID NO: 2950144 - RNA, 15 nt, Human
uucacaguucucucc

SEQ ID NO: 2950145 - RNA, 20 nt, Human
uucacagaugggugcuugga

SEQ ID NO: 2950146 - RNA, 22 nt, Human
uucacaagacccaaaaggcaga

SEQ ID NO: 2950147 - RNA, 23 nt, Human
uucacaagacccaaaaggcagaa

SEQ ID NO: 2950148 - RNA, 15 nt, Human
auagcuuuuuucucu

SEQ ID NO: 2950149 - RNA, 17 nt, Human
auaggaaaaacugauuu

SEQ ID NO: 2950150 - RNA, 16 nt, Human
auaggaaaaacugauu

SEQ ID NO: 2950151 - RNA, 14 nt, Human
auaggaaaaacuga

SEQ ID NO: 2950152 - RNA, 12 nt, Human
auaggaaaaacu

SEQ ID NO: 2950153 - RNA, 17 nt, Human
auaggcguaacuaauuu

SEQ ID NO: 2950154 - RNA, 22 nt, Human
auaggaauugacccacaagaaa

SEQ ID NO: 2950155 - RNA, 23 nt, Human
uucaagaaugcaguacuaacauu

SEQ ID NO: 2950156 - RNA, 23 nt, Human
uucaagaaguccccucuccucca

SEQ ID NO: 2950157 - RNA, 18 nt, Human
uucaaacagucucaggaa

SEQ ID NO: 2950158 - RNA, 21 nt, Human
uucaagcgauucuucugcuuc

SEQ ID NO: 2950159 - RNA, 18 nt, Human
uuauuuuuagacagaguc

SEQ ID NO: 2950160 - RNA, 17 nt, Human
uuauuuuuagacagagu

SEQ ID NO: 2950161 - RNA, 12 nt, Human
uucauacaaggc

SEQ ID NO: 2950162 - RNA, 18 nt, Human
uucagugccuuauggaac

SEQ ID NO: 2950163 - RNA, 13 nt, Human
uucagugccuuau

SEQ ID NO: 2950164 - RNA, 12 nt, Human
uucagugccuua

SEQ ID NO: 2950165 - RNA, 16 nt, Human
uucagugccaaaaaca

SEQ ID NO: 2950166 - RNA, 11 nt, Human
uucagaaaugu

SEQ ID NO: 2950167 - RNA, 13 nt, Human
uucagaaaugugu

SEQ ID NO: 2950168 - RNA, 13 nt, Human
uucauauuuaauu

SEQ ID NO: 2950169 - RNA, 17 nt, Human
uucaucccucuggggcu

SEQ ID NO: 2950170 - RNA, 21 nt, Human
uucaucccucuggggcuguuc

SEQ ID NO: 2950171 - RNA, 17 nt, Human
auauguaacaagccacc

SEQ ID NO: 2950172 - RNA, 16 nt, Human
auauguaacaagccac

SEQ ID NO: 2950173 - RNA, 16 nt, Human
auaugaugacuguuuu

SEQ ID NO: 2950174 - RNA, 13 nt, Human
auaugcacacauu

SEQ ID NO: 2950175 - RNA, 16 nt, Human
auaugcacacauuuuu

SEQ ID NO: 2950176 - RNA, 14 nt, Human
auaugcacacauuu

SEQ ID NO: 2950177 - RNA, 15 nt, Human
auaugcacacauuuu

SEQ ID NO: 2950178 - RNA, 16 nt, Human
auaucugaaaauguau

SEQ ID NO: 2950179 - RNA, 17 nt, Human
auaucugaaaauguaug

SEQ ID NO: 2950180 - RNA, 20 nt, Human
auaucugaaaauguaugugu

SEQ ID NO: 2950181 - RNA, 19 nt, Human
auaucuccgucaacucaua

SEQ ID NO: 2950182 - RNA, 20 nt, Human
auaucuccgucaacucauau

SEQ ID NO: 2950183 - RNA, 21 nt, Human
auaucuccgucaacucauauu

SEQ ID NO: 2950184 - RNA, 17 nt, Human
uuccaggggugggacac

SEQ ID NO: 2950185 - RNA, 18 nt, Human
uuccaccaucaagccacc

SEQ ID NO: 2950186 - RNA, 22 nt, Human
uuccacaagagcccaggccucc

SEQ ID NO: 2950187 - RNA, 19 nt, Human
uuccaccaucaagccacca

SEQ ID NO: 2950188 - RNA, 18 nt, Human
uucauuuaggugaggaag

SEQ ID NO: 2950189 - RNA, 15 nt, Human
uuccaaggguacuaa

SEQ ID NO: 2950190 - RNA, 17 nt, Human
uuccaaggguacuaagg

SEQ ID NO: 2950191 - RNA, 16 nt, Human
auauguggaguucauc

SEQ ID NO: 2950192 - RNA, 15 nt, Human
auauguggaguucau

SEQ ID NO: 2950193 - RNA, 23 nt, Human
uucccaaagcagugcaugcuguc

SEQ ID NO: 2950194 - RNA, 22 nt, Human
uuccagugaggcucugcccuug

SEQ ID NO: 2950195 - RNA, 21 nt, Human
uuccagugaggcucugcccuu

SEQ ID NO: 2950196 - RNA, 20 nt, Human
uuccagugaggcucugcccu

SEQ ID NO: 2950197 - RNA, 19 nt, Human
uuccagugaggcucugccc

SEQ ID NO: 2950198 - RNA, 17 nt, Human
uuccagugaggcucugc

SEQ ID NO: 2950199 - RNA, 21 nt, Human
uuccaggggugggacacccug

SEQ ID NO: 2950200 - RNA, 18 nt, Human
uucccaagcucugcuccu

SEQ ID NO: 2950201 - RNA, 22 nt, Human
uucccaccucucucacuccuug

SEQ ID NO: 2950202 - RNA, 12 nt, Human
uucccaccucuc

SEQ ID NO: 2950203 - RNA, 13 nt, Human
uucccaagcucug

SEQ ID NO: 2950204 - RNA, 14 nt, Human
uucccaagcucugc

SEQ ID NO: 2950205 - RNA, 15 nt, Human
uucccaagcucugcu

SEQ ID NO: 2950206 - RNA, 16 nt, Human
uucccaagcucugcuc

SEQ ID NO: 2950207 - RNA, 18 nt, Human
uucccaacuccagaaagu

SEQ ID NO: 2950208 - RNA, 12 nt, Human
uucccaaauuuc

SEQ ID NO: 2950209 - RNA, 14 nt, Human
uuccuucaagaaug

SEQ ID NO: 2950210 - RNA, 21 nt, Human
uuccuucaagaaugcaguacu

SEQ ID NO: 2950211 - RNA, 14 nt, Human
aucaaguuauuuuu

SEQ ID NO: 2950212 - RNA, 19 nt, Human
aucaaccccuucgcuccug

SEQ ID NO: 2950213 - RNA, 20 nt, Human
aucaaccccuucgcuccugu

SEQ ID NO: 2950214 - RNA, 22 nt, Human
aucaaccccuucgcuccugugu

SEQ ID NO: 2950215 - RNA, 20 nt, Human
aucaaauaugcaaagcacug

SEQ ID NO: 2950216 - RNA, 18 nt, Human
uucccuuuuuuggcugcu

SEQ ID NO: 2950217 - RNA, 20 nt, Human
uucccuuuuuuggcugcuga

SEQ ID NO: 2950218 - RNA, 19 nt, Human
uucccuuuuuuggcugcug

SEQ ID NO: 2950219 - RNA, 15 nt, Human
auauuuuacauaaau

SEQ ID NO: 2950220 - RNA, 16 nt, Human
auauuuuacauaaauu

SEQ ID NO: 2950221 - RNA, 20 nt, Human
auauuuuacauaaauuuagu

SEQ ID NO: 2950222 - RNA, 21 nt, Human
uucgcaggauucuuccucccu

SEQ ID NO: 2950223 - RNA, 22 nt, Human
uucuaaauaucccuuggacauu

SEQ ID NO: 2950224 - RNA, 19 nt, Human
uucuaaaucuccaaaauaa

SEQ ID NO: 2950225 - RNA, 13 nt, Human
uucgcuccugugu

SEQ ID NO: 2950226 - RNA, 17 nt, Human
uucuaaguaaaaccaca

SEQ ID NO: 2950227 - RNA, 20 nt, Human
uucuaaguaaaaccacagca

SEQ ID NO: 2950228 - RNA, 19 nt, Human
uucuaaguaaaaccacagc

SEQ ID NO: 2950229 - RNA, 13 nt, Human
aucaggccaggcc

SEQ ID NO: 2950230 - RNA, 13 nt, Human
uucucagcagagu

SEQ ID NO: 2950231 - RNA, 13 nt, Human
uucucagaaucuc

SEQ ID NO: 2950232 - RNA, 21 nt, Human
uucucacugccaugccagcuu

SEQ ID NO: 2950233 - RNA, 14 nt, Human
uucuauaauuuaaa

SEQ ID NO: 2950234 - RNA, 13 nt, Human
uucuauaauuuaa

SEQ ID NO: 2950235 - RNA, 21 nt, Human
uucuaaguaaaaccacagcag

SEQ ID NO: 2950236 - RNA, 20 nt, Human
uucuguuuuucuaggccugg

SEQ ID NO: 2950237 - RNA, 11 nt, Human
uucuguucuuu

SEQ ID NO: 2950238 - RNA, 18 nt, Human
uucuguucuuucuggcua

SEQ ID NO: 2950239 - RNA, 13 nt, Human
uucuuaauucuua

SEQ ID NO: 2950240 - RNA, 23 nt, Human
uucuuccucccucccucuuuccc

SEQ ID NO: 2950241 - RNA, 12 nt, Human
uucuuuuaagaa

SEQ ID NO: 2950242 - RNA, 14 nt, Human
uucuuuuaagaauc

SEQ ID NO: 2950243 - RNA, 22 nt, Human
uucuuucuggcuaugcauuuga

SEQ ID NO: 2950244 - RNA, 12 nt, Human
uucuugcaaagu

SEQ ID NO: 2950245 - RNA, 13 nt, Human
uucuugcaaagua

SEQ ID NO: 2950246 - RNA, 15 nt, Human
uucuuggcccaggau

SEQ ID NO: 2950247 - RNA, 21 nt, Human
auccuaagcuauucaguaaua

SEQ ID NO: 2950248 - RNA, 12 nt, Human
auccuaauaaaa

SEQ ID NO: 2950249 - RNA, 17 nt, Human
auccuaauaaaaaggug

SEQ ID NO: 2950250 - RNA, 16 nt, Human
auccuaauaaaaaggu

SEQ ID NO: 2950251 - RNA, 15 nt, Human
auccuaauaaaaagg

SEQ ID NO: 2950252 - RNA, 14 nt, Human
auccuaauaaaaag

SEQ ID NO: 2950253 - RNA, 23 nt, Human
uugaacauuuggguuacuauuuc

SEQ ID NO: 2950254 - RNA, 22 nt, Human
auccuaauaaaaaggugaccau

SEQ ID NO: 2950255 - RNA, 18 nt, Human
auccuaauaaaaagguga

SEQ ID NO: 2950256 - RNA, 20 nt, Human
auccuagucauucuucccua

SEQ ID NO: 2950257 - RNA, 13 nt, Human
auccuaguuccac

SEQ ID NO: 2950258 - RNA, 21 nt, Human
auccuaggcauuugcugaaua

SEQ ID NO: 2950259 - RNA, 17 nt, Human
uucuuuuaagaaucaau

SEQ ID NO: 2950260 - RNA, 15 nt, Human
uucuuuuugaaaugu

SEQ ID NO: 2950261 - RNA, 14 nt, Human
uucuuuuugaaaug

SEQ ID NO: 2950262 - RNA, 14 nt, Human
uugaaaugauuuca

SEQ ID NO: 2950263 - RNA, 21 nt, Human
uugaaauuuuuauuaaauuau

SEQ ID NO: 2950264 - RNA, 19 nt, Human
uugaaauauugacuuuuua

SEQ ID NO: 2950265 - RNA, 20 nt, Human
uugaaauauaggaacuuaaa

SEQ ID NO: 2950266 - RNA, 11 nt, Human
uugaaaucuuu

SEQ ID NO: 2950267 - RNA, 13 nt, Human
aucauuucaagaa

SEQ ID NO: 2950268 - RNA, 21 nt, Human
aucauugaaaucuuuuugcuu

SEQ ID NO: 2950269 - RNA, 20 nt, Human
aucaggccaggcccucugcc

SEQ ID NO: 2950270 - RNA, 20 nt, Human
aucauugaaaucuuuuugcu

SEQ ID NO: 2950271 - RNA, 23 nt, Human
aucaggccaggcccucugcccac

SEQ ID NO: 2950272 - RNA, 22 nt, Human
aucaggccaggcccucugccca

SEQ ID NO: 2950273 - RNA, 21 nt, Human
aucaggccaggcccucugccc

SEQ ID NO: 2950274 - RNA, 13 nt, Human
uucugccgcagcc

SEQ ID NO: 2950275 - RNA, 14 nt, Human
uucugacccaugcu

SEQ ID NO: 2950276 - RNA, 16 nt, Human
uucucuuuucaaaaca

SEQ ID NO: 2950277 - RNA, 23 nt, Human
uucucuacccaucuuaaaaacaa

SEQ ID NO: 2950278 - RNA, 17 nt, Human
uucucuacucuagggaa

SEQ ID NO: 2950279 - RNA, 16 nt, Human
uucuggcuaugcauuu

SEQ ID NO: 2950280 - RNA, 15 nt, Human
uucugccgcagcccu

SEQ ID NO: 2950281 - RNA, 14 nt, Human
uucugccgcagccc

SEQ ID NO: 2950282 - RNA, 18 nt, Human
uucuggcuaugcauuuga

SEQ ID NO: 2950283 - RNA, 20 nt, Human
uucuggcuaugcauuugaaa

SEQ ID NO: 2950284 - RNA, 14 nt, Human
auccauacauuugu

SEQ ID NO: 2950285 - RNA, 21 nt, Human
augagacuuuaaaagcauuuu

SEQ ID NO: 2950286 - RNA, 23 nt, Human
augagagacacacugaagaagca

SEQ ID NO: 2950287 - RNA, 20 nt, Human
augagagacacacugaagaa

SEQ ID NO: 2950288 - RNA, 21 nt, Human
augagagacacacugaagaag

SEQ ID NO: 2950289 - RNA, 21 nt, Human
uugugaggaagccgcuggggc

SEQ ID NO: 2950290 - RNA, 18 nt, Human
uugugauacaaugcugug

SEQ ID NO: 2950291 - RNA, 21 nt, Human
uuguucugaaaugucaguucu

SEQ ID NO: 2950292 - RNA, 23 nt, Human
uuguucugaaaugucaguucuga

SEQ ID NO: 2950293 - RNA, 22 nt, Human
uuguucuggcucuuccaggcug

SEQ ID NO: 2950294 - RNA, 20 nt, Human
uuguucuggcucuuccaggc

SEQ ID NO: 2950295 - RNA, 19 nt, Human
uuguucuggcucuuccagg

SEQ ID NO: 2950296 - RNA, 17 nt, Human
uuguguguuuauuguca

SEQ ID NO: 2950297 - RNA, 13 nt, Human
uugugguuaaucu

SEQ ID NO: 2950298 - RNA, 23 nt, Human
uugugugaaagguacuucaaauc

SEQ ID NO: 2950299 - RNA, 14 nt, Human
augcaccagcccuu

SEQ ID NO: 2950300 - RNA, 12 nt, Human
augcacuuuguu

SEQ ID NO: 2950301 - RNA, 13 nt, Human
augcaccagcccu

SEQ ID NO: 2950302 - RNA, 15 nt, Human
augcaaagcacugac

SEQ ID NO: 2950303 - RNA, 21 nt, Human
augauucaacagguuuuccug

SEQ ID NO: 2950304 - RNA, 21 nt, Human
augauucaaaugucuauaaac

SEQ ID NO: 2950305 - RNA, 13 nt, Human
augauuucacagu

SEQ ID NO: 2950306 - RNA, 12 nt, Human
augauucccagc

SEQ ID NO: 2950307 - RNA, 15 nt, Human
uuguugucugcaacu

SEQ ID NO: 2950308 - RNA, 19 nt, Human
augauuaaccacuucagcu

SEQ ID NO: 2950309 - RNA, 22 nt, Human
augauuaugaauuacauuugua

SEQ ID NO: 2950310 - RNA, 21 nt, Human
augauuaaccacuucagcuga

SEQ ID NO: 2950311 - RNA, 20 nt, Human
augauuaaccacuucagcug

SEQ ID NO: 2950312 - RNA, 12 nt, Human
uuuaauucaguu

SEQ ID NO: 2950313 - RNA, 17 nt, Human
uuuaagugcugcauuua

SEQ ID NO: 2950314 - RNA, 19 nt, Human
uuuaagugcugcauuuaaa

SEQ ID NO: 2950315 - RNA, 15 nt, Human
uuuaagugcugcauu

SEQ ID NO: 2950316 - RNA, 16 nt, Human
uuuaagugcugcauuu

SEQ ID NO: 2950317 - RNA, 14 nt, Human
uuuaagaggcaggg

SEQ ID NO: 2950318 - RNA, 14 nt, Human
uuguuuucauuauc

SEQ ID NO: 2950319 - RNA, 15 nt, Human
augcacuuuguucug

SEQ ID NO: 2950320 - RNA, 13 nt, Human
uuguuuucagugu

SEQ ID NO: 2950321 - RNA, 16 nt, Human
uuguuuucaguguaca

SEQ ID NO: 2950322 - RNA, 18 nt, Human
augcaguucugaagaaga

SEQ ID NO: 2950323 - RNA, 19 nt, Human
augcaguucugaagaagau

SEQ ID NO: 2950324 - RNA, 15 nt, Human
augccacuaaauuga

SEQ ID NO: 2950325 - RNA, 17 nt, Human
augccacuaaauugaca

SEQ ID NO: 2950326 - RNA, 17 nt, Human
augcagccucacagucc

SEQ ID NO: 2950327 - RNA, 15 nt, Human
augcagccucacagu

SEQ ID NO: 2950328 - RNA, 14 nt, Human
augcagccucacag

SEQ ID NO: 2950329 - RNA, 13 nt, Human
augcagccucaca

SEQ ID NO: 2950330 - RNA, 17 nt, Human
augcaguacaggacaua

SEQ ID NO: 2950331 - RNA, 19 nt, Human
augcaguacaggacauaua

SEQ ID NO: 2950332 - RNA, 20 nt, Human
augcaguacaggacauauau

SEQ ID NO: 2950333 - RNA, 13 nt, Human
augcagguuuuau

SEQ ID NO: 2950334 - RNA, 18 nt, Human
augcaguacuaacauuua

SEQ ID NO: 2950335 - RNA, 15 nt, Human
augcaguucugaaga

SEQ ID NO: 2950336 - RNA, 17 nt, Human
augcaguucugaagaag

SEQ ID NO: 2950337 - RNA, 14 nt, Human
auggacaugaucuu

SEQ ID NO: 2950338 - RNA, 17 nt, Human
auggaauacucuuauau

SEQ ID NO: 2950339 - RNA, 16 nt, Human
auggaauacucuuaua

SEQ ID NO: 2950340 - RNA, 16 nt, Human
auggaagacagcucuu

SEQ ID NO: 2950341 - RNA, 13 nt, Human
uuucagaaaugug

SEQ ID NO: 2950342 - RNA, 17 nt, Human
auggcacaucagcacga

SEQ ID NO: 2950343 - RNA, 23 nt, Human
auggcacaucagcacgauuucug

SEQ ID NO: 2950344 - RNA, 20 nt, Human
auggacguguuaugacucca

SEQ ID NO: 2950345 - RNA, 19 nt, Human
auggacguguuaugacucc

SEQ ID NO: 2950346 - RNA, 23 nt, Human
auggacguguuaugacuccagaa

SEQ ID NO: 2950347 - RNA, 18 nt, Human
auggauuuccagccaaag

SEQ ID NO: 2950348 - RNA, 21 nt, Human
auggccgggcgcgguggcuca

SEQ ID NO: 2950349 - RNA, 20 nt, Human
auggccuuugcuugaaagaa

SEQ ID NO: 2950350 - RNA, 20 nt, Human
auggcuaguaucaaaagaaa

SEQ ID NO: 2950351 - RNA, 15 nt, Human
augcuagaacucccu

SEQ ID NO: 2950352 - RNA, 16 nt, Human
augcuagaacucccuu

SEQ ID NO: 2950353 - RNA, 12 nt, Human
augcuguacaua

SEQ ID NO: 2950354 - RNA, 15 nt, Human
augcuguacauacuu

SEQ ID NO: 2950355 - RNA, 22 nt, Human
augcuguaacuuucugaaauaa

SEQ ID NO: 2950356 - RNA, 15 nt, Human
augcucugcauguua

SEQ ID NO: 2950357 - RNA, 11 nt, Human
auggaacacuc

SEQ ID NO: 2950358 - RNA, 15 nt, Human
auggaacacucugag

SEQ ID NO: 2950359 - RNA, 14 nt, Human
auggaacacucuga

SEQ ID NO: 2950360 - RNA, 15 nt, Human
auggaagacagcucu

SEQ ID NO: 2950361 - RNA, 16 nt, Human
auggaacacucugaga

SEQ ID NO: 2950362 - RNA, 16 nt, Human
augcuguacauacuuu

SEQ ID NO: 2950363 - RNA, 18 nt, Human
augcuguacauacuuuuu

SEQ ID NO: 2950364 - RNA, 19 nt, Human
augcugucccuuacgugag

SEQ ID NO: 2950365 - RNA, 22 nt, Human
augcugucuacacuaagagaga

SEQ ID NO: 2950366 - RNA, 23 nt, Human
augcugucccuuacgugaguccu

SEQ ID NO: 2950367 - RNA, 15 nt, Human
uuuaguagagacagg

SEQ ID NO: 2950368 - RNA, 22 nt, Human
uuuagcuggaaaaguauguuag

SEQ ID NO: 2950369 - RNA, 18 nt, Human
uuuagaugaaugucaguu

SEQ ID NO: 2950370 - RNA, 15 nt, Human
augcccccuguggau

SEQ ID NO: 2950371 - RNA, 19 nt, Human
augcccccuguggaugcug

SEQ ID NO: 2950372 - RNA, 22 nt, Human
uuuagaugaaugucaguuguua

SEQ ID NO: 2950373 - RNA, 20 nt, Human
uuuagcuggaaaaguauguu

SEQ ID NO: 2950374 - RNA, 24 nt, Human
uuuauggcuuuugugcauuaucua

SEQ ID NO: 2950375 - RNA, 20 nt, Human
uuuauggcuuuugugcauua

SEQ ID NO: 2950376 - RNA, 13 nt, Human
uuuauauaagcuu

SEQ ID NO: 2950377 - RNA, 23 nt, Human
aucugugaaaggaaagagggagg

SEQ ID NO: 2950378 - RNA, 19 nt, Human
aucuggguucacugcaacc

SEQ ID NO: 2950379 - RNA, 17 nt, Human
aucuggguucacugcaa

SEQ ID NO: 2950380 - RNA, 12 nt, Human
aucuguuacaca

SEQ ID NO: 2950381 - RNA, 18 nt, Human
aucuugaauuguaaggaa

SEQ ID NO: 2950382 - RNA, 17 nt, Human
aucuugcucugcugaca

SEQ ID NO: 2950383 - RNA, 19 nt, Human
aucuugcucugcugacaga

SEQ ID NO: 2950384 - RNA, 20 nt, Human
uugccuaauaugaugacugu

SEQ ID NO: 2950385 - RNA, 18 nt, Human
uugccgucuaccugaggg

SEQ ID NO: 2950386 - RNA, 15 nt, Human
uugccgucuaccuga

SEQ ID NO: 2950387 - RNA, 19 nt, Human
uugccgucuaccugagggg

SEQ ID NO: 2950388 - RNA, 14 nt, Human
uugccguuauuaaa

SEQ ID NO: 2950389 - RNA, 13 nt, Human
uugccgucuaccu

SEQ ID NO: 2950390 - RNA, 13 nt, Human
uugcccuguuaaa

SEQ ID NO: 2950391 - RNA, 19 nt, Human
auccuaguuccaccaucaa

SEQ ID NO: 2950392 - RNA, 15 nt, Human
auccuaguuccacca

SEQ ID NO: 2950393 - RNA, 16 nt, Human
aucucacacaugagca

SEQ ID NO: 2950394 - RNA, 13 nt, Human
aucucaauauuuc

SEQ ID NO: 2950395 - RNA, 15 nt, Human
aucucacacaugagc

SEQ ID NO: 2950396 - RNA, 13 nt, Human
aucucccccagcc

SEQ ID NO: 2950397 - RNA, 12 nt, Human
aucucccccagc

SEQ ID NO: 2950398 - RNA, 14 nt, Human
aucucauuuccaag

SEQ ID NO: 2950399 - RNA, 23 nt, Human
aucucauuuccaagcaaguauua

SEQ ID NO: 2950400 - RNA, 21 nt, Human
aucucauuuccaagcaaguau

SEQ ID NO: 2950401 - RNA, 23 nt, Human
uugcacauuaaaugacucuuccc

SEQ ID NO: 2950402 - RNA, 11 nt, Human
uugcacauuaa

SEQ ID NO: 2950403 - RNA, 21 nt, Human
uugcacacuuuggcccagggu

SEQ ID NO: 2950404 - RNA, 16 nt, Human
uugauucagacagcug

SEQ ID NO: 2950405 - RNA, 15 nt, Human
uugauucagacagcu

SEQ ID NO: 2950406 - RNA, 20 nt, Human
aucucuuaucuuacgaaaaa

SEQ ID NO: 2950407 - RNA, 18 nt, Human
aucucuuaucuuacgaaa

SEQ ID NO: 2950408 - RNA, 18 nt, Human
uugauggugguauguuuu

SEQ ID NO: 2950409 - RNA, 14 nt, Human
uugauucagacagc

SEQ ID NO: 2950410 - RNA, 22 nt, Human
uugauucaccuccuaaaacaac

SEQ ID NO: 2950411 - RNA, 20 nt, Human
uugauucaccuccuaaaaca

SEQ ID NO: 2950412 - RNA, 21 nt, Human
uugauucaccuccuaaaacaa

SEQ ID NO: 2950413 - RNA, 19 nt, Human
uugauggugguauguuuuc

SEQ ID NO: 2950414 - RNA, 18 nt, Human
augacacgaauauugcug

SEQ ID NO: 2950415 - RNA, 14 nt, Human
augacauucccugc

SEQ ID NO: 2950416 - RNA, 16 nt, Human
augacauugacuauuu

SEQ ID NO: 2950417 - RNA, 19 nt, Human
augacauugacuauuuuug

SEQ ID NO: 2950418 - RNA, 22 nt, Human
augacuuaagcacacuugacau

SEQ ID NO: 2950419 - RNA, 14 nt, Human
augacuuacuguac

SEQ ID NO: 2950420 - RNA, 20 nt, Human
augagaaacuggcaaagcag

SEQ ID NO: 2950421 - RNA, 22 nt, Human
augagaaacuggcaaagcagaa

SEQ ID NO: 2950422 - RNA, 18 nt, Human
augacuuggugucuaaug

SEQ ID NO: 2950423 - RNA, 23 nt, Human
augacuuggugucuaauguguag

SEQ ID NO: 2950424 - RNA, 16 nt, Human
augacuuacuguacau

SEQ ID NO: 2950425 - RNA, 17 nt, Human
augacuuacuguacaug

SEQ ID NO: 2950426 - RNA, 21 nt, Human
augagaaagguugaagcacca

SEQ ID NO: 2950427 - RNA, 22 nt, Human
augagaaagguugaagcaccaa

SEQ ID NO: 2950428 - RNA, 13 nt, Human
augagagacacac

SEQ ID NO: 2950429 - RNA, 14 nt, Human
augagagacacacu

SEQ ID NO: 2950430 - RNA, 17 nt, Human
augagagacacacugaa

SEQ ID NO: 2950431 - RNA, 19 nt, Human
augagagacacacugaaga

SEQ ID NO: 2950432 - RNA, 17 nt, Human
uuguauaaaauaauuuu

SEQ ID NO: 2950433 - RNA, 14 nt, Human
augacacaugcaag

SEQ ID NO: 2950434 - RNA, 22 nt, Human
augacacaugcaaggucauuuu

SEQ ID NO: 2950435 - RNA, 16 nt, Human
uuguaucacaaaucuu

SEQ ID NO: 2950436 - RNA, 18 nt, Human
uugguucuggacuaaaac

SEQ ID NO: 2950437 - RNA, 20 nt, Human
uugguucuggacuaaaacua

SEQ ID NO: 2950438 - RNA, 17 nt, Human
uugguugggaugacuug

SEQ ID NO: 2950439 - RNA, 21 nt, Human
uugguugguaacucuguaauu

SEQ ID NO: 2950440 - RNA, 16 nt, Human
uuguauaaaauaauuu

SEQ ID NO: 2950441 - RNA, 15 nt, Human
uuguauaaaauaauu

SEQ ID NO: 2950442 - RNA, 22 nt, Human
uuggggggcugaggugggagga

SEQ ID NO: 2950443 - RNA, 18 nt, Human
uuggggcucccagccagg

SEQ ID NO: 2950444 - RNA, 22 nt, Human
uuggggcucccagccaggcccu

SEQ ID NO: 2950445 - RNA, 13 nt, Human
uuggggcucccag

SEQ ID NO: 2950446 - RNA, 14 nt, Human
uuggggcucccagc

SEQ ID NO: 2950447 - RNA, 15 nt, Human
uuggggcucccagcc

SEQ ID NO: 2950448 - RNA, 14 nt, Human
uuggggauauuuuu

SEQ ID NO: 2950449 - RNA, 21 nt, Human
augaaugcccagugagacugu

SEQ ID NO: 2950450 - RNA, 13 nt, Human
augaaugcccagu

SEQ ID NO: 2950451 - RNA, 20 nt, Human
augaaugucagugugacuga

SEQ ID NO: 2950452 - RNA, 18 nt, Human
augaagauguagaggaga

SEQ ID NO: 2950453 - RNA, 13 nt, Human
augaaugaauggc

SEQ ID NO: 2950454 - RNA, 16 nt, Human
augaagauacugaaau

SEQ ID NO: 2950455 - RNA, 17 nt, Human
augaagauacugaaaua

SEQ ID NO: 2950456 - RNA, 15 nt, Human
augaagauacugaaa

SEQ ID NO: 2950457 - RNA, 18 nt, Human
augaaauauuauguuaaa

SEQ ID NO: 2950458 - RNA, 13 nt, Human
augaaauauuaug

SEQ ID NO: 2950459 - RNA, 17 nt, Human
augaaauauuauguuaa

SEQ ID NO: 2950460 - RNA, 18 nt, Human
uuggcuagagguucaaag

SEQ ID NO: 2950461 - RNA, 23 nt, Human
uuggcgcugccccuggcagcccc

SEQ ID NO: 2950462 - RNA, 22 nt, Human
uuggcgcugccccuggcagccc

SEQ ID NO: 2950463 - RNA, 18 nt, Human
aucuuugcagacaggcaa

SEQ ID NO: 2950464 - RNA, 12 nt, Human
augaaagauuca

SEQ ID NO: 2950465 - RNA, 15 nt, Human
augaaagcagggacu

SEQ ID NO: 2950466 - RNA, 13 nt, Human
aucuuuuucuaac

SEQ ID NO: 2950467 - RNA, 13 nt, Human
auaauguuucaaa

SEQ ID NO: 2950468 - RNA, 18 nt, Human
auaaggguaucuggugac

SEQ ID NO: 2950469 - RNA, 21 nt, Human
auaagccagacaucaacagau

SEQ ID NO: 2950470 - RNA, 22 nt, Human
auaagccagacaucaacagaua

SEQ ID NO: 2950471 - RNA, 14 nt, Human
auaagccagacauc

SEQ ID NO: 2950472 - RNA, 16 nt, Human
auaccugucccccuga

SEQ ID NO: 2950473 - RNA, 15 nt, Human
auaccugucccccug

SEQ ID NO: 2950474 - RNA, 14 nt, Human
auaccugucccccu

SEQ ID NO: 2950475 - RNA, 13 nt, Human
auaccuguccccc

SEQ ID NO: 2950476 - RNA, 13 nt, Human
auacccaccccca

SEQ ID NO: 2950477 - RNA, 16 nt, Human
auacccacccccaccc

SEQ ID NO: 2950478 - RNA, 14 nt, Human
auacccacccccac

SEQ ID NO: 2950479 - RNA, 19 nt, Human
auaccccaagacucccaug

SEQ ID NO: 2950480 - RNA, 17 nt, Human
auaccccaagacuccca

SEQ ID NO: 2950481 - RNA, 13 nt, Human
auacagaaaaguu

SEQ ID NO: 2950482 - RNA, 17 nt, Human
auacccacccccaccca

SEQ ID NO: 2950483 - RNA, 18 nt, Human
auaauguuucaaacauau

SEQ ID NO: 2950484 - RNA, 14 nt, Human
auacaaugcugugc

SEQ ID NO: 2950485 - RNA, 17 nt, Human
auacaaugcugugcccu

SEQ ID NO: 2950486 - RNA, 13 nt, Human
auacacuuacacu

SEQ ID NO: 2950487 - RNA, 22 nt, Human
auacacuuacacuuuaugcaca

SEQ ID NO: 2950488 - RNA, 21 nt, Human
auaacaaugcuguauuuuaaa

SEQ ID NO: 2950489 - RNA, 19 nt, Human
auaacaaugcuguauuuua

SEQ ID NO: 2950490 - RNA, 20 nt, Human
auaacaaugcuguauuuuaa

SEQ ID NO: 2950491 - RNA, 14 nt, Human
auaacaaugaaagu

SEQ ID NO: 2950492 - RNA, 15 nt, Human
auaacaaugcuguau

SEQ ID NO: 2950493 - RNA, 17 nt, Human
auaacaaugcuguauuu

SEQ ID NO: 2950494 - RNA, 12 nt, Human
auaacauguaau

SEQ ID NO: 2950495 - RNA, 13 nt, Human
auaacauguaauu

SEQ ID NO: 2950496 - RNA, 18 nt, Human
auaacauguaauuaagua

SEQ ID NO: 2950497 - RNA, 20 nt, Human
auaacauguaauuaaguacu

SEQ ID NO: 2950498 - RNA, 23 nt, Human
aguuugauuaaauucuugcaaag

SEQ ID NO: 2950499 - RNA, 11 nt, Human
aguuuggccag

SEQ ID NO: 2950500 - RNA, 22 nt, Human
aguuguuacauuuuuaagugcu

SEQ ID NO: 2950501 - RNA, 19 nt, Human
aguuguuacauuuuuaagu

SEQ ID NO: 2950502 - RNA, 20 nt, Human
aguuguuacauuuuuaagug

SEQ ID NO: 2950503 - RNA, 17 nt, Human
aguuugauuaaauucuu

SEQ ID NO: 2950504 - RNA, 18 nt, Human
aguuugauuaaauucuug

SEQ ID NO: 2950505 - RNA, 20 nt, Human
aguuugauuaaauucuugca

SEQ ID NO: 2950506 - RNA, 22 nt, Human
aguuugauuaaauucuugcaaa

SEQ ID NO: 2950507 - RNA, 19 nt, Human
aguuugagaucagccuggg

SEQ ID NO: 2950508 - RNA, 18 nt, Human
aguuugagaucagccugg

SEQ ID NO: 2950509 - RNA, 16 nt, Human
aguuugauuaaauucu

SEQ ID NO: 2950510 - RNA, 21 nt, Human
aguuugaauuccuaaaauuau

SEQ ID NO: 2950511 - RNA, 20 nt, Human
aguuugagaucagccugggc

SEQ ID NO: 2950512 - RNA, 24 nt, Human
auagguuuggacaaaauggaauac

SEQ ID NO: 2950513 - RNA, 18 nt, Human
auagguuuggacaaaaug

SEQ ID NO: 2950514 - RNA, 15 nt, Human
auagccuaggugaca

SEQ ID NO: 2950515 - RNA, 17 nt, Human
auagccuaggugacaga

SEQ ID NO: 2950516 - RNA, 17 nt, Human
auagaaaguugcaaggc

SEQ ID NO: 2950517 - RNA, 18 nt, Human
auagaaaguugcaaggca

SEQ ID NO: 2950518 - RNA, 23 nt, Human
auagaaaguugcaaggcaaaugu

SEQ ID NO: 2950519 - RNA, 15 nt, Human
auagcacagacccug

SEQ ID NO: 2950520 - RNA, 18 nt, Human
auagcacagacccugccc

SEQ ID NO: 2950521 - RNA, 17 nt, Human
auagcacagacccugcc

SEQ ID NO: 2950522 - RNA, 19 nt, Human
auagcauguccuaaugcuu

SEQ ID NO: 2950523 - RNA, 16 nt, Human
auagcauguccuaaug

SEQ ID NO: 2950524 - RNA, 22 nt, Human
auagcagcccucaauugugaaa

SEQ ID NO: 2950525 - RNA, 21 nt, Human
auagcagcccucaauugugaa

SEQ ID NO: 2950526 - RNA, 15 nt, Human
auagcagcuuauuca

SEQ ID NO: 2950527 - RNA, 18 nt, Human
auauauuuuuuaaaauaa

SEQ ID NO: 2950528 - RNA, 22 nt, Human
auauauuuuuuaaaauaagucu

SEQ ID NO: 2950529 - RNA, 18 nt, Human
auauauuuuuuucugaaa

SEQ ID NO: 2950530 - RNA, 17 nt, Human
auauucauucuuuuuga

SEQ ID NO: 2950531 - RNA, 23 nt, Human
auauuucagauaaucacaauaca

SEQ ID NO: 2950532 - RNA, 17 nt, Human
auauucaggaagcucag

SEQ ID NO: 2950533 - RNA, 19 nt, Human
auauucaggaagcucaggg

SEQ ID NO: 2950534 - RNA, 14 nt, Human
auauuauguuaaaa

SEQ ID NO: 2950535 - RNA, 22 nt, Human
auaugcacacauuuuuuaaaug

SEQ ID NO: 2950536 - RNA, 16 nt, Human
auaugcucugcauguu

SEQ ID NO: 2950537 - RNA, 17 nt, Human
auaugcucugcauguua

SEQ ID NO: 2950538 - RNA, 20 nt, Human
auaugcucugcauguuacau

SEQ ID NO: 2950539 - RNA, 13 nt, Human
auauuauguuaaa

SEQ ID NO: 2950540 - RNA, 17 nt, Human
agugaauguaggcuggc

SEQ ID NO: 2950541 - RNA, 16 nt, Human
agugaauguaggcugg

SEQ ID NO: 2950542 - RNA, 17 nt, Human
agucugaaggcuggguu

SEQ ID NO: 2950543 - RNA, 19 nt, Human
aguccuuaccagcagagca

SEQ ID NO: 2950544 - RNA, 22 nt, Human
aguccucuuuucugagaggacu

SEQ ID NO: 2950545 - RNA, 20 nt, Human
aguccuuaccagcagagcac

SEQ ID NO: 2950546 - RNA, 19 nt, Human
aguccucuuuucugagagg

SEQ ID NO: 2950547 - RNA, 15 nt, Human
aguacguugugcauu

SEQ ID NO: 2950548 - RNA, 14 nt, Human
aguacguugugcau

SEQ ID NO: 2950549 - RNA, 16 nt, Human
aggucuguucuuucca

SEQ ID NO: 2950550 - RNA, 13 nt, Human
aggucuguucuuu

SEQ ID NO: 2950551 - RNA, 15 nt, Human
aggucuguucuuucc

SEQ ID NO: 2950552 - RNA, 16 nt, Human
aguacuaacauuuauu

SEQ ID NO: 2950553 - RNA, 18 nt, Human
aguacguugugcauuugg

SEQ ID NO: 2950554 - RNA, 16 nt, Human
aguacguugugcauuu

SEQ ID NO: 2950555 - RNA, 17 nt, Human
aguacguugugcauuug

SEQ ID NO: 2950556 - RNA, 14 nt, Human
aguacuauaauuua

SEQ ID NO: 2950557 - RNA, 22 nt, Human
aguacuacaguccucccaucuc

SEQ ID NO: 2950558 - RNA, 19 nt, Human
aguacuacaguccucccau

SEQ ID NO: 2950559 - RNA, 17 nt, Human
aguacuucuccacccug

SEQ ID NO: 2950560 - RNA, 12 nt, Human
aguacuucuuuu

SEQ ID NO: 2950561 - RNA, 22 nt, Human
aguacuucuccacccugcucuc

SEQ ID NO: 2950562 - RNA, 12 nt, Human
aguacuauguau

SEQ ID NO: 2950563 - RNA, 14 nt, Human
aguacuauguauca

SEQ ID NO: 2950564 - RNA, 22 nt, Human
agucacacaguauuacuucugc

SEQ ID NO: 2950565 - RNA, 20 nt, Human
aguaugaggcauuuguuuga

SEQ ID NO: 2950566 - RNA, 21 nt, Human
aguaugaggcauuuguuugaa

SEQ ID NO: 2950567 - RNA, 17 nt, Human
aguauuuuguuucagug

SEQ ID NO: 2950568 - RNA, 23 nt, Human
aguaugaggcauuuguuugaacu

SEQ ID NO: 2950569 - RNA, 14 nt, Human
aguauuuuguuuca

SEQ ID NO: 2950570 - RNA, 17 nt, Human
aguaugaggcauuuguu

SEQ ID NO: 2950571 - RNA, 24 nt, Human
aguauuuuuuacauuuuacacacu

SEQ ID NO: 2950572 - RNA, 20 nt, Human
aguauuuuuuacauuuuaca

SEQ ID NO: 2950573 - RNA, 22 nt, Human
aguauuuuuuacauuuuacaca

SEQ ID NO: 2950574 - RNA, 15 nt, Human
aguauuuuuuacauu

SEQ ID NO: 2950575 - RNA, 18 nt, Human
aguauuuuuuacauuuua

SEQ ID NO: 2950576 - RNA, 19 nt, Human
aguauuuuuuacauuuuac

SEQ ID NO: 2950577 - RNA, 16 nt, Human
aguugauacuacaguu

SEQ ID NO: 2950578 - RNA, 18 nt, Human
aguugaaaagacuccaaa

SEQ ID NO: 2950579 - RNA, 14 nt, Human
aguugaaaagacuc

SEQ ID NO: 2950580 - RNA, 20 nt, Human
aguugaaaagacuccaaaga

SEQ ID NO: 2950581 - RNA, 19 nt, Human
aguugaaaagacuccaaag

SEQ ID NO: 2950582 - RNA, 18 nt, Human
aguucagguaacaggcag

SEQ ID NO: 2950583 - RNA, 13 nt, Human
aguucaucuugaa

SEQ ID NO: 2950584 - RNA, 19 nt, Human
aguucaucuugaauuguaa

SEQ ID NO: 2950585 - RNA, 15 nt, Human
aguucaucuugaauu

SEQ ID NO: 2950586 - RNA, 23 nt, Human
aguucagagcugcccucuccugg

SEQ ID NO: 2950587 - RNA, 21 nt, Human
aguucagagcugcccucuccu

SEQ ID NO: 2950588 - RNA, 22 nt, Human
aguucagagcugcccucuccug

SEQ ID NO: 2950589 - RNA, 20 nt, Human
aguucagagcugcccucucc

SEQ ID NO: 2950590 - RNA, 19 nt, Human
aguucagagcugcccucuc

SEQ ID NO: 2950591 - RNA, 14 nt, Human
agugauucuccugc

SEQ ID NO: 2950592 - RNA, 18 nt, Human
agugccuuacacaauggu

SEQ ID NO: 2950593 - RNA, 15 nt, Human
agugauucuccugcc

SEQ ID NO: 2950594 - RNA, 17 nt, Human
agugauucuccugccuc

SEQ ID NO: 2950595 - RNA, 14 nt, Human
agugauccucccac

SEQ ID NO: 2950596 - RNA, 15 nt, Human
agugauccucccacc

SEQ ID NO: 2950597 - RNA, 18 nt, Human
agugauccucccaccuca

SEQ ID NO: 2950598 - RNA, 23 nt, Human
agugauccucccaccucagccuc

SEQ ID NO: 2950599 - RNA, 24 nt, Human
agugauccucccaccucagccucc

SEQ ID NO: 2950600 - RNA, 15 nt, Human
agugccuuauggaac

SEQ ID NO: 2950601 - RNA, 14 nt, Human
agugccuuauggaa

SEQ ID NO: 2950602 - RNA, 13 nt, Human
agugccuuaugga

SEQ ID NO: 2950603 - RNA, 10 nt, Human
agugccuuau

SEQ ID NO: 2950604 - RNA, 16 nt, Human
agugccuuauggaaca

SEQ ID NO: 2950605 - RNA, 16 nt, Human
agugggagcugccugu

SEQ ID NO: 2950606 - RNA, 19 nt, Human
agugucaaugcagccccca

SEQ ID NO: 2950607 - RNA, 14 nt, Human
auguuugccucugc

SEQ ID NO: 2950608 - RNA, 15 nt, Human
auguuugccucugcc

SEQ ID NO: 2950609 - RNA, 17 nt, Human
auguuugccucugccuc

SEQ ID NO: 2950610 - RNA, 15 nt, Human
auguucugggacaca

SEQ ID NO: 2950611 - RNA, 17 nt, Human
auguucucugaggacac

SEQ ID NO: 2950612 - RNA, 14 nt, Human
auguucugggacac

SEQ ID NO: 2950613 - RNA, 13 nt, Human
auguucucugagg

SEQ ID NO: 2950614 - RNA, 17 nt, Human
auguucucucuucucca

SEQ ID NO: 2950615 - RNA, 17 nt, Human
auguuccuagugaaaga

SEQ ID NO: 2950616 - RNA, 16 nt, Human
auguucucucuucucc

SEQ ID NO: 2950617 - RNA, 16 nt, Human
auguuccuagugaaag

SEQ ID NO: 2950618 - RNA, 15 nt, Human
auguuccuagugaaa

SEQ ID NO: 2950619 - RNA, 13 nt, Human
auguguaaguauu

SEQ ID NO: 2950620 - RNA, 17 nt, Human
auguguaagacaaaaag

SEQ ID NO: 2950621 - RNA, 19 nt, Human
auguguaagacaaaaagcu

SEQ ID NO: 2950622 - RNA, 17 nt, Human
augucacaggcaggucc

SEQ ID NO: 2950623 - RNA, 19 nt, Human
augucacaggcagguccag

SEQ ID NO: 2950624 - RNA, 15 nt, Human
augugaacacaucag

SEQ ID NO: 2950625 - RNA, 23 nt, Human
auguaauuaaguacuauguauca

SEQ ID NO: 2950626 - RNA, 13 nt, Human
augucacaggcag

SEQ ID NO: 2950627 - RNA, 21 nt, Human
augucaaucagccuaguugau

SEQ ID NO: 2950628 - RNA, 16 nt, Human
augucaaucagccuag

SEQ ID NO: 2950629 - RNA, 13 nt, Human
augguagcauuuu

SEQ ID NO: 2950630 - RNA, 18 nt, Human
augguagcauuuuaaaca

SEQ ID NO: 2950631 - RNA, 23 nt, Human
augguagcauuuuaaacaaaaua

SEQ ID NO: 2950632 - RNA, 15 nt, Human
augguaguuuuacag

SEQ ID NO: 2950633 - RNA, 22 nt, Human
augguaguuuuacaguguuucu

SEQ ID NO: 2950634 - RNA, 21 nt, Human
augguaguuuuacaguguuuc

SEQ ID NO: 2950635 - RNA, 16 nt, Human
auggucccaucugcag

SEQ ID NO: 2950636 - RNA, 23 nt, Human
augggugcuuggaggaaggaaac

SEQ ID NO: 2950637 - RNA, 21 nt, Human
augggugcuuggaggaaggaa

SEQ ID NO: 2950638 - RNA, 20 nt, Human
augggugcuuggaggaagga

SEQ ID NO: 2950639 - RNA, 16 nt, Human
augcacacacauauau

SEQ ID NO: 2950640 - RNA, 15 nt, Human
augcacacacauaua

SEQ ID NO: 2950641 - RNA, 15 nt, Human
augcacacauuuuuu

SEQ ID NO: 2950642 - RNA, 13 nt, Human
augcacacauuuu

SEQ ID NO: 2950643 - RNA, 14 nt, Human
augcacacauuuuu

SEQ ID NO: 2950644 - RNA, 19 nt, Human
augcacagaguuguuacau

SEQ ID NO: 2950645 - RNA, 21 nt, Human
augcacagaguuguuacauuu

SEQ ID NO: 2950646 - RNA, 22 nt, Human
augcacagaguuguuacauuuu

SEQ ID NO: 2950647 - RNA, 20 nt, Human
augccuggauggggcugcac

SEQ ID NO: 2950648 - RNA, 19 nt, Human
augccuggauggggcugca

SEQ ID NO: 2950649 - RNA, 18 nt, Human
augcacaaacagaggccg

SEQ ID NO: 2950650 - RNA, 18 nt, Human
augaugaaaugaggucag

SEQ ID NO: 2950651 - RNA, 23 nt, Human
augaugaaaugaggucagagccu

SEQ ID NO: 2950652 - RNA, 21 nt, Human
augaugaucuuuaaaauacac

SEQ ID NO: 2950653 - RNA, 18 nt, Human
augaugaucuuuaaaaua

SEQ ID NO: 2950654 - RNA, 15 nt, Human
augaugauccuaggc

SEQ ID NO: 2950655 - RNA, 18 nt, Human
augaucuuugcagacagg

SEQ ID NO: 2950656 - RNA, 19 nt, Human
augaucuuugcagacaggc

SEQ ID NO: 2950657 - RNA, 21 nt, Human
augaucuuugcagacaggcaa

SEQ ID NO: 2950658 - RNA, 17 nt, Human
augaucuuugcagacag

SEQ ID NO: 2950659 - RNA, 16 nt, Human
augaucuuuaaaauac

SEQ ID NO: 2950660 - RNA, 16 nt, Human
augcugcccugugagu

SEQ ID NO: 2950661 - RNA, 15 nt, Human
augcugcccugugag

SEQ ID NO: 2950662 - RNA, 14 nt, Human
augcugcccuguga

SEQ ID NO: 2950663 - RNA, 12 nt, Human
augcugcccugu

SEQ ID NO: 2950664 - RNA, 13 nt, Human
augcugcccugug

SEQ ID NO: 2950665 - RNA, 16 nt, Human
augcuuguacauaaug

SEQ ID NO: 2950666 - RNA, 15 nt, Human
augcuuguacauaau

SEQ ID NO: 2950667 - RNA, 18 nt, Human
auggcuggagcuagaauu

SEQ ID NO: 2950668 - RNA, 18 nt, Human
auggcuuuugugcauuau

SEQ ID NO: 2950669 - RNA, 16 nt, Human
auggcuuuugugcauu

SEQ ID NO: 2950670 - RNA, 17 nt, Human
auggcuuuugugcauua

SEQ ID NO: 2950671 - RNA, 13 nt, Human
aucagcuuauugu

SEQ ID NO: 2950672 - RNA, 22 nt, Human
aucagcuugcccuguuaaaaga

SEQ ID NO: 2950673 - RNA, 16 nt, Human
aucaugucagucugcu

SEQ ID NO: 2950674 - RNA, 14 nt, Human
aucaugucuggcua

SEQ ID NO: 2950675 - RNA, 17 nt, Human
aucaugaauuaguuuua

SEQ ID NO: 2950676 - RNA, 24 nt, Human
aucaaaagguuaauaaaguaauua

SEQ ID NO: 2950677 - RNA, 23 nt, Human
aucaaagagguuuuaaaaaaauc

SEQ ID NO: 2950678 - RNA, 20 nt, Human
aucaaagagguuuuaaaaaa

SEQ ID NO: 2950679 - RNA, 20 nt, Human
aucaccaacgucugugccau

SEQ ID NO: 2950680 - RNA, 13 nt, Human
aucaccagacagg

SEQ ID NO: 2950681 - RNA, 13 nt, Human
aucacagccucug

SEQ ID NO: 2950682 - RNA, 14 nt, Human
aucaaauaugcaaa

SEQ ID NO: 2950683 - RNA, 17 nt, Human
auccucauacccacccc

SEQ ID NO: 2950684 - RNA, 21 nt, Human
aucgcuccaccuugcagcucu

SEQ ID NO: 2950685 - RNA, 17 nt, Human
aucgcuccaccuugcag

SEQ ID NO: 2950686 - RNA, 19 nt, Human
auccagacccggcugcgug

SEQ ID NO: 2950687 - RNA, 19 nt, Human
aucccaugagccucagcau

SEQ ID NO: 2950688 - RNA, 19 nt, Human
auccucaguuuuugugaaa

SEQ ID NO: 2950689 - RNA, 23 nt, Human
aucucugauucccugauuuaaua

SEQ ID NO: 2950690 - RNA, 20 nt, Human
aucuccgucaacucauauuu

SEQ ID NO: 2950691 - RNA, 12 nt, Human
aucuaguaguug

SEQ ID NO: 2950692 - RNA, 15 nt, Human
aucuaguaguuguuc

SEQ ID NO: 2950693 - RNA, 21 nt, Human
aucuaguaguuguucugaaau

SEQ ID NO: 2950694 - RNA, 17 nt, Human
augagggagaugccaug

SEQ ID NO: 2950695 - RNA, 16 nt, Human
augagggagaugccau

SEQ ID NO: 2950696 - RNA, 14 nt, Human
augacuguuuuuaa

SEQ ID NO: 2950697 - RNA, 13 nt, Human
augaggcauuugu

SEQ ID NO: 2950698 - RNA, 14 nt, Human
augaggcauuuguu

SEQ ID NO: 2950699 - RNA, 21 nt, Human
augaggcauuuguuugaacug

SEQ ID NO: 2950700 - RNA, 22 nt, Human
augaggcauuuguuugaacuga

SEQ ID NO: 2950701 - RNA, 20 nt, Human
augaaguccaagcauuuaga

SEQ ID NO: 2950702 - RNA, 23 nt, Human
augaaguccaagcauuuagaugu

SEQ ID NO: 2950703 - RNA, 13 nt, Human
augaaguacucau

SEQ ID NO: 2950704 - RNA, 21 nt, Human
augaaguacucauacauguua

SEQ ID NO: 2950705 - RNA, 14 nt, Human
augaaaacacauuu

SEQ ID NO: 2950706 - RNA, 15 nt, Human
augaaaacacauuuu

SEQ ID NO: 2950707 - RNA, 16 nt, Human
augaaaacacauuuuu

SEQ ID NO: 2950708 - RNA, 15 nt, Human
agcugaaccugggua

SEQ ID NO: 2950709 - RNA, 20 nt, Human
agcuccccucggagaagagc

SEQ ID NO: 2950710 - RNA, 19 nt, Human
agcuccccucggagaagag

SEQ ID NO: 2950711 - RNA, 17 nt, Human
agcuccccucggagaag

SEQ ID NO: 2950712 - RNA, 22 nt, Human
agcugguuuuuagcggagacgg

SEQ ID NO: 2950713 - RNA, 16 nt, Human
agcugguugagguuuc

SEQ ID NO: 2950714 - RNA, 19 nt, Human
agcugcugagauccuggac

SEQ ID NO: 2950715 - RNA, 18 nt, Human
agcuggucccacucaguc

SEQ ID NO: 2950716 - RNA, 13 nt, Human
agcugcugacagu

SEQ ID NO: 2950717 - RNA, 14 nt, Human
agcugcugacagug

SEQ ID NO: 2950718 - RNA, 16 nt, Human
agcuggucccacucag

SEQ ID NO: 2950719 - RNA, 17 nt, Human
agcuggucccacucagu

SEQ ID NO: 2950720 - RNA, 12 nt, Human
agcugcugacag

SEQ ID NO: 2950721 - RNA, 19 nt, Human
agcugcgguccacccagga

SEQ ID NO: 2950722 - RNA, 20 nt, Human
agcugcgguccacccaggag

SEQ ID NO: 2950723 - RNA, 13 nt, Human
agcugcgguccac

SEQ ID NO: 2950724 - RNA, 16 nt, Human
agcugcgguccaccca

SEQ ID NO: 2950725 - RNA, 17 nt, Human
agcugcgguccacccag

SEQ ID NO: 2950726 - RNA, 18 nt, Human
agcugcgguccacccagg

SEQ ID NO: 2950727 - RNA, 12 nt, Human
agcucagagagg

SEQ ID NO: 2950728 - RNA, 14 nt, Human
agcucagagagggu

SEQ ID NO: 2950729 - RNA, 18 nt, Human
agcucagagaggguggga

SEQ ID NO: 2950730 - RNA, 19 nt, Human
agcucaccagccccagugc

SEQ ID NO: 2950731 - RNA, 20 nt, Human
agcucaccagccccagugcc

SEQ ID NO: 2950732 - RNA, 15 nt, Human
agcucaccagcccca

SEQ ID NO: 2950733 - RNA, 12 nt, Human
agcucaccucuc

SEQ ID NO: 2950734 - RNA, 19 nt, Human
agcucaccucucccuugga

SEQ ID NO: 2950735 - RNA, 18 nt, Human
agcucaccucucccuugg

SEQ ID NO: 2950736 - RNA, 15 nt, Human
agcucaccucucccu

SEQ ID NO: 2950737 - RNA, 16 nt, Human
agcucaccagccccag

SEQ ID NO: 2950738 - RNA, 12 nt, Human
agccugggaggu

SEQ ID NO: 2950739 - RNA, 19 nt, Human
agcgagcccugguggcagu

SEQ ID NO: 2950740 - RNA, 13 nt, Human
agcgagcccuggu

SEQ ID NO: 2950741 - RNA, 17 nt, Human
agcgacagugagacucu

SEQ ID NO: 2950742 - RNA, 16 nt, Human
aggacccgucuccagc

SEQ ID NO: 2950743 - RNA, 15 nt, Human
aggagaggagagggg

SEQ ID NO: 2950744 - RNA, 20 nt, Human
agcugcugagauccuggacu

SEQ ID NO: 2950745 - RNA, 23 nt, Human
agcuuuguuuguugucagcugaa

SEQ ID NO: 2950746 - RNA, 22 nt, Human
agcuuuguuuguugucagcuga

SEQ ID NO: 2950747 - RNA, 19 nt, Human
agcuucauuuccugugucu

SEQ ID NO: 2950748 - RNA, 18 nt, Human
agcuucauuuccuguguc

SEQ ID NO: 2950749 - RNA, 20 nt, Human
agcuuauuuccucauuuuua

SEQ ID NO: 2950750 - RNA, 20 nt, Human
aggaacaaggcaaggcuguc

SEQ ID NO: 2950751 - RNA, 21 nt, Human
aggaacuuaaauaaugugaaa

SEQ ID NO: 2950752 - RNA, 23 nt, Human
aggaaccgagggggcugcuccca

SEQ ID NO: 2950753 - RNA, 12 nt, Human
aggaacaaggca

SEQ ID NO: 2950754 - RNA, 19 nt, Human
aggaacaaggcaaggcugu

SEQ ID NO: 2950755 - RNA, 17 nt, Human
aggaacaaggcaaggcu

SEQ ID NO: 2950756 - RNA, 16 nt, Human
aggaacaaggcaaggc

SEQ ID NO: 2950757 - RNA, 13 nt, Human
aggaacaaggcaa

SEQ ID NO: 2950758 - RNA, 22 nt, Human
aggaauaccugucccccugaca

SEQ ID NO: 2950759 - RNA, 18 nt, Human
aggaauaccugucccccu

SEQ ID NO: 2950760 - RNA, 15 nt, Human
aggaauaccuguccc

SEQ ID NO: 2950761 - RNA, 13 nt, Human
aggaaguagagga

SEQ ID NO: 2950762 - RNA, 15 nt, Human
agggauuagggagag

SEQ ID NO: 2950763 - RNA, 22 nt, Human
agggauuuucagcccucagaau

SEQ ID NO: 2950764 - RNA, 17 nt, Human
agggauuuucagcccuc

SEQ ID NO: 2950765 - RNA, 14 nt, Human
agggccugcaaggg

SEQ ID NO: 2950766 - RNA, 15 nt, Human
agggccugcaaggga

SEQ ID NO: 2950767 - RNA, 13 nt, Human
agggccuggccug

SEQ ID NO: 2950768 - RNA, 12 nt, Human
agggccuggccu

SEQ ID NO: 2950769 - RNA, 16 nt, Human
agggauacccauccca

SEQ ID NO: 2950770 - RNA, 22 nt, Human
aggggcccaaauucuuucagug

SEQ ID NO: 2950771 - RNA, 14 nt, Human
agggccuggccuga

SEQ ID NO: 2950772 - RNA, 21 nt, Human
aggguaucuggugacuuuccu

SEQ ID NO: 2950773 - RNA, 13 nt, Human
aggguauuccaga

SEQ ID NO: 2950774 - RNA, 14 nt, Human
agggucccuggugg

SEQ ID NO: 2950775 - RNA, 12 nt, Human
agggucccuggu

SEQ ID NO: 2950776 - RNA, 22 nt, Human
agggucccugguggcagcucac

SEQ ID NO: 2950777 - RNA, 20 nt, Human
agggucccugguggcagcuc

SEQ ID NO: 2950778 - RNA, 17 nt, Human
agggucccugguggcag

SEQ ID NO: 2950779 - RNA, 16 nt, Human
agggucccugguggca

SEQ ID NO: 2950780 - RNA, 22 nt, Human
aggguuuugccauguuggccag

SEQ ID NO: 2950781 - RNA, 23 nt, Human
aggguuuugccauguuggccagg

SEQ ID NO: 2950782 - RNA, 13 nt, Human
agguacucuccug

SEQ ID NO: 2950783 - RNA, 14 nt, Human
agguacucuccugg

SEQ ID NO: 2950784 - RNA, 22 nt, Human
agguacgaaaagaggggaagag

SEQ ID NO: 2950785 - RNA, 16 nt, Human
agguaacaggcagaua

SEQ ID NO: 2950786 - RNA, 13 nt, Human
agguaacaggcag

SEQ ID NO: 2950787 - RNA, 14 nt, Human
agguaacaggcaga

SEQ ID NO: 2950788 - RNA, 20 nt, Human
agggucucacuauguugccc

SEQ ID NO: 2950789 - RNA, 18 nt, Human
aggcauggacuucuggau

SEQ ID NO: 2950790 - RNA, 15 nt, Human
aggcagcagacacau

SEQ ID NO: 2950791 - RNA, 15 nt, Human
aggcaugguggccca

SEQ ID NO: 2950792 - RNA, 17 nt, Human
aggcaugugaugagagg

SEQ ID NO: 2950793 - RNA, 17 nt, Human
aggcauguucucugagg

SEQ ID NO: 2950794 - RNA, 21 nt, Human
aggcaugugaugagaggaaau

SEQ ID NO: 2950795 - RNA, 20 nt, Human
aggcaugugaugagaggaaa

SEQ ID NO: 2950796 - RNA, 19 nt, Human
aggcaugugaugagaggaa

SEQ ID NO: 2950797 - RNA, 18 nt, Human
aggcauguucucugagga

SEQ ID NO: 2950798 - RNA, 19 nt, Human
aggcauguucucugaggac

SEQ ID NO: 2950799 - RNA, 12 nt, Human
aggcauguucuc

SEQ ID NO: 2950800 - RNA, 17 nt, Human
aggcauuccccaggagg

SEQ ID NO: 2950801 - RNA, 18 nt, Human
aggcauuccccaggaggc

SEQ ID NO: 2950802 - RNA, 15 nt, Human
aggccaggcccucug

SEQ ID NO: 2950803 - RNA, 14 nt, Human
aggccaggcccucu

SEQ ID NO: 2950804 - RNA, 13 nt, Human
aggccaggcccuc

SEQ ID NO: 2950805 - RNA, 23 nt, Human
aggccagcugcuugggcuucauc

SEQ ID NO: 2950806 - RNA, 20 nt, Human
aggcauuccccaggaggcca

SEQ ID NO: 2950807 - RNA, 19 nt, Human
aggcauuccccaggaggcc

SEQ ID NO: 2950808 - RNA, 12 nt, Human
aggcccuucucu

SEQ ID NO: 2950809 - RNA, 19 nt, Human
aggcccuucucuccagccc

SEQ ID NO: 2950810 - RNA, 15 nt, Human
aggcccuucucucca

SEQ ID NO: 2950811 - RNA, 21 nt, Human
aggccaugggcacugugggua

SEQ ID NO: 2950812 - RNA, 21 nt, Human
aggcccucugcccacucccug

SEQ ID NO: 2950813 - RNA, 23 nt, Human
aggcccucugcccacucccugca

SEQ ID NO: 2950814 - RNA, 22 nt, Human
aggcccucugcccacucccugc

SEQ ID NO: 2950815 - RNA, 16 nt, Human
aggcugaggcaggaga

SEQ ID NO: 2950816 - RNA, 18 nt, Human
aggcugaggcaggagacu

SEQ ID NO: 2950817 - RNA, 16 nt, Human
aggcugaggcgggugg

SEQ ID NO: 2950818 - RNA, 18 nt, Human
aggcuggguucugauccu

SEQ ID NO: 2950819 - RNA, 13 nt, Human
aggcuaccuuugu

SEQ ID NO: 2950820 - RNA, 14 nt, Human
aggcuaccuuugua

SEQ ID NO: 2950821 - RNA, 15 nt, Human
aggcuaccuuuguau

SEQ ID NO: 2950822 - RNA, 20 nt, Human
aggcuguaucccaugagccu

SEQ ID NO: 2950823 - RNA, 21 nt, Human
aggcuguaucccaugagccuc

SEQ ID NO: 2950824 - RNA, 22 nt, Human
aggcuguaucccaugagccuca

SEQ ID NO: 2950825 - RNA, 24 nt, Human
aggcuuagacccucaugcugccaa

SEQ ID NO: 2950826 - RNA, 17 nt, Human
aggcuuagucacugaga

SEQ ID NO: 2950827 - RNA, 18 nt, Human
aggcuuagucacugagac

SEQ ID NO: 2950828 - RNA, 15 nt, Human
agggacugaggggag

SEQ ID NO: 2950829 - RNA, 15 nt, Human
agggacccuccacca

SEQ ID NO: 2950830 - RNA, 20 nt, Human
agacaaugacuuacuguaca

SEQ ID NO: 2950831 - RNA, 11 nt, Human
agacagagucu

SEQ ID NO: 2950832 - RNA, 13 nt, Human
agacagagcuaca

SEQ ID NO: 2950833 - RNA, 19 nt, Human
agacagagucucacuguug

SEQ ID NO: 2950834 - RNA, 20 nt, Human
agacagagucucacuguugc

SEQ ID NO: 2950835 - RNA, 15 nt, Human
agacagagcuacaca

SEQ ID NO: 2950836 - RNA, 21 nt, Human
agacaaugacuuacuguacau

SEQ ID NO: 2950837 - RNA, 22 nt, Human
agacaaugacuuacuguacaug

SEQ ID NO: 2950838 - RNA, 21 nt, Human
agacagagucucacuguugcc

SEQ ID NO: 2950839 - RNA, 22 nt, Human
agacagauacuccuccaagguu

SEQ ID NO: 2950840 - RNA, 15 nt, Human
agaccacguuucuaa

SEQ ID NO: 2950841 - RNA, 17 nt, Human
agacccaaaaggcagaa

SEQ ID NO: 2950842 - RNA, 19 nt, Human
agacccaaaaggcagaagc

SEQ ID NO: 2950843 - RNA, 17 nt, Human
agaaugagagacacacu

SEQ ID NO: 2950844 - RNA, 22 nt, Human
agaaugagagacacacugaaga

SEQ ID NO: 2950845 - RNA, 17 nt, Human
agaaugauuaugaauua

SEQ ID NO: 2950846 - RNA, 22 nt, Human
agaaugcacaaacagaggccgc

SEQ ID NO: 2950847 - RNA, 19 nt, Human
agaaugcacaaacagaggc

SEQ ID NO: 2950848 - RNA, 18 nt, Human
agaaugaaagggcccaga

SEQ ID NO: 2950849 - RNA, 22 nt, Human
agaagucacauuccugaacagg

SEQ ID NO: 2950850 - RNA, 21 nt, Human
agaagugaaaaucuacacucc

SEQ ID NO: 2950851 - RNA, 21 nt, Human
agaagucuucuauuuauuuau

SEQ ID NO: 2950852 - RNA, 21 nt, Human
agaagagauugugguuucauu

SEQ ID NO: 2950853 - RNA, 21 nt, Human
agaagagcuguucacagccag

SEQ ID NO: 2950854 - RNA, 22 nt, Human
agaagagcuguucacagccaga

SEQ ID NO: 2950855 - RNA, 21 nt, Human
acuuuccucuuuggucuacac

SEQ ID NO: 2950856 - RNA, 13 nt, Human
agaagacacugau

SEQ ID NO: 2950857 - RNA, 21 nt, Human
agaagacacugaugggcaacc

SEQ ID NO: 2950858 - RNA, 20 nt, Human
agaagucacauuccugaaca

SEQ ID NO: 2950859 - RNA, 21 nt, Human
agaagucacauuccugaacag

SEQ ID NO: 2950860 - RNA, 18 nt, Human
agaagucacauuccugaa

SEQ ID NO: 2950861 - RNA, 14 nt, Human
agaaguaacuuacu

SEQ ID NO: 2950862 - RNA, 13 nt, Human
agagcccaccuug

SEQ ID NO: 2950863 - RNA, 13 nt, Human
agagccagggucu

SEQ ID NO: 2950864 - RNA, 16 nt, Human
agagagaccacuuuuc

SEQ ID NO: 2950865 - RNA, 16 nt, Human
agacuggauaguccgu

SEQ ID NO: 2950866 - RNA, 18 nt, Human
agacucugucucaaaaaa

SEQ ID NO: 2950867 - RNA, 13 nt, Human
agacucugucuca

SEQ ID NO: 2950868 - RNA, 22 nt, Human
agacugaguacguugugcauuu

SEQ ID NO: 2950869 - RNA, 18 nt, Human
agacucugucucagucca

SEQ ID NO: 2950870 - RNA, 20 nt, Human
agacugaguacguugugcau

SEQ ID NO: 2950871 - RNA, 16 nt, Human
agacgcugugcugccc

SEQ ID NO: 2950872 - RNA, 14 nt, Human
agaggacuuuucuu

SEQ ID NO: 2950873 - RNA, 21 nt, Human
agaggacuuuucuuuguggcu

SEQ ID NO: 2950874 - RNA, 22 nt, Human
agaggacuuuucuuuguggcuu

SEQ ID NO: 2950875 - RNA, 19 nt, Human
agaggggguggccucccaa

SEQ ID NO: 2950876 - RNA, 17 nt, Human
agaggggguggccuccc

SEQ ID NO: 2950877 - RNA, 16 nt, Human
agagggccugcaaggg

SEQ ID NO: 2950878 - RNA, 13 nt, Human
agagggccugcaa

SEQ ID NO: 2950879 - RNA, 13 nt, Human
agaggaaugaagu

SEQ ID NO: 2950880 - RNA, 19 nt, Human
agauguagaggagaaacug

SEQ ID NO: 2950881 - RNA, 16 nt, Human
agauguagaggagaaa

SEQ ID NO: 2950882 - RNA, 22 nt, Human
agauucuuguauuuauuacaac

SEQ ID NO: 2950883 - RNA, 14 nt, Human
agaugagugagcau

SEQ ID NO: 2950884 - RNA, 16 nt, Human
agaguggaauaagaca

SEQ ID NO: 2950885 - RNA, 14 nt, Human
agaugaaggucugu

SEQ ID NO: 2950886 - RNA, 17 nt, Human
agaugaaggucuguuuu

SEQ ID NO: 2950887 - RNA, 23 nt, Human
agcaaaauuuuuucucuaggaaa

SEQ ID NO: 2950888 - RNA, 18 nt, Human
agcaaaagaugcuucuca

SEQ ID NO: 2950889 - RNA, 24 nt, Human
agcaaaauuuuuucucuaggaaau

SEQ ID NO: 2950890 - RNA, 18 nt, Human
agauucuuuccugaggcu

SEQ ID NO: 2950891 - RNA, 21 nt, Human
agauucuuuccugaggcuggg

SEQ ID NO: 2950892 - RNA, 19 nt, Human
agauucuuuccugaggcug

SEQ ID NO: 2950893 - RNA, 23 nt, Human
agauugcaacaggcugggcuuca

SEQ ID NO: 2950894 - RNA, 20 nt, Human
agauugcaacaggcugggcu

SEQ ID NO: 2950895 - RNA, 21 nt, Human
agauugcaacaggcugggcuu

SEQ ID NO: 2950896 - RNA, 20 nt, Human
agcaaaggagauuggaagga

SEQ ID NO: 2950897 - RNA, 17 nt, Human
agcaauuaugaaaauaa

SEQ ID NO: 2950898 - RNA, 15 nt, Human
agcaauuaugaaaau

SEQ ID NO: 2950899 - RNA, 12 nt, Human
agcacagacccu

SEQ ID NO: 2950900 - RNA, 15 nt, Human
agcacagacccugcc

SEQ ID NO: 2950901 - RNA, 14 nt, Human
agcacagacccugc

SEQ ID NO: 2950902 - RNA, 16 nt, Human
agcacagacccugccc

SEQ ID NO: 2950903 - RNA, 17 nt, Human
agcacgauuucuguuua

SEQ ID NO: 2950904 - RNA, 19 nt, Human
agcacgauuucuguuuaga

SEQ ID NO: 2950905 - RNA, 21 nt, Human
agcacgauuucuguuuagaua

SEQ ID NO: 2950906 - RNA, 16 nt, Human
agccaaagcuaggccu

SEQ ID NO: 2950907 - RNA, 14 nt, Human
agcauccuggcacc

SEQ ID NO: 2950908 - RNA, 17 nt, Human
agcauccuggcacccgg

SEQ ID NO: 2950909 - RNA, 15 nt, Human
agccagaggagagag

SEQ ID NO: 2950910 - RNA, 13 nt, Human
agccagaggagag

SEQ ID NO: 2950911 - RNA, 14 nt, Human
agccagcaggcucu

SEQ ID NO: 2950912 - RNA, 18 nt, Human
agccagaggagagaggac

SEQ ID NO: 2950913 - RNA, 17 nt, Human
agccagaggagagagga

SEQ ID NO: 2950914 - RNA, 23 nt, Human
agcccacgcccccacuggugaca

SEQ ID NO: 2950915 - RNA, 20 nt, Human
agcccacgcccccacuggug

SEQ ID NO: 2950916 - RNA, 14 nt, Human
agcccacgccccca

SEQ ID NO: 2950917 - RNA, 16 nt, Human
agcccaccuuggcuca

SEQ ID NO: 2950918 - RNA, 14 nt, Human
agcccaccuuggcu

SEQ ID NO: 2950919 - RNA, 15 nt, Human
agcccaccccucaac

SEQ ID NO: 2950920 - RNA, 16 nt, Human
agccagcaggcucuca

SEQ ID NO: 2950921 - RNA, 13 nt, Human
agcauccuggcac

SEQ ID NO: 2950922 - RNA, 13 nt, Human
agccccacagccc

SEQ ID NO: 2950923 - RNA, 21 nt, Human
agcccgggcucugccucccau

SEQ ID NO: 2950924 - RNA, 20 nt, Human
agcccgggcucugccuccca

SEQ ID NO: 2950925 - RNA, 18 nt, Human
agcccgggcucugccucc

SEQ ID NO: 2950926 - RNA, 17 nt, Human
agcccgggcucugccuc

SEQ ID NO: 2950927 - RNA, 15 nt, Human
agccccauccucugu

SEQ ID NO: 2950928 - RNA, 23 nt, Human
agccccauccucuguacagagcc

SEQ ID NO: 2950929 - RNA, 17 nt, Human
agccccauccucuguac

SEQ ID NO: 2950930 - RNA, 17 nt, Human
agccccauucugccugc

SEQ ID NO: 2950931 - RNA, 18 nt, Human
agccccauucugccugcc

SEQ ID NO: 2950932 - RNA, 19 nt, Human
agccccauucugccugccc

SEQ ID NO: 2950933 - RNA, 15 nt, Human
aagggauuuucagcc

SEQ ID NO: 2950934 - RNA, 17 nt, Human
aagggauggcaagaugu

SEQ ID NO: 2950935 - RNA, 14 nt, Human
aagggauggcaaga

SEQ ID NO: 2950936 - RNA, 23 nt, Human
aagggauuuucagcccucagaau

SEQ ID NO: 2950937 - RNA, 21 nt, Human
aagggauuuucagcccucaga

SEQ ID NO: 2950938 - RNA, 20 nt, Human
aagggacuuggaagcuccgc

SEQ ID NO: 2950939 - RNA, 18 nt, Human
aagggacgcuacccggga

SEQ ID NO: 2950940 - RNA, 19 nt, Human
aaggucuguuuuguguacu

SEQ ID NO: 2950941 - RNA, 20 nt, Human
aaggucuguuuuguguacuu

SEQ ID NO: 2950942 - RNA, 23 nt, Human
aaggucuguuuuguguacuuuua

SEQ ID NO: 2950943 - RNA, 12 nt, Human
aaguagaggagg

SEQ ID NO: 2950944 - RNA, 21 nt, Human
aagcgugagccacugcaccgg

SEQ ID NO: 2950945 - RNA, 17 nt, Human
aagcgugagccacugca

SEQ ID NO: 2950946 - RNA, 20 nt, Human
aagcgugagccacugcaccg

SEQ ID NO: 2950947 - RNA, 14 nt, Human
aagcugcugacagu

SEQ ID NO: 2950948 - RNA, 22 nt, Human
aagcugccagccgagauagcca

SEQ ID NO: 2950949 - RNA, 12 nt, Human
aagcugccagcc

SEQ ID NO: 2950950 - RNA, 11 nt, Human
aagcugccagc

SEQ ID NO: 2950951 - RNA, 16 nt, Human
aagcugcugacagugu

SEQ ID NO: 2950952 - RNA, 23 nt, Human
aaggaaugauuaauuaaaacaca

SEQ ID NO: 2950953 - RNA, 15 nt, Human
aaggaaugcaaagau

SEQ ID NO: 2950954 - RNA, 16 nt, Human
aaggaaugcaaagaug

SEQ ID NO: 2950955 - RNA, 15 nt, Human
aagcgauucuucugc

SEQ ID NO: 2950956 - RNA, 14 nt, Human
aagcgauucuucug

SEQ ID NO: 2950957 - RNA, 16 nt, Human
aagcgugagccacugc

SEQ ID NO: 2950958 - RNA, 16 nt, Human
aagcgauucuucugcu

SEQ ID NO: 2950959 - RNA, 15 nt, Human
aagccagcaggcucu

SEQ ID NO: 2950960 - RNA, 18 nt, Human
aagccagcaggcucucag

SEQ ID NO: 2950961 - RNA, 21 nt, Human
aagccaccaacauacucccau

SEQ ID NO: 2950962 - RNA, 19 nt, Human
aagccagauuuuccugaaa

SEQ ID NO: 2950963 - RNA, 16 nt, Human
aagacuuuggaaagag

SEQ ID NO: 2950964 - RNA, 23 nt, Human
aagacagugaaagaaaauaacaa

SEQ ID NO: 2950965 - RNA, 13 nt, Human
aacuguuuagaug

SEQ ID NO: 2950966 - RNA, 15 nt, Human
aagagaacuuccaga

SEQ ID NO: 2950967 - RNA, 17 nt, Human
aagacuuugguuauuuu

SEQ ID NO: 2950968 - RNA, 23 nt, Human
aagacuuugguuauuuuacuuuu

SEQ ID NO: 2950969 - RNA, 13 nt, Human
aagacuuugguua

SEQ ID NO: 2950970 - RNA, 15 nt, Human
aagacuuugguuauu

SEQ ID NO: 2950971 - RNA, 14 nt, Human
aagauacugaaaua

SEQ ID NO: 2950972 - RNA, 16 nt, Human
aagauacugaaauaaa

SEQ ID NO: 2950973 - RNA, 20 nt, Human
aagauacugaaauaaacguc

SEQ ID NO: 2950974 - RNA, 22 nt, Human
aagauucuauguuaauauuuua

SEQ ID NO: 2950975 - RNA, 21 nt, Human
aagauucuauguuaauauuuu

SEQ ID NO: 2950976 - RNA, 20 nt, Human
aagauucauauuuacuucuu

SEQ ID NO: 2950977 - RNA, 20 nt, Human
aagauucaaugccccugaau

SEQ ID NO: 2950978 - RNA, 21 nt, Human
aagauucaaugccccugaauu

SEQ ID NO: 2950979 - RNA, 19 nt, Human
aagauuuugaaauuuuuau

SEQ ID NO: 2950980 - RNA, 20 nt, Human
aagcagaguggcagucuuca

SEQ ID NO: 2950981 - RNA, 19 nt, Human
aagccaccaacauacuccc

SEQ ID NO: 2950982 - RNA, 11 nt, Human
aagcagagugg

SEQ ID NO: 2950983 - RNA, 14 nt, Human
aagcagaguggcag

SEQ ID NO: 2950984 - RNA, 15 nt, Human
aagcagggacuugaa

SEQ ID NO: 2950985 - RNA, 21 nt, Human
aagcagaggaaggagaggaga

SEQ ID NO: 2950986 - RNA, 14 nt, Human
aagcagaaugugau

SEQ ID NO: 2950987 - RNA, 10 nt, Human
aagcagagug

SEQ ID NO: 2950988 - RNA, 12 nt, Human
aaguauagaaaa

SEQ ID NO: 2950989 - RNA, 16 nt, Human
aaguauagaaaaucuu

SEQ ID NO: 2950990 - RNA, 18 nt, Human
aaguauagaaaaucuuca

SEQ ID NO: 2950991 - RNA, 19 nt, Human
aaguauagaaaaucuucau

SEQ ID NO: 2950992 - RNA, 14 nt, Human
aagugcugcauuua

SEQ ID NO: 2950993 - RNA, 13 nt, Human
aagugcugcauuu

SEQ ID NO: 2950994 - RNA, 22 nt, Human
aaguugauaugccuuuucccaa

SEQ ID NO: 2950995 - RNA, 17 nt, Human
aaguucugcagauaaac

SEQ ID NO: 2950996 - RNA, 15 nt, Human
aauaaacgucuuaaa

SEQ ID NO: 2950997 - RNA, 10 nt, Human
aauaaaccau

SEQ ID NO: 2950998 - RNA, 17 nt, Human
aauaaaauuuuaguuga

SEQ ID NO: 2950999 - RNA, 12 nt, Human
aauaauguuuca

SEQ ID NO: 2951000 - RNA, 14 nt, Human
aauaauguuucaaa

SEQ ID NO: 2951001 - RNA, 19 nt, Human
aauagaaaguugcaaggca

SEQ ID NO: 2951002 - RNA, 13 nt, Human
aauauaaaaauaa

SEQ ID NO: 2951003 - RNA, 21 nt, Human
aauaccugucccccugacaac

SEQ ID NO: 2951004 - RNA, 19 nt, Human
aauacgugggcauucaaau

SEQ ID NO: 2951005 - RNA, 20 nt, Human
aauacgugggcauucaaaug

SEQ ID NO: 2951006 - RNA, 16 nt, Human
aauauaggaacuuaaa

SEQ ID NO: 2951007 - RNA, 21 nt, Human
aaugcgugcauaccacuuuug

SEQ ID NO: 2951008 - RNA, 23 nt, Human
aaugcgugcauaccacuuuuguu

SEQ ID NO: 2951009 - RNA, 13 nt, Human
aaugggacacuaa

SEQ ID NO: 2951010 - RNA, 14 nt, Human
aaugggagcucaug

SEQ ID NO: 2951011 - RNA, 23 nt, Human
aaugcucuuuacuucauggacuu

SEQ ID NO: 2951012 - RNA, 15 nt, Human
aaugucacaggcagg

SEQ ID NO: 2951013 - RNA, 15 nt, Human
aaugggggugcauuu

SEQ ID NO: 2951014 - RNA, 17 nt, Human
aaugggggugcauuuga

SEQ ID NO: 2951015 - RNA, 18 nt, Human
aaucuccaaaauaaaacu

SEQ ID NO: 2951016 - RNA, 15 nt, Human
aauccaaugaaauga

SEQ ID NO: 2951017 - RNA, 16 nt, Human
aauccauacauuugug

SEQ ID NO: 2951018 - RNA, 14 nt, Human
aauccauacauuug

SEQ ID NO: 2951019 - RNA, 17 nt, Human
aauccauacauuugugu

SEQ ID NO: 2951020 - RNA, 15 nt, Human
aaugauagcuacugu

SEQ ID NO: 2951021 - RNA, 13 nt, Human
aaugauuaauuaa

SEQ ID NO: 2951022 - RNA, 12 nt, Human
aaugauuaauua

SEQ ID NO: 2951023 - RNA, 15 nt, Human
aaugauaacuggaaa

SEQ ID NO: 2951024 - RNA, 16 nt, Human
aaugauaacuggaaac

SEQ ID NO: 2951025 - RNA, 14 nt, Human
aaugauaacuggaa

SEQ ID NO: 2951026 - RNA, 22 nt, Human
aaucauuucugcaucagcugcu

SEQ ID NO: 2951027 - RNA, 22 nt, Human
aaucaaauaugcaaagcacuga

SEQ ID NO: 2951028 - RNA, 16 nt, Human
aaucaaauaugcaaag

SEQ ID NO: 2951029 - RNA, 15 nt, Human
aaucaaauaugcaaa

SEQ ID NO: 2951030 - RNA, 17 nt, Human
aacucaaacucuuaaaa

SEQ ID NO: 2951031 - RNA, 17 nt, Human
aacucaccccagcccca

SEQ ID NO: 2951032 - RNA, 16 nt, Human
aacucaccccagcccc

SEQ ID NO: 2951033 - RNA, 18 nt, Human
aacucaccccagccccaa

SEQ ID NO: 2951034 - RNA, 15 nt, Human
aacucaccccagccc

SEQ ID NO: 2951035 - RNA, 18 nt, Human
aacugaaguucuauuuau

SEQ ID NO: 2951036 - RNA, 18 nt, Human
aacucauauuuucaugcu

SEQ ID NO: 2951037 - RNA, 15 nt, Human
aacucauauuuucau

SEQ ID NO: 2951038 - RNA, 16 nt, Human
aacucauauuuucaug

SEQ ID NO: 2951039 - RNA, 23 nt, Human
aacugagaugugaacacaucagc

SEQ ID NO: 2951040 - RNA, 14 nt, Human
aacgaaagaaggca

SEQ ID NO: 2951041 - RNA, 22 nt, Human
aacaugcuacacacugcauguu

SEQ ID NO: 2951042 - RNA, 21 nt, Human
aacaugcuguacauacuuuuu

SEQ ID NO: 2951043 - RNA, 18 nt, Human
aacaugcuguacauacuu

SEQ ID NO: 2951044 - RNA, 19 nt, Human
aacaugcuguacauacuuu

SEQ ID NO: 2951045 - RNA, 20 nt, Human
aacaugcuguacauacuuuu

SEQ ID NO: 2951046 - RNA, 15 nt, Human
aacauggaaguacua

SEQ ID NO: 2951047 - RNA, 13 nt, Human
aacccuucagugc

SEQ ID NO: 2951048 - RNA, 19 nt, Human
aaccaguguuguggauuua

SEQ ID NO: 2951049 - RNA, 17 nt, Human
aaccaguguuguggauu

SEQ ID NO: 2951050 - RNA, 19 nt, Human
aaccgagggggcugcuccc

SEQ ID NO: 2951051 - RNA, 20 nt, Human
aaccgagggggcugcuccca

SEQ ID NO: 2951052 - RNA, 21 nt, Human
aaccgagggggcugcucccac

SEQ ID NO: 2951053 - RNA, 17 nt, Human
aacagcaacacaaagcu

SEQ ID NO: 2951054 - RNA, 18 nt, Human
aacagcaacacaaagcuu

SEQ ID NO: 2951055 - RNA, 16 nt, Human
aacagcuaaugggaca

SEQ ID NO: 2951056 - RNA, 12 nt, Human
aaauuaacuuuu

SEQ ID NO: 2951057 - RNA, 22 nt, Human
aaauugacacuuaaaaaugguu

SEQ ID NO: 2951058 - RNA, 13 nt, Human
aaauuaacuuuua

SEQ ID NO: 2951059 - RNA, 14 nt, Human
aaauuaacuuuuau

SEQ ID NO: 2951060 - RNA, 22 nt, Human
aacaaaccuguuucugcagcca

SEQ ID NO: 2951061 - RNA, 21 nt, Human
aacacauacaggaagguagaa

SEQ ID NO: 2951062 - RNA, 19 nt, Human
aacaccucugcacaagcug

SEQ ID NO: 2951063 - RNA, 12 nt, Human
aacacaucagcu

SEQ ID NO: 2951064 - RNA, 17 nt, Human
aaauguucaucaaugaa

SEQ ID NO: 2951065 - RNA, 20 nt, Human
aaauguucaucaaugaauga

SEQ ID NO: 2951066 - RNA, 17 nt, Human
aaauggaauacucuuau

SEQ ID NO: 2951067 - RNA, 14 nt, Human
aaauggacguguua

SEQ ID NO: 2951068 - RNA, 17 nt, Human
aaauggacguguuauga

SEQ ID NO: 2951069 - RNA, 15 nt, Human
aaauggacguguuau

SEQ ID NO: 2951070 - RNA, 22 nt, Human
aaaucuccaaaauaaaacuuuu

SEQ ID NO: 2951071 - RNA, 19 nt, Human
aaaucuccaaaauaaaacu

SEQ ID NO: 2951072 - RNA, 14 nt, Human
aaaucuuaacuuga

SEQ ID NO: 2951073 - RNA, 19 nt, Human
aaaauccauacauuugugu

SEQ ID NO: 2951074 - RNA, 15 nt, Human
aaaauuauggaaaca

SEQ ID NO: 2951075 - RNA, 17 nt, Human
aaaauuauggaaacaga

SEQ ID NO: 2951076 - RNA, 14 nt, Human
aaaauuauggaaac

SEQ ID NO: 2951077 - RNA, 18 nt, Human
aaaauuauggaaacagau

SEQ ID NO: 2951078 - RNA, 15 nt, Human
aaaauuagccaagug

SEQ ID NO: 2951079 - RNA, 17 nt, Human
aaacagcuaaugggaca

SEQ ID NO: 2951080 - RNA, 11 nt, Human
aaacagggccu

SEQ ID NO: 2951081 - RNA, 13 nt, Human
aaagaaacauuug

SEQ ID NO: 2951082 - RNA, 19 nt, Human
aaacugauuuuuuuuuccu

SEQ ID NO: 2951083 - RNA, 13 nt, Human
aaacugauuuuuu

SEQ ID NO: 2951084 - RNA, 20 nt, Human
aaacugauuuuuuuuuccuu

SEQ ID NO: 2951085 - RNA, 14 nt, Human
aaacccuucagugc

SEQ ID NO: 2951086 - RNA, 17 nt, Human
aaacucuugaccucagg

SEQ ID NO: 2951087 - RNA, 18 nt, Human
aaacccagcucuggucca

SEQ ID NO: 2951088 - RNA, 17 nt, Human
aaaccccaucucuacaa

SEQ ID NO: 2951089 - RNA, 21 nt, Human
aaacccugucucuacuaaaaa

SEQ ID NO: 2951090 - RNA, 15 nt, Human
aaagauacaguuacu

SEQ ID NO: 2951091 - RNA, 14 nt, Human
aaaggcuccaggag

SEQ ID NO: 2951092 - RNA, 17 nt, Human
aaaggcuaccuuuguau

SEQ ID NO: 2951093 - RNA, 14 nt, Human
aaaggcuaccuuug

SEQ ID NO: 2951094 - RNA, 21 nt, Human
aaaggcuccaggagcagccac

SEQ ID NO: 2951095 - RNA, 22 nt, Human
aaaggcuccaggagcagccaca

SEQ ID NO: 2951096 - RNA, 19 nt, Human
aaaggcagaagcaacccaa

SEQ ID NO: 2951097 - RNA, 15 nt, Human
aaagccaaagcuagg

SEQ ID NO: 2951098 - RNA, 20 nt, Human
aaagcauuguaaaugugcuu

SEQ ID NO: 2951099 - RNA, 19 nt, Human
aaagcauuguaaaugugcu

SEQ ID NO: 2951100 - RNA, 11 nt, Human
aaauaaauuau

SEQ ID NO: 2951101 - RNA, 12 nt, Human
aaagugcccagc

SEQ ID NO: 2951102 - RNA, 15 nt, Human
aaauaaacgucuuaa

SEQ ID NO: 2951103 - RNA, 16 nt, Human
aaauaaacgucuuaaa

SEQ ID NO: 2951104 - RNA, 13 nt, Human
acaauuuauuaug

SEQ ID NO: 2951105 - RNA, 14 nt, Human
acaauuuauuaugg

SEQ ID NO: 2951106 - RNA, 16 nt, Human
acaaggauugcuacug

SEQ ID NO: 2951107 - RNA, 20 nt, Human
acaaggaugaucuaggaaga

SEQ ID NO: 2951108 - RNA, 19 nt, Human
acacagcucuucuccaggc

SEQ ID NO: 2951109 - RNA, 19 nt, Human
acacaaaaguuucucuuuu

SEQ ID NO: 2951110 - RNA, 20 nt, Human
acacagcucuucuccaggcu

SEQ ID NO: 2951111 - RNA, 21 nt, Human
acacagcucuucuccaggcug

SEQ ID NO: 2951112 - RNA, 14 nt, Human
acacauuuuuuaaa

SEQ ID NO: 2951113 - RNA, 16 nt, Human
acacauuuuuuaaaug

SEQ ID NO: 2951114 - RNA, 18 nt, Human
acacauuuuuuaaaugca

SEQ ID NO: 2951115 - RNA, 14 nt, Human
acaccacuacauuc

SEQ ID NO: 2951116 - RNA, 19 nt, Human
acacauuuuuuaaaugcac

SEQ ID NO: 2951117 - RNA, 15 nt, Human
acaccacuacauucu

SEQ ID NO: 2951118 - RNA, 14 nt, Human
acacgaauauugcu

SEQ ID NO: 2951119 - RNA, 12 nt, Human
acacgaauauug

SEQ ID NO: 2951120 - RNA, 17 nt, Human
acaccacuacauucugu

SEQ ID NO: 2951121 - RNA, 20 nt, Human
acaccacuacauucuguuaa

SEQ ID NO: 2951122 - RNA, 21 nt, Human
acacgaauauugcugauggug

SEQ ID NO: 2951123 - RNA, 15 nt, Human
acacgaauauugcug

SEQ ID NO: 2951124 - RNA, 22 nt, Human
acacugugcugagucugaaggc

SEQ ID NO: 2951125 - RNA, 17 nt, Human
acacugugcugagucug

SEQ ID NO: 2951126 - RNA, 13 nt, Human
acagaggcagccc

SEQ ID NO: 2951127 - RNA, 23 nt, Human
acagaggcagccccauucugccu

SEQ ID NO: 2951128 - RNA, 17 nt, Human
acagaggccaugggccu

SEQ ID NO: 2951129 - RNA, 21 nt, Human
acagaggccaugggccuccug

SEQ ID NO: 2951130 - RNA, 13 nt, Human
acagacaaagcgu

SEQ ID NO: 2951131 - RNA, 14 nt, Human
acagacaaagcgug

SEQ ID NO: 2951132 - RNA, 18 nt, Human
acagaagaaaauagaauu

SEQ ID NO: 2951133 - RNA, 16 nt, Human
acagaagcuccaggua

SEQ ID NO: 2951134 - RNA, 21 nt, Human
acaaggaugaauuaaguuuuu

SEQ ID NO: 2951135 - RNA, 15 nt, Human
acaagaaaugaaagc

SEQ ID NO: 2951136 - RNA, 16 nt, Human
acaagaaaugaaagca

SEQ ID NO: 2951137 - RNA, 13 nt, Human
acaagaaaugaaa

SEQ ID NO: 2951138 - RNA, 13 nt, Human
acaaaauggaaua

SEQ ID NO: 2951139 - RNA, 14 nt, Human
acaaaauggaauac

SEQ ID NO: 2951140 - RNA, 22 nt, Human
acaaaaugaaacgcaaccacca

SEQ ID NO: 2951141 - RNA, 13 nt, Human
acaaaaugaaacg

SEQ ID NO: 2951142 - RNA, 14 nt, Human
aauuuugauguuuu

SEQ ID NO: 2951143 - RNA, 13 nt, Human
aauuuugugaagc

SEQ ID NO: 2951144 - RNA, 17 nt, Human
aauuuugugaagcaaaa

SEQ ID NO: 2951145 - RNA, 18 nt, Human
aauuuugugaagcaaaau

SEQ ID NO: 2951146 - RNA, 16 nt, Human
aauuuugugcccccau

SEQ ID NO: 2951147 - RNA, 20 nt, Human
aauuuauuuaugggauccug

SEQ ID NO: 2951148 - RNA, 17 nt, Human
aauuuauuauggcacau

SEQ ID NO: 2951149 - RNA, 16 nt, Human
aauuguaaggaaugau

SEQ ID NO: 2951150 - RNA, 12 nt, Human
aauuguaaggaa

SEQ ID NO: 2951151 - RNA, 16 nt, Human
aaugucacaggcaggu

SEQ ID NO: 2951152 - RNA, 19 nt, Human
aaugucacaggcaggucca

SEQ ID NO: 2951153 - RNA, 17 nt, Human
aauuuccugggagcuuu

SEQ ID NO: 2951154 - RNA, 18 nt, Human
aauuuccugggagcuuuu

SEQ ID NO: 2951155 - RNA, 21 nt, Human
aauuuccugggagcuuuugua

SEQ ID NO: 2951156 - RNA, 19 nt, Human
acaguggggaaugaagaua

SEQ ID NO: 2951157 - RNA, 15 nt, Human
acaguggggaaugaa

SEQ ID NO: 2951158 - RNA, 23 nt, Human
acagugagucgaggacagggagg

SEQ ID NO: 2951159 - RNA, 20 nt, Human
acagugauuaccagggacug

SEQ ID NO: 2951160 - RNA, 21 nt, Human
acagugauuaccagggacuga

SEQ ID NO: 2951161 - RNA, 22 nt, Human
acagugagucgaggacagggag

SEQ ID NO: 2951162 - RNA, 19 nt, Human
acaggugugaaccaccaca

SEQ ID NO: 2951163 - RNA, 22 nt, Human
acaggugugagucaccaagccc

SEQ ID NO: 2951164 - RNA, 23 nt, Human
acaggugugagucaccaagccca

SEQ ID NO: 2951165 - RNA, 14 nt, Human
acaggcaaugcugg

SEQ ID NO: 2951166 - RNA, 19 nt, Human
acaggcaagcaccuccugc

SEQ ID NO: 2951167 - RNA, 13 nt, Human
acagggccucugc

SEQ ID NO: 2951168 - RNA, 17 nt, Human
acagggccucugcggag

SEQ ID NO: 2951169 - RNA, 12 nt, Human
acagggccucug

SEQ ID NO: 2951170 - RNA, 20 nt, Human
acaggcaagcaccuccugcc

SEQ ID NO: 2951171 - RNA, 23 nt, Human
acaggcaagcaccuccugccucg

SEQ ID NO: 2951172 - RNA, 13 nt, Human
acagcucuguccu

SEQ ID NO: 2951173 - RNA, 16 nt, Human
acagcucuguccuggg

SEQ ID NO: 2951174 - RNA, 17 nt, Human
acagcucuguccuggga

SEQ ID NO: 2951175 - RNA, 15 nt, Human
acagcuccuucuguc

SEQ ID NO: 2951176 - RNA, 19 nt, Human
acagaggggguggccuccc

SEQ ID NO: 2951177 - RNA, 18 nt, Human
acagaggggguggccucc

SEQ ID NO: 2951178 - RNA, 17 nt, Human
acagaggggguggccuc

SEQ ID NO: 2951179 - RNA, 16 nt, Human
acagcuccuucugucc

SEQ ID NO: 2951180 - RNA, 18 nt, Human
acagcuccuucuguccua

SEQ ID NO: 2951181 - RNA, 23 nt, Human
acagcuccuucuguccuacucug

SEQ ID NO: 2951182 - RNA, 14 nt, Human
acagcucuguccug

SEQ ID NO: 2951183 - RNA, 20 nt, Human
acaucccuuaccugggaaag

SEQ ID NO: 2951184 - RNA, 16 nt, Human
acaugcaaggucauuu

SEQ ID NO: 2951185 - RNA, 14 nt, Human
acaugccuaccaau

SEQ ID NO: 2951186 - RNA, 17 nt, Human
acaugcaaggucauuuu

SEQ ID NO: 2951187 - RNA, 18 nt, Human
acaugccucucucaggcc

SEQ ID NO: 2951188 - RNA, 17 nt, Human
acaugccucucucaggc

SEQ ID NO: 2951189 - RNA, 16 nt, Human
acaugccucucucagg

SEQ ID NO: 2951190 - RNA, 15 nt, Human
acaugccucucucag

SEQ ID NO: 2951191 - RNA, 15 nt, Human
acauaagauaaaugu

SEQ ID NO: 2951192 - RNA, 16 nt, Human
acauaagauaaaugug

SEQ ID NO: 2951193 - RNA, 15 nt, Human
accaucaagccacca

SEQ ID NO: 2951194 - RNA, 12 nt, Human
accaucauugaa

SEQ ID NO: 2951195 - RNA, 15 nt, Human
accaucauugaaauc

SEQ ID NO: 2951196 - RNA, 23 nt, Human
accaucauugaaaucuuuuugcu

SEQ ID NO: 2951197 - RNA, 14 nt, Human
accaucaagccacc

SEQ ID NO: 2951198 - RNA, 13 nt, Human
acccaugcugccc

SEQ ID NO: 2951199 - RNA, 15 nt, Human
acccacccuccuuuc

SEQ ID NO: 2951200 - RNA, 19 nt, Human
accaugaaagacuucucua

SEQ ID NO: 2951201 - RNA, 12 nt, Human
accaugaaagac

SEQ ID NO: 2951202 - RNA, 14 nt, Human
accaugaaagacuu

SEQ ID NO: 2951203 - RNA, 17 nt, Human
acccacccccacccaag

SEQ ID NO: 2951204 - RNA, 15 nt, Human
acccacccccaccca

SEQ ID NO: 2951205 - RNA, 23 nt, Human
acaugucuuuucuugcaugaggc

SEQ ID NO: 2951206 - RNA, 19 nt, Human
acaugccucucucaggcca

SEQ ID NO: 2951207 - RNA, 18 nt, Human
acaugccuaccaauauuu

SEQ ID NO: 2951208 - RNA, 19 nt, Human
acaugccuaccaauauuua

SEQ ID NO: 2951209 - RNA, 20 nt, Human
accagccccagugcccacag

SEQ ID NO: 2951210 - RNA, 18 nt, Human
accagccccagugcccac

SEQ ID NO: 2951211 - RNA, 19 nt, Human
accagccccagugcccaca

SEQ ID NO: 2951212 - RNA, 16 nt, Human
accagccccagugccc

SEQ ID NO: 2951213 - RNA, 17 nt, Human
accagccccagugccca

SEQ ID NO: 2951214 - RNA, 14 nt, Human
accagcagaaaugc

SEQ ID NO: 2951215 - RNA, 13 nt, Human
accagcagagcac

SEQ ID NO: 2951216 - RNA, 12 nt, Human
accagcagagca

SEQ ID NO: 2951217 - RNA, 20 nt, Human
accaaggcugauuaaaccaa

SEQ ID NO: 2951218 - RNA, 17 nt, Human
acauuucucauguugaa

SEQ ID NO: 2951219 - RNA, 17 nt, Human
accaagaauugauuggg

SEQ ID NO: 2951220 - RNA, 19 nt, Human
accaaggcugauuaaacca

SEQ ID NO: 2951221 - RNA, 17 nt, Human
acuucuuauacauuuga

SEQ ID NO: 2951222 - RNA, 18 nt, Human
acuucuuauacauuugau

SEQ ID NO: 2951223 - RNA, 19 nt, Human
acuucugccauauucuguu

SEQ ID NO: 2951224 - RNA, 20 nt, Human
acuucugccauauucuguug

SEQ ID NO: 2951225 - RNA, 19 nt, Human
acuucagcgguuuauauaa

SEQ ID NO: 2951226 - RNA, 20 nt, Human
acuucaaauccuugaagauu

SEQ ID NO: 2951227 - RNA, 17 nt, Human
acuucagcgguuuauau

SEQ ID NO: 2951228 - RNA, 18 nt, Human
acuucagcgguuuauaua

SEQ ID NO: 2951229 - RNA, 19 nt, Human
acuucaaauccuugaagau

SEQ ID NO: 2951230 - RNA, 14 nt, Human
acuuaaauaaugug

SEQ ID NO: 2951231 - RNA, 13 nt, Human
acuuaaaaauggu

SEQ ID NO: 2951232 - RNA, 14 nt, Human
acuuaaaaaugguu

SEQ ID NO: 2951233 - RNA, 12 nt, Human
acuuuaugcuaa

SEQ ID NO: 2951234 - RNA, 17 nt, Human
acuuuaugcuaagugaa

SEQ ID NO: 2951235 - RNA, 22 nt, Human
acuugggaggcugagaugggag

SEQ ID NO: 2951236 - RNA, 19 nt, Human
acugccauccuggcccagg

SEQ ID NO: 2951237 - RNA, 22 nt, Human
acugcccggcaggguccuagaa

SEQ ID NO: 2951238 - RNA, 14 nt, Human
acugcuuuuggucu

SEQ ID NO: 2951239 - RNA, 15 nt, Human
acugcuuuuggucug

SEQ ID NO: 2951240 - RNA, 16 nt, Human
acugcuuuuggucugu

SEQ ID NO: 2951241 - RNA, 20 nt, Human
acugcuuuuggucuguguga

SEQ ID NO: 2951242 - RNA, 14 nt, Human
acugccauccuggc

SEQ ID NO: 2951243 - RNA, 15 nt, Human
acugcccggcagggu

SEQ ID NO: 2951244 - RNA, 12 nt, Human
acugaugggcaa

SEQ ID NO: 2951245 - RNA, 22 nt, Human
acugaugggcaacccccagccu

SEQ ID NO: 2951246 - RNA, 22 nt, Human
acugauggcuaauguacugcau

SEQ ID NO: 2951247 - RNA, 13 nt, Human
acugaucucucgu

SEQ ID NO: 2951248 - RNA, 22 nt, Human
acugacauuguuggccaaagcc

SEQ ID NO: 2951249 - RNA, 23 nt, Human
acugacauuguuggccaaagcca

SEQ ID NO: 2951250 - RNA, 22 nt, Human
acugauuuuuuuuuccuucagu

SEQ ID NO: 2951251 - RNA, 21 nt, Human
acugauuuuuuuuuccuucag

SEQ ID NO: 2951252 - RNA, 23 nt, Human
acugauuuuuuuuuccuucagug

SEQ ID NO: 2951253 - RNA, 19 nt, Human
acucugucucaaaaaaaca

SEQ ID NO: 2951254 - RNA, 21 nt, Human
acucugugucagguggggcag

SEQ ID NO: 2951255 - RNA, 19 nt, Human
acucugugucagguggggc

SEQ ID NO: 2951256 - RNA, 15 nt, Human
acucugucucagucc

SEQ ID NO: 2951257 - RNA, 17 nt, Human
acucugucucaguccau

SEQ ID NO: 2951258 - RNA, 20 nt, Human
acucuuaagaagacugcauu

SEQ ID NO: 2951259 - RNA, 14 nt, Human
acucuuaagaagac

SEQ ID NO: 2951260 - RNA, 15 nt, Human
acucuuaagaagacu

SEQ ID NO: 2951261 - RNA, 15 nt, Human
accgggccacagaga

SEQ ID NO: 2951262 - RNA, 19 nt, Human
accgggccacagagaaagu

SEQ ID NO: 2951263 - RNA, 14 nt, Human
accgugaggccaga

SEQ ID NO: 2951264 - RNA, 15 nt, Human
accggcuggccuggc

SEQ ID NO: 2951265 - RNA, 14 nt, Human
accggcuggccugg

SEQ ID NO: 2951266 - RNA, 20 nt, Human
accgggcacucagaagacac

SEQ ID NO: 2951267 - RNA, 19 nt, Human
accggcuggccuggccccu

SEQ ID NO: 2951268 - RNA, 18 nt, Human
accggcuggccuggcccc

SEQ ID NO: 2951269 - RNA, 17 nt, Human
accggcuggccuggccc

SEQ ID NO: 2951270 - RNA, 17 nt, Human
acccuguuaccauuuug

SEQ ID NO: 2951271 - RNA, 15 nt, Human
accccaagacuccca

SEQ ID NO: 2951272 - RNA, 16 nt, Human
accccaagacucccau

SEQ ID NO: 2951273 - RNA, 17 nt, Human
accccaagacucccaug

SEQ ID NO: 2951274 - RNA, 18 nt, Human
accccaagacucccauga

SEQ ID NO: 2951275 - RNA, 15 nt, Human
acccaugcugcccug

SEQ ID NO: 2951276 - RNA, 14 nt, Human
acccaugcugcccu

SEQ ID NO: 2951277 - RNA, 16 nt, Human
accccacacacgccag

SEQ ID NO: 2951278 - RNA, 22 nt, Human
acccugugauggggcccugccu

SEQ ID NO: 2951279 - RNA, 18 nt, Human
accucaggugagaagcag

SEQ ID NO: 2951280 - RNA, 22 nt, Human
accucaggccugggggcugggc

SEQ ID NO: 2951281 - RNA, 14 nt, Human
accucaggccuggg

SEQ ID NO: 2951282 - RNA, 13 nt, Human
accucaggccugg

SEQ ID NO: 2951283 - RNA, 12 nt, Human
accucaggccug

SEQ ID NO: 2951284 - RNA, 17 nt, Human
accgugaggccagagac

SEQ ID NO: 2951285 - RNA, 16 nt, Human
accgugaggccagaga

SEQ ID NO: 2951286 - RNA, 18 nt, Human
accugccagggacagagg

SEQ ID NO: 2951287 - RNA, 16 nt, Human
accugccagggacaga

SEQ ID NO: 2951288 - RNA, 15 nt, Human
accugccagggacag

SEQ ID NO: 2951289 - RNA, 13 nt, Human
accugccagggac

SEQ ID NO: 2951290 - RNA, 12 nt, Human
accugccaggga

SEQ ID NO: 2951291 - RNA, 11 nt, Human
accugccaggg

SEQ ID NO: 2951292 - RNA, 17 nt, Human
accucugccucagaaaa

SEQ ID NO: 2951293 - RNA, 18 nt, Human
accucugccucagaaaac

SEQ ID NO: 2951294 - RNA, 17 nt, Human
accucuugagccuugaa

SEQ ID NO: 2951295 - RNA, 19 nt, Human
accucuugagccuugaacu

SEQ ID NO: 2951296 - RNA, 20 nt, Human
accucuugagccuugaacuu

SEQ ID NO: 2951297 - RNA, 21 nt, Human
accucuugagccuugaacuuu

SEQ ID NO: 2951298 - RNA, 17 nt, Human
acuagggaagauaauau

SEQ ID NO: 2951299 - RNA, 16 nt, Human
acuauuguuagucucu

SEQ ID NO: 2951300 - RNA, 19 nt, Human
acuaguauuucuaugaaau

SEQ ID NO: 2951301 - RNA, 18 nt, Human
acuaguauuucuaugaaa

SEQ ID NO: 2951302 - RNA, 11 nt, Human
accugugucuc

SEQ ID NO: 2951303 - RNA, 15 nt, Human
acuaauagacaauuu

SEQ ID NO: 2951304 - RNA, 15 nt, Human
acgucugacaggcaa

SEQ ID NO: 2951305 - RNA, 23 nt, Human
acgucugacaggcaaugcuggcu

SEQ ID NO: 2951306 - RNA, 19 nt, Human
acgcuggagugcagugagc

SEQ ID NO: 2951307 - RNA, 18 nt, Human
acgcuggagugcagugag

SEQ ID NO: 2951308 - RNA, 16 nt, Human
acggaagagccuugcg

SEQ ID NO: 2951309 - RNA, 15 nt, Human
acggaagagccuugc

SEQ ID NO: 2951310 - RNA, 15 nt, Human
acggaauaguuggcu

SEQ ID NO: 2951311 - RNA, 19 nt, Human
acggacgaaccuugaaaac

SEQ ID NO: 2951312 - RNA, 19 nt, Human
acggacacucaaaagcugg

SEQ ID NO: 2951313 - RNA, 13 nt, Human
cacaaacagaggc

SEQ ID NO: 2951314 - RNA, 14 nt, Human
cacaaacagaggcc

SEQ ID NO: 2951315 - RNA, 22 nt, Human
caauuuuucuuauuucauuucu

SEQ ID NO: 2951316 - RNA, 17 nt, Human
caauuaccagaaagaua

SEQ ID NO: 2951317 - RNA, 18 nt, Human
caauuacaggaaguacug

SEQ ID NO: 2951318 - RNA, 17 nt, Human
caauuacaggaaguacu

SEQ ID NO: 2951319 - RNA, 14 nt, Human
caauguucucucuu

SEQ ID NO: 2951320 - RNA, 22 nt, Human
caaugugaaaagaaaaaugagc

SEQ ID NO: 2951321 - RNA, 19 nt, Human
caaugugaaaagaaaaaug

SEQ ID NO: 2951322 - RNA, 22 nt, Human
caauauccuaauaaaaagguga

SEQ ID NO: 2951323 - RNA, 20 nt, Human
cacaagaaaugaaagcaggg

SEQ ID NO: 2951324 - RNA, 21 nt, Human
cacaagaaaugaaagcaggga

SEQ ID NO: 2951325 - RNA, 18 nt, Human
cacaagaaaugaaagcag

SEQ ID NO: 2951326 - RNA, 13 nt, Human
cacaaaggagagc

SEQ ID NO: 2951327 - RNA, 16 nt, Human
cacaaagcuuuugcau

SEQ ID NO: 2951328 - RNA, 13 nt, Human
cacaaagcuuuug

SEQ ID NO: 2951329 - RNA, 15 nt, Human
cacacaaacaaggcc

SEQ ID NO: 2951330 - RNA, 17 nt, Human
cacacacgcgugcacac

SEQ ID NO: 2951331 - RNA, 13 nt, Human
cacagauuggcca

SEQ ID NO: 2951332 - RNA, 23 nt, Human
cacagaugggugcuuggaggaag

SEQ ID NO: 2951333 - RNA, 21 nt, Human
cacagaguuguuacauuuuua

SEQ ID NO: 2951334 - RNA, 22 nt, Human
cacagaguuguuacauuuuuaa

SEQ ID NO: 2951335 - RNA, 13 nt, Human
cacagaggcugcc

SEQ ID NO: 2951336 - RNA, 19 nt, Human
cacagagaaaguacuucuc

SEQ ID NO: 2951337 - RNA, 20 nt, Human
cacagagaaaguacuucucc

SEQ ID NO: 2951338 - RNA, 12 nt, Human
cacagagaaagu

SEQ ID NO: 2951339 - RNA, 13 nt, Human
cacacugaagaag

SEQ ID NO: 2951340 - RNA, 16 nt, Human
cacagcagugagacug

SEQ ID NO: 2951341 - RNA, 17 nt, Human
cacagcagugagacugg

SEQ ID NO: 2951342 - RNA, 19 nt, Human
cacagcaggcugccagugc

SEQ ID NO: 2951343 - RNA, 20 nt, Human
cacagcaggcugccagugcc

SEQ ID NO: 2951344 - RNA, 21 nt, Human
cacagcaggcugccagugccu

SEQ ID NO: 2951345 - RNA, 22 nt, Human
cacagcaggcugccagugccug

SEQ ID NO: 2951346 - RNA, 21 nt, Human
cacagcaguugaaaagacucc

SEQ ID NO: 2951347 - RNA, 15 nt, Human
cacagcaggcugcca

SEQ ID NO: 2951348 - RNA, 16 nt, Human
cacagcaggcugccag

SEQ ID NO: 2951349 - RNA, 17 nt, Human
cacagcaggcugccagu

SEQ ID NO: 2951350 - RNA, 13 nt, Human
cacagcaggcugc

SEQ ID NO: 2951351 - RNA, 19 nt, Human
cacagcaguugaaaagacu

SEQ ID NO: 2951352 - RNA, 21 nt, Human
cacagcucuucuccaggcugu

SEQ ID NO: 2951353 - RNA, 14 nt, Human
cacagccccaucug

SEQ ID NO: 2951354 - RNA, 18 nt, Human
cacagccagacuggcaca

SEQ ID NO: 2951355 - RNA, 17 nt, Human
cacagccagacuggcac

SEQ ID NO: 2951356 - RNA, 18 nt, Human
caauaacuggaacacucu

SEQ ID NO: 2951357 - RNA, 19 nt, Human
caauagauugcucaaauca

SEQ ID NO: 2951358 - RNA, 15 nt, Human
caauaggaaaaacug

SEQ ID NO: 2951359 - RNA, 17 nt, Human
caauaggaaaaacugau

SEQ ID NO: 2951360 - RNA, 16 nt, Human
caauaggaaaaacuga

SEQ ID NO: 2951361 - RNA, 17 nt, Human
caauagucaaauugugu

SEQ ID NO: 2951362 - RNA, 19 nt, Human
caauagucaaauuguguga

SEQ ID NO: 2951363 - RNA, 18 nt, Human
caaggcugggggaagaag

SEQ ID NO: 2951364 - RNA, 22 nt, Human
caaggcuuagacccucaugcug

SEQ ID NO: 2951365 - RNA, 19 nt, Human
caaggcuuagacccucaug

SEQ ID NO: 2951366 - RNA, 21 nt, Human
caagggugaugggaaagcauu

SEQ ID NO: 2951367 - RNA, 23 nt, Human
caagggugaugggaaagcauugu

SEQ ID NO: 2951368 - RNA, 18 nt, Human
caagcgauucuucugcuu

SEQ ID NO: 2951369 - RNA, 21 nt, Human
caagcugcacccucaggcagg

SEQ ID NO: 2951370 - RNA, 15 nt, Human
caagcgauucuucug

SEQ ID NO: 2951371 - RNA, 17 nt, Human
caagcgauucuucugcu

SEQ ID NO: 2951372 - RNA, 21 nt, Human
caagcuggucccacucagucc

SEQ ID NO: 2951373 - RNA, 22 nt, Human
caagcugcacccucaggcaggu

SEQ ID NO: 2951374 - RNA, 16 nt, Human
caaggagauuuacaac

SEQ ID NO: 2951375 - RNA, 19 nt, Human
caaggauccugagccagau

SEQ ID NO: 2951376 - RNA, 18 nt, Human
caaggauccugagccaga

SEQ ID NO: 2951377 - RNA, 20 nt, Human
caaggauccugagccagauu

SEQ ID NO: 2951378 - RNA, 22 nt, Human
caaggcugcagugagccgagau

SEQ ID NO: 2951379 - RNA, 17 nt, Human
caaggcugcagugagcc

SEQ ID NO: 2951380 - RNA, 20 nt, Human
caaggaaaaaauaacaauga

SEQ ID NO: 2951381 - RNA, 22 nt, Human
caagcuggucccacucagucca

SEQ ID NO: 2951382 - RNA, 23 nt, Human
caagcuggucccacucaguccau

SEQ ID NO: 2951383 - RNA, 18 nt, Human
caaggaaaaaauaacaau

SEQ ID NO: 2951384 - RNA, 18 nt, Human
caauaggaaaaacugauu

SEQ ID NO: 2951385 - RNA, 14 nt, Human
caaauguucaucaa

SEQ ID NO: 2951386 - RNA, 18 nt, Human
caaauguucaucaaugaa

SEQ ID NO: 2951387 - RNA, 22 nt, Human
caaauggaaaugggcagagcag

SEQ ID NO: 2951388 - RNA, 23 nt, Human
caaauggaaaugggcagagcaga

SEQ ID NO: 2951389 - RNA, 12 nt, Human
caaauaugcaaa

SEQ ID NO: 2951390 - RNA, 13 nt, Human
caaauaugcaaag

SEQ ID NO: 2951391 - RNA, 13 nt, Human
caaagugcuggga

SEQ ID NO: 2951392 - RNA, 19 nt, Human
caaagugcugggauuacaa

SEQ ID NO: 2951393 - RNA, 19 nt, Human
caaaguggugagaggcauc

SEQ ID NO: 2951394 - RNA, 23 nt, Human
caaagugcugggauuacaagcgu

SEQ ID NO: 2951395 - RNA, 15 nt, Human
caaauuucuaaaucu

SEQ ID NO: 2951396 - RNA, 22 nt, Human
caaauuucuaaaucuccaaaau

SEQ ID NO: 2951397 - RNA, 20 nt, Human
caacauacucccaucuguga

SEQ ID NO: 2951398 - RNA, 12 nt, Human
caacaggcuggg

SEQ ID NO: 2951399 - RNA, 19 nt, Human
caacauacucccaucugug

SEQ ID NO: 2951400 - RNA, 17 nt, Human
caacauacucccaucug

SEQ ID NO: 2951401 - RNA, 14 nt, Human
caagagcaaaguag

SEQ ID NO: 2951402 - RNA, 15 nt, Human
caagacgcugugcug

SEQ ID NO: 2951403 - RNA, 13 nt, Human
caagacgcugugc

SEQ ID NO: 2951404 - RNA, 23 nt, Human
caagaccuucuccuucaccuuug

SEQ ID NO: 2951405 - RNA, 21 nt, Human
caagaccuucuccuucaccuu

SEQ ID NO: 2951406 - RNA, 14 nt, Human
caagaagcccagga

SEQ ID NO: 2951407 - RNA, 13 nt, Human
caagaagcccagg

SEQ ID NO: 2951408 - RNA, 15 nt, Human
caagaaaugaaagca

SEQ ID NO: 2951409 - RNA, 17 nt, Human
caagaaaugaaagcagg

SEQ ID NO: 2951410 - RNA, 19 nt, Human
caagaaaugaaagcaggga

SEQ ID NO: 2951411 - RNA, 16 nt, Human
caaaacucuccucugc

SEQ ID NO: 2951412 - RNA, 15 nt, Human
caaaacucuccucug

SEQ ID NO: 2951413 - RNA, 18 nt, Human
auuuuauuuuauuaugca

SEQ ID NO: 2951414 - RNA, 21 nt, Human
caaaacgguuuuacugcagcu

SEQ ID NO: 2951415 - RNA, 15 nt, Human
caaaacgguuuuacu

SEQ ID NO: 2951416 - RNA, 14 nt, Human
caaaaguuucucuu

SEQ ID NO: 2951417 - RNA, 23 nt, Human
caaaacucuccucugcugcuggc

SEQ ID NO: 2951418 - RNA, 18 nt, Human
caaaacugcacugucaag

SEQ ID NO: 2951419 - RNA, 17 nt, Human
caaaacugcacugucaa

SEQ ID NO: 2951420 - RNA, 14 nt, Human
caaaacugcacugu

SEQ ID NO: 2951421 - RNA, 19 nt, Human
caaaacucuccucugcugc

SEQ ID NO: 2951422 - RNA, 21 nt, Human
caaaaucgaugcagugcuucc

SEQ ID NO: 2951423 - RNA, 21 nt, Human
caaaauagaaaguugcaaggc

SEQ ID NO: 2951424 - RNA, 22 nt, Human
caaaauagaaaguugcaaggca

SEQ ID NO: 2951425 - RNA, 12 nt, Human
caaaauagaaag

SEQ ID NO: 2951426 - RNA, 13 nt, Human
caaaauagaaagu

SEQ ID NO: 2951427 - RNA, 14 nt, Human
caaaauaaaacuuu

SEQ ID NO: 2951428 - RNA, 16 nt, Human
caaaauaaaacuuuuu

SEQ ID NO: 2951429 - RNA, 20 nt, Human
caaaauaaaacuuuuuaaaa

SEQ ID NO: 2951430 - RNA, 22 nt, Human
caaaaugaaacgcaaccaccac

SEQ ID NO: 2951431 - RNA, 11 nt, Human
caaaaugaaac

SEQ ID NO: 2951432 - RNA, 21 nt, Human
caaacaaggccugucagcuaa

SEQ ID NO: 2951433 - RNA, 13 nt, Human
caaacagaggccg

SEQ ID NO: 2951434 - RNA, 17 nt, Human
caaacucuugaccucag

SEQ ID NO: 2951435 - RNA, 19 nt, Human
caaacucuugaccucaggu

SEQ ID NO: 2951436 - RNA, 20 nt, Human
caaacucuugaccucaggug

SEQ ID NO: 2951437 - RNA, 21 nt, Human
caaacucuugaccucagguga

SEQ ID NO: 2951438 - RNA, 16 nt, Human
caaacugacucuuaag

SEQ ID NO: 2951439 - RNA, 17 nt, Human
caaacugacucuuaaga

SEQ ID NO: 2951440 - RNA, 21 nt, Human
caaacugacucuuaagaagac

SEQ ID NO: 2951441 - RNA, 17 nt, Human
cacaguucaauucucau

SEQ ID NO: 2951442 - RNA, 14 nt, Human
cagugugacaagga

SEQ ID NO: 2951443 - RNA, 12 nt, Human
cagugugacuga

SEQ ID NO: 2951444 - RNA, 21 nt, Human
caguguguggucaacauuucu

SEQ ID NO: 2951445 - RNA, 17 nt, Human
caguguguggucaacau

SEQ ID NO: 2951446 - RNA, 16 nt, Human
caguguacauggaaua

SEQ ID NO: 2951447 - RNA, 20 nt, Human
caguguacauggaauaacau

SEQ ID NO: 2951448 - RNA, 23 nt, Human
caguguacauggaauaacaugua

SEQ ID NO: 2951449 - RNA, 14 nt, Human
cagugucaaugcag

SEQ ID NO: 2951450 - RNA, 22 nt, Human
cagugguuccuaauccucuagg

SEQ ID NO: 2951451 - RNA, 12 nt, Human
caguggcagcug

SEQ ID NO: 2951452 - RNA, 13 nt, Human
caguggcagcugc

SEQ ID NO: 2951453 - RNA, 14 nt, Human
caguggcagcugcu

SEQ ID NO: 2951454 - RNA, 15 nt, Human
caguggcagcugcuu

SEQ ID NO: 2951455 - RNA, 16 nt, Human
caguggcagcugcuuu

SEQ ID NO: 2951456 - RNA, 20 nt, Human
cagugcuuggcccaggaguu

SEQ ID NO: 2951457 - RNA, 19 nt, Human
cagugcuuggcccaggagu

SEQ ID NO: 2951458 - RNA, 18 nt, Human
cagugcuuggcccaggag

SEQ ID NO: 2951459 - RNA, 17 nt, Human
cagugcuuggcccagga

SEQ ID NO: 2951460 - RNA, 16 nt, Human
cagugcuuggcccagg

SEQ ID NO: 2951461 - RNA, 15 nt, Human
cagugcuuggcccag

SEQ ID NO: 2951462 - RNA, 14 nt, Human
cagugcuuggccca

SEQ ID NO: 2951463 - RNA, 13 nt, Human
cagugcuuggccc

SEQ ID NO: 2951464 - RNA, 19 nt, Human
caguguuguggauuuaaca

SEQ ID NO: 2951465 - RNA, 20 nt, Human
caguguuguggauuuaacag

SEQ ID NO: 2951466 - RNA, 22 nt, Human
caguguuguggauuuaacagaa

SEQ ID NO: 2951467 - RNA, 16 nt, Human
caguguuuuaggagca

SEQ ID NO: 2951468 - RNA, 20 nt, Human
caguguuuuaggagcaugag

SEQ ID NO: 2951469 - RNA, 14 nt, Human
caguuaagagaaau

SEQ ID NO: 2951470 - RNA, 13 nt, Human
caguuaagagaaa

SEQ ID NO: 2951471 - RNA, 14 nt, Human
caguuacucagaau

SEQ ID NO: 2951472 - RNA, 21 nt, Human
caguuaccucugccucagaaa

SEQ ID NO: 2951473 - RNA, 19 nt, Human
caguugaaaaacagcugag

SEQ ID NO: 2951474 - RNA, 18 nt, Human
caguugaaaaacagcuga

SEQ ID NO: 2951475 - RNA, 12 nt, Human
caguugaaaaac

SEQ ID NO: 2951476 - RNA, 13 nt, Human
caguucucuccuu

SEQ ID NO: 2951477 - RNA, 15 nt, Human
caguucucuccuucu

SEQ ID NO: 2951478 - RNA, 14 nt, Human
caguucucuccuuc

SEQ ID NO: 2951479 - RNA, 22 nt, Human
caguucggugagcuacaaaugc

SEQ ID NO: 2951480 - RNA, 22 nt, Human
caguucugaagaagaugguacc

SEQ ID NO: 2951481 - RNA, 15 nt, Human
caguucugaagaaga

SEQ ID NO: 2951482 - RNA, 16 nt, Human
caguucugaagaagau

SEQ ID NO: 2951483 - RNA, 12 nt, Human
caguucugaaga

SEQ ID NO: 2951484 - RNA, 22 nt, Human
caguucucuccuucuucccccc

SEQ ID NO: 2951485 - RNA, 13 nt, Human
caguucugaagaa

SEQ ID NO: 2951486 - RNA, 14 nt, Human
caguucugaagaag

SEQ ID NO: 2951487 - RNA, 19 nt, Human
cauaaauuuaguauuuugu

SEQ ID NO: 2951488 - RNA, 20 nt, Human
cauaaauuuaguauuuuguu

SEQ ID NO: 2951489 - RNA, 16 nt, Human
cauaaccuagccuuag

SEQ ID NO: 2951490 - RNA, 21 nt, Human
cauaaaaauuagccaagugug

SEQ ID NO: 2951491 - RNA, 22 nt, Human
cauaaacaagaccacguuucua

SEQ ID NO: 2951492 - RNA, 20 nt, Human
cauaaacaagaccacguuuc

SEQ ID NO: 2951493 - RNA, 21 nt, Human
cauaaacaagaccacguuucu

SEQ ID NO: 2951494 - RNA, 20 nt, Human
cauaagcuacugccauccug

SEQ ID NO: 2951495 - RNA, 18 nt, Human
cauaagugcuauugcaga

SEQ ID NO: 2951496 - RNA, 22 nt, Human
cauaaguccucuagugaaugua

SEQ ID NO: 2951497 - RNA, 22 nt, Human
cauaagugcuauugcagagccg

SEQ ID NO: 2951498 - RNA, 20 nt, Human
cauaagccaaaacugagcau

SEQ ID NO: 2951499 - RNA, 14 nt, Human
cauaagcuacugcc

SEQ ID NO: 2951500 - RNA, 16 nt, Human
cauaagcuacugccau

SEQ ID NO: 2951501 - RNA, 17 nt, Human
cauaagcuacugccauc

SEQ ID NO: 2951502 - RNA, 14 nt, Human
cauaagauaaaugu

SEQ ID NO: 2951503 - RNA, 19 nt, Human
cauaccacuuuuguucuug

SEQ ID NO: 2951504 - RNA, 12 nt, Human
cauacccacccc

SEQ ID NO: 2951505 - RNA, 11 nt, Human
cauacccaccc

SEQ ID NO: 2951506 - RNA, 13 nt, Human
cauaccacuuuug

SEQ ID NO: 2951507 - RNA, 14 nt, Human
cauaccacuuuugu

SEQ ID NO: 2951508 - RNA, 15 nt, Human
cauaccacuuuuguu

SEQ ID NO: 2951509 - RNA, 18 nt, Human
cauaccacuuuuguucuu

SEQ ID NO: 2951510 - RNA, 17 nt, Human
cauaccaacacgagcag

SEQ ID NO: 2951511 - RNA, 20 nt, Human
caguuuucugagaaagacua

SEQ ID NO: 2951512 - RNA, 19 nt, Human
caguuuucugagaaagacu

SEQ ID NO: 2951513 - RNA, 19 nt, Human
caguuuuuuuccuucaaga

SEQ ID NO: 2951514 - RNA, 17 nt, Human
caguuguuagugugucu

SEQ ID NO: 2951515 - RNA, 15 nt, Human
caguuuucugagaaa

SEQ ID NO: 2951516 - RNA, 14 nt, Human
caguuuucugagaa

SEQ ID NO: 2951517 - RNA, 16 nt, Human
caguuggguggaugcc

SEQ ID NO: 2951518 - RNA, 23 nt, Human
caguugccagucaccccggccac

SEQ ID NO: 2951519 - RNA, 18 nt, Human
caguuggguggaugccug

SEQ ID NO: 2951520 - RNA, 19 nt, Human
caguuggguggaugccugg

SEQ ID NO: 2951521 - RNA, 18 nt, Human
caguuggucccccuucca

SEQ ID NO: 2951522 - RNA, 11 nt, Human
caguuggguuu

SEQ ID NO: 2951523 - RNA, 16 nt, Human
caguuggguuuuuuaa

SEQ ID NO: 2951524 - RNA, 18 nt, Human
caguuggguuuuuuaagg

SEQ ID NO: 2951525 - RNA, 22 nt, Human
caguuggucccccuuccaugga

SEQ ID NO: 2951526 - RNA, 21 nt, Human
caguuggucccccuuccaugg

SEQ ID NO: 2951527 - RNA, 20 nt, Human
caguuggucccccuuccaug

SEQ ID NO: 2951528 - RNA, 19 nt, Human
caguuggucccccuuccau

SEQ ID NO: 2951529 - RNA, 23 nt, Human
caguugaaaagacuccaaagaaa

SEQ ID NO: 2951530 - RNA, 22 nt, Human
caguugaaaagacuccaaagaa

SEQ ID NO: 2951531 - RNA, 21 nt, Human
caguugaaaagacuccaaaga

SEQ ID NO: 2951532 - RNA, 18 nt, Human
caguugaaaagacuccaa

SEQ ID NO: 2951533 - RNA, 14 nt, Human
caguugaaaagacu

SEQ ID NO: 2951534 - RNA, 14 nt, Human
cauacuauuaaaca

SEQ ID NO: 2951535 - RNA, 21 nt, Human
cauacccacccccacccaagg

SEQ ID NO: 2951536 - RNA, 18 nt, Human
cauacccacccccaccca

SEQ ID NO: 2951537 - RNA, 17 nt, Human
cauacccacccccaccc

SEQ ID NO: 2951538 - RNA, 14 nt, Human
cauacccaccccca

SEQ ID NO: 2951539 - RNA, 13 nt, Human
cauacguacacau

SEQ ID NO: 2951540 - RNA, 15 nt, Human
cauacguacacauuu

SEQ ID NO: 2951541 - RNA, 16 nt, Human
cauacguacacauuuu

SEQ ID NO: 2951542 - RNA, 17 nt, Human
cauacguacacauuuua

SEQ ID NO: 2951543 - RNA, 18 nt, Human
cauacguacacauuuuau

SEQ ID NO: 2951544 - RNA, 14 nt, Human
cauacuaaccagca

SEQ ID NO: 2951545 - RNA, 21 nt, Human
cauacuaaccagcagaaaugc

SEQ ID NO: 2951546 - RNA, 14 nt, Human
caucuagugagcag

SEQ ID NO: 2951547 - RNA, 15 nt, Human
caucuacccuccgau

SEQ ID NO: 2951548 - RNA, 19 nt, Human
cauccucuguacagagccc

SEQ ID NO: 2951549 - RNA, 18 nt, Human
cauccucuguacagagcc

SEQ ID NO: 2951550 - RNA, 15 nt, Human
cauccucuguacaga

SEQ ID NO: 2951551 - RNA, 20 nt, Human
caucucacacaugagcauca

SEQ ID NO: 2951552 - RNA, 17 nt, Human
caucucacacaugagca

SEQ ID NO: 2951553 - RNA, 16 nt, Human
caucucacacaugagc

SEQ ID NO: 2951554 - RNA, 22 nt, Human
caucuagugagcagucaggaaa

SEQ ID NO: 2951555 - RNA, 16 nt, Human
cauccucauacccacc

SEQ ID NO: 2951556 - RNA, 15 nt, Human
cauccucauacccac

SEQ ID NO: 2951557 - RNA, 12 nt, Human
cauccuccucag

SEQ ID NO: 2951558 - RNA, 11 nt, Human
cauccuccuca

SEQ ID NO: 2951559 - RNA, 19 nt, Human
cauccuccucagaucuucu

SEQ ID NO: 2951560 - RNA, 18 nt, Human
cauccuccucagaucuuc

SEQ ID NO: 2951561 - RNA, 16 nt, Human
cauccuccucagaucu

SEQ ID NO: 2951562 - RNA, 15 nt, Human
cauccuccucagauc

SEQ ID NO: 2951563 - RNA, 13 nt, Human
cauccucccaagg

SEQ ID NO: 2951564 - RNA, 22 nt, Human
cauccucauacccacccccacc

SEQ ID NO: 2951565 - RNA, 21 nt, Human
cauccucauacccacccccac

SEQ ID NO: 2951566 - RNA, 18 nt, Human
cauccucauacccacccc

SEQ ID NO: 2951567 - RNA, 17 nt, Human
cauccucauacccaccc

SEQ ID NO: 2951568 - RNA, 20 nt, Human
caucuugcucugcugacaga

SEQ ID NO: 2951569 - RNA, 14 nt, Human
caucuugcucugcu

SEQ ID NO: 2951570 - RNA, 13 nt, Human
caucuugcucugc

SEQ ID NO: 2951571 - RNA, 22 nt, Human
caucuuccaaggguacuaagga

SEQ ID NO: 2951572 - RNA, 21 nt, Human
caucccugaaggccccgccca

SEQ ID NO: 2951573 - RNA, 19 nt, Human
caucccugaaggccccgcc

SEQ ID NO: 2951574 - RNA, 18 nt, Human
caucccugaaggccccgc

SEQ ID NO: 2951575 - RNA, 17 nt, Human
caucccugaaggccccg

SEQ ID NO: 2951576 - RNA, 12 nt, Human
caucauuucaag

SEQ ID NO: 2951577 - RNA, 14 nt, Human
caucauuucaagaa

SEQ ID NO: 2951578 - RNA, 15 nt, Human
caucaccaacgucug

SEQ ID NO: 2951579 - RNA, 13 nt, Human
caucauugaaauc

SEQ ID NO: 2951580 - RNA, 21 nt, Human
caucauugaaaucuuuuugcu

SEQ ID NO: 2951581 - RNA, 20 nt, Human
caucauugaaaucuuuuugc

SEQ ID NO: 2951582 - RNA, 15 nt, Human
caucauugaaaucuu

SEQ ID NO: 2951583 - RNA, 14 nt, Human
caucauugaaaucu

SEQ ID NO: 2951584 - RNA, 15 nt, Human
cauccagguucagcu

SEQ ID NO: 2951585 - RNA, 12 nt, Human
caucccucccuc

SEQ ID NO: 2951586 - RNA, 13 nt, Human
caucccucccucc

SEQ ID NO: 2951587 - RNA, 14 nt, Human
caucccucccucca

SEQ ID NO: 2951588 - RNA, 19 nt, Human
caucccucuggggcuguuc

SEQ ID NO: 2951589 - RNA, 13 nt, Human
caucccugaaggc

SEQ ID NO: 2951590 - RNA, 11 nt, Human
caucccugaag

SEQ ID NO: 2951591 - RNA, 18 nt, Human
cauacuauuaaacaugcu

SEQ ID NO: 2951592 - RNA, 11 nt, Human
cauacucugcu

SEQ ID NO: 2951593 - RNA, 20 nt, Human
cauacucccaucugugaaag

SEQ ID NO: 2951594 - RNA, 18 nt, Human
cauacucccaucugugaa

SEQ ID NO: 2951595 - RNA, 15 nt, Human
cauacucccaucugu

SEQ ID NO: 2951596 - RNA, 16 nt, Human
cauacucccaucugug

SEQ ID NO: 2951597 - RNA, 12 nt, Human
cauacuuuuugg

SEQ ID NO: 2951598 - RNA, 16 nt, Human
cauacuuuuuggguuu

SEQ ID NO: 2951599 - RNA, 18 nt, Human
cauacuuuuuggguuuau

SEQ ID NO: 2951600 - RNA, 21 nt, Human
cauagagagcaagacgcugug

SEQ ID NO: 2951601 - RNA, 19 nt, Human
cauagagagcaagacgcug

SEQ ID NO: 2951602 - RNA, 23 nt, Human
cauagagagcaagacgcugugcu

SEQ ID NO: 2951603 - RNA, 17 nt, Human
cauaguaugguggcugg

SEQ ID NO: 2951604 - RNA, 20 nt, Human
cauaguaugguggcuggguu

SEQ ID NO: 2951605 - RNA, 18 nt, Human
cauaguaugguggcuggg

SEQ ID NO: 2951606 - RNA, 19 nt, Human
cauaguaugguggcugggu

SEQ ID NO: 2951607 - RNA, 21 nt, Human
cauaguuugggcuuguaccac

SEQ ID NO: 2951608 - RNA, 22 nt, Human
cauaguggcuuaaaacaacacu

SEQ ID NO: 2951609 - RNA, 16 nt, Human
cauauccaaguuugaa

SEQ ID NO: 2951610 - RNA, 14 nt, Human
cauauccaaguuug

SEQ ID NO: 2951611 - RNA, 22 nt, Human
cauauauauguuuuaagaggca

SEQ ID NO: 2951612 - RNA, 15 nt, Human
cauauauuuuuuaaa

SEQ ID NO: 2951613 - RNA, 16 nt, Human
cauauauuuuuuaaaa

SEQ ID NO: 2951614 - RNA, 20 nt, Human
cauauauuuuuuaaaauaag

SEQ ID NO: 2951615 - RNA, 21 nt, Human
cauauauuuuuuaaaauaagu

SEQ ID NO: 2951616 - RNA, 20 nt, Human
cauauauaacaaugcuguau

SEQ ID NO: 2951617 - RNA, 13 nt, Human
cauaugccugggc

SEQ ID NO: 2951618 - RNA, 14 nt, Human
cauauuuacuucuu

SEQ ID NO: 2951619 - RNA, 20 nt, Human
cauauuuacuucuuauacau

SEQ ID NO: 2951620 - RNA, 16 nt, Human
cauauuuacuucuuau

SEQ ID NO: 2951621 - RNA, 17 nt, Human
cauauuuacuucuuaua

SEQ ID NO: 2951622 - RNA, 12 nt, Human
cauauuuucaug

SEQ ID NO: 2951623 - RNA, 14 nt, Human
caucaagaugugac

SEQ ID NO: 2951624 - RNA, 22 nt, Human
caucaagucuuucacauuuaaa

SEQ ID NO: 2951625 - RNA, 18 nt, Human
caucaaugaaugaaugaa

SEQ ID NO: 2951626 - RNA, 22 nt, Human
cauggaaguacuauaauuuacc

SEQ ID NO: 2951627 - RNA, 20 nt, Human
cauggaaguacuauaauuua

SEQ ID NO: 2951628 - RNA, 16 nt, Human
cauggaauaacaugua

SEQ ID NO: 2951629 - RNA, 17 nt, Human
cauggacuucuggaugc

SEQ ID NO: 2951630 - RNA, 18 nt, Human
cauggacaugaucuucuu

SEQ ID NO: 2951631 - RNA, 23 nt, Human
caugccuggauggggcugcaccg

SEQ ID NO: 2951632 - RNA, 21 nt, Human
caugccuggauggggcugcac

SEQ ID NO: 2951633 - RNA, 18 nt, Human
caugccuggauggggcug

SEQ ID NO: 2951634 - RNA, 17 nt, Human
caugcgggcuuccuccu

SEQ ID NO: 2951635 - RNA, 23 nt, Human
caugcugucuacacuaagagaga

SEQ ID NO: 2951636 - RNA, 22 nt, Human
caugcugucccuuacgugaguc

SEQ ID NO: 2951637 - RNA, 20 nt, Human
caugcuguucaugaaagauu

SEQ ID NO: 2951638 - RNA, 17 nt, Human
caugcugucccuuacgu

SEQ ID NO: 2951639 - RNA, 18 nt, Human
caugggaaugaaugucag

SEQ ID NO: 2951640 - RNA, 16 nt, Human
cauggaguauauguca

SEQ ID NO: 2951641 - RNA, 17 nt, Human
cauggagguuugaagau

SEQ ID NO: 2951642 - RNA, 13 nt, Human
cauggacuuuguu

SEQ ID NO: 2951643 - RNA, 11 nt, Human
cauggacuuug

SEQ ID NO: 2951644 - RNA, 16 nt, Human
caugggccuccugugu

SEQ ID NO: 2951645 - RNA, 17 nt, Human
caugggccuccugugug

SEQ ID NO: 2951646 - RNA, 15 nt, Human
caugggccuccugug

SEQ ID NO: 2951647 - RNA, 17 nt, Human
caugggacagggaggac

SEQ ID NO: 2951648 - RNA, 22 nt, Human
caugggaaugaaugucagugug

SEQ ID NO: 2951649 - RNA, 17 nt, Human
caugccuaccaauauuu

SEQ ID NO: 2951650 - RNA, 15 nt, Human
caugccucucucagg

SEQ ID NO: 2951651 - RNA, 14 nt, Human
caugccucucucag

SEQ ID NO: 2951652 - RNA, 13 nt, Human
caugccuggaugg

SEQ ID NO: 2951653 - RNA, 19 nt, Human
caugccucucucaggccaa

SEQ ID NO: 2951654 - RNA, 18 nt, Human
caugccucucucaggcca

SEQ ID NO: 2951655 - RNA, 17 nt, Human
caugccucucucaggcc

SEQ ID NO: 2951656 - RNA, 16 nt, Human
caugccucucucaggc

SEQ ID NO: 2951657 - RNA, 20 nt, Human
caugcauagagugugaugua

SEQ ID NO: 2951658 - RNA, 20 nt, Human
caugccagcuuaucucaggg

SEQ ID NO: 2951659 - RNA, 19 nt, Human
caugccagcuuaucucagg

SEQ ID NO: 2951660 - RNA, 20 nt, Human
caugccagggccaugucaga

SEQ ID NO: 2951661 - RNA, 13 nt, Human
caugccccugaac

SEQ ID NO: 2951662 - RNA, 15 nt, Human
cauguuugugauuga

SEQ ID NO: 2951663 - RNA, 23 nt, Human
cauguuugauguaucugagcagg

SEQ ID NO: 2951664 - RNA, 15 nt, Human
cauguuuaugagaaa

SEQ ID NO: 2951665 - RNA, 21 nt, Human
caugugccagguuuuuggucu

SEQ ID NO: 2951666 - RNA, 15 nt, Human
caugugcacaugcac

SEQ ID NO: 2951667 - RNA, 16 nt, Human
cauggucggaaaacau

SEQ ID NO: 2951668 - RNA, 18 nt, Human
cauguaauuaaguacuau

SEQ ID NO: 2951669 - RNA, 21 nt, Human
cauguaauuaaguacuaugua

SEQ ID NO: 2951670 - RNA, 23 nt, Human
caugucuuuucuugcaugaggcu

SEQ ID NO: 2951671 - RNA, 21 nt, Human
caugucuuuucuugcaugagg

SEQ ID NO: 2951672 - RNA, 19 nt, Human
caugucuuuucuugcauga

SEQ ID NO: 2951673 - RNA, 14 nt, Human
caugucuuuucuug

SEQ ID NO: 2951674 - RNA, 13 nt, Human
cauuaaaugacuc

SEQ ID NO: 2951675 - RNA, 14 nt, Human
cauuaaaugacucu

SEQ ID NO: 2951676 - RNA, 18 nt, Human
cauuaaaugacucuuccc

SEQ ID NO: 2951677 - RNA, 17 nt, Human
cauuaaagguacuuugc

SEQ ID NO: 2951678 - RNA, 21 nt, Human
cauuaaagccugaguuugcuu

SEQ ID NO: 2951679 - RNA, 15 nt, Human
cauguuuuguuuacg

SEQ ID NO: 2951680 - RNA, 18 nt, Human
cauguuuuucuucucccu

SEQ ID NO: 2951681 - RNA, 21 nt, Human
ccaacacgagcaggcuacugu

SEQ ID NO: 2951682 - RNA, 13 nt, Human
ccaacaucaacau

SEQ ID NO: 2951683 - RNA, 14 nt, Human
ccaacauacuccca

SEQ ID NO: 2951684 - RNA, 16 nt, Human
ccaacaucaacaucuu

SEQ ID NO: 2951685 - RNA, 15 nt, Human
ccaaauucuuucagu

SEQ ID NO: 2951686 - RNA, 22 nt, Human
ccaaauucuuucaguggcuacc

SEQ ID NO: 2951687 - RNA, 14 nt, Human
ccaacacgagcagg

SEQ ID NO: 2951688 - RNA, 15 nt, Human
ccaagaccuucuccu

SEQ ID NO: 2951689 - RNA, 15 nt, Human
ccaacccucaucacc

SEQ ID NO: 2951690 - RNA, 13 nt, Human
ccaacccucauca

SEQ ID NO: 2951691 - RNA, 14 nt, Human
ccaagacucccaug

SEQ ID NO: 2951692 - RNA, 15 nt, Human
ccaagacucccauga

SEQ ID NO: 2951693 - RNA, 19 nt, Human
ccaagacucccaugaggga

SEQ ID NO: 2951694 - RNA, 12 nt, Human
ccaagacuccca

SEQ ID NO: 2951695 - RNA, 13 nt, Human
ccaaagaugcagc

SEQ ID NO: 2951696 - RNA, 14 nt, Human
ccaaagaugcagcc

SEQ ID NO: 2951697 - RNA, 15 nt, Human
ccacaaguuaaauaa

SEQ ID NO: 2951698 - RNA, 20 nt, Human
ccacaaguuaaauaaaucau

SEQ ID NO: 2951699 - RNA, 21 nt, Human
ccacaagagcccaggccuccu

SEQ ID NO: 2951700 - RNA, 20 nt, Human
ccacaagagcccaggccucc

SEQ ID NO: 2951701 - RNA, 19 nt, Human
ccacaagagcccaggccuc

SEQ ID NO: 2951702 - RNA, 18 nt, Human
ccacaagagcccaggccu

SEQ ID NO: 2951703 - RNA, 17 nt, Human
ccacaagagcccaggcc

SEQ ID NO: 2951704 - RNA, 16 nt, Human
ccacaagagcccaggc

SEQ ID NO: 2951705 - RNA, 14 nt, Human
ccaagcaggacaug

SEQ ID NO: 2951706 - RNA, 23 nt, Human
ccaagcagagguugggaggccau

SEQ ID NO: 2951707 - RNA, 13 nt, Human
ccaagcucccagg

SEQ ID NO: 2951708 - RNA, 12 nt, Human
ccaagcucccag

SEQ ID NO: 2951709 - RNA, 13 nt, Human
ccaaggccuuccc

SEQ ID NO: 2951710 - RNA, 19 nt, Human
ccaaggccuuccccuggca

SEQ ID NO: 2951711 - RNA, 18 nt, Human
ccaaggcuagaaccaccu

SEQ ID NO: 2951712 - RNA, 18 nt, Human
ccaaggugggaggauugc

SEQ ID NO: 2951713 - RNA, 14 nt, Human
ccaaggcuggggga

SEQ ID NO: 2951714 - RNA, 19 nt, Human
ccaaggcugauuaaaccaa

SEQ ID NO: 2951715 - RNA, 23 nt, Human
ccaagugccaaagaagcagacca

SEQ ID NO: 2951716 - RNA, 20 nt, Human
ccaauauucauagcagcuua

SEQ ID NO: 2951717 - RNA, 21 nt, Human
ccaauauuuaaucuuuuauga

SEQ ID NO: 2951718 - RNA, 19 nt, Human
ccaauuugcacauuaaaug

SEQ ID NO: 2951719 - RNA, 20 nt, Human
ccaauuugcacauuaaauga

SEQ ID NO: 2951720 - RNA, 18 nt, Human
ccacaaaggagagcuagc

SEQ ID NO: 2951721 - RNA, 16 nt, Human
ccacaagaaaugaaag

SEQ ID NO: 2951722 - RNA, 22 nt, Human
ccacaagaaaugaaagcaggga

SEQ ID NO: 2951723 - RNA, 13 nt, Human
ccacaagagccca

SEQ ID NO: 2951724 - RNA, 16 nt, Human
ccacaagacccuugug

SEQ ID NO: 2951725 - RNA, 21 nt, Human
cauuuaaaagauacaguuacu

SEQ ID NO: 2951726 - RNA, 16 nt, Human
cauuuacuuaagacuu

SEQ ID NO: 2951727 - RNA, 17 nt, Human
cauuuacuuaagacuua

SEQ ID NO: 2951728 - RNA, 13 nt, Human
cauuuacuuaaga

SEQ ID NO: 2951729 - RNA, 14 nt, Human
cauuuacuuaagac

SEQ ID NO: 2951730 - RNA, 15 nt, Human
cauuuacuuaagacu

SEQ ID NO: 2951731 - RNA, 12 nt, Human
cauuuccaagca

SEQ ID NO: 2951732 - RNA, 17 nt, Human
cauuuacuuuguguuca

SEQ ID NO: 2951733 - RNA, 21 nt, Human
cauuuacuuuguguucaccuu

SEQ ID NO: 2951734 - RNA, 19 nt, Human
cauuuaaagcuuauuaaaa

SEQ ID NO: 2951735 - RNA, 17 nt, Human
cauuucucauguugaaa

SEQ ID NO: 2951736 - RNA, 16 nt, Human
cauuucucauguugaa

SEQ ID NO: 2951737 - RNA, 23 nt, Human
cauuucugcaucagcugcugaaa

SEQ ID NO: 2951738 - RNA, 21 nt, Human
cauuucuuccacaagagccca

SEQ ID NO: 2951739 - RNA, 14 nt, Human
cauugacagauuga

SEQ ID NO: 2951740 - RNA, 22 nt, Human
cauugaaaucuaggaaaauuau

SEQ ID NO: 2951741 - RNA, 22 nt, Human
cauugacuauuuuuguuuuuau

SEQ ID NO: 2951742 - RNA, 22 nt, Human
cauugaccugaggcccuucucu

SEQ ID NO: 2951743 - RNA, 13 nt, Human
cauugaccugagg

SEQ ID NO: 2951744 - RNA, 19 nt, Human
cauugaaaucuuuuugcuu

SEQ ID NO: 2951745 - RNA, 17 nt, Human
cauuugaggucuguucu

SEQ ID NO: 2951746 - RNA, 18 nt, Human
cauuugaggucuguucuu

SEQ ID NO: 2951747 - RNA, 19 nt, Human
cauuugaggucuguucuuu

SEQ ID NO: 2951748 - RNA, 14 nt, Human
cauuugagcagggc

SEQ ID NO: 2951749 - RNA, 23 nt, Human
cauuucuuccacaagagcccagg

SEQ ID NO: 2951750 - RNA, 20 nt, Human
cauuuugggguacccacugc

SEQ ID NO: 2951751 - RNA, 21 nt, Human
cauuuugggguacccacugcu

SEQ ID NO: 2951752 - RNA, 22 nt, Human
cauuuugggguacccacugcuc

SEQ ID NO: 2951753 - RNA, 24 nt, Human
cauuuugcuaaaugugaaugauga

SEQ ID NO: 2951754 - RNA, 21 nt, Human
cauuuugcuaaaugugaauga

SEQ ID NO: 2951755 - RNA, 18 nt, Human
cauuuugcuaaaugugaa

SEQ ID NO: 2951756 - RNA, 23 nt, Human
cauuuugggguacccacugcucu

SEQ ID NO: 2951757 - RNA, 19 nt, Human
cauuuuuaguagagacagg

SEQ ID NO: 2951758 - RNA, 18 nt, Human
cauuuuuaguagagacag

SEQ ID NO: 2951759 - RNA, 15 nt, Human
cauuuuuaagugcug

SEQ ID NO: 2951760 - RNA, 20 nt, Human
cauuuuuaagugcugcauuu

SEQ ID NO: 2951761 - RNA, 19 nt, Human
cauuuuauuuuauuaugca

SEQ ID NO: 2951762 - RNA, 21 nt, Human
cauuuuauuuuauuaugcaug

SEQ ID NO: 2951763 - RNA, 22 nt, Human
cauuuuaaacaaaauagaaagu

SEQ ID NO: 2951764 - RNA, 23 nt, Human
cauuuuaaacaaaauagaaaguu

SEQ ID NO: 2951765 - RNA, 13 nt, Human
cauuuuaaacaaa

SEQ ID NO: 2951766 - RNA, 16 nt, Human
cauuuuaaacaaaaua

SEQ ID NO: 2951767 - RNA, 17 nt, Human
cauuuuaaacaaaauag

SEQ ID NO: 2951768 - RNA, 16 nt, Human
cauuugcucauggaau

SEQ ID NO: 2951769 - RNA, 22 nt, Human
cauuugaggucuguucuuucca

SEQ ID NO: 2951770 - RNA, 12 nt, Human
cauuuuaaacaa

SEQ ID NO: 2951771 - RNA, 15 nt, Human
cauuugcucauggaa

SEQ ID NO: 2951772 - RNA, 14 nt, Human
cauuugcucaugga

SEQ ID NO: 2951773 - RNA, 20 nt, Human
cauuuuuaguagagacaggg

SEQ ID NO: 2951774 - RNA, 18 nt, Human
ccaaaauaaaacuuuuua

SEQ ID NO: 2951775 - RNA, 21 nt, Human
ccaaaauaaaacuuuuuaaaa

SEQ ID NO: 2951776 - RNA, 17 nt, Human
ccaaagaaauguaaggg

SEQ ID NO: 2951777 - RNA, 14 nt, Human
ccaucaugucuggc

SEQ ID NO: 2951778 - RNA, 16 nt, Human
ccaucaugucuggcua

SEQ ID NO: 2951779 - RNA, 16 nt, Human
ccauccugaggcucca

SEQ ID NO: 2951780 - RNA, 18 nt, Human
ccauccuggcccagggca

SEQ ID NO: 2951781 - RNA, 19 nt, Human
ccauccuggcccagggcau

SEQ ID NO: 2951782 - RNA, 20 nt, Human
ccauccuggcccagggcauc

SEQ ID NO: 2951783 - RNA, 22 nt, Human
ccauccuggcccagggcaucug

SEQ ID NO: 2951784 - RNA, 15 nt, Human
ccauccugaggcucc

SEQ ID NO: 2951785 - RNA, 21 nt, Human
ccauccucuguacagagccca

SEQ ID NO: 2951786 - RNA, 23 nt, Human
ccauagagagcaagacgcugugc

SEQ ID NO: 2951787 - RNA, 19 nt, Human
ccauauuaccacagacaua

SEQ ID NO: 2951788 - RNA, 15 nt, Human
ccauauucuguuggc

SEQ ID NO: 2951789 - RNA, 18 nt, Human
ccauauucuguuggccag

SEQ ID NO: 2951790 - RNA, 12 nt, Human
ccaucacccgcu

SEQ ID NO: 2951791 - RNA, 14 nt, Human
ccagugccucuccc

SEQ ID NO: 2951792 - RNA, 16 nt, Human
ccagugccucucccug

SEQ ID NO: 2951793 - RNA, 19 nt, Human
ccagugccucucccugcug

SEQ ID NO: 2951794 - RNA, 21 nt, Human
ccagugccucucccugcugcu

SEQ ID NO: 2951795 - RNA, 13 nt, Human
ccagugccugggu

SEQ ID NO: 2951796 - RNA, 14 nt, Human
ccagugccugggug

SEQ ID NO: 2951797 - RNA, 23 nt, Human
ccagggacagaggggguggccuc

SEQ ID NO: 2951798 - RNA, 19 nt, Human
ccaggccccugccacccug

SEQ ID NO: 2951799 - RNA, 21 nt, Human
ccaggccccugccacccuggg

SEQ ID NO: 2951800 - RNA, 23 nt, Human
ccaggccccugccacccugggga

SEQ ID NO: 2951801 - RNA, 14 nt, Human
ccaggccagaggga

SEQ ID NO: 2951802 - RNA, 21 nt, Human
ccaggccagagggagugacag

SEQ ID NO: 2951803 - RNA, 14 nt, Human
ccaggagcagccac

SEQ ID NO: 2951804 - RNA, 19 nt, Human
ccaggccuccuacagcuug

SEQ ID NO: 2951805 - RNA, 18 nt, Human
ccaggccuccuacagcuu

SEQ ID NO: 2951806 - RNA, 13 nt, Human
ccaggccuccuac

SEQ ID NO: 2951807 - RNA, 19 nt, Human
ccaggcccucugcccacuc

SEQ ID NO: 2951808 - RNA, 18 nt, Human
ccaggcccucugcccacu

SEQ ID NO: 2951809 - RNA, 17 nt, Human
ccaggcccucugcccac

SEQ ID NO: 2951810 - RNA, 16 nt, Human
ccaggcccucugccca

SEQ ID NO: 2951811 - RNA, 22 nt, Human
ccagcugugcucuggacaggca

SEQ ID NO: 2951812 - RNA, 23 nt, Human
ccagcugugcucuggacaggcau

SEQ ID NO: 2951813 - RNA, 19 nt, Human
ccaggaagccagcaggcuc

SEQ ID NO: 2951814 - RNA, 17 nt, Human
ccaggaagccagcaggc

SEQ ID NO: 2951815 - RNA, 15 nt, Human
ccaggaagccagcag

SEQ ID NO: 2951816 - RNA, 14 nt, Human
ccaggaagccagca

SEQ ID NO: 2951817 - RNA, 13 nt, Human
ccaggagcagcca

SEQ ID NO: 2951818 - RNA, 12 nt, Human
ccaggagcagcc

SEQ ID NO: 2951819 - RNA, 18 nt, Human
ccagcugugcucuggaca

SEQ ID NO: 2951820 - RNA, 20 nt, Human
ccagcugugcucuggacagg

SEQ ID NO: 2951821 - RNA, 21 nt, Human
ccagcugugcucuggacaggc

SEQ ID NO: 2951822 - RNA, 15 nt, Human
ccagcugcuugggcu

SEQ ID NO: 2951823 - RNA, 13 nt, Human
ccagcugcuuggg

SEQ ID NO: 2951824 - RNA, 18 nt, Human
ccagcugcuugggcuuca

SEQ ID NO: 2951825 - RNA, 16 nt, Human
ccagcugcuugggcuu

SEQ ID NO: 2951826 - RNA, 15 nt, Human
ccagccuggaugcca

SEQ ID NO: 2951827 - RNA, 13 nt, Human
ccagccuggaugc

SEQ ID NO: 2951828 - RNA, 17 nt, Human
ccagccuggaugccauc

SEQ ID NO: 2951829 - RNA, 21 nt, Human
ccccaaauggaaaugggcaga

SEQ ID NO: 2951830 - RNA, 20 nt, Human
cccauuaugcgcuguggcca

SEQ ID NO: 2951831 - RNA, 20 nt, Human
cccaucugugaaaggaaaga

SEQ ID NO: 2951832 - RNA, 13 nt, Human
cccaucucacaca

SEQ ID NO: 2951833 - RNA, 18 nt, Human
cccaucucacacaugagc

SEQ ID NO: 2951834 - RNA, 12 nt, Human
cccaucugugaa

SEQ ID NO: 2951835 - RNA, 14 nt, Human
cccaugcugcccug

SEQ ID NO: 2951836 - RNA, 13 nt, Human
cccaugcugcccu

SEQ ID NO: 2951837 - RNA, 12 nt, Human
cccaugcugccc

SEQ ID NO: 2951838 - RNA, 20 nt, Human
cccaugagccucagcauccu

SEQ ID NO: 2951839 - RNA, 15 nt, Human
cccaugagccucagc

SEQ ID NO: 2951840 - RNA, 16 nt, Human
cccaugagccucagca

SEQ ID NO: 2951841 - RNA, 15 nt, Human
cccaggguggccaca

SEQ ID NO: 2951842 - RNA, 19 nt, Human
cccaggguggccacaccuc

SEQ ID NO: 2951843 - RNA, 13 nt, Human
cccaggguggcca

SEQ ID NO: 2951844 - RNA, 14 nt, Human
cccaggguggccac

SEQ ID NO: 2951845 - RNA, 17 nt, Human
cccaggcauuccccagg

SEQ ID NO: 2951846 - RNA, 23 nt, Human
cccaggcaggucuugaacuccug

SEQ ID NO: 2951847 - RNA, 15 nt, Human
cccaggcauucccca

SEQ ID NO: 2951848 - RNA, 16 nt, Human
cccaggaggccagccu

SEQ ID NO: 2951849 - RNA, 15 nt, Human
cccaggaggccagcc

SEQ ID NO: 2951850 - RNA, 15 nt, Human
cccaguccugcccgc

SEQ ID NO: 2951851 - RNA, 13 nt, Human
cccagguuucuau

SEQ ID NO: 2951852 - RNA, 15 nt, Human
cccagugccgagaag

SEQ ID NO: 2951853 - RNA, 21 nt, Human
cccagugcccacaggaucagu

SEQ ID NO: 2951854 - RNA, 10 nt, Human
cccagucugg

SEQ ID NO: 2951855 - RNA, 18 nt, Human
cccagucuggaaugcagu

SEQ ID NO: 2951856 - RNA, 19 nt, Human
cccagucuggaaugcagug

SEQ ID NO: 2951857 - RNA, 20 nt, Human
cccagugguuccuaauccuc

SEQ ID NO: 2951858 - RNA, 14 nt, Human
cccaguuagcucuc

SEQ ID NO: 2951859 - RNA, 17 nt, Human
cccaguguuuuaggagc

SEQ ID NO: 2951860 - RNA, 16 nt, Human
cccaguguuuuaggag

SEQ ID NO: 2951861 - RNA, 13 nt, Human
cccaggagccccg

SEQ ID NO: 2951862 - RNA, 14 nt, Human
cccaggagccccga

SEQ ID NO: 2951863 - RNA, 14 nt, Human
cccaggaggccagc

SEQ ID NO: 2951864 - RNA, 22 nt, Human
cccagcuacucgggaggcugag

SEQ ID NO: 2951865 - RNA, 20 nt, Human
cccagcuacucgggaggcug

SEQ ID NO: 2951866 - RNA, 14 nt, Human
cccagcgagcccug

SEQ ID NO: 2951867 - RNA, 18 nt, Human
cccagcucugguccauag

SEQ ID NO: 2951868 - RNA, 16 nt, Human
cccagcucugguccau

SEQ ID NO: 2951869 - RNA, 15 nt, Human
cccagcucuggucca

SEQ ID NO: 2951870 - RNA, 12 nt, Human
cccagcucuggu

SEQ ID NO: 2951871 - RNA, 14 nt, Human
cccagcucuggucc

SEQ ID NO: 2951872 - RNA, 13 nt, Human
cccagcucugguc

SEQ ID NO: 2951873 - RNA, 15 nt, Human
cccagccccauccuc

SEQ ID NO: 2951874 - RNA, 14 nt, Human
cccagccccauccu

SEQ ID NO: 2951875 - RNA, 14 nt, Human
cccagccccauccc

SEQ ID NO: 2951876 - RNA, 13 nt, Human
cccagccccaucc

SEQ ID NO: 2951877 - RNA, 19 nt, Human
cccagccccauccucugua

SEQ ID NO: 2951878 - RNA, 18 nt, Human
cccagccccauccucugu

SEQ ID NO: 2951879 - RNA, 13 nt, Human
cccagccccaaug

SEQ ID NO: 2951880 - RNA, 12 nt, Human
cccagccccauc

SEQ ID NO: 2951881 - RNA, 11 nt, Human
cccagccccau

SEQ ID NO: 2951882 - RNA, 17 nt, Human
cccagccccaaugaaca

SEQ ID NO: 2951883 - RNA, 23 nt, Human
cccagauugcaacaggcugggcu

SEQ ID NO: 2951884 - RNA, 18 nt, Human
cccaggaggccagccuug

SEQ ID NO: 2951885 - RNA, 19 nt, Human
ccauguuggccaggcuggu

SEQ ID NO: 2951886 - RNA, 21 nt, Human
ccauguuggccaggcuggucu

SEQ ID NO: 2951887 - RNA, 18 nt, Human
ccauguuggccaggcugg

SEQ ID NO: 2951888 - RNA, 15 nt, Human
ccauguuggccaggc

SEQ ID NO: 2951889 - RNA, 15 nt, Human
cccaccuggccucug

SEQ ID NO: 2951890 - RNA, 12 nt, Human
cccaccuggccu

SEQ ID NO: 2951891 - RNA, 16 nt, Human
cccaccuuggcugcag

SEQ ID NO: 2951892 - RNA, 17 nt, Human
cccaccuuggcugcagg

SEQ ID NO: 2951893 - RNA, 19 nt, Human
cccaccuuggcugcaggga

SEQ ID NO: 2951894 - RNA, 20 nt, Human
cccaccuuggcugcagggag

SEQ ID NO: 2951895 - RNA, 15 nt, Human
cccacgcccccacug

SEQ ID NO: 2951896 - RNA, 14 nt, Human
cccacgcccccacu

SEQ ID NO: 2951897 - RNA, 13 nt, Human
cccacgcccccac

SEQ ID NO: 2951898 - RNA, 15 nt, Human
ccaugcugcccugug

SEQ ID NO: 2951899 - RNA, 18 nt, Human
ccaugcuccuggcccacu

SEQ ID NO: 2951900 - RNA, 15 nt, Human
ccaugcuccuggccc

SEQ ID NO: 2951901 - RNA, 17 nt, Human
ccaugcugcccugugag

SEQ ID NO: 2951902 - RNA, 16 nt, Human
ccaugcugcccuguga

SEQ ID NO: 2951903 - RNA, 10 nt, Human
ccaugaaaga

SEQ ID NO: 2951904 - RNA, 13 nt, Human
ccaugcuccuggc

SEQ ID NO: 2951905 - RNA, 13 nt, Human
ccauguuggccag

SEQ ID NO: 2951906 - RNA, 14 nt, Human
ccauguuggccagg

SEQ ID NO: 2951907 - RNA, 13 nt, Human
ccaugugccaggu

SEQ ID NO: 2951908 - RNA, 23 nt, Human
ccauggcacucuauguucuaaga

SEQ ID NO: 2951909 - RNA, 17 nt, Human
ccgggaagggggcuggg

SEQ ID NO: 2951910 - RNA, 12 nt, Human
cccuucccaccu

SEQ ID NO: 2951911 - RNA, 13 nt, Human
cccuucccaccuc

SEQ ID NO: 2951912 - RNA, 20 nt, Human
cccuuguggucccaccccac

SEQ ID NO: 2951913 - RNA, 22 nt, Human
cccuuguggucccaccccacac

SEQ ID NO: 2951914 - RNA, 19 nt, Human
cccuugucggccccaccag

SEQ ID NO: 2951915 - RNA, 22 nt, Human
cccuugucggccccaccagugc

SEQ ID NO: 2951916 - RNA, 23 nt, Human
cccuugguuaggcauugugggaa

SEQ ID NO: 2951917 - RNA, 22 nt, Human
cccuugguuaggcauuguggga

SEQ ID NO: 2951918 - RNA, 14 nt, Human
cccuuggacauuuu

SEQ ID NO: 2951919 - RNA, 15 nt, Human
cccuuggacauuuua

SEQ ID NO: 2951920 - RNA, 17 nt, Human
cccuuggauuguccccg

SEQ ID NO: 2951921 - RNA, 17 nt, Human
cccuucuuuccacagaa

SEQ ID NO: 2951922 - RNA, 21 nt, Human
ccuagaaauuccccacccuga

SEQ ID NO: 2951923 - RNA, 13 nt, Human
ccuaggugacaga

SEQ ID NO: 2951924 - RNA, 13 nt, Human
ccuacccacccuc

SEQ ID NO: 2951925 - RNA, 18 nt, Human
ccuacccacccuccuuuc

SEQ ID NO: 2951926 - RNA, 19 nt, Human
ccuacuguaauuugugaua

SEQ ID NO: 2951927 - RNA, 22 nt, Human
ccuacaguugaaaaacagcuga

SEQ ID NO: 2951928 - RNA, 19 nt, Human
ccuacagcuugaccgugag

SEQ ID NO: 2951929 - RNA, 16 nt, Human
ccuaaaauucagugga

SEQ ID NO: 2951930 - RNA, 13 nt, Human
ccuaaacauauga

SEQ ID NO: 2951931 - RNA, 12 nt, Human
ccguuauuaaaa

SEQ ID NO: 2951932 - RNA, 15 nt, Human
ccuaggugacagagu

SEQ ID NO: 2951933 - RNA, 23 nt, Human
ccucacaguccuuaccagcagag

SEQ ID NO: 2951934 - RNA, 24 nt, Human
ccucacaguccuuaccagcagagc

SEQ ID NO: 2951935 - RNA, 16 nt, Human
ccuauuagagaagaga

SEQ ID NO: 2951936 - RNA, 17 nt, Human
ccuauuagagaagagau

SEQ ID NO: 2951937 - RNA, 23 nt, Human
ccucaggccugggggcugggcag

SEQ ID NO: 2951938 - RNA, 20 nt, Human
ccucagggucccugguggca

SEQ ID NO: 2951939 - RNA, 17 nt, Human
ccucagggucccuggug

SEQ ID NO: 2951940 - RNA, 16 nt, Human
ccucagggucccuggu

SEQ ID NO: 2951941 - RNA, 20 nt, Human
ccucagaugcacaugagcug

SEQ ID NO: 2951942 - RNA, 16 nt, Human
ccucagaucuucugug

SEQ ID NO: 2951943 - RNA, 21 nt, Human
ccucugacacacagcucuguc

SEQ ID NO: 2951944 - RNA, 14 nt, Human
ccucuccuccacau

SEQ ID NO: 2951945 - RNA, 13 nt, Human
ccucugacacaca

SEQ ID NO: 2951946 - RNA, 14 nt, Human
ccucugacacacag

SEQ ID NO: 2951947 - RNA, 19 nt, Human
ccucugacacacagcucug

SEQ ID NO: 2951948 - RNA, 20 nt, Human
ccucugacacacagcucugu

SEQ ID NO: 2951949 - RNA, 15 nt, Human
ccucugcacuccccu

SEQ ID NO: 2951950 - RNA, 17 nt, Human
ccucugcacuccccugc

SEQ ID NO: 2951951 - RNA, 16 nt, Human
ccucugcacuccccug

SEQ ID NO: 2951952 - RNA, 18 nt, Human
ccucugcacuccccugcu

SEQ ID NO: 2951953 - RNA, 23 nt, Human
ccucugcacuccccugcugggug

SEQ ID NO: 2951954 - RNA, 14 nt, Human
ccucugcagcaaua

SEQ ID NO: 2951955 - RNA, 18 nt, Human
ccucugcagcaauaaagc

SEQ ID NO: 2951956 - RNA, 16 nt, Human
ccucugcccacucccu

SEQ ID NO: 2951957 - RNA, 13 nt, Human
ccucugcccacuc

SEQ ID NO: 2951958 - RNA, 19 nt, Human
ccucugcagcaauaaagca

SEQ ID NO: 2951959 - RNA, 21 nt, Human
ccuccuccagccgccaugcuc

SEQ ID NO: 2951960 - RNA, 15 nt, Human
ccucuccccagcaag

SEQ ID NO: 2951961 - RNA, 23 nt, Human
ccucucccugcugcuccuaggac

SEQ ID NO: 2951962 - RNA, 15 nt, Human
ccucucccugcugcu

SEQ ID NO: 2951963 - RNA, 17 nt, Human
ccucucccugcugcucc

SEQ ID NO: 2951964 - RNA, 19 nt, Human
ccucucccugcugcuccua

SEQ ID NO: 2951965 - RNA, 14 nt, Human
ccucucccugcugc

SEQ ID NO: 2951966 - RNA, 22 nt, Human
ccucucccuuggauuguccccg

SEQ ID NO: 2951967 - RNA, 13 nt, Human
ccucucccuugga

SEQ ID NO: 2951968 - RNA, 20 nt, Human
ccucuccccagcaagugaga

SEQ ID NO: 2951969 - RNA, 20 nt, Human
ccucaggugagaagcagagg

SEQ ID NO: 2951970 - RNA, 18 nt, Human
ccucaggugagaagcaga

SEQ ID NO: 2951971 - RNA, 17 nt, Human
ccucaggugagaagcag

SEQ ID NO: 2951972 - RNA, 12 nt, Human
ccuccaggugca

SEQ ID NO: 2951973 - RNA, 11 nt, Human
ccuccaggugc

SEQ ID NO: 2951974 - RNA, 17 nt, Human
ccuccaggugcacaagc

SEQ ID NO: 2951975 - RNA, 12 nt, Human
ccuccauguggg

SEQ ID NO: 2951976 - RNA, 15 nt, Human
ccuccaugugggcua

SEQ ID NO: 2951977 - RNA, 17 nt, Human
ccucccaaagugcuggg

SEQ ID NO: 2951978 - RNA, 14 nt, Human
ccucccaacucacc

SEQ ID NO: 2951979 - RNA, 12 nt, Human
ccuccauccuga

SEQ ID NO: 2951980 - RNA, 13 nt, Human
ccuccauccugag

SEQ ID NO: 2951981 - RNA, 13 nt, Human
ccucccucuuucc

SEQ ID NO: 2951982 - RNA, 11 nt, Human
ccuccucagau

SEQ ID NO: 2951983 - RNA, 12 nt, Human
ccuccuccagcc

SEQ ID NO: 2951984 - RNA, 17 nt, Human
ccucccgaguagcuggg

SEQ ID NO: 2951985 - RNA, 18 nt, Human
ccucccgaguagcuggga

SEQ ID NO: 2951986 - RNA, 21 nt, Human
ccucccgaauagcugggacua

SEQ ID NO: 2951987 - RNA, 19 nt, Human
ccucccgaauagcugggac

SEQ ID NO: 2951988 - RNA, 20 nt, Human
ccucccgaauagcugggacu

SEQ ID NO: 2951989 - RNA, 16 nt, Human
ccucccccuggcacug

SEQ ID NO: 2951990 - RNA, 15 nt, Human
ccucccaacucaccc

SEQ ID NO: 2951991 - RNA, 18 nt, Human
ccucccgaauagcuggga

SEQ ID NO: 2951992 - RNA, 12 nt, Human
ccuccccuccuc

SEQ ID NO: 2951993 - RNA, 13 nt, Human
ccuccccuccucu

SEQ ID NO: 2951994 - RNA, 19 nt, Human
cccugcugguucaggguug

SEQ ID NO: 2951995 - RNA, 20 nt, Human
cccugcugguucaggguugg

SEQ ID NO: 2951996 - RNA, 13 nt, Human
cccugcugguuca

SEQ ID NO: 2951997 - RNA, 22 nt, Human
cccugguggcagugggagcugc

SEQ ID NO: 2951998 - RNA, 12 nt, Human
cccugccacccu

SEQ ID NO: 2951999 - RNA, 14 nt, Human
cccugccacccugg

SEQ ID NO: 2952000 - RNA, 15 nt, Human
cccugccacccuggg

SEQ ID NO: 2952001 - RNA, 17 nt, Human
cccugccacccugggga

SEQ ID NO: 2952002 - RNA, 18 nt, Human
cccugccacccuggggag

SEQ ID NO: 2952003 - RNA, 23 nt, Human
cccugccuccuuugugaggaagc

SEQ ID NO: 2952004 - RNA, 16 nt, Human
cccugccuccuuugug

SEQ ID NO: 2952005 - RNA, 14 nt, Human
cccugccuccuuug

SEQ ID NO: 2952006 - RNA, 21 nt, Human
cccugauuuaauaugcaaagu

SEQ ID NO: 2952007 - RNA, 22 nt, Human
cccugcacuugcagacucuaca

SEQ ID NO: 2952008 - RNA, 12 nt, Human
cccugcagaggg

SEQ ID NO: 2952009 - RNA, 18 nt, Human
cccugcagagggcacaga

SEQ ID NO: 2952010 - RNA, 14 nt, Human
cccugcaauaaaau

SEQ ID NO: 2952011 - RNA, 15 nt, Human
cccugcaauaaaaug

SEQ ID NO: 2952012 - RNA, 16 nt, Human
cccugcaaccugauug

SEQ ID NO: 2952013 - RNA, 22 nt, Human
cccugcaaccugauugugucuc

SEQ ID NO: 2952014 - RNA, 14 nt, Human
cccugguggcagcu

SEQ ID NO: 2952015 - RNA, 22 nt, Human
ccccuguccccgcacugggcuu

SEQ ID NO: 2952016 - RNA, 20 nt, Human
ccccuguucuggcagaguug

SEQ ID NO: 2952017 - RNA, 22 nt, Human
cccgcuaagagggagggagggc

SEQ ID NO: 2952018 - RNA, 23 nt, Human
cccgauggaggacuccaggcagc

SEQ ID NO: 2952019 - RNA, 22 nt, Human
cccgauggaggacuccaggcag

SEQ ID NO: 2952020 - RNA, 20 nt, Human
cccgaggccuucucugaagg

SEQ ID NO: 2952021 - RNA, 15 nt, Human
cccgaggccuucucu

SEQ ID NO: 2952022 - RNA, 13 nt, Human
ccccagccugcua

SEQ ID NO: 2952023 - RNA, 14 nt, Human
ccccaccagugccu

SEQ ID NO: 2952024 - RNA, 13 nt, Human
ccccaccagugcc

SEQ ID NO: 2952025 - RNA, 15 nt, Human
ccccagccccauccu

SEQ ID NO: 2952026 - RNA, 12 nt, Human
ccccacagcccc

SEQ ID NO: 2952027 - RNA, 16 nt, Human
ccccagccccauccca

SEQ ID NO: 2952028 - RNA, 12 nt, Human
ccccaggaggcc

SEQ ID NO: 2952029 - RNA, 15 nt, Human
ccccuggcagccccu

SEQ ID NO: 2952030 - RNA, 14 nt, Human
ccccuggcagcccc

SEQ ID NO: 2952031 - RNA, 12 nt, Human
ccccuggcagcc

SEQ ID NO: 2952032 - RNA, 14 nt, Human
ccccaggugccagu

SEQ ID NO: 2952033 - RNA, 22 nt, Human
ccccaggugguuauggagaggg

SEQ ID NO: 2952034 - RNA, 15 nt, Human
cccucagggucccug

SEQ ID NO: 2952035 - RNA, 19 nt, Human
cccucagggucccuggugg

SEQ ID NO: 2952036 - RNA, 18 nt, Human
cccucagggucccuggug

SEQ ID NO: 2952037 - RNA, 17 nt, Human
cccucagggucccuggu

SEQ ID NO: 2952038 - RNA, 16 nt, Human
cccucagggucccugg

SEQ ID NO: 2952039 - RNA, 22 nt, Human
cccuaaaguguauuuuuuuacu

SEQ ID NO: 2952040 - RNA, 17 nt, Human
cccuaaaguguauuuuu

SEQ ID NO: 2952041 - RNA, 16 nt, Human
cccggcaggguccuag

SEQ ID NO: 2952042 - RNA, 21 nt, Human
cccucagggucccugguggca

SEQ ID NO: 2952043 - RNA, 20 nt, Human
cccucagucuggcccuuccu

SEQ ID NO: 2952044 - RNA, 22 nt, Human
cccucaucaccaacgucugugc

SEQ ID NO: 2952045 - RNA, 20 nt, Human
cccucauccucauacccacc

SEQ ID NO: 2952046 - RNA, 17 nt, Human
cccucauccucauaccc

SEQ ID NO: 2952047 - RNA, 21 nt, Human
cccuccaagaccuucuccuuc

SEQ ID NO: 2952048 - RNA, 22 nt, Human
cccucauccucauacccacccc

SEQ ID NO: 2952049 - RNA, 17 nt, Human
cccucaugcugccaaua

SEQ ID NO: 2952050 - RNA, 14 nt, Human
cccucaugcugcca

SEQ ID NO: 2952051 - RNA, 19 nt, Human
cccuccagagccccacagc

SEQ ID NO: 2952052 - RNA, 21 nt, Human
cccuccagagccccacagccc

SEQ ID NO: 2952053 - RNA, 17 nt, Human
cccuccaugugggcuag

SEQ ID NO: 2952054 - RNA, 13 nt, Human
cccucccuccacc

SEQ ID NO: 2952055 - RNA, 12 nt, Human
cccucccuccac

SEQ ID NO: 2952056 - RNA, 20 nt, Human
cccucccuccaccucccugc

SEQ ID NO: 2952057 - RNA, 13 nt, Human
cccucccucuuuc

SEQ ID NO: 2952058 - RNA, 14 nt, Human
cuaugcauuugaaa

SEQ ID NO: 2952059 - RNA, 21 nt, Human
cucaacucuccuccagaguca

SEQ ID NO: 2952060 - RNA, 20 nt, Human
cucaacucuccuccagaguc

SEQ ID NO: 2952061 - RNA, 15 nt, Human
cucaagagcaaagua

SEQ ID NO: 2952062 - RNA, 19 nt, Human
cucaacucuccuccagagu

SEQ ID NO: 2952063 - RNA, 23 nt, Human
cucacaguccuuaccagcagagc

SEQ ID NO: 2952064 - RNA, 18 nt, Human
cucaagugauucuccugc

SEQ ID NO: 2952065 - RNA, 19 nt, Human
cucaagugauucuccugcc

SEQ ID NO: 2952066 - RNA, 20 nt, Human
cucaagugauucuccugccu

SEQ ID NO: 2952067 - RNA, 20 nt, Human
cucaccagccccagugccca

SEQ ID NO: 2952068 - RNA, 21 nt, Human
cucaccagccccagugcccac

SEQ ID NO: 2952069 - RNA, 19 nt, Human
cucaccagccccagugccc

SEQ ID NO: 2952070 - RNA, 14 nt, Human
cucaccccagcccc

SEQ ID NO: 2952071 - RNA, 13 nt, Human
cucaccccagccc

SEQ ID NO: 2952072 - RNA, 12 nt, Human
cucaccccagcc

SEQ ID NO: 2952073 - RNA, 16 nt, Human
cucacuauguugccca

SEQ ID NO: 2952074 - RNA, 17 nt, Human
cucacuauguugcccag

SEQ ID NO: 2952075 - RNA, 17 nt, Human
cucaccccuugccauaa

SEQ ID NO: 2952076 - RNA, 11 nt, Human
cuaugcauuug

SEQ ID NO: 2952077 - RNA, 12 nt, Human
cuaugcauuuga

SEQ ID NO: 2952078 - RNA, 22 nt, Human
cuauauuuuuuguuaaaugauu

SEQ ID NO: 2952079 - RNA, 20 nt, Human
cuaucaaguauuauaccuuu

SEQ ID NO: 2952080 - RNA, 14 nt, Human
cuaugacacaugca

SEQ ID NO: 2952081 - RNA, 13 nt, Human
cuaugaaauauua

SEQ ID NO: 2952082 - RNA, 18 nt, Human
cuaguguuuucaauuuua

SEQ ID NO: 2952083 - RNA, 22 nt, Human
cuaguguuuucaauuuuaaaca

SEQ ID NO: 2952084 - RNA, 18 nt, Human
cuauauuguuugcuaagc

SEQ ID NO: 2952085 - RNA, 19 nt, Human
cuauauuguuugcuaagca

SEQ ID NO: 2952086 - RNA, 22 nt, Human
cuauauuguuuucaguguacau

SEQ ID NO: 2952087 - RNA, 20 nt, Human
cuauauuuuuuguuaaauga

SEQ ID NO: 2952088 - RNA, 23 nt, Human
cuauauuguuuucaguguacaug

SEQ ID NO: 2952089 - RNA, 20 nt, Human
cuaggacccgucuccagcug

SEQ ID NO: 2952090 - RNA, 21 nt, Human
cuaggacccgucuccagcugc

SEQ ID NO: 2952091 - RNA, 22 nt, Human
cuaggaccccuccaugugggcu

SEQ ID NO: 2952092 - RNA, 22 nt, Human
cuaggacccgucuccagcugcu

SEQ ID NO: 2952093 - RNA, 23 nt, Human
cuaggacccgucuccagcugcug

SEQ ID NO: 2952094 - RNA, 22 nt, Human
cuaggacugaauuaugaaacuu

SEQ ID NO: 2952095 - RNA, 14 nt, Human
cuaggagguaauga

SEQ ID NO: 2952096 - RNA, 17 nt, Human
cuaggaggucucuaaga

SEQ ID NO: 2952097 - RNA, 22 nt, Human
cuaggaaauauuuauuuuaaua

SEQ ID NO: 2952098 - RNA, 15 nt, Human
cuaggaacacuccuu

SEQ ID NO: 2952099 - RNA, 13 nt, Human
cuaggaacacucc

SEQ ID NO: 2952100 - RNA, 21 nt, Human
cuaggaagacuuuggaaagag

SEQ ID NO: 2952101 - RNA, 19 nt, Human
cuagugugguguuuccugg

SEQ ID NO: 2952102 - RNA, 23 nt, Human
cuagugugguguuuccuggcacu

SEQ ID NO: 2952103 - RNA, 22 nt, Human
cuagugugguguuuccuggcac

SEQ ID NO: 2952104 - RNA, 21 nt, Human
cuagugugguguuuccuggca

SEQ ID NO: 2952105 - RNA, 21 nt, Human
cuaggcauuugcugaauacag

SEQ ID NO: 2952106 - RNA, 22 nt, Human
cuaguauuucuaugaaauauua

SEQ ID NO: 2952107 - RNA, 19 nt, Human
cuaguauuucuaugaaaua

SEQ ID NO: 2952108 - RNA, 20 nt, Human
cuaguauuucuaugaaauau

SEQ ID NO: 2952109 - RNA, 23 nt, Human
cuaguaucaaaagaaagaaaauc

SEQ ID NO: 2952110 - RNA, 15 nt, Human
cuaguaucaaaagaa

SEQ ID NO: 2952111 - RNA, 17 nt, Human
cuaguaucaaaagaaag

SEQ ID NO: 2952112 - RNA, 14 nt, Human
cuacugaggugcua

SEQ ID NO: 2952113 - RNA, 17 nt, Human
cuacuguaauuugugau

SEQ ID NO: 2952114 - RNA, 16 nt, Human
cuacuguaauuuguga

SEQ ID NO: 2952115 - RNA, 13 nt, Human
cuacucuguguca

SEQ ID NO: 2952116 - RNA, 16 nt, Human
cuacucugugucaggu

SEQ ID NO: 2952117 - RNA, 21 nt, Human
cuacucugugucagguggggc

SEQ ID NO: 2952118 - RNA, 21 nt, Human
cuacccgggaagggggcuggg

SEQ ID NO: 2952119 - RNA, 20 nt, Human
cuacccgggaagggggcugg

SEQ ID NO: 2952120 - RNA, 15 nt, Human
cuacccgggaagggg

SEQ ID NO: 2952121 - RNA, 14 nt, Human
cuacccgggaaggg

SEQ ID NO: 2952122 - RNA, 22 nt, Human
cuacuuauuguagcauccugga

SEQ ID NO: 2952123 - RNA, 15 nt, Human
cuacuugggaggcug

SEQ ID NO: 2952124 - RNA, 18 nt, Human
cuacuugggaggcugaga

SEQ ID NO: 2952125 - RNA, 19 nt, Human
cuacuugggaggcugagau

SEQ ID NO: 2952126 - RNA, 21 nt, Human
cuagacgagcaggcuucuucc

SEQ ID NO: 2952127 - RNA, 20 nt, Human
cuagacgagcaggcuucuuc

SEQ ID NO: 2952128 - RNA, 21 nt, Human
cuagagugaacuugggccacu

SEQ ID NO: 2952129 - RNA, 17 nt, Human
cuagagugaacuugggc

SEQ ID NO: 2952130 - RNA, 17 nt, Human
cuagcacuuugggaggc

SEQ ID NO: 2952131 - RNA, 18 nt, Human
cuaauauguaacaagcca

SEQ ID NO: 2952132 - RNA, 20 nt, Human
cuaauaaaauuuaaaagucu

SEQ ID NO: 2952133 - RNA, 16 nt, Human
cuaaggugugcucuga

SEQ ID NO: 2952134 - RNA, 21 nt, Human
cuaauaaaauuuaaaagucuu

SEQ ID NO: 2952135 - RNA, 14 nt, Human
cuaauguacugcau

SEQ ID NO: 2952136 - RNA, 16 nt, Human
cuaauguacugcauau

SEQ ID NO: 2952137 - RNA, 20 nt, Human
cuacccagcgagcccuggug

SEQ ID NO: 2952138 - RNA, 19 nt, Human
cuacccagcgagcccuggu

SEQ ID NO: 2952139 - RNA, 17 nt, Human
cuacccacccuccuuuc

SEQ ID NO: 2952140 - RNA, 13 nt, Human
cuacccacccucc

SEQ ID NO: 2952141 - RNA, 22 nt, Human
cuacccacccuccuuucaccac

SEQ ID NO: 2952142 - RNA, 15 nt, Human
cuacagaggccaugg

SEQ ID NO: 2952143 - RNA, 18 nt, Human
cuacacaccuaacuuaug

SEQ ID NO: 2952144 - RNA, 13 nt, Human
cuacacacugcau

SEQ ID NO: 2952145 - RNA, 15 nt, Human
cuacacacugcaugu

SEQ ID NO: 2952146 - RNA, 16 nt, Human
cuacacuccagugaga

SEQ ID NO: 2952147 - RNA, 17 nt, Human
cuacacuccagugagac

SEQ ID NO: 2952148 - RNA, 18 nt, Human
cuacacugugcugagucu

SEQ ID NO: 2952149 - RNA, 15 nt, Human
cuaaggugugcucug

SEQ ID NO: 2952150 - RNA, 19 nt, Human
cuaagcuauucaguaauaa

SEQ ID NO: 2952151 - RNA, 21 nt, Human
cuaagcuauucaguaauaacu

SEQ ID NO: 2952152 - RNA, 16 nt, Human
cuaaccagcagaaaug

SEQ ID NO: 2952153 - RNA, 17 nt, Human
cuaaccacgcuggaccu

SEQ ID NO: 2952154 - RNA, 17 nt, Human
cuaaccagcagaaaugc

SEQ ID NO: 2952155 - RNA, 14 nt, Human
cuaagcaaaaugug

SEQ ID NO: 2952156 - RNA, 15 nt, Human
cuaagcaaaauguga

SEQ ID NO: 2952157 - RNA, 18 nt, Human
cuaagcaaaaugugauau

SEQ ID NO: 2952158 - RNA, 16 nt, Human
cuaaauguugaaagau

SEQ ID NO: 2952159 - RNA, 23 nt, Human
cuaaauugacacuuaaaaauggu

SEQ ID NO: 2952160 - RNA, 17 nt, Human
cuaacauggaaguacua

SEQ ID NO: 2952161 - RNA, 15 nt, Human
cuaacauggaaguac

SEQ ID NO: 2952162 - RNA, 15 nt, Human
cuaaauggaaccacu

SEQ ID NO: 2952163 - RNA, 20 nt, Human
cuaaaucuccaaaauaaaac

SEQ ID NO: 2952164 - RNA, 16 nt, Human
cuaaauggaaccacuc

SEQ ID NO: 2952165 - RNA, 17 nt, Human
cuaaauggaaccacucu

SEQ ID NO: 2952166 - RNA, 18 nt, Human
cuaaauggaaccacucua

SEQ ID NO: 2952167 - RNA, 17 nt, Human
cuaaaacaacagaugua

SEQ ID NO: 2952168 - RNA, 22 nt, Human
cuaaaaaugcaaaaaaaauuag

SEQ ID NO: 2952169 - RNA, 13 nt, Human
cuaaaauguucua

SEQ ID NO: 2952170 - RNA, 14 nt, Human
cgucuccagcugcu

SEQ ID NO: 2952171 - RNA, 16 nt, Human
cgucuaccugaggggc

SEQ ID NO: 2952172 - RNA, 16 nt, Human
cgucucauacucaccu

SEQ ID NO: 2952173 - RNA, 18 nt, Human
cggugcuaucucccccag

SEQ ID NO: 2952174 - RNA, 21 nt, Human
cggugcuaucucccccagccc

SEQ ID NO: 2952175 - RNA, 20 nt, Human
cggugcuaucucccccagcc

SEQ ID NO: 2952176 - RNA, 22 nt, Human
cggugcuaucucccccagcccc

SEQ ID NO: 2952177 - RNA, 20 nt, Human
cgucugacaggcaaugcugg

SEQ ID NO: 2952178 - RNA, 21 nt, Human
cgucugacaggcaaugcuggc

SEQ ID NO: 2952179 - RNA, 22 nt, Human
cgucugacaggcaaugcuggcu

SEQ ID NO: 2952180 - RNA, 16 nt, Human
cgugcacacaccagag

SEQ ID NO: 2952181 - RNA, 21 nt, Human
cgugcaguggugcgaucuggg

SEQ ID NO: 2952182 - RNA, 23 nt, Human
cgugcauaccacuuuuguucuug

SEQ ID NO: 2952183 - RNA, 18 nt, Human
cgugcacacaccagagcc

SEQ ID NO: 2952184 - RNA, 19 nt, Human
cgugcacacaccagagccc

SEQ ID NO: 2952185 - RNA, 18 nt, Human
cgugcacgcacacugucu

SEQ ID NO: 2952186 - RNA, 14 nt, Human
cgugcacacaccag

SEQ ID NO: 2952187 - RNA, 22 nt, Human
cgcuaagagggagggagggcuc

SEQ ID NO: 2952188 - RNA, 16 nt, Human
cgcuacccgggaaggg

SEQ ID NO: 2952189 - RNA, 14 nt, Human
cgcucucuggccuu

SEQ ID NO: 2952190 - RNA, 15 nt, Human
cgcucucuggccuuc

SEQ ID NO: 2952191 - RNA, 15 nt, Human
cggaaaacaugcuac

SEQ ID NO: 2952192 - RNA, 20 nt, Human
cggaaaacaugcuacacacu

SEQ ID NO: 2952193 - RNA, 18 nt, Human
cgcugugcugcccugccc

SEQ ID NO: 2952194 - RNA, 15 nt, Human
cgcugugcugcccug

SEQ ID NO: 2952195 - RNA, 17 nt, Human
cgcugugcugcccugcc

SEQ ID NO: 2952196 - RNA, 16 nt, Human
cgcugugcugcccugc

SEQ ID NO: 2952197 - RNA, 22 nt, Human
cgcugucagccauuccuguucc

SEQ ID NO: 2952198 - RNA, 18 nt, Human
cgcucucuggccuucggc

SEQ ID NO: 2952199 - RNA, 20 nt, Human
ccucugcccacucccugcaa

SEQ ID NO: 2952200 - RNA, 19 nt, Human
ccucugcccacucccugca

SEQ ID NO: 2952201 - RNA, 17 nt, Human
ccucugcccacucccug

SEQ ID NO: 2952202 - RNA, 22 nt, Human
cgccagauucuuuccugaggcu

SEQ ID NO: 2952203 - RNA, 22 nt, Human
cgccagcucaccccaucauccc

SEQ ID NO: 2952204 - RNA, 16 nt, Human
cgccaucccagcccca

SEQ ID NO: 2952205 - RNA, 14 nt, Human
cgccaucccagccc

SEQ ID NO: 2952206 - RNA, 23 nt, Human
cgccaggggaaaaucagccugcu

SEQ ID NO: 2952207 - RNA, 22 nt, Human
cgcccaggcuuagucacugaga

SEQ ID NO: 2952208 - RNA, 23 nt, Human
cggggacagcuccuucuguccua

SEQ ID NO: 2952209 - RNA, 14 nt, Human
cgggggcagugcuc

SEQ ID NO: 2952210 - RNA, 22 nt, Human
cgggggcagugcucacccacac

SEQ ID NO: 2952211 - RNA, 15 nt, Human
cgggggcagagaggg

SEQ ID NO: 2952212 - RNA, 20 nt, Human
cgggaggucgaggcaggagg

SEQ ID NO: 2952213 - RNA, 18 nt, Human
cgggaggucgaggcagga

SEQ ID NO: 2952214 - RNA, 22 nt, Human
cggggacagcuccuucuguccu

SEQ ID NO: 2952215 - RNA, 14 nt, Human
cgggcacucagaag

SEQ ID NO: 2952216 - RNA, 22 nt, Human
cgggcacucagaagacacugau

SEQ ID NO: 2952217 - RNA, 19 nt, Human
cggcuggccuggccccuca

SEQ ID NO: 2952218 - RNA, 22 nt, Human
cggcuggccuggccccucaggg

SEQ ID NO: 2952219 - RNA, 23 nt, Human
cggcuggccuggccccucagggu

SEQ ID NO: 2952220 - RNA, 20 nt, Human
cggugagaggggaacagacu

SEQ ID NO: 2952221 - RNA, 21 nt, Human
cggugagaggggaacagacug

SEQ ID NO: 2952222 - RNA, 17 nt, Human
cggugagcuacaaaugc

SEQ ID NO: 2952223 - RNA, 22 nt, Human
cggucggguuuuauuguuuaaa

SEQ ID NO: 2952224 - RNA, 14 nt, Human
cgguccacccagga

SEQ ID NO: 2952225 - RNA, 15 nt, Human
cgguccacccaggag

SEQ ID NO: 2952226 - RNA, 16 nt, Human
cgguccacccaggagc

SEQ ID NO: 2952227 - RNA, 20 nt, Human
cgguccacccaggagccccg

SEQ ID NO: 2952228 - RNA, 21 nt, Human
cggguuuuauuguuuaaaauc

SEQ ID NO: 2952229 - RNA, 17 nt, Human
cggccaccugcggugcu

SEQ ID NO: 2952230 - RNA, 16 nt, Human
cggccaccugcggugc

SEQ ID NO: 2952231 - RNA, 15 nt, Human
cggccaccugcggug

SEQ ID NO: 2952232 - RNA, 11 nt, Human
cggccaccugc

SEQ ID NO: 2952233 - RNA, 13 nt, Human
cggaagagccuug

SEQ ID NO: 2952234 - RNA, 13 nt, Human
cggccccugcugg

SEQ ID NO: 2952235 - RNA, 18 nt, Human
cggccccugcugguucag

SEQ ID NO: 2952236 - RNA, 19 nt, Human
cggccccugcugguucagg

SEQ ID NO: 2952237 - RNA, 24 nt, Human
cggccaggccagagggagugacag

SEQ ID NO: 2952238 - RNA, 12 nt, Human
cggccuccaucc

SEQ ID NO: 2952239 - RNA, 17 nt, Human
cucccaaagugcuggga

SEQ ID NO: 2952240 - RNA, 13 nt, Human
cuccaugugggcu

SEQ ID NO: 2952241 - RNA, 18 nt, Human
cucacuauguugcccagg

SEQ ID NO: 2952242 - RNA, 18 nt, Human
cuccauccugaggcucca

SEQ ID NO: 2952243 - RNA, 14 nt, Human
cuccauccugaggc

SEQ ID NO: 2952244 - RNA, 16 nt, Human
cuccauccugaggcuc

SEQ ID NO: 2952245 - RNA, 22 nt, Human
cucccaacucaccccagcccca

SEQ ID NO: 2952246 - RNA, 18 nt, Human
cucccaaagugcugggau

SEQ ID NO: 2952247 - RNA, 17 nt, Human
cucccaacucaccccag

SEQ ID NO: 2952248 - RNA, 16 nt, Human
cucccaacucacccca

SEQ ID NO: 2952249 - RNA, 23 nt, Human
cucccaucugugaaaggaaagag

SEQ ID NO: 2952250 - RNA, 18 nt, Human
cucccaucugugaaagga

SEQ ID NO: 2952251 - RNA, 15 nt, Human
cucccaucugugaaa

SEQ ID NO: 2952252 - RNA, 14 nt, Human
cucccaucugugaa

SEQ ID NO: 2952253 - RNA, 11 nt, Human
cucccaucugu

SEQ ID NO: 2952254 - RNA, 21 nt, Human
cucccaucucacacaugagca

SEQ ID NO: 2952255 - RNA, 17 nt, Human
cucccgaauagcuggga

SEQ ID NO: 2952256 - RNA, 16 nt, Human
cucccgaauagcuggg

SEQ ID NO: 2952257 - RNA, 13 nt, Human
cuccccugcuggg

SEQ ID NO: 2952258 - RNA, 15 nt, Human
cucccgaguagcugg

SEQ ID NO: 2952259 - RNA, 18 nt, Human
cucccgaauagcugggac

SEQ ID NO: 2952260 - RNA, 16 nt, Human
cucccgaguagcuggg

SEQ ID NO: 2952261 - RNA, 17 nt, Human
cucccgaguagcuggga

SEQ ID NO: 2952262 - RNA, 18 nt, Human
cucccaugagggagaugc

SEQ ID NO: 2952263 - RNA, 20 nt, Human
cucccaugagggagaugcca

SEQ ID NO: 2952264 - RNA, 22 nt, Human
cucccaugagggagaugccaug

SEQ ID NO: 2952265 - RNA, 12 nt, Human
cuccccagcaag

SEQ ID NO: 2952266 - RNA, 20 nt, Human
cuccccagcaagugagagcu

SEQ ID NO: 2952267 - RNA, 20 nt, Human
cuccccagccccaucccaaa

SEQ ID NO: 2952268 - RNA, 12 nt, Human
cuccccugcugg

SEQ ID NO: 2952269 - RNA, 20 nt, Human
cuccugcaggcagccaggcc

SEQ ID NO: 2952270 - RNA, 18 nt, Human
cuccugcaggcagccagg

SEQ ID NO: 2952271 - RNA, 11 nt, Human
cuccugcccuu

SEQ ID NO: 2952272 - RNA, 13 nt, Human
cuccugccucagc

SEQ ID NO: 2952273 - RNA, 14 nt, Human
cuccugccucagcc

SEQ ID NO: 2952274 - RNA, 17 nt, Human
cuccugcaggcagccag

SEQ ID NO: 2952275 - RNA, 16 nt, Human
cuccugcaggcagcca

SEQ ID NO: 2952276 - RNA, 11 nt, Human
cuccugcaggc

SEQ ID NO: 2952277 - RNA, 16 nt, Human
cuccugugugugcgcc

SEQ ID NO: 2952278 - RNA, 19 nt, Human
cuccugugugugcgccuac

SEQ ID NO: 2952279 - RNA, 15 nt, Human
cuccugccucagccu

SEQ ID NO: 2952280 - RNA, 22 nt, Human
cuccucuccccagcaagugaga

SEQ ID NO: 2952281 - RNA, 13 nt, Human
cuccuccacauuu

SEQ ID NO: 2952282 - RNA, 22 nt, Human
cuccuccagccgccaugcuccu

SEQ ID NO: 2952283 - RNA, 15 nt, Human
cuccgaccagacacc

SEQ ID NO: 2952284 - RNA, 18 nt, Human
cucccucagucuggcccu

SEQ ID NO: 2952285 - RNA, 15 nt, Human
cucccuccaccuccc

SEQ ID NO: 2952286 - RNA, 17 nt, Human
cucccuccaccucccug

SEQ ID NO: 2952287 - RNA, 17 nt, Human
cucccuuucuucccuac

SEQ ID NO: 2952288 - RNA, 13 nt, Human
cucuacagaggcc

SEQ ID NO: 2952289 - RNA, 19 nt, Human
cucuacagaggccaugggc

SEQ ID NO: 2952290 - RNA, 14 nt, Human
cucuacagaggcca

SEQ ID NO: 2952291 - RNA, 16 nt, Human
cucuacagaggccaug

SEQ ID NO: 2952292 - RNA, 13 nt, Human
cucuacaaaaagc

SEQ ID NO: 2952293 - RNA, 19 nt, Human
cuccuucacagaugggugc

SEQ ID NO: 2952294 - RNA, 20 nt, Human
cuccugugugugcgccuaca

SEQ ID NO: 2952295 - RNA, 14 nt, Human
cuccugugugugcg

SEQ ID NO: 2952296 - RNA, 17 nt, Human
cuccuucacagaugggu

SEQ ID NO: 2952297 - RNA, 16 nt, Human
cuccuucacagauggg

SEQ ID NO: 2952298 - RNA, 22 nt, Human
cucuacccaucuuaaaaacaac

SEQ ID NO: 2952299 - RNA, 20 nt, Human
cucuaccauccccuguagag

SEQ ID NO: 2952300 - RNA, 21 nt, Human
cucuacccaucuuaaaaacaa

SEQ ID NO: 2952301 - RNA, 13 nt, Human
cucuacccuggca

SEQ ID NO: 2952302 - RNA, 20 nt, Human
cucuagugaauguaggcugg

SEQ ID NO: 2952303 - RNA, 23 nt, Human
cucuagggaaaaaccagcgugug

SEQ ID NO: 2952304 - RNA, 17 nt, Human
cucuaggaaauauuuau

SEQ ID NO: 2952305 - RNA, 15 nt, Human
cucuaggaaauauuu

SEQ ID NO: 2952306 - RNA, 15 nt, Human
cucuaguuugauuaa

SEQ ID NO: 2952307 - RNA, 19 nt, Human
cucuaguuugauuaaauuc

SEQ ID NO: 2952308 - RNA, 20 nt, Human
cucuaguuugauuaaauucu

SEQ ID NO: 2952309 - RNA, 21 nt, Human
cucuaguuugauuaaauucuu

SEQ ID NO: 2952310 - RNA, 12 nt, Human
cucucaggccaa

SEQ ID NO: 2952311 - RNA, 21 nt, Human
cucucaggccaaacucaccug

SEQ ID NO: 2952312 - RNA, 20 nt, Human
cucucaggccaaacucaccu

SEQ ID NO: 2952313 - RNA, 15 nt, Human
cucucaggccagcug

SEQ ID NO: 2952314 - RNA, 13 nt, Human
cucucaggccagc

SEQ ID NO: 2952315 - RNA, 23 nt, Human
cucucaggccaaacucaccugcc

SEQ ID NO: 2952316 - RNA, 22 nt, Human
cucucaggccaaacucaccugc

SEQ ID NO: 2952317 - RNA, 14 nt, Human
cucuccagccccug

SEQ ID NO: 2952318 - RNA, 18 nt, Human
cucuccagccccuggaug

SEQ ID NO: 2952319 - RNA, 17 nt, Human
cucuccagccccuggau

SEQ ID NO: 2952320 - RNA, 16 nt, Human
cucuccagccccugga

SEQ ID NO: 2952321 - RNA, 15 nt, Human
cucuccagccccugg

SEQ ID NO: 2952322 - RNA, 21 nt, Human
cucucaggccagcugcuuggg

SEQ ID NO: 2952323 - RNA, 19 nt, Human
cucucaggccagcugcuug

SEQ ID NO: 2952324 - RNA, 18 nt, Human
cucucaggccagcugcuu

SEQ ID NO: 2952325 - RNA, 17 nt, Human
cucucaggccagcugcu

SEQ ID NO: 2952326 - RNA, 18 nt, Human
cucuccucugcugcuggc

SEQ ID NO: 2952327 - RNA, 15 nt, Human
cucuccucugcugcu

SEQ ID NO: 2952328 - RNA, 14 nt, Human
cucuccucugcugc

SEQ ID NO: 2952329 - RNA, 13 nt, Human
cucuccucugcug

SEQ ID NO: 2952330 - RNA, 14 nt, Human
cucuccccagcaag

SEQ ID NO: 2952331 - RNA, 22 nt, Human
cucuccccagcaagugagagcu

SEQ ID NO: 2952332 - RNA, 24 nt, Human
cucuccccagcaagugagagcugg

SEQ ID NO: 2952333 - RNA, 12 nt, Human
cucuccucugcu

SEQ ID NO: 2952334 - RNA, 19 nt, Human
cucuccagccccuggaugc

SEQ ID NO: 2952335 - RNA, 13 nt, Human
cucuccccagcaa

SEQ ID NO: 2952336 - RNA, 13 nt, Human
cucucucaggcca

SEQ ID NO: 2952337 - RNA, 12 nt, Human
cucucucacucc

SEQ ID NO: 2952338 - RNA, 12 nt, Human
cucuccugggca

SEQ ID NO: 2952339 - RNA, 15 nt, Human
cucuccugggcagcu

SEQ ID NO: 2952340 - RNA, 16 nt, Human
cucuccugggcagcug

SEQ ID NO: 2952341 - RNA, 18 nt, Human
cucuccugggcagcugcc

SEQ ID NO: 2952342 - RNA, 19 nt, Human
cucuccugggcagcugccu

SEQ ID NO: 2952343 - RNA, 20 nt, Human
cucuccugggcagcugccuc

SEQ ID NO: 2952344 - RNA, 21 nt, Human
cugacauuguuggccaaagcc

SEQ ID NO: 2952345 - RNA, 21 nt, Human
cugacaggcaaugcuggcugu

SEQ ID NO: 2952346 - RNA, 22 nt, Human
cugacauuguuggccaaagcca

SEQ ID NO: 2952347 - RNA, 12 nt, Human
cugacccacugc

SEQ ID NO: 2952348 - RNA, 16 nt, Human
cugacccaugcugccc

SEQ ID NO: 2952349 - RNA, 15 nt, Human
cugacccaugcugcc

SEQ ID NO: 2952350 - RNA, 14 nt, Human
cugacccaugcugc

SEQ ID NO: 2952351 - RNA, 13 nt, Human
cugacccacugcu

SEQ ID NO: 2952352 - RNA, 14 nt, Human
cugacccacugcuu

SEQ ID NO: 2952353 - RNA, 13 nt, Human
cugacccaugcug

SEQ ID NO: 2952354 - RNA, 16 nt, Human
cugacuguuuucucuu

SEQ ID NO: 2952355 - RNA, 17 nt, Human
cugacucuuaagaagac

SEQ ID NO: 2952356 - RNA, 16 nt, Human
cugacuucuaaguaaa

SEQ ID NO: 2952357 - RNA, 18 nt, Human
cugacuguuuucucuuga

SEQ ID NO: 2952358 - RNA, 15 nt, Human
cugacuucuaaguaa

SEQ ID NO: 2952359 - RNA, 13 nt, Human
cugacuucuaagu

SEQ ID NO: 2952360 - RNA, 15 nt, Human
cugagacagcccggg

SEQ ID NO: 2952361 - RNA, 14 nt, Human
cugagacagcccgg

SEQ ID NO: 2952362 - RNA, 23 nt, Human
cugagaaagacuauucaaacagu

SEQ ID NO: 2952363 - RNA, 22 nt, Human
cugagaaagacuauucaaacag

SEQ ID NO: 2952364 - RNA, 18 nt, Human
cugaggcaggagacuggc

SEQ ID NO: 2952365 - RNA, 17 nt, Human
cugaggcaggagacugg

SEQ ID NO: 2952366 - RNA, 20 nt, Human
cugaggcccuucucuccagc

SEQ ID NO: 2952367 - RNA, 19 nt, Human
cugaggcccuucucuccag

SEQ ID NO: 2952368 - RNA, 18 nt, Human
cugaggcccuucucucca

SEQ ID NO: 2952369 - RNA, 15 nt, Human
cugaggcccuucucu

SEQ ID NO: 2952370 - RNA, 14 nt, Human
cugaggcccuucuc

SEQ ID NO: 2952371 - RNA, 23 nt, Human
cugaggcccagagggccugcaag

SEQ ID NO: 2952372 - RNA, 21 nt, Human
cugaggcccagagggccugca

SEQ ID NO: 2952373 - RNA, 19 nt, Human
cugaggcccagagggccug

SEQ ID NO: 2952374 - RNA, 18 nt, Human
cugaggcccagagggccu

SEQ ID NO: 2952375 - RNA, 17 nt, Human
cugaggcccagagggcc

SEQ ID NO: 2952376 - RNA, 16 nt, Human
cugaggcccagagggc

SEQ ID NO: 2952377 - RNA, 15 nt, Human
cugaggcccagaggg

SEQ ID NO: 2952378 - RNA, 14 nt, Human
cugaggcccagagg

SEQ ID NO: 2952379 - RNA, 13 nt, Human
cugaggcccagag

SEQ ID NO: 2952380 - RNA, 12 nt, Human
cugaggcccaga

SEQ ID NO: 2952381 - RNA, 16 nt, Human
cugagccucacagcag

SEQ ID NO: 2952382 - RNA, 17 nt, Human
cugagccucacagcagu

SEQ ID NO: 2952383 - RNA, 19 nt, Human
cugagccucacagcaguga

SEQ ID NO: 2952384 - RNA, 15 nt, Human
cugagccucacagca

SEQ ID NO: 2952385 - RNA, 15 nt, Human
cugagccagauuuca

SEQ ID NO: 2952386 - RNA, 21 nt, Human
cugagccagauuucacucucc

SEQ ID NO: 2952387 - RNA, 20 nt, Human
cugagccagauuucacucuc

SEQ ID NO: 2952388 - RNA, 19 nt, Human
cugagccagauuucacucu

SEQ ID NO: 2952389 - RNA, 18 nt, Human
cugagccagauuucacuc

SEQ ID NO: 2952390 - RNA, 17 nt, Human
cugagccagauuucacu

SEQ ID NO: 2952391 - RNA, 18 nt, Human
cugagacagcccgggcuc

SEQ ID NO: 2952392 - RNA, 17 nt, Human
cugagacagcccgggcu

SEQ ID NO: 2952393 - RNA, 16 nt, Human
cugagacagcccgggc

SEQ ID NO: 2952394 - RNA, 16 nt, Human
cugagcgacagugaga

SEQ ID NO: 2952395 - RNA, 20 nt, Human
cugagcgacagugagacucu

SEQ ID NO: 2952396 - RNA, 13 nt, Human
cucucuccucccu

SEQ ID NO: 2952397 - RNA, 22 nt, Human
cucugccugaagucacacagug

SEQ ID NO: 2952398 - RNA, 10 nt, Human
cucugccuga

SEQ ID NO: 2952399 - RNA, 21 nt, Human
cucugccugaagucacacagu

SEQ ID NO: 2952400 - RNA, 15 nt, Human
cucuggacaggcaug

SEQ ID NO: 2952401 - RNA, 12 nt, Human
cucugcuugcca

SEQ ID NO: 2952402 - RNA, 14 nt, Human
cucugcuugccauc

SEQ ID NO: 2952403 - RNA, 17 nt, Human
cucugcuugccaucccu

SEQ ID NO: 2952404 - RNA, 20 nt, Human
cucugcuugccaucccuccc

SEQ ID NO: 2952405 - RNA, 14 nt, Human
cucuggcagcucag

SEQ ID NO: 2952406 - RNA, 12 nt, Human
cucuggcagcuc

SEQ ID NO: 2952407 - RNA, 14 nt, Human
cucuggacaggcau

SEQ ID NO: 2952408 - RNA, 16 nt, Human
cucuggacaggcaugu

SEQ ID NO: 2952409 - RNA, 22 nt, Human
cucuggacaggcauguucucug

SEQ ID NO: 2952410 - RNA, 12 nt, Human
cucuggccuucg

SEQ ID NO: 2952411 - RNA, 16 nt, Human
cucuggcagcucagag

SEQ ID NO: 2952412 - RNA, 15 nt, Human
cucuggcagcucaga

SEQ ID NO: 2952413 - RNA, 19 nt, Human
cucuggccuucggccucca

SEQ ID NO: 2952414 - RNA, 13 nt, Human
cucuuccaggcug

SEQ ID NO: 2952415 - RNA, 15 nt, Human
cucuuccaggcuggg

SEQ ID NO: 2952416 - RNA, 14 nt, Human
cucuuccaggcugg

SEQ ID NO: 2952417 - RNA, 15 nt, Human
cucuuagaaaaacca

SEQ ID NO: 2952418 - RNA, 13 nt, Human
cucuuagaaaaac

SEQ ID NO: 2952419 - RNA, 16 nt, Human
cucuguggcgagccau

SEQ ID NO: 2952420 - RNA, 15 nt, Human
cucugugucaggugg

SEQ ID NO: 2952421 - RNA, 21 nt, Human
cucuuggguucaagcgauucu

SEQ ID NO: 2952422 - RNA, 19 nt, Human
cucuuggguucaagcgauu

SEQ ID NO: 2952423 - RNA, 22 nt, Human
cucuugaaauauaggaacuuaa

SEQ ID NO: 2952424 - RNA, 22 nt, Human
cucuucuuuaaagggauggcaa

SEQ ID NO: 2952425 - RNA, 18 nt, Human
cucuuuaaugucacaggc

SEQ ID NO: 2952426 - RNA, 17 nt, Human
cucuugguccugcugca

SEQ ID NO: 2952427 - RNA, 16 nt, Human
cucuugguccugcugc

SEQ ID NO: 2952428 - RNA, 15 nt, Human
cucuugguccugcug

SEQ ID NO: 2952429 - RNA, 13 nt, Human
cucuugguccugc

SEQ ID NO: 2952430 - RNA, 20 nt, Human
cucuuuaaugucacaggcag

SEQ ID NO: 2952431 - RNA, 21 nt, Human
cucuuuaaugucacaggcagg

SEQ ID NO: 2952432 - RNA, 22 nt, Human
cucuuuaaugucacaggcaggu

SEQ ID NO: 2952433 - RNA, 23 nt, Human
cucuuuaaugucacaggcagguc

SEQ ID NO: 2952434 - RNA, 13 nt, Human
cucuuucccuccc

SEQ ID NO: 2952435 - RNA, 17 nt, Human
cucuuucccucccuucc

SEQ ID NO: 2952436 - RNA, 16 nt, Human
cugaaauaaggaauga

SEQ ID NO: 2952437 - RNA, 21 nt, Human
cugaaauaaacgucuuaaaua

SEQ ID NO: 2952438 - RNA, 23 nt, Human
cugaaagcccugagcuuucugcu

SEQ ID NO: 2952439 - RNA, 19 nt, Human
cugaaagcccugagcuuuc

SEQ ID NO: 2952440 - RNA, 18 nt, Human
cugaaagcccugagcuuu

SEQ ID NO: 2952441 - RNA, 17 nt, Human
cugaaagcccugagcuu

SEQ ID NO: 2952442 - RNA, 16 nt, Human
cugaaagcccugagcu

SEQ ID NO: 2952443 - RNA, 15 nt, Human
cugaaagcccugagc

SEQ ID NO: 2952444 - RNA, 13 nt, Human
cugaaauuuccug

SEQ ID NO: 2952445 - RNA, 23 nt, Human
cugaaauuuccugggagcuuuug

SEQ ID NO: 2952446 - RNA, 16 nt, Human
cugaaauuuccuggga

SEQ ID NO: 2952447 - RNA, 17 nt, Human
cugaacaucacagcuua

SEQ ID NO: 2952448 - RNA, 14 nt, Human
cugaagaagauggu

SEQ ID NO: 2952449 - RNA, 19 nt, Human
cugaagaauugaaaaacca

SEQ ID NO: 2952450 - RNA, 23 nt, Human
cugaagaagcaccaaucaugaau

SEQ ID NO: 2952451 - RNA, 19 nt, Human
cugcuugugaaaggaaaga

SEQ ID NO: 2952452 - RNA, 19 nt, Human
cugcuugggcuucauccuc

SEQ ID NO: 2952453 - RNA, 18 nt, Human
cugcuugggcuucauccu

SEQ ID NO: 2952454 - RNA, 17 nt, Human
cugcuugggcuucaucc

SEQ ID NO: 2952455 - RNA, 15 nt, Human
cugcuugggcuucau

SEQ ID NO: 2952456 - RNA, 13 nt, Human
cugcuugggcuuc

SEQ ID NO: 2952457 - RNA, 22 nt, Human
cugcuugaggcaacucaucuua

SEQ ID NO: 2952458 - RNA, 16 nt, Human
cugcuugccaucccuc

SEQ ID NO: 2952459 - RNA, 15 nt, Human
cugcuugccaucccu

SEQ ID NO: 2952460 - RNA, 18 nt, Human
cugcuugccaucccuccc

SEQ ID NO: 2952461 - RNA, 19 nt, Human
cugcuugccaucccucccu

SEQ ID NO: 2952462 - RNA, 20 nt, Human
cugcuugccaucccucccuc

SEQ ID NO: 2952463 - RNA, 22 nt, Human
cugcuugccaucccucccucca

SEQ ID NO: 2952464 - RNA, 20 nt, Human
cugcuugcuugcuuuuuaau

SEQ ID NO: 2952465 - RNA, 15 nt, Human
cugcuuuuggucugu

SEQ ID NO: 2952466 - RNA, 17 nt, Human
cugcuuuuggucugugu

SEQ ID NO: 2952467 - RNA, 22 nt, Human
cugcugggagguuaaaaagaaa

SEQ ID NO: 2952468 - RNA, 18 nt, Human
cugcugggagguuaaaaa

SEQ ID NO: 2952469 - RNA, 13 nt, Human
cugcugcuggcug

SEQ ID NO: 2952470 - RNA, 12 nt, Human
cugcugcuggcu

SEQ ID NO: 2952471 - RNA, 15 nt, Human
cugcuggguguggcg

SEQ ID NO: 2952472 - RNA, 14 nt, Human
cugcuggguguggc

SEQ ID NO: 2952473 - RNA, 17 nt, Human
cugcuggguguggcgca

SEQ ID NO: 2952474 - RNA, 21 nt, Human
cugcuugaggcaacucaucuu

SEQ ID NO: 2952475 - RNA, 20 nt, Human
cugcuugaggcaacucaucu

SEQ ID NO: 2952476 - RNA, 13 nt, Human
cugcuugaggcaa

SEQ ID NO: 2952477 - RNA, 12 nt, Human
cugcucugguua

SEQ ID NO: 2952478 - RNA, 13 nt, Human
cugcugcaguugc

SEQ ID NO: 2952479 - RNA, 10 nt, Human
cugcugcagu

SEQ ID NO: 2952480 - RNA, 14 nt, Human
cugcugcaguugcc

SEQ ID NO: 2952481 - RNA, 15 nt, Human
cugcugcaguugcca

SEQ ID NO: 2952482 - RNA, 21 nt, Human
cugcgggggcagugcucaccc

SEQ ID NO: 2952483 - RNA, 17 nt, Human
cugcucccaccuggcuc

SEQ ID NO: 2952484 - RNA, 20 nt, Human
cugcucccaccuggcucugu

SEQ ID NO: 2952485 - RNA, 18 nt, Human
cugcucccaccuggcucu

SEQ ID NO: 2952486 - RNA, 19 nt, Human
cugcucccaccuggcucug

SEQ ID NO: 2952487 - RNA, 23 nt, Human
cugcggugcuaucucccccagcc

SEQ ID NO: 2952488 - RNA, 22 nt, Human
cugcggugcuaucucccccagc

SEQ ID NO: 2952489 - RNA, 21 nt, Human
cugcggugcuaucucccccag

SEQ ID NO: 2952490 - RNA, 20 nt, Human
cugcggugcuaucuccccca

SEQ ID NO: 2952491 - RNA, 23 nt, Human
cugcuccucuccccagcaaguga

SEQ ID NO: 2952492 - RNA, 19 nt, Human
cugcuccucuccccagcaa

SEQ ID NO: 2952493 - RNA, 20 nt, Human
cugcuccucuccccagcaag

SEQ ID NO: 2952494 - RNA, 15 nt, Human
cugcucuccgaccag

SEQ ID NO: 2952495 - RNA, 18 nt, Human
cugcgggggcagugcuca

SEQ ID NO: 2952496 - RNA, 23 nt, Human
cugcgguccacccaggagccccg

SEQ ID NO: 2952497 - RNA, 19 nt, Human
cugcggugcuaucuccccc

SEQ ID NO: 2952498 - RNA, 18 nt, Human
cugcggugcuaucucccc

SEQ ID NO: 2952499 - RNA, 19 nt, Human
cugccugaagucacacagu

SEQ ID NO: 2952500 - RNA, 18 nt, Human
cugccugaagucacacag

SEQ ID NO: 2952501 - RNA, 16 nt, Human
cugccugaagucacac

SEQ ID NO: 2952502 - RNA, 15 nt, Human
cugcccucuccuggg

SEQ ID NO: 2952503 - RNA, 21 nt, Human
cugcccugcccaccuggccuc

SEQ ID NO: 2952504 - RNA, 12 nt, Human
cugcccucuccu

SEQ ID NO: 2952505 - RNA, 13 nt, Human
cugcccucuccug

SEQ ID NO: 2952506 - RNA, 14 nt, Human
cugcccucuccugg

SEQ ID NO: 2952507 - RNA, 17 nt, Human
cugcccugcccaccugg

SEQ ID NO: 2952508 - RNA, 20 nt, Human
cugcccugcccaccuggccu

SEQ ID NO: 2952509 - RNA, 23 nt, Human
cugcaguuuuuuuccuucaagaa

SEQ ID NO: 2952510 - RNA, 22 nt, Human
cugcaguuuuuuuccuucaaga

SEQ ID NO: 2952511 - RNA, 15 nt, Human
cugcauaugaaagga

SEQ ID NO: 2952512 - RNA, 20 nt, Human
cugcaucaagaugugacaug

SEQ ID NO: 2952513 - RNA, 21 nt, Human
cugccacccuggggagaaagu

SEQ ID NO: 2952514 - RNA, 12 nt, Human
cugccacccugg

SEQ ID NO: 2952515 - RNA, 23 nt, Human
cugccauccuggcccagggcauc

SEQ ID NO: 2952516 - RNA, 21 nt, Human
cugccauccuggcccagggca

SEQ ID NO: 2952517 - RNA, 22 nt, Human
cugccauccuggcccagggcau

SEQ ID NO: 2952518 - RNA, 13 nt, Human
cugccauccuggc

SEQ ID NO: 2952519 - RNA, 16 nt, Human
cugccauccuggccca

SEQ ID NO: 2952520 - RNA, 17 nt, Human
cugccauccuggcccag

SEQ ID NO: 2952521 - RNA, 18 nt, Human
cugccauccuggcccagg

SEQ ID NO: 2952522 - RNA, 19 nt, Human
cugccauccuggcccaggg

SEQ ID NO: 2952523 - RNA, 20 nt, Human
cugccauccuggcccagggc

SEQ ID NO: 2952524 - RNA, 21 nt, Human
cugccauccagguucagcuug

SEQ ID NO: 2952525 - RNA, 15 nt, Human
cugccauccucccaa

SEQ ID NO: 2952526 - RNA, 22 nt, Human
cugccaggaagccagcaggcuc

SEQ ID NO: 2952527 - RNA, 15 nt, Human
cugccagcaacgcag

SEQ ID NO: 2952528 - RNA, 21 nt, Human
cugccaggaagccagcaggcu

SEQ ID NO: 2952529 - RNA, 20 nt, Human
cugccaggaagccagcaggc

SEQ ID NO: 2952530 - RNA, 14 nt, Human
cugccaggaagcca

SEQ ID NO: 2952531 - RNA, 13 nt, Human
cugccaggaagcc

SEQ ID NO: 2952532 - RNA, 16 nt, Human
cugcccaggccccugc

SEQ ID NO: 2952533 - RNA, 18 nt, Human
cugcccaggccccugcca

SEQ ID NO: 2952534 - RNA, 19 nt, Human
cugcccaggccccugccac

SEQ ID NO: 2952535 - RNA, 20 nt, Human
cugcccaggccccugccacc

SEQ ID NO: 2952536 - RNA, 12 nt, Human
cugcccaccugg

SEQ ID NO: 2952537 - RNA, 14 nt, Human
cugcccaggccccu

SEQ ID NO: 2952538 - RNA, 15 nt, Human
cugcccaggccccug

SEQ ID NO: 2952539 - RNA, 15 nt, Human
cugccauuucugaga

SEQ ID NO: 2952540 - RNA, 20 nt, Human
cugcccggcaggguccuaga

SEQ ID NO: 2952541 - RNA, 13 nt, Human
cugcccggcaggg

SEQ ID NO: 2952542 - RNA, 19 nt, Human
cugccccuggcagccccug

SEQ ID NO: 2952543 - RNA, 17 nt, Human
cugccccuggcagcccc

SEQ ID NO: 2952544 - RNA, 18 nt, Human
cugccccuggcagccccu

SEQ ID NO: 2952545 - RNA, 20 nt, Human
cugcaguuuuuuuccuucaa

SEQ ID NO: 2952546 - RNA, 16 nt, Human
cugcaguugccaguca

SEQ ID NO: 2952547 - RNA, 13 nt, Human
cugcaguugccag

SEQ ID NO: 2952548 - RNA, 17 nt, Human
cugcagcaauaaagcag

SEQ ID NO: 2952549 - RNA, 14 nt, Human
cugcaccgggccac

SEQ ID NO: 2952550 - RNA, 15 nt, Human
cugcaccgggccaca

SEQ ID NO: 2952551 - RNA, 16 nt, Human
cugcaccggcuggccu

SEQ ID NO: 2952552 - RNA, 15 nt, Human
cugcaccggcuggcc

SEQ ID NO: 2952553 - RNA, 14 nt, Human
cugcaccggcuggc

SEQ ID NO: 2952554 - RNA, 23 nt, Human
cugaggcccuucucuccagcccc

SEQ ID NO: 2952555 - RNA, 22 nt, Human
cugaggcccuucucuccagccc

SEQ ID NO: 2952556 - RNA, 18 nt, Human
cugcaccgggccacagag

SEQ ID NO: 2952557 - RNA, 20 nt, Human
cugcacuccagccuggguga

SEQ ID NO: 2952558 - RNA, 13 nt, Human
cugcacuccccug

SEQ ID NO: 2952559 - RNA, 20 nt, Human
cugcacuccccugcugggug

SEQ ID NO: 2952560 - RNA, 19 nt, Human
cugcacuccccugcugggu

SEQ ID NO: 2952561 - RNA, 13 nt, Human
cugcagagggcac

SEQ ID NO: 2952562 - RNA, 15 nt, Human
cugcagcaauaaagc

SEQ ID NO: 2952563 - RNA, 16 nt, Human
cugcagcaauaaagca

SEQ ID NO: 2952564 - RNA, 10 nt, Human
cugcagaggg

SEQ ID NO: 2952565 - RNA, 12 nt, Human
cugcacugucaa

SEQ ID NO: 2952566 - RNA, 18 nt, Human
cugcacuccccugcuggg

SEQ ID NO: 2952567 - RNA, 21 nt, Human
cugcacuccccugcugggugu

SEQ ID NO: 2952568 - RNA, 16 nt, Human
cuggcuguuggcuggg

SEQ ID NO: 2952569 - RNA, 17 nt, Human
cuggcuguuggcugggg

SEQ ID NO: 2952570 - RNA, 20 nt, Human
cuggcugguuagagguuccc

SEQ ID NO: 2952571 - RNA, 15 nt, Human
cuggcuuucagagua

SEQ ID NO: 2952572 - RNA, 21 nt, Human
cugggagagccuuccaggggu

SEQ ID NO: 2952573 - RNA, 20 nt, Human
cugggagagccuuccagggg

SEQ ID NO: 2952574 - RNA, 19 nt, Human
cugggagagccuuccaggg

SEQ ID NO: 2952575 - RNA, 20 nt, Human
cugggaaagggauuuucagc

SEQ ID NO: 2952576 - RNA, 18 nt, Human
cugggagagccuuccagg

SEQ ID NO: 2952577 - RNA, 17 nt, Human
cugggagagccuuccag

SEQ ID NO: 2952578 - RNA, 20 nt, Human
cugggagguuaaaaagaaaa

SEQ ID NO: 2952579 - RNA, 21 nt, Human
cugggaggucaaggcugcagu

SEQ ID NO: 2952580 - RNA, 19 nt, Human
cugggaggucaaggcugca

SEQ ID NO: 2952581 - RNA, 17 nt, Human
cugggauuacaggugug

SEQ ID NO: 2952582 - RNA, 20 nt, Human
cugggauuacaggugugaac

SEQ ID NO: 2952583 - RNA, 18 nt, Human
cugggaugauuggagggg

SEQ ID NO: 2952584 - RNA, 20 nt, Human
cugggaucccucauccucau

SEQ ID NO: 2952585 - RNA, 16 nt, Human
cuggcacccggccccu

SEQ ID NO: 2952586 - RNA, 17 nt, Human
cuggcacccggccccug

SEQ ID NO: 2952587 - RNA, 18 nt, Human
cuggcacccggccccugc

SEQ ID NO: 2952588 - RNA, 22 nt, Human
cuggcacccggccccugcuggu

SEQ ID NO: 2952589 - RNA, 18 nt, Human
cuggaauauauaaccagu

SEQ ID NO: 2952590 - RNA, 14 nt, Human
cuggcaagaaugug

SEQ ID NO: 2952591 - RNA, 15 nt, Human
cuggcacuauaaugu

SEQ ID NO: 2952592 - RNA, 16 nt, Human
cuggcacuauaaugua

SEQ ID NO: 2952593 - RNA, 22 nt, Human
cuggcaugggaaugaaugucag

SEQ ID NO: 2952594 - RNA, 19 nt, Human
cuggcaugggaaugaaugu

SEQ ID NO: 2952595 - RNA, 18 nt, Human
cuggcaugggaaugaaug

SEQ ID NO: 2952596 - RNA, 16 nt, Human
cuggcaugggaaugaa

SEQ ID NO: 2952597 - RNA, 24 nt, Human
cuggcaugggaaugaaugucagug

SEQ ID NO: 2952598 - RNA, 22 nt, Human
cuggccagaugcaccagcccuu

SEQ ID NO: 2952599 - RNA, 23 nt, Human
cuggccucaagugauucuccugc

SEQ ID NO: 2952600 - RNA, 12 nt, Human
cuggccucugca

SEQ ID NO: 2952601 - RNA, 22 nt, Human
cuggccucaagugauucuccug

SEQ ID NO: 2952602 - RNA, 16 nt, Human
cuggccugagcuggga

SEQ ID NO: 2952603 - RNA, 14 nt, Human
cuggccucugcacu

SEQ ID NO: 2952604 - RNA, 13 nt, Human
cuggccucugcac

SEQ ID NO: 2952605 - RNA, 13 nt, Human
cuggccuggcccc

SEQ ID NO: 2952606 - RNA, 14 nt, Human
cuggccuggccccu

SEQ ID NO: 2952607 - RNA, 18 nt, Human
cuggccugagcugggaug

SEQ ID NO: 2952608 - RNA, 15 nt, Human
cuggccugagcuggg

SEQ ID NO: 2952609 - RNA, 16 nt, Human
cuggccuucggccucc

SEQ ID NO: 2952610 - RNA, 17 nt, Human
cuggccuucggccucca

SEQ ID NO: 2952611 - RNA, 18 nt, Human
cuggccuucggccuccau

SEQ ID NO: 2952612 - RNA, 21 nt, Human
cuggccuucggccuccauccu

SEQ ID NO: 2952613 - RNA, 15 nt, Human
cuggccuucggccuc

SEQ ID NO: 2952614 - RNA, 14 nt, Human
cuggccugugucua

SEQ ID NO: 2952615 - RNA, 17 nt, Human
cuggccuggccccucag

SEQ ID NO: 2952616 - RNA, 16 nt, Human
cuggccuggccccuca

SEQ ID NO: 2952617 - RNA, 22 nt, Human
cugucccuuacgugaguccugg

SEQ ID NO: 2952618 - RNA, 16 nt, Human
cuguccuacucugugu

SEQ ID NO: 2952619 - RNA, 17 nt, Human
cuguccuacucuguguc

SEQ ID NO: 2952620 - RNA, 18 nt, Human
cuguccuacucuguguca

SEQ ID NO: 2952621 - RNA, 20 nt, Human
cuguccuacucugugucagg

SEQ ID NO: 2952622 - RNA, 14 nt, Human
cugucccccugaca

SEQ ID NO: 2952623 - RNA, 13 nt, Human
cugucccccugac

SEQ ID NO: 2952624 - RNA, 21 nt, Human
cuguccuauuauauucauucu

SEQ ID NO: 2952625 - RNA, 15 nt, Human
cuguccuauuauauu

SEQ ID NO: 2952626 - RNA, 22 nt, Human
cugucucaaaaaaagaaaaaga

SEQ ID NO: 2952627 - RNA, 21 nt, Human
cuguccuacucugugucaggu

SEQ ID NO: 2952628 - RNA, 20 nt, Human
cugucuccucucucuguaau

SEQ ID NO: 2952629 - RNA, 17 nt, Human
cugucuccucucucugu

SEQ ID NO: 2952630 - RNA, 18 nt, Human
cugucucuacuaaaaaua

SEQ ID NO: 2952631 - RNA, 13 nt, Human
cuguauuuuaaaa

SEQ ID NO: 2952632 - RNA, 16 nt, Human
cuguauuuuaaaagaa

SEQ ID NO: 2952633 - RNA, 22 nt, Human
cugucccagugccgagaaggaa

SEQ ID NO: 2952634 - RNA, 14 nt, Human
cuguaucccaugag

SEQ ID NO: 2952635 - RNA, 15 nt, Human
cuguaucccaugagc

SEQ ID NO: 2952636 - RNA, 22 nt, Human
cuguaccucuugagccuugaac

SEQ ID NO: 2952637 - RNA, 18 nt, Human
cuguaucccaugagccuc

SEQ ID NO: 2952638 - RNA, 15 nt, Human
cuguaugauucccag

SEQ ID NO: 2952639 - RNA, 15 nt, Human
cuggguuggagggug

SEQ ID NO: 2952640 - RNA, 18 nt, Human
cuggguacuuguggacac

SEQ ID NO: 2952641 - RNA, 16 nt, Human
cuggguacuuguggac

SEQ ID NO: 2952642 - RNA, 14 nt, Human
cuggguacuugugg

SEQ ID NO: 2952643 - RNA, 22 nt, Human
cugggcucccuucccaccucuc

SEQ ID NO: 2952644 - RNA, 21 nt, Human
cugggcucccuucccaccucu

SEQ ID NO: 2952645 - RNA, 20 nt, Human
cugggcucccuucccaccuc

SEQ ID NO: 2952646 - RNA, 19 nt, Human
cugggcucccuucccaccu

SEQ ID NO: 2952647 - RNA, 21 nt, Human
cugguccauagagagcaagac

SEQ ID NO: 2952648 - RNA, 13 nt, Human
cuggucccacuca

SEQ ID NO: 2952649 - RNA, 23 nt, Human
cuggucucaaacucuugaccuca

SEQ ID NO: 2952650 - RNA, 12 nt, Human
cugguggcagcu

SEQ ID NO: 2952651 - RNA, 14 nt, Human
cugguggcagcuca

SEQ ID NO: 2952652 - RNA, 13 nt, Human
cugguggcagcuc

SEQ ID NO: 2952653 - RNA, 20 nt, Human
cugguucaggguuggccccu

SEQ ID NO: 2952654 - RNA, 15 nt, Human
cuguacauacuuuuu

SEQ ID NO: 2952655 - RNA, 22 nt, Human
cuguacaugaaaacacauuuuu

SEQ ID NO: 2952656 - RNA, 23 nt, Human
cuguacaugaaaacacauuuuuc

SEQ ID NO: 2952657 - RNA, 21 nt, Human
cuguaccucuugagccuugaa

SEQ ID NO: 2952658 - RNA, 16 nt, Human
cuguacauacuuuuug

SEQ ID NO: 2952659 - RNA, 21 nt, Human
cuguaaguuacaugaaggcag

SEQ ID NO: 2952660 - RNA, 18 nt, Human
cuguaauuugugauacaa

SEQ ID NO: 2952661 - RNA, 17 nt, Human
cuguaauuugugauaca

SEQ ID NO: 2952662 - RNA, 23 nt, Human
cuguacagagcccacgcccccac

SEQ ID NO: 2952663 - RNA, 21 nt, Human
cuguaauuugugauacaaugc

SEQ ID NO: 2952664 - RNA, 22 nt, Human
cuguaauuugugauacaaugcu

SEQ ID NO: 2952665 - RNA, 20 nt, Human
gaagauucuuguauuuauua

SEQ ID NO: 2952666 - RNA, 18 nt, Human
gaagcauuuacuuugugu

SEQ ID NO: 2952667 - RNA, 16 nt, Human
gaagacuucaucccuc

SEQ ID NO: 2952668 - RNA, 15 nt, Human
gaagacuucaucccu

SEQ ID NO: 2952669 - RNA, 19 nt, Human
gaagacuucaucccucugg

SEQ ID NO: 2952670 - RNA, 17 nt, Human
gaagacuucaucccucu

SEQ ID NO: 2952671 - RNA, 12 nt, Human
gaagagccuugc

SEQ ID NO: 2952672 - RNA, 23 nt, Human
gaagagcuguucacagccagacu

SEQ ID NO: 2952673 - RNA, 13 nt, Human
gaagagcuguuca

SEQ ID NO: 2952674 - RNA, 20 nt, Human
gaagagcuguucacagccag

SEQ ID NO: 2952675 - RNA, 15 nt, Human
gaagagcuguucaca

SEQ ID NO: 2952676 - RNA, 14 nt, Human
gaagaagcucucuc

SEQ ID NO: 2952677 - RNA, 16 nt, Human
gaacuuugaccucugc

SEQ ID NO: 2952678 - RNA, 22 nt, Human
gaacuuugaccucugcagcaau

SEQ ID NO: 2952679 - RNA, 17 nt, Human
gaacuuuccaggaaggc

SEQ ID NO: 2952680 - RNA, 22 nt, Human
gaacuuguaaaggaauuuaaaa

SEQ ID NO: 2952681 - RNA, 18 nt, Human
gaacuuggcgcugccccu

SEQ ID NO: 2952682 - RNA, 17 nt, Human
gaacuugggccacugug

SEQ ID NO: 2952683 - RNA, 17 nt, Human
gaacuuaaauaauguga

SEQ ID NO: 2952684 - RNA, 14 nt, Human
gaacuuaaauaaug

SEQ ID NO: 2952685 - RNA, 17 nt, Human
gaacuuggcgcugcccc

SEQ ID NO: 2952686 - RNA, 18 nt, Human
gaaccacaucuugcucug

SEQ ID NO: 2952687 - RNA, 14 nt, Human
gaaccacaagacug

SEQ ID NO: 2952688 - RNA, 15 nt, Human
gaaccacaagacugc

SEQ ID NO: 2952689 - RNA, 15 nt, Human
gaacucccuuucaac

SEQ ID NO: 2952690 - RNA, 16 nt, Human
gaacucccuuucaaca

SEQ ID NO: 2952691 - RNA, 14 nt, Human
gaaggaugcugucu

SEQ ID NO: 2952692 - RNA, 19 nt, Human
gaaggucuguuuuguguac

SEQ ID NO: 2952693 - RNA, 20 nt, Human
gaaggcauggacuucuggau

SEQ ID NO: 2952694 - RNA, 13 nt, Human
gaagggggcuggg

SEQ ID NO: 2952695 - RNA, 19 nt, Human
gaaguaauaugcacacauu

SEQ ID NO: 2952696 - RNA, 20 nt, Human
gaaguaauaugcacacauuu

SEQ ID NO: 2952697 - RNA, 13 nt, Human
gaagucacacagu

SEQ ID NO: 2952698 - RNA, 18 nt, Human
gaagucaaggcuuagacc

SEQ ID NO: 2952699 - RNA, 21 nt, Human
gaaguaauaugcacacauuuu

SEQ ID NO: 2952700 - RNA, 21 nt, Human
gaagucacauuccugaacagg

SEQ ID NO: 2952701 - RNA, 16 nt, Human
gaagucacauuccuga

SEQ ID NO: 2952702 - RNA, 20 nt, Human
gaagucacauuccugaacag

SEQ ID NO: 2952703 - RNA, 23 nt, Human
gaaguccccucuccuccacauuu

SEQ ID NO: 2952704 - RNA, 18 nt, Human
gaagucuuagauguauau

SEQ ID NO: 2952705 - RNA, 18 nt, Human
gaaguccccucuccucca

SEQ ID NO: 2952706 - RNA, 23 nt, Human
gaaguccaagcauuuagauguau

SEQ ID NO: 2952707 - RNA, 19 nt, Human
gaaggaagacuucaucccu

SEQ ID NO: 2952708 - RNA, 15 nt, Human
gaaggaacguccccu

SEQ ID NO: 2952709 - RNA, 22 nt, Human
gaaggaaacccagcucuggucc

SEQ ID NO: 2952710 - RNA, 21 nt, Human
gaaggaaacccagcucugguc

SEQ ID NO: 2952711 - RNA, 19 nt, Human
gaaggacauugcggacagc

SEQ ID NO: 2952712 - RNA, 20 nt, Human
gaaggacauugcggacagcc

SEQ ID NO: 2952713 - RNA, 21 nt, Human
gaaggacauugcggacagcca

SEQ ID NO: 2952714 - RNA, 20 nt, Human
gaaggaaacccagcucuggu

SEQ ID NO: 2952715 - RNA, 19 nt, Human
gaaggaaacccagcucugg

SEQ ID NO: 2952716 - RNA, 14 nt, Human
gaagccgcuggggc

SEQ ID NO: 2952717 - RNA, 20 nt, Human
gaagccgcuggggccaguug

SEQ ID NO: 2952718 - RNA, 18 nt, Human
gaagccgcuggggccagu

SEQ ID NO: 2952719 - RNA, 15 nt, Human
gaaauauuuauuuua

SEQ ID NO: 2952720 - RNA, 16 nt, Human
gaaauauuuauuuuaa

SEQ ID NO: 2952721 - RNA, 13 nt, Human
gaaauauuuauuu

SEQ ID NO: 2952722 - RNA, 18 nt, Human
gaaauaucugaaaaugua

SEQ ID NO: 2952723 - RNA, 19 nt, Human
gaaauaucugaaaauguau

SEQ ID NO: 2952724 - RNA, 17 nt, Human
gaaauauaggaacuuaa

SEQ ID NO: 2952725 - RNA, 18 nt, Human
gaaauaaacgucuuaaau

SEQ ID NO: 2952726 - RNA, 21 nt, Human
gaaauaaacgucuuaaauauu

SEQ ID NO: 2952727 - RNA, 14 nt, Human
gaaauaaacgucuu

SEQ ID NO: 2952728 - RNA, 16 nt, Human
gaaauaaacgucuuaa

SEQ ID NO: 2952729 - RNA, 17 nt, Human
gaaauaaacgucuuaaa

SEQ ID NO: 2952730 - RNA, 18 nt, Human
gaaaugaggucagagccu

SEQ ID NO: 2952731 - RNA, 11 nt, Human
gaaaugagcug

SEQ ID NO: 2952732 - RNA, 15 nt, Human
gaaaugggcagagca

SEQ ID NO: 2952733 - RNA, 16 nt, Human
gaaaugggcagagcag

SEQ ID NO: 2952734 - RNA, 17 nt, Human
gaaaugucaguucugau

SEQ ID NO: 2952735 - RNA, 22 nt, Human
gaaauguaagggaaacugccag

SEQ ID NO: 2952736 - RNA, 17 nt, Human
gaaauguacagcaagga

SEQ ID NO: 2952737 - RNA, 19 nt, Human
gaaaugggcagagcagaga

SEQ ID NO: 2952738 - RNA, 17 nt, Human
gaaaugggcagagcaga

SEQ ID NO: 2952739 - RNA, 20 nt, Human
gaaauuagguugaaacauau

SEQ ID NO: 2952740 - RNA, 18 nt, Human
gaaauuagguugaaacau

SEQ ID NO: 2952741 - RNA, 19 nt, Human
gaaauuagguugaaacaua

SEQ ID NO: 2952742 - RNA, 17 nt, Human
gaaauuagguugaaaca

SEQ ID NO: 2952743 - RNA, 15 nt, Human
gaacacucuauaaca

SEQ ID NO: 2952744 - RNA, 21 nt, Human
gaacacucuauaacaaaggau

SEQ ID NO: 2952745 - RNA, 17 nt, Human
gaacacuccuucacaga

SEQ ID NO: 2952746 - RNA, 20 nt, Human
gaacagacuggaagcacagc

SEQ ID NO: 2952747 - RNA, 19 nt, Human
gaacagacuggaagcacag

SEQ ID NO: 2952748 - RNA, 21 nt, Human
gaaauuuccugggagcuuuug

SEQ ID NO: 2952749 - RNA, 16 nt, Human
gaacacuccuucacag

SEQ ID NO: 2952750 - RNA, 15 nt, Human
gaacacuccuucaca

SEQ ID NO: 2952751 - RNA, 22 nt, Human
gaacaguuguguuugaagcaca

SEQ ID NO: 2952752 - RNA, 22 nt, Human
gaacagacuggaagcacagcuu

SEQ ID NO: 2952753 - RNA, 17 nt, Human
gaacaggauauucucac

SEQ ID NO: 2952754 - RNA, 22 nt, Human
gaacaguaacauagcugugauu

SEQ ID NO: 2952755 - RNA, 24 nt, Human
gaacaguuaccucugccucagaaa

SEQ ID NO: 2952756 - RNA, 20 nt, Human
gaacaguuguguuugaagca

SEQ ID NO: 2952757 - RNA, 16 nt, Human
gaaaaaugagccuggc

SEQ ID NO: 2952758 - RNA, 15 nt, Human
gaaacugccagcaac

SEQ ID NO: 2952759 - RNA, 13 nt, Human
gaaacugccagca

SEQ ID NO: 2952760 - RNA, 16 nt, Human
gaaacugacacaugcu

SEQ ID NO: 2952761 - RNA, 16 nt, Human
gaaagaucaaaagguu

SEQ ID NO: 2952762 - RNA, 13 nt, Human
gaaagcagaacag

SEQ ID NO: 2952763 - RNA, 19 nt, Human
gaaagacuauucaaacagu

SEQ ID NO: 2952764 - RNA, 23 nt, Human
gaaagacuauucaaacagucuca

SEQ ID NO: 2952765 - RNA, 22 nt, Human
gaaagacuauucaaacagucuc

SEQ ID NO: 2952766 - RNA, 21 nt, Human
gaaaggaagugggacuggcac

SEQ ID NO: 2952767 - RNA, 20 nt, Human
gaaaggaaugcaaagaugaa

SEQ ID NO: 2952768 - RNA, 22 nt, Human
gaaaguacuucuccacccugcu

SEQ ID NO: 2952769 - RNA, 21 nt, Human
gaaagcuugcccuggugccuc

SEQ ID NO: 2952770 - RNA, 16 nt, Human
gaaaggaaagaggcuc

SEQ ID NO: 2952771 - RNA, 11 nt, Human
gaaaggaaaga

SEQ ID NO: 2952772 - RNA, 22 nt, Human
gaaaguugcaaggcaaauguuu

SEQ ID NO: 2952773 - RNA, 21 nt, Human
gaaaguugcaaggcaaauguu

SEQ ID NO: 2952774 - RNA, 17 nt, Human
gaaaguugcaaggcaaa

SEQ ID NO: 2952775 - RNA, 12 nt, Human
cuuuuuauaacu

SEQ ID NO: 2952776 - RNA, 18 nt, Human
cuuuuuauauucucagca

SEQ ID NO: 2952777 - RNA, 16 nt, Human
cuuuuuauaacuuuuu

SEQ ID NO: 2952778 - RNA, 22 nt, Human
cuuuuuauauucucagcagagu

SEQ ID NO: 2952779 - RNA, 15 nt, Human
cuuuuuuauacauaa

SEQ ID NO: 2952780 - RNA, 16 nt, Human
cuuuuuuauacauaaa

SEQ ID NO: 2952781 - RNA, 17 nt, Human
cuuuuuuauacauaaac

SEQ ID NO: 2952782 - RNA, 18 nt, Human
cuuuuuuauacauaaaca

SEQ ID NO: 2952783 - RNA, 16 nt, Human
gaaaaagaaaaaauau

SEQ ID NO: 2952784 - RNA, 11 nt, Human
gaaaaagaaaa

SEQ ID NO: 2952785 - RNA, 15 nt, Human
cuuuugcauauugca

SEQ ID NO: 2952786 - RNA, 23 nt, Human
cuuuugcauauugcauacuauua

SEQ ID NO: 2952787 - RNA, 22 nt, Human
cuuuuuaauauugauaugcuua

SEQ ID NO: 2952788 - RNA, 13 nt, Human
cuuuucuuuucuu

SEQ ID NO: 2952789 - RNA, 17 nt, Human
cuuuucuuucagccaag

SEQ ID NO: 2952790 - RNA, 22 nt, Human
cuuuucauuuaggugaggaagc

SEQ ID NO: 2952791 - RNA, 23 nt, Human
cuuuuccaacccucaucaccaac

SEQ ID NO: 2952792 - RNA, 13 nt, Human
cuuuuccaacccu

SEQ ID NO: 2952793 - RNA, 20 nt, Human
cuuuucgcaggauucuuccu

SEQ ID NO: 2952794 - RNA, 21 nt, Human
cuuuucgcaggauucuuccuc

SEQ ID NO: 2952795 - RNA, 14 nt, Human
cuuuuaagaaucaa

SEQ ID NO: 2952796 - RNA, 17 nt, Human
cuuuuaagacuuugguu

SEQ ID NO: 2952797 - RNA, 11 nt, Human
cuuuuaaacuc

SEQ ID NO: 2952798 - RNA, 12 nt, Human
cuuucccuuggu

SEQ ID NO: 2952799 - RNA, 17 nt, Human
cuuucccuuggugcccu

SEQ ID NO: 2952800 - RNA, 14 nt, Human
cuuuccaggaaggc

SEQ ID NO: 2952801 - RNA, 16 nt, Human
cuuuccaaaguacacu

SEQ ID NO: 2952802 - RNA, 22 nt, Human
cuuuccaaaguacacuguuuca

SEQ ID NO: 2952803 - RNA, 16 nt, Human
cuuuccaaaugcccag

SEQ ID NO: 2952804 - RNA, 21 nt, Human
cuuguggacacagcucuucuc

SEQ ID NO: 2952805 - RNA, 14 nt, Human
cuuugcagacaggc

SEQ ID NO: 2952806 - RNA, 15 nt, Human
cuuugcagacaggca

SEQ ID NO: 2952807 - RNA, 23 nt, Human
cuuuggaaagaguaggaagacuu

SEQ ID NO: 2952808 - RNA, 19 nt, Human
cuuuggaaagaguaggaag

SEQ ID NO: 2952809 - RNA, 21 nt, Human
cuuuccugaggcugggcuccc

SEQ ID NO: 2952810 - RNA, 20 nt, Human
cuuuccugaggcugggcucc

SEQ ID NO: 2952811 - RNA, 16 nt, Human
cuuuccugaggcuggg

SEQ ID NO: 2952812 - RNA, 17 nt, Human
cuuuccugaggcugggc

SEQ ID NO: 2952813 - RNA, 19 nt, Human
cuugaaauauaggaacuua

SEQ ID NO: 2952814 - RNA, 22 nt, Human
cuucuuuauaauucuacuuuga

SEQ ID NO: 2952815 - RNA, 13 nt, Human
cuucuuuccacag

SEQ ID NO: 2952816 - RNA, 19 nt, Human
cuucuuuccacagaagcuc

SEQ ID NO: 2952817 - RNA, 15 nt, Human
cuugaacuuugaccu

SEQ ID NO: 2952818 - RNA, 18 nt, Human
cuugaacuggguacuugu

SEQ ID NO: 2952819 - RNA, 20 nt, Human
cuugaacuggguacuugugg

SEQ ID NO: 2952820 - RNA, 19 nt, Human
cuugaacuccuggccucaa

SEQ ID NO: 2952821 - RNA, 16 nt, Human
cuugaacuggguacuu

SEQ ID NO: 2952822 - RNA, 14 nt, Human
cuugaacuccuggc

SEQ ID NO: 2952823 - RNA, 15 nt, Human
cuugaacuccuggcc

SEQ ID NO: 2952824 - RNA, 17 nt, Human
cuugaacuccuggccuc

SEQ ID NO: 2952825 - RNA, 18 nt, Human
cuugaacuccuggccuca

SEQ ID NO: 2952826 - RNA, 20 nt, Human
cuugaacccgggaggcagag

SEQ ID NO: 2952827 - RNA, 19 nt, Human
cuugaacccgggaggcaga

SEQ ID NO: 2952828 - RNA, 14 nt, Human
cuugaacccgggag

SEQ ID NO: 2952829 - RNA, 19 nt, Human
cuugagccuugaacuuuga

SEQ ID NO: 2952830 - RNA, 20 nt, Human
cuugaccauucuccaccugc

SEQ ID NO: 2952831 - RNA, 17 nt, Human
cuugaccauucuccacc

SEQ ID NO: 2952832 - RNA, 21 nt, Human
cuugaccauucuccaccugcc

SEQ ID NO: 2952833 - RNA, 14 nt, Human
cuugagagggugga

SEQ ID NO: 2952834 - RNA, 20 nt, Human
cuugagccuugaacuuugac

SEQ ID NO: 2952835 - RNA, 22 nt, Human
cuugagccuugaacuuugaccu

SEQ ID NO: 2952836 - RNA, 14 nt, Human
cuugcaauggcagc

SEQ ID NO: 2952837 - RNA, 22 nt, Human
cuugagugucaagcugaccuug

SEQ ID NO: 2952838 - RNA, 16 nt, Human
cuugagugcucaguag

SEQ ID NO: 2952839 - RNA, 22 nt, Human
cuugcaaaguaucccuacugua

SEQ ID NO: 2952840 - RNA, 18 nt, Human
cuugcagacucuacagag

SEQ ID NO: 2952841 - RNA, 18 nt, Human
cuugcaugguuuggagcu

SEQ ID NO: 2952842 - RNA, 19 nt, Human
cuugcaugguuuggagcug

SEQ ID NO: 2952843 - RNA, 21 nt, Human
cuugcaugguuuagaaagcuu

SEQ ID NO: 2952844 - RNA, 17 nt, Human
cuugcaugaggcuagug

SEQ ID NO: 2952845 - RNA, 21 nt, Human
cuugcaugaggcuaguguggu

SEQ ID NO: 2952846 - RNA, 16 nt, Human
cuuguggacacagcuc

SEQ ID NO: 2952847 - RNA, 17 nt, Human
cuuguggacacagcucu

SEQ ID NO: 2952848 - RNA, 18 nt, Human
cuuguggacacagcucuu

SEQ ID NO: 2952849 - RNA, 16 nt, Human
cuuggggaccagagcu

SEQ ID NO: 2952850 - RNA, 17 nt, Human
cuuggggaccagagcug

SEQ ID NO: 2952851 - RNA, 19 nt, Human
cuuggggaccagagcugcc

SEQ ID NO: 2952852 - RNA, 18 nt, Human
cuuggggaccagagcugc

SEQ ID NO: 2952853 - RNA, 20 nt, Human
cuugguuuguaaauuaacuu

SEQ ID NO: 2952854 - RNA, 21 nt, Human
cuuguaaauagcucagguguc

SEQ ID NO: 2952855 - RNA, 19 nt, Human
cuuggacauuuuaugucuu

SEQ ID NO: 2952856 - RNA, 12 nt, Human
cuuggcugcagg

SEQ ID NO: 2952857 - RNA, 13 nt, Human
cuuggcugcaggg

SEQ ID NO: 2952858 - RNA, 23 nt, Human
cuuggcucaaguccucuuuucug

SEQ ID NO: 2952859 - RNA, 14 nt, Human
cuuggauugucccc

SEQ ID NO: 2952860 - RNA, 13 nt, Human
cuuggauuguccc

SEQ ID NO: 2952861 - RNA, 13 nt, Human
cuugcuugcuuuu

SEQ ID NO: 2952862 - RNA, 16 nt, Human
cuuggacauuuuaugu

SEQ ID NO: 2952863 - RNA, 18 nt, Human
cuuggacauuuuaugucu

SEQ ID NO: 2952864 - RNA, 17 nt, Human
cuuggacauuuuauguc

SEQ ID NO: 2952865 - RNA, 19 nt, Human
cuugcugcugauuuaaaca

SEQ ID NO: 2952866 - RNA, 17 nt, Human
cuugcugcugauuuaaa

SEQ ID NO: 2952867 - RNA, 20 nt, Human
cuugcaugguuuggagcuga

SEQ ID NO: 2952868 - RNA, 22 nt, Human
cuugcaugguuuggagcugauc

SEQ ID NO: 2952869 - RNA, 17 nt, Human
cuugccaaauauaaaua

SEQ ID NO: 2952870 - RNA, 22 nt, Human
gacguguuaugacuccagaauu

SEQ ID NO: 2952871 - RNA, 12 nt, Human
gacuacaggcac

SEQ ID NO: 2952872 - RNA, 17 nt, Human
gacuacucccccaggug

SEQ ID NO: 2952873 - RNA, 18 nt, Human
gacucccaugagggagau

SEQ ID NO: 2952874 - RNA, 14 nt, Human
gacuccugcaggca

SEQ ID NO: 2952875 - RNA, 16 nt, Human
gacuccugcaggcagc

SEQ ID NO: 2952876 - RNA, 15 nt, Human
gacuccugcaggcag

SEQ ID NO: 2952877 - RNA, 18 nt, Human
gacuccaaagaaauguaa

SEQ ID NO: 2952878 - RNA, 15 nt, Human
gacuccaggcagcag

SEQ ID NO: 2952879 - RNA, 16 nt, Human
gacuccaggcagcaga

SEQ ID NO: 2952880 - RNA, 17 nt, Human
gacuccaggcagcagac

SEQ ID NO: 2952881 - RNA, 20 nt, Human
gacuccaggcagcagacaca

SEQ ID NO: 2952882 - RNA, 21 nt, Human
gacuccaggcagcagacacau

SEQ ID NO: 2952883 - RNA, 20 nt, Human
gacguguuaugacuccagaa

SEQ ID NO: 2952884 - RNA, 17 nt, Human
gacguguuaugacucca

SEQ ID NO: 2952885 - RNA, 14 nt, Human
gacggagucccacc

SEQ ID NO: 2952886 - RNA, 18 nt, Human
gacggagucccaccuugg

SEQ ID NO: 2952887 - RNA, 21 nt, Human
gacggagucccaccuuggcug

SEQ ID NO: 2952888 - RNA, 18 nt, Human
gaccuuguagugagccga

SEQ ID NO: 2952889 - RNA, 21 nt, Human
gaccuuucaauaggaaaaacu

SEQ ID NO: 2952890 - RNA, 23 nt, Human
gaccuugaacuggguacuugugg

SEQ ID NO: 2952891 - RNA, 13 nt, Human
gaccccuccaugu

SEQ ID NO: 2952892 - RNA, 18 nt, Human
gacccugaggcccagagg

SEQ ID NO: 2952893 - RNA, 21 nt, Human
gacccugaggcccagagggcc

SEQ ID NO: 2952894 - RNA, 12 nt, Human
gacccugcccug

SEQ ID NO: 2952895 - RNA, 20 nt, Human
gacccugaggcccagagggc

SEQ ID NO: 2952896 - RNA, 19 nt, Human
gacccugaggcccagaggg

SEQ ID NO: 2952897 - RNA, 15 nt, Human
gacccugcccugugg

SEQ ID NO: 2952898 - RNA, 13 nt, Human
gacccugcccugu

SEQ ID NO: 2952899 - RNA, 16 nt, Human
gacccugcccuguggg

SEQ ID NO: 2952900 - RNA, 23 nt, Human
gacccugucucaaaaaaagaaaa

SEQ ID NO: 2952901 - RNA, 13 nt, Human
gacccaugcugcc

SEQ ID NO: 2952902 - RNA, 15 nt, Human
gacccaugcugcccu

SEQ ID NO: 2952903 - RNA, 14 nt, Human
gacccaugcugccc

SEQ ID NO: 2952904 - RNA, 16 nt, Human
gacccaugcugcccug

SEQ ID NO: 2952905 - RNA, 11 nt, Human
gacccacugcu

SEQ ID NO: 2952906 - RNA, 22 nt, Human
gacccacaagaaaugaaagcag

SEQ ID NO: 2952907 - RNA, 19 nt, Human
gaccgugaggccagagaca

SEQ ID NO: 2952908 - RNA, 15 nt, Human
gaccgugaggccaga

SEQ ID NO: 2952909 - RNA, 14 nt, Human
gaccgugaggccag

SEQ ID NO: 2952910 - RNA, 21 nt, Human
gaccugaggcccuucucucca

SEQ ID NO: 2952911 - RNA, 18 nt, Human
gaccugaggcccuucucu

SEQ ID NO: 2952912 - RNA, 15 nt, Human
gaccugaggcccuuc

SEQ ID NO: 2952913 - RNA, 13 nt, Human
gaccucaggccug

SEQ ID NO: 2952914 - RNA, 12 nt, Human
gaccucaggccu

SEQ ID NO: 2952915 - RNA, 11 nt, Human
gaccucaggcc

SEQ ID NO: 2952916 - RNA, 23 nt, Human
gaccugauuucugagcauuuaau

SEQ ID NO: 2952917 - RNA, 16 nt, Human
gacaaugacccagugg

SEQ ID NO: 2952918 - RNA, 16 nt, Human
gaagucuuuguacaga

SEQ ID NO: 2952919 - RNA, 17 nt, Human
gaagucuucuauuuauu

SEQ ID NO: 2952920 - RNA, 13 nt, Human
gaagucuucuauu

SEQ ID NO: 2952921 - RNA, 14 nt, Human
gaagucuuuguaca

SEQ ID NO: 2952922 - RNA, 21 nt, Human
gacaaggauugcuacuguccu

SEQ ID NO: 2952923 - RNA, 22 nt, Human
gacaaggauugcuacuguccua

SEQ ID NO: 2952924 - RNA, 12 nt, Human
gacacaggcccg

SEQ ID NO: 2952925 - RNA, 15 nt, Human
gacacaggcccggcu

SEQ ID NO: 2952926 - RNA, 17 nt, Human
gacacaggcccggcucc

SEQ ID NO: 2952927 - RNA, 22 nt, Human
gacacaagccuucggcgccuua

SEQ ID NO: 2952928 - RNA, 13 nt, Human
gacaauuuauuau

SEQ ID NO: 2952929 - RNA, 19 nt, Human
gacaauuuauuauggcaca

SEQ ID NO: 2952930 - RNA, 12 nt, Human
gacaauuuauua

SEQ ID NO: 2952931 - RNA, 18 nt, Human
gacaaugcaaaccaucau

SEQ ID NO: 2952932 - RNA, 16 nt, Human
gacaaugcaaaccauc

SEQ ID NO: 2952933 - RNA, 17 nt, Human
gacaaugacuuacugua

SEQ ID NO: 2952934 - RNA, 20 nt, Human
gacaaugacuuacuguacau

SEQ ID NO: 2952935 - RNA, 12 nt, Human
gacaaugcaaac

SEQ ID NO: 2952936 - RNA, 21 nt, Human
gacaaugacuuacuguacaug

SEQ ID NO: 2952937 - RNA, 15 nt, Human
gacacgaauauugcu

SEQ ID NO: 2952938 - RNA, 18 nt, Human
gacaccuugacagggcac

SEQ ID NO: 2952939 - RNA, 20 nt, Human
gacaccuugacagggcacac

SEQ ID NO: 2952940 - RNA, 15 nt, Human
gacaccuugacaggg

SEQ ID NO: 2952941 - RNA, 17 nt, Human
gacaccuugacagggca

SEQ ID NO: 2952942 - RNA, 19 nt, Human
gacacgaauauugcugaug

SEQ ID NO: 2952943 - RNA, 18 nt, Human
gacacgaauauugcugau

SEQ ID NO: 2952944 - RNA, 17 nt, Human
gacacgaauauugcuga

SEQ ID NO: 2952945 - RNA, 15 nt, Human
gacacuaaccacgcu

SEQ ID NO: 2952946 - RNA, 16 nt, Human
gacacuaaccacgcug

SEQ ID NO: 2952947 - RNA, 17 nt, Human
gacacuaaccacgcugg

SEQ ID NO: 2952948 - RNA, 18 nt, Human
gacacuaaccacgcugga

SEQ ID NO: 2952949 - RNA, 23 nt, Human
gacacccugugauggggcccugc

SEQ ID NO: 2952950 - RNA, 22 nt, Human
gacacccugugauggggcccug

SEQ ID NO: 2952951 - RNA, 13 nt, Human
gacacccugugau

SEQ ID NO: 2952952 - RNA, 12 nt, Human
gacacccuguga

SEQ ID NO: 2952953 - RNA, 18 nt, Human
gacacaggcccggcucca

SEQ ID NO: 2952954 - RNA, 13 nt, Human
gacagccacggcc

SEQ ID NO: 2952955 - RNA, 13 nt, Human
gacagcugccugg

SEQ ID NO: 2952956 - RNA, 12 nt, Human
gacagcugccug

SEQ ID NO: 2952957 - RNA, 12 nt, Human
gacagacacagg

SEQ ID NO: 2952958 - RNA, 14 nt, Human
gacagacacaggcc

SEQ ID NO: 2952959 - RNA, 20 nt, Human
gacacuaaccacgcuggacc

SEQ ID NO: 2952960 - RNA, 21 nt, Human
gacacuaaccacgcuggaccu

SEQ ID NO: 2952961 - RNA, 15 nt, Human
gacagacacaggccc

SEQ ID NO: 2952962 - RNA, 16 nt, Human
gacagacacaggcccg

SEQ ID NO: 2952963 - RNA, 14 nt, Human
gacaggcaaugcug

SEQ ID NO: 2952964 - RNA, 16 nt, Human
gacaggcaaugcuggc

SEQ ID NO: 2952965 - RNA, 24 nt, Human
gacaggcaaugcuggcuguuggcu

SEQ ID NO: 2952966 - RNA, 17 nt, Human
gacaggcaaugcuggcu

SEQ ID NO: 2952967 - RNA, 18 nt, Human
gacaggcauguucucuga

SEQ ID NO: 2952968 - RNA, 19 nt, Human
gacaggcauguucucugag

SEQ ID NO: 2952969 - RNA, 15 nt, Human
gacagcugccuggga

SEQ ID NO: 2952970 - RNA, 14 nt, Human
gacagcugccuggg

SEQ ID NO: 2952971 - RNA, 15 nt, Human
gacauacuaaccagc

SEQ ID NO: 2952972 - RNA, 16 nt, Human
gacauacuaaccagca

SEQ ID NO: 2952973 - RNA, 23 nt, Human
gacauacuaaccagcagaaaugc

SEQ ID NO: 2952974 - RNA, 17 nt, Human
gacauauauuuuuuaaa

SEQ ID NO: 2952975 - RNA, 20 nt, Human
gacauauauuuuuuaaaaua

SEQ ID NO: 2952976 - RNA, 21 nt, Human
gacauauauuuuuuaaaauaa

SEQ ID NO: 2952977 - RNA, 21 nt, Human
gacaugucuuuucuugcauga

SEQ ID NO: 2952978 - RNA, 17 nt, Human
gacaugucuuuucuugc

SEQ ID NO: 2952979 - RNA, 17 nt, Human
gacaugggacauuugcu

SEQ ID NO: 2952980 - RNA, 22 nt, Human
gacaugggacauuugcucaugg

SEQ ID NO: 2952981 - RNA, 21 nt, Human
gagauagccaaggccaaagga

SEQ ID NO: 2952982 - RNA, 20 nt, Human
gagauagccaaggccaaagg

SEQ ID NO: 2952983 - RNA, 19 nt, Human
gagauagccaaggccaaag

SEQ ID NO: 2952984 - RNA, 16 nt, Human
gagcagagaccauccc

SEQ ID NO: 2952985 - RNA, 18 nt, Human
gagcagagaccaucccug

SEQ ID NO: 2952986 - RNA, 17 nt, Human
gagcagagaccaucccu

SEQ ID NO: 2952987 - RNA, 23 nt, Human
gagcagagaccaucccugaaggc

SEQ ID NO: 2952988 - RNA, 21 nt, Human
gagcagagaccaucccugaag

SEQ ID NO: 2952989 - RNA, 19 nt, Human
gagcagagaccaucccuga

SEQ ID NO: 2952990 - RNA, 21 nt, Human
gagcagccacauuccugaugc

SEQ ID NO: 2952991 - RNA, 22 nt, Human
gagcagccacauuccugaugcu

SEQ ID NO: 2952992 - RNA, 13 nt, Human
gagccagauuuca

SEQ ID NO: 2952993 - RNA, 13 nt, Human
gagcccaccuugg

SEQ ID NO: 2952994 - RNA, 15 nt, Human
gagcccaccuuggcu

SEQ ID NO: 2952995 - RNA, 17 nt, Human
gagcccaccuuggcuca

SEQ ID NO: 2952996 - RNA, 18 nt, Human
gagccacugcaccgggcc

SEQ ID NO: 2952997 - RNA, 19 nt, Human
gagccacugcaccgggcca

SEQ ID NO: 2952998 - RNA, 13 nt, Human
gagccacugcacc

SEQ ID NO: 2952999 - RNA, 20 nt, Human
gagccacugcaccgggccac

SEQ ID NO: 2953000 - RNA, 15 nt, Human
gagccagauuucacu

SEQ ID NO: 2953001 - RNA, 19 nt, Human
gagccagauuucacucucc

SEQ ID NO: 2953002 - RNA, 18 nt, Human
gagccagauuucacucuc

SEQ ID NO: 2953003 - RNA, 16 nt, Human
gagccgcccaaggccu

SEQ ID NO: 2953004 - RNA, 20 nt, Human
gagccgagaucgcgccacug

SEQ ID NO: 2953005 - RNA, 13 nt, Human
gagccgcccaagg

SEQ ID NO: 2953006 - RNA, 21 nt, Human
gagccgagaucacgccacugc

SEQ ID NO: 2953007 - RNA, 22 nt, Human
gagccgagaucacgccacugca

SEQ ID NO: 2953008 - RNA, 19 nt, Human
gagccgagaucacgccacu

SEQ ID NO: 2953009 - RNA, 20 nt, Human
gagccgagaucacgccacug

SEQ ID NO: 2953010 - RNA, 18 nt, Human
gagcccacgcccccacug

SEQ ID NO: 2953011 - RNA, 13 nt, Human
gagccucacagca

SEQ ID NO: 2953012 - RNA, 14 nt, Human
gagccucacagcag

SEQ ID NO: 2953013 - RNA, 13 nt, Human
gagccucagcauc

SEQ ID NO: 2953014 - RNA, 15 nt, Human
gagccucacagcagu

SEQ ID NO: 2953015 - RNA, 18 nt, Human
gagccucacagcagugag

SEQ ID NO: 2953016 - RNA, 17 nt, Human
gagccucagcauccugg

SEQ ID NO: 2953017 - RNA, 14 nt, Human
gagccucagcaucc

SEQ ID NO: 2953018 - RNA, 15 nt, Human
gagccucagcauccu

SEQ ID NO: 2953019 - RNA, 12 nt, Human
gagccugcaguu

SEQ ID NO: 2953020 - RNA, 13 nt, Human
gagccuccugccc

SEQ ID NO: 2953021 - RNA, 15 nt, Human
gagccugcaguuauu

SEQ ID NO: 2953022 - RNA, 17 nt, Human
gagcuagcagcagggag

SEQ ID NO: 2953023 - RNA, 15 nt, Human
gagcuagcagcaggg

SEQ ID NO: 2953024 - RNA, 15 nt, Human
gagcugaguggggga

SEQ ID NO: 2953025 - RNA, 21 nt, Human
gagcugaucgcuucuccccca

SEQ ID NO: 2953026 - RNA, 16 nt, Human
gagcugaucgcuucuc

SEQ ID NO: 2953027 - RNA, 17 nt, Human
gagcugcccucuccugg

SEQ ID NO: 2953028 - RNA, 16 nt, Human
gagcucgugggacagu

SEQ ID NO: 2953029 - RNA, 14 nt, Human
gaggaacaaggcaa

SEQ ID NO: 2953030 - RNA, 16 nt, Human
gaggaacaaggcaagg

SEQ ID NO: 2953031 - RNA, 17 nt, Human
gaggaagagaaaaaaua

SEQ ID NO: 2953032 - RNA, 13 nt, Human
gaggaagccgcug

SEQ ID NO: 2953033 - RNA, 18 nt, Human
gaggaagccgcuggggcc

SEQ ID NO: 2953034 - RNA, 17 nt, Human
gaggaagccgcuggggc

SEQ ID NO: 2953035 - RNA, 14 nt, Human
gaggaagccgcugg

SEQ ID NO: 2953036 - RNA, 17 nt, Human
gaggaaagcaaaggaga

SEQ ID NO: 2953037 - RNA, 16 nt, Human
gaggaaagcaaaggag

SEQ ID NO: 2953038 - RNA, 14 nt, Human
gagcuuuuguagaa

SEQ ID NO: 2953039 - RNA, 18 nt, Human
gagcugcccucuccuggg

SEQ ID NO: 2953040 - RNA, 19 nt, Human
gagcugcccucuccugggc

SEQ ID NO: 2953041 - RNA, 21 nt, Human
gagcugcccucuccugggcag

SEQ ID NO: 2953042 - RNA, 23 nt, Human
gagcugcccucuccugggcagcu

SEQ ID NO: 2953043 - RNA, 22 nt, Human
gagcuuucugcuaucaaagagg

SEQ ID NO: 2953044 - RNA, 20 nt, Human
gagcuuugaaaauucagugg

SEQ ID NO: 2953045 - RNA, 14 nt, Human
gagacuuuaaaagc

SEQ ID NO: 2953046 - RNA, 16 nt, Human
gagacuuuaaaagcau

SEQ ID NO: 2953047 - RNA, 17 nt, Human
gagacuuuaaaagcauu

SEQ ID NO: 2953048 - RNA, 17 nt, Human
gagagaagagaaugcac

SEQ ID NO: 2953049 - RNA, 14 nt, Human
gagagccuuccagg

SEQ ID NO: 2953050 - RNA, 13 nt, Human
gagagccuuccag

SEQ ID NO: 2953051 - RNA, 13 nt, Human
gagaggggaacag

SEQ ID NO: 2953052 - RNA, 18 nt, Human
gagaggggaacagacugg

SEQ ID NO: 2953053 - RNA, 21 nt, Human
gagagggugggagugggccca

SEQ ID NO: 2953054 - RNA, 20 nt, Human
gagagggugggagugggccc

SEQ ID NO: 2953055 - RNA, 15 nt, Human
gagagugaacaaauu

SEQ ID NO: 2953056 - RNA, 19 nt, Human
gagagugaacaaauuuaca

SEQ ID NO: 2953057 - RNA, 17 nt, Human
gagauacagaauuuuau

SEQ ID NO: 2953058 - RNA, 14 nt, Human
gagacucugucuca

SEQ ID NO: 2953059 - RNA, 18 nt, Human
gagacucgcgacaaugca

SEQ ID NO: 2953060 - RNA, 16 nt, Human
gagacucgcgacaaug

SEQ ID NO: 2953061 - RNA, 22 nt, Human
gagacuccugcaggcagccagg

SEQ ID NO: 2953062 - RNA, 15 nt, Human
gagacagcucugcau

SEQ ID NO: 2953063 - RNA, 18 nt, Human
gagacagcucugcauacu

SEQ ID NO: 2953064 - RNA, 13 nt, Human
gagacagcucugc

SEQ ID NO: 2953065 - RNA, 24 nt, Human
gagacagcccgggcucugccuccc

SEQ ID NO: 2953066 - RNA, 23 nt, Human
gagacagcccgggcucugccucc

SEQ ID NO: 2953067 - RNA, 22 nt, Human
gagacagcccgggcucugccuc

SEQ ID NO: 2953068 - RNA, 21 nt, Human
gagacagcccgggcucugccu

SEQ ID NO: 2953069 - RNA, 20 nt, Human
gagacagcccgggcucugcc

SEQ ID NO: 2953070 - RNA, 19 nt, Human
gagacagcccgggcucugc

SEQ ID NO: 2953071 - RNA, 18 nt, Human
gagacagcccgggcucug

SEQ ID NO: 2953072 - RNA, 17 nt, Human
gagacagcccgggcucu

SEQ ID NO: 2953073 - RNA, 14 nt, Human
gagacagcccgggc

SEQ ID NO: 2953074 - RNA, 18 nt, Human
gagacacacugaagaagc

SEQ ID NO: 2953075 - RNA, 17 nt, Human
gagacacaagccuucgg

SEQ ID NO: 2953076 - RNA, 15 nt, Human
gagacacaagccuuc

SEQ ID NO: 2953077 - RNA, 19 nt, Human
gagacagaguuuucacucu

SEQ ID NO: 2953078 - RNA, 12 nt, Human
gagacagcccgg

SEQ ID NO: 2953079 - RNA, 21 nt, Human
gagaaugagagacacacugaa

SEQ ID NO: 2953080 - RNA, 22 nt, Human
gagaaugcacaaacagaggccg

SEQ ID NO: 2953081 - RNA, 21 nt, Human
gagaaugcacaaacagaggcc

SEQ ID NO: 2953082 - RNA, 20 nt, Human
gagaaugcacaaacagaggc

SEQ ID NO: 2953083 - RNA, 16 nt, Human
gagaagaacugaaauc

SEQ ID NO: 2953084 - RNA, 13 nt, Human
gagaagaacugaa

SEQ ID NO: 2953085 - RNA, 14 nt, Human
gagaagaacugaaa

SEQ ID NO: 2953086 - RNA, 13 nt, Human
gagaagagcuguu

SEQ ID NO: 2953087 - RNA, 22 nt, Human
gagaagagcuguucacagccag

SEQ ID NO: 2953088 - RNA, 15 nt, Human
gagaagagcuguuca

SEQ ID NO: 2953089 - RNA, 14 nt, Human
gacuuggaagcucc

SEQ ID NO: 2953090 - RNA, 15 nt, Human
gacuuggaagcuccg

SEQ ID NO: 2953091 - RNA, 16 nt, Human
gacuuggaagcuccgc

SEQ ID NO: 2953092 - RNA, 19 nt, Human
gacucgcgacaaugcaaac

SEQ ID NO: 2953093 - RNA, 18 nt, Human
gacucgcgacaaugcaaa

SEQ ID NO: 2953094 - RNA, 17 nt, Human
gacuccugcaggcagcc

SEQ ID NO: 2953095 - RNA, 21 nt, Human
gagaaaauggacguguuauga

SEQ ID NO: 2953096 - RNA, 13 nt, Human
gacuuggaagcuc

SEQ ID NO: 2953097 - RNA, 23 nt, Human
gagaaaguacuucuccacccugc

SEQ ID NO: 2953098 - RNA, 22 nt, Human
gagaaaguacuucuccacccug

SEQ ID NO: 2953099 - RNA, 19 nt, Human
gagaaacuggcaaagcaga

SEQ ID NO: 2953100 - RNA, 18 nt, Human
gagaaacuggcaaagcag

SEQ ID NO: 2953101 - RNA, 18 nt, Human
gagaaagacuauucaaac

SEQ ID NO: 2953102 - RNA, 17 nt, Human
gagaaagacuauucaaa

SEQ ID NO: 2953103 - RNA, 15 nt, Human
gagaaagacuauuca

SEQ ID NO: 2953104 - RNA, 13 nt, Human
gagaaagacuauu

SEQ ID NO: 2953105 - RNA, 16 nt, Human
gaucccucauccucau

SEQ ID NO: 2953106 - RNA, 15 nt, Human
gaucccucauccuca

SEQ ID NO: 2953107 - RNA, 22 nt, Human
gauccugagccagauuucacuc

SEQ ID NO: 2953108 - RNA, 21 nt, Human
gauccugagccagauuucacu

SEQ ID NO: 2953109 - RNA, 18 nt, Human
gaucuuugcagacaggca

SEQ ID NO: 2953110 - RNA, 17 nt, Human
gaucuuugcagacaggc

SEQ ID NO: 2953111 - RNA, 18 nt, Human
gaugaaggucuguuuugu

SEQ ID NO: 2953112 - RNA, 15 nt, Human
gaugaaggucuguuu

SEQ ID NO: 2953113 - RNA, 14 nt, Human
gaugaaaauauuug

SEQ ID NO: 2953114 - RNA, 17 nt, Human
gaugccugguggcagcu

SEQ ID NO: 2953115 - RNA, 12 nt, Human
gaugcagccuca

SEQ ID NO: 2953116 - RNA, 14 nt, Human
gaugcagccucaca

SEQ ID NO: 2953117 - RNA, 13 nt, Human
gaugcaccagccc

SEQ ID NO: 2953118 - RNA, 21 nt, Human
gaugcacagaguuguuacauu

SEQ ID NO: 2953119 - RNA, 22 nt, Human
gaugcacagaguuguuacauuu

SEQ ID NO: 2953120 - RNA, 17 nt, Human
gaugacauucccugcua

SEQ ID NO: 2953121 - RNA, 17 nt, Human
gaugacauugacuauuu

SEQ ID NO: 2953122 - RNA, 21 nt, Human
gaugacauugacuauuuuugu

SEQ ID NO: 2953123 - RNA, 23 nt, Human
gaugacauugacuauuuuuguuu

SEQ ID NO: 2953124 - RNA, 15 nt, Human
gaugacauucccugc

SEQ ID NO: 2953125 - RNA, 20 nt, Human
gaugccugguggcagcugcg

SEQ ID NO: 2953126 - RNA, 18 nt, Human
gaugccugguggcagcug

SEQ ID NO: 2953127 - RNA, 19 nt, Human
gaugccugguggcagcugc

SEQ ID NO: 2953128 - RNA, 22 nt, Human
gauggauuuccagccaaagccu

SEQ ID NO: 2953129 - RNA, 13 nt, Human
gauggggcccugc

SEQ ID NO: 2953130 - RNA, 22 nt, Human
gauggggcccugccuccuuugu

SEQ ID NO: 2953131 - RNA, 14 nt, Human
gauggggcccugcc

SEQ ID NO: 2953132 - RNA, 21 nt, Human
gauggcuaguaucaaaagaaa

SEQ ID NO: 2953133 - RNA, 11 nt, Human
gauacagaaaa

SEQ ID NO: 2953134 - RNA, 23 nt, Human
gauagauaggucagugcaaauac

SEQ ID NO: 2953135 - RNA, 14 nt, Human
gauaauacaccacu

SEQ ID NO: 2953136 - RNA, 18 nt, Human
gauaauacaccacuacau

SEQ ID NO: 2953137 - RNA, 21 nt, Human
gauaauacaccacuacauucu

SEQ ID NO: 2953138 - RNA, 22 nt, Human
gauaauacaccacuacauucug

SEQ ID NO: 2953139 - RNA, 18 nt, Human
gauacaggaaaagcugcu

SEQ ID NO: 2953140 - RNA, 17 nt, Human
gauaggucagugcaaau

SEQ ID NO: 2953141 - RNA, 20 nt, Human
gauagcacagacccugcccu

SEQ ID NO: 2953142 - RNA, 22 nt, Human
gauagcacagacccugcccugu

SEQ ID NO: 2953143 - RNA, 21 nt, Human
gauagcacagacccugcccug

SEQ ID NO: 2953144 - RNA, 21 nt, Human
gaggaaggaaacccagcucug

SEQ ID NO: 2953145 - RNA, 20 nt, Human
gaggaaggaaacccagcucu

SEQ ID NO: 2953146 - RNA, 19 nt, Human
gaggaaggaaacccagcuc

SEQ ID NO: 2953147 - RNA, 13 nt, Human
gaggaaggaaacc

SEQ ID NO: 2953148 - RNA, 22 nt, Human
gauaaauaguuuaugauuccac

SEQ ID NO: 2953149 - RNA, 17 nt, Human
gaucauccacugugcca

SEQ ID NO: 2953150 - RNA, 19 nt, Human
gaucauccacugugccaug

SEQ ID NO: 2953151 - RNA, 14 nt, Human
gaucaugcauagag

SEQ ID NO: 2953152 - RNA, 17 nt, Human
gaucaugcauagagugu

SEQ ID NO: 2953153 - RNA, 16 nt, Human
gaucauccacugugcc

SEQ ID NO: 2953154 - RNA, 21 nt, Human
gaucauccacugugccaugug

SEQ ID NO: 2953155 - RNA, 22 nt, Human
gaucagucugauucccaagcuc

SEQ ID NO: 2953156 - RNA, 15 nt, Human
gaucagccugggcaa

SEQ ID NO: 2953157 - RNA, 12 nt, Human
gaucagccuggg

SEQ ID NO: 2953158 - RNA, 12 nt, Human
gaucacggcuca

SEQ ID NO: 2953159 - RNA, 21 nt, Human
gaucaaguuauuuuuaauuug

SEQ ID NO: 2953160 - RNA, 16 nt, Human
gaucacgccacugcac

SEQ ID NO: 2953161 - RNA, 18 nt, Human
gaucacgccacugcacua

SEQ ID NO: 2953162 - RNA, 19 nt, Human
gauuuucagcccucagaau

SEQ ID NO: 2953163 - RNA, 15 nt, Human
gauuuucagcccuca

SEQ ID NO: 2953164 - RNA, 11 nt, Human
gauuuucagcc

SEQ ID NO: 2953165 - RNA, 15 nt, Human
gauuuuccugaaaac

SEQ ID NO: 2953166 - RNA, 11 nt, Human
gauuucuguuu

SEQ ID NO: 2953167 - RNA, 19 nt, Human
gauuucuguuuagauaaua

SEQ ID NO: 2953168 - RNA, 15 nt, Human
gauuuccguuaaaau

SEQ ID NO: 2953169 - RNA, 18 nt, Human
gauuuccguuaaaauacc

SEQ ID NO: 2953170 - RNA, 21 nt, Human
gauugcaacaggcugggcuuc

SEQ ID NO: 2953171 - RNA, 23 nt, Human
gauugcaccacugcacuccagcc

SEQ ID NO: 2953172 - RNA, 16 nt, Human
gauugcaccacugcac

SEQ ID NO: 2953173 - RNA, 20 nt, Human
gauugcaacaggcugggcuu

SEQ ID NO: 2953174 - RNA, 18 nt, Human
gauucuuuccugaggcug

SEQ ID NO: 2953175 - RNA, 17 nt, Human
gauucuuuccugaggcu

SEQ ID NO: 2953176 - RNA, 16 nt, Human
gauucuuuccugaggc

SEQ ID NO: 2953177 - RNA, 12 nt, Human
gauucuuuccug

SEQ ID NO: 2953178 - RNA, 21 nt, Human
gauucccaagcucugcuccuc

SEQ ID NO: 2953179 - RNA, 19 nt, Human
gauucccaagcucugcucc

SEQ ID NO: 2953180 - RNA, 20 nt, Human
gauucccaagcucugcuccu

SEQ ID NO: 2953181 - RNA, 19 nt, Human
gauucagacagcugccugg

SEQ ID NO: 2953182 - RNA, 15 nt, Human
gauucagcucugcaa

SEQ ID NO: 2953183 - RNA, 13 nt, Human
gauucagcucugc

SEQ ID NO: 2953184 - RNA, 19 nt, Human
gauggggcugcaccggcug

SEQ ID NO: 2953185 - RNA, 23 nt, Human
gauggggcugcaccggcuggccu

SEQ ID NO: 2953186 - RNA, 18 nt, Human
gauucccaagcucugcuc

SEQ ID NO: 2953187 - RNA, 12 nt, Human
gauucauauuua

SEQ ID NO: 2953188 - RNA, 17 nt, Human
gauucauauuuacuucu

SEQ ID NO: 2953189 - RNA, 18 nt, Human
gauucauauuuacuucuu

SEQ ID NO: 2953190 - RNA, 19 nt, Human
gauucauauuuacuucuua

SEQ ID NO: 2953191 - RNA, 23 nt, Human
gcaagacgcugugcugcccugcc

SEQ ID NO: 2953192 - RNA, 22 nt, Human
gcaagacgcugugcugcccugc

SEQ ID NO: 2953193 - RNA, 21 nt, Human
gcaagacgcugugcugcccug

SEQ ID NO: 2953194 - RNA, 20 nt, Human
gcaagacgcugugcugcccu

SEQ ID NO: 2953195 - RNA, 14 nt, Human
gcaagacgcugugc

SEQ ID NO: 2953196 - RNA, 17 nt, Human
gcaagaauugaagcagg

SEQ ID NO: 2953197 - RNA, 16 nt, Human
gcaaaguaucccuacu

SEQ ID NO: 2953198 - RNA, 13 nt, Human
gcaaacagggccu

SEQ ID NO: 2953199 - RNA, 16 nt, Human
gcaaacagggccucug

SEQ ID NO: 2953200 - RNA, 17 nt, Human
gcaaacagggccucugc

SEQ ID NO: 2953201 - RNA, 18 nt, Human
gcaaacagggccucugcg

SEQ ID NO: 2953202 - RNA, 23 nt, Human
gcaaagcacugacuucuaaguaa

SEQ ID NO: 2953203 - RNA, 23 nt, Human
gcaaugaccuuucaauaggaaaa

SEQ ID NO: 2953204 - RNA, 13 nt, Human
gcaaugcuggcug

SEQ ID NO: 2953205 - RNA, 14 nt, Human
gcaaugcuggcugu

SEQ ID NO: 2953206 - RNA, 22 nt, Human
gcaaugcuggcuguuggcuggg

SEQ ID NO: 2953207 - RNA, 23 nt, Human
gcaaugcuggcuguuggcugggg

SEQ ID NO: 2953208 - RNA, 17 nt, Human
gcaaucaaaucugcuuu

SEQ ID NO: 2953209 - RNA, 15 nt, Human
gcaaucaaaucugcu

SEQ ID NO: 2953210 - RNA, 22 nt, Human
gcaaugaccuuucaauaggaaa

SEQ ID NO: 2953211 - RNA, 20 nt, Human
gcaaugaccuuucaauagga

SEQ ID NO: 2953212 - RNA, 17 nt, Human
gcaaugaccuuucaaua

SEQ ID NO: 2953213 - RNA, 15 nt, Human
gcaaugaccuuucaa

SEQ ID NO: 2953214 - RNA, 18 nt, Human
gcaaggagauuuacaacu

SEQ ID NO: 2953215 - RNA, 22 nt, Human
gcaaggcaaauguuuauuuaaa

SEQ ID NO: 2953216 - RNA, 10 nt, Human
gcaagccaga

SEQ ID NO: 2953217 - RNA, 11 nt, Human
gcaaggcuguc

SEQ ID NO: 2953218 - RNA, 14 nt, Human
gcaagggugauggg

SEQ ID NO: 2953219 - RNA, 19 nt, Human
gcagggcucagcggggaca

SEQ ID NO: 2953220 - RNA, 21 nt, Human
gcagggcucagcggggacagc

SEQ ID NO: 2953221 - RNA, 16 nt, Human
gcaggcagccaggcca

SEQ ID NO: 2953222 - RNA, 15 nt, Human
gcaggcagccaggcc

SEQ ID NO: 2953223 - RNA, 14 nt, Human
gcagggcucagcgg

SEQ ID NO: 2953224 - RNA, 22 nt, Human
gcagggcucagcggggacagcu

SEQ ID NO: 2953225 - RNA, 17 nt, Human
gcagggucucacucugu

SEQ ID NO: 2953226 - RNA, 18 nt, Human
gcagggucucacucuguc

SEQ ID NO: 2953227 - RNA, 19 nt, Human
gcaggucuugaacuccugg

SEQ ID NO: 2953228 - RNA, 20 nt, Human
gcaggucuugaacuccuggc

SEQ ID NO: 2953229 - RNA, 22 nt, Human
gcagguccaggguuugaguuca

SEQ ID NO: 2953230 - RNA, 16 nt, Human
gcagugcaugcugucc

SEQ ID NO: 2953231 - RNA, 15 nt, Human
gcagugcaugcuguc

SEQ ID NO: 2953232 - RNA, 20 nt, Human
gcagugcuuggcccaggagu

SEQ ID NO: 2953233 - RNA, 19 nt, Human
gcagugcuuggcccaggag

SEQ ID NO: 2953234 - RNA, 18 nt, Human
gcagugcuuggcccagga

SEQ ID NO: 2953235 - RNA, 17 nt, Human
gcauagguuuaauaauu

SEQ ID NO: 2953236 - RNA, 22 nt, Human
gcaguggugguuuucuguucuu

SEQ ID NO: 2953237 - RNA, 23 nt, Human
gcaguggugguuuucuguucuuu

SEQ ID NO: 2953238 - RNA, 13 nt, Human
gcagugggagcug

SEQ ID NO: 2953239 - RNA, 12 nt, Human
gcagugggagcu

SEQ ID NO: 2953240 - RNA, 14 nt, Human
gcagugggagcugc

SEQ ID NO: 2953241 - RNA, 15 nt, Human
gcagugggagcugcc

SEQ ID NO: 2953242 - RNA, 14 nt, Human
gcaguucugaagaa

SEQ ID NO: 2953243 - RNA, 17 nt, Human
gcaguucugaagaagau

SEQ ID NO: 2953244 - RNA, 13 nt, Human
gcauagaaguaaa

SEQ ID NO: 2953245 - RNA, 17 nt, Human
gcaguuauuaacacuaa

SEQ ID NO: 2953246 - RNA, 16 nt, Human
gcaguucagagcugcc

SEQ ID NO: 2953247 - RNA, 15 nt, Human
gcaguucugaagaag

SEQ ID NO: 2953248 - RNA, 17 nt, Human
gcaguucagagcugccc

SEQ ID NO: 2953249 - RNA, 18 nt, Human
gcaguucagagcugcccu

SEQ ID NO: 2953250 - RNA, 12 nt, Human
gcaucagcugcu

SEQ ID NO: 2953251 - RNA, 18 nt, Human
gcaugaaguaauaugcac

SEQ ID NO: 2953252 - RNA, 18 nt, Human
gcaugcgggcuuccuccu

SEQ ID NO: 2953253 - RNA, 14 nt, Human
gcauguucucugag

SEQ ID NO: 2953254 - RNA, 15 nt, Human
gcauguucucugagg

SEQ ID NO: 2953255 - RNA, 21 nt, Human
gcauguucucugaggacacua

SEQ ID NO: 2953256 - RNA, 22 nt, Human
gcauguucucugaggacacuaa

SEQ ID NO: 2953257 - RNA, 13 nt, Human
gcauuauauuuau

SEQ ID NO: 2953258 - RNA, 19 nt, Human
gcauucaaauguauuacag

SEQ ID NO: 2953259 - RNA, 17 nt, Human
gcauuaucuagauacug

SEQ ID NO: 2953260 - RNA, 21 nt, Human
gcauuugaggucuguucuuuc

SEQ ID NO: 2953261 - RNA, 13 nt, Human
gcauuugcugaau

SEQ ID NO: 2953262 - RNA, 14 nt, Human
gcauuugcugaaua

SEQ ID NO: 2953263 - RNA, 16 nt, Human
gcauuuguguugaaga

SEQ ID NO: 2953264 - RNA, 16 nt, Human
gcauuuguuugaacug

SEQ ID NO: 2953265 - RNA, 13 nt, Human
gccaaagccaaag

SEQ ID NO: 2953266 - RNA, 20 nt, Human
gccaaagccaaagcuaggcc

SEQ ID NO: 2953267 - RNA, 19 nt, Human
gccaaagccuccuccagcc

SEQ ID NO: 2953268 - RNA, 16 nt, Human
gccaaagccuccucca

SEQ ID NO: 2953269 - RNA, 16 nt, Human
gccaaagcuaggccug

SEQ ID NO: 2953270 - RNA, 22 nt, Human
gccaaagcuaggccuggccaga

SEQ ID NO: 2953271 - RNA, 12 nt, Human
gccaaaggaagc

SEQ ID NO: 2953272 - RNA, 18 nt, Human
gcauuuguuugaacugau

SEQ ID NO: 2953273 - RNA, 19 nt, Human
gcauuuuuuaaccuccuaa

SEQ ID NO: 2953274 - RNA, 16 nt, Human
gccaaacucaccugcc

SEQ ID NO: 2953275 - RNA, 14 nt, Human
gccaaacucaccug

SEQ ID NO: 2953276 - RNA, 19 nt, Human
gcacugguuuguucccugu

SEQ ID NO: 2953277 - RNA, 23 nt, Human
gcagacaggcaagcaccuccugc

SEQ ID NO: 2953278 - RNA, 19 nt, Human
gcagacaggcaagcaccuc

SEQ ID NO: 2953279 - RNA, 15 nt, Human
gcagacaggaccagg

SEQ ID NO: 2953280 - RNA, 13 nt, Human
gcagacaggacca

SEQ ID NO: 2953281 - RNA, 12 nt, Human
gcagacaggacc

SEQ ID NO: 2953282 - RNA, 18 nt, Human
gcacugcuuccagugagg

SEQ ID NO: 2953283 - RNA, 16 nt, Human
gcacugcuuccaguga

SEQ ID NO: 2953284 - RNA, 17 nt, Human
gcacugguuuguucccu

SEQ ID NO: 2953285 - RNA, 20 nt, Human
gcacugcuuccagugaggcu

SEQ ID NO: 2953286 - RNA, 14 nt, Human
gcaauggcagccuu

SEQ ID NO: 2953287 - RNA, 20 nt, Human
gcaccacugcacuccagccu

SEQ ID NO: 2953288 - RNA, 12 nt, Human
gcaauggcagcc

SEQ ID NO: 2953289 - RNA, 13 nt, Human
gcaauggcagccu

SEQ ID NO: 2953290 - RNA, 14 nt, Human
gcaccagcagccug

SEQ ID NO: 2953291 - RNA, 15 nt, Human
gcaccagcagccugg

SEQ ID NO: 2953292 - RNA, 22 nt, Human
gcaccacugcacuccagccugg

SEQ ID NO: 2953293 - RNA, 21 nt, Human
gcaccacugcacuccagccug

SEQ ID NO: 2953294 - RNA, 16 nt, Human
gcaccagcagccugga

SEQ ID NO: 2953295 - RNA, 22 nt, Human
gcacccaccaucaugucuggcu

SEQ ID NO: 2953296 - RNA, 18 nt, Human
gcacccggccccugcugg

SEQ ID NO: 2953297 - RNA, 19 nt, Human
gcacccggccccugcuggu

SEQ ID NO: 2953298 - RNA, 22 nt, Human
gcaccuggaauauauaaccagu

SEQ ID NO: 2953299 - RNA, 17 nt, Human
gcaccuuagacaguccc

SEQ ID NO: 2953300 - RNA, 14 nt, Human
gcaccuuagacagu

SEQ ID NO: 2953301 - RNA, 15 nt, Human
gcacccucaggcagg

SEQ ID NO: 2953302 - RNA, 18 nt, Human
gcaccuggaauauauaac

SEQ ID NO: 2953303 - RNA, 21 nt, Human
gcaccuggaauauauaaccag

SEQ ID NO: 2953304 - RNA, 18 nt, Human
gcaccuuagacagucccu

SEQ ID NO: 2953305 - RNA, 12 nt, Human
gcacgauuucug

SEQ ID NO: 2953306 - RNA, 12 nt, Human
gcaggcaccugu

SEQ ID NO: 2953307 - RNA, 12 nt, Human
gcaggcagccag

SEQ ID NO: 2953308 - RNA, 14 nt, Human
gcaggcagccaggc

SEQ ID NO: 2953309 - RNA, 13 nt, Human
gcaggcagccagg

SEQ ID NO: 2953310 - RNA, 20 nt, Human
gcaggaggaucacuugaguc

SEQ ID NO: 2953311 - RNA, 23 nt, Human
gcaggaggaucacuugaguccag

SEQ ID NO: 2953312 - RNA, 14 nt, Human
gcagcucaccucuc

SEQ ID NO: 2953313 - RNA, 15 nt, Human
gcagccuuggcaaac

SEQ ID NO: 2953314 - RNA, 15 nt, Human
gcagcucaccucucc

SEQ ID NO: 2953315 - RNA, 17 nt, Human
gcagcccugcagagggc

SEQ ID NO: 2953316 - RNA, 16 nt, Human
gcagcccugcagaggg

SEQ ID NO: 2953317 - RNA, 15 nt, Human
gcagcccugcagagg

SEQ ID NO: 2953318 - RNA, 14 nt, Human
gcagcccugcagag

SEQ ID NO: 2953319 - RNA, 22 nt, Human
gcagauacaggaaaagcugcug

SEQ ID NO: 2953320 - RNA, 20 nt, Human
gcagaccauuggggcuccca

SEQ ID NO: 2953321 - RNA, 21 nt, Human
gcagaccauuggggcucccag

SEQ ID NO: 2953322 - RNA, 22 nt, Human
gcagaccauuggggcucccagc

SEQ ID NO: 2953323 - RNA, 23 nt, Human
gcagaccauuggggcucccagcc

SEQ ID NO: 2953324 - RNA, 17 nt, Human
gcagacaguuaagagaa

SEQ ID NO: 2953325 - RNA, 21 nt, Human
gcagaguugaagacagagcua

SEQ ID NO: 2953326 - RNA, 18 nt, Human
gcagauaaacaguaguga

SEQ ID NO: 2953327 - RNA, 20 nt, Human
gcagaguugaagacagagcu

SEQ ID NO: 2953328 - RNA, 17 nt, Human
gcagccccauucugccu

SEQ ID NO: 2953329 - RNA, 16 nt, Human
gcagcaauaaagcagc

SEQ ID NO: 2953330 - RNA, 23 nt, Human
gcagcaauaaagcagcguuucua

SEQ ID NO: 2953331 - RNA, 18 nt, Human
gcagccccauucugccug

SEQ ID NO: 2953332 - RNA, 19 nt, Human
gcagccccauucugccugc

SEQ ID NO: 2953333 - RNA, 21 nt, Human
gcagccccauucugccugccc

SEQ ID NO: 2953334 - RNA, 24 nt, Human
gcagccccauucugccugcccagg

SEQ ID NO: 2953335 - RNA, 19 nt, Human
gcagcccucaauugugaaa

SEQ ID NO: 2953336 - RNA, 13 nt, Human
gcagcccugcaga

SEQ ID NO: 2953337 - RNA, 20 nt, Human
gcagccccgugggguuccuc

SEQ ID NO: 2953338 - RNA, 21 nt, Human
gcagccccuguucuggcagag

SEQ ID NO: 2953339 - RNA, 20 nt, Human
gcagccccuguucuggcaga

SEQ ID NO: 2953340 - RNA, 13 nt, Human
gcuacaguaauaa

SEQ ID NO: 2953341 - RNA, 14 nt, Human
gcuacaguaauaaa

SEQ ID NO: 2953342 - RNA, 15 nt, Human
gcuacaguaauaaau

SEQ ID NO: 2953343 - RNA, 19 nt, Human
gcuagaacucccuuucaac

SEQ ID NO: 2953344 - RNA, 16 nt, Human
gcuaccuuuguauucu

SEQ ID NO: 2953345 - RNA, 20 nt, Human
gcuaccuuuguauucucucc

SEQ ID NO: 2953346 - RNA, 18 nt, Human
gcuagaacucccuuucaa

SEQ ID NO: 2953347 - RNA, 15 nt, Human
gcuaggaacacuccu

SEQ ID NO: 2953348 - RNA, 13 nt, Human
gcuauaggugcua

SEQ ID NO: 2953349 - RNA, 14 nt, Human
gcuacacaggggaa

SEQ ID NO: 2953350 - RNA, 13 nt, Human
gcuacacacugca

SEQ ID NO: 2953351 - RNA, 20 nt, Human
gcuacacacugcauguuugu

SEQ ID NO: 2953352 - RNA, 20 nt, Human
gcuaagagggagggagggcu

SEQ ID NO: 2953353 - RNA, 13 nt, Human
gcuacacaccuaa

SEQ ID NO: 2953354 - RNA, 20 nt, Human
gcuaaagaaguuugaacauu

SEQ ID NO: 2953355 - RNA, 15 nt, Human
gcuaaagaaguuuga

SEQ ID NO: 2953356 - RNA, 18 nt, Human
gcuaaagaaguuugaaca

SEQ ID NO: 2953357 - RNA, 19 nt, Human
gcuaaagaaguuugaacau

SEQ ID NO: 2953358 - RNA, 13 nt, Human
gcuaagagggagg

SEQ ID NO: 2953359 - RNA, 15 nt, Human
gcggacagccacggc

SEQ ID NO: 2953360 - RNA, 19 nt, Human
gcgucucauacucaccuca

SEQ ID NO: 2953361 - RNA, 11 nt, Human
gcggacagcca

SEQ ID NO: 2953362 - RNA, 13 nt, Human
gcggacagccacg

SEQ ID NO: 2953363 - RNA, 15 nt, Human
gcgccuacaggagug

SEQ ID NO: 2953364 - RNA, 12 nt, Human
gcgacagugaga

SEQ ID NO: 2953365 - RNA, 18 nt, Human
gccugguggcagcugcgg

SEQ ID NO: 2953366 - RNA, 19 nt, Human
gccugguggcagcugcggu

SEQ ID NO: 2953367 - RNA, 21 nt, Human
gccugguggcagcugcggucc

SEQ ID NO: 2953368 - RNA, 13 nt, Human
gccugguggcagc

SEQ ID NO: 2953369 - RNA, 22 nt, Human
gccugggggcugggcagaggaa

SEQ ID NO: 2953370 - RNA, 21 nt, Human
gccugggggcugggcagagga

SEQ ID NO: 2953371 - RNA, 14 nt, Human
gccuuauggaacac

SEQ ID NO: 2953372 - RNA, 10 nt, Human
gccuuaugga

SEQ ID NO: 2953373 - RNA, 19 nt, Human
gccuuagaagucacacagu

SEQ ID NO: 2953374 - RNA, 17 nt, Human
gccuuagaagucacaca

SEQ ID NO: 2953375 - RNA, 18 nt, Human
gccuuagaagucacacag

SEQ ID NO: 2953376 - RNA, 21 nt, Human
gccuguugggccaggagccuc

SEQ ID NO: 2953377 - RNA, 21 nt, Human
gccuuacacaaugguuuucuu

SEQ ID NO: 2953378 - RNA, 18 nt, Human
gccuuacccucauguucu

SEQ ID NO: 2953379 - RNA, 20 nt, Human
gccuuacacaaugguuuucu

SEQ ID NO: 2953380 - RNA, 21 nt, Human
gccuuccaggggugggacacc

SEQ ID NO: 2953381 - RNA, 16 nt, Human
gccuuccagggguggg

SEQ ID NO: 2953382 - RNA, 15 nt, Human
gccuuccaggggugg

SEQ ID NO: 2953383 - RNA, 12 nt, Human
gccuuccagggg

SEQ ID NO: 2953384 - RNA, 20 nt, Human
gccuuauggaacacucugag

SEQ ID NO: 2953385 - RNA, 19 nt, Human
gccuuauggaacacucuga

SEQ ID NO: 2953386 - RNA, 18 nt, Human
gccuuauggaacacucug

SEQ ID NO: 2953387 - RNA, 16 nt, Human
gccuuauggaacacuc

SEQ ID NO: 2953388 - RNA, 23 nt, Human
gcgacaaugcaaaccaucauuga

SEQ ID NO: 2953389 - RNA, 13 nt, Human
gccuuuggcuuca

SEQ ID NO: 2953390 - RNA, 12 nt, Human
gccucugccucu

SEQ ID NO: 2953391 - RNA, 13 nt, Human
gccucugccucug

SEQ ID NO: 2953392 - RNA, 15 nt, Human
gccugcaagggagug

SEQ ID NO: 2953393 - RNA, 13 nt, Human
gccugcaagggag

SEQ ID NO: 2953394 - RNA, 14 nt, Human
gccucucucaggcc

SEQ ID NO: 2953395 - RNA, 13 nt, Human
gccucucucaggc

SEQ ID NO: 2953396 - RNA, 17 nt, Human
gccucugacacacagcu

SEQ ID NO: 2953397 - RNA, 18 nt, Human
gccucugacacacagcuc

SEQ ID NO: 2953398 - RNA, 16 nt, Human
gccucucucaggccaa

SEQ ID NO: 2953399 - RNA, 19 nt, Human
gccucugacacacagcucu

SEQ ID NO: 2953400 - RNA, 20 nt, Human
gccucugacacacagcucug

SEQ ID NO: 2953401 - RNA, 21 nt, Human
gccucugacacacagcucugu

SEQ ID NO: 2953402 - RNA, 14 nt, Human
gccucugcacuccc

SEQ ID NO: 2953403 - RNA, 18 nt, Human
gccucacaguccuuacca

SEQ ID NO: 2953404 - RNA, 15 nt, Human
gccucagcauccugg

SEQ ID NO: 2953405 - RNA, 16 nt, Human
gccucagcauccuggc

SEQ ID NO: 2953406 - RNA, 18 nt, Human
gccucccaaagugcuggg

SEQ ID NO: 2953407 - RNA, 19 nt, Human
gccucccaaagugcuggga

SEQ ID NO: 2953408 - RNA, 13 nt, Human
gccucccaacuca

SEQ ID NO: 2953409 - RNA, 16 nt, Human
gccucccaucacccgc

SEQ ID NO: 2953410 - RNA, 14 nt, Human
gccucccaucaccc

SEQ ID NO: 2953411 - RNA, 19 nt, Human
gccucccaacucaccccag

SEQ ID NO: 2953412 - RNA, 18 nt, Human
gccucccaacucacccca

SEQ ID NO: 2953413 - RNA, 17 nt, Human
gccucccaacucacccc

SEQ ID NO: 2953414 - RNA, 16 nt, Human
gccucccaacucaccc

SEQ ID NO: 2953415 - RNA, 20 nt, Human
gccucccgaguagcugggac

SEQ ID NO: 2953416 - RNA, 18 nt, Human
gccucccgaguagcuggg

SEQ ID NO: 2953417 - RNA, 19 nt, Human
gccucccgaguagcuggga

SEQ ID NO: 2953418 - RNA, 17 nt, Human
gccucccgaguagcugg

SEQ ID NO: 2953419 - RNA, 20 nt, Human
gccuccccuccucugcuugc

SEQ ID NO: 2953420 - RNA, 22 nt, Human
gccuccccuccucugcuugcca

SEQ ID NO: 2953421 - RNA, 17 nt, Human
gccuccccuccucugcu

SEQ ID NO: 2953422 - RNA, 19 nt, Human
gccuccccuccucugcuug

SEQ ID NO: 2953423 - RNA, 16 nt, Human
gccuccccuccucugc

SEQ ID NO: 2953424 - RNA, 16 nt, Human
gcccuugucggcccca

SEQ ID NO: 2953425 - RNA, 21 nt, Human
gcccuugucggccccaccagu

SEQ ID NO: 2953426 - RNA, 16 nt, Human
gcccuuggccaugggu

SEQ ID NO: 2953427 - RNA, 18 nt, Human
gcccuucucuccagcccc

SEQ ID NO: 2953428 - RNA, 17 nt, Human
gcccuucucuccagccc

SEQ ID NO: 2953429 - RNA, 16 nt, Human
gcccuucucuccagcc

SEQ ID NO: 2953430 - RNA, 14 nt, Human
gcccuucucuccag

SEQ ID NO: 2953431 - RNA, 20 nt, Human
gccgagaucacgccacugca

SEQ ID NO: 2953432 - RNA, 21 nt, Human
gccgagaucacgccacugcac

SEQ ID NO: 2953433 - RNA, 22 nt, Human
gccgagaucacgccacugcacu

SEQ ID NO: 2953434 - RNA, 12 nt, Human
gccgcagcccug

SEQ ID NO: 2953435 - RNA, 11 nt, Human
gccgcagcccu

SEQ ID NO: 2953436 - RNA, 21 nt, Human
gccgggcgugguggcaggcac

SEQ ID NO: 2953437 - RNA, 21 nt, Human
gccgggcgcgguggcucacgc

SEQ ID NO: 2953438 - RNA, 20 nt, Human
gccgggcgugguggugagug

SEQ ID NO: 2953439 - RNA, 17 nt, Human
gccgucuaccugagggg

SEQ ID NO: 2953440 - RNA, 16 nt, Human
gccgucuaccugaggg

SEQ ID NO: 2953441 - RNA, 15 nt, Human
gccgucuaccugagg

SEQ ID NO: 2953442 - RNA, 23 nt, Human
gccguggugauuuagcaggaagc

SEQ ID NO: 2953443 - RNA, 20 nt, Human
gccguguaaccauggaccca

SEQ ID NO: 2953444 - RNA, 18 nt, Human
gccucaaccuccugggcu

SEQ ID NO: 2953445 - RNA, 19 nt, Human
gccucaaccuccugggcua

SEQ ID NO: 2953446 - RNA, 19 nt, Human
gccucacagcagugagacu

SEQ ID NO: 2953447 - RNA, 15 nt, Human
gccucacagcaguga

SEQ ID NO: 2953448 - RNA, 17 nt, Human
gccucaaccuccugggc

SEQ ID NO: 2953449 - RNA, 17 nt, Human
gccucacaguccuuacc

SEQ ID NO: 2953450 - RNA, 13 nt, Human
gccucacaguccu

SEQ ID NO: 2953451 - RNA, 22 nt, Human
gccgugugugugcguccugucg

SEQ ID NO: 2953452 - RNA, 14 nt, Human
gccauccuggccca

SEQ ID NO: 2953453 - RNA, 23 nt, Human
gccauccuggcccagggcaucug

SEQ ID NO: 2953454 - RNA, 20 nt, Human
gccauccuggcccagggcau

SEQ ID NO: 2953455 - RNA, 18 nt, Human
gccauccuggcccagggc

SEQ ID NO: 2953456 - RNA, 19 nt, Human
gccauccuggcccagggca

SEQ ID NO: 2953457 - RNA, 23 nt, Human
gccaucccucccuccaccucccu

SEQ ID NO: 2953458 - RNA, 18 nt, Human
gccaucccucccuccacc

SEQ ID NO: 2953459 - RNA, 16 nt, Human
gccaucccucccucca

SEQ ID NO: 2953460 - RNA, 20 nt, Human
gccaugaggaacaaggcaag

SEQ ID NO: 2953461 - RNA, 14 nt, Human
gccaugcuccuggc

SEQ ID NO: 2953462 - RNA, 13 nt, Human
gccaggcuggucu

SEQ ID NO: 2953463 - RNA, 15 nt, Human
gccaggcuggucuca

SEQ ID NO: 2953464 - RNA, 23 nt, Human
gccaguaaaugggggugcauuug

SEQ ID NO: 2953465 - RNA, 12 nt, Human
gccaguaaaugg

SEQ ID NO: 2953466 - RNA, 21 nt, Human
gccagucaccccggccaccug

SEQ ID NO: 2953467 - RNA, 14 nt, Human
gcccacuucugcca

SEQ ID NO: 2953468 - RNA, 13 nt, Human
gcccaccuuggcu

SEQ ID NO: 2953469 - RNA, 15 nt, Human
gcccaccuuggcuca

SEQ ID NO: 2953470 - RNA, 16 nt, Human
gcccaccuuggcucaa

SEQ ID NO: 2953471 - RNA, 17 nt, Human
gcccaccuuggcucaag

SEQ ID NO: 2953472 - RNA, 16 nt, Human
gcccaccuggccucug

SEQ ID NO: 2953473 - RNA, 15 nt, Human
gcccaccuggccucu

SEQ ID NO: 2953474 - RNA, 24 nt, Human
gcccaccuggccucugcacucccc

SEQ ID NO: 2953475 - RNA, 21 nt, Human
gcccaccuggccucugcacuc

SEQ ID NO: 2953476 - RNA, 20 nt, Human
gcccaccuggccucugcacu

SEQ ID NO: 2953477 - RNA, 17 nt, Human
gcccaccuggccucugc

SEQ ID NO: 2953478 - RNA, 16 nt, Human
gcccaaggccuucccc

SEQ ID NO: 2953479 - RNA, 13 nt, Human
gcccaaggccuuc

SEQ ID NO: 2953480 - RNA, 15 nt, Human
gccaugggccuccug

SEQ ID NO: 2953481 - RNA, 16 nt, Human
gccaugggccuccugu

SEQ ID NO: 2953482 - RNA, 19 nt, Human
gccaugggcacugugggua

SEQ ID NO: 2953483 - RNA, 24 nt, Human
gccaugcuccuggcccacugcauc

SEQ ID NO: 2953484 - RNA, 20 nt, Human
gccaggaagccagcaggcuc

SEQ ID NO: 2953485 - RNA, 15 nt, Human
gccaggaagccagca

SEQ ID NO: 2953486 - RNA, 16 nt, Human
gccaggagccuccugc

SEQ ID NO: 2953487 - RNA, 14 nt, Human
gccaggagccuccu

SEQ ID NO: 2953488 - RNA, 20 nt, Human
gccaggagccuccugcccuu

SEQ ID NO: 2953489 - RNA, 19 nt, Human
gccaggagccuccugcccu

SEQ ID NO: 2953490 - RNA, 16 nt, Human
gccagcugcuugggcu

SEQ ID NO: 2953491 - RNA, 18 nt, Human
gccagcugcuugggcuuc

SEQ ID NO: 2953492 - RNA, 17 nt, Human
gccagcugcuugggcuu

SEQ ID NO: 2953493 - RNA, 14 nt, Human
gccaggaagccagc

SEQ ID NO: 2953494 - RNA, 13 nt, Human
gccaggaagccag

SEQ ID NO: 2953495 - RNA, 12 nt, Human
gccaggaagcca

SEQ ID NO: 2953496 - RNA, 20 nt, Human
gccagcugcuugggcuucau

SEQ ID NO: 2953497 - RNA, 19 nt, Human
gccagauucuuuccugagg

SEQ ID NO: 2953498 - RNA, 22 nt, Human
gccagccgagauagccaaggcc

SEQ ID NO: 2953499 - RNA, 15 nt, Human
gccagaugcaccagc

SEQ ID NO: 2953500 - RNA, 20 nt, Human
gccagauucuuuccugaggc

SEQ ID NO: 2953501 - RNA, 13 nt, Human
gccagauuucacu

SEQ ID NO: 2953502 - RNA, 24 nt, Human
gccagauucuuuccugaggcuggg

SEQ ID NO: 2953503 - RNA, 14 nt, Human
gccagaugcaccag

SEQ ID NO: 2953504 - RNA, 20 nt, Human
gccacugcaccgggccacag

SEQ ID NO: 2953505 - RNA, 21 nt, Human
gccacugcaccgggccacaga

SEQ ID NO: 2953506 - RNA, 19 nt, Human
gccacugcaccgggccaca

SEQ ID NO: 2953507 - RNA, 22 nt, Human
gccagagacacaagccuucggc

SEQ ID NO: 2953508 - RNA, 21 nt, Human
gccagagacacaagccuucgg

SEQ ID NO: 2953509 - RNA, 20 nt, Human
gccaaggccaaaggaagcac

SEQ ID NO: 2953510 - RNA, 19 nt, Human
gccaaggccaaaggaagca

SEQ ID NO: 2953511 - RNA, 24 nt, Human
gccaaggccaaaggaagcacaugc

SEQ ID NO: 2953512 - RNA, 20 nt, Human
gcccaggguggccacaccuc

SEQ ID NO: 2953513 - RNA, 15 nt, Human
gcccaggguggccac

SEQ ID NO: 2953514 - RNA, 22 nt, Human
gcccaguuggguggaugccugg

SEQ ID NO: 2953515 - RNA, 15 nt, Human
gcccagagagggugg

SEQ ID NO: 2953516 - RNA, 21 nt, Human
gcccagagaggguggugaccu

SEQ ID NO: 2953517 - RNA, 23 nt, Human
gcccaggccccugccacccuggg

SEQ ID NO: 2953518 - RNA, 13 nt, Human
gcccaggccuccu

SEQ ID NO: 2953519 - RNA, 12 nt, Human
gcccaggcuggc

SEQ ID NO: 2953520 - RNA, 14 nt, Human
gcccagggcaucug

SEQ ID NO: 2953521 - RNA, 15 nt, Human
gcccagggcaucugg

SEQ ID NO: 2953522 - RNA, 18 nt, Human
gcccagggcaucugggag

SEQ ID NO: 2953523 - RNA, 15 nt, Human
gccccauucugccug

SEQ ID NO: 2953524 - RNA, 14 nt, Human
gccccauucugccu

SEQ ID NO: 2953525 - RNA, 22 nt, Human
gccccauccucuguacagagcc

SEQ ID NO: 2953526 - RNA, 14 nt, Human
gccccauccucugu

SEQ ID NO: 2953527 - RNA, 13 nt, Human
gccccauccucug

SEQ ID NO: 2953528 - RNA, 13 nt, Human
gccccagugccca

SEQ ID NO: 2953529 - RNA, 14 nt, Human
gccccagugcccac

SEQ ID NO: 2953530 - RNA, 18 nt, Human
gccccaucccaaacccuu

SEQ ID NO: 2953531 - RNA, 12 nt, Human
gccccagugccc

SEQ ID NO: 2953532 - RNA, 20 nt, Human
gccccuucugacccaugcug

SEQ ID NO: 2953533 - RNA, 15 nt, Human
gccccgaggccuucu

SEQ ID NO: 2953534 - RNA, 17 nt, Human
gcccccuguggaugcug

SEQ ID NO: 2953535 - RNA, 13 nt, Human
gcccccuguggau

SEQ ID NO: 2953536 - RNA, 18 nt, Human
gccccgaggccuucucug

SEQ ID NO: 2953537 - RNA, 14 nt, Human
gccccucagggucc

SEQ ID NO: 2953538 - RNA, 18 nt, Human
gccccucagggucccugg

SEQ ID NO: 2953539 - RNA, 16 nt, Human
gccccucagggucccu

SEQ ID NO: 2953540 - RNA, 21 nt, Human
gcccuccaagaccuucuccuu

SEQ ID NO: 2953541 - RNA, 19 nt, Human
gcccuccaagaccuucucc

SEQ ID NO: 2953542 - RNA, 20 nt, Human
gcccuccagagccccacagc

SEQ ID NO: 2953543 - RNA, 22 nt, Human
gcccuccagagccccacagccc

SEQ ID NO: 2953544 - RNA, 14 nt, Human
gcccuccagagccc

SEQ ID NO: 2953545 - RNA, 16 nt, Human
gcccuccagagcccca

SEQ ID NO: 2953546 - RNA, 18 nt, Human
gcccuccagagccccaca

SEQ ID NO: 2953547 - RNA, 12 nt, Human
gcccuccagagc

SEQ ID NO: 2953548 - RNA, 23 nt, Human
gcccuccaagaccuucuccuuca

SEQ ID NO: 2953549 - RNA, 22 nt, Human
gcccuccaagaccuucuccuuc

SEQ ID NO: 2953550 - RNA, 19 nt, Human
gcccucugcccacucccug

SEQ ID NO: 2953551 - RNA, 18 nt, Human
gcccucugcccacucccu

SEQ ID NO: 2953552 - RNA, 16 nt, Human
gcccucugcccacucc

SEQ ID NO: 2953553 - RNA, 13 nt, Human
gcccucugcccac

SEQ ID NO: 2953554 - RNA, 13 nt, Human
gcccugcagaggg

SEQ ID NO: 2953555 - RNA, 14 nt, Human
gcccugcagagggc

SEQ ID NO: 2953556 - RNA, 15 nt, Human
gcccugcagagggca

SEQ ID NO: 2953557 - RNA, 19 nt, Human
uuuuaauauggaucuguau

SEQ ID NO: 2953558 - RNA, 20 nt, Human
uuuuaauaauguuucaaaca

SEQ ID NO: 2953559 - RNA, 11 nt, Human
uuuuaaaugca

SEQ ID NO: 2953560 - RNA, 12 nt, Human
uuuuaaaugcac

SEQ ID NO: 2953561 - RNA, 21 nt, Human
uuuuaaaugcaccuggaauau

SEQ ID NO: 2953562 - RNA, 12 nt, Human
uuuguucccugu

SEQ ID NO: 2953563 - RNA, 21 nt, Human
uuuguucuggcucuuccaggc

SEQ ID NO: 2953564 - RNA, 17 nt, Human
uuuuaaagaaugcucuu

SEQ ID NO: 2953565 - RNA, 15 nt, Human
uuuuaaaagaaugau

SEQ ID NO: 2953566 - RNA, 21 nt, Human
uuuuaaaagaaugauuaugaa

SEQ ID NO: 2953567 - RNA, 13 nt, Human
uuugguuucuagc

SEQ ID NO: 2953568 - RNA, 19 nt, Human
uuugguuuucacauuggaa

SEQ ID NO: 2953569 - RNA, 13 nt, Human
uuuguauaaaaua

SEQ ID NO: 2953570 - RNA, 14 nt, Human
uuuguauaaaauaa

SEQ ID NO: 2953571 - RNA, 16 nt, Human
uuuguauaaaauaauu

SEQ ID NO: 2953572 - RNA, 21 nt, Human
uuuggaauuuugugcccccau

SEQ ID NO: 2953573 - RNA, 15 nt, Human
uuugcauauugcaua

SEQ ID NO: 2953574 - RNA, 20 nt, Human
uuugcauauugcauacuauu

SEQ ID NO: 2953575 - RNA, 15 nt, Human
uuugcuuugugauuu

SEQ ID NO: 2953576 - RNA, 16 nt, Human
uuugcuuugugauuuu

SEQ ID NO: 2953577 - RNA, 14 nt, Human
uuuggaaaagaaua

SEQ ID NO: 2953578 - RNA, 14 nt, Human
uuuggaauuuugug

SEQ ID NO: 2953579 - RNA, 17 nt, Human
uuucuuauuucauuucu

SEQ ID NO: 2953580 - RNA, 18 nt, Human
uuucuuagggaaggauac

SEQ ID NO: 2953581 - RNA, 23 nt, Human
uuucuuagggaaggauacaaaag

SEQ ID NO: 2953582 - RNA, 13 nt, Human
uuucuucucccuc

SEQ ID NO: 2953583 - RNA, 12 nt, Human
uuucuucucccu

SEQ ID NO: 2953584 - RNA, 17 nt, Human
uuugaacugauaaagau

SEQ ID NO: 2953585 - RNA, 19 nt, Human
uuugaacugauaaagauga

SEQ ID NO: 2953586 - RNA, 15 nt, Human
uuugaacugauaaag

SEQ ID NO: 2953587 - RNA, 14 nt, Human
uuugaacucuucaa

SEQ ID NO: 2953588 - RNA, 16 nt, Human
uuugaagauucuaugu

SEQ ID NO: 2953589 - RNA, 22 nt, Human
uuugaagaugccgcauuuggau

SEQ ID NO: 2953590 - RNA, 18 nt, Human
uuugaaucaucaagucuu

SEQ ID NO: 2953591 - RNA, 22 nt, Human
uuaccaauugaaguaaaaugug

SEQ ID NO: 2953592 - RNA, 14 nt, Human
uuaccacagacaua

SEQ ID NO: 2953593 - RNA, 17 nt, Human
uuaccacagacauacua

SEQ ID NO: 2953594 - RNA, 23 nt, Human
uuacauuuuuaagugcugcauuu

SEQ ID NO: 2953595 - RNA, 15 nt, Human
uuacauuuuacacac

SEQ ID NO: 2953596 - RNA, 14 nt, Human
uuacauuuuacaca

SEQ ID NO: 2953597 - RNA, 16 nt, Human
uuuccugaggcugggc

SEQ ID NO: 2953598 - RNA, 18 nt, Human
uuuccucauuuuuauaau

SEQ ID NO: 2953599 - RNA, 23 nt, Human
uuaccaauugaaguaaaaugugg

SEQ ID NO: 2953600 - RNA, 22 nt, Human
uuuccucaaaacuucagacaua

SEQ ID NO: 2953601 - RNA, 23 nt, Human
uuucuacucgaguuacagacaaa

SEQ ID NO: 2953602 - RNA, 20 nt, Human
uuucuaaaggcuaccuuugu

SEQ ID NO: 2953603 - RNA, 21 nt, Human
uuucuaaaggcuaccuuugua

SEQ ID NO: 2953604 - RNA, 18 nt, Human
uuucuaaaggcuaccuuu

SEQ ID NO: 2953605 - RNA, 19 nt, Human
uuucugaaauuuccuggga

SEQ ID NO: 2953606 - RNA, 21 nt, Human
uuucugaaauuuccugggagc

SEQ ID NO: 2953607 - RNA, 15 nt, Human
uuucucugauacaga

SEQ ID NO: 2953608 - RNA, 16 nt, Human
uuucucugauacagaa

SEQ ID NO: 2953609 - RNA, 17 nt, Human
uuucucugauacagaaa

SEQ ID NO: 2953610 - RNA, 18 nt, Human
uuucucugauacagaaaa

SEQ ID NO: 2953611 - RNA, 20 nt, Human
uuucuguucuuucuggcuau

SEQ ID NO: 2953612 - RNA, 13 nt, Human
uuucugagaaaga

SEQ ID NO: 2953613 - RNA, 23 nt, Human
uuuuucucugauacagaaaaguu

SEQ ID NO: 2953614 - RNA, 19 nt, Human
uuuuucucuaggaaauauu

SEQ ID NO: 2953615 - RNA, 19 nt, Human
uuuuuccuucagugccuua

SEQ ID NO: 2953616 - RNA, 21 nt, Human
uuuuuccuucaagaaugcagu

SEQ ID NO: 2953617 - RNA, 20 nt, Human
uuuuuaagggcccuuuuuca

SEQ ID NO: 2953618 - RNA, 23 nt, Human
uuuuuaagaaaaaggaugcacag

SEQ ID NO: 2953619 - RNA, 11 nt, Human
uuuuuccuuca

SEQ ID NO: 2953620 - RNA, 19 nt, Human
uuuuguagagccagggucu

SEQ ID NO: 2953621 - RNA, 16 nt, Human
uuuugucauauaagau

SEQ ID NO: 2953622 - RNA, 18 nt, Human
uuuuuaaaaaagaaacau

SEQ ID NO: 2953623 - RNA, 22 nt, Human
uuuucuuuugcuuuauggguuu

SEQ ID NO: 2953624 - RNA, 20 nt, Human
uuuugacaaggggcaguggu

SEQ ID NO: 2953625 - RNA, 17 nt, Human
uuuuggguuuauuugga

SEQ ID NO: 2953626 - RNA, 18 nt, Human
uuuuggguuuauuuggaa

SEQ ID NO: 2953627 - RNA, 14 nt, Human
uuuuggcugcugaa

SEQ ID NO: 2953628 - RNA, 14 nt, Human
uuuugguauuugaa

SEQ ID NO: 2953629 - RNA, 16 nt, Human
uuuugguauuugaaac

SEQ ID NO: 2953630 - RNA, 15 nt, Human
uuuuggucuguguga

SEQ ID NO: 2953631 - RNA, 18 nt, Human
uuuuggucuggagggaag

SEQ ID NO: 2953632 - RNA, 14 nt, Human
uuuuccuucaagaa

SEQ ID NO: 2953633 - RNA, 21 nt, Human
uuuuccuucaagaaugcagua

SEQ ID NO: 2953634 - RNA, 13 nt, Human
uuuucuuuuaaga

SEQ ID NO: 2953635 - RNA, 15 nt, Human
uuuucuuuuaagaau

SEQ ID NO: 2953636 - RNA, 13 nt, Human
uuuuccuucaaga

SEQ ID NO: 2953637 - RNA, 13 nt, Human
uuuuccugaaaac

SEQ ID NO: 2953638 - RNA, 14 nt, Human
uuuuccugaaaacc

SEQ ID NO: 2953639 - RNA, 23 nt, Human
guccacccaggagccccgaggcc

SEQ ID NO: 2953640 - RNA, 12 nt, Human
guccacccagga

SEQ ID NO: 2953641 - RNA, 21 nt, Human
gucccaccuuggcugcaggga

SEQ ID NO: 2953642 - RNA, 19 nt, Human
gucauuauguuaauauuuc

SEQ ID NO: 2953643 - RNA, 17 nt, Human
gucauuauguuaauauu

SEQ ID NO: 2953644 - RNA, 14 nt, Human
gucauucuucccua

SEQ ID NO: 2953645 - RNA, 21 nt, Human
gucauucagauaugauucaaa

SEQ ID NO: 2953646 - RNA, 23 nt, Human
gucagcuccccucggagaagagc

SEQ ID NO: 2953647 - RNA, 22 nt, Human
gucagcuccccucggagaagag

SEQ ID NO: 2953648 - RNA, 21 nt, Human
gucagcuccccucggagaaga

SEQ ID NO: 2953649 - RNA, 17 nt, Human
guccccaccgcagacag

SEQ ID NO: 2953650 - RNA, 20 nt, Human
gucccaccuuggcugcaggg

SEQ ID NO: 2953651 - RNA, 23 nt, Human
gucccaccuuggcugcagggagu

SEQ ID NO: 2953652 - RNA, 16 nt, Human
gucccugcacuugcag

SEQ ID NO: 2953653 - RNA, 19 nt, Human
gucccugcacuugcagacu

SEQ ID NO: 2953654 - RNA, 21 nt, Human
gucccugcacuugcagacucu

SEQ ID NO: 2953655 - RNA, 22 nt, Human
gucaccccggccaccugcggug

SEQ ID NO: 2953656 - RNA, 18 nt, Human
gucaccccggccaccugc

SEQ ID NO: 2953657 - RNA, 17 nt, Human
gucaccccggccaccug

SEQ ID NO: 2953658 - RNA, 19 nt, Human
gucacucuggcagcucaga

SEQ ID NO: 2953659 - RNA, 17 nt, Human
gucacucuggcagcuca

SEQ ID NO: 2953660 - RNA, 16 nt, Human
gucacucuggcagcuc

SEQ ID NO: 2953661 - RNA, 14 nt, Human
gucacucuggcagc

SEQ ID NO: 2953662 - RNA, 13 nt, Human
gucacucuggcag

SEQ ID NO: 2953663 - RNA, 12 nt, Human
gucacucuggca

SEQ ID NO: 2953664 - RNA, 14 nt, Human
gucagagccugcag

SEQ ID NO: 2953665 - RNA, 15 nt, Human
gucagagccugcagu

SEQ ID NO: 2953666 - RNA, 16 nt, Human
gucagagccugcaguu

SEQ ID NO: 2953667 - RNA, 19 nt, Human
gucagcuccccucggagaa

SEQ ID NO: 2953668 - RNA, 13 nt, Human
guauuuugaaauu

SEQ ID NO: 2953669 - RNA, 22 nt, Human
guauuuucuccaaauguucacu

SEQ ID NO: 2953670 - RNA, 14 nt, Human
guauuuuacuaaua

SEQ ID NO: 2953671 - RNA, 18 nt, Human
guauuuuaaaagaaugau

SEQ ID NO: 2953672 - RNA, 13 nt, Human
guauuuuaaucac

SEQ ID NO: 2953673 - RNA, 20 nt, Human
guauuuuaaaagaaugauua

SEQ ID NO: 2953674 - RNA, 15 nt, Human
gucaccccggccacc

SEQ ID NO: 2953675 - RNA, 15 nt, Human
gucaaugcagccccc

SEQ ID NO: 2953676 - RNA, 20 nt, Human
gucaaggcuuagacccucau

SEQ ID NO: 2953677 - RNA, 18 nt, Human
gucaaggcuuagacccuc

SEQ ID NO: 2953678 - RNA, 16 nt, Human
gucaaggcuuagaccc

SEQ ID NO: 2953679 - RNA, 19 nt, Human
guauuuuguuuuugucuua

SEQ ID NO: 2953680 - RNA, 23 nt, Human
gucaauaaaauccauacauuugu

SEQ ID NO: 2953681 - RNA, 22 nt, Human
gucaauaaaauccauacauuug

SEQ ID NO: 2953682 - RNA, 15 nt, Human
gucaagugaaaaagg

SEQ ID NO: 2953683 - RNA, 19 nt, Human
guaucuggugacuuuccuc

SEQ ID NO: 2953684 - RNA, 12 nt, Human
guaucuggugac

SEQ ID NO: 2953685 - RNA, 12 nt, Human
guaucugagcag

SEQ ID NO: 2953686 - RNA, 13 nt, Human
guaugaggcauuu

SEQ ID NO: 2953687 - RNA, 15 nt, Human
guaugaggcauuugu

SEQ ID NO: 2953688 - RNA, 20 nt, Human
guauguuuuauauagcaaga

SEQ ID NO: 2953689 - RNA, 20 nt, Human
guaugaucacggcucacugc

SEQ ID NO: 2953690 - RNA, 17 nt, Human
guaugaggcauuuguuu

SEQ ID NO: 2953691 - RNA, 20 nt, Human
guaugaggcauuuguuugaa

SEQ ID NO: 2953692 - RNA, 21 nt, Human
guaugaucacggcucacugca

SEQ ID NO: 2953693 - RNA, 17 nt, Human
guauguuagugcaaauu

SEQ ID NO: 2953694 - RNA, 23 nt, Human
guauauguagauguaugcacaca

SEQ ID NO: 2953695 - RNA, 22 nt, Human
guauaugucaagccauaauugu

SEQ ID NO: 2953696 - RNA, 16 nt, Human
guauagauguugcuaa

SEQ ID NO: 2953697 - RNA, 15 nt, Human
guauagauguugcua

SEQ ID NO: 2953698 - RNA, 14 nt, Human
guauagaaaaucuu

SEQ ID NO: 2953699 - RNA, 15 nt, Human
guauagaauaggcac

SEQ ID NO: 2953700 - RNA, 21 nt, Human
guauagaauaggcacuuuaaa

SEQ ID NO: 2953701 - RNA, 21 nt, Human
guaggcuauuccugagagcug

SEQ ID NO: 2953702 - RNA, 16 nt, Human
guagggcgggaggaug

SEQ ID NO: 2953703 - RNA, 23 nt, Human
guagggcgggaggauguucuggg

SEQ ID NO: 2953704 - RNA, 21 nt, Human
guagggcgggaggauguucug

SEQ ID NO: 2953705 - RNA, 22 nt, Human
guagggcgggaggauguucugg

SEQ ID NO: 2953706 - RNA, 13 nt, Human
guagcauuuuaaa

SEQ ID NO: 2953707 - RNA, 15 nt, Human
guagcauuuuaaaca

SEQ ID NO: 2953708 - RNA, 21 nt, Human
guagcauuuguguugaagagg

SEQ ID NO: 2953709 - RNA, 16 nt, Human
guagcauccuggaaua

SEQ ID NO: 2953710 - RNA, 20 nt, Human
guagauguaugcacacacau

SEQ ID NO: 2953711 - RNA, 17 nt, Human
guagauguaugcacaca

SEQ ID NO: 2953712 - RNA, 18 nt, Human
gcuauaggugcuacaaaa

SEQ ID NO: 2953713 - RNA, 15 nt, Human
guagagugugccuga

SEQ ID NO: 2953714 - RNA, 16 nt, Human
guaggguuauaauaau

SEQ ID NO: 2953715 - RNA, 14 nt, Human
guagucaggugccu

SEQ ID NO: 2953716 - RNA, 13 nt, Human
guagugagccgag

SEQ ID NO: 2953717 - RNA, 14 nt, Human
guaguguuggagaa

SEQ ID NO: 2953718 - RNA, 15 nt, Human
guaguguuggagaag

SEQ ID NO: 2953719 - RNA, 13 nt, Human
gugaacacaucag

SEQ ID NO: 2953720 - RNA, 21 nt, Human
gugaacaaauuuacagagaca

SEQ ID NO: 2953721 - RNA, 21 nt, Human
gugaaugaugauccuaggcau

SEQ ID NO: 2953722 - RNA, 20 nt, Human
gugacaaggauugcuacugu

SEQ ID NO: 2953723 - RNA, 16 nt, Human
gugacaagcucacaga

SEQ ID NO: 2953724 - RNA, 15 nt, Human
gugaccucugccuga

SEQ ID NO: 2953725 - RNA, 12 nt, Human
gugaccucugcc

SEQ ID NO: 2953726 - RNA, 15 nt, Human
gugacagaggcagcc

SEQ ID NO: 2953727 - RNA, 13 nt, Human
gugaccucugccu

SEQ ID NO: 2953728 - RNA, 14 nt, Human
gugaccucugccug

SEQ ID NO: 2953729 - RNA, 12 nt, Human
gugacagaggca

SEQ ID NO: 2953730 - RNA, 13 nt, Human
gugacagaggcag

SEQ ID NO: 2953731 - RNA, 14 nt, Human
gugacagaggcagc

SEQ ID NO: 2953732 - RNA, 14 nt, Human
gugagccacugcac

SEQ ID NO: 2953733 - RNA, 15 nt, Human
gugagccacugcacc

SEQ ID NO: 2953734 - RNA, 20 nt, Human
gugagccacugcaccgggcc

SEQ ID NO: 2953735 - RNA, 17 nt, Human
gugaggaugaaaaaaua

SEQ ID NO: 2953736 - RNA, 19 nt, Human
gugagccgagaucacgcca

SEQ ID NO: 2953737 - RNA, 17 nt, Human
gugauacaaugcugugc

SEQ ID NO: 2953738 - RNA, 15 nt, Human
gugauacaaugcugu

SEQ ID NO: 2953739 - RNA, 17 nt, Human
gugaguugauagcacag

SEQ ID NO: 2953740 - RNA, 22 nt, Human
gugauccacccaccucagccuc

SEQ ID NO: 2953741 - RNA, 22 nt, Human
gugcacuaauguguaagacaaa

SEQ ID NO: 2953742 - RNA, 23 nt, Human
gugauccacccaccucagccucc

SEQ ID NO: 2953743 - RNA, 24 nt, Human
gugauccacccaccucagccuccc

SEQ ID NO: 2953744 - RNA, 13 nt, Human
gugauuuuuguaa

SEQ ID NO: 2953745 - RNA, 18 nt, Human
gugauuuuuguaauuuuu

SEQ ID NO: 2953746 - RNA, 22 nt, Human
gugcauaccacuuuuguucuug

SEQ ID NO: 2953747 - RNA, 20 nt, Human
gugcaguggugcgaucuggg

SEQ ID NO: 2953748 - RNA, 23 nt, Human
gugcaguggugcgaucuggguuc

SEQ ID NO: 2953749 - RNA, 21 nt, Human
gugcgaucuggguucacugca

SEQ ID NO: 2953750 - RNA, 14 nt, Human
gugccaugugccag

SEQ ID NO: 2953751 - RNA, 16 nt, Human
gugccaugugccaggu

SEQ ID NO: 2953752 - RNA, 13 nt, Human
gugcguccugucg

SEQ ID NO: 2953753 - RNA, 13 nt, Human
gugcgggguacac

SEQ ID NO: 2953754 - RNA, 14 nt, Human
gugcggccuuuggc

SEQ ID NO: 2953755 - RNA, 14 nt, Human
gugcgccuacagga

SEQ ID NO: 2953756 - RNA, 15 nt, Human
gucucacucugucgc

SEQ ID NO: 2953757 - RNA, 16 nt, Human
gucucacucugucgcc

SEQ ID NO: 2953758 - RNA, 18 nt, Human
gucucacucugucgccca

SEQ ID NO: 2953759 - RNA, 19 nt, Human
gucucacucugucgcccag

SEQ ID NO: 2953760 - RNA, 22 nt, Human
gucucacucugucgcccagucu

SEQ ID NO: 2953761 - RNA, 13 nt, Human
gucugacuguuuc

SEQ ID NO: 2953762 - RNA, 15 nt, Human
gucccugccaaugga

SEQ ID NO: 2953763 - RNA, 14 nt, Human
gucccugccaaugg

SEQ ID NO: 2953764 - RNA, 11 nt, Human
gucccugccaa

SEQ ID NO: 2953765 - RNA, 19 nt, Human
guccuuaccagcagagcac

SEQ ID NO: 2953766 - RNA, 18 nt, Human
guccuuaccagcagagca

SEQ ID NO: 2953767 - RNA, 21 nt, Human
guccuuaccagcagagcaccu

SEQ ID NO: 2953768 - RNA, 15 nt, Human
gucggccccaccagu

SEQ ID NO: 2953769 - RNA, 16 nt, Human
gucggagcccugucuc

SEQ ID NO: 2953770 - RNA, 17 nt, Human
gucggccccaccagugc

SEQ ID NO: 2953771 - RNA, 19 nt, Human
gucggccccaccagugccu

SEQ ID NO: 2953772 - RNA, 22 nt, Human
gucggccccaccagugccucuc

SEQ ID NO: 2953773 - RNA, 12 nt, Human
gucggagcccug

SEQ ID NO: 2953774 - RNA, 21 nt, Human
gucggaaaacaugcuacacac

SEQ ID NO: 2953775 - RNA, 23 nt, Human
gucggguuuuauuguuuaaaauc

SEQ ID NO: 2953776 - RNA, 16 nt, Human
gucgggcaugacacga

SEQ ID NO: 2953777 - RNA, 18 nt, Human
gucucacuauguugccca

SEQ ID NO: 2953778 - RNA, 11 nt, Human
gucucacucug

SEQ ID NO: 2953779 - RNA, 19 nt, Human
gucucacuauguugcccag

SEQ ID NO: 2953780 - RNA, 18 nt, Human
gucgucaaagcugaaaug

SEQ ID NO: 2953781 - RNA, 21 nt, Human
gucuuaaaaaguggaaaaaua

SEQ ID NO: 2953782 - RNA, 20 nt, Human
gucuguuuuguguacuuuua

SEQ ID NO: 2953783 - RNA, 15 nt, Human
gucuguuuuguguac

SEQ ID NO: 2953784 - RNA, 16 nt, Human
gucuugaacuccuggc

SEQ ID NO: 2953785 - RNA, 17 nt, Human
gucuugaacuccuggcc

SEQ ID NO: 2953786 - RNA, 21 nt, Human
gucuugaacuccuggccucaa

SEQ ID NO: 2953787 - RNA, 18 nt, Human
gucuugaacuccuggccu

SEQ ID NO: 2953788 - RNA, 20 nt, Human
gucuugaacuccuggccuca

SEQ ID NO: 2953789 - RNA, 16 nt, Human
gucuugcaauggcagc

SEQ ID NO: 2953790 - RNA, 17 nt, Human
gucuugcaauggcagcc

SEQ ID NO: 2953791 - RNA, 18 nt, Human
gucuugcaauggcagccu

SEQ ID NO: 2953792 - RNA, 19 nt, Human
gucuugcaauggcagccuu

SEQ ID NO: 2953793 - RNA, 16 nt, Human
gucuuuuuucacuaca

SEQ ID NO: 2953794 - RNA, 23 nt, Human
gucuugcaauggcagccuuggca

SEQ ID NO: 2953795 - RNA, 20 nt, Human
gucuugcaauggcagccuug

SEQ ID NO: 2953796 - RNA, 21 nt, Human
gucuugcaauggcagccuugg

SEQ ID NO: 2953797 - RNA, 14 nt, Human
gucuguuuugugua

SEQ ID NO: 2953798 - RNA, 14 nt, Human
gucuguucuuucca

SEQ ID NO: 2953799 - RNA, 17 nt, Human
gucuguucuuuccaaag

SEQ ID NO: 2953800 - RNA, 17 nt, Human
gucugucuuuuaaacuc

SEQ ID NO: 2953801 - RNA, 18 nt, Human
gucugugccauuuuguau

SEQ ID NO: 2953802 - RNA, 22 nt, Human
gucugugagaugcuagaacucc

SEQ ID NO: 2953803 - RNA, 23 nt, Human
gucugugagaugcuagaacuccc

SEQ ID NO: 2953804 - RNA, 15 nt, Human
gucugugagaugcua

SEQ ID NO: 2953805 - RNA, 16 nt, Human
gucugugagaugcuag

SEQ ID NO: 2953806 - RNA, 17 nt, Human
gucugugagaugcuaga

SEQ ID NO: 2953807 - RNA, 21 nt, Human
gucugugagaugcuagaacuc

SEQ ID NO: 2953808 - RNA, 18 nt, Human
guugaagagguuuuaaag

SEQ ID NO: 2953809 - RNA, 16 nt, Human
guugaagacagagcua

SEQ ID NO: 2953810 - RNA, 12 nt, Human
guugaaacauau

SEQ ID NO: 2953811 - RNA, 21 nt, Human
guugauggugguauguuuuca

SEQ ID NO: 2953812 - RNA, 20 nt, Human
guugauggugguauguuuuc

SEQ ID NO: 2953813 - RNA, 15 nt, Human
guugcaggaccucag

SEQ ID NO: 2953814 - RNA, 14 nt, Human
guugccagucaccc

SEQ ID NO: 2953815 - RNA, 13 nt, Human
guugccagucacc

SEQ ID NO: 2953816 - RNA, 23 nt, Human
guugccagucaccccggccaccu

SEQ ID NO: 2953817 - RNA, 18 nt, Human
guugccagucaccccggc

SEQ ID NO: 2953818 - RNA, 17 nt, Human
guugccagucaccccgg

SEQ ID NO: 2953819 - RNA, 16 nt, Human
guugccagucaccccg

SEQ ID NO: 2953820 - RNA, 12 nt, Human
guugcccaggca

SEQ ID NO: 2953821 - RNA, 14 nt, Human
guugcccaggcagg

SEQ ID NO: 2953822 - RNA, 17 nt, Human
guuggccaggcuggucu

SEQ ID NO: 2953823 - RNA, 19 nt, Human
guuggccaggcuggucuca

SEQ ID NO: 2953824 - RNA, 14 nt, Human
guuggccaguguga

SEQ ID NO: 2953825 - RNA, 15 nt, Human
guuggccaggcuggu

SEQ ID NO: 2953826 - RNA, 14 nt, Human
guuggccaggcugg

SEQ ID NO: 2953827 - RNA, 13 nt, Human
guuggccaggcug

SEQ ID NO: 2953828 - RNA, 18 nt, Human
guuggcaaaaaggcagga

SEQ ID NO: 2953829 - RNA, 14 nt, Human
guuggcaaaaaggc

SEQ ID NO: 2953830 - RNA, 23 nt, Human
guuggccaaagccaaagcuaggc

SEQ ID NO: 2953831 - RNA, 12 nt, Human
guucuggcucuu

SEQ ID NO: 2953832 - RNA, 20 nt, Human
guucuggcucuuccaggcug

SEQ ID NO: 2953833 - RNA, 16 nt, Human
guucuggcucuuccag

SEQ ID NO: 2953834 - RNA, 23 nt, Human
guucuggcagaguugaagacaga

SEQ ID NO: 2953835 - RNA, 11 nt, Human
guucugggaca

SEQ ID NO: 2953836 - RNA, 12 nt, Human
guucugggacac

SEQ ID NO: 2953837 - RNA, 14 nt, Human
guucugggacacag

SEQ ID NO: 2953838 - RNA, 15 nt, Human
guucugggacacagu

SEQ ID NO: 2953839 - RNA, 16 nt, Human
guucugggacacaguu

SEQ ID NO: 2953840 - RNA, 18 nt, Human
guucuuucacccuuuucu

SEQ ID NO: 2953841 - RNA, 13 nt, Human
guucuuuccaaag

SEQ ID NO: 2953842 - RNA, 14 nt, Human
guucuuuccaaagu

SEQ ID NO: 2953843 - RNA, 18 nt, Human
guucuuuccaaaguacac

SEQ ID NO: 2953844 - RNA, 20 nt, Human
guucuuuccaaaguacacug

SEQ ID NO: 2953845 - RNA, 17 nt, Human
guugaaaaacagcugag

SEQ ID NO: 2953846 - RNA, 23 nt, Human
guugaaaagacuccaaagaaaug

SEQ ID NO: 2953847 - RNA, 22 nt, Human
guugaaaagacuccaaagaaau

SEQ ID NO: 2953848 - RNA, 17 nt, Human
guugaaaagacuccaaa

SEQ ID NO: 2953849 - RNA, 19 nt, Human
guucugauccuaguuccac

SEQ ID NO: 2953850 - RNA, 12 nt, Human
guucugaagaag

SEQ ID NO: 2953851 - RNA, 13 nt, Human
guucugaagaaga

SEQ ID NO: 2953852 - RNA, 20 nt, Human
guucugaaaugucaguucug

SEQ ID NO: 2953853 - RNA, 14 nt, Human
guucugaagaagau

SEQ ID NO: 2953854 - RNA, 15 nt, Human
guucugaagaagaug

SEQ ID NO: 2953855 - RNA, 15 nt, Human
guuacucagaauucu

SEQ ID NO: 2953856 - RNA, 22 nt, Human
guuacuaaguuuuuauggcuuu

SEQ ID NO: 2953857 - RNA, 14 nt, Human
guuauaacuuaaug

SEQ ID NO: 2953858 - RNA, 17 nt, Human
guuauaacuuaaugaaa

SEQ ID NO: 2953859 - RNA, 21 nt, Human
guuauaacuuaaugaaaacaa

SEQ ID NO: 2953860 - RNA, 24 nt, Human
guuaguucaaucuggauucauauu

SEQ ID NO: 2953861 - RNA, 22 nt, Human
guuaguuucuccaagcaggaca

SEQ ID NO: 2953862 - RNA, 19 nt, Human
guuaguuucuccaagcagg

SEQ ID NO: 2953863 - RNA, 16 nt, Human
guuaguuucuccaagc

SEQ ID NO: 2953864 - RNA, 17 nt, Human
guuacagacaaagcgug

SEQ ID NO: 2953865 - RNA, 15 nt, Human
guuacagacaaagcg

SEQ ID NO: 2953866 - RNA, 18 nt, Human
guuacauaagauaaaugu

SEQ ID NO: 2953867 - RNA, 19 nt, Human
guuacauaagauaaaugug

SEQ ID NO: 2953868 - RNA, 21 nt, Human
guuacauuuuuaagugcugca

SEQ ID NO: 2953869 - RNA, 23 nt, Human
guuaccauuuugggguacccacu

SEQ ID NO: 2953870 - RNA, 16 nt, Human
guuacccaaauuaaga

SEQ ID NO: 2953871 - RNA, 23 nt, Human
guuaccucugccucagaaaacaa

SEQ ID NO: 2953872 - RNA, 19 nt, Human
guucaagcgauucuucugc

SEQ ID NO: 2953873 - RNA, 19 nt, Human
guuauuaaaaaucucaaau

SEQ ID NO: 2953874 - RNA, 20 nt, Human
guucaagcgauucuucugcu

SEQ ID NO: 2953875 - RNA, 23 nt, Human
guucaauucucauuugucacaca

SEQ ID NO: 2953876 - RNA, 16 nt, Human
guucaauucucauuug

SEQ ID NO: 2953877 - RNA, 23 nt, Human
guucaaucuggauucauauuuaa

SEQ ID NO: 2953878 - RNA, 21 nt, Human
guuaugacuccagaauuuccc

SEQ ID NO: 2953879 - RNA, 20 nt, Human
guuccaccaucaagccacca

SEQ ID NO: 2953880 - RNA, 17 nt, Human
guuccaccaucaagcca

SEQ ID NO: 2953881 - RNA, 14 nt, Human
guuccuaauccucu

SEQ ID NO: 2953882 - RNA, 22 nt, Human
guuccucauuagcauuuugcua

SEQ ID NO: 2953883 - RNA, 12 nt, Human
guucaugaaaga

SEQ ID NO: 2953884 - RNA, 18 nt, Human
guucaucuugaauuguaa

SEQ ID NO: 2953885 - RNA, 13 nt, Human
guucaucuugaau

SEQ ID NO: 2953886 - RNA, 12 nt, Human
guucaucuugaa

SEQ ID NO: 2953887 - RNA, 16 nt, Human
guucaucaaugaauga

SEQ ID NO: 2953888 - RNA, 17 nt, Human
guucaucauccuaagcu

SEQ ID NO: 2953889 - RNA, 19 nt, Human
guucacugcaaccuccgcc

SEQ ID NO: 2953890 - RNA, 23 nt, Human
guucagagcugcccucuccuggg

SEQ ID NO: 2953891 - RNA, 20 nt, Human
guucagagcugcccucuccu

SEQ ID NO: 2953892 - RNA, 22 nt, Human
guucagagcugcccucuccugg

SEQ ID NO: 2953893 - RNA, 15 nt, Human
guucagagcugcccu

SEQ ID NO: 2953894 - RNA, 16 nt, Human
guucagagcugcccuc

SEQ ID NO: 2953895 - RNA, 17 nt, Human
guucagagcugcccucu

SEQ ID NO: 2953896 - RNA, 19 nt, Human
guucagagcugcccucucc

SEQ ID NO: 2953897 - RNA, 24 nt, Human
guucacuggacacuucacgcccuu

SEQ ID NO: 2953898 - RNA, 13 nt, Human
guucagagcugcc

SEQ ID NO: 2953899 - RNA, 14 nt, Human
guucagagcugccc

SEQ ID NO: 2953900 - RNA, 18 nt, Human
guguuaugacuccagaau

SEQ ID NO: 2953901 - RNA, 14 nt, Human
guguuacuaaguuu

SEQ ID NO: 2953902 - RNA, 12 nt, Human
guguuacuaagu

SEQ ID NO: 2953903 - RNA, 15 nt, Human
guuacacuaaaaggu

SEQ ID NO: 2953904 - RNA, 16 nt, Human
guuacacuaaaaggug

SEQ ID NO: 2953905 - RNA, 13 nt, Human
guuacagacaaag

SEQ ID NO: 2953906 - RNA, 20 nt, Human
guuaaaagaugaaaauauuu

SEQ ID NO: 2953907 - RNA, 22 nt, Human
guuaaaauaccagccaguaaau

SEQ ID NO: 2953908 - RNA, 14 nt, Human
guuaaaaagaaaag

SEQ ID NO: 2953909 - RNA, 22 nt, Human
guuaaaaagaaaaguuuauaaa

SEQ ID NO: 2953910 - RNA, 16 nt, Human
guuaaaagaugaaaau

SEQ ID NO: 2953911 - RNA, 14 nt, Human
guuaaaagaugaaa

SEQ ID NO: 2953912 - RNA, 21 nt, Human
guguggagaagcggcuggcag

SEQ ID NO: 2953913 - RNA, 13 nt, Human
guguggagaagcg

SEQ ID NO: 2953914 - RNA, 12 nt, Human
gugugcucugau

SEQ ID NO: 2953915 - RNA, 15 nt, Human
gugugcucugaucau

SEQ ID NO: 2953916 - RNA, 22 nt, Human
gugugcucugaucauccacugu

SEQ ID NO: 2953917 - RNA, 16 nt, Human
gugugcguccugucgg

SEQ ID NO: 2953918 - RNA, 14 nt, Human
gugugcguccuguc

SEQ ID NO: 2953919 - RNA, 20 nt, Human
gugugagucaccaagcccag

SEQ ID NO: 2953920 - RNA, 22 nt, Human
gugucucuugguccugcugcag

SEQ ID NO: 2953921 - RNA, 21 nt, Human
gugucucuugguccugcugca

SEQ ID NO: 2953922 - RNA, 20 nt, Human
gugucucuugguccugcugc

SEQ ID NO: 2953923 - RNA, 19 nt, Human
gugucucuugguccugcug

SEQ ID NO: 2953924 - RNA, 18 nt, Human
gugucucuugguccugcu

SEQ ID NO: 2953925 - RNA, 17 nt, Human
gugucucccuucauccu

SEQ ID NO: 2953926 - RNA, 14 nt, Human
gugucucuuggucc

SEQ ID NO: 2953927 - RNA, 23 nt, Human
gugucccugcacuugcagacucu

SEQ ID NO: 2953928 - RNA, 14 nt, Human
guguccggucccug

SEQ ID NO: 2953929 - RNA, 15 nt, Human
gugucgggcaugaca

SEQ ID NO: 2953930 - RNA, 21 nt, Human
guguaaguagauaggccaugg

SEQ ID NO: 2953931 - RNA, 21 nt, Human
guguaaguauucuuauuuaau

SEQ ID NO: 2953932 - RNA, 17 nt, Human
guguaagacaaaaagcu

SEQ ID NO: 2953933 - RNA, 19 nt, Human
guggugcgaucuggguuca

SEQ ID NO: 2953934 - RNA, 14 nt, Human
guggugaccucugc

SEQ ID NO: 2953935 - RNA, 17 nt, Human
guggugaccucugccug

SEQ ID NO: 2953936 - RNA, 21 nt, Human
guggugagaggcauccaguau

SEQ ID NO: 2953937 - RNA, 18 nt, Human
gugguccuaaucuucuga

SEQ ID NO: 2953938 - RNA, 17 nt, Human
guggucccaccccacac

SEQ ID NO: 2953939 - RNA, 16 nt, Human
guggucccaccccaca

SEQ ID NO: 2953940 - RNA, 15 nt, Human
guggucccaccccac

SEQ ID NO: 2953941 - RNA, 14 nt, Human
guggucccacccca

SEQ ID NO: 2953942 - RNA, 17 nt, Human
gugguagagugugccug

SEQ ID NO: 2953943 - RNA, 19 nt, Human
gugguaugaucacggcuca

SEQ ID NO: 2953944 - RNA, 13 nt, Human
gugucccugcacu

SEQ ID NO: 2953945 - RNA, 16 nt, Human
gugucccugcacuugc

SEQ ID NO: 2953946 - RNA, 18 nt, Human
gugucccugcacuugcag

SEQ ID NO: 2953947 - RNA, 22 nt, Human
guguacauggaauaacauguaa

SEQ ID NO: 2953948 - RNA, 17 nt, Human
guguacauggaauaaca

SEQ ID NO: 2953949 - RNA, 18 nt, Human
guggggaccucaggccug

SEQ ID NO: 2953950 - RNA, 15 nt, Human
guggggaccucaggc

SEQ ID NO: 2953951 - RNA, 23 nt, Human
guggguuucuaaagcugccagcc

SEQ ID NO: 2953952 - RNA, 13 nt, Human
guggggcagcuug

SEQ ID NO: 2953953 - RNA, 17 nt, Human
guggggcagcuugaggg

SEQ ID NO: 2953954 - RNA, 23 nt, Human
guggggcagugcuuggcccagga

SEQ ID NO: 2953955 - RNA, 14 nt, Human
guggggcagugcuu

SEQ ID NO: 2953956 - RNA, 15 nt, Human
gugggcuaguugggc

SEQ ID NO: 2953957 - RNA, 17 nt, Human
gugggcccaaugcacuu

SEQ ID NO: 2953958 - RNA, 15 nt, Human
gugggcauucaaaug

SEQ ID NO: 2953959 - RNA, 19 nt, Human
guggcuggguuggagggug

SEQ ID NO: 2953960 - RNA, 23 nt, Human
guggcugcuucaaggauccugag

SEQ ID NO: 2953961 - RNA, 22 nt, Human
guggcugcuucaaggauccuga

SEQ ID NO: 2953962 - RNA, 19 nt, Human
guggcugcuucaaggaucc

SEQ ID NO: 2953963 - RNA, 16 nt, Human
guggcugcuucaagga

SEQ ID NO: 2953964 - RNA, 15 nt, Human
guggcugcuucaagg

SEQ ID NO: 2953965 - RNA, 22 nt, Human
guggcuuaaaacaacacucaca

SEQ ID NO: 2953966 - RNA, 14 nt, Human
guggcugcuucaag

SEQ ID NO: 2953967 - RNA, 12 nt, Human
guggcugcuuca

SEQ ID NO: 2953968 - RNA, 20 nt, Human
gugcuacaaaaacacagcaa

SEQ ID NO: 2953969 - RNA, 15 nt, Human
gugcuacaaaaacac

SEQ ID NO: 2953970 - RNA, 14 nt, Human
guggcucacgccug

SEQ ID NO: 2953971 - RNA, 17 nt, Human
guuuagaaagcuugccc

SEQ ID NO: 2953972 - RNA, 14 nt, Human
guuuagauaauaca

SEQ ID NO: 2953973 - RNA, 15 nt, Human
guuuagauaauacac

SEQ ID NO: 2953974 - RNA, 19 nt, Human
guuguucugaaaugucagu

SEQ ID NO: 2953975 - RNA, 14 nt, Human
guuguuacauuuuu

SEQ ID NO: 2953976 - RNA, 15 nt, Human
guuguuacauuuuua

SEQ ID NO: 2953977 - RNA, 20 nt, Human
guuuauauaagcuuguauuc

SEQ ID NO: 2953978 - RNA, 20 nt, Human
guuuagcuggaaaaguaugu

SEQ ID NO: 2953979 - RNA, 21 nt, Human
guuuagcuggaaaaguauguu

SEQ ID NO: 2953980 - RNA, 19 nt, Human
guugucugcaacucugaag

SEQ ID NO: 2953981 - RNA, 14 nt, Human
guugugguuaaucu

SEQ ID NO: 2953982 - RNA, 22 nt, Human
guuguggauuuaacagaaaugu

SEQ ID NO: 2953983 - RNA, 12 nt, Human
guugucagcuga

SEQ ID NO: 2953984 - RNA, 19 nt, Human
guuggcugggggccucagu

SEQ ID NO: 2953985 - RNA, 20 nt, Human
guuggccccugcccggcugc

SEQ ID NO: 2953986 - RNA, 13 nt, Human
guuggccccugcc

SEQ ID NO: 2953987 - RNA, 14 nt, Human
guuggccccugccc

SEQ ID NO: 2953988 - RNA, 12 nt, Human
guuggcuggggg

SEQ ID NO: 2953989 - RNA, 16 nt, Human
guuugacggcaagguu

SEQ ID NO: 2953990 - RNA, 17 nt, Human
guuugagaucagccugg

SEQ ID NO: 2953991 - RNA, 23 nt, Human
guuugauuaaauucuugcaaagu

SEQ ID NO: 2953992 - RNA, 20 nt, Human
guuuguaaauuaacuuuuau

SEQ ID NO: 2953993 - RNA, 18 nt, Human
guuuggggaugagaaagg

SEQ ID NO: 2953994 - RNA, 21 nt, Human
guuugauucagacagcugccu

SEQ ID NO: 2953995 - RNA, 20 nt, Human
guuugauucagacagcugcc

SEQ ID NO: 2953996 - RNA, 16 nt, Human
guuugauucagacagc

SEQ ID NO: 2953997 - RNA, 18 nt, Human
guuuguuucugaaaggga

SEQ ID NO: 2953998 - RNA, 20 nt, Human
guuuucaauuuuaaacauau

SEQ ID NO: 2953999 - RNA, 18 nt, Human
guuuucaauuuuaaacau

SEQ ID NO: 2954000 - RNA, 11 nt, Human
guuuucacucu

SEQ ID NO: 2954001 - RNA, 12 nt, Human
guuuucacucuu

SEQ ID NO: 2954002 - RNA, 17 nt, Human
guuuucaaaauaaaaau

SEQ ID NO: 2954003 - RNA, 20 nt, Human
guuuguuucugaaagggacg

SEQ ID NO: 2954004 - RNA, 13 nt, Human
guuuuccugaaga

SEQ ID NO: 2954005 - RNA, 20 nt, Human
guuuuccaugaguccccugu

SEQ ID NO: 2954006 - RNA, 19 nt, Human
guuuuccaugaguccccug

SEQ ID NO: 2954007 - RNA, 20 nt, Human
guuuuccagguuuaagcugu

SEQ ID NO: 2954008 - RNA, 21 nt, Human
uaaaagguaugcaaucaaauc

SEQ ID NO: 2954009 - RNA, 21 nt, Human
uaaaaggaagcuuacaugccu

SEQ ID NO: 2954010 - RNA, 12 nt, Human
uaaaaggagcca

SEQ ID NO: 2954011 - RNA, 18 nt, Human
uaaaaggaagcuuacaug

SEQ ID NO: 2954012 - RNA, 12 nt, Human
uaaaaggugacc

SEQ ID NO: 2954013 - RNA, 13 nt, Human
uaaaaucauuucu

SEQ ID NO: 2954014 - RNA, 10 nt, Human
uaaaaucauu

SEQ ID NO: 2954015 - RNA, 15 nt, Human
uaaaauccauacauu

SEQ ID NO: 2954016 - RNA, 17 nt, Human
uaaaauccauacauuug

SEQ ID NO: 2954017 - RNA, 22 nt, Human
uaaaaucauuucugcaucagcu

SEQ ID NO: 2954018 - RNA, 18 nt, Human
uaaaaucauuucugcauc

SEQ ID NO: 2954019 - RNA, 21 nt, Human
uaaaagauacaguuacucaga

SEQ ID NO: 2954020 - RNA, 14 nt, Human
uaaaagauacaguu

SEQ ID NO: 2954021 - RNA, 17 nt, Human
uaaaagauacaguuacu

SEQ ID NO: 2954022 - RNA, 20 nt, Human
uaaaagauacaguuacucag

SEQ ID NO: 2954023 - RNA, 17 nt, Human
uaaaacacaacaucuuu

SEQ ID NO: 2954024 - RNA, 23 nt, Human
uaaaacacaacaucuuuuucuac

SEQ ID NO: 2954025 - RNA, 22 nt, Human
uaaaacacaacaucuuuuucua

SEQ ID NO: 2954026 - RNA, 16 nt, Human
uaaaacaacagaugua

SEQ ID NO: 2954027 - RNA, 19 nt, Human
uaaaacaacagauguacga

SEQ ID NO: 2954028 - RNA, 15 nt, Human
uaaaacaacacucac

SEQ ID NO: 2954029 - RNA, 22 nt, Human
uaaaacaagcacuaaacaaaga

SEQ ID NO: 2954030 - RNA, 18 nt, Human
uaaaaacaacgaaagaag

SEQ ID NO: 2954031 - RNA, 19 nt, Human
uaaaaaugguuuaaauggu

SEQ ID NO: 2954032 - RNA, 15 nt, Human
uaaaaaugguuuaaa

SEQ ID NO: 2954033 - RNA, 18 nt, Human
uaaaaaugguuuaaaugg

SEQ ID NO: 2954034 - RNA, 17 nt, Human
uaaaggcuaccuuugua

SEQ ID NO: 2954035 - RNA, 14 nt, Human
uaaaguguuugaaa

SEQ ID NO: 2954036 - RNA, 20 nt, Human
uaaagccugaguuugcuuuc

SEQ ID NO: 2954037 - RNA, 15 nt, Human
uaaaggcuaccuuug

SEQ ID NO: 2954038 - RNA, 12 nt, Human
uaaagaaaacug

SEQ ID NO: 2954039 - RNA, 16 nt, Human
uaaagcagcguuucua

SEQ ID NO: 2954040 - RNA, 17 nt, Human
uaaagcagcguuucuau

SEQ ID NO: 2954041 - RNA, 19 nt, Human
uaaagcagcguuucuauga

SEQ ID NO: 2954042 - RNA, 20 nt, Human
uaaacaugcuguacauacuu

SEQ ID NO: 2954043 - RNA, 19 nt, Human
uaaacaugcuguacauacu

SEQ ID NO: 2954044 - RNA, 22 nt, Human
uaaacacauuaaagguacuuug

SEQ ID NO: 2954045 - RNA, 21 nt, Human
uaaacaagaccacguuucuaa

SEQ ID NO: 2954046 - RNA, 22 nt, Human
uaaacaagaccacguuucuaaa

SEQ ID NO: 2954047 - RNA, 20 nt, Human
uaaacaagaccacguuucua

SEQ ID NO: 2954048 - RNA, 19 nt, Human
uaaacaagaccacguuucu

SEQ ID NO: 2954049 - RNA, 23 nt, Human
uaaacaugcuguacauacuuuuu

SEQ ID NO: 2954050 - RNA, 21 nt, Human
uaaacaugcuguacauacuuu

SEQ ID NO: 2954051 - RNA, 22 nt, Human
uaaacaugcuguacauacuuuu

SEQ ID NO: 2954052 - RNA, 22 nt, Human
uaaacuugguuuuuaaaaaacu

SEQ ID NO: 2954053 - RNA, 16 nt, Human
uaaugguaguuuuaca

SEQ ID NO: 2954054 - RNA, 22 nt, Human
uaauguuucaaacauauauaac

SEQ ID NO: 2954055 - RNA, 20 nt, Human
uaauuaaguacuauguauca

SEQ ID NO: 2954056 - RNA, 14 nt, Human
uaauuaaguacuau

SEQ ID NO: 2954057 - RNA, 17 nt, Human
uaauuaaguacuaugua

SEQ ID NO: 2954058 - RNA, 19 nt, Human
uaaugcuugcugcugauuu

SEQ ID NO: 2954059 - RNA, 15 nt, Human
uaauggggcggugag

SEQ ID NO: 2954060 - RNA, 23 nt, Human
uaaugcgugcauaccacuuuugu

SEQ ID NO: 2954061 - RNA, 19 nt, Human
uaaugcgugcauaccacuu

SEQ ID NO: 2954062 - RNA, 22 nt, Human
uaaugcgugcauaccacuuuug

SEQ ID NO: 2954063 - RNA, 15 nt, Human
uaaugcgugcauacc

SEQ ID NO: 2954064 - RNA, 17 nt, Human
uaaugauaacuggaaac

SEQ ID NO: 2954065 - RNA, 22 nt, Human
uaaugauaacuggaaacuucag

SEQ ID NO: 2954066 - RNA, 15 nt, Human
uaauaugaugacugu

SEQ ID NO: 2954067 - RNA, 15 nt, Human
uaauaugcaaagucu

SEQ ID NO: 2954068 - RNA, 16 nt, Human
uaauaugcaaagucua

SEQ ID NO: 2954069 - RNA, 15 nt, Human
uaauauggaucugua

SEQ ID NO: 2954070 - RNA, 19 nt, Human
uaauaugcacacauuuuuu

SEQ ID NO: 2954071 - RNA, 15 nt, Human
uaauaugcacacauu

SEQ ID NO: 2954072 - RNA, 16 nt, Human
uaauaugcacacauuu

SEQ ID NO: 2954073 - RNA, 17 nt, Human
uaauaugcacacauuuu

SEQ ID NO: 2954074 - RNA, 18 nt, Human
uaauaugcacacauuuuu

SEQ ID NO: 2954075 - RNA, 20 nt, Human
uaauauuaaggaagacaaug

SEQ ID NO: 2954076 - RNA, 20 nt, Human
uaauccucuaggaggucucu

SEQ ID NO: 2954077 - RNA, 12 nt, Human
uaaucuaaaugg

SEQ ID NO: 2954078 - RNA, 13 nt, Human
uaaucuaaaugga

SEQ ID NO: 2954079 - RNA, 16 nt, Human
uaaggauguucuagca

SEQ ID NO: 2954080 - RNA, 18 nt, Human
uaagcuacugccauccug

SEQ ID NO: 2954081 - RNA, 15 nt, Human
uaagcuacugccauc

SEQ ID NO: 2954082 - RNA, 16 nt, Human
uaagcuacugccaucc

SEQ ID NO: 2954083 - RNA, 14 nt, Human
uaagcuacugccau

SEQ ID NO: 2954084 - RNA, 12 nt, Human
uaagaggcaggg

SEQ ID NO: 2954085 - RNA, 15 nt, Human
uaagaggcagggucu

SEQ ID NO: 2954086 - RNA, 20 nt, Human
uaagguggguacgggagggu

SEQ ID NO: 2954087 - RNA, 15 nt, Human
uaaggugugcucuga

SEQ ID NO: 2954088 - RNA, 17 nt, Human
uaaggguaucuggugac

SEQ ID NO: 2954089 - RNA, 14 nt, Human
uaaguguauuuuga

SEQ ID NO: 2954090 - RNA, 15 nt, Human
uaagugcugcauuua

SEQ ID NO: 2954091 - RNA, 16 nt, Human
uaagugcugcauuuaa

SEQ ID NO: 2954092 - RNA, 18 nt, Human
uaagugcugcauuuaaaa

SEQ ID NO: 2954093 - RNA, 22 nt, Human
uaagugcugcauuuaaaagaua

SEQ ID NO: 2954094 - RNA, 13 nt, Human
uaauaaauauguu

SEQ ID NO: 2954095 - RNA, 20 nt, Human
uaauaaauauguuucacaca

SEQ ID NO: 2954096 - RNA, 23 nt, Human
uaagugaggaugaaaaaauaaca

SEQ ID NO: 2954097 - RNA, 12 nt, Human
uaagugagagag

SEQ ID NO: 2954098 - RNA, 14 nt, Human
uaagugcugcauuu

SEQ ID NO: 2954099 - RNA, 14 nt, Human
uaagucugauuuaa

SEQ ID NO: 2954100 - RNA, 13 nt, Human
uaagugaaauaag

SEQ ID NO: 2954101 - RNA, 16 nt, Human
uaaaugugccuucauu

SEQ ID NO: 2954102 - RNA, 11 nt, Human
uaaauuauuuu

SEQ ID NO: 2954103 - RNA, 22 nt, Human
uaaauucuugcaaaguaucccu

SEQ ID NO: 2954104 - RNA, 17 nt, Human
uaaauucuugcaaagua

SEQ ID NO: 2954105 - RNA, 18 nt, Human
uaaauucuugcaaaguau

SEQ ID NO: 2954106 - RNA, 16 nt, Human
uaaauucuugcaaagu

SEQ ID NO: 2954107 - RNA, 22 nt, Human
uaaauuuaguauuuuguuucag

SEQ ID NO: 2954108 - RNA, 13 nt, Human
uaaauucuuucau

SEQ ID NO: 2954109 - RNA, 20 nt, Human
uaaauugacacuuaaaaaug

SEQ ID NO: 2954110 - RNA, 18 nt, Human
uaacaccaugauuaacca

SEQ ID NO: 2954111 - RNA, 22 nt, Human
uaaaugucucuuuaaugucaca

SEQ ID NO: 2954112 - RNA, 20 nt, Human
uaaaugucuaguuguaacac

SEQ ID NO: 2954113 - RNA, 18 nt, Human
uaaaugggggugcauuug

SEQ ID NO: 2954114 - RNA, 19 nt, Human
uaaaugggggugcauuuga

SEQ ID NO: 2954115 - RNA, 20 nt, Human
uaaauggcuuccuggcaaua

SEQ ID NO: 2954116 - RNA, 14 nt, Human
uaaaugggggugca

SEQ ID NO: 2954117 - RNA, 17 nt, Human
uaaaugggggugcauuu

SEQ ID NO: 2954118 - RNA, 16 nt, Human
uaaauggaaccacucu

SEQ ID NO: 2954119 - RNA, 17 nt, Human
uaaaugcccagccccuu

SEQ ID NO: 2954120 - RNA, 16 nt, Human
uaaaugcccagccccu

SEQ ID NO: 2954121 - RNA, 15 nt, Human
uaaaugcccagcccc

SEQ ID NO: 2954122 - RNA, 14 nt, Human
uaaaugcccagccc

SEQ ID NO: 2954123 - RNA, 13 nt, Human
uaaaugcccagcc

SEQ ID NO: 2954124 - RNA, 18 nt, Human
uaacucaccuggcaucuu

SEQ ID NO: 2954125 - RNA, 11 nt, Human
uaacagaaaug

SEQ ID NO: 2954126 - RNA, 17 nt, Human
uaaccaggggccaugaa

SEQ ID NO: 2954127 - RNA, 23 nt, Human
uaaccaguguuguggauuuaaca

SEQ ID NO: 2954128 - RNA, 16 nt, Human
uaaccacuucagcuga

SEQ ID NO: 2954129 - RNA, 21 nt, Human
uaagaaaauaucacuugucaa

SEQ ID NO: 2954130 - RNA, 14 nt, Human
uaagagagaaugag

SEQ ID NO: 2954131 - RNA, 19 nt, Human
uaagaaccuuuugagugcc

SEQ ID NO: 2954132 - RNA, 13 nt, Human
uaagagagaauga

SEQ ID NO: 2954133 - RNA, 19 nt, Human
uaagaaaaaggaugcacag

SEQ ID NO: 2954134 - RNA, 23 nt, Human
uaagaaaaaggaugcacagaguu

SEQ ID NO: 2954135 - RNA, 15 nt, Human
uaacuuuuuauauuc

SEQ ID NO: 2954136 - RNA, 16 nt, Human
uaacuuuuuauauucu

SEQ ID NO: 2954137 - RNA, 13 nt, Human
uaacuuuuuauau

SEQ ID NO: 2954138 - RNA, 14 nt, Human
uaacuuuuuauauu

SEQ ID NO: 2954139 - RNA, 16 nt, Human
uaagaaaaaggaugca

SEQ ID NO: 2954140 - RNA, 18 nt, Human
uaagaaaaaggaugcaca

SEQ ID NO: 2954141 - RNA, 10 nt, Human
uaacuggaac

SEQ ID NO: 2954142 - RNA, 15 nt, Human
uaacuggaaacuuca

SEQ ID NO: 2954143 - RNA, 17 nt, Human
uaucaugacaaagacug

SEQ ID NO: 2954144 - RNA, 20 nt, Human
uaucaggugcugccauccag

SEQ ID NO: 2954145 - RNA, 19 nt, Human
uaucaggugcugccaucca

SEQ ID NO: 2954146 - RNA, 14 nt, Human
uaucaaaagaaaga

SEQ ID NO: 2954147 - RNA, 21 nt, Human
uauauuuuuuguuaaaugauu

SEQ ID NO: 2954148 - RNA, 16 nt, Human
uauauuuuuuucugaa

SEQ ID NO: 2954149 - RNA, 19 nt, Human
uauauuuuuuucugaaauu

SEQ ID NO: 2954150 - RNA, 20 nt, Human
uauauuuuuuucugaaauuu

SEQ ID NO: 2954151 - RNA, 20 nt, Human
uauauuugaaauauugacuu

SEQ ID NO: 2954152 - RNA, 14 nt, Human
uauaugcuucuguu

SEQ ID NO: 2954153 - RNA, 16 nt, Human
uauaugcuucuguuuu

SEQ ID NO: 2954154 - RNA, 12 nt, Human
uauagaaaaucu

SEQ ID NO: 2954155 - RNA, 15 nt, Human
uauagaaaaucuuca

SEQ ID NO: 2954156 - RNA, 20 nt, Human
uauagaauaggcacuuuaaa

SEQ ID NO: 2954157 - RNA, 23 nt, Human
uauagaauaggcacuuuaaaaca

SEQ ID NO: 2954158 - RNA, 13 nt, Human
uauauaacaaugc

SEQ ID NO: 2954159 - RNA, 17 nt, Human
uauauaacaaugcugua

SEQ ID NO: 2954160 - RNA, 19 nt, Human
uauauaacaaugcuguauu

SEQ ID NO: 2954161 - RNA, 22 nt, Human
uaguuguuugauucagacagcu

SEQ ID NO: 2954162 - RNA, 21 nt, Human
uaguuguuugauucagacagc

SEQ ID NO: 2954163 - RNA, 20 nt, Human
uaguuguuugauucagacag

SEQ ID NO: 2954164 - RNA, 20 nt, Human
uaguggcuuaaaacaacacu

SEQ ID NO: 2954165 - RNA, 16 nt, Human
uaguaugguggcuggg

SEQ ID NO: 2954166 - RNA, 15 nt, Human
uaguaugaggcauuu

SEQ ID NO: 2954167 - RNA, 17 nt, Human
uaguauuguccaggucu

SEQ ID NO: 2954168 - RNA, 15 nt, Human
uaguuugauuaaauu

SEQ ID NO: 2954169 - RNA, 16 nt, Human
uaguuugauuaaauuc

SEQ ID NO: 2954170 - RNA, 17 nt, Human
uauaaacuuuaccuuuu

SEQ ID NO: 2954171 - RNA, 15 nt, Human
uauaaacuuuaccuu

SEQ ID NO: 2954172 - RNA, 16 nt, Human
uauaaacuuuaccuuu

SEQ ID NO: 2954173 - RNA, 18 nt, Human
uauaaaccgaacugaugu

SEQ ID NO: 2954174 - RNA, 11 nt, Human
uauaaacuuua

SEQ ID NO: 2954175 - RNA, 13 nt, Human
uauaaacuuuacc

SEQ ID NO: 2954176 - RNA, 14 nt, Human
uauaaacuuuaccu

SEQ ID NO: 2954177 - RNA, 17 nt, Human
uaggugugggggaagca

SEQ ID NO: 2954178 - RNA, 13 nt, Human
uagguguggggga

SEQ ID NO: 2954179 - RNA, 19 nt, Human
uaggugugacugaauuucu

SEQ ID NO: 2954180 - RNA, 21 nt, Human
uaggugugacugaauuucuuu

SEQ ID NO: 2954181 - RNA, 23 nt, Human
uaggugugacugaauuucuuuug

SEQ ID NO: 2954182 - RNA, 22 nt, Human
uaguagagguacacuugugaau

SEQ ID NO: 2954183 - RNA, 20 nt, Human
uaguagagguacacuuguga

SEQ ID NO: 2954184 - RNA, 21 nt, Human
uaguagagguacacuugugaa

SEQ ID NO: 2954185 - RNA, 17 nt, Human
uaguaugaggcauuugu

SEQ ID NO: 2954186 - RNA, 18 nt, Human
uaguaugaggcauuuguu

SEQ ID NO: 2954187 - RNA, 22 nt, Human
uagcuggucuuauuuguaaagc

SEQ ID NO: 2954188 - RNA, 11 nt, Human
uaggugacaga

SEQ ID NO: 2954189 - RNA, 16 nt, Human
uaggugacagagugag

SEQ ID NO: 2954190 - RNA, 18 nt, Human
uaggugcuacaaaaacac

SEQ ID NO: 2954191 - RNA, 23 nt, Human
uaggugcuacaaaaacacagcaa

SEQ ID NO: 2954192 - RNA, 22 nt, Human
uaggugcuacaaaaacacagca

SEQ ID NO: 2954193 - RNA, 20 nt, Human
uaggugcuacaaaaacacag

SEQ ID NO: 2954194 - RNA, 18 nt, Human
uagcauccuggaauaucu

SEQ ID NO: 2954195 - RNA, 13 nt, Human
uagcauccuggaa

SEQ ID NO: 2954196 - RNA, 15 nt, Human
uagcauccuggaaua

SEQ ID NO: 2954197 - RNA, 16 nt, Human
uagcauccuggaauau

SEQ ID NO: 2954198 - RNA, 11 nt, Human
uagcagggaaa

SEQ ID NO: 2954199 - RNA, 16 nt, Human
uagcauacguacacau

SEQ ID NO: 2954200 - RNA, 17 nt, Human
uagcauacguacacauu

SEQ ID NO: 2954201 - RNA, 18 nt, Human
uagcauacguacacauuu

SEQ ID NO: 2954202 - RNA, 19 nt, Human
uagcauacguacacauuuu

SEQ ID NO: 2954203 - RNA, 16 nt, Human
uagauacuguaucaug

SEQ ID NO: 2954204 - RNA, 14 nt, Human
uagauaggccaugg

SEQ ID NO: 2954205 - RNA, 12 nt, Human
uagcugggacua

SEQ ID NO: 2954206 - RNA, 15 nt, Human
uagcugggacuacag

SEQ ID NO: 2954207 - RNA, 17 nt, Human
uagcugggacuacaggc

SEQ ID NO: 2954208 - RNA, 19 nt, Human
uagcugggacuacaggcac

SEQ ID NO: 2954209 - RNA, 18 nt, Human
uagccugugccucuggga

SEQ ID NO: 2954210 - RNA, 20 nt, Human
uagccugugccucugggacu

SEQ ID NO: 2954211 - RNA, 20 nt, Human
uagcucaggugucccugcac

SEQ ID NO: 2954212 - RNA, 21 nt, Human
uagcucaggugucccugcacu

SEQ ID NO: 2954213 - RNA, 12 nt, Human
uagcucauucuc

SEQ ID NO: 2954214 - RNA, 16 nt, Human
uagcaugaagacagag

SEQ ID NO: 2954215 - RNA, 22 nt, Human
uagccgggcgugguggcaggca

SEQ ID NO: 2954216 - RNA, 18 nt, Human
uagacccucaugcugcca

SEQ ID NO: 2954217 - RNA, 17 nt, Human
uagacccucaugcugcc

SEQ ID NO: 2954218 - RNA, 19 nt, Human
uagacccucaugcugccaa

SEQ ID NO: 2954219 - RNA, 23 nt, Human
uagacccucaugcugccaauauc

SEQ ID NO: 2954220 - RNA, 18 nt, Human
uagagugugauguaugug

SEQ ID NO: 2954221 - RNA, 12 nt, Human
uagagugggagc

SEQ ID NO: 2954222 - RNA, 14 nt, Human
uagaguugauacua

SEQ ID NO: 2954223 - RNA, 17 nt, Human
uagaguugauacuacag

SEQ ID NO: 2954224 - RNA, 14 nt, Human
uagagguucaaaga

SEQ ID NO: 2954225 - RNA, 15 nt, Human
uagagguucaaagau

SEQ ID NO: 2954226 - RNA, 12 nt, Human
uacuuuaaacua

SEQ ID NO: 2954227 - RNA, 20 nt, Human
uagaagucuuagauguauau

SEQ ID NO: 2954228 - RNA, 16 nt, Human
uagaauaggcacuuua

SEQ ID NO: 2954229 - RNA, 22 nt, Human
uagaauaggcacuuuaaaacac

SEQ ID NO: 2954230 - RNA, 22 nt, Human
uagaaguucuaguguuuucaau

SEQ ID NO: 2954231 - RNA, 20 nt, Human
uagaaguucuaguguuuuca

SEQ ID NO: 2954232 - RNA, 23 nt, Human
uagaauaccacaggaaccacaag

SEQ ID NO: 2954233 - RNA, 18 nt, Human
uagaauguuuucaaaugu

SEQ ID NO: 2954234 - RNA, 19 nt, Human
uagaauguuuucaaauguu

SEQ ID NO: 2954235 - RNA, 15 nt, Human
uagaauuaacacaug

SEQ ID NO: 2954236 - RNA, 16 nt, Human
uagaauuaacacauga

SEQ ID NO: 2954237 - RNA, 18 nt, Human
uagaauuaacacaugauc

SEQ ID NO: 2954238 - RNA, 23 nt, Human
uagaauuaguggcacuugcuuuu

SEQ ID NO: 2954239 - RNA, 14 nt, Human
uacaaaguagaagu

SEQ ID NO: 2954240 - RNA, 18 nt, Human
uacaaaguagaagucuua

SEQ ID NO: 2954241 - RNA, 18 nt, Human
uaauuuugugaagcaaaa

SEQ ID NO: 2954242 - RNA, 12 nt, Human
uaauuuuuauau

SEQ ID NO: 2954243 - RNA, 16 nt, Human
uaauuuuuauauuuga

SEQ ID NO: 2954244 - RNA, 18 nt, Human
uaauuccuguuuuuauua

SEQ ID NO: 2954245 - RNA, 13 nt, Human
uaauuuugugaag

SEQ ID NO: 2954246 - RNA, 11 nt, Human
uacacacacac

SEQ ID NO: 2954247 - RNA, 12 nt, Human
uacaaauguuuu

SEQ ID NO: 2954248 - RNA, 21 nt, Human
uacacugugcugagucugaag

SEQ ID NO: 2954249 - RNA, 14 nt, Human
uacacuccagugag

SEQ ID NO: 2954250 - RNA, 17 nt, Human
uacacacucaaaucaag

SEQ ID NO: 2954251 - RNA, 15 nt, Human
uacacacugcauguu

SEQ ID NO: 2954252 - RNA, 16 nt, Human
uacacacucaaaucaa

SEQ ID NO: 2954253 - RNA, 16 nt, Human
uacaugaaaacacauu

SEQ ID NO: 2954254 - RNA, 16 nt, Human
uacauaagauaaaugu

SEQ ID NO: 2954255 - RNA, 17 nt, Human
uacauaagauaaaugug

SEQ ID NO: 2954256 - RNA, 17 nt, Human
uacaugaaaacacauuu

SEQ ID NO: 2954257 - RNA, 18 nt, Human
uacaugaaaacacauuuu

SEQ ID NO: 2954258 - RNA, 19 nt, Human
uacaugaaaacacauuuuu

SEQ ID NO: 2954259 - RNA, 23 nt, Human
uacaugaaaacacauuuuucuua

SEQ ID NO: 2954260 - RNA, 16 nt, Human
uacauaaacaaguccu

SEQ ID NO: 2954261 - RNA, 19 nt, Human
uacaguuuguuaguaugag

SEQ ID NO: 2954262 - RNA, 21 nt, Human
uacaguuuguuaguaugaggc

SEQ ID NO: 2954263 - RNA, 16 nt, Human
uacaugccuaccaaua

SEQ ID NO: 2954264 - RNA, 19 nt, Human
uacaugccuaccaauauuu

SEQ ID NO: 2954265 - RNA, 21 nt, Human
uacauggcuggagcuagaauu

SEQ ID NO: 2954266 - RNA, 14 nt, Human
uacauuuuuaagug

SEQ ID NO: 2954267 - RNA, 19 nt, Human
uacauuuuuaagugcugca

SEQ ID NO: 2954268 - RNA, 22 nt, Human
uacauuuuuaagugcugcauuu

SEQ ID NO: 2954269 - RNA, 14 nt, Human
uacauggaauaaca

SEQ ID NO: 2954270 - RNA, 18 nt, Human
uacauggaauaacaugua

SEQ ID NO: 2954271 - RNA, 19 nt, Human
uacauggaauaacauguaa

SEQ ID NO: 2954272 - RNA, 22 nt, Human
uacauggaauaacauguaauua

SEQ ID NO: 2954273 - RNA, 20 nt, Human
uacacuguuucaaacuuuac

SEQ ID NO: 2954274 - RNA, 23 nt, Human
uacacugugcugagucugaaggc

SEQ ID NO: 2954275 - RNA, 22 nt, Human
uacacugugcugagucugaagg

SEQ ID NO: 2954276 - RNA, 22 nt, Human
uacacuguuucaaacuuuacua

SEQ ID NO: 2954277 - RNA, 16 nt, Human
uacacuuacacuuuau

SEQ ID NO: 2954278 - RNA, 20 nt, Human
uacagcuugaccgugaggcc

SEQ ID NO: 2954279 - RNA, 13 nt, Human
uacaggaaguacu

SEQ ID NO: 2954280 - RNA, 18 nt, Human
uacaggaagguagaaaua

SEQ ID NO: 2954281 - RNA, 18 nt, Human
uacaguuuguuaguauga

SEQ ID NO: 2954282 - RNA, 20 nt, Human
uacaguugaaaaacagcuga

SEQ ID NO: 2954283 - RNA, 14 nt, Human
uacaggacauauau

SEQ ID NO: 2954284 - RNA, 19 nt, Human
uacaguugaaaaacagcug

SEQ ID NO: 2954285 - RNA, 17 nt, Human
uacaguugaaaaacagc

SEQ ID NO: 2954286 - RNA, 15 nt, Human
uacaggagugagcac

SEQ ID NO: 2954287 - RNA, 22 nt, Human
uacaggaaguacuggagaaaau

SEQ ID NO: 2954288 - RNA, 15 nt, Human
uacaggaaguacugg

SEQ ID NO: 2954289 - RNA, 14 nt, Human
uacaggaaguacug

SEQ ID NO: 2954290 - RNA, 23 nt, Human
uacaguucggugagcuacaaaug

SEQ ID NO: 2954291 - RNA, 13 nt, Human
uacuacaguuugu

SEQ ID NO: 2954292 - RNA, 14 nt, Human
uacuacaguuuguu

SEQ ID NO: 2954293 - RNA, 22 nt, Human
uacuacaguccucccaucucac

SEQ ID NO: 2954294 - RNA, 18 nt, Human
uacucgaguuacagacaa

SEQ ID NO: 2954295 - RNA, 22 nt, Human
uacucgaguuacagacaaagcg

SEQ ID NO: 2954296 - RNA, 22 nt, Human
uacucgggaggcugaggcagga

SEQ ID NO: 2954297 - RNA, 15 nt, Human
uacucgggaggcuga

SEQ ID NO: 2954298 - RNA, 22 nt, Human
uacugccauccuggcccagggc

SEQ ID NO: 2954299 - RNA, 18 nt, Human
uacugccauccuggccca

SEQ ID NO: 2954300 - RNA, 19 nt, Human
uacugccauccuggcccag

SEQ ID NO: 2954301 - RNA, 15 nt, Human
uacugccauccuggc

SEQ ID NO: 2954302 - RNA, 12 nt, Human
uacuuaagacuu

SEQ ID NO: 2954303 - RNA, 14 nt, Human
uacuuaagacuuaa

SEQ ID NO: 2954304 - RNA, 13 nt, Human
uacuuguggacac

SEQ ID NO: 2954305 - RNA, 21 nt, Human
uacugucuucaguaagccgug

SEQ ID NO: 2954306 - RNA, 16 nt, Human
uacuguccuacccacc

SEQ ID NO: 2954307 - RNA, 23 nt, Human
uacugucagcuccccucggagaa

SEQ ID NO: 2954308 - RNA, 15 nt, Human
uaccuacauacaauu

SEQ ID NO: 2954309 - RNA, 16 nt, Human
uaccuaucaucuuaag

SEQ ID NO: 2954310 - RNA, 23 nt, Human
uacauuuuuaagugcugcauuua

SEQ ID NO: 2954311 - RNA, 15 nt, Human
uacccacugcucugg

SEQ ID NO: 2954312 - RNA, 22 nt, Human
uaccaaaaaucucaauauuuca

SEQ ID NO: 2954313 - RNA, 22 nt, Human
uaccuaacgaaguauccuucag

SEQ ID NO: 2954314 - RNA, 17 nt, Human
uaccuuuuuuauacaua

SEQ ID NO: 2954315 - RNA, 13 nt, Human
uaccuuuuuuaua

SEQ ID NO: 2954316 - RNA, 16 nt, Human
uaccuuuuuuauacau

SEQ ID NO: 2954317 - RNA, 23 nt, Human
uacgaaaaaaugguagcauuuua

SEQ ID NO: 2954318 - RNA, 21 nt, Human
uacgaaaagaggggaagagac

SEQ ID NO: 2954319 - RNA, 18 nt, Human
uacgaaaagaggggaaga

SEQ ID NO: 2954320 - RNA, 14 nt, Human
uacuaaggaaucuu

SEQ ID NO: 2954321 - RNA, 20 nt, Human
uacuaauagacaauuuauua

SEQ ID NO: 2954322 - RNA, 21 nt, Human
uacuaauagacaauuuauuau

SEQ ID NO: 2954323 - RNA, 17 nt, Human
uacuaacauuuauuuga

SEQ ID NO: 2954324 - RNA, 13 nt, Human
uacuaacuuuccu

SEQ ID NO: 2954325 - RNA, 18 nt, Human
uacuaacauuuauuugag

SEQ ID NO: 2954326 - RNA, 18 nt, Human
uaccucggugccuuccuc

SEQ ID NO: 2954327 - RNA, 21 nt, Human
uaccucuugagccuugaacuu

SEQ ID NO: 2954328 - RNA, 13 nt, Human
uaccuuuuuuaga

SEQ ID NO: 2954329 - RNA, 19 nt, Human
uaccuuuuuuagaguugau

SEQ ID NO: 2954330 - RNA, 22 nt, Human
uaccuuuuuuagaguugauacu

SEQ ID NO: 2954331 - RNA, 23 nt, Human
uaccuuuguucccaaauuucaua

SEQ ID NO: 2954332 - RNA, 13 nt, Human
ugacaacacucau

SEQ ID NO: 2954333 - RNA, 16 nt, Human
ugaauuuaaauagcuu

SEQ ID NO: 2954334 - RNA, 23 nt, Human
ugacaacacucauugaccugagg

SEQ ID NO: 2954335 - RNA, 21 nt, Human
ugaauuguaaggaaugauuaa

SEQ ID NO: 2954336 - RNA, 13 nt, Human
ugaauuguaagga

SEQ ID NO: 2954337 - RNA, 14 nt, Human
ugaauuaaguuuuu

SEQ ID NO: 2954338 - RNA, 13 nt, Human
ugaauuacauuug

SEQ ID NO: 2954339 - RNA, 15 nt, Human
ugacacacagcucug

SEQ ID NO: 2954340 - RNA, 14 nt, Human
ugacacacagcucu

SEQ ID NO: 2954341 - RNA, 14 nt, Human
ugacagacacaggc

SEQ ID NO: 2954342 - RNA, 16 nt, Human
ugacagacacaggccc

SEQ ID NO: 2954343 - RNA, 13 nt, Human
ugacagacacagg

SEQ ID NO: 2954344 - RNA, 23 nt, Human
ugacaaggauugcuacuguccua

SEQ ID NO: 2954345 - RNA, 23 nt, Human
ugacaucaacugcaucaagaugu

SEQ ID NO: 2954346 - RNA, 22 nt, Human
ugacagagcaagugagacccug

SEQ ID NO: 2954347 - RNA, 17 nt, Human
ugacagacacaggcccg

SEQ ID NO: 2954348 - RNA, 18 nt, Human
ugacagacacaggcccgg

SEQ ID NO: 2954349 - RNA, 15 nt, Human
ugaccaugaaagacu

SEQ ID NO: 2954350 - RNA, 16 nt, Human
ugaccacugcagaaga

SEQ ID NO: 2954351 - RNA, 17 nt, Human
ugaccacugcagaagac

SEQ ID NO: 2954352 - RNA, 20 nt, Human
ugaccagcaccaucucuccu

SEQ ID NO: 2954353 - RNA, 19 nt, Human
ugaagagguuuuaaagcuu

SEQ ID NO: 2954354 - RNA, 20 nt, Human
ugaagagguuuuaaagcuuc

SEQ ID NO: 2954355 - RNA, 21 nt, Human
ugaagagguuuuaaagcuucc

SEQ ID NO: 2954356 - RNA, 18 nt, Human
ugaaggccccgcccaggc

SEQ ID NO: 2954357 - RNA, 16 nt, Human
ugaaggcuggguucug

SEQ ID NO: 2954358 - RNA, 20 nt, Human
ugaaggccccgcccaggcuu

SEQ ID NO: 2954359 - RNA, 19 nt, Human
ugaaggccccgcccaggcu

SEQ ID NO: 2954360 - RNA, 21 nt, Human
ugaaacacugguuuuaaauau

SEQ ID NO: 2954361 - RNA, 22 nt, Human
ugaaacauaucucuuaucuuac

SEQ ID NO: 2954362 - RNA, 23 nt, Human
ugaacuggguacuuguggacaca

SEQ ID NO: 2954363 - RNA, 19 nt, Human
ugaagacucauucuucugu

SEQ ID NO: 2954364 - RNA, 20 nt, Human
ugaagacucauucuucugua

SEQ ID NO: 2954365 - RNA, 21 nt, Human
ugaaggcuggguucugauccu

SEQ ID NO: 2954366 - RNA, 20 nt, Human
ugaaggcuggguucugaucc

SEQ ID NO: 2954367 - RNA, 18 nt, Human
ugaaugcagguuuuauca

SEQ ID NO: 2954368 - RNA, 20 nt, Human
ugaaugcagguuuuaucaga

SEQ ID NO: 2954369 - RNA, 23 nt, Human
ugaaugaugauccuaggcauuug

SEQ ID NO: 2954370 - RNA, 15 nt, Human
ugaaugaauggcuaa

SEQ ID NO: 2954371 - RNA, 13 nt, Human
ugacucuuaagaa

SEQ ID NO: 2954372 - RNA, 14 nt, Human
ugacucuuaagaag

SEQ ID NO: 2954373 - RNA, 15 nt, Human
ugacucuuaagaaga

SEQ ID NO: 2954374 - RNA, 16 nt, Human
ugacucuuaagaagac

SEQ ID NO: 2954375 - RNA, 15 nt, Human
ugacucuucccucaa

SEQ ID NO: 2954376 - RNA, 14 nt, Human
ugaccauucuccac

SEQ ID NO: 2954377 - RNA, 13 nt, Human
ugaccauucucca

SEQ ID NO: 2954378 - RNA, 16 nt, Human
ugaccaugaaagacuu

SEQ ID NO: 2954379 - RNA, 21 nt, Human
ugacucuuucuauuguuucuu

SEQ ID NO: 2954380 - RNA, 16 nt, Human
ugacuuuccucuuugg

SEQ ID NO: 2954381 - RNA, 14 nt, Human
ugagaccaaccugg

SEQ ID NO: 2954382 - RNA, 18 nt, Human
ugagaggggaacagacug

SEQ ID NO: 2954383 - RNA, 14 nt, Human
ugagaggggaacag

SEQ ID NO: 2954384 - RNA, 15 nt, Human
ugagcaggauuuuaa

SEQ ID NO: 2954385 - RNA, 20 nt, Human
ugagcaggauuuuaaucuuu

SEQ ID NO: 2954386 - RNA, 22 nt, Human
ugacuuuucuguccgagcuuug

SEQ ID NO: 2954387 - RNA, 15 nt, Human
ugagaaauaaaguuu

SEQ ID NO: 2954388 - RNA, 15 nt, Human
ugagaaagacuauuc

SEQ ID NO: 2954389 - RNA, 20 nt, Human
ugagaaagacuauucaaaca

SEQ ID NO: 2954390 - RNA, 21 nt, Human
ugagaaacuggcaaagcagaa

SEQ ID NO: 2954391 - RNA, 19 nt, Human
ugagcucaggaguuugaga

SEQ ID NO: 2954392 - RNA, 11 nt, Human
ugagcucagga

SEQ ID NO: 2954393 - RNA, 15 nt, Human
ugagccgcccaaggc

SEQ ID NO: 2954394 - RNA, 17 nt, Human
ugagccgcccaaggccu

SEQ ID NO: 2954395 - RNA, 18 nt, Human
ugagccgcccaaggccuu

SEQ ID NO: 2954396 - RNA, 19 nt, Human
ugagccgcccaaggccuuc

SEQ ID NO: 2954397 - RNA, 23 nt, Human
ugagccgagaucacgccacugca

SEQ ID NO: 2954398 - RNA, 14 nt, Human
ugagccgcccaagg

SEQ ID NO: 2954399 - RNA, 20 nt, Human
ugagcagggcucagcgggga

SEQ ID NO: 2954400 - RNA, 22 nt, Human
ugagcagggcucagcggggaca

SEQ ID NO: 2954401 - RNA, 23 nt, Human
ugagcagggcucagcggggacag

SEQ ID NO: 2954402 - RNA, 22 nt, Human
ugagccgagaucacgccacugc

SEQ ID NO: 2954403 - RNA, 22 nt, Human
ugaggaugaaaaaauaacacug

SEQ ID NO: 2954404 - RNA, 21 nt, Human
ugaggugggaggaucucuuga

SEQ ID NO: 2954405 - RNA, 21 nt, Human
ugaggcugggcucccuuccca

SEQ ID NO: 2954406 - RNA, 18 nt, Human
ugaggucagagccugcag

SEQ ID NO: 2954407 - RNA, 19 nt, Human
ugaggucagagccugcagu

SEQ ID NO: 2954408 - RNA, 20 nt, Human
ugaggcggguggaucacgag

SEQ ID NO: 2954409 - RNA, 15 nt, Human
ugaggcucugcccuu

SEQ ID NO: 2954410 - RNA, 16 nt, Human
ugaggcucugcccuug

SEQ ID NO: 2954411 - RNA, 18 nt, Human
ugaggcucugcccuuggu

SEQ ID NO: 2954412 - RNA, 16 nt, Human
ugaggcugggcucccu

SEQ ID NO: 2954413 - RNA, 15 nt, Human
ugaggcugggcuccc

SEQ ID NO: 2954414 - RNA, 16 nt, Human
ucuucuuggucucagu

SEQ ID NO: 2954415 - RNA, 20 nt, Human
ucuugaaauauaggaacuua

SEQ ID NO: 2954416 - RNA, 21 nt, Human
ucuugaaauauaggaacuuaa

SEQ ID NO: 2954417 - RNA, 15 nt, Human
ucuugcaugaggcua

SEQ ID NO: 2954418 - RNA, 22 nt, Human
ucuugaagacuuuucuuucagc

SEQ ID NO: 2954419 - RNA, 13 nt, Human
ucuugaagacuuu

SEQ ID NO: 2954420 - RNA, 15 nt, Human
ucuugcucugcugac

SEQ ID NO: 2954421 - RNA, 23 nt, Human
ucuugcucugcugacagacacag

SEQ ID NO: 2954422 - RNA, 14 nt, Human
ucuugcucugcuga

SEQ ID NO: 2954423 - RNA, 20 nt, Human
ucuugcaugguuuggagcug

SEQ ID NO: 2954424 - RNA, 15 nt, Human
ucuugcaugguuugg

SEQ ID NO: 2954425 - RNA, 19 nt, Human
ucuugcaugguuuggagcu

SEQ ID NO: 2954426 - RNA, 19 nt, Human
ucuugccaaauauaaauaa

SEQ ID NO: 2954427 - RNA, 17 nt, Human
ucuucaguuugcagagu

SEQ ID NO: 2954428 - RNA, 18 nt, Human
ucuucaguuugcagagua

SEQ ID NO: 2954429 - RNA, 14 nt, Human
ucuucagaucucua

SEQ ID NO: 2954430 - RNA, 14 nt, Human
ucuuaucuuacgaa

SEQ ID NO: 2954431 - RNA, 21 nt, Human
ucuucagagacuccugcaggc

SEQ ID NO: 2954432 - RNA, 22 nt, Human
ucuuauccaacaucaacaucuu

SEQ ID NO: 2954433 - RNA, 15 nt, Human
ucuuagauguauaua

SEQ ID NO: 2954434 - RNA, 14 nt, Human
ucuuagauguauau

SEQ ID NO: 2954435 - RNA, 17 nt, Human
ucugugucagguggggc

SEQ ID NO: 2954436 - RNA, 20 nt, Human
ucugugucagguggggcagc

SEQ ID NO: 2954437 - RNA, 22 nt, Human
ucuuaggguuaugauuaaguaa

SEQ ID NO: 2954438 - RNA, 23 nt, Human
ucuuagguuggcaaaaaggcagg

SEQ ID NO: 2954439 - RNA, 20 nt, Human
ucuuagguuggcaaaaaggc

SEQ ID NO: 2954440 - RNA, 14 nt, Human
ucuuauaauuuaaa

SEQ ID NO: 2954441 - RNA, 13 nt, Human
ucuuauaauuuaa

SEQ ID NO: 2954442 - RNA, 15 nt, Human
ugaaaagaaaaauga

SEQ ID NO: 2954443 - RNA, 19 nt, Human
ugaaaagaaaaaugagccu

SEQ ID NO: 2954444 - RNA, 22 nt, Human
ugaaaagaaaaaugagccuggc

SEQ ID NO: 2954445 - RNA, 20 nt, Human
ugaaaagaaaaaugagccug

SEQ ID NO: 2954446 - RNA, 12 nt, Human
ugaaaauuuuga

SEQ ID NO: 2954447 - RNA, 15 nt, Human
ugaaacacugguuuu

SEQ ID NO: 2954448 - RNA, 20 nt, Human
ugaaacacugguuuuaaaua

SEQ ID NO: 2954449 - RNA, 14 nt, Human
ugaaaauucagugg

SEQ ID NO: 2954450 - RNA, 23 nt, Human
ugaaaacacuguucucugcccuc

SEQ ID NO: 2954451 - RNA, 22 nt, Human
ugaaaacacuguucucugcccu

SEQ ID NO: 2954452 - RNA, 21 nt, Human
ugaaaacacuguucucugccc

SEQ ID NO: 2954453 - RNA, 20 nt, Human
ugaaaacacuguucucugcc

SEQ ID NO: 2954454 - RNA, 17 nt, Human
ugaaaacacuguucucu

SEQ ID NO: 2954455 - RNA, 20 nt, Human
ugaaaacacauuuuucuuag

SEQ ID NO: 2954456 - RNA, 21 nt, Human
ugaaaacacauuuuucuuagg

SEQ ID NO: 2954457 - RNA, 13 nt, Human
ucuuugcagacag

SEQ ID NO: 2954458 - RNA, 23 nt, Human
ucuuugagugaagcugggagaac

SEQ ID NO: 2954459 - RNA, 14 nt, Human
ucuuugcagacagg

SEQ ID NO: 2954460 - RNA, 17 nt, Human
ucuuugcagacaggcaa

SEQ ID NO: 2954461 - RNA, 13 nt, Human
ucuuuggacccug

SEQ ID NO: 2954462 - RNA, 15 nt, Human
ucuuuggacccugag

SEQ ID NO: 2954463 - RNA, 14 nt, Human
ucuuuggacccuga

SEQ ID NO: 2954464 - RNA, 16 nt, Human
ucuuuggacccugagg

SEQ ID NO: 2954465 - RNA, 23 nt, Human
ucuugugguuauaacuuaaugaa

SEQ ID NO: 2954466 - RNA, 19 nt, Human
ucuugugguuauaacuuaa

SEQ ID NO: 2954467 - RNA, 13 nt, Human
ucuuguguguuua

SEQ ID NO: 2954468 - RNA, 23 nt, Human
ucuuuccaaaguacacuguuuca

SEQ ID NO: 2954469 - RNA, 13 nt, Human
ucuuucccucccu

SEQ ID NO: 2954470 - RNA, 23 nt, Human
ucuuucccucccuuccucuuucc

SEQ ID NO: 2954471 - RNA, 17 nt, Human
ucuuuccacagaagcuc

SEQ ID NO: 2954472 - RNA, 17 nt, Human
ucuuuccaaaguacacu

SEQ ID NO: 2954473 - RNA, 12 nt, Human
ucuuucccuccc

SEQ ID NO: 2954474 - RNA, 24 nt, Human
ucugagaucaaaacgguuuuacug

SEQ ID NO: 2954475 - RNA, 18 nt, Human
ucugagaggacuuuucuu

SEQ ID NO: 2954476 - RNA, 23 nt, Human
ucugacccaugcugcccugugag

SEQ ID NO: 2954477 - RNA, 22 nt, Human
ucugacccaugcugcccuguga

SEQ ID NO: 2954478 - RNA, 20 nt, Human
ucugacccaugcugcccugu

SEQ ID NO: 2954479 - RNA, 19 nt, Human
ucugacccaugcugcccug

SEQ ID NO: 2954480 - RNA, 22 nt, Human
ucugaggaauccagacccggcu

SEQ ID NO: 2954481 - RNA, 13 nt, Human
ucugauuuaauug

SEQ ID NO: 2954482 - RNA, 18 nt, Human
ucugaggaauccagaccc

SEQ ID NO: 2954483 - RNA, 21 nt, Human
ucugaggaauccagacccggc

SEQ ID NO: 2954484 - RNA, 13 nt, Human
ucugcacuccccu

SEQ ID NO: 2954485 - RNA, 15 nt, Human
ucugccucugacaca

SEQ ID NO: 2954486 - RNA, 18 nt, Human
ucugccucugacacacag

SEQ ID NO: 2954487 - RNA, 21 nt, Human
ucugccucccaucacccgcua

SEQ ID NO: 2954488 - RNA, 20 nt, Human
ucugccucccaucacccgcu

SEQ ID NO: 2954489 - RNA, 17 nt, Human
ucugccucccaucaccc

SEQ ID NO: 2954490 - RNA, 16 nt, Human
ucugccucccaucacc

SEQ ID NO: 2954491 - RNA, 23 nt, Human
ucugccucugacacacagcucug

SEQ ID NO: 2954492 - RNA, 21 nt, Human
ucugccucugacacacagcuc

SEQ ID NO: 2954493 - RNA, 22 nt, Human
ucugccucugacacacagcucu

SEQ ID NO: 2954494 - RNA, 19 nt, Human
ucugccugaagucacacag

SEQ ID NO: 2954495 - RNA, 20 nt, Human
ucugccugaagucacacagu

SEQ ID NO: 2954496 - RNA, 18 nt, Human
ucugccauauucuguugg

SEQ ID NO: 2954497 - RNA, 12 nt, Human
ucugcccacucc

SEQ ID NO: 2954498 - RNA, 22 nt, Human
ucugccauauucuguuggccag

SEQ ID NO: 2954499 - RNA, 23 nt, Human
ucugccauauucuguuggccagu

SEQ ID NO: 2954500 - RNA, 14 nt, Human
ucugcccacucccu

SEQ ID NO: 2954501 - RNA, 13 nt, Human
ucugcccacuccc

SEQ ID NO: 2954502 - RNA, 12 nt, Human
ucugccucccau

SEQ ID NO: 2954503 - RNA, 15 nt, Human
ucugccucccaucac

SEQ ID NO: 2954504 - RNA, 13 nt, Human
ucugccucccauc

SEQ ID NO: 2954505 - RNA, 13 nt, Human
ucugcugcuggcu

SEQ ID NO: 2954506 - RNA, 11 nt, Human
ucugcugcugg

SEQ ID NO: 2954507 - RNA, 21 nt, Human
ucugcuccucuccccagcaag

SEQ ID NO: 2954508 - RNA, 17 nt, Human
ucugccugcccaggccc

SEQ ID NO: 2954509 - RNA, 18 nt, Human
ucugccugcccaggcccc

SEQ ID NO: 2954510 - RNA, 20 nt, Human
ucugccugcccaggccccug

SEQ ID NO: 2954511 - RNA, 14 nt, Human
ucuggacuaaaacu

SEQ ID NO: 2954512 - RNA, 16 nt, Human
ucuggaaugcaguggu

SEQ ID NO: 2954513 - RNA, 17 nt, Human
ucugcugcuggcugguu

SEQ ID NO: 2954514 - RNA, 15 nt, Human
ucugcugcuggcugg

SEQ ID NO: 2954515 - RNA, 14 nt, Human
ucugcugcuggcug

SEQ ID NO: 2954516 - RNA, 16 nt, Human
ucuggugacuuuccuc

SEQ ID NO: 2954517 - RNA, 20 nt, Human
ucuguccuacucugugucag

SEQ ID NO: 2954518 - RNA, 15 nt, Human
ucuguacagagccca

SEQ ID NO: 2954519 - RNA, 14 nt, Human
ucuguacagagccc

SEQ ID NO: 2954520 - RNA, 12 nt, Human
ucuguccuggga

SEQ ID NO: 2954521 - RNA, 17 nt, Human
ucugucgcccagucugg

SEQ ID NO: 2954522 - RNA, 16 nt, Human
ucugucgcccagucug

SEQ ID NO: 2954523 - RNA, 13 nt, Human
ucugucuaggaau

SEQ ID NO: 2954524 - RNA, 14 nt, Human
ucugucucagucca

SEQ ID NO: 2954525 - RNA, 15 nt, Human
ucagcugcuacuacu

SEQ ID NO: 2954526 - RNA, 16 nt, Human
ucagcugcugaaacaa

SEQ ID NO: 2954527 - RNA, 16 nt, Human
ucagccugcuccagcu

SEQ ID NO: 2954528 - RNA, 22 nt, Human
ucagccucccaaagugcuggga

SEQ ID NO: 2954529 - RNA, 12 nt, Human
ucagccucccga

SEQ ID NO: 2954530 - RNA, 20 nt, Human
ucagccucccgaauagcugg

SEQ ID NO: 2954531 - RNA, 15 nt, Human
ucagcuccagcucac

SEQ ID NO: 2954532 - RNA, 18 nt, Human
ucagcuccagcucaccag

SEQ ID NO: 2954533 - RNA, 21 nt, Human
ucagcuccagcucaccagccc

SEQ ID NO: 2954534 - RNA, 22 nt, Human
ucagcuccagcucaccagcccc

SEQ ID NO: 2954535 - RNA, 21 nt, Human
ucagcuccccucggagaagag

SEQ ID NO: 2954536 - RNA, 22 nt, Human
ucagcuccccucggagaagagc

SEQ ID NO: 2954537 - RNA, 17 nt, Human
ucagauaugauucaaau

SEQ ID NO: 2954538 - RNA, 16 nt, Human
ucagauaugauucaaa

SEQ ID NO: 2954539 - RNA, 18 nt, Human
ucagauaugauucaaaug

SEQ ID NO: 2954540 - RNA, 15 nt, Human
ucagcauccuggcac

SEQ ID NO: 2954541 - RNA, 16 nt, Human
ucagcauccuggcacc

SEQ ID NO: 2954542 - RNA, 17 nt, Human
ucagcauccuggcaccc

SEQ ID NO: 2954543 - RNA, 18 nt, Human
ucagcauccuggcacccg

SEQ ID NO: 2954544 - RNA, 12 nt, Human
ucagccucccaa

SEQ ID NO: 2954545 - RNA, 13 nt, Human
ucagccucccaaa

SEQ ID NO: 2954546 - RNA, 15 nt, Human
ucagcacgauuucug

SEQ ID NO: 2954547 - RNA, 16 nt, Human
ucagcacgauuucugu

SEQ ID NO: 2954548 - RNA, 17 nt, Human
ucagcacgauuucuguu

SEQ ID NO: 2954549 - RNA, 15 nt, Human
ucauacucaccucac

SEQ ID NO: 2954550 - RNA, 21 nt, Human
ucauggaauuggagcucgugg

SEQ ID NO: 2954551 - RNA, 19 nt, Human
ucauggaauuggagcucgu

SEQ ID NO: 2954552 - RNA, 13 nt, Human
ucaugaaagauuc

SEQ ID NO: 2954553 - RNA, 18 nt, Human
ucagugugacugaucucu

SEQ ID NO: 2954554 - RNA, 17 nt, Human
ucagucugauucccaag

SEQ ID NO: 2954555 - RNA, 19 nt, Human
ucagucugauucccaagcu

SEQ ID NO: 2954556 - RNA, 14 nt, Human
ucagguggggcagc

SEQ ID NO: 2954557 - RNA, 18 nt, Human
ucaggugcugccauccag

SEQ ID NO: 2954558 - RNA, 20 nt, Human
ucaggugcugccauccaggu

SEQ ID NO: 2954559 - RNA, 15 nt, Human
ucagguggggcagcu

SEQ ID NO: 2954560 - RNA, 16 nt, Human
ucagguggggcagcuu

SEQ ID NO: 2954561 - RNA, 21 nt, Human
ucagguggggcagcuugaggg

SEQ ID NO: 2954562 - RNA, 17 nt, Human
ucagguggggcagcuug

SEQ ID NO: 2954563 - RNA, 21 nt, Human
ucagguggggucacucuggca

SEQ ID NO: 2954564 - RNA, 20 nt, Human
ucagguggggucacucuggc

SEQ ID NO: 2954565 - RNA, 17 nt, Human
ucagguggggucacucu

SEQ ID NO: 2954566 - RNA, 15 nt, Human
ucaguccauagcaga

SEQ ID NO: 2954567 - RNA, 18 nt, Human
ucaguccaugaagaugua

SEQ ID NO: 2954568 - RNA, 21 nt, Human
uccacaagagcccaggccucc

SEQ ID NO: 2954569 - RNA, 19 nt, Human
uccacaagagcccaggccu

SEQ ID NO: 2954570 - RNA, 20 nt, Human
uccacaagagcccaggccuc

SEQ ID NO: 2954571 - RNA, 14 nt, Human
uccaagaagcccag

SEQ ID NO: 2954572 - RNA, 16 nt, Human
uccaagaagcccagga

SEQ ID NO: 2954573 - RNA, 15 nt, Human
uccaagaagcccagg

SEQ ID NO: 2954574 - RNA, 20 nt, Human
uccaagaccuucuccuucac

SEQ ID NO: 2954575 - RNA, 19 nt, Human
uccaagaagcccaggaaag

SEQ ID NO: 2954576 - RNA, 19 nt, Human
uccaagaccuucuccuuca

SEQ ID NO: 2954577 - RNA, 14 nt, Human
uccaagcaggacau

SEQ ID NO: 2954578 - RNA, 20 nt, Human
uccaagcauuuagauguaua

SEQ ID NO: 2954579 - RNA, 21 nt, Human
uccacccugcucuccgaccag

SEQ ID NO: 2954580 - RNA, 13 nt, Human
uccacccugcucu

SEQ ID NO: 2954581 - RNA, 14 nt, Human
uccacccugcucuc

SEQ ID NO: 2954582 - RNA, 22 nt, Human
uccacugugccaugugccaggu

SEQ ID NO: 2954583 - RNA, 17 nt, Human
uccagagccccacagcc

SEQ ID NO: 2954584 - RNA, 14 nt, Human
uccacuuucuagcc

SEQ ID NO: 2954585 - RNA, 18 nt, Human
uccagcugcugagauccu

SEQ ID NO: 2954586 - RNA, 21 nt, Human
uccagcugcugagauccugga

SEQ ID NO: 2954587 - RNA, 22 nt, Human
uccagcugcugagauccuggac

SEQ ID NO: 2954588 - RNA, 18 nt, Human
ucccaccucagccucccg

SEQ ID NO: 2954589 - RNA, 16 nt, Human
ucccaccucagccucc

SEQ ID NO: 2954590 - RNA, 14 nt, Human
ucccaccucucuca

SEQ ID NO: 2954591 - RNA, 18 nt, Human
ucccaccucucucacucc

SEQ ID NO: 2954592 - RNA, 17 nt, Human
ucccaccucucucacuc

SEQ ID NO: 2954593 - RNA, 19 nt, Human
ucccaccuuggcugcaggg

SEQ ID NO: 2954594 - RNA, 21 nt, Human
ucccaccuuggcugcagggag

SEQ ID NO: 2954595 - RNA, 20 nt, Human
ucccaccucucucacuccuu

SEQ ID NO: 2954596 - RNA, 14 nt, Human
ucccacucagucca

SEQ ID NO: 2954597 - RNA, 18 nt, Human
ucccaggcauuccccagg

SEQ ID NO: 2954598 - RNA, 17 nt, Human
ucccaggcauuccccag

SEQ ID NO: 2954599 - RNA, 15 nt, Human
ucccaugagccucag

SEQ ID NO: 2954600 - RNA, 16 nt, Human
ucccaugagccucagc

SEQ ID NO: 2954601 - RNA, 18 nt, Human
ucccaacucaccccagcc

SEQ ID NO: 2954602 - RNA, 17 nt, Human
ucccaacucaccccagc

SEQ ID NO: 2954603 - RNA, 21 nt, Human
ucccaacucaccccagcccca

SEQ ID NO: 2954604 - RNA, 19 nt, Human
ucccaacucaccccagccc

SEQ ID NO: 2954605 - RNA, 20 nt, Human
uccauagagagcaagacgcu

SEQ ID NO: 2954606 - RNA, 17 nt, Human
uccauagagagcaagac

SEQ ID NO: 2954607 - RNA, 18 nt, Human
ucuaggaggucucuaaga

SEQ ID NO: 2954608 - RNA, 18 nt, Human
ucuacucuagggaaaaac

SEQ ID NO: 2954609 - RNA, 21 nt, Human
ucuacucgaguuacagacaaa

SEQ ID NO: 2954610 - RNA, 20 nt, Human
ucuacucgaguuacagacaa

SEQ ID NO: 2954611 - RNA, 12 nt, Human
ucuagggaaaaa

SEQ ID NO: 2954612 - RNA, 13 nt, Human
ucuauauuuuaca

SEQ ID NO: 2954613 - RNA, 16 nt, Human
ucuacuaaaaaugcaa

SEQ ID NO: 2954614 - RNA, 19 nt, Human
ucuacuaaaaauacaaaaa

SEQ ID NO: 2954615 - RNA, 15 nt, Human
ucuacuaaaaauaca

SEQ ID NO: 2954616 - RNA, 12 nt, Human
ucuacuaaaaau

SEQ ID NO: 2954617 - RNA, 14 nt, Human
ucucacuguugccc

SEQ ID NO: 2954618 - RNA, 15 nt, Human
ucucacuguugccca

SEQ ID NO: 2954619 - RNA, 23 nt, Human
ucucacucugucgcccagucugg

SEQ ID NO: 2954620 - RNA, 21 nt, Human
ucucacacaugagcaucaggc

SEQ ID NO: 2954621 - RNA, 20 nt, Human
ucucacugccaugccagcuu

SEQ ID NO: 2954622 - RNA, 16 nt, Human
ucucacacaugagcau

SEQ ID NO: 2954623 - RNA, 18 nt, Human
ucucaaauuucuaaaucu

SEQ ID NO: 2954624 - RNA, 13 nt, Human
ucucaaauuucua

SEQ ID NO: 2954625 - RNA, 14 nt, Human
ucucaaauuucuaa

SEQ ID NO: 2954626 - RNA, 16 nt, Human
ucucaaauuucuaaau

SEQ ID NO: 2954627 - RNA, 22 nt, Human
uccuuggugucgggcaugacac

SEQ ID NO: 2954628 - RNA, 17 nt, Human
uccuuugugaggaagcc

SEQ ID NO: 2954629 - RNA, 22 nt, Human
uccuuugugaggaagccgcugg

SEQ ID NO: 2954630 - RNA, 18 nt, Human
uccuuugugaggaagccg

SEQ ID NO: 2954631 - RNA, 21 nt, Human
uccuuggugucgggcaugaca

SEQ ID NO: 2954632 - RNA, 18 nt, Human
uccuuggugucgggcaug

SEQ ID NO: 2954633 - RNA, 17 nt, Human
uccuugcaucaauuuuu

SEQ ID NO: 2954634 - RNA, 23 nt, Human
uccuugaaaacacuguucucugc

SEQ ID NO: 2954635 - RNA, 22 nt, Human
uccuugaaaacacuguucucug

SEQ ID NO: 2954636 - RNA, 21 nt, Human
uccuuaccagcagagcaccuu

SEQ ID NO: 2954637 - RNA, 20 nt, Human
uccuuaccagcagagcaccu

SEQ ID NO: 2954638 - RNA, 17 nt, Human
ucgcaggauucuuccuc

SEQ ID NO: 2954639 - RNA, 21 nt, Human
ucgcaggauucuuccucccuc

SEQ ID NO: 2954640 - RNA, 23 nt, Human
ucgcaggauucuuccucccuccc

SEQ ID NO: 2954641 - RNA, 22 nt, Human
uccuuuucgcaggauucuuccu

SEQ ID NO: 2954642 - RNA, 18 nt, Human
uccuuuucgcaggauucu

SEQ ID NO: 2954643 - RNA, 14 nt, Human
ucgcccagucugga

SEQ ID NO: 2954644 - RNA, 19 nt, Human
ucgcccagucuggaaugca

SEQ ID NO: 2954645 - RNA, 23 nt, Human
ucgcccagucuggaaugcagugg

SEQ ID NO: 2954646 - RNA, 15 nt, Human
ucggaaaacaugcua

SEQ ID NO: 2954647 - RNA, 18 nt, Human
ucggaaaacaugcuacac

SEQ ID NO: 2954648 - RNA, 15 nt, Human
ucggagcccugucuc

SEQ ID NO: 2954649 - RNA, 14 nt, Human
ucggagcccugucu

SEQ ID NO: 2954650 - RNA, 18 nt, Human
ucggccccaccagugccu

SEQ ID NO: 2954651 - RNA, 19 nt, Human
ucggccccaccagugccuc

SEQ ID NO: 2954652 - RNA, 15 nt, Human
ucggccuccauccug

SEQ ID NO: 2954653 - RNA, 16 nt, Human
ucggccuccauccuga

SEQ ID NO: 2954654 - RNA, 19 nt, Human
ucccaugagggagaugcca

SEQ ID NO: 2954655 - RNA, 23 nt, Human
ucccaugagggagaugccaugag

SEQ ID NO: 2954656 - RNA, 17 nt, Human
ucccaugagccucagca

SEQ ID NO: 2954657 - RNA, 22 nt, Human
ucccaugagccucagcauccug

SEQ ID NO: 2954658 - RNA, 18 nt, Human
ucccucccuuccucuuuc

SEQ ID NO: 2954659 - RNA, 16 nt, Human
ucccugccaauggacu

SEQ ID NO: 2954660 - RNA, 14 nt, Human
ucccugccaaugga

SEQ ID NO: 2954661 - RNA, 20 nt, Human
ucccugcacuugcagacucu

SEQ ID NO: 2954662 - RNA, 17 nt, Human
ucccucuggggcuguuc

SEQ ID NO: 2954663 - RNA, 13 nt, Human
ucccucuggggcu

SEQ ID NO: 2954664 - RNA, 16 nt, Human
ucccuucccaccucuc

SEQ ID NO: 2954665 - RNA, 14 nt, Human
ucccuucccaccuc

SEQ ID NO: 2954666 - RNA, 21 nt, Human
ucccuucccacuggaggcaug

SEQ ID NO: 2954667 - RNA, 17 nt, Human
ucccuucccaccucucu

SEQ ID NO: 2954668 - RNA, 21 nt, Human
uccgaaagggacuuggaagcu

SEQ ID NO: 2954669 - RNA, 22 nt, Human
uccgaaagggacuuggaagcuc

SEQ ID NO: 2954670 - RNA, 21 nt, Human
uccgcuuucuacccagcgagc

SEQ ID NO: 2954671 - RNA, 12 nt, Human
uccuccucagau

SEQ ID NO: 2954672 - RNA, 13 nt, Human
uccuccaggugca

SEQ ID NO: 2954673 - RNA, 12 nt, Human
uccuccaggugc

SEQ ID NO: 2954674 - RNA, 22 nt, Human
uccuccaggugcacaagcucca

SEQ ID NO: 2954675 - RNA, 20 nt, Human
uccuccaggugcacaagcuc

SEQ ID NO: 2954676 - RNA, 18 nt, Human
uccuccaggugcacaagc

SEQ ID NO: 2954677 - RNA, 14 nt, Human
uccuccaggugcac

SEQ ID NO: 2954678 - RNA, 21 nt, Human
uccuaguuccaccaucaagcc

SEQ ID NO: 2954679 - RNA, 16 nt, Human
uccuaagcuauucagu

SEQ ID NO: 2954680 - RNA, 12 nt, Human
uccuaguuccac

SEQ ID NO: 2954681 - RNA, 18 nt, Human
uccuaagcuauucaguaa

SEQ ID NO: 2954682 - RNA, 17 nt, Human
uccuaguuccaccauca

SEQ ID NO: 2954683 - RNA, 14 nt, Human
uccuaguuccacca

SEQ ID NO: 2954684 - RNA, 21 nt, Human
uccuccuuuucacaguucucu

SEQ ID NO: 2954685 - RNA, 22 nt, Human
uccucuagugaauguaggcugg

SEQ ID NO: 2954686 - RNA, 17 nt, Human
uccucuaggaggucucu

SEQ ID NO: 2954687 - RNA, 21 nt, Human
uccucuaggaggucucuaaga

SEQ ID NO: 2954688 - RNA, 15 nt, Human
uccucuggccugugu

SEQ ID NO: 2954689 - RNA, 13 nt, Human
uccucuguacaga

SEQ ID NO: 2954690 - RNA, 17 nt, Human
uccucugcugcuggcug

SEQ ID NO: 2954691 - RNA, 14 nt, Human
uccucugcuugcca

SEQ ID NO: 2954692 - RNA, 15 nt, Human
uccucugcuugccau

SEQ ID NO: 2954693 - RNA, 16 nt, Human
uccucugcuugccauc

SEQ ID NO: 2954694 - RNA, 17 nt, Human
uccucugcuugccaucc

SEQ ID NO: 2954695 - RNA, 19 nt, Human
uccucuguacagagcccac

SEQ ID NO: 2954696 - RNA, 23 nt, Human
uccucuguacagagcccacgccc

SEQ ID NO: 2954697 - RNA, 17 nt, Human
uccugagccagauuuca

SEQ ID NO: 2954698 - RNA, 15 nt, Human
uccugaggcuccacu

SEQ ID NO: 2954699 - RNA, 19 nt, Human
uccugagccagauuucacu

SEQ ID NO: 2954700 - RNA, 18 nt, Human
uccugagccagauuucac

SEQ ID NO: 2954701 - RNA, 16 nt, Human
uccugaggcuccacuu

SEQ ID NO: 2954702 - RNA, 21 nt, Human
uccugaggcuccacuuggucu

SEQ ID NO: 2954703 - RNA, 12 nt, Human
uccugaggcugg

SEQ ID NO: 2954704 - RNA, 19 nt, Human
uccugaggcugggcucccu

SEQ ID NO: 2954705 - RNA, 17 nt, Human
uccugaggcugggcucc

SEQ ID NO: 2954706 - RNA, 16 nt, Human
uccugaggcugggcuc

SEQ ID NO: 2954707 - RNA, 15 nt, Human
uccugaggcugggcu

SEQ ID NO: 2954708 - RNA, 15 nt, Human
ugcuaaaugugaaug

SEQ ID NO: 2954709 - RNA, 21 nt, Human
ugcuaacagcaacacaaagcu

SEQ ID NO: 2954710 - RNA, 22 nt, Human
ugcuaacagcaacacaaagcuu

SEQ ID NO: 2954711 - RNA, 23 nt, Human
ugcuaacagcaacacaaagcuuu

SEQ ID NO: 2954712 - RNA, 22 nt, Human
ugcgccuacaggagugagcacu

SEQ ID NO: 2954713 - RNA, 14 nt, Human
ugcgccuacaggag

SEQ ID NO: 2954714 - RNA, 16 nt, Human
ugcgccuacaggagug

SEQ ID NO: 2954715 - RNA, 14 nt, Human
ugcgaucuggguuc

SEQ ID NO: 2954716 - RNA, 15 nt, Human
ugcgaucuggguuca

SEQ ID NO: 2954717 - RNA, 19 nt, Human
ugcgaucuggguucacugc

SEQ ID NO: 2954718 - RNA, 20 nt, Human
ugcgaucuggguucacugca

SEQ ID NO: 2954719 - RNA, 21 nt, Human
ugcgaucuggguucacugcaa

SEQ ID NO: 2954720 - RNA, 15 nt, Human
ugccuucucaacucc

SEQ ID NO: 2954721 - RNA, 20 nt, Human
ugccucucccugcugcuccu

SEQ ID NO: 2954722 - RNA, 17 nt, Human
ugccucucccugcugcu

SEQ ID NO: 2954723 - RNA, 18 nt, Human
ugccccuggcagccccug

SEQ ID NO: 2954724 - RNA, 20 nt, Human
ugccucgaacuggcugcaaa

SEQ ID NO: 2954725 - RNA, 18 nt, Human
ugccucgaacuggcugca

SEQ ID NO: 2954726 - RNA, 19 nt, Human
ugccucgaacuggcugcaa

SEQ ID NO: 2954727 - RNA, 18 nt, Human
ugccugggcagaaggaag

SEQ ID NO: 2954728 - RNA, 21 nt, Human
ugccugggaucccucauccuc

SEQ ID NO: 2954729 - RNA, 14 nt, Human
ugccugguggcagc

SEQ ID NO: 2954730 - RNA, 15 nt, Human
ugccugguggcagcu

SEQ ID NO: 2954731 - RNA, 16 nt, Human
ugccugguggcagcug

SEQ ID NO: 2954732 - RNA, 18 nt, Human
ugccuguaaucacagcua

SEQ ID NO: 2954733 - RNA, 13 nt, Human
ugcugcuggcugg

SEQ ID NO: 2954734 - RNA, 23 nt, Human
ugcugcaguugccagucaccccg

SEQ ID NO: 2954735 - RNA, 18 nt, Human
ugcugcaguugccaguca

SEQ ID NO: 2954736 - RNA, 22 nt, Human
ugcugacagacacaggcccggc

SEQ ID NO: 2954737 - RNA, 23 nt, Human
ugcugacagacacaggcccggcu

SEQ ID NO: 2954738 - RNA, 13 nt, Human
ugcugaaggcucg

SEQ ID NO: 2954739 - RNA, 12 nt, Human
ugcugaaggcuc

SEQ ID NO: 2954740 - RNA, 13 nt, Human
ugcugauggugca

SEQ ID NO: 2954741 - RNA, 17 nt, Human
ugcugauggugcaauga

SEQ ID NO: 2954742 - RNA, 15 nt, Human
ugcugauggugcaau

SEQ ID NO: 2954743 - RNA, 15 nt, Human
ugcugauuuaaacac

SEQ ID NO: 2954744 - RNA, 17 nt, Human
ugcugauuuaaacacau

SEQ ID NO: 2954745 - RNA, 18 nt, Human
ugcugauggugcaaugac

SEQ ID NO: 2954746 - RNA, 18 nt, Human
ugcuccuuucuuguuuua

SEQ ID NO: 2954747 - RNA, 17 nt, Human
ugcuccucuccccagca

SEQ ID NO: 2954748 - RNA, 17 nt, Human
ugcugaaacaacaaaua

SEQ ID NO: 2954749 - RNA, 14 nt, Human
ugcuccucucccca

SEQ ID NO: 2954750 - RNA, 16 nt, Human
ugcucaguagucagac

SEQ ID NO: 2954751 - RNA, 15 nt, Human
ugcucacauaucugu

SEQ ID NO: 2954752 - RNA, 16 nt, Human
ugcucacauaucuguc

SEQ ID NO: 2954753 - RNA, 15 nt, Human
ugcuaagcauuccaa

SEQ ID NO: 2954754 - RNA, 19 nt, Human
ugcuaagcauuccaacuau

SEQ ID NO: 2954755 - RNA, 19 nt, Human
ugcaucaagaugugacaug

SEQ ID NO: 2954756 - RNA, 14 nt, Human
ugcaucaagaugug

SEQ ID NO: 2954757 - RNA, 22 nt, Human
ugccaaauauaaauaaaaauaa

SEQ ID NO: 2954758 - RNA, 19 nt, Human
ugccaaauauaaauaaaaa

SEQ ID NO: 2954759 - RNA, 18 nt, Human
ugccaaauauaaauaaaa

SEQ ID NO: 2954760 - RNA, 17 nt, Human
ugccaaauauaaauaaa

SEQ ID NO: 2954761 - RNA, 18 nt, Human
ugccagguuuuuggucug

SEQ ID NO: 2954762 - RNA, 19 nt, Human
ugccagguuuuuggucuga

SEQ ID NO: 2954763 - RNA, 22 nt, Human
ugccagguuuuuggucugaccc

SEQ ID NO: 2954764 - RNA, 22 nt, Human
ugccacuacggaauaguuggcu

SEQ ID NO: 2954765 - RNA, 19 nt, Human
ugccacccuggggagaaag

SEQ ID NO: 2954766 - RNA, 20 nt, Human
ugccacuaaauugacacuua

SEQ ID NO: 2954767 - RNA, 19 nt, Human
ugccccucaacucuccucc

SEQ ID NO: 2954768 - RNA, 17 nt, Human
ugccccuggcagccccu

SEQ ID NO: 2954769 - RNA, 23 nt, Human
ugccccucaacucuccuccagag

SEQ ID NO: 2954770 - RNA, 11 nt, Human
ugcccaggcug

SEQ ID NO: 2954771 - RNA, 16 nt, Human
ugcccacucccugcaa

SEQ ID NO: 2954772 - RNA, 15 nt, Human
ugcccacucccugca

SEQ ID NO: 2954773 - RNA, 14 nt, Human
ugcccacucccugc

SEQ ID NO: 2954774 - RNA, 13 nt, Human
ugcccaccuggcc

SEQ ID NO: 2954775 - RNA, 13 nt, Human
ugcccacucccug

SEQ ID NO: 2954776 - RNA, 21 nt, Human
ugccauccagguucagcuugu

SEQ ID NO: 2954777 - RNA, 20 nt, Human
ugccauccagguucagcuug

SEQ ID NO: 2954778 - RNA, 11 nt, Human
ugccaucccuc

SEQ ID NO: 2954779 - RNA, 12 nt, Human
ugccaucccucc

SEQ ID NO: 2954780 - RNA, 15 nt, Human
ugcaguugccaguca

SEQ ID NO: 2954781 - RNA, 19 nt, Human
ugcaguucugaagaagaug

SEQ ID NO: 2954782 - RNA, 22 nt, Human
ugcaguucugaagaagauggua

SEQ ID NO: 2954783 - RNA, 14 nt, Human
ugcaguugccaguc

SEQ ID NO: 2954784 - RNA, 13 nt, Human
ugcaguugccagu

SEQ ID NO: 2954785 - RNA, 22 nt, Human
ugcagugguaugaucacggcuc

SEQ ID NO: 2954786 - RNA, 14 nt, Human
ugcaguucugaaga

SEQ ID NO: 2954787 - RNA, 15 nt, Human
ugcaguucugaagaa

SEQ ID NO: 2954788 - RNA, 16 nt, Human
ugcaguucugaagaag

SEQ ID NO: 2954789 - RNA, 17 nt, Human
ugcaguucugaagaaga

SEQ ID NO: 2954790 - RNA, 18 nt, Human
ugcaguucugaagaagau

SEQ ID NO: 2954791 - RNA, 15 nt, Human
ugcaggcagccaggc

SEQ ID NO: 2954792 - RNA, 14 nt, Human
ugcaggcagccagg

SEQ ID NO: 2954793 - RNA, 13 nt, Human
ugcaggcagccag

SEQ ID NO: 2954794 - RNA, 10 nt, Human
ugcagugcag

SEQ ID NO: 2954795 - RNA, 16 nt, Human
ugcagugcaguauaga

SEQ ID NO: 2954796 - RNA, 17 nt, Human
ugcagugcaguauagaa

SEQ ID NO: 2954797 - RNA, 16 nt, Human
ugcagugcuuccaagg

SEQ ID NO: 2954798 - RNA, 19 nt, Human
ugcagugagccgagauugu

SEQ ID NO: 2954799 - RNA, 14 nt, Human
ugcacuuuguucug

SEQ ID NO: 2954800 - RNA, 12 nt, Human
ugcacuuuguuc

SEQ ID NO: 2954801 - RNA, 20 nt, Human
ugcagcaauaaagcagcguu

SEQ ID NO: 2954802 - RNA, 23 nt, Human
ugcagcaauaaagcagcguuucu

SEQ ID NO: 2954803 - RNA, 17 nt, Human
ugcaccgggccacagag

SEQ ID NO: 2954804 - RNA, 22 nt, Human
ugcaccgggccacagagaaagu

SEQ ID NO: 2954805 - RNA, 14 nt, Human
ugcaccgggccaca

SEQ ID NO: 2954806 - RNA, 15 nt, Human
ugcaccgggccacag

SEQ ID NO: 2954807 - RNA, 23 nt, Human
ugcaccggcuggccuggccccuc

SEQ ID NO: 2954808 - RNA, 19 nt, Human
ugaguccccuguuuguuuc

SEQ ID NO: 2954809 - RNA, 19 nt, Human
ugcacgcacacugucugcc

SEQ ID NO: 2954810 - RNA, 13 nt, Human
ugggcuacaagga

SEQ ID NO: 2954811 - RNA, 16 nt, Human
ugggcuaguugggcuu

SEQ ID NO: 2954812 - RNA, 17 nt, Human
ugggcuggugucaccug

SEQ ID NO: 2954813 - RNA, 23 nt, Human
ugggcuggguucuacccaggugc

SEQ ID NO: 2954814 - RNA, 22 nt, Human
ugggcuaagugauccucccacc

SEQ ID NO: 2954815 - RNA, 16 nt, Human
ugggcagaggaaagca

SEQ ID NO: 2954816 - RNA, 17 nt, Human
ugggcuucaguggcagc

SEQ ID NO: 2954817 - RNA, 15 nt, Human
ugggcuucaguggca

SEQ ID NO: 2954818 - RNA, 19 nt, Human
ugggggcugggcagaggaa

SEQ ID NO: 2954819 - RNA, 12 nt, Human
ugggggugcauu

SEQ ID NO: 2954820 - RNA, 15 nt, Human
ugggggugcauuuga

SEQ ID NO: 2954821 - RNA, 18 nt, Human
ugggggcugggcagagga

SEQ ID NO: 2954822 - RNA, 17 nt, Human
ugggggcugggcagagg

SEQ ID NO: 2954823 - RNA, 20 nt, Human
ugggggaucacagccucuga

SEQ ID NO: 2954824 - RNA, 21 nt, Human
ugggggaucacagccucugaa

SEQ ID NO: 2954825 - RNA, 16 nt, Human
uggguaacuagggaag

SEQ ID NO: 2954826 - RNA, 19 nt, Human
ugggguuuaucagaauucu

SEQ ID NO: 2954827 - RNA, 15 nt, Human
uggguguaaacacau

SEQ ID NO: 2954828 - RNA, 22 nt, Human
uggguucuacccaggugcuagg

SEQ ID NO: 2954829 - RNA, 16 nt, Human
uggguucuacccaggu

SEQ ID NO: 2954830 - RNA, 15 nt, Human
uggguucuacccagg

SEQ ID NO: 2954831 - RNA, 15 nt, Human
ugguaguuuuacagu

SEQ ID NO: 2954832 - RNA, 18 nt, Human
uggguuucuaaagcugcc

SEQ ID NO: 2954833 - RNA, 17 nt, Human
uggguuucuaaagcugc

SEQ ID NO: 2954834 - RNA, 21 nt, Human
uggguuucuaaagcugccagc

SEQ ID NO: 2954835 - RNA, 21 nt, Human
ugguauguuuucaggcuagau

SEQ ID NO: 2954836 - RNA, 23 nt, Human
ugguauuggcuagagguucaaag

SEQ ID NO: 2954837 - RNA, 19 nt, Human
uggcccagggcaucuggga

SEQ ID NO: 2954838 - RNA, 21 nt, Human
uggcugcuucaaggauccuga

SEQ ID NO: 2954839 - RNA, 16 nt, Human
uggcugcuucaaggau

SEQ ID NO: 2954840 - RNA, 21 nt, Human
uggcugggggccucagugcca

SEQ ID NO: 2954841 - RNA, 22 nt, Human
uggcuuccuaaaauucagugga

SEQ ID NO: 2954842 - RNA, 16 nt, Human
uggcuuccuggcaaua

SEQ ID NO: 2954843 - RNA, 14 nt, Human
uggcuuuugugcau

SEQ ID NO: 2954844 - RNA, 13 nt, Human
ugggacacccugu

SEQ ID NO: 2954845 - RNA, 12 nt, Human
ugggacacccug

SEQ ID NO: 2954846 - RNA, 12 nt, Human
ugggagcugccu

SEQ ID NO: 2954847 - RNA, 13 nt, Human
ugggagcugccug

SEQ ID NO: 2954848 - RNA, 14 nt, Human
ugggagcugccugu

SEQ ID NO: 2954849 - RNA, 13 nt, Human
ugggagcaaaaga

SEQ ID NO: 2954850 - RNA, 15 nt, Human
ugggcagaggaaagc

SEQ ID NO: 2954851 - RNA, 16 nt, Human
ugggauuacaggugug

SEQ ID NO: 2954852 - RNA, 13 nt, Human
ugggauccuggag

SEQ ID NO: 2954853 - RNA, 18 nt, Human
ugggauccuccaggugca

SEQ ID NO: 2954854 - RNA, 15 nt, Human
ugggagugagcuggu

SEQ ID NO: 2954855 - RNA, 15 nt, Human
ugggauccuccaggu

SEQ ID NO: 2954856 - RNA, 17 nt, Human
ugggagcugccuguuca

SEQ ID NO: 2954857 - RNA, 21 nt, Human
ugggagcugccuguucagcuc

SEQ ID NO: 2954858 - RNA, 22 nt, Human
ugggagcugccuguucagcucc

SEQ ID NO: 2954859 - RNA, 14 nt, Human
ugggaguacaaaag

SEQ ID NO: 2954860 - RNA, 21 nt, Human
uggcacccggccccugcuggu

SEQ ID NO: 2954861 - RNA, 13 nt, Human
uggcagcugcuuu

SEQ ID NO: 2954862 - RNA, 20 nt, Human
uggccagaugcaccagcccu

SEQ ID NO: 2954863 - RNA, 21 nt, Human
uggccagaugcaccagcccuu

SEQ ID NO: 2954864 - RNA, 13 nt, Human
uggcccaggaguu

SEQ ID NO: 2954865 - RNA, 19 nt, Human
uggcccaggaguuuggcca

SEQ ID NO: 2954866 - RNA, 14 nt, Human
uggcccaggaguuu

SEQ ID NO: 2954867 - RNA, 21 nt, Human
uggcccaggaguuuggccaga

SEQ ID NO: 2954868 - RNA, 20 nt, Human
uggcccaggaguuuggccag

SEQ ID NO: 2954869 - RNA, 22 nt, Human
uggcccaggaguuuggccagaa

SEQ ID NO: 2954870 - RNA, 13 nt, Human
uggcccagggcau

SEQ ID NO: 2954871 - RNA, 14 nt, Human
uggcccagggcauc

SEQ ID NO: 2954872 - RNA, 20 nt, Human
uggauuuaacagaaauguac

SEQ ID NO: 2954873 - RNA, 24 nt, Human
uggauuuaacagaaauguacagca

SEQ ID NO: 2954874 - RNA, 20 nt, Human
uggaggaaggaaacccagcu

SEQ ID NO: 2954875 - RNA, 18 nt, Human
uggaggaaggaaacccag

SEQ ID NO: 2954876 - RNA, 12 nt, Human
uggaggaaggaa

SEQ ID NO: 2954877 - RNA, 11 nt, Human
uggagggaagc

SEQ ID NO: 2954878 - RNA, 19 nt, Human
uggacaugcacagcuaaca

SEQ ID NO: 2954879 - RNA, 13 nt, Human
uggacaugcacag

SEQ ID NO: 2954880 - RNA, 14 nt, Human
uggaauaacaugua

SEQ ID NO: 2954881 - RNA, 15 nt, Human
uggaauaacauguaa

SEQ ID NO: 2954882 - RNA, 19 nt, Human
uggaauaacauguaauuaa

SEQ ID NO: 2954883 - RNA, 15 nt, Human
uggaauauauaacca

SEQ ID NO: 2954884 - RNA, 16 nt, Human
uggaauauauaaccag

SEQ ID NO: 2954885 - RNA, 22 nt, Human
uggaauaauccuaaacauauga

SEQ ID NO: 2954886 - RNA, 17 nt, Human
uggaauaaggagaauga

SEQ ID NO: 2954887 - RNA, 14 nt, Human
uggaauaagacaga

SEQ ID NO: 2954888 - RNA, 18 nt, Human
uggaauaagacagagacc

SEQ ID NO: 2954889 - RNA, 21 nt, Human
ugcuuuaccaauugaaguaaa

SEQ ID NO: 2954890 - RNA, 20 nt, Human
uggaaaaauagccugccucu

SEQ ID NO: 2954891 - RNA, 17 nt, Human
uggaaaaauagccugcc

SEQ ID NO: 2954892 - RNA, 17 nt, Human
uggaaacaagucaguca

SEQ ID NO: 2954893 - RNA, 21 nt, Human
uggaaagacuuuuccaacccu

SEQ ID NO: 2954894 - RNA, 23 nt, Human
uggaaacuucagcgguuuauaua

SEQ ID NO: 2954895 - RNA, 20 nt, Human
uggaaagaguaggaagacuu

SEQ ID NO: 2954896 - RNA, 21 nt, Human
uggaacauaaaauacaauguu

SEQ ID NO: 2954897 - RNA, 20 nt, Human
uggaacauaaaauacaaugu

SEQ ID NO: 2954898 - RNA, 12 nt, Human
uguguagggcgg

SEQ ID NO: 2954899 - RNA, 22 nt, Human
ugugggcuaguugggcuuccuc

SEQ ID NO: 2954900 - RNA, 18 nt, Human
uguggacacagcucuucu

SEQ ID NO: 2954901 - RNA, 19 nt, Human
uguggacacagcucuucuc

SEQ ID NO: 2954902 - RNA, 12 nt, Human
uguggcgagcca

SEQ ID NO: 2954903 - RNA, 22 nt, Human
uguggcgagccauuugucccaa

SEQ ID NO: 2954904 - RNA, 23 nt, Human
uguggcgcagcauauucaggaag

SEQ ID NO: 2954905 - RNA, 23 nt, Human
ugugcauuaucuagauacuguau

SEQ ID NO: 2954906 - RNA, 20 nt, Human
ugugcauuaucuagauacug

SEQ ID NO: 2954907 - RNA, 21 nt, Human
ugugcauuaucuagauacugu

SEQ ID NO: 2954908 - RNA, 14 nt, Human
ugugcacguacaca

SEQ ID NO: 2954909 - RNA, 15 nt, Human
ugugcacaucuguuu

SEQ ID NO: 2954910 - RNA, 17 nt, Human
ugugcacaucuguuuug

SEQ ID NO: 2954911 - RNA, 16 nt, Human
ugugcauuaucuagau

SEQ ID NO: 2954912 - RNA, 19 nt, Human
ugugcauuaucuagauacu

SEQ ID NO: 2954913 - RNA, 14 nt, Human
ugugcauuaucuag

SEQ ID NO: 2954914 - RNA, 14 nt, Human
ugugcgccuacagg

SEQ ID NO: 2954915 - RNA, 19 nt, Human
ugugcgccuacaggaguga

SEQ ID NO: 2954916 - RNA, 19 nt, Human
ugugcuaguaauuggaaag

SEQ ID NO: 2954917 - RNA, 23 nt, Human
ugugaaggcaggggaauguaugu

SEQ ID NO: 2954918 - RNA, 15 nt, Human
ugugacauguuuuau

SEQ ID NO: 2954919 - RNA, 12 nt, Human
ugugaggaagcc

SEQ ID NO: 2954920 - RNA, 20 nt, Human
ugugaggaagccgcuggggc

SEQ ID NO: 2954921 - RNA, 18 nt, Human
ugugaggaagccgcuggg

SEQ ID NO: 2954922 - RNA, 13 nt, Human
ugugaggaagccg

SEQ ID NO: 2954923 - RNA, 19 nt, Human
ugugagucaccaagcccag

SEQ ID NO: 2954924 - RNA, 21 nt, Human
ugugagucaccaagcccaguu

SEQ ID NO: 2954925 - RNA, 15 nt, Human
ugugagucaccaagc

SEQ ID NO: 2954926 - RNA, 17 nt, Human
ugugagucaccaagccc

SEQ ID NO: 2954927 - RNA, 14 nt, Human
ugucuuuggacccu

SEQ ID NO: 2954928 - RNA, 21 nt, Human
ugucuuuucuugcaugaggcu

SEQ ID NO: 2954929 - RNA, 16 nt, Human
ugucuuuggacccuga

SEQ ID NO: 2954930 - RNA, 21 nt, Human
ugugaaaagaaaaaugagccu

SEQ ID NO: 2954931 - RNA, 23 nt, Human
ugugaaaagaaaaaugagccugg

SEQ ID NO: 2954932 - RNA, 23 nt, Human
ugucuuuucuugcaugaggcuag

SEQ ID NO: 2954933 - RNA, 15 nt, Human
uguaugauucccagc

SEQ ID NO: 2954934 - RNA, 22 nt, Human
uguauucucuccuguaccucuu

SEQ ID NO: 2954935 - RNA, 13 nt, Human
ugucacacacuuu

SEQ ID NO: 2954936 - RNA, 13 nt, Human
uguauuuugaaau

SEQ ID NO: 2954937 - RNA, 17 nt, Human
ugucacacacuuuggcu

SEQ ID NO: 2954938 - RNA, 12 nt, Human
ugucacaggcag

SEQ ID NO: 2954939 - RNA, 19 nt, Human
uguauuuuacuaauaaaau

SEQ ID NO: 2954940 - RNA, 13 nt, Human
uguccccaccgca

SEQ ID NO: 2954941 - RNA, 22 nt, Human
uguccccaccgcagacaggacc

SEQ ID NO: 2954942 - RNA, 19 nt, Human
uguccccaccgcagacagg

SEQ ID NO: 2954943 - RNA, 14 nt, Human
ugucccaagugcca

SEQ ID NO: 2954944 - RNA, 15 nt, Human
ugucccaagugccaa

SEQ ID NO: 2954945 - RNA, 12 nt, Human
ugucccaagugc

SEQ ID NO: 2954946 - RNA, 13 nt, Human
ugucccaagugcc

SEQ ID NO: 2954947 - RNA, 18 nt, Human
uguccccaccgcagacag

SEQ ID NO: 2954948 - RNA, 12 nt, Human
uguccuacucug

SEQ ID NO: 2954949 - RNA, 17 nt, Human
uguccuacucuguguca

SEQ ID NO: 2954950 - RNA, 20 nt, Human
uguccuacccacccuccuuu

SEQ ID NO: 2954951 - RNA, 17 nt, Human
uguccccgacccuugcc

SEQ ID NO: 2954952 - RNA, 16 nt, Human
uguccccgacccuugc

SEQ ID NO: 2954953 - RNA, 13 nt, Human
ugucaccugaaga

SEQ ID NO: 2954954 - RNA, 16 nt, Human
ugucauuugagcaggg

SEQ ID NO: 2954955 - RNA, 19 nt, Human
ugucauuugagcagggcuc

SEQ ID NO: 2954956 - RNA, 23 nt, Human
ugucccaaaaagaaaggagggga

SEQ ID NO: 2954957 - RNA, 20 nt, Human
uguaauaaacucauuucuag

SEQ ID NO: 2954958 - RNA, 17 nt, Human
uguaauuaaguacuaug

SEQ ID NO: 2954959 - RNA, 13 nt, Human
uguacagagccca

SEQ ID NO: 2954960 - RNA, 17 nt, Human
uguacagagcccacgcc

SEQ ID NO: 2954961 - RNA, 16 nt, Human
uguacagagcccacgc

SEQ ID NO: 2954962 - RNA, 15 nt, Human
uguaccgcaauguga

SEQ ID NO: 2954963 - RNA, 16 nt, Human
uguaccgcaaugugac

SEQ ID NO: 2954964 - RNA, 18 nt, Human
uguacagagcccacgccc

SEQ ID NO: 2954965 - RNA, 14 nt, Human
uguagauguaugca

SEQ ID NO: 2954966 - RNA, 18 nt, Human
uguagauguaugcacaca

SEQ ID NO: 2954967 - RNA, 17 nt, Human
uguagcauccuggaaua

SEQ ID NO: 2954968 - RNA, 18 nt, Human
uguagcauccuggaauau

SEQ ID NO: 2954969 - RNA, 14 nt, Human
uguagcauccugga

SEQ ID NO: 2954970 - RNA, 16 nt, Human
uguagcauccuggaau

SEQ ID NO: 2954971 - RNA, 15 nt, Human
uguacgucugacagg

SEQ ID NO: 2954972 - RNA, 19 nt, Human
uguacugcauaugaaagga

SEQ ID NO: 2954973 - RNA, 22 nt, Human
uguaguguuggagaagaacuga

SEQ ID NO: 2954974 - RNA, 16 nt, Human
uguuuuaagaggcagg

SEQ ID NO: 2954975 - RNA, 18 nt, Human
uguuucuggcuuagaaca

SEQ ID NO: 2954976 - RNA, 15 nt, Human
uguuuccuggcacug

SEQ ID NO: 2954977 - RNA, 17 nt, Human
uguuuuaagaggcaggg

SEQ ID NO: 2954978 - RNA, 19 nt, Human
uguuuuaaggaugcuugua

SEQ ID NO: 2954979 - RNA, 22 nt, Human
uguuuuaaggaugcuuguacau

SEQ ID NO: 2954980 - RNA, 23 nt, Human
uguuuuaaggaugcuuguacaua

SEQ ID NO: 2954981 - RNA, 22 nt, Human
uuaaaaaaaaaccugagcccca

SEQ ID NO: 2954982 - RNA, 18 nt, Human
uuaaaugacucuucccuc

SEQ ID NO: 2954983 - RNA, 11 nt, Human
uuaaaugacuc

SEQ ID NO: 2954984 - RNA, 14 nt, Human
uuaaaugcccagcc

SEQ ID NO: 2954985 - RNA, 16 nt, Human
uuaaaugcccagcccc

SEQ ID NO: 2954986 - RNA, 15 nt, Human
uuaaaugcccagccc

SEQ ID NO: 2954987 - RNA, 20 nt, Human
uuaaauauuuugacuuguug

SEQ ID NO: 2954988 - RNA, 15 nt, Human
uuaaaauaagucuga

SEQ ID NO: 2954989 - RNA, 17 nt, Human
uuaaaauaagucugauu

SEQ ID NO: 2954990 - RNA, 14 nt, Human
uuaaaacccaagug

SEQ ID NO: 2954991 - RNA, 22 nt, Human
uuaaacuuaaucuaaauggaac

SEQ ID NO: 2954992 - RNA, 23 nt, Human
uuaaacuacauuagguugugaau

SEQ ID NO: 2954993 - RNA, 22 nt, Human
uuaaacuacauuagguugugaa

SEQ ID NO: 2954994 - RNA, 18 nt, Human
uuaaaauacacacucaaa

SEQ ID NO: 2954995 - RNA, 18 nt, Human
uuacacacuguacacaua

SEQ ID NO: 2954996 - RNA, 23 nt, Human
uuaaugagacuuuaaaagcauuu

SEQ ID NO: 2954997 - RNA, 16 nt, Human
uuaaugagacuuuaaa

SEQ ID NO: 2954998 - RNA, 18 nt, Human
uuaaugagacuuuaaaag

SEQ ID NO: 2954999 - RNA, 21 nt, Human
uuaaugagacuuuaaaagcau

SEQ ID NO: 2955000 - RNA, 22 nt, Human
uuaauuaaaacacaacaucuuu

SEQ ID NO: 2955001 - RNA, 13 nt, Human
uuacacuuuaugc

SEQ ID NO: 2955002 - RNA, 20 nt, Human
uuacacuuuaugcacaaaau

SEQ ID NO: 2955003 - RNA, 20 nt, Human
uuacauuuguauaaaauaau

SEQ ID NO: 2955004 - RNA, 12 nt, Human
uuacauuuuuaa

SEQ ID NO: 2955005 - RNA, 17 nt, Human
uuacauuuuuaagugcu

SEQ ID NO: 2955006 - RNA, 12 nt, Human
uuaacuuuuaua

SEQ ID NO: 2955007 - RNA, 13 nt, Human
uuaacuuuuauaa

SEQ ID NO: 2955008 - RNA, 13 nt, Human
uuaaaugcccagc

SEQ ID NO: 2955009 - RNA, 14 nt, Human
uuaacuuuuauaaa

SEQ ID NO: 2955010 - RNA, 14 nt, Human
uguuggagaagaac

SEQ ID NO: 2955011 - RNA, 16 nt, Human
uguuggagaagaacug

SEQ ID NO: 2955012 - RNA, 17 nt, Human
uguuggagaagaacuga

SEQ ID NO: 2955013 - RNA, 19 nt, Human
uguuggagaagaacugaaa

SEQ ID NO: 2955014 - RNA, 20 nt, Human
uguuggagaagaacugaaau

SEQ ID NO: 2955015 - RNA, 15 nt, Human
uguuggccaggcugg

SEQ ID NO: 2955016 - RNA, 16 nt, Human
uguuggccaggcuggu

SEQ ID NO: 2955017 - RNA, 17 nt, Human
uguuggcugggggccuc

SEQ ID NO: 2955018 - RNA, 19 nt, Human
uguuggcugggggccucag

SEQ ID NO: 2955019 - RNA, 18 nt, Human
uguuuaaaaucauuucug

SEQ ID NO: 2955020 - RNA, 17 nt, Human
uguuuaaaaucauuucu

SEQ ID NO: 2955021 - RNA, 14 nt, Human
uguuuaaaaucauu

SEQ ID NO: 2955022 - RNA, 16 nt, Human
uguucucucuucucca

SEQ ID NO: 2955023 - RNA, 15 nt, Human
uguucucucuucucc

SEQ ID NO: 2955024 - RNA, 19 nt, Human
uguucaucauccuaagcua

SEQ ID NO: 2955025 - RNA, 13 nt, Human
uguucaugaaaga

SEQ ID NO: 2955026 - RNA, 14 nt, Human
uguucaugaaagau

SEQ ID NO: 2955027 - RNA, 22 nt, Human
uguucaucaacagugagagacu

SEQ ID NO: 2955028 - RNA, 12 nt, Human
uguucuggcucu

SEQ ID NO: 2955029 - RNA, 16 nt, Human
uguucuggcucuucca

SEQ ID NO: 2955030 - RNA, 13 nt, Human
uguucuggcucuu

SEQ ID NO: 2955031 - RNA, 16 nt, Human
uguucucugcccucca

SEQ ID NO: 2955032 - RNA, 15 nt, Human
uguucucugcccucc

SEQ ID NO: 2955033 - RNA, 14 nt, Human
uguucucugcccuc

SEQ ID NO: 2955034 - RNA, 13 nt, Human
uguucucugcccu

SEQ ID NO: 2955035 - RNA, 23 nt, Human
uguucuuucuggcuaugcauuug

SEQ ID NO: 2955036 - RNA, 21 nt, Human
uguucuggcucuuccaggcug

SEQ ID NO: 2955037 - RNA, 20 nt, Human
uguucuggcucuuccaggcu

SEQ ID NO: 2955038 - RNA, 17 nt, Human
uguucuggcucuuccag

SEQ ID NO: 2955039 - RNA, 20 nt, Human
uguugacaugggacauuugc

SEQ ID NO: 2955040 - RNA, 20 nt, Human
ugugugaaagguacuucaaa

SEQ ID NO: 2955041 - RNA, 21 nt, Human
ugugugaaagguacuucaaau

SEQ ID NO: 2955042 - RNA, 22 nt, Human
ugugugaaagguacuucaaauc

SEQ ID NO: 2955043 - RNA, 19 nt, Human
ugugugcacguacacacac

SEQ ID NO: 2955044 - RNA, 23 nt, Human
uguguggucaacauuucucaugu

SEQ ID NO: 2955045 - RNA, 14 nt, Human
uguguggucaacau

SEQ ID NO: 2955046 - RNA, 16 nt, Human
uguguuuauugucaaa

SEQ ID NO: 2955047 - RNA, 13 nt, Human
uguguuugaagca

SEQ ID NO: 2955048 - RNA, 13 nt, Human
uguguuuugcaag

SEQ ID NO: 2955049 - RNA, 19 nt, Human
uguguuuugcaagccagau

SEQ ID NO: 2955050 - RNA, 18 nt, Human
uguucagcuccagcucac

SEQ ID NO: 2955051 - RNA, 20 nt, Human
uguucagcuccagcucacca

SEQ ID NO: 2955052 - RNA, 21 nt, Human
uguucagcuccagcucaccag

SEQ ID NO: 2955053 - RNA, 22 nt, Human
uguucagcuccagcucaccagc

SEQ ID NO: 2955054 - RNA, 18 nt, Human
uguucacuggacacuuca

SEQ ID NO: 2955055 - RNA, 19 nt, Human
uguuaguaugaggcauuug

SEQ ID NO: 2955056 - RNA, 20 nt, Human
uguuaguaugaggcauuugu

SEQ ID NO: 2955057 - RNA, 17 nt, Human
uguuaguaugaggcauu

SEQ ID NO: 2955058 - RNA, 14 nt, Human
uguuacuaaguuuu

SEQ ID NO: 2955059 - RNA, 21 nt, Human
uguuaaaagaugaaaauauuu

SEQ ID NO: 2955060 - RNA, 18 nt, Human
cuccuuugugaggaagcc

SEQ ID NO: 2955061 - RNA, 17 nt, Human
cuccuuugugaggaagc

SEQ ID NO: 2955062 - RNA, 17 nt, Human
cucgguguggagaagcg

SEQ ID NO: 2955063 - RNA, 16 nt, Human
cucgguguggagaagc

SEQ ID NO: 2955064 - RNA, 20 nt, Human
cucucccugcugcuccuagg

SEQ ID NO: 2955065 - RNA, 16 nt, Human
cucucccugcugcucc

SEQ ID NO: 2955066 - RNA, 19 nt, Human
cucucccugcugcuccuag

SEQ ID NO: 2955067 - RNA, 22 nt, Human
cucucuggccuucggccuccau

SEQ ID NO: 2955068 - RNA, 21 nt, Human
cucucuguaauaaacucauuu

SEQ ID NO: 2955069 - RNA, 16 nt, Human
cucucuguaauaaacu

SEQ ID NO: 2955070 - RNA, 19 nt, Human
cucuauguucuaagaagug

SEQ ID NO: 2955071 - RNA, 16 nt, Human
cucuccccaugauguu

SEQ ID NO: 2955072 - RNA, 15 nt, Human
cucuccccaugaugu

SEQ ID NO: 2955073 - RNA, 13 nt, Human
cucucccugcugc

SEQ ID NO: 2955074 - RNA, 14 nt, Human
cucucccugcugcu

SEQ ID NO: 2955075 - RNA, 12 nt, Human
cucuccuccaga

SEQ ID NO: 2955076 - RNA, 15 nt, Human
cucuccuccagaguc

SEQ ID NO: 2955077 - RNA, 13 nt, Human
cucuccuccagag

SEQ ID NO: 2955078 - RNA, 14 nt, Human
cucucuggccuucg

SEQ ID NO: 2955079 - RNA, 16 nt, Human
cucucuggccuucggc

SEQ ID NO: 2955080 - RNA, 13 nt, Human
cucucuggccuuc

SEQ ID NO: 2955081 - RNA, 16 nt, Human
cucuccuccagaguca

SEQ ID NO: 2955082 - RNA, 14 nt, Human
cucugcacuccccu

SEQ ID NO: 2955083 - RNA, 16 nt, Human
cucugcacuccccugc

SEQ ID NO: 2955084 - RNA, 15 nt, Human
cucugcacuccccug

SEQ ID NO: 2955085 - RNA, 19 nt, Human
cucugcacaagcugcaccc

SEQ ID NO: 2955086 - RNA, 21 nt, Human
cucugcacaagcugcacccuc

SEQ ID NO: 2955087 - RNA, 20 nt, Human
cucugcacaagcugcacccu

SEQ ID NO: 2955088 - RNA, 20 nt, Human
cucugcuccucuccccagca

SEQ ID NO: 2955089 - RNA, 21 nt, Human
cucugcuccucuccccagcaa

SEQ ID NO: 2955090 - RNA, 17 nt, Human
cucugcacuccccugcu

SEQ ID NO: 2955091 - RNA, 21 nt, Human
cucugcugacagacacaggcc

SEQ ID NO: 2955092 - RNA, 22 nt, Human
cucugcugacagacacaggccc

SEQ ID NO: 2955093 - RNA, 20 nt, Human
cucugcugacagacacaggc

SEQ ID NO: 2955094 - RNA, 13 nt, Human
cucugcugcuggc

SEQ ID NO: 2955095 - RNA, 23 nt, Human
cucugcugacagacacaggcccg

SEQ ID NO: 2955096 - RNA, 13 nt, Human
cucuguacagagc

SEQ ID NO: 2955097 - RNA, 15 nt, Human
cucuguacagagccc

SEQ ID NO: 2955098 - RNA, 14 nt, Human
cucuguacagagcc

SEQ ID NO: 2955099 - RNA, 16 nt, Human
cucugcugcuggcugg

SEQ ID NO: 2955100 - RNA, 15 nt, Human
cucugcugcuggcug

SEQ ID NO: 2955101 - RNA, 14 nt, Human
cucugcugcuggcu

SEQ ID NO: 2955102 - RNA, 16 nt, Human
cucuguacagagccca

SEQ ID NO: 2955103 - RNA, 23 nt, Human
cuccgcuuucuacccagcgagcc

SEQ ID NO: 2955104 - RNA, 19 nt, Human
cuccggcccuccagagccc

SEQ ID NO: 2955105 - RNA, 16 nt, Human
cuccuguaccucuuga

SEQ ID NO: 2955106 - RNA, 15 nt, Human
cuccuuucaccacau

SEQ ID NO: 2955107 - RNA, 14 nt, Human
cuccuuguguuacu

SEQ ID NO: 2955108 - RNA, 19 nt, Human
cuccuggccucaagugauu

SEQ ID NO: 2955109 - RNA, 18 nt, Human
cuccugggcuaagugauc

SEQ ID NO: 2955110 - RNA, 19 nt, Human
cuccuggcccacugcaucg

SEQ ID NO: 2955111 - RNA, 22 nt, Human
cuccucugcuugccaucccucc

SEQ ID NO: 2955112 - RNA, 15 nt, Human
cuccucugcugcugg

SEQ ID NO: 2955113 - RNA, 14 nt, Human
cuccucugcugcug

SEQ ID NO: 2955114 - RNA, 13 nt, Human
cuccucugcugcu

SEQ ID NO: 2955115 - RNA, 23 nt, Human
cuccaggugcacaagcuccaagc

SEQ ID NO: 2955116 - RNA, 15 nt, Human
cuccaggcuccuuua

SEQ ID NO: 2955117 - RNA, 23 nt, Human
cuccaggcuccuuuagcgcccag

SEQ ID NO: 2955118 - RNA, 20 nt, Human
cuccaggcuguaucccauga

SEQ ID NO: 2955119 - RNA, 20 nt, Human
cucccucuuucccucccuuc

SEQ ID NO: 2955120 - RNA, 22 nt, Human
cucccuccaccucccugcaaua

SEQ ID NO: 2955121 - RNA, 20 nt, Human
cucccuccaccucccugcaa

SEQ ID NO: 2955122 - RNA, 21 nt, Human
cucccuccaccucccugcaau

SEQ ID NO: 2955123 - RNA, 19 nt, Human
cucccuccaccucccugca

SEQ ID NO: 2955124 - RNA, 15 nt, Human
cucaggccagcugcu

SEQ ID NO: 2955125 - RNA, 21 nt, Human
cucaggccaaacucaccugcc

SEQ ID NO: 2955126 - RNA, 20 nt, Human
cucaggccaaacucaccugc

SEQ ID NO: 2955127 - RNA, 19 nt, Human
cucaggccaaacucaccug

SEQ ID NO: 2955128 - RNA, 11 nt, Human
cucaggccugg

SEQ ID NO: 2955129 - RNA, 22 nt, Human
cucaggccugggggcugggcag

SEQ ID NO: 2955130 - RNA, 18 nt, Human
cucaggccagcugcuugg

SEQ ID NO: 2955131 - RNA, 17 nt, Human
cucaggccagcugcuug

SEQ ID NO: 2955132 - RNA, 16 nt, Human
cucaggccagcugcuu

SEQ ID NO: 2955133 - RNA, 13 nt, Human
cucagaagacacu

SEQ ID NO: 2955134 - RNA, 15 nt, Human
cucagaagacacuga

SEQ ID NO: 2955135 - RNA, 17 nt, Human
cucagaagacacugaug

SEQ ID NO: 2955136 - RNA, 20 nt, Human
cucagaagacacugaugggc

SEQ ID NO: 2955137 - RNA, 22 nt, Human
cucagaagacacugaugggcaa

SEQ ID NO: 2955138 - RNA, 17 nt, Human
cucaccuuucccaucuu

SEQ ID NO: 2955139 - RNA, 23 nt, Human
cucagaagacacugaugggcaac

SEQ ID NO: 2955140 - RNA, 19 nt, Human
cucagccucccgaauagcu

SEQ ID NO: 2955141 - RNA, 21 nt, Human
cucagccucccgaauagcugg

SEQ ID NO: 2955142 - RNA, 22 nt, Human
cucagccucccgaauagcuggg

SEQ ID NO: 2955143 - RNA, 18 nt, Human
cucaguagucagacugga

SEQ ID NO: 2955144 - RNA, 23 nt, Human
cucaggugucccugcacuugcag

SEQ ID NO: 2955145 - RNA, 22 nt, Human
cucagucuggcccuuccuuuuc

SEQ ID NO: 2955146 - RNA, 15 nt, Human
cucaguccauagcag

SEQ ID NO: 2955147 - RNA, 17 nt, Human
cucaguccauagcagag

SEQ ID NO: 2955148 - RNA, 20 nt, Human
cucagucuggcccuuccuuu

SEQ ID NO: 2955149 - RNA, 16 nt, Human
cucaguccaugaagau

SEQ ID NO: 2955150 - RNA, 12 nt, Human
cuauguuuuugu

SEQ ID NO: 2955151 - RNA, 21 nt, Human
cucaagugauucuccugccuc

SEQ ID NO: 2955152 - RNA, 23 nt, Human
cucaauuauuuugcauuuuuucu

SEQ ID NO: 2955153 - RNA, 17 nt, Human
cuaucacugguuugguu

SEQ ID NO: 2955154 - RNA, 23 nt, Human
cuaugucauuugcuggagcucug

SEQ ID NO: 2955155 - RNA, 14 nt, Human
cuaugugagaccau

SEQ ID NO: 2955156 - RNA, 18 nt, Human
cuaucucauuuccaagca

SEQ ID NO: 2955157 - RNA, 14 nt, Human
cuaucucccccagc

SEQ ID NO: 2955158 - RNA, 13 nt, Human
cuaucucccccag

SEQ ID NO: 2955159 - RNA, 18 nt, Human
cuauguugcccaggcagg

SEQ ID NO: 2955160 - RNA, 19 nt, Human
cuauguugcccaggcaggu

SEQ ID NO: 2955161 - RNA, 21 nt, Human
cuauguugcccaggcaggucu

SEQ ID NO: 2955162 - RNA, 22 nt, Human
cuauguugcccaggcaggucuu

SEQ ID NO: 2955163 - RNA, 21 nt, Human
cuauguuaauauuuuaggugu

SEQ ID NO: 2955164 - RNA, 18 nt, Human
cuauguucuaagaaguga

SEQ ID NO: 2955165 - RNA, 14 nt, Human
cuauguuaauauuu

SEQ ID NO: 2955166 - RNA, 17 nt, Human
cuauguuaauauuuuag

SEQ ID NO: 2955167 - RNA, 15 nt, Human
cuauguuaauauuuu

SEQ ID NO: 2955168 - RNA, 13 nt, Human
cuauguuaauauu

SEQ ID NO: 2955169 - RNA, 20 nt, Human
cgcugccccuggcagccccu

SEQ ID NO: 2955170 - RNA, 19 nt, Human
cgcugccccuggcagcccc

SEQ ID NO: 2955171 - RNA, 17 nt, Human
cgcuggagugcagugag

SEQ ID NO: 2955172 - RNA, 18 nt, Human
cgcuggagugcagugagc

SEQ ID NO: 2955173 - RNA, 15 nt, Human
cgagggggcugcucc

SEQ ID NO: 2955174 - RNA, 17 nt, Human
cgagggggcugcuccca

SEQ ID NO: 2955175 - RNA, 18 nt, Human
cgagggggcugcucccac

SEQ ID NO: 2955176 - RNA, 23 nt, Human
cgagggggcugcucccaccuggc

SEQ ID NO: 2955177 - RNA, 23 nt, Human
cgccaaggcugggggaagaagcu

SEQ ID NO: 2955178 - RNA, 12 nt, Human
ccuuuucccaac

SEQ ID NO: 2955179 - RNA, 23 nt, Human
cggagucccaccuuggcugcagg

SEQ ID NO: 2955180 - RNA, 21 nt, Human
cggagucccaccuuggcugca

SEQ ID NO: 2955181 - RNA, 22 nt, Human
cggagucccaccuuggcugcag

SEQ ID NO: 2955182 - RNA, 20 nt, Human
cggagacggagucccaccuu

SEQ ID NO: 2955183 - RNA, 17 nt, Human
cggagacggagucccac

SEQ ID NO: 2955184 - RNA, 17 nt, Human
cgggccacagagaaagu

SEQ ID NO: 2955185 - RNA, 19 nt, Human
cgggcucagcaaaagaugc

SEQ ID NO: 2955186 - RNA, 12 nt, Human
cgggcucugccu

SEQ ID NO: 2955187 - RNA, 22 nt, Human
cguacacauuuuauuuuauuau

SEQ ID NO: 2955188 - RNA, 20 nt, Human
cgguggcucacgccuguaau

SEQ ID NO: 2955189 - RNA, 14 nt, Human
cuaaguuuuuaugg

SEQ ID NO: 2955190 - RNA, 19 nt, Human
cuaauaaaaaggugaccau

SEQ ID NO: 2955191 - RNA, 20 nt, Human
cuacaaaaacacagcaaggg

SEQ ID NO: 2955192 - RNA, 19 nt, Human
cuacaaaaagcauaaaaau

SEQ ID NO: 2955193 - RNA, 18 nt, Human
cuaaguaucaaguauaga

SEQ ID NO: 2955194 - RNA, 22 nt, Human
cgugagccacugcaccgggcca

SEQ ID NO: 2955195 - RNA, 14 nt, Human
cgugaggccagaga

SEQ ID NO: 2955196 - RNA, 14 nt, Human
cgugagccacugca

SEQ ID NO: 2955197 - RNA, 15 nt, Human
cgugagccacugcac

SEQ ID NO: 2955198 - RNA, 20 nt, Human
cgugagccacugcaccgggc

SEQ ID NO: 2955199 - RNA, 14 nt, Human
cgugacaacacuug

SEQ ID NO: 2955200 - RNA, 15 nt, Human
cgugacaacacuugu

SEQ ID NO: 2955201 - RNA, 12 nt, Human
cgugacaacacu

SEQ ID NO: 2955202 - RNA, 15 nt, Human
cguguuaugacucca

SEQ ID NO: 2955203 - RNA, 19 nt, Human
cguguuaugacuccagaau

SEQ ID NO: 2955204 - RNA, 18 nt, Human
cgugaguccuggcauggg

SEQ ID NO: 2955205 - RNA, 19 nt, Human
cgugaguccuggcauggga

SEQ ID NO: 2955206 - RNA, 11 nt, Human
cuaaagcugcc

SEQ ID NO: 2955207 - RNA, 13 nt, Human
cuaacuuggguua

SEQ ID NO: 2955208 - RNA, 22 nt, Human
cuaacuugucuuuggacccuga

SEQ ID NO: 2955209 - RNA, 14 nt, Human
cuaacuugucuuug

SEQ ID NO: 2955210 - RNA, 20 nt, Human
cuaacgaaguauccuucagc

SEQ ID NO: 2955211 - RNA, 22 nt, Human
ccuucuguccuacucuguguca

SEQ ID NO: 2955212 - RNA, 20 nt, Human
ccuucuguccuacucugugu

SEQ ID NO: 2955213 - RNA, 21 nt, Human
ccuucuguccuacucuguguc

SEQ ID NO: 2955214 - RNA, 17 nt, Human
ccuucucuucacaguca

SEQ ID NO: 2955215 - RNA, 23 nt, Human
ccuucucuccagccccuggaugc
